United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 114

SEQ ID NO: 4037419 - RNA, 20 nt, Staphylococcus aureus subsp. aureus N315
agaauaacgucauauguuuu

SEQ ID NO: 4037420 - RNA, 12 nt, Staphylococcus aureus subsp. aureus N315
agaauaacuauu

SEQ ID NO: 4037421 - RNA, 14 nt, Staphylococcus aureus subsp. aureus N315
agaauacaaauauu

SEQ ID NO: 4037422 - RNA, 16 nt, Staphylococcus aureus subsp. aureus N315
agaauacuaaaagugu

SEQ ID NO: 4037423 - RNA, 18 nt, Staphylococcus aureus subsp. aureus N315
agaauaguuaccaaaauu

SEQ ID NO: 4037424 - RNA, 21 nt, Staphylococcus aureus subsp. aureus N315
agaauaguuaccaaaauuuga

SEQ ID NO: 4037425 - RNA, 13 nt, Staphylococcus aureus subsp. aureus N315
agaauauauguau

SEQ ID NO: 4037426 - RNA, 11 nt, Staphylococcus aureus subsp. aureus N315
agaauauuaag

SEQ ID NO: 4037427 - RNA, 13 nt, Staphylococcus aureus subsp. aureus N315
agaauauucagau

SEQ ID NO: 4037428 - RNA, 19 nt, Staphylococcus aureus subsp. aureus N315
agaauauucagauuuucga

SEQ ID NO: 4037429 - RNA, 18 nt, Staphylococcus aureus subsp. aureus N315
agaaucaaccguuuuauu

SEQ ID NO: 4037430 - RNA, 14 nt, Staphylococcus aureus subsp. aureus N315
agaaucaauuauug

SEQ ID NO: 4037431 - RNA, 17 nt, Staphylococcus aureus subsp. aureus N315
agaaucagcuaaauauu

SEQ ID NO: 4037432 - RNA, 20 nt, Staphylococcus aureus subsp. aureus N315
agaauccuaugccaaauaac

SEQ ID NO: 4037433 - RNA, 15 nt, Staphylococcus aureus subsp. aureus N315
agaaucuccauuuaa

SEQ ID NO: 4037434 - RNA, 18 nt, Staphylococcus aureus subsp. aureus N315
agaaugaauaauuccagu

SEQ ID NO: 4037435 - RNA, 18 nt, Staphylococcus aureus subsp. aureus N315
agaaugcaccaacaauag

SEQ ID NO: 4037436 - RNA, 16 nt, Staphylococcus aureus subsp. aureus N315
agaaugccauaccugc

SEQ ID NO: 4037437 - RNA, 17 nt, Staphylococcus aureus subsp. aureus N315
agaaugcgauuuccuuu

SEQ ID NO: 4037438 - RNA, 17 nt, Staphylococcus aureus subsp. aureus N315
agaauguacaauuuuuu

SEQ ID NO: 4037439 - RNA, 17 nt, Staphylococcus aureus subsp. aureus N315
agaaugucgauauuucu

SEQ ID NO: 4037440 - RNA, 12 nt, Staphylococcus aureus subsp. aureus N315
agaauuaacaac

SEQ ID NO: 4037441 - RNA, 20 nt, Staphylococcus aureus subsp. aureus N315
agaauuaacaacaaauauaa

SEQ ID NO: 4037442 - RNA, 12 nt, Staphylococcus aureus subsp. aureus N315
agaauuauucaa

SEQ ID NO: 4037443 - RNA, 18 nt, Staphylococcus aureus subsp. aureus N315
agaauuauucaaguaaua

SEQ ID NO: 4037444 - RNA, 14 nt, Staphylococcus aureus subsp. aureus N315
agaauuauuuagaa

SEQ ID NO: 4037445 - RNA, 14 nt, Staphylococcus aureus subsp. aureus N315
agaauuauuuugga

SEQ ID NO: 4037446 - RNA, 19 nt, Staphylococcus aureus subsp. aureus N315
agaauucuaaaagaauuau

SEQ ID NO: 4037447 - RNA, 21 nt, Staphylococcus aureus subsp. aureus N315
agaauucucuauucacgaaau

SEQ ID NO: 4037448 - RNA, 15 nt, Staphylococcus aureus subsp. aureus N315
agaauugcaacgcau

SEQ ID NO: 4037449 - RNA, 14 nt, Staphylococcus aureus subsp. aureus N315
agauacguuauuuc

SEQ ID NO: 4037450 - RNA, 20 nt, Staphylococcus aureus subsp. aureus N315
agauacugguuaguaaaauu

SEQ ID NO: 4037451 - RNA, 16 nt, Staphylococcus aureus subsp. aureus N315
agauacuucuuuugca

SEQ ID NO: 4037452 - RNA, 14 nt, Staphylococcus aureus subsp. aureus N315
agauagaaauuacc

SEQ ID NO: 4037453 - RNA, 22 nt, Staphylococcus aureus subsp. aureus N315
agauagacuuucuugaugaauu

SEQ ID NO: 4037454 - RNA, 17 nt, Staphylococcus aureus subsp. aureus N315
agauagauaaaucaaga

SEQ ID NO: 4037455 - RNA, 15 nt, Staphylococcus aureus subsp. aureus N315
agauaggaaacuuaa

SEQ ID NO: 4037456 - RNA, 19 nt, Staphylococcus aureus subsp. aureus N315
agauaggaaacuuaaauau

SEQ ID NO: 4037457 - RNA, 20 nt, Staphylococcus aureus subsp. aureus N315
agauaggaaacuuaaauauu

SEQ ID NO: 4037458 - RNA, 22 nt, Staphylococcus aureus subsp. aureus N315
agauaggauuuacaccuauacc

SEQ ID NO: 4037459 - RNA, 15 nt, Staphylococcus aureus subsp. aureus N315
agauaggauuugcac

SEQ ID NO: 4037460 - RNA, 17 nt, Staphylococcus aureus subsp. aureus N315
agauauaaacauuuaua

SEQ ID NO: 4037461 - RNA, 23 nt, Staphylococcus aureus subsp. aureus N315
agauauagcaucuaugauuguau

SEQ ID NO: 4037462 - RNA, 18 nt, Staphylococcus aureus subsp. aureus N315
agauauauaauaccccaa

SEQ ID NO: 4037463 - RNA, 15 nt, Staphylococcus aureus subsp. aureus N315
agauauauuugaaag

SEQ ID NO: 4037464 - RNA, 15 nt, Staphylococcus aureus subsp. aureus N315
agauaucauaauauu

SEQ ID NO: 4037465 - RNA, 19 nt, Staphylococcus aureus subsp. aureus N315
agauaucauuuuauccaaa

SEQ ID NO: 4037466 - RNA, 18 nt, Staphylococcus aureus subsp. aureus N315
agauaucuuaaucuaaaa

SEQ ID NO: 4037467 - RNA, 21 nt, Staphylococcus aureus subsp. aureus N315
agauaucuuauaacaaaaauu

SEQ ID NO: 4037468 - RNA, 22 nt, Staphylococcus aureus subsp. aureus N315
agauauguuuauauugcaaaaa

SEQ ID NO: 4037469 - RNA, 22 nt, Staphylococcus aureus subsp. aureus N315
agauauuauaaaaacagcagug

SEQ ID NO: 4037470 - RNA, 18 nt, Staphylococcus aureus subsp. aureus N315
agauauuuauaagaggag

SEQ ID NO: 4037471 - RNA, 14 nt, Staphylococcus aureus subsp. aureus N315
agaucaauaucacu

SEQ ID NO: 4037472 - RNA, 21 nt, Staphylococcus aureus subsp. aureus N315
agaucaauaucacuaucagcu

SEQ ID NO: 4037473 - RNA, 14 nt, Staphylococcus aureus subsp. aureus N315
agaucauuuucaac

SEQ ID NO: 4037474 - RNA, 18 nt, Staphylococcus aureus subsp. aureus N315
agaucauuuucaacauaa

SEQ ID NO: 4037475 - RNA, 13 nt, Staphylococcus aureus subsp. aureus N315
agaucuaacaaua

SEQ ID NO: 4037476 - RNA, 21 nt, Staphylococcus aureus subsp. aureus N315
agaucuuuguaugcaucaguu

SEQ ID NO: 4037477 - RNA, 13 nt, Staphylococcus aureus subsp. aureus N315
agaugaauaaugu

SEQ ID NO: 4037478 - RNA, 21 nt, Staphylococcus aureus subsp. aureus N315
agaugaaugccuaauuuugug

SEQ ID NO: 4037479 - RNA, 22 nt, Staphylococcus aureus subsp. aureus N315
agaugaaugccuaauuuuguga

SEQ ID NO: 4037480 - RNA, 13 nt, Staphylococcus aureus subsp. aureus N315
agaugagaaagua

SEQ ID NO: 4037481 - RNA, 16 nt, Staphylococcus aureus subsp. aureus N315
agaugaggcgauaaaa

SEQ ID NO: 4037482 - RNA, 16 nt, Staphylococcus aureus subsp. aureus N315
agaugauacauucuau

SEQ ID NO: 4037483 - RNA, 15 nt, Staphylococcus aureus subsp. aureus N315
agaugaugcuucuca

SEQ ID NO: 4037484 - RNA, 19 nt, Staphylococcus aureus subsp. aureus N315
agaugauugucuagcagag

SEQ ID NO: 4037485 - RNA, 13 nt, Staphylococcus aureus subsp. aureus N315
agaugcauaaaaa

SEQ ID NO: 4037486 - RNA, 16 nt, Staphylococcus aureus subsp. aureus N315
agaugcauaaaaaaag

SEQ ID NO: 4037487 - RNA, 16 nt, Staphylococcus aureus subsp. aureus N315
agaugcauaaaaaccu

SEQ ID NO: 4037488 - RNA, 15 nt, Staphylococcus aureus subsp. aureus N315
agaugcuaauguaau

SEQ ID NO: 4037489 - RNA, 18 nt, Staphylococcus aureus subsp. aureus N315
agaugcucauugcauuuc

SEQ ID NO: 4037490 - RNA, 14 nt, Staphylococcus aureus subsp. aureus N315
agaugcuucaaaaa

SEQ ID NO: 4037491 - RNA, 17 nt, Staphylococcus aureus subsp. aureus N315
agauggcugcaucaaua

SEQ ID NO: 4037492 - RNA, 20 nt, Staphylococcus aureus subsp. aureus N315
agauggucuuuuaauuaaaa

SEQ ID NO: 4037493 - RNA, 21 nt, Staphylococcus aureus subsp. aureus N315
agaugucacuguuaaagaugu

SEQ ID NO: 4037494 - RNA, 16 nt, Staphylococcus aureus subsp. aureus N315
agauguugaugaagua

SEQ ID NO: 4037495 - RNA, 21 nt, Staphylococcus aureus subsp. aureus N315
agauguugguucaucaaacaa

SEQ ID NO: 4037496 - RNA, 15 nt, Staphylococcus aureus subsp. aureus N315
agauguuucaaaaua

SEQ ID NO: 4037497 - RNA, 22 nt, Staphylococcus aureus subsp. aureus N315
agauguuugcaacauauuuuca

SEQ ID NO: 4037498 - RNA, 13 nt, Staphylococcus aureus subsp. aureus N315
agauuaaaaaauc

SEQ ID NO: 4037499 - RNA, 24 nt, Staphylococcus aureus subsp. aureus N315
agauuaguguagggggcauuauua

SEQ ID NO: 4037500 - RNA, 21 nt, Staphylococcus aureus subsp. aureus N315
agauuaugaaaacauuauuaa

SEQ ID NO: 4037501 - RNA, 15 nt, Staphylococcus aureus subsp. aureus N315
agauuaugacaacau

SEQ ID NO: 4037502 - RNA, 22 nt, Staphylococcus aureus subsp. aureus N315
agauuauuauuacaaugaaaaa

SEQ ID NO: 4037503 - RNA, 18 nt, Staphylococcus aureus subsp. aureus N315
agauuauugguugaaauu

SEQ ID NO: 4037504 - RNA, 20 nt, Staphylococcus aureus subsp. aureus N315
agauucaaacguuuucacuu

SEQ ID NO: 4037505 - RNA, 18 nt, Staphylococcus aureus subsp. aureus N315
agauucacuguauaaaua

SEQ ID NO: 4037506 - RNA, 20 nt, Staphylococcus aureus subsp. aureus N315
agauucauaucuuucaauua

SEQ ID NO: 4037507 - RNA, 14 nt, Staphylococcus aureus subsp. aureus N315
agauucauauuuau

SEQ ID NO: 4037508 - RNA, 17 nt, Staphylococcus aureus subsp. aureus N315
agauuccaucacgauau

SEQ ID NO: 4037509 - RNA, 22 nt, Staphylococcus aureus subsp. aureus N315
agauuccaucacgauauguugu

SEQ ID NO: 4037510 - RNA, 14 nt, Staphylococcus aureus subsp. aureus N315
agauuccugcaaaa

SEQ ID NO: 4037511 - RNA, 15 nt, Staphylococcus aureus subsp. aureus N315
agauuccuguaacaa

SEQ ID NO: 4037512 - RNA, 14 nt, Staphylococcus aureus subsp. aureus N315
agauugagaauuca

SEQ ID NO: 4037513 - RNA, 21 nt, Staphylococcus aureus subsp. aureus N315
agauugauauaaauuaucaga

SEQ ID NO: 4037514 - RNA, 23 nt, Staphylococcus aureus subsp. aureus N315
agauuguaaaaauacauaauaaa

SEQ ID NO: 4037515 - RNA, 15 nt, Staphylococcus aureus subsp. aureus N315
agauuguauuuaaua

SEQ ID NO: 4037516 - RNA, 23 nt, Staphylococcus aureus subsp. aureus N315
agauuuaaacauccaauuauguu

SEQ ID NO: 4037517 - RNA, 22 nt, Staphylococcus aureus subsp. aureus N315
agauuuaguuuuuuuaaaguuu

SEQ ID NO: 4037518 - RNA, 22 nt, Staphylococcus aureus subsp. aureus N315
agauuuauaacgacguaauccu

SEQ ID NO: 4037519 - RNA, 20 nt, Staphylococcus aureus subsp. aureus N315
agauuuauuaaauauaugcg

SEQ ID NO: 4037520 - RNA, 19 nt, Staphylococcus aureus subsp. aureus N315
agauuugaaauuuauuaua

SEQ ID NO: 4037521 - RNA, 16 nt, Staphylococcus aureus subsp. aureus N315
agauuuguauuuugcg

SEQ ID NO: 4037522 - RNA, 17 nt, Staphylococcus aureus subsp. aureus N315
agauuuuaaacgcucau

SEQ ID NO: 4037523 - RNA, 15 nt, Staphylococcus aureus subsp. aureus N315
agcaaaagaugaaaa

SEQ ID NO: 4037524 - RNA, 21 nt, Staphylococcus aureus subsp. aureus N315
agcaaaauuauguaaaaaaua

SEQ ID NO: 4037525 - RNA, 22 nt, Staphylococcus aureus subsp. aureus N315
agcaaaauuauguaaaaaauau

SEQ ID NO: 4037526 - RNA, 17 nt, Staphylococcus aureus subsp. aureus N315
agcaaauauuauuaaau

SEQ ID NO: 4037527 - RNA, 15 nt, Staphylococcus aureus subsp. aureus N315
agcaaaugcacugua

SEQ ID NO: 4037528 - RNA, 16 nt, Staphylococcus aureus subsp. aureus N315
agcaaaugcacuguau

SEQ ID NO: 4037529 - RNA, 19 nt, Staphylococcus aureus subsp. aureus N315
agcaaaugcuuaagaaauu

SEQ ID NO: 4037530 - RNA, 20 nt, Staphylococcus aureus subsp. aureus N315
agcaaauuauauagaaaacu

SEQ ID NO: 4037531 - RNA, 16 nt, Staphylococcus aureus subsp. aureus N315
agcaacaucggcacca

SEQ ID NO: 4037532 - RNA, 17 nt, Staphylococcus aureus subsp. aureus N315
agcaacgauaccaaaua

SEQ ID NO: 4037533 - RNA, 19 nt, Staphylococcus aureus subsp. aureus N315
agcaacgauaccaaauaua

SEQ ID NO: 4037534 - RNA, 19 nt, Staphylococcus aureus subsp. aureus N315
agcaacucaggaauagaug

SEQ ID NO: 4037535 - RNA, 19 nt, Staphylococcus aureus subsp. aureus N315
agcaagucuucuaaaaaau

SEQ ID NO: 4037536 - RNA, 16 nt, Staphylococcus aureus subsp. aureus N315
agcuauaaaaaaucuu

SEQ ID NO: 4037537 - RNA, 18 nt, Staphylococcus aureus subsp. aureus N315
agcuauaaaaaaucuuuu

SEQ ID NO: 4037538 - RNA, 22 nt, Staphylococcus aureus subsp. aureus N315
agcuauagaaaugauagggcau

SEQ ID NO: 4037539 - RNA, 17 nt, Staphylococcus aureus subsp. aureus N315
agcuaucuucagauucc

SEQ ID NO: 4037540 - RNA, 22 nt, Staphylococcus aureus subsp. aureus N315
agcuaugcuuuuuuuacaauau

SEQ ID NO: 4037541 - RNA, 15 nt, Staphylococcus aureus subsp. aureus N315
agcuauuacuauaaa

SEQ ID NO: 4037542 - RNA, 19 nt, Staphylococcus aureus subsp. aureus N315
agcucaauaaauuaugaaa

SEQ ID NO: 4037543 - RNA, 20 nt, Staphylococcus aureus subsp. aureus N315
agcucaauugaaucuuuguu

SEQ ID NO: 4037544 - RNA, 13 nt, Staphylococcus aureus subsp. aureus N315
agcuccagucauu

SEQ ID NO: 4037545 - RNA, 16 nt, Staphylococcus aureus subsp. aureus N315
agcucguuaaaucaca

SEQ ID NO: 4037546 - RNA, 17 nt, Staphylococcus aureus subsp. aureus N315
agcucguuaaaucacau

SEQ ID NO: 4037547 - RNA, 15 nt, Staphylococcus aureus subsp. aureus N315
agcucguuuuuucau

SEQ ID NO: 4037548 - RNA, 23 nt, Staphylococcus aureus subsp. aureus N315
agcucugaaggagacauuuccca

SEQ ID NO: 4037549 - RNA, 20 nt, Staphylococcus aureus subsp. aureus N315
agcucuuuuuugauuuggaa

SEQ ID NO: 4037550 - RNA, 21 nt, Staphylococcus aureus subsp. aureus N315
agcucuuuuuugauuuggaaa

SEQ ID NO: 4037551 - RNA, 16 nt, Staphylococcus aureus subsp. aureus N315
agcugaacguaaguuu

SEQ ID NO: 4037552 - RNA, 17 nt, Staphylococcus aureus subsp. aureus N315
agcugauuaaaauguua

SEQ ID NO: 4037553 - RNA, 18 nt, Staphylococcus aureus subsp. aureus N315
agcugauuccauuucgau

SEQ ID NO: 4037554 - RNA, 17 nt, Staphylococcus aureus subsp. aureus N315
agcugcucgauauaugu

SEQ ID NO: 4037555 - RNA, 15 nt, Staphylococcus aureus subsp. aureus N315
agcugcuuuaaggaa

SEQ ID NO: 4037556 - RNA, 16 nt, Staphylococcus aureus subsp. aureus N315
agcugucauaccuuuu

SEQ ID NO: 4037557 - RNA, 23 nt, Staphylococcus aureus subsp. aureus N315
agcugugcugucauuuucugcuu

SEQ ID NO: 4037558 - RNA, 19 nt, Staphylococcus aureus subsp. aureus N315
agcuuaauaaauuguauga

SEQ ID NO: 4037559 - RNA, 13 nt, Staphylococcus aureus subsp. aureus N315
agcuuaauuuuau

SEQ ID NO: 4037560 - RNA, 20 nt, Staphylococcus aureus subsp. aureus N315
agcuuauuaagcuugaaaca

SEQ ID NO: 4037561 - RNA, 22 nt, Staphylococcus aureus subsp. aureus N315
agcuuauuaagcuugaaacaag

SEQ ID NO: 4037562 - RNA, 22 nt, Staphylococcus aureus subsp. aureus N315
agcuucaguuaaaucacugcuu

SEQ ID NO: 4037563 - RNA, 15 nt, Staphylococcus aureus subsp. aureus N315
agcuucuaaguaaua

SEQ ID NO: 4037564 - RNA, 17 nt, Staphylococcus aureus subsp. aureus N315
agcuucucauugaaauc

SEQ ID NO: 4037565 - RNA, 16 nt, Staphylococcus aureus subsp. aureus N315
agcuucuuaaaucaac

SEQ ID NO: 4037566 - RNA, 15 nt, Staphylococcus aureus subsp. aureus N315
agcuucuuuaacaau

SEQ ID NO: 4037567 - RNA, 20 nt, Staphylococcus aureus subsp. aureus N315
agcuucuuuaacaauugauu

SEQ ID NO: 4037568 - RNA, 15 nt, Staphylococcus aureus subsp. aureus N315
agcuugaauaauaua

SEQ ID NO: 4037569 - RNA, 18 nt, Staphylococcus aureus subsp. aureus N315
agcuugaauaauauauuu

SEQ ID NO: 4037570 - RNA, 18 nt, Staphylococcus aureus subsp. aureus N315
agcuugaccgccuaugau

SEQ ID NO: 4037571 - RNA, 22 nt, Staphylococcus aureus subsp. aureus N315
agcuugauuuaacaaccucuga

SEQ ID NO: 4037572 - RNA, 22 nt, Staphylococcus aureus subsp. aureus N315
agcuugcuuacaauaaucacuu

SEQ ID NO: 4037573 - RNA, 14 nt, Staphylococcus aureus subsp. aureus N315
agcuuguaacaagc

SEQ ID NO: 4037574 - RNA, 19 nt, Staphylococcus aureus subsp. aureus N315
agcuuuaaguuauuuuguc

SEQ ID NO: 4037575 - RNA, 22 nt, Staphylococcus aureus subsp. aureus N315
agcuuuaaucauagcauuaaga

SEQ ID NO: 4037576 - RNA, 14 nt, Staphylococcus aureus subsp. aureus N315
agcuuuaauuuuuu

SEQ ID NO: 4037577 - RNA, 11 nt, Staphylococcus aureus subsp. aureus N315
agcuuucaguu

SEQ ID NO: 4037578 - RNA, 18 nt, Staphylococcus aureus subsp. aureus N315
agcuuugcucauagauga

SEQ ID NO: 4037579 - RNA, 19 nt, Staphylococcus aureus subsp. aureus N315
agcuuugcugcuuuuccag

SEQ ID NO: 4037580 - RNA, 17 nt, Staphylococcus aureus subsp. aureus N315
agcuuuguuagcaucug

SEQ ID NO: 4037581 - RNA, 18 nt, Staphylococcus aureus subsp. aureus N315
agcuuuuaaacgaucacu

SEQ ID NO: 4037582 - RNA, 21 nt, Staphylococcus aureus subsp. aureus N315
agcuuuuacgccuucuuuaua

SEQ ID NO: 4037583 - RNA, 12 nt, Staphylococcus aureus subsp. aureus N315
agcuuuuguaaa

SEQ ID NO: 4037584 - RNA, 13 nt, Staphylococcus aureus subsp. aureus N315
agcuuuuguaaag

SEQ ID NO: 4037585 - RNA, 23 nt, Staphylococcus aureus subsp. aureus N315
agcuuuuuucaauucuagucagg

SEQ ID NO: 4037586 - RNA, 14 nt, Staphylococcus aureus subsp. aureus N315
aggaaaauaaaaac

SEQ ID NO: 4037587 - RNA, 21 nt, Staphylococcus aureus subsp. aureus N315
aggaaacgguucaaaaguaaa

SEQ ID NO: 4037588 - RNA, 13 nt, Staphylococcus aureus subsp. aureus N315
aggaaacuuaaau

SEQ ID NO: 4037589 - RNA, 16 nt, Staphylococcus aureus subsp. aureus N315
aggaaagccauuaaac

SEQ ID NO: 4037590 - RNA, 15 nt, Staphylococcus aureus subsp. aureus N315
aggaaauaaaaaaua

SEQ ID NO: 4037591 - RNA, 18 nt, Staphylococcus aureus subsp. aureus N315
aggaaauccgcauaaauu

SEQ ID NO: 4037592 - RNA, 22 nt, Staphylococcus aureus subsp. aureus N315
aggaacagcggaauacagauga

SEQ ID NO: 4037593 - RNA, 17 nt, Staphylococcus aureus subsp. aureus N315
aggaagaccacuauuuu

SEQ ID NO: 4037594 - RNA, 14 nt, Staphylococcus aureus subsp. aureus N315
aggaauauaaaacu

SEQ ID NO: 4037595 - RNA, 15 nt, Staphylococcus aureus subsp. aureus N315
aggaauauaaaacug

SEQ ID NO: 4037596 - RNA, 17 nt, Staphylococcus aureus subsp. aureus N315
aggaauaucuuucaaau

SEQ ID NO: 4037597 - RNA, 18 nt, Staphylococcus aureus subsp. aureus N315
aggaauaucuuucaaauu

SEQ ID NO: 4037598 - RNA, 13 nt, Staphylococcus aureus subsp. aureus N315
aggaauaugaauu

SEQ ID NO: 4037599 - RNA, 16 nt, Staphylococcus aureus subsp. aureus N315
aggaauaugaauugcu

SEQ ID NO: 4037600 - RNA, 21 nt, Staphylococcus aureus subsp. aureus N315
aggaauauuucccuaugaaau

SEQ ID NO: 4037601 - RNA, 15 nt, Staphylococcus aureus subsp. aureus N315
aggaauccaaagcug

SEQ ID NO: 4037602 - RNA, 15 nt, Staphylococcus aureus subsp. aureus N315
aggaauguuuaaaaa

SEQ ID NO: 4037603 - RNA, 19 nt, Staphylococcus aureus subsp. aureus N315
aggacacauuuacuuaaga

SEQ ID NO: 4037604 - RNA, 16 nt, Staphylococcus aureus subsp. aureus N315
aggaccacucaauucu

SEQ ID NO: 4037605 - RNA, 13 nt, Staphylococcus aureus subsp. aureus N315
aggacggaaaagg

SEQ ID NO: 4037606 - RNA, 12 nt, Staphylococcus aureus subsp. aureus N315
aggacuuuaugc

SEQ ID NO: 4037607 - RNA, 22 nt, Staphylococcus aureus subsp. aureus N315
aggagcgagccauuauuauuuu

SEQ ID NO: 4037608 - RNA, 16 nt, Staphylococcus aureus subsp. aureus N315
aggauaagaacgagaa

SEQ ID NO: 4037609 - RNA, 17 nt, Staphylococcus aureus subsp. aureus N315
aggauaagaacgagaau

SEQ ID NO: 4037610 - RNA, 14 nt, Staphylococcus aureus subsp. aureus N315
aggauaauuauuag

SEQ ID NO: 4037611 - RNA, 19 nt, Staphylococcus aureus subsp. aureus N315
aggauacauaaaucuaaua

SEQ ID NO: 4037612 - RNA, 23 nt, Staphylococcus aureus subsp. aureus N315
aggauauuuauucuaaguuaaaa

SEQ ID NO: 4037613 - RNA, 18 nt, Staphylococcus aureus subsp. aureus N315
aggaucaagugcagaugu

SEQ ID NO: 4037614 - RNA, 14 nt, Staphylococcus aureus subsp. aureus N315
aggaugaguuuaaa

SEQ ID NO: 4037615 - RNA, 15 nt, Staphylococcus aureus subsp. aureus N315
aggaugaguuuaaaa

SEQ ID NO: 4037616 - RNA, 15 nt, Staphylococcus aureus subsp. aureus N315
aggauguuauaaaau

SEQ ID NO: 4037617 - RNA, 14 nt, Staphylococcus aureus subsp. aureus N315
aggauguucaucaa

SEQ ID NO: 4037618 - RNA, 15 nt, Staphylococcus aureus subsp. aureus N315
aggauguucaucaac

SEQ ID NO: 4037619 - RNA, 15 nt, Staphylococcus aureus subsp. aureus N315
aggauuauuaucaaa

SEQ ID NO: 4037620 - RNA, 20 nt, Staphylococcus aureus subsp. aureus N315
aggauuguuuuuaagucguu

SEQ ID NO: 4037621 - RNA, 20 nt, Staphylococcus aureus subsp. aureus N315
aggauuuccggaacaauacc

SEQ ID NO: 4037622 - RNA, 14 nt, Staphylococcus aureus subsp. aureus N315
aggcaacaacuuuu

SEQ ID NO: 4037623 - RNA, 11 nt, Staphylococcus aureus subsp. aureus N315
aggcaacuuuu

SEQ ID NO: 4037624 - RNA, 16 nt, Staphylococcus aureus subsp. aureus N315
aguaacaauaacaccu

SEQ ID NO: 4037625 - RNA, 17 nt, Staphylococcus aureus subsp. aureus N315
aguaacauacuauaaaa

SEQ ID NO: 4037626 - RNA, 18 nt, Staphylococcus aureus subsp. aureus N315
aguaacauacuauaaaaa

SEQ ID NO: 4037627 - RNA, 16 nt, Staphylococcus aureus subsp. aureus N315
aguaacucaacauuuu

SEQ ID NO: 4037628 - RNA, 22 nt, Staphylococcus aureus subsp. aureus N315
aguaacucaacauuuuuucuau

SEQ ID NO: 4037629 - RNA, 15 nt, Staphylococcus aureus subsp. aureus N315
aguaacucaagugau

SEQ ID NO: 4037630 - RNA, 12 nt, Staphylococcus aureus subsp. aureus N315
aguaacuuuguc

SEQ ID NO: 4037631 - RNA, 16 nt, Staphylococcus aureus subsp. aureus N315
aguaagacgauuucaa

SEQ ID NO: 4037632 - RNA, 19 nt, Staphylococcus aureus subsp. aureus N315
aguaagauaauuuucaauu

SEQ ID NO: 4037633 - RNA, 20 nt, Staphylococcus aureus subsp. aureus N315
aguaaguagaagcaaaagau

SEQ ID NO: 4037634 - RNA, 22 nt, Staphylococcus aureus subsp. aureus N315
aguaauaaaagucgauaaauau

SEQ ID NO: 4037635 - RNA, 22 nt, Staphylococcus aureus subsp. aureus N315
aguaauaaaauaaaaaaaugau

SEQ ID NO: 4037636 - RNA, 13 nt, Staphylococcus aureus subsp. aureus N315
aguaauaauauaa

SEQ ID NO: 4037637 - RNA, 18 nt, Staphylococcus aureus subsp. aureus N315
aguaauaauauaaauaaa

SEQ ID NO: 4037638 - RNA, 21 nt, Staphylococcus aureus subsp. aureus N315
aguaauaauggcaauuaaaac

SEQ ID NO: 4037639 - RNA, 16 nt, Staphylococcus aureus subsp. aureus N315
aguaauaauuuauuga

SEQ ID NO: 4037640 - RNA, 16 nt, Staphylococcus aureus subsp. aureus N315
aguaauauauaaaagu

SEQ ID NO: 4037641 - RNA, 17 nt, Staphylococcus aureus subsp. aureus N315
aguaauauucaacuugu

SEQ ID NO: 4037642 - RNA, 22 nt, Staphylococcus aureus subsp. aureus N315
aguaauccccgaagcacagaaa

SEQ ID NO: 4037643 - RNA, 22 nt, Staphylococcus aureus subsp. aureus N315
aguaaucuuguuuucauuuaaa

SEQ ID NO: 4037644 - RNA, 14 nt, Staphylococcus aureus subsp. aureus N315
aguaaugaagcuuc

SEQ ID NO: 4037645 - RNA, 14 nt, Staphylococcus aureus subsp. aureus N315
aguaaugauuaacu

SEQ ID NO: 4037646 - RNA, 18 nt, Staphylococcus aureus subsp. aureus N315
aguaauguuccauauaac

SEQ ID NO: 4037647 - RNA, 16 nt, Staphylococcus aureus subsp. aureus N315
aguaauuaaauacuug

SEQ ID NO: 4037648 - RNA, 14 nt, Staphylococcus aureus subsp. aureus N315
aguaauuaauuccu

SEQ ID NO: 4037649 - RNA, 19 nt, Staphylococcus aureus subsp. aureus N315
aguaauucuucaucuucuu

SEQ ID NO: 4037650 - RNA, 22 nt, Staphylococcus aureus subsp. aureus N315
aguaauuuaauugguucuucuu

SEQ ID NO: 4037651 - RNA, 15 nt, Staphylococcus aureus subsp. aureus N315
aguacaaauaacaaa

SEQ ID NO: 4037652 - RNA, 13 nt, Staphylococcus aureus subsp. aureus N315
aguacaaauaaua

SEQ ID NO: 4037653 - RNA, 12 nt, Staphylococcus aureus subsp. aureus N315
aguacaauaaua

SEQ ID NO: 4037654 - RNA, 16 nt, Staphylococcus aureus subsp. aureus N315
aguacagcgguuugua

SEQ ID NO: 4037655 - RNA, 18 nt, Staphylococcus aureus subsp. aureus N315
aguacagcgguuuguaug

SEQ ID NO: 4037656 - RNA, 22 nt, Staphylococcus aureus subsp. aureus N315
aguacagcgguuuguaugauaa

SEQ ID NO: 4037657 - RNA, 23 nt, Staphylococcus aureus subsp. aureus N315
aguacaguuaguggcauuauauu

SEQ ID NO: 4037658 - RNA, 23 nt, Staphylococcus aureus subsp. aureus N315
aguacauuuauuuucaauaaaua

SEQ ID NO: 4037659 - RNA, 18 nt, Staphylococcus aureus subsp. aureus N315
aguaccaaagaaaucacc

SEQ ID NO: 4037660 - RNA, 16 nt, Staphylococcus aureus subsp. aureus N315
aguacccagaaugcga

SEQ ID NO: 4037661 - RNA, 19 nt, Staphylococcus aureus subsp. aureus N315
aguaccuaaaauagaaaaa

SEQ ID NO: 4037662 - RNA, 21 nt, Staphylococcus aureus subsp. aureus N315
aguaccuaaaauagaaaaauu

SEQ ID NO: 4037663 - RNA, 23 nt, Staphylococcus aureus subsp. aureus N315
aguaccucuuuauuuuaucucuu

SEQ ID NO: 4037664 - RNA, 22 nt, Staphylococcus aureus subsp. aureus N315
aguacggcugcuuuaacuguac

SEQ ID NO: 4037665 - RNA, 16 nt, Staphylococcus aureus subsp. aureus N315
aguacgguuauuuaau

SEQ ID NO: 4037666 - RNA, 21 nt, Staphylococcus aureus subsp. aureus N315
aguacuaaaccgauuaauaua

SEQ ID NO: 4037667 - RNA, 23 nt, Staphylococcus aureus subsp. aureus N315
aguacuaaucaauacuaaaccaa

SEQ ID NO: 4037668 - RNA, 23 nt, Staphylococcus aureus subsp. aureus N315
aguacuuggaaaauacuauacug

SEQ ID NO: 4037669 - RNA, 16 nt, Staphylococcus aureus subsp. aureus N315
aguacuuuaaaauugu

SEQ ID NO: 4037670 - RNA, 21 nt, Staphylococcus aureus subsp. aureus N315
aguacuuucgaguaauacuuu

SEQ ID NO: 4037671 - RNA, 17 nt, Staphylococcus aureus subsp. aureus N315
aguacuuuuacaaacuu

SEQ ID NO: 4037672 - RNA, 13 nt, Staphylococcus aureus subsp. aureus N315
aguagaauuauuu

SEQ ID NO: 4037673 - RNA, 14 nt, Staphylococcus aureus subsp. aureus N315
aguagaauuauuua

SEQ ID NO: 4037674 - RNA, 13 nt, Staphylococcus aureus subsp. aureus N315
aguagauuuauua

SEQ ID NO: 4037675 - RNA, 19 nt, Staphylococcus aureus subsp. aureus N315
aguagauuuauuaaauaua

SEQ ID NO: 4037676 - RNA, 16 nt, Staphylococcus aureus subsp. aureus N315
aguagcuagaacagau

SEQ ID NO: 4037677 - RNA, 15 nt, Staphylococcus aureus subsp. aureus N315
aguaguguauucauu

SEQ ID NO: 4037678 - RNA, 20 nt, Staphylococcus aureus subsp. aureus N315
aguaguuaauugaaugaaaa

SEQ ID NO: 4037679 - RNA, 22 nt, Staphylococcus aureus subsp. aureus N315
aguaguucggaugagaaauguu

SEQ ID NO: 4037680 - RNA, 14 nt, Staphylococcus aureus subsp. aureus N315
aguaguuggaaaau

SEQ ID NO: 4037681 - RNA, 18 nt, Staphylococcus aureus subsp. aureus N315
aguaguuggaaaauuaca

SEQ ID NO: 4037682 - RNA, 17 nt, Staphylococcus aureus subsp. aureus N315
aguaguuguacuucuuu

SEQ ID NO: 4037683 - RNA, 20 nt, Staphylococcus aureus subsp. aureus N315
aguauaaaccgccaacuaau

SEQ ID NO: 4037684 - RNA, 16 nt, Staphylococcus aureus subsp. aureus N315
aguauaaacguccaaa

SEQ ID NO: 4037685 - RNA, 12 nt, Staphylococcus aureus subsp. aureus N315
aguauaaauaaa

SEQ ID NO: 4037686 - RNA, 13 nt, Staphylococcus aureus subsp. aureus N315
aguauaaauaaaa

SEQ ID NO: 4037687 - RNA, 20 nt, Staphylococcus aureus subsp. aureus N315
aguauaaauaaaaauacaua

SEQ ID NO: 4037688 - RNA, 14 nt, Staphylococcus aureus subsp. aureus N315
aguauaaaugcagc

SEQ ID NO: 4037689 - RNA, 15 nt, Staphylococcus aureus subsp. aureus N315
aguauaaaugcagcu

SEQ ID NO: 4037690 - RNA, 18 nt, Staphylococcus aureus subsp. aureus N315
aguauaagguugaagaag

SEQ ID NO: 4037691 - RNA, 21 nt, Staphylococcus aureus subsp. aureus N315
aguauaaguagcucaaaacaa

SEQ ID NO: 4037692 - RNA, 13 nt, Staphylococcus aureus subsp. aureus N315
aguauaauccauc

SEQ ID NO: 4037693 - RNA, 13 nt, Staphylococcus aureus subsp. aureus N315
aguauaauuaaac

SEQ ID NO: 4037694 - RNA, 20 nt, Staphylococcus aureus subsp. aureus N315
aguauagcgcagcaaaugcu

SEQ ID NO: 4037695 - RNA, 21 nt, Staphylococcus aureus subsp. aureus N315
aguauagcgcagcaaaugcuu

SEQ ID NO: 4037696 - RNA, 14 nt, Staphylococcus aureus subsp. aureus N315
aguauaguuuugau

SEQ ID NO: 4037697 - RNA, 17 nt, Staphylococcus aureus subsp. aureus N315
aguauauaucaaauaca

SEQ ID NO: 4037698 - RNA, 18 nt, Staphylococcus aureus subsp. aureus N315
aguauauccgcaucuuuu

SEQ ID NO: 4037699 - RNA, 21 nt, Staphylococcus aureus subsp. aureus N315
aguaucauguucuuauaaaaa

SEQ ID NO: 4037700 - RNA, 22 nt, Staphylococcus aureus subsp. aureus N315
aguaucauguucuuauaaaaaa

SEQ ID NO: 4037701 - RNA, 23 nt, Staphylococcus aureus subsp. aureus N315
aguaucauuguguccauaaauau

SEQ ID NO: 4037702 - RNA, 21 nt, Staphylococcus aureus subsp. aureus N315
aguauccagaguuaaagucau

SEQ ID NO: 4037703 - RNA, 16 nt, Staphylococcus aureus subsp. aureus N315
aguauccugauuuaau

SEQ ID NO: 4037704 - RNA, 18 nt, Staphylococcus aureus subsp. aureus N315
aguaucuauacaauuaug

SEQ ID NO: 4037705 - RNA, 14 nt, Staphylococcus aureus subsp. aureus N315
aguaucuaugaaau

SEQ ID NO: 4037706 - RNA, 14 nt, Staphylococcus aureus subsp. aureus N315
aguaucucauuuuu

SEQ ID NO: 4037707 - RNA, 21 nt, Staphylococcus aureus subsp. aureus N315
aguaucucuuuucuauucaaa

SEQ ID NO: 4037708 - RNA, 18 nt, Staphylococcus aureus subsp. aureus N315
aguaugagacgcauugca

SEQ ID NO: 4037709 - RNA, 23 nt, Staphylococcus aureus subsp. aureus N315
aguaugcauauucauuaguuuua

SEQ ID NO: 4037710 - RNA, 18 nt, Staphylococcus aureus subsp. aureus N315
aguauggcgaaauguuuu

SEQ ID NO: 4037711 - RNA, 16 nt, Staphylococcus aureus subsp. aureus N315
aguuaaaaauguaaau

SEQ ID NO: 4037712 - RNA, 11 nt, Staphylococcus aureus subsp. aureus N315
aguuaaaaccu

SEQ ID NO: 4037713 - RNA, 19 nt, Staphylococcus aureus subsp. aureus N315
aguuaaaauugguuuggau

SEQ ID NO: 4037714 - RNA, 21 nt, Staphylococcus aureus subsp. aureus N315
aguuaaagacuagccauaccu

SEQ ID NO: 4037715 - RNA, 18 nt, Staphylococcus aureus subsp. aureus N315
aguuaaagucauaggcuu

SEQ ID NO: 4037716 - RNA, 14 nt, Staphylococcus aureus subsp. aureus N315
aguuaaauaguaag

SEQ ID NO: 4037717 - RNA, 18 nt, Staphylococcus aureus subsp. aureus N315
aguuaaauaucauaccgu

SEQ ID NO: 4037718 - RNA, 16 nt, Staphylococcus aureus subsp. aureus N315
aguuaaaucacugcuu

SEQ ID NO: 4037719 - RNA, 15 nt, Staphylococcus aureus subsp. aureus N315
aguuaacuauaacaa

SEQ ID NO: 4037720 - RNA, 20 nt, Staphylococcus aureus subsp. aureus N315
aguuaagugucuauguugaa

SEQ ID NO: 4037721 - RNA, 13 nt, Staphylococcus aureus subsp. aureus N315
aguuaauuauuua

SEQ ID NO: 4037722 - RNA, 19 nt, Staphylococcus aureus subsp. aureus N315
aguuacuauauuuauuagu

SEQ ID NO: 4037723 - RNA, 15 nt, Staphylococcus aureus subsp. aureus N315
aguuacuuacgccaa

SEQ ID NO: 4037724 - RNA, 21 nt, Staphylococcus aureus subsp. aureus N315
aguuacuuacgccaaucacaa

SEQ ID NO: 4037725 - RNA, 17 nt, Staphylococcus aureus subsp. aureus N315
aguuacuucaguuuggu

SEQ ID NO: 4037726 - RNA, 18 nt, Staphylococcus aureus subsp. aureus N315
aguuagaagaugauuauu

SEQ ID NO: 4037727 - RNA, 21 nt, Staphylococcus aureus subsp. aureus N315
aguuaggcgacuuaacuuaag

SEQ ID NO: 4037728 - RNA, 19 nt, Staphylococcus aureus subsp. aureus N315
aguuauaccauauuuaugg

SEQ ID NO: 4037729 - RNA, 14 nt, Staphylococcus aureus subsp. aureus N315
aguuauagaaacuu

SEQ ID NO: 4037730 - RNA, 14 nt, Staphylococcus aureus subsp. aureus N315
aguuauaugugcuu

SEQ ID NO: 4037731 - RNA, 14 nt, Staphylococcus aureus subsp. aureus N315
aguuauauuguuaa

SEQ ID NO: 4037732 - RNA, 15 nt, Staphylococcus aureus subsp. aureus N315
aguuaugaaaugucu

SEQ ID NO: 4037733 - RNA, 13 nt, Staphylococcus aureus subsp. aureus N315
aguuauuaagcca

SEQ ID NO: 4037734 - RNA, 20 nt, Staphylococcus aureus subsp. aureus N315
aguucaaagcgauaaaguau

SEQ ID NO: 4037735 - RNA, 16 nt, Staphylococcus aureus subsp. aureus N315
aguucaaauugaacuu

SEQ ID NO: 4037736 - RNA, 15 nt, Staphylococcus aureus subsp. aureus N315
aguucacaacaaagu

SEQ ID NO: 4037737 - RNA, 13 nt, Staphylococcus aureus subsp. aureus N315
aguucacaugaau

SEQ ID NO: 4037738 - RNA, 21 nt, Staphylococcus aureus subsp. aureus N315
aguucaccguaaucuuuuaac

SEQ ID NO: 4037739 - RNA, 19 nt, Staphylococcus aureus subsp. aureus N315
aguucaucuggugcaauau

SEQ ID NO: 4037740 - RNA, 23 nt, Staphylococcus aureus subsp. aureus N315
aguuccucgguauucaauucugu

SEQ ID NO: 4037741 - RNA, 16 nt, Staphylococcus aureus subsp. aureus N315
aguucgaacacacacu

SEQ ID NO: 4037742 - RNA, 23 nt, Staphylococcus aureus subsp. aureus N315
aguucgacacgcccgacaucaua

SEQ ID NO: 4037743 - RNA, 21 nt, Staphylococcus aureus subsp. aureus N315
aguucuagauuauuuaaaaau

SEQ ID NO: 4037744 - RNA, 14 nt, Staphylococcus aureus subsp. aureus N315
aguucuuagauuuu

SEQ ID NO: 4037745 - RNA, 12 nt, Staphylococcus aureus subsp. aureus N315
aguucuuuaaau

SEQ ID NO: 4037746 - RNA, 13 nt, Staphylococcus aureus subsp. aureus N315
aguucuuuuugau

SEQ ID NO: 4037747 - RNA, 21 nt, Staphylococcus aureus subsp. aureus N315
aguugaaaaccucuuuuuguu

SEQ ID NO: 4037748 - RNA, 23 nt, Staphylococcus aureus subsp. aureus N315
aguugaaaauaaucgaacagaaa

SEQ ID NO: 4037749 - RNA, 22 nt, Staphylococcus aureus subsp. aureus N315
aguugaagcuaauucauauuca

SEQ ID NO: 4037750 - RNA, 15 nt, Staphylococcus aureus subsp. aureus N315
aguugaauauaaaaa

SEQ ID NO: 4037751 - RNA, 16 nt, Staphylococcus aureus subsp. aureus N315
aguugaauauaaaaaa

SEQ ID NO: 4037752 - RNA, 15 nt, Staphylococcus aureus subsp. aureus N315
aguugacaauacaaa

SEQ ID NO: 4037753 - RNA, 17 nt, Staphylococcus aureus subsp. aureus N315
aguugagucaauuucuu

SEQ ID NO: 4037754 - RNA, 12 nt, Staphylococcus aureus subsp. aureus N315
aguugauaaugu

SEQ ID NO: 4037755 - RNA, 22 nt, Staphylococcus aureus subsp. aureus N315
aguugaucaaaaauguuaucua

SEQ ID NO: 4037756 - RNA, 18 nt, Staphylococcus aureus subsp. aureus N315
aguugcauaaucaauuuc

SEQ ID NO: 4037757 - RNA, 22 nt, Staphylococcus aureus subsp. aureus N315
aguugcgaacucguuauagaua

SEQ ID NO: 4037758 - RNA, 16 nt, Staphylococcus aureus subsp. aureus N315
aguugcugaauaaaau

SEQ ID NO: 4037759 - RNA, 21 nt, Staphylococcus aureus subsp. aureus N315
aguuggcugauagaugaaaau

SEQ ID NO: 4037760 - RNA, 16 nt, Staphylococcus aureus subsp. aureus N315
aguuggggaugggccc

SEQ ID NO: 4037761 - RNA, 14 nt, Staphylococcus aureus subsp. aureus N315
aguugguaucgauu

SEQ ID NO: 4037762 - RNA, 14 nt, Staphylococcus aureus subsp. aureus N315
aguugguuuagaca

SEQ ID NO: 4037763 - RNA, 19 nt, Staphylococcus aureus subsp. aureus N315
aguuguacuacuugauucu

SEQ ID NO: 4037764 - RNA, 15 nt, Staphylococcus aureus subsp. aureus N315
aguuguccauuuuau

SEQ ID NO: 4037765 - RNA, 17 nt, Staphylococcus aureus subsp. aureus N315
aguuguccauuuuaugc

SEQ ID NO: 4037766 - RNA, 23 nt, Staphylococcus aureus subsp. aureus N315
aguuguggucuaaccaucucaac

SEQ ID NO: 4037767 - RNA, 15 nt, Staphylococcus aureus subsp. aureus N315
aguuguuaggggcuu

SEQ ID NO: 4037768 - RNA, 14 nt, Staphylococcus aureus subsp. aureus N315
aguuguuauauucu

SEQ ID NO: 4037769 - RNA, 17 nt, Staphylococcus aureus subsp. aureus N315
aguuguuauuuuugcua

SEQ ID NO: 4037770 - RNA, 14 nt, Staphylococcus aureus subsp. aureus N315
aguuguugaaauuu

SEQ ID NO: 4037771 - RNA, 13 nt, Staphylococcus aureus subsp. aureus N315
aguuguugcaaau

SEQ ID NO: 4037772 - RNA, 15 nt, Staphylococcus aureus subsp. aureus N315
aguuguugcaacuug

SEQ ID NO: 4037773 - RNA, 14 nt, Staphylococcus aureus subsp. aureus N315
aguuguugcuuugg

SEQ ID NO: 4037774 - RNA, 21 nt, Staphylococcus aureus subsp. aureus N315
aguuguuucuccaguuuuugg

SEQ ID NO: 4037775 - RNA, 13 nt, Staphylococcus aureus subsp. aureus N315
aguuuaacaauac

SEQ ID NO: 4037776 - RNA, 17 nt, Staphylococcus aureus subsp. aureus N315
aguuuaagucuaacuuu

SEQ ID NO: 4037777 - RNA, 15 nt, Staphylococcus aureus subsp. aureus N315
aguuuaaucgcauug

SEQ ID NO: 4037778 - RNA, 23 nt, Staphylococcus aureus subsp. aureus N315
aguuuagauucacuguauaaaua

SEQ ID NO: 4037779 - RNA, 19 nt, Staphylococcus aureus subsp. aureus N315
aguuuagguugauuucugc

SEQ ID NO: 4037780 - RNA, 17 nt, Staphylococcus aureus subsp. aureus N315
aguuuaucugaguuaua

SEQ ID NO: 4037781 - RNA, 13 nt, Staphylococcus aureus subsp. aureus N315
aguuuauuaauau

SEQ ID NO: 4037782 - RNA, 16 nt, Staphylococcus aureus subsp. aureus N315
aguuuauuaauauuag

SEQ ID NO: 4037783 - RNA, 23 nt, Staphylococcus aureus subsp. aureus N315
aguuuauugccgguuaaauuauu

SEQ ID NO: 4037784 - RNA, 19 nt, Staphylococcus aureus subsp. aureus N315
aguuucaaucgcauuuugu

SEQ ID NO: 4037785 - RNA, 21 nt, Staphylococcus aureus subsp. aureus N315
aguuucaucaaguauaaaugu

SEQ ID NO: 4037786 - RNA, 18 nt, Staphylococcus aureus subsp. aureus N315
aguuucaucuucaacuuu

SEQ ID NO: 4037787 - RNA, 20 nt, Staphylococcus aureus subsp. aureus N315
aguuuccauaaauaaaaugc

SEQ ID NO: 4037788 - RNA, 20 nt, Staphylococcus aureus subsp. aureus N315
aguuucggaaaaagaugaaa

SEQ ID NO: 4037789 - RNA, 15 nt, Staphylococcus aureus subsp. aureus N315
aguuucguuguacag

SEQ ID NO: 4037790 - RNA, 19 nt, Staphylococcus aureus subsp. aureus N315
aguuucuacuguauaagug

SEQ ID NO: 4037791 - RNA, 14 nt, Staphylococcus aureus subsp. aureus N315
aguuucugagaaga

SEQ ID NO: 4037792 - RNA, 19 nt, Staphylococcus aureus subsp. aureus N315
aguuugaaggugauaaugu

SEQ ID NO: 4037793 - RNA, 14 nt, Staphylococcus aureus subsp. aureus N315
aguuugacaucuau

SEQ ID NO: 4037794 - RNA, 22 nt, Staphylococcus aureus subsp. aureus N315
aguuugaucauaauucaguguu

SEQ ID NO: 4037795 - RNA, 15 nt, Staphylococcus aureus subsp. aureus N315
aguuugcguuuuaau

SEQ ID NO: 4037796 - RNA, 14 nt, Staphylococcus aureus subsp. aureus N315
aguuuguaauaauu

SEQ ID NO: 4037797 - RNA, 15 nt, Staphylococcus aureus subsp. aureus N315
aguuuguuucuaaau

SEQ ID NO: 4037798 - RNA, 16 nt, Staphylococcus aureus subsp. aureus N315
aguuuguuucuaaauu

SEQ ID NO: 4037799 - RNA, 22 nt, Staphylococcus aureus subsp. aureus N315
auaaauaacuucguuuuaauaa

SEQ ID NO: 4037800 - RNA, 22 nt, Staphylococcus aureus subsp. aureus N315
auaaauaagcaaucauaauacu

SEQ ID NO: 4037801 - RNA, 21 nt, Staphylococcus aureus subsp. aureus N315
auaaauaagcaguaagaugac

SEQ ID NO: 4037802 - RNA, 22 nt, Staphylococcus aureus subsp. aureus N315
auaaauaauaaguugaauauaa

SEQ ID NO: 4037803 - RNA, 21 nt, Staphylococcus aureus subsp. aureus N315
auaaauaauuucggauuaucu

SEQ ID NO: 4037804 - RNA, 15 nt, Staphylococcus aureus subsp. aureus N315
auaaauacaaaaaua

SEQ ID NO: 4037805 - RNA, 17 nt, Staphylococcus aureus subsp. aureus N315
auaaauagagaacagca

SEQ ID NO: 4037806 - RNA, 17 nt, Staphylococcus aureus subsp. aureus N315
auaaauagauaauauau

SEQ ID NO: 4037807 - RNA, 12 nt, Staphylococcus aureus subsp. aureus N315
auaaauauaaaa

SEQ ID NO: 4037808 - RNA, 15 nt, Staphylococcus aureus subsp. aureus N315
auaaauauaaaaagu

SEQ ID NO: 4037809 - RNA, 20 nt, Staphylococcus aureus subsp. aureus N315
auaaauaucauaaaugcaua

SEQ ID NO: 4037810 - RNA, 20 nt, Staphylococcus aureus subsp. aureus N315
auaaauaugauguuaaaaaa

SEQ ID NO: 4037811 - RNA, 16 nt, Staphylococcus aureus subsp. aureus N315
auaaauauuaaauuca

SEQ ID NO: 4037812 - RNA, 15 nt, Staphylococcus aureus subsp. aureus N315
auaaauauuaagcgu

SEQ ID NO: 4037813 - RNA, 17 nt, Staphylococcus aureus subsp. aureus N315
auaaauauugaacaauu

SEQ ID NO: 4037814 - RNA, 14 nt, Staphylococcus aureus subsp. aureus N315
auaaauauuuaaaa

SEQ ID NO: 4037815 - RNA, 19 nt, Staphylococcus aureus subsp. aureus N315
auaaauauuuaaaauauua

SEQ ID NO: 4037816 - RNA, 14 nt, Staphylococcus aureus subsp. aureus N315
auaaauauuuuuaa

SEQ ID NO: 4037817 - RNA, 14 nt, Staphylococcus aureus subsp. aureus N315
auaaaucaaacuuu

SEQ ID NO: 4037818 - RNA, 14 nt, Staphylococcus aureus subsp. aureus N315
auaaaucaaagagg

SEQ ID NO: 4037819 - RNA, 16 nt, Staphylococcus aureus subsp. aureus N315
auaaaucaagaaaugu

SEQ ID NO: 4037820 - RNA, 17 nt, Staphylococcus aureus subsp. aureus N315
auaaaucaagaaauguu

SEQ ID NO: 4037821 - RNA, 18 nt, Staphylococcus aureus subsp. aureus N315
auaaaucacgccauaauc

SEQ ID NO: 4037822 - RNA, 23 nt, Staphylococcus aureus subsp. aureus N315
auaaaucacgccauaaucuucau

SEQ ID NO: 4037823 - RNA, 13 nt, Staphylococcus aureus subsp. aureus N315
auaaaucaucauu

SEQ ID NO: 4037824 - RNA, 15 nt, Staphylococcus aureus subsp. aureus N315
auaaaucaugaaaua

SEQ ID NO: 4037825 - RNA, 16 nt, Staphylococcus aureus subsp. aureus N315
auaaaucaugaaauaa

SEQ ID NO: 4037826 - RNA, 22 nt, Staphylococcus aureus subsp. aureus N315
auaaaucauuaguuguaucagu

SEQ ID NO: 4037827 - RNA, 20 nt, Staphylococcus aureus subsp. aureus N315
auaaauccuaagucuuuuaa

SEQ ID NO: 4037828 - RNA, 15 nt, Staphylococcus aureus subsp. aureus N315
auaaaucgauaaaau

SEQ ID NO: 4037829 - RNA, 16 nt, Staphylococcus aureus subsp. aureus N315
auaaaucgauaaaaug

SEQ ID NO: 4037830 - RNA, 20 nt, Staphylococcus aureus subsp. aureus N315
auaaaucguaauaauuuugu

SEQ ID NO: 4037831 - RNA, 18 nt, Staphylococcus aureus subsp. aureus N315
auaaaucguguuaauucu

SEQ ID NO: 4037832 - RNA, 15 nt, Staphylococcus aureus subsp. aureus N315
auaaaucuaucuacu

SEQ ID NO: 4037833 - RNA, 21 nt, Staphylococcus aureus subsp. aureus N315
auaaaucuccauuaaucauuu

SEQ ID NO: 4037834 - RNA, 13 nt, Staphylococcus aureus subsp. aureus N315
auaaaucuuuuuu

SEQ ID NO: 4037835 - RNA, 13 nt, Staphylococcus aureus subsp. aureus N315
auaaaugacauuu

SEQ ID NO: 4037836 - RNA, 15 nt, Staphylococcus aureus subsp. aureus N315
auaaaugacauuuaa

SEQ ID NO: 4037837 - RNA, 19 nt, Staphylococcus aureus subsp. aureus N315
auaaaugacauuuaauacu

SEQ ID NO: 4037838 - RNA, 13 nt, Staphylococcus aureus subsp. aureus N315
auaaaugauuaaa

SEQ ID NO: 4037839 - RNA, 17 nt, Staphylococcus aureus subsp. aureus N315
auaaaugcuaaaaguau

SEQ ID NO: 4037840 - RNA, 20 nt, Staphylococcus aureus subsp. aureus N315
auaaaugcuaaaaguauaaa

SEQ ID NO: 4037841 - RNA, 13 nt, Staphylococcus aureus subsp. aureus N315
auaaaugucacug

SEQ ID NO: 4037842 - RNA, 21 nt, Staphylococcus aureus subsp. aureus N315
auaaaugucacugcaaacaca

SEQ ID NO: 4037843 - RNA, 16 nt, Staphylococcus aureus subsp. aureus N315
auaaaugucauaguau

SEQ ID NO: 4037844 - RNA, 19 nt, Staphylococcus aureus subsp. aureus N315
auaaauguuaaagauuauu

SEQ ID NO: 4037845 - RNA, 13 nt, Staphylococcus aureus subsp. aureus N315
auaaauuaaauuu

SEQ ID NO: 4037846 - RNA, 15 nt, Staphylococcus aureus subsp. aureus N315
auaaauuaauugcuu

SEQ ID NO: 4037847 - RNA, 15 nt, Staphylococcus aureus subsp. aureus N315
auaaauuagaugaaa

SEQ ID NO: 4037848 - RNA, 14 nt, Staphylococcus aureus subsp. aureus N315
auaaauuaguuuuu

SEQ ID NO: 4037849 - RNA, 19 nt, Staphylococcus aureus subsp. aureus N315
auaaauucucuuggauagu

SEQ ID NO: 4037850 - RNA, 20 nt, Staphylococcus aureus subsp. aureus N315
auaaauugaguuuuuuaaaa

SEQ ID NO: 4037851 - RNA, 17 nt, Staphylococcus aureus subsp. aureus N315
auaaauuguaugaauaa

SEQ ID NO: 4037852 - RNA, 20 nt, Staphylococcus aureus subsp. aureus N315
auaaauuuaacguuauucau

SEQ ID NO: 4037853 - RNA, 21 nt, Staphylococcus aureus subsp. aureus N315
auaaauuuguaccaaauaaau

SEQ ID NO: 4037854 - RNA, 19 nt, Staphylococcus aureus subsp. aureus N315
auaaauuuuacgaaaauau

SEQ ID NO: 4037855 - RNA, 17 nt, Staphylococcus aureus subsp. aureus N315
auaaauuuuuaguuaaa

SEQ ID NO: 4037856 - RNA, 23 nt, Staphylococcus aureus subsp. aureus N315
auaacaaaaauugcuauauuagu

SEQ ID NO: 4037857 - RNA, 14 nt, Staphylococcus aureus subsp. aureus N315
auaacaaaacgauu

SEQ ID NO: 4037858 - RNA, 18 nt, Staphylococcus aureus subsp. aureus N315
auaacaaaauuaaauaug

SEQ ID NO: 4037859 - RNA, 11 nt, Staphylococcus aureus subsp. aureus N315
auaacaaacau

SEQ ID NO: 4037860 - RNA, 16 nt, Staphylococcus aureus subsp. aureus N315
auaacaacgauaauug

SEQ ID NO: 4037861 - RNA, 16 nt, Staphylococcus aureus subsp. aureus N315
auaacaacuacuuaaa

SEQ ID NO: 4037862 - RNA, 17 nt, Staphylococcus aureus subsp. aureus N315
auaacaagaaguaaugu

SEQ ID NO: 4037863 - RNA, 20 nt, Staphylococcus aureus subsp. aureus N315
auaacaaguauaaaugcagc

SEQ ID NO: 4037864 - RNA, 22 nt, Staphylococcus aureus subsp. aureus N315
auaacaauagugacuuuuauaa

SEQ ID NO: 4037865 - RNA, 18 nt, Staphylococcus aureus subsp. aureus N315
auaacaauuuuaaaucuu

SEQ ID NO: 4037866 - RNA, 21 nt, Staphylococcus aureus subsp. aureus N315
auaacaauuuuaaaucuuuua

SEQ ID NO: 4037867 - RNA, 17 nt, Staphylococcus aureus subsp. aureus N315
auaacaccaauuaaauc

SEQ ID NO: 4037868 - RNA, 16 nt, Staphylococcus aureus subsp. aureus N315
auaacagcuacaaaua

SEQ ID NO: 4037869 - RNA, 17 nt, Staphylococcus aureus subsp. aureus N315
auaacagcuacaaauaa

SEQ ID NO: 4037870 - RNA, 21 nt, Staphylococcus aureus subsp. aureus N315
auaacagcuacaaauaaugag

SEQ ID NO: 4037871 - RNA, 19 nt, Staphylococcus aureus subsp. aureus N315
auaacaguuaauuauaccg

SEQ ID NO: 4037872 - RNA, 15 nt, Staphylococcus aureus subsp. aureus N315
auaacaucaaauaga

SEQ ID NO: 4037873 - RNA, 21 nt, Staphylococcus aureus subsp. aureus N315
auaacauccccuucuugagca

SEQ ID NO: 4037874 - RNA, 17 nt, Staphylococcus aureus subsp. aureus N315
auaacauuaaaaugaua

SEQ ID NO: 4037875 - RNA, 18 nt, Staphylococcus aureus subsp. aureus N315
auaacauucuucaaaaaa

SEQ ID NO: 4037876 - RNA, 19 nt, Staphylococcus aureus subsp. aureus N315
auaacauucuucaaaaaau

SEQ ID NO: 4037877 - RNA, 20 nt, Staphylococcus aureus subsp. aureus N315
auaacauucuucaaaaaaua

SEQ ID NO: 4037878 - RNA, 22 nt, Staphylococcus aureus subsp. aureus N315
auaacauucuucaaaaaauaau

SEQ ID NO: 4037879 - RNA, 20 nt, Staphylococcus aureus subsp. aureus N315
auaacauuggcaaacgaaua

SEQ ID NO: 4037880 - RNA, 22 nt, Staphylococcus aureus subsp. aureus N315
auaaccacaccaugcugcacau

SEQ ID NO: 4037881 - RNA, 23 nt, Staphylococcus aureus subsp. aureus N315
auaaccacaccaugcugcacauu

SEQ ID NO: 4037882 - RNA, 22 nt, Staphylococcus aureus subsp. aureus N315
auaaccaccaucccauuaaacc

SEQ ID NO: 4037883 - RNA, 14 nt, Staphylococcus aureus subsp. aureus N315
auaaccauaaugaa

SEQ ID NO: 4037884 - RNA, 18 nt, Staphylococcus aureus subsp. aureus N315
auaaccauaguaauaaaa

SEQ ID NO: 4037885 - RNA, 14 nt, Staphylococcus aureus subsp. aureus N315
auaaccauuuuuuc

SEQ ID NO: 4037886 - RNA, 22 nt, Staphylococcus aureus subsp. aureus N315
auaaucaagucugcauuaauuu

SEQ ID NO: 4037887 - RNA, 14 nt, Staphylococcus aureus subsp. aureus N315
auaaucaguauuua

SEQ ID NO: 4037888 - RNA, 16 nt, Staphylococcus aureus subsp. aureus N315
auaaucaguauuuacu

SEQ ID NO: 4037889 - RNA, 13 nt, Staphylococcus aureus subsp. aureus N315
auaaucauccaua

SEQ ID NO: 4037890 - RNA, 15 nt, Staphylococcus aureus subsp. aureus N315
auaauccaagauaua

SEQ ID NO: 4037891 - RNA, 21 nt, Staphylococcus aureus subsp. aureus N315
auaauccaagauauauaacua

SEQ ID NO: 4037892 - RNA, 19 nt, Staphylococcus aureus subsp. aureus N315
auaauccagccacaccaaa

SEQ ID NO: 4037893 - RNA, 11 nt, Staphylococcus aureus subsp. aureus N315
auaauccauuc

SEQ ID NO: 4037894 - RNA, 17 nt, Staphylococcus aureus subsp. aureus N315
auaauccauucuucuug

SEQ ID NO: 4037895 - RNA, 16 nt, Staphylococcus aureus subsp. aureus N315
auaaucgaacagaaaa

SEQ ID NO: 4037896 - RNA, 18 nt, Staphylococcus aureus subsp. aureus N315
auaaucgaacauaaauaa

SEQ ID NO: 4037897 - RNA, 20 nt, Staphylococcus aureus subsp. aureus N315
auaaucgaacauaaauaaac

SEQ ID NO: 4037898 - RNA, 16 nt, Staphylococcus aureus subsp. aureus N315
auaaucgagguaguac

SEQ ID NO: 4037899 - RNA, 19 nt, Staphylococcus aureus subsp. aureus N315
auaaucguauucauaucau

SEQ ID NO: 4037900 - RNA, 14 nt, Staphylococcus aureus subsp. aureus N315
auaaucguuuuuac

SEQ ID NO: 4037901 - RNA, 23 nt, Staphylococcus aureus subsp. aureus N315
auaaucguuuuuacuguaaucaa

SEQ ID NO: 4037902 - RNA, 21 nt, Staphylococcus aureus subsp. aureus N315
auaaucucauucuuuaauaua

SEQ ID NO: 4037903 - RNA, 16 nt, Staphylococcus aureus subsp. aureus N315
auaaucuuacugcuuu

SEQ ID NO: 4037904 - RNA, 19 nt, Staphylococcus aureus subsp. aureus N315
auaaucuuacugcuuuuuu

SEQ ID NO: 4037905 - RNA, 14 nt, Staphylococcus aureus subsp. aureus N315
auaaucuucaguau

SEQ ID NO: 4037906 - RNA, 16 nt, Staphylococcus aureus subsp. aureus N315
auaaucuuuaacauuu

SEQ ID NO: 4037907 - RNA, 17 nt, Staphylococcus aureus subsp. aureus N315
auaaucuuuauuaauaa

SEQ ID NO: 4037908 - RNA, 16 nt, Staphylococcus aureus subsp. aureus N315
auaaucuuuuuuacua

SEQ ID NO: 4037909 - RNA, 18 nt, Staphylococcus aureus subsp. aureus N315
auaaugaauaauuaaaaa

SEQ ID NO: 4037910 - RNA, 21 nt, Staphylococcus aureus subsp. aureus N315
auaaugaauucauucaauacg

SEQ ID NO: 4037911 - RNA, 14 nt, Staphylococcus aureus subsp. aureus N315
auaaugauaaauua

SEQ ID NO: 4037912 - RNA, 14 nt, Staphylococcus aureus subsp. aureus N315
auaaugauuuuuau

SEQ ID NO: 4037913 - RNA, 15 nt, Staphylococcus aureus subsp. aureus N315
auaaugcuauauuuc

SEQ ID NO: 4037914 - RNA, 14 nt, Staphylococcus aureus subsp. aureus N315
auaauggacgguau

SEQ ID NO: 4037915 - RNA, 17 nt, Staphylococcus aureus subsp. aureus N315
auaaugguugaauaaca

SEQ ID NO: 4037916 - RNA, 21 nt, Staphylococcus aureus subsp. aureus N315
auaauguaauuguuuuuucuu

SEQ ID NO: 4037917 - RNA, 13 nt, Staphylococcus aureus subsp. aureus N315
auaauguacacuu

SEQ ID NO: 4037918 - RNA, 15 nt, Staphylococcus aureus subsp. aureus N315
auaauguacauguau

SEQ ID NO: 4037919 - RNA, 16 nt, Staphylococcus aureus subsp. aureus N315
auaauguacauguaua

SEQ ID NO: 4037920 - RNA, 16 nt, Staphylococcus aureus subsp. aureus N315
auaauguauaaaacag

SEQ ID NO: 4037921 - RNA, 22 nt, Staphylococcus aureus subsp. aureus N315
auaauguauaaaacagaauuuc

SEQ ID NO: 4037922 - RNA, 16 nt, Staphylococcus aureus subsp. aureus N315
auaaugucuuacuugu

SEQ ID NO: 4037923 - RNA, 20 nt, Staphylococcus aureus subsp. aureus N315
auaaugucuuacuuuuaaau

SEQ ID NO: 4037924 - RNA, 22 nt, Staphylococcus aureus subsp. aureus N315
auaaugucuuacuuuuaaauua

SEQ ID NO: 4037925 - RNA, 20 nt, Staphylococcus aureus subsp. aureus N315
auaauguuuccugauauuuc

SEQ ID NO: 4037926 - RNA, 21 nt, Staphylococcus aureus subsp. aureus N315
auaauguuuccugauauuuca

SEQ ID NO: 4037927 - RNA, 21 nt, Staphylococcus aureus subsp. aureus N315
auaauuaaaauaagauauaua

SEQ ID NO: 4037928 - RNA, 18 nt, Staphylococcus aureus subsp. aureus N315
auaauuaaacuaauagca

SEQ ID NO: 4037929 - RNA, 12 nt, Staphylococcus aureus subsp. aureus N315
auaauuaaauaa

SEQ ID NO: 4037930 - RNA, 18 nt, Staphylococcus aureus subsp. aureus N315
auaauuaaauaaaaauau

SEQ ID NO: 4037931 - RNA, 14 nt, Staphylococcus aureus subsp. aureus N315
auaauuaaauaacu

SEQ ID NO: 4037932 - RNA, 14 nt, Staphylococcus aureus subsp. aureus N315
auaauuaaauauaa

SEQ ID NO: 4037933 - RNA, 16 nt, Staphylococcus aureus subsp. aureus N315
auaauuaaauauaaag

SEQ ID NO: 4037934 - RNA, 14 nt, Staphylococcus aureus subsp. aureus N315
auaauuaacacauu

SEQ ID NO: 4037935 - RNA, 14 nt, Staphylococcus aureus subsp. aureus N315
auaauuaauaacau

SEQ ID NO: 4037936 - RNA, 13 nt, Staphylococcus aureus subsp. aureus N315
auaauuaauguuu

SEQ ID NO: 4037937 - RNA, 18 nt, Staphylococcus aureus subsp. aureus N315
auaauuaauuaaaauucu

SEQ ID NO: 4037938 - RNA, 22 nt, Staphylococcus aureus subsp. aureus N315
auaauuaauuuguccauccauu

SEQ ID NO: 4037939 - RNA, 23 nt, Staphylococcus aureus subsp. aureus N315
auaauuaccuuuccauucguaua

SEQ ID NO: 4037940 - RNA, 21 nt, Staphylococcus aureus subsp. aureus N315
auaauuacuaaccuaaagaua

SEQ ID NO: 4037941 - RNA, 16 nt, Staphylococcus aureus subsp. aureus N315
auaauuagauuuaaaa

SEQ ID NO: 4037942 - RNA, 21 nt, Staphylococcus aureus subsp. aureus N315
auaauuagauuuaaaauguca

SEQ ID NO: 4037943 - RNA, 12 nt, Staphylococcus aureus subsp. aureus N315
auaauuagucau

SEQ ID NO: 4037944 - RNA, 13 nt, Staphylococcus aureus subsp. aureus N315
auaauuaugaaaa

SEQ ID NO: 4037945 - RNA, 13 nt, Staphylococcus aureus subsp. aureus N315
auaauucaacuua

SEQ ID NO: 4037946 - RNA, 16 nt, Staphylococcus aureus subsp. aureus N315
auaauucaacuuaaau

SEQ ID NO: 4037947 - RNA, 15 nt, Staphylococcus aureus subsp. aureus N315
auaauucagaugaau

SEQ ID NO: 4037948 - RNA, 13 nt, Staphylococcus aureus subsp. aureus N315
auaauucaucuug

SEQ ID NO: 4037949 - RNA, 21 nt, Staphylococcus aureus subsp. aureus N315
auaauucgaaaucaaauauuu

SEQ ID NO: 4037950 - RNA, 19 nt, Staphylococcus aureus subsp. aureus N315
auaauucgauuaucuacua

SEQ ID NO: 4037951 - RNA, 20 nt, Staphylococcus aureus subsp. aureus N315
auaauucgugauuacauucu

SEQ ID NO: 4037952 - RNA, 18 nt, Staphylococcus aureus subsp. aureus N315
auaauugauaauggauua

SEQ ID NO: 4037953 - RNA, 22 nt, Staphylococcus aureus subsp. aureus N315
auaauugaugugccuuucuaau

SEQ ID NO: 4037954 - RNA, 23 nt, Staphylococcus aureus subsp. aureus N315
auaauugauugucauauaaaaca

SEQ ID NO: 4037955 - RNA, 22 nt, Staphylococcus aureus subsp. aureus N315
auaauugcauagcuaaauaaau

SEQ ID NO: 4037956 - RNA, 19 nt, Staphylococcus aureus subsp. aureus N315
auaauugcauguaaaauua

SEQ ID NO: 4037957 - RNA, 20 nt, Staphylococcus aureus subsp. aureus N315
auaauugcauguaaaauuaa

SEQ ID NO: 4037958 - RNA, 22 nt, Staphylococcus aureus subsp. aureus N315
auaauugcauguaaaauuaaau

SEQ ID NO: 4037959 - RNA, 15 nt, Staphylococcus aureus subsp. aureus N315
auaauugcauuacua

SEQ ID NO: 4037960 - RNA, 15 nt, Staphylococcus aureus subsp. aureus N315
auaauugcuaaaaua

SEQ ID NO: 4037961 - RNA, 12 nt, Staphylococcus aureus subsp. aureus N315
auaauuuaaaag

SEQ ID NO: 4037962 - RNA, 13 nt, Staphylococcus aureus subsp. aureus N315
auaauuuaaaaga

SEQ ID NO: 4037963 - RNA, 23 nt, Staphylococcus aureus subsp. aureus N315
auaauuuaaaggcauaauaacca

SEQ ID NO: 4037964 - RNA, 15 nt, Staphylococcus aureus subsp. aureus N315
auaauuuaauaaugu

SEQ ID NO: 4037965 - RNA, 22 nt, Staphylococcus aureus subsp. aureus N315
auaauuuauuuagcaucuuuac

SEQ ID NO: 4037966 - RNA, 15 nt, Staphylococcus aureus subsp. aureus N315
auaauuucucaaacg

SEQ ID NO: 4037967 - RNA, 16 nt, Staphylococcus aureus subsp. aureus N315
auaauuucuucuucug

SEQ ID NO: 4037968 - RNA, 16 nt, Staphylococcus aureus subsp. aureus N315
auaauuugugugcgau

SEQ ID NO: 4037969 - RNA, 15 nt, Staphylococcus aureus subsp. aureus N315
auaauuuuaaaaaua

SEQ ID NO: 4037970 - RNA, 16 nt, Staphylococcus aureus subsp. aureus N315
auaauuuuaauauuau

SEQ ID NO: 4037971 - RNA, 18 nt, Staphylococcus aureus subsp. aureus N315
auaauuuuaauauuaugu

SEQ ID NO: 4037972 - RNA, 20 nt, Staphylococcus aureus subsp. aureus N315
auaauuuuaucuaaagcuau

SEQ ID NO: 4037973 - RNA, 20 nt, Staphylococcus aureus subsp. aureus N315
auaauuuuccaucuauccga

SEQ ID NO: 4037974 - RNA, 15 nt, Staphylococcus aureus subsp. aureus N315
auacuaaauuugaaa

SEQ ID NO: 4037975 - RNA, 18 nt, Staphylococcus aureus subsp. aureus N315
auacuaauaucuucuuua

SEQ ID NO: 4037976 - RNA, 15 nt, Staphylococcus aureus subsp. aureus N315
auacuaaucaaagaa

SEQ ID NO: 4037977 - RNA, 22 nt, Staphylococcus aureus subsp. aureus N315
auacuaaucaaagaaaaaguga

SEQ ID NO: 4037978 - RNA, 16 nt, Staphylococcus aureus subsp. aureus N315
auacuaccguuuuuau

SEQ ID NO: 4037979 - RNA, 17 nt, Staphylococcus aureus subsp. aureus N315
auacuacuguugacauu

SEQ ID NO: 4037980 - RNA, 19 nt, Staphylococcus aureus subsp. aureus N315
auacuacuuguuuguuuuu

SEQ ID NO: 4037981 - RNA, 15 nt, Staphylococcus aureus subsp. aureus N315
auacuaguucaacuc

SEQ ID NO: 4037982 - RNA, 16 nt, Staphylococcus aureus subsp. aureus N315
auacuauaugaaaaga

SEQ ID NO: 4037983 - RNA, 16 nt, Staphylococcus aureus subsp. aureus N315
auacuauaugucuuau

SEQ ID NO: 4037984 - RNA, 21 nt, Staphylococcus aureus subsp. aureus N315
auacuauaugucuuaucaauu

SEQ ID NO: 4037985 - RNA, 17 nt, Staphylococcus aureus subsp. aureus N315
auacucaauaaaauugg

SEQ ID NO: 4037986 - RNA, 21 nt, Staphylococcus aureus subsp. aureus N315
auacucaucuguccgauaucu

SEQ ID NO: 4037987 - RNA, 16 nt, Staphylococcus aureus subsp. aureus N315
auacucuaacuuacca

SEQ ID NO: 4037988 - RNA, 17 nt, Staphylococcus aureus subsp. aureus N315
auacucugggcauuuug

SEQ ID NO: 4037989 - RNA, 18 nt, Staphylococcus aureus subsp. aureus N315
auacucugggcauuuuga

SEQ ID NO: 4037990 - RNA, 14 nt, Staphylococcus aureus subsp. aureus N315
auacugaaauuuca

SEQ ID NO: 4037991 - RNA, 14 nt, Staphylococcus aureus subsp. aureus N315
auacugauauuuag

SEQ ID NO: 4037992 - RNA, 22 nt, Staphylococcus aureus subsp. aureus N315
auacugaugaaaacuuaaaaau

SEQ ID NO: 4037993 - RNA, 19 nt, Staphylococcus aureus subsp. aureus N315
auacugccauauguuuuag

SEQ ID NO: 4037994 - RNA, 14 nt, Staphylococcus aureus subsp. aureus N315
auacuguuuaaaua

SEQ ID NO: 4037995 - RNA, 14 nt, Staphylococcus aureus subsp. aureus N315
auacuuaauuuaaa

SEQ ID NO: 4037996 - RNA, 17 nt, Staphylococcus aureus subsp. aureus N315
auacuuacugaaacuaa

SEQ ID NO: 4037997 - RNA, 20 nt, Staphylococcus aureus subsp. aureus N315
auacuucaaacguuauguac

SEQ ID NO: 4037998 - RNA, 17 nt, Staphylococcus aureus subsp. aureus N315
auacuucaccaucuuua

SEQ ID NO: 4037999 - RNA, 21 nt, Staphylococcus aureus subsp. aureus N315
auacuucuuuugcaaaacgca

SEQ ID NO: 4038000 - RNA, 13 nt, Staphylococcus aureus subsp. aureus N315
auacuugaagaaa

SEQ ID NO: 4038001 - RNA, 21 nt, Staphylococcus aureus subsp. aureus N315
auacuugaagcaucgauuuau

SEQ ID NO: 4038002 - RNA, 16 nt, Staphylococcus aureus subsp. aureus N315
auacuugaauuuaaua

SEQ ID NO: 4038003 - RNA, 16 nt, Staphylococcus aureus subsp. aureus N315
auacuugaugaaacug

SEQ ID NO: 4038004 - RNA, 23 nt, Staphylococcus aureus subsp. aureus N315
auacuuucacuuugaauacaugu

SEQ ID NO: 4038005 - RNA, 22 nt, Staphylococcus aureus subsp. aureus N315
auacuuuuaccauugugaauaa

SEQ ID NO: 4038006 - RNA, 20 nt, Staphylococcus aureus subsp. aureus N315
auacuuuuauagaaaauuaa

SEQ ID NO: 4038007 - RNA, 18 nt, Staphylococcus aureus subsp. aureus N315
auacuuuuggucuguuga

SEQ ID NO: 4038008 - RNA, 13 nt, Staphylococcus aureus subsp. aureus N315
auacuuuuuaaau

SEQ ID NO: 4038009 - RNA, 18 nt, Staphylococcus aureus subsp. aureus N315
auagaaaaauuucaaaaa

SEQ ID NO: 4038010 - RNA, 20 nt, Staphylococcus aureus subsp. aureus N315
auagaaaagggacagaaaag

SEQ ID NO: 4038011 - RNA, 20 nt, Staphylococcus aureus subsp. aureus N315
auagaaaaugaguacaacau

SEQ ID NO: 4038012 - RNA, 15 nt, Staphylococcus aureus subsp. aureus N315
auagaaauaaucaca

SEQ ID NO: 4038013 - RNA, 16 nt, Staphylococcus aureus subsp. aureus N315
auagaaauaaucacau

SEQ ID NO: 4038014 - RNA, 12 nt, Staphylococcus aureus subsp. aureus N315
auagaaaugaua

SEQ ID NO: 4038015 - RNA, 23 nt, Staphylococcus aureus subsp. aureus N315
auagaaccuauuuuuuauaugau

SEQ ID NO: 4038016 - RNA, 20 nt, Staphylococcus aureus subsp. aureus N315
auagaagaacgaagaaugau

SEQ ID NO: 4038017 - RNA, 22 nt, Staphylococcus aureus subsp. aureus N315
auagaagaacgaagaaugauac

SEQ ID NO: 4038018 - RNA, 12 nt, Staphylococcus aureus subsp. aureus N315
auagaaggggac

SEQ ID NO: 4038019 - RNA, 20 nt, Staphylococcus aureus subsp. aureus N315
auagaagguuauuuuuuaug

SEQ ID NO: 4038020 - RNA, 14 nt, Staphylococcus aureus subsp. aureus N315
auagaaguuuuuug

SEQ ID NO: 4038021 - RNA, 18 nt, Staphylococcus aureus subsp. aureus N315
auagaaguuuuuugauua

SEQ ID NO: 4038022 - RNA, 15 nt, Staphylococcus aureus subsp. aureus N315
auagaaugaauaauu

SEQ ID NO: 4038023 - RNA, 12 nt, Staphylococcus aureus subsp. aureus N315
auagaauuuuuc

SEQ ID NO: 4038024 - RNA, 19 nt, Staphylococcus aureus subsp. aureus N315
auagaauuuuucauauacu

SEQ ID NO: 4038025 - RNA, 15 nt, Staphylococcus aureus subsp. aureus N315
auagacaccaaaaaa

SEQ ID NO: 4038026 - RNA, 15 nt, Staphylococcus aureus subsp. aureus N315
auagacuaacuguac

SEQ ID NO: 4038027 - RNA, 22 nt, Staphylococcus aureus subsp. aureus N315
auagacuuucuugaugaauuaa

SEQ ID NO: 4038028 - RNA, 14 nt, Staphylococcus aureus subsp. aureus N315
auagagaacagcag

SEQ ID NO: 4038029 - RNA, 14 nt, Staphylococcus aureus subsp. aureus N315
auagauaaugcacc

SEQ ID NO: 4038030 - RNA, 19 nt, Staphylococcus aureus subsp. aureus N315
auagauagaaauugugcuu

SEQ ID NO: 4038031 - RNA, 22 nt, Staphylococcus aureus subsp. aureus N315
auagauagacuuucuugaugaa

SEQ ID NO: 4038032 - RNA, 15 nt, Staphylococcus aureus subsp. aureus N315
auagauaucauuuua

SEQ ID NO: 4038033 - RNA, 13 nt, Staphylococcus aureus subsp. aureus N315
auagaucuuugua

SEQ ID NO: 4038034 - RNA, 22 nt, Staphylococcus aureus subsp. aureus N315
auagaugacuguagaaaacaug

SEQ ID NO: 4038035 - RNA, 16 nt, Staphylococcus aureus subsp. aureus N315
auagaugcauaaaaac

SEQ ID NO: 4038036 - RNA, 17 nt, Staphylococcus aureus subsp. aureus N315
auagaugcauaaaaacc

SEQ ID NO: 4038037 - RNA, 18 nt, Staphylococcus aureus subsp. aureus N315
auagaugcuucaaaaauu

SEQ ID NO: 4038038 - RNA, 15 nt, Staphylococcus aureus subsp. aureus N315
auagaugugucuuuu

SEQ ID NO: 4038039 - RNA, 14 nt, Staphylococcus aureus subsp. aureus N315
auagauuaaaaaau

SEQ ID NO: 4038040 - RNA, 15 nt, Staphylococcus aureus subsp. aureus N315
auagauuaaaaaauc

SEQ ID NO: 4038041 - RNA, 18 nt, Staphylococcus aureus subsp. aureus N315
auagauuaaaaaaucauu

SEQ ID NO: 4038042 - RNA, 15 nt, Staphylococcus aureus subsp. aureus N315
auagauugaaaaaau

SEQ ID NO: 4038043 - RNA, 23 nt, Staphylococcus aureus subsp. aureus N315
auagauuuaucaccuuuaggcaa

SEQ ID NO: 4038044 - RNA, 21 nt, Staphylococcus aureus subsp. aureus N315
auagcaaaauuauguaaaaaa

SEQ ID NO: 4038045 - RNA, 18 nt, Staphylococcus aureus subsp. aureus N315
auagcaaccauauuuuua

SEQ ID NO: 4038046 - RNA, 21 nt, Staphylococcus aureus subsp. aureus N315
auagcaccguaacauauguac

SEQ ID NO: 4038047 - RNA, 20 nt, Staphylococcus aureus subsp. aureus N315
auagcagguggcauccauau

SEQ ID NO: 4038048 - RNA, 19 nt, Staphylococcus aureus subsp. aureus N315
auagcauaaaauuucugcu

SEQ ID NO: 4038049 - RNA, 22 nt, Staphylococcus aureus subsp. aureus N315
auagcaucuaugauuguaugac

SEQ ID NO: 4038050 - RNA, 13 nt, Staphylococcus aureus subsp. aureus N315
auagcauuucuuu

SEQ ID NO: 4038051 - RNA, 21 nt, Staphylococcus aureus subsp. aureus N315
auagcauuucuuuauuagaau

SEQ ID NO: 4038052 - RNA, 22 nt, Staphylococcus aureus subsp. aureus N315
auagcauuucuuuauuagaaug

SEQ ID NO: 4038053 - RNA, 19 nt, Staphylococcus aureus subsp. aureus N315
auagccguuaacaucagua

SEQ ID NO: 4038054 - RNA, 17 nt, Staphylococcus aureus subsp. aureus N315
auagccuauuuaaaaga

SEQ ID NO: 4038055 - RNA, 14 nt, Staphylococcus aureus subsp. aureus N315
auagccuucaaaau

SEQ ID NO: 4038056 - RNA, 22 nt, Staphylococcus aureus subsp. aureus N315
auagcgauuuuaaagaaaaguu

SEQ ID NO: 4038057 - RNA, 16 nt, Staphylococcus aureus subsp. aureus N315
auagcgcagcaaaugc

SEQ ID NO: 4038058 - RNA, 21 nt, Staphylococcus aureus subsp. aureus N315
auagcgcucuggauuuuucuu

SEQ ID NO: 4038059 - RNA, 14 nt, Staphylococcus aureus subsp. aureus N315
auagcgguguuuug

SEQ ID NO: 4038060 - RNA, 14 nt, Staphylococcus aureus subsp. aureus N315
auagcgguuuaaaa

SEQ ID NO: 4038061 - RNA, 15 nt, Staphylococcus aureus subsp. aureus N315
auauagcauaaaauu

SEQ ID NO: 4038062 - RNA, 22 nt, Staphylococcus aureus subsp. aureus N315
auauagcauaaaauuucugcuu

SEQ ID NO: 4038063 - RNA, 21 nt, Staphylococcus aureus subsp. aureus N315
auauagcgcgcuuauugaaaa

SEQ ID NO: 4038064 - RNA, 22 nt, Staphylococcus aureus subsp. aureus N315
auauagcggugucaauauugua

SEQ ID NO: 4038065 - RNA, 14 nt, Staphylococcus aureus subsp. aureus N315
auauaguaaaauaa

SEQ ID NO: 4038066 - RNA, 21 nt, Staphylococcus aureus subsp. aureus N315
auauaguaggguauugaaaua

SEQ ID NO: 4038067 - RNA, 17 nt, Staphylococcus aureus subsp. aureus N315
auauagucuaugaauaa

SEQ ID NO: 4038068 - RNA, 18 nt, Staphylococcus aureus subsp. aureus N315
auauaguggugguacuuu

SEQ ID NO: 4038069 - RNA, 19 nt, Staphylococcus aureus subsp. aureus N315
auauaguggugguacuuuu

SEQ ID NO: 4038070 - RNA, 22 nt, Staphylococcus aureus subsp. aureus N315
auauaguggugguacuuuuuug

SEQ ID NO: 4038071 - RNA, 15 nt, Staphylococcus aureus subsp. aureus N315
auauaguugaucaaa

SEQ ID NO: 4038072 - RNA, 11 nt, Staphylococcus aureus subsp. aureus N315
auauauaaaag

SEQ ID NO: 4038073 - RNA, 16 nt, Staphylococcus aureus subsp. aureus N315
auauauaaagaaauaa

SEQ ID NO: 4038074 - RNA, 13 nt, Staphylococcus aureus subsp. aureus N315
auauauaaccaua

SEQ ID NO: 4038075 - RNA, 23 nt, Staphylococcus aureus subsp. aureus N315
auauauaauaaaaccaccuguuu

SEQ ID NO: 4038076 - RNA, 15 nt, Staphylococcus aureus subsp. aureus N315
auauauaaugaaggu

SEQ ID NO: 4038077 - RNA, 13 nt, Staphylococcus aureus subsp. aureus N315
auauauagauuaa

SEQ ID NO: 4038078 - RNA, 19 nt, Staphylococcus aureus subsp. aureus N315
auauauagauuaaaccgca

SEQ ID NO: 4038079 - RNA, 12 nt, Staphylococcus aureus subsp. aureus N315
auauaucaaaua

SEQ ID NO: 4038080 - RNA, 16 nt, Staphylococcus aureus subsp. aureus N315
auauaucaacguuaau

SEQ ID NO: 4038081 - RNA, 18 nt, Staphylococcus aureus subsp. aureus N315
auauauccugccaauaua

SEQ ID NO: 4038082 - RNA, 21 nt, Staphylococcus aureus subsp. aureus N315
auauauccugccaauauauuc

SEQ ID NO: 4038083 - RNA, 14 nt, Staphylococcus aureus subsp. aureus N315
auauaugauaaaua

SEQ ID NO: 4038084 - RNA, 22 nt, Staphylococcus aureus subsp. aureus N315
auauauuaucguaauuguuaaa

SEQ ID NO: 4038085 - RNA, 15 nt, Staphylococcus aureus subsp. aureus N315
auauauugucgacuu

SEQ ID NO: 4038086 - RNA, 22 nt, Staphylococcus aureus subsp. aureus N315
auauauuucuauuccuucuaac

SEQ ID NO: 4038087 - RNA, 12 nt, Staphylococcus aureus subsp. aureus N315
auauauuugaaa

SEQ ID NO: 4038088 - RNA, 17 nt, Staphylococcus aureus subsp. aureus N315
auauauuugaaagguaa

SEQ ID NO: 4038089 - RNA, 21 nt, Staphylococcus aureus subsp. aureus N315
auauauuuggaggugaugaga

SEQ ID NO: 4038090 - RNA, 13 nt, Staphylococcus aureus subsp. aureus N315
auaucaaaaaaua

SEQ ID NO: 4038091 - RNA, 21 nt, Staphylococcus aureus subsp. aureus N315
auaucaaaaaauacguuuaau

SEQ ID NO: 4038092 - RNA, 17 nt, Staphylococcus aureus subsp. aureus N315
auaucaaaauauaaaau

SEQ ID NO: 4038093 - RNA, 13 nt, Staphylococcus aureus subsp. aureus N315
auaucaaauacau

SEQ ID NO: 4038094 - RNA, 17 nt, Staphylococcus aureus subsp. aureus N315
auaucaaauacauuuca

SEQ ID NO: 4038095 - RNA, 21 nt, Staphylococcus aureus subsp. aureus N315
auaucaaauacauuucaaaaa

SEQ ID NO: 4038096 - RNA, 22 nt, Staphylococcus aureus subsp. aureus N315
auaucaacauguuccgcuacaa

SEQ ID NO: 4038097 - RNA, 14 nt, Staphylococcus aureus subsp. aureus N315
auaucaaguuuuaa

SEQ ID NO: 4038098 - RNA, 16 nt, Staphylococcus aureus subsp. aureus N315
auaucaauaaugcugc

SEQ ID NO: 4038099 - RNA, 20 nt, Staphylococcus aureus subsp. aureus N315
auaucaauuguugcaaaaua

SEQ ID NO: 4038100 - RNA, 21 nt, Staphylococcus aureus subsp. aureus N315
auaucacaacacauaaauuaa

SEQ ID NO: 4038101 - RNA, 17 nt, Staphylococcus aureus subsp. aureus N315
auaucacugaaugcuaa

SEQ ID NO: 4038102 - RNA, 17 nt, Staphylococcus aureus subsp. aureus N315
auaucacuuuagauaaa

SEQ ID NO: 4038103 - RNA, 20 nt, Staphylococcus aureus subsp. aureus N315
auaucagcuaaguuaaauau

SEQ ID NO: 4038104 - RNA, 15 nt, Staphylococcus aureus subsp. aureus N315
auaucaguaauaaua

SEQ ID NO: 4038105 - RNA, 20 nt, Staphylococcus aureus subsp. aureus N315
auaucauaccaaaaaguauu

SEQ ID NO: 4038106 - RNA, 16 nt, Staphylococcus aureus subsp. aureus N315
auaucauauaaugguu

SEQ ID NO: 4038107 - RNA, 23 nt, Staphylococcus aureus subsp. aureus N315
auaucauauuugaauacuuuauu

SEQ ID NO: 4038108 - RNA, 12 nt, Staphylococcus aureus subsp. aureus N315
auaucauccaca

SEQ ID NO: 4038109 - RNA, 17 nt, Staphylococcus aureus subsp. aureus N315
auaucaucucuaugucu

SEQ ID NO: 4038110 - RNA, 17 nt, Staphylococcus aureus subsp. aureus N315
auaucaugcaaaacuaa

SEQ ID NO: 4038111 - RNA, 15 nt, Staphylococcus aureus subsp. aureus N315
auaucaugcaaaaua

SEQ ID NO: 4038112 - RNA, 22 nt, Staphylococcus aureus subsp. aureus N315
auaucaugcacaauauucguag

SEQ ID NO: 4038113 - RNA, 23 nt, Staphylococcus aureus subsp. aureus N315
auaucaugcuuaucuguaaauaa

SEQ ID NO: 4038114 - RNA, 13 nt, Staphylococcus aureus subsp. aureus N315
auaucauucugug

SEQ ID NO: 4038115 - RNA, 23 nt, Staphylococcus aureus subsp. aureus N315
auaucauucuguguaaauauaaa

SEQ ID NO: 4038116 - RNA, 21 nt, Staphylococcus aureus subsp. aureus N315
auauccaaaauccugaaauua

SEQ ID NO: 4038117 - RNA, 17 nt, Staphylococcus aureus subsp. aureus N315
auauccugccaauauau

SEQ ID NO: 4038118 - RNA, 14 nt, Staphylococcus aureus subsp. aureus N315
auauccuucauuag

SEQ ID NO: 4038119 - RNA, 15 nt, Staphylococcus aureus subsp. aureus N315
auaucgauaaaugua

SEQ ID NO: 4038120 - RNA, 21 nt, Staphylococcus aureus subsp. aureus N315
auaucgaugacuuugucuuua

SEQ ID NO: 4038121 - RNA, 16 nt, Staphylococcus aureus subsp. aureus N315
auaucgucguaacucu

SEQ ID NO: 4038122 - RNA, 11 nt, Staphylococcus aureus subsp. aureus N315
auaucuaaguc

SEQ ID NO: 4038123 - RNA, 14 nt, Staphylococcus aureus subsp. aureus N315
auaucuacagagaa

SEQ ID NO: 4038124 - RNA, 17 nt, Staphylococcus aureus subsp. aureus N315
auaucuacagagaauca

SEQ ID NO: 4038125 - RNA, 23 nt, Staphylococcus aureus subsp. aureus N315
auaucuacagagaaucaauuauu

SEQ ID NO: 4038126 - RNA, 22 nt, Staphylococcus aureus subsp. aureus N315
auaucuagcugcuucugcugua

SEQ ID NO: 4038127 - RNA, 12 nt, Staphylococcus aureus subsp. aureus N315
auaucucaagau

SEQ ID NO: 4038128 - RNA, 14 nt, Staphylococcus aureus subsp. aureus N315
auaucucaagauau

SEQ ID NO: 4038129 - RNA, 15 nt, Staphylococcus aureus subsp. aureus N315
auaucuguugcauua

SEQ ID NO: 4038130 - RNA, 17 nt, Staphylococcus aureus subsp. aureus N315
auaucuuaaagaauuaa

SEQ ID NO: 4038131 - RNA, 19 nt, Staphylococcus aureus subsp. aureus N315
auaucuuaaguacauaaau

SEQ ID NO: 4038132 - RNA, 21 nt, Staphylococcus aureus subsp. aureus N315
auaucuuaugauacuuugaaa

SEQ ID NO: 4038133 - RNA, 22 nt, Staphylococcus aureus subsp. aureus N315
auaucuugcuuggauaauugca

SEQ ID NO: 4038134 - RNA, 15 nt, Staphylococcus aureus subsp. aureus N315
auaucuuuauuugau

SEQ ID NO: 4038135 - RNA, 21 nt, Staphylococcus aureus subsp. aureus N315
auaucuuucaauuaauuuaaa

SEQ ID NO: 4038136 - RNA, 22 nt, Staphylococcus aureus subsp. aureus N315
auaucuuuuuuuuuauaguggu

SEQ ID NO: 4038137 - RNA, 12 nt, Staphylococcus aureus subsp. aureus N315
auaugaaaagag

SEQ ID NO: 4038138 - RNA, 14 nt, Staphylococcus aureus subsp. aureus N315
auaugaauaaccau

SEQ ID NO: 4038139 - RNA, 13 nt, Staphylococcus aureus subsp. aureus N315
auaugaauugagu

SEQ ID NO: 4038140 - RNA, 22 nt, Staphylococcus aureus subsp. aureus N315
auaugaauugcuuguuuuaaau

SEQ ID NO: 4038141 - RNA, 21 nt, Staphylococcus aureus subsp. aureus N315
auaugacgcgugaauuaaaaa

SEQ ID NO: 4038142 - RNA, 16 nt, Staphylococcus aureus subsp. aureus N315
auaugacuuuauuucu

SEQ ID NO: 4038143 - RNA, 17 nt, Staphylococcus aureus subsp. aureus N315
auaugacuuuauuucua

SEQ ID NO: 4038144 - RNA, 20 nt, Staphylococcus aureus subsp. aureus N315
auaugacuuuuuauuaguau

SEQ ID NO: 4038145 - RNA, 12 nt, Staphylococcus aureus subsp. aureus N315
auaugauaacca

SEQ ID NO: 4038146 - RNA, 15 nt, Staphylococcus aureus subsp. aureus N315
auaugauaaccaaac

SEQ ID NO: 4038147 - RNA, 19 nt, Staphylococcus aureus subsp. aureus N315
auaugauuaaauaaucaac

SEQ ID NO: 4038148 - RNA, 17 nt, Staphylococcus aureus subsp. aureus N315
auauuuaaaugucuuuc

SEQ ID NO: 4038149 - RNA, 15 nt, Staphylococcus aureus subsp. aureus N315
auauuuaacaaaauu

SEQ ID NO: 4038150 - RNA, 16 nt, Staphylococcus aureus subsp. aureus N315
auauuuaacaaaauua

SEQ ID NO: 4038151 - RNA, 14 nt, Staphylococcus aureus subsp. aureus N315
auauuuaacauuuu

SEQ ID NO: 4038152 - RNA, 13 nt, Staphylococcus aureus subsp. aureus N315
auauuuaaccuuu

SEQ ID NO: 4038153 - RNA, 17 nt, Staphylococcus aureus subsp. aureus N315
auauuuacacagaauga

SEQ ID NO: 4038154 - RNA, 20 nt, Staphylococcus aureus subsp. aureus N315
auauuuagaauaagaaauaa

SEQ ID NO: 4038155 - RNA, 22 nt, Staphylococcus aureus subsp. aureus N315
auauuuagauuggucaaacuua

SEQ ID NO: 4038156 - RNA, 17 nt, Staphylococcus aureus subsp. aureus N315
auauuuaguuaauuauu

SEQ ID NO: 4038157 - RNA, 22 nt, Staphylococcus aureus subsp. aureus N315
auauuuaucgcgauuauuacca

SEQ ID NO: 4038158 - RNA, 12 nt, Staphylococcus aureus subsp. aureus N315
auauuuauucua

SEQ ID NO: 4038159 - RNA, 13 nt, Staphylococcus aureus subsp. aureus N315
auauuuauuuaau

SEQ ID NO: 4038160 - RNA, 14 nt, Staphylococcus aureus subsp. aureus N315
auauuuauuuuaau

SEQ ID NO: 4038161 - RNA, 14 nt, Staphylococcus aureus subsp. aureus N315
auauuuauuuuaua

SEQ ID NO: 4038162 - RNA, 17 nt, Staphylococcus aureus subsp. aureus N315
auauuuauuuuauaaua

SEQ ID NO: 4038163 - RNA, 18 nt, Staphylococcus aureus subsp. aureus N315
auauuucaacuuuuuaau

SEQ ID NO: 4038164 - RNA, 19 nt, Staphylococcus aureus subsp. aureus N315
auauuucccuaugaaauaa

SEQ ID NO: 4038165 - RNA, 15 nt, Staphylococcus aureus subsp. aureus N315
auauuucgguauuuu

SEQ ID NO: 4038166 - RNA, 16 nt, Staphylococcus aureus subsp. aureus N315
auauuucgguauuuua

SEQ ID NO: 4038167 - RNA, 19 nt, Staphylococcus aureus subsp. aureus N315
auauuucgguauuuuaaau

SEQ ID NO: 4038168 - RNA, 21 nt, Staphylococcus aureus subsp. aureus N315
auauuucgguuagucuuaauc

SEQ ID NO: 4038169 - RNA, 16 nt, Staphylococcus aureus subsp. aureus N315
auauuucuaaaccauu

SEQ ID NO: 4038170 - RNA, 14 nt, Staphylococcus aureus subsp. aureus N315
auauuucuaaauua

SEQ ID NO: 4038171 - RNA, 21 nt, Staphylococcus aureus subsp. aureus N315
auauuugaaagguaaguacuu

SEQ ID NO: 4038172 - RNA, 16 nt, Staphylococcus aureus subsp. aureus N315
auauuugauaacaaaa

SEQ ID NO: 4038173 - RNA, 20 nt, Staphylococcus aureus subsp. aureus N315
auauuugaugaucccaaaau

SEQ ID NO: 4038174 - RNA, 20 nt, Staphylococcus aureus subsp. aureus N315
auauuugcuagucauaauuu

SEQ ID NO: 4038175 - RNA, 17 nt, Staphylococcus aureus subsp. aureus N315
auauuuggaaguuuuca

SEQ ID NO: 4038176 - RNA, 22 nt, Staphylococcus aureus subsp. aureus N315
auauuuguagccuacaaccuuu

SEQ ID NO: 4038177 - RNA, 17 nt, Staphylococcus aureus subsp. aureus N315
auauuuuaaaaaguaau

SEQ ID NO: 4038178 - RNA, 14 nt, Staphylococcus aureus subsp. aureus N315
auauuuuaguucac

SEQ ID NO: 4038179 - RNA, 19 nt, Staphylococcus aureus subsp. aureus N315
auauuuuauuuaaaaauag

SEQ ID NO: 4038180 - RNA, 19 nt, Staphylococcus aureus subsp. aureus N315
auauuuucuuagaaaauca

SEQ ID NO: 4038181 - RNA, 12 nt, Staphylococcus aureus subsp. aureus N315
auauuuugauuu

SEQ ID NO: 4038182 - RNA, 20 nt, Staphylococcus aureus subsp. aureus N315
auauuuuuaauuauuuuaaa

SEQ ID NO: 4038183 - RNA, 18 nt, Staphylococcus aureus subsp. aureus N315
auauuuuuacauauuuau

SEQ ID NO: 4038184 - RNA, 16 nt, Staphylococcus aureus subsp. aureus N315
auauuuuuagcuuuau

SEQ ID NO: 4038185 - RNA, 13 nt, Staphylococcus aureus subsp. aureus N315
auauuuuuaggaa

SEQ ID NO: 4038186 - RNA, 15 nt, Staphylococcus aureus subsp. aureus N315
auauuuuuaggaaua

SEQ ID NO: 4038187 - RNA, 15 nt, Staphylococcus aureus subsp. aureus N315
auauuuuucaauuaa

SEQ ID NO: 4038188 - RNA, 12 nt, Staphylococcus aureus subsp. aureus N315
auauuuuucuuc

SEQ ID NO: 4038189 - RNA, 19 nt, Staphylococcus aureus subsp. aureus N315
auauuuuucuucaguuaaa

SEQ ID NO: 4038190 - RNA, 21 nt, Staphylococcus aureus subsp. aureus N315
auauuuuuuaaaaugauagcu

SEQ ID NO: 4038191 - RNA, 14 nt, Staphylococcus aureus subsp. aureus N315
auauuuuuuaaauu

SEQ ID NO: 4038192 - RNA, 19 nt, Staphylococcus aureus subsp. aureus N315
aucaaaaauaauuaugaaa

SEQ ID NO: 4038193 - RNA, 12 nt, Staphylococcus aureus subsp. aureus N315
aucaaaaccgcu

SEQ ID NO: 4038194 - RNA, 18 nt, Staphylococcus aureus subsp. aureus N315
aucaaaaguuuguauauu

SEQ ID NO: 4038195 - RNA, 20 nt, Staphylococcus aureus subsp. aureus N315
aucaaaauauaaaauccuaa

SEQ ID NO: 4038196 - RNA, 23 nt, Staphylococcus aureus subsp. aureus N315
aucaaaauauaaaauccuaagca

SEQ ID NO: 4038197 - RNA, 22 nt, Staphylococcus aureus subsp. aureus N315
aucaaaaucgguuugauuaaaa

SEQ ID NO: 4038198 - RNA, 21 nt, Staphylococcus aureus subsp. aureus N315
aucaaacuuggcaaugaaauu

SEQ ID NO: 4038199 - RNA, 20 nt, Staphylococcus aureus subsp. aureus N315
aucaaagaggaacagcggaa

SEQ ID NO: 4038200 - RNA, 20 nt, Staphylococcus aureus subsp. aureus N315
aucaaagaggcuuuaaaauu

SEQ ID NO: 4038201 - RNA, 18 nt, Staphylococcus aureus subsp. aureus N315
aucaaagcuauauaugaa

SEQ ID NO: 4038202 - RNA, 21 nt, Staphylococcus aureus subsp. aureus N315
aucaaaguaucagucauugca

SEQ ID NO: 4038203 - RNA, 24 nt, Staphylococcus aureus subsp. aureus N315
aucaaaguuuucaggaauuguuaa

SEQ ID NO: 4038204 - RNA, 17 nt, Staphylococcus aureus subsp. aureus N315
aucaaauacauuucaaa

SEQ ID NO: 4038205 - RNA, 19 nt, Staphylococcus aureus subsp. aureus N315
aucaaauagacaccaaaaa

SEQ ID NO: 4038206 - RNA, 23 nt, Staphylococcus aureus subsp. aureus N315
aucaaauccaaaaucuuuacuug

SEQ ID NO: 4038207 - RNA, 11 nt, Staphylococcus aureus subsp. aureus N315
aucaaauuacc

SEQ ID NO: 4038208 - RNA, 13 nt, Staphylococcus aureus subsp. aureus N315
aucaaauuaccau

SEQ ID NO: 4038209 - RNA, 21 nt, Staphylococcus aureus subsp. aureus N315
aucaaauuagucauccaaaga

SEQ ID NO: 4038210 - RNA, 13 nt, Staphylococcus aureus subsp. aureus N315
aucaaauuuuucg

SEQ ID NO: 4038211 - RNA, 22 nt, Staphylococcus aureus subsp. aureus N315
aucaacaagaacuuagaaaugc

SEQ ID NO: 4038212 - RNA, 15 nt, Staphylococcus aureus subsp. aureus N315
aucaacaauuuaaac

SEQ ID NO: 4038213 - RNA, 17 nt, Staphylococcus aureus subsp. aureus N315
aucaacagcuucaaaau

SEQ ID NO: 4038214 - RNA, 21 nt, Staphylococcus aureus subsp. aureus N315
aucaacaguuuuauuaucuuu

SEQ ID NO: 4038215 - RNA, 17 nt, Staphylococcus aureus subsp. aureus N315
aucaacauuaauaaaua

SEQ ID NO: 4038216 - RNA, 14 nt, Staphylococcus aureus subsp. aureus N315
aucaaccuguucuu

SEQ ID NO: 4038217 - RNA, 18 nt, Staphylococcus aureus subsp. aureus N315
aucaaccuguucuuuauu

SEQ ID NO: 4038218 - RNA, 19 nt, Staphylococcus aureus subsp. aureus N315
aucaacgagucauaaauau

SEQ ID NO: 4038219 - RNA, 18 nt, Staphylococcus aureus subsp. aureus N315
aucaacgccauauuuauu

SEQ ID NO: 4038220 - RNA, 14 nt, Staphylococcus aureus subsp. aureus N315
aucaacuauauaua

SEQ ID NO: 4038221 - RNA, 18 nt, Staphylococcus aureus subsp. aureus N315
aucaacugaaauuuuucc

SEQ ID NO: 4038222 - RNA, 19 nt, Staphylococcus aureus subsp. aureus N315
aucaagaaauguuaaauua

SEQ ID NO: 4038223 - RNA, 13 nt, Staphylococcus aureus subsp. aureus N315
aucaagaauauaa

SEQ ID NO: 4038224 - RNA, 21 nt, Staphylococcus aureus subsp. aureus N315
aucaagacucccuuuuuaaaa

SEQ ID NO: 4038225 - RNA, 16 nt, Staphylococcus aureus subsp. aureus N315
aucaagagguaaaucu

SEQ ID NO: 4038226 - RNA, 15 nt, Staphylococcus aureus subsp. aureus N315
aucaagcugagcuuu

SEQ ID NO: 4038227 - RNA, 23 nt, Staphylococcus aureus subsp. aureus N315
aucaagcugagcuuuaauuuuuu

SEQ ID NO: 4038228 - RNA, 15 nt, Staphylococcus aureus subsp. aureus N315
aucaaguugauaaug

SEQ ID NO: 4038229 - RNA, 16 nt, Staphylococcus aureus subsp. aureus N315
aucaauaguuuauaaa

SEQ ID NO: 4038230 - RNA, 20 nt, Staphylococcus aureus subsp. aureus N315
aucaauaguuuauaaauuaa

SEQ ID NO: 4038231 - RNA, 17 nt, Staphylococcus aureus subsp. aureus N315
aucaauaucaaauuugg

SEQ ID NO: 4038232 - RNA, 19 nt, Staphylococcus aureus subsp. aureus N315
aucaauaucacuaucagcu

SEQ ID NO: 4038233 - RNA, 14 nt, Staphylococcus aureus subsp. aureus N315
aucaauauugauau

SEQ ID NO: 4038234 - RNA, 11 nt, Staphylococcus aureus subsp. aureus N315
aucaauauuua

SEQ ID NO: 4038235 - RNA, 17 nt, Staphylococcus aureus subsp. aureus N315
aucaauccaucaauacc

SEQ ID NO: 4038236 - RNA, 21 nt, Staphylococcus aureus subsp. aureus N315
aucaucucugcuuuaauauaa

SEQ ID NO: 4038237 - RNA, 19 nt, Staphylococcus aureus subsp. aureus N315
aucaucuucuggauaggua

SEQ ID NO: 4038238 - RNA, 16 nt, Staphylococcus aureus subsp. aureus N315
aucaugaaauaaaaaa

SEQ ID NO: 4038239 - RNA, 16 nt, Staphylococcus aureus subsp. aureus N315
aucaugaaguugguuu

SEQ ID NO: 4038240 - RNA, 14 nt, Staphylococcus aureus subsp. aureus N315
aucaugacacaaag

SEQ ID NO: 4038241 - RNA, 17 nt, Staphylococcus aureus subsp. aureus N315
aucaugacacaaaggau

SEQ ID NO: 4038242 - RNA, 19 nt, Staphylococcus aureus subsp. aureus N315
aucaugacuauuucgcuuu

SEQ ID NO: 4038243 - RNA, 19 nt, Staphylococcus aureus subsp. aureus N315
aucaugacuauuuuccauc

SEQ ID NO: 4038244 - RNA, 24 nt, Staphylococcus aureus subsp. aureus N315
aucaugacuauuuuccaucacaua

SEQ ID NO: 4038245 - RNA, 17 nt, Staphylococcus aureus subsp. aureus N315
aucaugauagccgcuuc

SEQ ID NO: 4038246 - RNA, 13 nt, Staphylococcus aureus subsp. aureus N315
aucaugccuucau

SEQ ID NO: 4038247 - RNA, 19 nt, Staphylococcus aureus subsp. aureus N315
aucaugccuucaugaauaa

SEQ ID NO: 4038248 - RNA, 11 nt, Staphylococcus aureus subsp. aureus N315
aucaugcuuuu

SEQ ID NO: 4038249 - RNA, 21 nt, Staphylococcus aureus subsp. aureus N315
aucauggucaacuuuuuuaac

SEQ ID NO: 4038250 - RNA, 19 nt, Staphylococcus aureus subsp. aureus N315
aucauguauauggcaucau

SEQ ID NO: 4038251 - RNA, 23 nt, Staphylococcus aureus subsp. aureus N315
aucauguauauggcaucaucacc

SEQ ID NO: 4038252 - RNA, 15 nt, Staphylococcus aureus subsp. aureus N315
aucaugugacauaac

SEQ ID NO: 4038253 - RNA, 23 nt, Staphylococcus aureus subsp. aureus N315
aucauguuccccauuaauuaaca

SEQ ID NO: 4038254 - RNA, 20 nt, Staphylococcus aureus subsp. aureus N315
aucauguucuaaugcugcuu

SEQ ID NO: 4038255 - RNA, 20 nt, Staphylococcus aureus subsp. aureus N315
aucauguucuuauaaaaaac

SEQ ID NO: 4038256 - RNA, 11 nt, Staphylococcus aureus subsp. aureus N315
aucauuaaaau

SEQ ID NO: 4038257 - RNA, 12 nt, Staphylococcus aureus subsp. aureus N315
aucauuaaaauc

SEQ ID NO: 4038258 - RNA, 22 nt, Staphylococcus aureus subsp. aureus N315
aucauuaaauugcuugaaauua

SEQ ID NO: 4038259 - RNA, 20 nt, Staphylococcus aureus subsp. aureus N315
aucauuaauuggauuuuuac

SEQ ID NO: 4038260 - RNA, 14 nt, Staphylococcus aureus subsp. aureus N315
aucauuagauaaua

SEQ ID NO: 4038261 - RNA, 22 nt, Staphylococcus aureus subsp. aureus N315
aucauuaguuuuuaaaauuauc

SEQ ID NO: 4038262 - RNA, 13 nt, Staphylococcus aureus subsp. aureus N315
aucauuauaaaau

SEQ ID NO: 4038263 - RNA, 14 nt, Staphylococcus aureus subsp. aureus N315
aucauuaucaaaua

SEQ ID NO: 4038264 - RNA, 24 nt, Staphylococcus aureus subsp. aureus N315
aucauucaaguguaguaaaaauca

SEQ ID NO: 4038265 - RNA, 13 nt, Staphylococcus aureus subsp. aureus N315
aucauucaccuug

SEQ ID NO: 4038266 - RNA, 20 nt, Staphylococcus aureus subsp. aureus N315
aucauucuguguaaauauaa

SEQ ID NO: 4038267 - RNA, 21 nt, Staphylococcus aureus subsp. aureus N315
aucauucuguguaaauauaaa

SEQ ID NO: 4038268 - RNA, 17 nt, Staphylococcus aureus subsp. aureus N315
aucauucuuuauagaaa

SEQ ID NO: 4038269 - RNA, 24 nt, Staphylococcus aureus subsp. aureus N315
aucauugaauguuggaucggcauu

SEQ ID NO: 4038270 - RNA, 15 nt, Staphylococcus aureus subsp. aureus N315
aucauugguuucauc

SEQ ID NO: 4038271 - RNA, 22 nt, Staphylococcus aureus subsp. aureus N315
aucauuguguccauaaauauua

SEQ ID NO: 4038272 - RNA, 19 nt, Staphylococcus aureus subsp. aureus N315
aucauuuaaaauauuuuuu

SEQ ID NO: 4038273 - RNA, 14 nt, Staphylococcus aureus subsp. aureus N315
aucauuuaaaauuu

SEQ ID NO: 4038274 - RNA, 23 nt, Staphylococcus aureus subsp. aureus N315
aucauuuaaauuaguuauacuaa

SEQ ID NO: 4038275 - RNA, 19 nt, Staphylococcus aureus subsp. aureus N315
aucauuuauguagauuuua

SEQ ID NO: 4038276 - RNA, 14 nt, Staphylococcus aureus subsp. aureus N315
aucauuucaaauaa

SEQ ID NO: 4038277 - RNA, 15 nt, Staphylococcus aureus subsp. aureus N315
aucauuucaaauaag

SEQ ID NO: 4038278 - RNA, 16 nt, Staphylococcus aureus subsp. aureus N315
aucauuucaaauaaga

SEQ ID NO: 4038279 - RNA, 18 nt, Staphylococcus aureus subsp. aureus N315
aucauuuggcguucaaca

SEQ ID NO: 4038280 - RNA, 22 nt, Staphylococcus aureus subsp. aureus N315
aucauuugugcguuucaaugag

SEQ ID NO: 4038281 - RNA, 21 nt, Staphylococcus aureus subsp. aureus N315
aucauuuguguauaaauguca

SEQ ID NO: 4038282 - RNA, 12 nt, Staphylococcus aureus subsp. aureus N315
aucauuuguguu

SEQ ID NO: 4038283 - RNA, 20 nt, Staphylococcus aureus subsp. aureus N315
aucauuuugccucguccauu

SEQ ID NO: 4038284 - RNA, 18 nt, Staphylococcus aureus subsp. aureus N315
aucauuuuuaauuuugac

SEQ ID NO: 4038285 - RNA, 18 nt, Staphylococcus aureus subsp. aureus N315
auccaaaauccugaaauu

SEQ ID NO: 4038286 - RNA, 11 nt, Staphylococcus aureus subsp. aureus N315
auccaaaccaa

SEQ ID NO: 4038287 - RNA, 21 nt, Staphylococcus aureus subsp. aureus N315
auccaaggauguuauaaaaug

SEQ ID NO: 4038288 - RNA, 23 nt, Staphylococcus aureus subsp. aureus N315
auccaaggauguuauaaaaugaa

SEQ ID NO: 4038289 - RNA, 20 nt, Staphylococcus aureus subsp. aureus N315
auccaagugacaacauuauu

SEQ ID NO: 4038290 - RNA, 14 nt, Staphylococcus aureus subsp. aureus N315
auccaccaaauaca

SEQ ID NO: 4038291 - RNA, 16 nt, Staphylococcus aureus subsp. aureus N315
auccaccaaauacagu

SEQ ID NO: 4038292 - RNA, 15 nt, Staphylococcus aureus subsp. aureus N315
auccacgguuuacca

SEQ ID NO: 4038293 - RNA, 23 nt, Staphylococcus aureus subsp. aureus N315
auccacuuuauaauuuuugagua

SEQ ID NO: 4038294 - RNA, 17 nt, Staphylococcus aureus subsp. aureus N315
auccaguaaucaaagau

SEQ ID NO: 4038295 - RNA, 15 nt, Staphylococcus aureus subsp. aureus N315
auccauaaaaauacg

SEQ ID NO: 4038296 - RNA, 20 nt, Staphylococcus aureus subsp. aureus N315
auccaucaauaccauaauua

SEQ ID NO: 4038297 - RNA, 13 nt, Staphylococcus aureus subsp. aureus N315
auccaucuaauuc

SEQ ID NO: 4038298 - RNA, 21 nt, Staphylococcus aureus subsp. aureus N315
auccaugugguucauuagcau

SEQ ID NO: 4038299 - RNA, 15 nt, Staphylococcus aureus subsp. aureus N315
auccauugaucuuuu

SEQ ID NO: 4038300 - RNA, 15 nt, Staphylococcus aureus subsp. aureus N315
aucccauuaaaccac

SEQ ID NO: 4038301 - RNA, 14 nt, Staphylococcus aureus subsp. aureus N315
auccccauuuaugu

SEQ ID NO: 4038302 - RNA, 23 nt, Staphylococcus aureus subsp. aureus N315
aucccccgccacuaugugaagug

SEQ ID NO: 4038303 - RNA, 12 nt, Staphylococcus aureus subsp. aureus N315
aucccuaaaaaa

SEQ ID NO: 4038304 - RNA, 16 nt, Staphylococcus aureus subsp. aureus N315
aucccucuaucaaauu

SEQ ID NO: 4038305 - RNA, 15 nt, Staphylococcus aureus subsp. aureus N315
aucccuguaaaacca

SEQ ID NO: 4038306 - RNA, 21 nt, Staphylococcus aureus subsp. aureus N315
auccgaauucuccguuaauuu

SEQ ID NO: 4038307 - RNA, 17 nt, Staphylococcus aureus subsp. aureus N315
auccgccaauuaaaauu

SEQ ID NO: 4038308 - RNA, 18 nt, Staphylococcus aureus subsp. aureus N315
auccuaaaaagcucaauc

SEQ ID NO: 4038309 - RNA, 20 nt, Staphylococcus aureus subsp. aureus N315
auccuaaaaagcucaauccu

SEQ ID NO: 4038310 - RNA, 23 nt, Staphylococcus aureus subsp. aureus N315
auccuacgacacguguaaaaaug

SEQ ID NO: 4038311 - RNA, 20 nt, Staphylococcus aureus subsp. aureus N315
auccuauggcgcaauuuuua

SEQ ID NO: 4038312 - RNA, 21 nt, Staphylococcus aureus subsp. aureus N315
auccuauggcgcaauuuuuaa

SEQ ID NO: 4038313 - RNA, 24 nt, Staphylococcus aureus subsp. aureus N315
auccucacaaauuugaauauacuu

SEQ ID NO: 4038314 - RNA, 16 nt, Staphylococcus aureus subsp. aureus N315
auccucauaauuauca

SEQ ID NO: 4038315 - RNA, 17 nt, Staphylococcus aureus subsp. aureus N315
auccucauuaauaaauu

SEQ ID NO: 4038316 - RNA, 23 nt, Staphylococcus aureus subsp. aureus N315
auccucgguauuuaauguuuuag

SEQ ID NO: 4038317 - RNA, 17 nt, Staphylococcus aureus subsp. aureus N315
auccugccaauauauuc

SEQ ID NO: 4038318 - RNA, 19 nt, Staphylococcus aureus subsp. aureus N315
auccugccaauauauucac

SEQ ID NO: 4038319 - RNA, 19 nt, Staphylococcus aureus subsp. aureus N315
auccugcuuauuaauuguu

SEQ ID NO: 4038320 - RNA, 20 nt, Staphylococcus aureus subsp. aureus N315
auccuuaccuuuuaaaccug

SEQ ID NO: 4038321 - RNA, 21 nt, Staphylococcus aureus subsp. aureus N315
auccuuuaaugcuuuagcauu

SEQ ID NO: 4038322 - RNA, 14 nt, Staphylococcus aureus subsp. aureus N315
auccuuuuugacuc

SEQ ID NO: 4038323 - RNA, 16 nt, Staphylococcus aureus subsp. aureus N315
aucucggcauuuuuau

SEQ ID NO: 4038324 - RNA, 16 nt, Staphylococcus aureus subsp. aureus N315
aucucguuuuuacaug

SEQ ID NO: 4038325 - RNA, 22 nt, Staphylococcus aureus subsp. aureus N315
aucucuaccuugaucuaaaaua

SEQ ID NO: 4038326 - RNA, 14 nt, Staphylococcus aureus subsp. aureus N315
aucucuauuuuuua

SEQ ID NO: 4038327 - RNA, 17 nt, Staphylococcus aureus subsp. aureus N315
aucucugcuuuaauaua

SEQ ID NO: 4038328 - RNA, 18 nt, Staphylococcus aureus subsp. aureus N315
aucucugcuuuaauauaa

SEQ ID NO: 4038329 - RNA, 13 nt, Staphylococcus aureus subsp. aureus N315
aucucuguauuga

SEQ ID NO: 4038330 - RNA, 13 nt, Staphylococcus aureus subsp. aureus N315
aucucuuauaagu

SEQ ID NO: 4038331 - RNA, 16 nt, Staphylococcus aureus subsp. aureus N315
aucucuuuucuauuca

SEQ ID NO: 4038332 - RNA, 19 nt, Staphylococcus aureus subsp. aureus N315
aucugaaaauaucacugaa

SEQ ID NO: 4038333 - RNA, 18 nt, Staphylococcus aureus subsp. aureus N315
aucugaagguaauuuaac

SEQ ID NO: 4038334 - RNA, 17 nt, Staphylococcus aureus subsp. aureus N315
aucugaaucaguuacug

SEQ ID NO: 4038335 - RNA, 15 nt, Staphylococcus aureus subsp. aureus N315
aucugacauuguugc

SEQ ID NO: 4038336 - RNA, 14 nt, Staphylococcus aureus subsp. aureus N315
aucugacauuuaaa

SEQ ID NO: 4038337 - RNA, 18 nt, Staphylococcus aureus subsp. aureus N315
aucugacauuucaucaau

SEQ ID NO: 4038338 - RNA, 13 nt, Staphylococcus aureus subsp. aureus N315
aucugauuucacu

SEQ ID NO: 4038339 - RNA, 17 nt, Staphylococcus aureus subsp. aureus N315
aucugcaacgauuuuaa

SEQ ID NO: 4038340 - RNA, 17 nt, Staphylococcus aureus subsp. aureus N315
aucugcaugguuugcug

SEQ ID NO: 4038341 - RNA, 13 nt, Staphylococcus aureus subsp. aureus N315
aucugcauuuaau

SEQ ID NO: 4038342 - RNA, 23 nt, Staphylococcus aureus subsp. aureus N315
aucugcuuuauuuuaucaucuau

SEQ ID NO: 4038343 - RNA, 22 nt, Staphylococcus aureus subsp. aureus N315
aucuguaacaaagucucuagua

SEQ ID NO: 4038344 - RNA, 14 nt, Staphylococcus aureus subsp. aureus N315
aucuguaacauaaa

SEQ ID NO: 4038345 - RNA, 19 nt, Staphylococcus aureus subsp. aureus N315
aucuguaccguauuuuaau

SEQ ID NO: 4038346 - RNA, 22 nt, Staphylococcus aureus subsp. aureus N315
aucuguagauuagcuuaaguaa

SEQ ID NO: 4038347 - RNA, 16 nt, Staphylococcus aureus subsp. aureus N315
aucuguugucaucaug

SEQ ID NO: 4038348 - RNA, 17 nt, Staphylococcus aureus subsp. aureus N315
aucuguuucuauuauua

SEQ ID NO: 4038349 - RNA, 14 nt, Staphylococcus aureus subsp. aureus N315
aucuguuucuuguu

SEQ ID NO: 4038350 - RNA, 21 nt, Staphylococcus aureus subsp. aureus N315
aucuguuuuagguuuguugcu

SEQ ID NO: 4038351 - RNA, 20 nt, Staphylococcus aureus subsp. aureus N315
aucuuaaagauuuuucagcu

SEQ ID NO: 4038352 - RNA, 14 nt, Staphylococcus aureus subsp. aureus N315
aucuuaagucauca

SEQ ID NO: 4038353 - RNA, 19 nt, Staphylococcus aureus subsp. aureus N315
aucuuaaucagcuauaaaa

SEQ ID NO: 4038354 - RNA, 19 nt, Staphylococcus aureus subsp. aureus N315
aucuuacauugauaaaaua

SEQ ID NO: 4038355 - RNA, 16 nt, Staphylococcus aureus subsp. aureus N315
aucuuaccuuuauguu

SEQ ID NO: 4038356 - RNA, 20 nt, Staphylococcus aureus subsp. aureus N315
aucuuacugcugcuuuuaau

SEQ ID NO: 4038357 - RNA, 19 nt, Staphylococcus aureus subsp. aureus N315
aucuuagacgcuguuuuaa

SEQ ID NO: 4038358 - RNA, 20 nt, Staphylococcus aureus subsp. aureus N315
aucuuauaacaaaaauugcu

SEQ ID NO: 4038359 - RNA, 13 nt, Staphylococcus aureus subsp. aureus N315
aucuuaucaagaa

SEQ ID NO: 4038360 - RNA, 18 nt, Staphylococcus aureus subsp. aureus N315
aucuuaugacugcuuuuu

SEQ ID NO: 4038361 - RNA, 23 nt, Staphylococcus aureus subsp. aureus N315
aucuucaacauaacucaaauauc

SEQ ID NO: 4038362 - RNA, 17 nt, Staphylococcus aureus subsp. aureus N315
aucuucaacuucgauau

SEQ ID NO: 4038363 - RNA, 22 nt, Staphylococcus aureus subsp. aureus N315
aucuucaacuucgauaugauua

SEQ ID NO: 4038364 - RNA, 16 nt, Staphylococcus aureus subsp. aureus N315
aucuucaauauuuaaa

SEQ ID NO: 4038365 - RNA, 14 nt, Staphylococcus aureus subsp. aureus N315
aucuucaguauaga

SEQ ID NO: 4038366 - RNA, 14 nt, Staphylococcus aureus subsp. aureus N315
aucuucaugaacag

SEQ ID NO: 4038367 - RNA, 16 nt, Staphylococcus aureus subsp. aureus N315
aucuucgacuacaagu

SEQ ID NO: 4038368 - RNA, 23 nt, Staphylococcus aureus subsp. aureus N315
aucuucgacuacaaguuuauaau

SEQ ID NO: 4038369 - RNA, 22 nt, Staphylococcus aureus subsp. aureus N315
aucuucguauaguacuaaaagu

SEQ ID NO: 4038370 - RNA, 23 nt, Staphylococcus aureus subsp. aureus N315
aucuucguauaguacuaaaagua

SEQ ID NO: 4038371 - RNA, 14 nt, Staphylococcus aureus subsp. aureus N315
aucuucuaauucca

SEQ ID NO: 4038372 - RNA, 23 nt, Staphylococcus aureus subsp. aureus N315
aucuucuaauucguuuugcuaac

SEQ ID NO: 4038373 - RNA, 19 nt, Staphylococcus aureus subsp. aureus N315
aucuucuaguaauucuuca

SEQ ID NO: 4038374 - RNA, 14 nt, Staphylococcus aureus subsp. aureus N315
aucuucucauaaaa

SEQ ID NO: 4038375 - RNA, 13 nt, Staphylococcus aureus subsp. aureus N315
aucuucuguuuau

SEQ ID NO: 4038376 - RNA, 16 nt, Staphylococcus aureus subsp. aureus N315
aucuucuguuuauaua

SEQ ID NO: 4038377 - RNA, 21 nt, Staphylococcus aureus subsp. aureus N315
aucuucuuuuaauauuugaua

SEQ ID NO: 4038378 - RNA, 16 nt, Staphylococcus aureus subsp. aureus N315
aucuugauuauauuuu

SEQ ID NO: 4038379 - RNA, 19 nt, Staphylococcus aureus subsp. aureus N315
aucuugauuauauuuuucu

SEQ ID NO: 4038380 - RNA, 16 nt, Staphylococcus aureus subsp. aureus N315
aucuugauuuaaacca

SEQ ID NO: 4038381 - RNA, 16 nt, Staphylococcus aureus subsp. aureus N315
aucuugcuuggauaau

SEQ ID NO: 4038382 - RNA, 21 nt, Staphylococcus aureus subsp. aureus N315
aucuugcuuggauaauugcau

SEQ ID NO: 4038383 - RNA, 23 nt, Staphylococcus aureus subsp. aureus N315
aucuugucuaguucgauuuuuua

SEQ ID NO: 4038384 - RNA, 20 nt, Staphylococcus aureus subsp. aureus N315
aucuuguuggauuuuaacaa

SEQ ID NO: 4038385 - RNA, 12 nt, Staphylococcus aureus subsp. aureus N315
aucuuuaacucu

SEQ ID NO: 4038386 - RNA, 22 nt, Staphylococcus aureus subsp. aureus N315
aucuuuaacuucugauucuuca

SEQ ID NO: 4038387 - RNA, 24 nt, Staphylococcus aureus subsp. aureus N315
aucuuuaaucaaaggaucauguuc

SEQ ID NO: 4038388 - RNA, 20 nt, Staphylococcus aureus subsp. aureus N315
aucuuuacgauaaacuaaaa

SEQ ID NO: 4038389 - RNA, 21 nt, Staphylococcus aureus subsp. aureus N315
aucuuuagagacuuauuuuau

SEQ ID NO: 4038390 - RNA, 22 nt, Staphylococcus aureus subsp. aureus N315
aucuuuagagacuuauuuuaua

SEQ ID NO: 4038391 - RNA, 19 nt, Staphylococcus aureus subsp. aureus N315
aucuuuaguauuucaucau

SEQ ID NO: 4038392 - RNA, 19 nt, Staphylococcus aureus subsp. aureus N315
aucuuuaucaguuuguccu

SEQ ID NO: 4038393 - RNA, 19 nt, Staphylococcus aureus subsp. aureus N315
aucuuuauuugauucuuca

SEQ ID NO: 4038394 - RNA, 20 nt, Staphylococcus aureus subsp. aureus N315
aucuuucaacgcauauucua

SEQ ID NO: 4038395 - RNA, 17 nt, Staphylococcus aureus subsp. aureus N315
aucuuucacaauuguau

SEQ ID NO: 4038396 - RNA, 22 nt, Staphylococcus aureus subsp. aureus N315
aucuuucacaauuguauaaugu

SEQ ID NO: 4038397 - RNA, 18 nt, Staphylococcus aureus subsp. aureus N315
aucuuuccacggcauuua

SEQ ID NO: 4038398 - RNA, 15 nt, Staphylococcus aureus subsp. aureus N315
aucuuucuuuguguu

SEQ ID NO: 4038399 - RNA, 17 nt, Staphylococcus aureus subsp. aureus N315
aucuuuguaaauuuuua

SEQ ID NO: 4038400 - RNA, 20 nt, Staphylococcus aureus subsp. aureus N315
aucuuuguaaccuaaaaaca

SEQ ID NO: 4038401 - RNA, 22 nt, Staphylococcus aureus subsp. aureus N315
aucuuuguaaccuaaaaacaaa

SEQ ID NO: 4038402 - RNA, 19 nt, Staphylococcus aureus subsp. aureus N315
aucuuuguuauauuuuuag

SEQ ID NO: 4038403 - RNA, 14 nt, Staphylococcus aureus subsp. aureus N315
aucuuuuaaauuua

SEQ ID NO: 4038404 - RNA, 11 nt, Staphylococcus aureus subsp. aureus N315
aucuuuuacua

SEQ ID NO: 4038405 - RNA, 12 nt, Staphylococcus aureus subsp. aureus N315
aucuuuuagcuu

SEQ ID NO: 4038406 - RNA, 13 nt, Staphylococcus aureus subsp. aureus N315
aucuuuuauccaa

SEQ ID NO: 4038407 - RNA, 11 nt, Staphylococcus aureus subsp. aureus N315
aucuuuuaugg

SEQ ID NO: 4038408 - RNA, 20 nt, Staphylococcus aureus subsp. aureus N315
aucuuuuccaaaacaaaaau

SEQ ID NO: 4038409 - RNA, 19 nt, Staphylococcus aureus subsp. aureus N315
aucuuuuccauucauaaaa

SEQ ID NO: 4038410 - RNA, 16 nt, Staphylococcus aureus subsp. aureus N315
augauaauaagaauau

SEQ ID NO: 4038411 - RNA, 22 nt, Staphylococcus aureus subsp. aureus N315
augauaauccaccaaauacagu

SEQ ID NO: 4038412 - RNA, 18 nt, Staphylococcus aureus subsp. aureus N315
augauaauuaauuaaaau

SEQ ID NO: 4038413 - RNA, 22 nt, Staphylococcus aureus subsp. aureus N315
augauaauuuaauaacguacau

SEQ ID NO: 4038414 - RNA, 12 nt, Staphylococcus aureus subsp. aureus N315
augauacauuau

SEQ ID NO: 4038415 - RNA, 20 nt, Staphylococcus aureus subsp. aureus N315
augauacauuauuaaauaga

SEQ ID NO: 4038416 - RNA, 18 nt, Staphylococcus aureus subsp. aureus N315
augauacgcuuuuuaaaa

SEQ ID NO: 4038417 - RNA, 21 nt, Staphylococcus aureus subsp. aureus N315
augauacgcuuuuuaaaaaau

SEQ ID NO: 4038418 - RNA, 22 nt, Staphylococcus aureus subsp. aureus N315
augauacgcuuuuuaaaaaauu

SEQ ID NO: 4038419 - RNA, 17 nt, Staphylococcus aureus subsp. aureus N315
augauacucaauaaaau

SEQ ID NO: 4038420 - RNA, 18 nt, Staphylococcus aureus subsp. aureus N315
augauacucaauaaaauu

SEQ ID NO: 4038421 - RNA, 16 nt, Staphylococcus aureus subsp. aureus N315
augauagaauacuaaa

SEQ ID NO: 4038422 - RNA, 15 nt, Staphylococcus aureus subsp. aureus N315
augauagauuuagga

SEQ ID NO: 4038423 - RNA, 16 nt, Staphylococcus aureus subsp. aureus N315
augauagccgcuucau

SEQ ID NO: 4038424 - RNA, 22 nt, Staphylococcus aureus subsp. aureus N315
augauaguguaugaauggcaau

SEQ ID NO: 4038425 - RNA, 21 nt, Staphylococcus aureus subsp. aureus N315
augauauacuugaagaaaagu

SEQ ID NO: 4038426 - RNA, 17 nt, Staphylococcus aureus subsp. aureus N315
augauaucuuuuccaaa

SEQ ID NO: 4038427 - RNA, 16 nt, Staphylococcus aureus subsp. aureus N315
augauauuacauauaa

SEQ ID NO: 4038428 - RNA, 18 nt, Staphylococcus aureus subsp. aureus N315
augauauuaccuucaagu

SEQ ID NO: 4038429 - RNA, 20 nt, Staphylococcus aureus subsp. aureus N315
augauauuaggcuuaaauau

SEQ ID NO: 4038430 - RNA, 16 nt, Staphylococcus aureus subsp. aureus N315
augauauugaaagugu

SEQ ID NO: 4038431 - RNA, 20 nt, Staphylococcus aureus subsp. aureus N315
augauauugauuugauucau

SEQ ID NO: 4038432 - RNA, 17 nt, Staphylococcus aureus subsp. aureus N315
augauauuuaacaaaau

SEQ ID NO: 4038433 - RNA, 22 nt, Staphylococcus aureus subsp. aureus N315
augaucuuuguagccuucaacu

SEQ ID NO: 4038434 - RNA, 17 nt, Staphylococcus aureus subsp. aureus N315
augaugaacuuaaugcu

SEQ ID NO: 4038435 - RNA, 23 nt, Staphylococcus aureus subsp. aureus N315
augaugaauuguuguacauguau

SEQ ID NO: 4038436 - RNA, 15 nt, Staphylococcus aureus subsp. aureus N315
augaugagauaaaau

SEQ ID NO: 4038437 - RNA, 20 nt, Staphylococcus aureus subsp. aureus N315
augaugauaaaaauaaaacc

SEQ ID NO: 4038438 - RNA, 14 nt, Staphylococcus aureus subsp. aureus N315
augaugauuuaagu

SEQ ID NO: 4038439 - RNA, 11 nt, Staphylococcus aureus subsp. aureus N315
augaugcacua

SEQ ID NO: 4038440 - RNA, 16 nt, Staphylococcus aureus subsp. aureus N315
augaugcgaaaccuuu

SEQ ID NO: 4038441 - RNA, 20 nt, Staphylococcus aureus subsp. aureus N315
augaugggaaaucaguaaua

SEQ ID NO: 4038442 - RNA, 22 nt, Staphylococcus aureus subsp. aureus N315
augauggguauuuuguucaguu

SEQ ID NO: 4038443 - RNA, 21 nt, Staphylococcus aureus subsp. aureus N315
augauguuaaaaaauauguau

SEQ ID NO: 4038444 - RNA, 21 nt, Staphylococcus aureus subsp. aureus N315
augauuaaaguguuucaacau

SEQ ID NO: 4038445 - RNA, 14 nt, Staphylococcus aureus subsp. aureus N315
augauuaaauaauc

SEQ ID NO: 4038446 - RNA, 17 nt, Staphylococcus aureus subsp. aureus N315
augauuaacuuucuaau

SEQ ID NO: 4038447 - RNA, 18 nt, Staphylococcus aureus subsp. aureus N315
augauuacaacuuauucu

SEQ ID NO: 4038448 - RNA, 23 nt, Staphylococcus aureus subsp. aureus N315
augauuacguugguuuaaaaauu

SEQ ID NO: 4038449 - RNA, 19 nt, Staphylococcus aureus subsp. aureus N315
augauuacuccaauuacca

SEQ ID NO: 4038450 - RNA, 23 nt, Staphylococcus aureus subsp. aureus N315
augauuagcgcaccaauuaucaa

SEQ ID NO: 4038451 - RNA, 13 nt, Staphylococcus aureus subsp. aureus N315
augauuauauuuu

SEQ ID NO: 4038452 - RNA, 17 nt, Staphylococcus aureus subsp. aureus N315
augauuauauuuucuca

SEQ ID NO: 4038453 - RNA, 20 nt, Staphylococcus aureus subsp. aureus N315
augauuauguuaaugucuua

SEQ ID NO: 4038454 - RNA, 18 nt, Staphylococcus aureus subsp. aureus N315
augauuauucucuuuauu

SEQ ID NO: 4038455 - RNA, 14 nt, Staphylococcus aureus subsp. aureus N315
augauucguauuca

SEQ ID NO: 4038456 - RNA, 16 nt, Staphylococcus aureus subsp. aureus N315
augauucguauucaaa

SEQ ID NO: 4038457 - RNA, 17 nt, Staphylococcus aureus subsp. aureus N315
augauucuacagcacug

SEQ ID NO: 4038458 - RNA, 20 nt, Staphylococcus aureus subsp. aureus N315
augauuggcuugaaguuguu

SEQ ID NO: 4038459 - RNA, 21 nt, Staphylococcus aureus subsp. aureus N315
augauugguauacaguuuuac

SEQ ID NO: 4038460 - RNA, 18 nt, Staphylococcus aureus subsp. aureus N315
augauuuaaguuuauaau

SEQ ID NO: 4038461 - RNA, 14 nt, Staphylococcus aureus subsp. aureus N315
augauuuauaaaaa

SEQ ID NO: 4038462 - RNA, 15 nt, Staphylococcus aureus subsp. aureus N315
augauuuauaaaaaa

SEQ ID NO: 4038463 - RNA, 15 nt, Staphylococcus aureus subsp. aureus N315
augauuuauaaaaac

SEQ ID NO: 4038464 - RNA, 16 nt, Staphylococcus aureus subsp. aureus N315
augauuuauaaaaacu

SEQ ID NO: 4038465 - RNA, 17 nt, Staphylococcus aureus subsp. aureus N315
augauuuauuaacucau

SEQ ID NO: 4038466 - RNA, 23 nt, Staphylococcus aureus subsp. aureus N315
augauuugauuuggguaauguuu

SEQ ID NO: 4038467 - RNA, 22 nt, Staphylococcus aureus subsp. aureus N315
augauuuuuauuauugucauca

SEQ ID NO: 4038468 - RNA, 13 nt, Staphylococcus aureus subsp. aureus N315
augcaaacucauu

SEQ ID NO: 4038469 - RNA, 21 nt, Staphylococcus aureus subsp. aureus N315
augcaaaucaaauacaucaau

SEQ ID NO: 4038470 - RNA, 22 nt, Staphylococcus aureus subsp. aureus N315
augcaaaucucgucacauauaa

SEQ ID NO: 4038471 - RNA, 19 nt, Staphylococcus aureus subsp. aureus N315
augcaagcgacgauuggaa

SEQ ID NO: 4038472 - RNA, 12 nt, Staphylococcus aureus subsp. aureus N315
augcacaauauu

SEQ ID NO: 4038473 - RNA, 19 nt, Staphylococcus aureus subsp. aureus N315
augcacaauauucguagca

SEQ ID NO: 4038474 - RNA, 22 nt, Staphylococcus aureus subsp. aureus N315
augcacaccagccucuauaagu

SEQ ID NO: 4038475 - RNA, 20 nt, Staphylococcus aureus subsp. aureus N315
augcacaucauugauagaua

SEQ ID NO: 4038476 - RNA, 17 nt, Staphylococcus aureus subsp. aureus N315
augcaccuuuacaacau

SEQ ID NO: 4038477 - RNA, 21 nt, Staphylococcus aureus subsp. aureus N315
augcaccuuuacaacauacau

SEQ ID NO: 4038478 - RNA, 14 nt, Staphylococcus aureus subsp. aureus N315
augcacuccuauug

SEQ ID NO: 4038479 - RNA, 20 nt, Staphylococcus aureus subsp. aureus N315
augcaguaaaaccaaaucgu

SEQ ID NO: 4038480 - RNA, 13 nt, Staphylococcus aureus subsp. aureus N315
augcauaaaaaaa

SEQ ID NO: 4038481 - RNA, 21 nt, Staphylococcus aureus subsp. aureus N315
augcauacacuugauuaucau

SEQ ID NO: 4038482 - RNA, 13 nt, Staphylococcus aureus subsp. aureus N315
augcauauauaua

SEQ ID NO: 4038483 - RNA, 21 nt, Staphylococcus aureus subsp. aureus N315
augcaucaacagauacuucag

SEQ ID NO: 4038484 - RNA, 22 nt, Staphylococcus aureus subsp. aureus N315
augcauccaaauauuaaaaaca

SEQ ID NO: 4038485 - RNA, 16 nt, Staphylococcus aureus subsp. aureus N315
augcaugcgcaaaagc

SEQ ID NO: 4038486 - RNA, 17 nt, Staphylococcus aureus subsp. aureus N315
augcaugcgcaaaagcg

SEQ ID NO: 4038487 - RNA, 21 nt, Staphylococcus aureus subsp. aureus N315
augcaugcgcaaaagcgcagg

SEQ ID NO: 4038488 - RNA, 24 nt, Staphylococcus aureus subsp. aureus N315
augcaugcgcaaaagcgcaggcga

SEQ ID NO: 4038489 - RNA, 13 nt, Staphylococcus aureus subsp. aureus N315
augcauucaauau

SEQ ID NO: 4038490 - RNA, 12 nt, Staphylococcus aureus subsp. aureus N315
augccaaauaac

SEQ ID NO: 4038491 - RNA, 23 nt, Staphylococcus aureus subsp. aureus N315
augccaaauaacguuaauauaau

SEQ ID NO: 4038492 - RNA, 14 nt, Staphylococcus aureus subsp. aureus N315
augccaacacguuu

SEQ ID NO: 4038493 - RNA, 18 nt, Staphylococcus aureus subsp. aureus N315
augccagaugcaaugaua

SEQ ID NO: 4038494 - RNA, 17 nt, Staphylococcus aureus subsp. aureus N315
augccauaccugcaccu

SEQ ID NO: 4038495 - RNA, 21 nt, Staphylococcus aureus subsp. aureus N315
augccaucuuuguaaccuaaa

SEQ ID NO: 4038496 - RNA, 16 nt, Staphylococcus aureus subsp. aureus N315
augccauuguuaucca

SEQ ID NO: 4038497 - RNA, 16 nt, Staphylococcus aureus subsp. aureus N315
auguaaauaaaaauua

SEQ ID NO: 4038498 - RNA, 18 nt, Staphylococcus aureus subsp. aureus N315
auguaaauaaaaauuaua

SEQ ID NO: 4038499 - RNA, 17 nt, Staphylococcus aureus subsp. aureus N315
auguaaauaguuaguuu

SEQ ID NO: 4038500 - RNA, 22 nt, Staphylococcus aureus subsp. aureus N315
auguaaaucgugcuguuaucau

SEQ ID NO: 4038501 - RNA, 22 nt, Staphylococcus aureus subsp. aureus N315
auguaacauaaagcuguuuauu

SEQ ID NO: 4038502 - RNA, 18 nt, Staphylococcus aureus subsp. aureus N315
auguaacguuucuuugua

SEQ ID NO: 4038503 - RNA, 17 nt, Staphylococcus aureus subsp. aureus N315
auguaacuuuagacaua

SEQ ID NO: 4038504 - RNA, 15 nt, Staphylococcus aureus subsp. aureus N315
auguaauagagaagg

SEQ ID NO: 4038505 - RNA, 18 nt, Staphylococcus aureus subsp. aureus N315
auguaauagagaagggag

SEQ ID NO: 4038506 - RNA, 13 nt, Staphylococcus aureus subsp. aureus N315
auguaauuauuuu

SEQ ID NO: 4038507 - RNA, 16 nt, Staphylococcus aureus subsp. aureus N315
auguaauuauuuuucu

SEQ ID NO: 4038508 - RNA, 21 nt, Staphylococcus aureus subsp. aureus N315
auguacaaccuuugcuuaaac

SEQ ID NO: 4038509 - RNA, 18 nt, Staphylococcus aureus subsp. aureus N315
auguacaauuuuuaaaaa

SEQ ID NO: 4038510 - RNA, 14 nt, Staphylococcus aureus subsp. aureus N315
auguacaauuuuuu

SEQ ID NO: 4038511 - RNA, 20 nt, Staphylococcus aureus subsp. aureus N315
auguacacgagucauuaaau

SEQ ID NO: 4038512 - RNA, 17 nt, Staphylococcus aureus subsp. aureus N315
auguacauguauaaaag

SEQ ID NO: 4038513 - RNA, 18 nt, Staphylococcus aureus subsp. aureus N315
auguacauuguaaauaua

SEQ ID NO: 4038514 - RNA, 22 nt, Staphylococcus aureus subsp. aureus N315
auguaccacucauaaucaaguc

SEQ ID NO: 4038515 - RNA, 15 nt, Staphylococcus aureus subsp. aureus N315
auguaccgaauccuu

SEQ ID NO: 4038516 - RNA, 22 nt, Staphylococcus aureus subsp. aureus N315
auguaccgaauccuucaucaau

SEQ ID NO: 4038517 - RNA, 23 nt, Staphylococcus aureus subsp. aureus N315
auguacguuuuuuuaaauacaua

SEQ ID NO: 4038518 - RNA, 22 nt, Staphylococcus aureus subsp. aureus N315
auguagaauuucuuuucgaaaa

SEQ ID NO: 4038519 - RNA, 13 nt, Staphylococcus aureus subsp. aureus N315
auguagcuuugug

SEQ ID NO: 4038520 - RNA, 21 nt, Staphylococcus aureus subsp. aureus N315
auguaggcuuuuuuauuaugu

SEQ ID NO: 4038521 - RNA, 19 nt, Staphylococcus aureus subsp. aureus N315
auguauaaaacagaauuuc

SEQ ID NO: 4038522 - RNA, 21 nt, Staphylococcus aureus subsp. aureus N315
auguauaugaauuuuauaaau

SEQ ID NO: 4038523 - RNA, 22 nt, Staphylococcus aureus subsp. aureus N315
auguauaugaauuuuauaaauu

SEQ ID NO: 4038524 - RNA, 18 nt, Staphylococcus aureus subsp. aureus N315
auguauauggcaucauca

SEQ ID NO: 4038525 - RNA, 16 nt, Staphylococcus aureus subsp. aureus N315
auguaugagucaaauu

SEQ ID NO: 4038526 - RNA, 13 nt, Staphylococcus aureus subsp. aureus N315
auguaugcuugua

SEQ ID NO: 4038527 - RNA, 21 nt, Staphylococcus aureus subsp. aureus N315
auguaugcuuguacaaaaaau

SEQ ID NO: 4038528 - RNA, 22 nt, Staphylococcus aureus subsp. aureus N315
auguauguuuuaucaauauuag

SEQ ID NO: 4038529 - RNA, 14 nt, Staphylococcus aureus subsp. aureus N315
auguauugcuauaa

SEQ ID NO: 4038530 - RNA, 19 nt, Staphylococcus aureus subsp. aureus N315
auguauuuaguaucaugau

SEQ ID NO: 4038531 - RNA, 17 nt, Staphylococcus aureus subsp. aureus N315
auguauuuuuauuuaua

SEQ ID NO: 4038532 - RNA, 24 nt, Staphylococcus aureus subsp. aureus N315
augucaaaucggcuauacauugau

SEQ ID NO: 4038533 - RNA, 19 nt, Staphylococcus aureus subsp. aureus N315
augucaauuuuuucaugau

SEQ ID NO: 4038534 - RNA, 18 nt, Staphylococcus aureus subsp. aureus N315
augucacugcaaacacag

SEQ ID NO: 4038535 - RNA, 23 nt, Staphylococcus aureus subsp. aureus N315
augucacugcaaacacaguacaa

SEQ ID NO: 4038536 - RNA, 21 nt, Staphylococcus aureus subsp. aureus N315
augucagucguuguaaaacua

SEQ ID NO: 4038537 - RNA, 18 nt, Staphylococcus aureus subsp. aureus N315
augucaguuuugaagaau

SEQ ID NO: 4038538 - RNA, 21 nt, Staphylococcus aureus subsp. aureus N315
augucauagccuauuuaaaag

SEQ ID NO: 4038539 - RNA, 17 nt, Staphylococcus aureus subsp. aureus N315
augucauguauugucca

SEQ ID NO: 4038540 - RNA, 18 nt, Staphylococcus aureus subsp. aureus N315
augucccagauucauauc

SEQ ID NO: 4038541 - RNA, 15 nt, Staphylococcus aureus subsp. aureus N315
auguccugaauguuc

SEQ ID NO: 4038542 - RNA, 17 nt, Staphylococcus aureus subsp. aureus N315
augucgaucuaacaauu

SEQ ID NO: 4038543 - RNA, 18 nt, Staphylococcus aureus subsp. aureus N315
augucgcacuauaaaauu

SEQ ID NO: 4038544 - RNA, 14 nt, Staphylococcus aureus subsp. aureus N315
augucuaaaaaugu

SEQ ID NO: 4038545 - RNA, 18 nt, Staphylococcus aureus subsp. aureus N315
augucucucuuucuuauu

SEQ ID NO: 4038546 - RNA, 22 nt, Staphylococcus aureus subsp. aureus N315
augucuuaggcgcuacaauguu

SEQ ID NO: 4038547 - RNA, 15 nt, Staphylococcus aureus subsp. aureus N315
augucuuaucaauua

SEQ ID NO: 4038548 - RNA, 13 nt, Staphylococcus aureus subsp. aureus N315
augucuuucaaau

SEQ ID NO: 4038549 - RNA, 19 nt, Staphylococcus aureus subsp. aureus N315
augugaacaucuaguuauu

SEQ ID NO: 4038550 - RNA, 12 nt, Staphylococcus aureus subsp. aureus N315
augugaugauua

SEQ ID NO: 4038551 - RNA, 17 nt, Staphylococcus aureus subsp. aureus N315
augugaugcuugaaugu

SEQ ID NO: 4038552 - RNA, 19 nt, Staphylococcus aureus subsp. aureus N315
augugaugcuugaauguuu

SEQ ID NO: 4038553 - RNA, 20 nt, Staphylococcus aureus subsp. aureus N315
augugaugcuugaauguuug

SEQ ID NO: 4038554 - RNA, 20 nt, Staphylococcus aureus subsp. aureus N315
augugauuuucuuucauaaa

SEQ ID NO: 4038555 - RNA, 20 nt, Staphylococcus aureus subsp. aureus N315
augugcaagugguaaaaaug

SEQ ID NO: 4038556 - RNA, 16 nt, Staphylococcus aureus subsp. aureus N315
augugcuaaucuauuu

SEQ ID NO: 4038557 - RNA, 14 nt, Staphylococcus aureus subsp. aureus N315
augugcuuuaucaa

SEQ ID NO: 4038558 - RNA, 17 nt, Staphylococcus aureus subsp. aureus N315
auguggaacaugauuca

SEQ ID NO: 4038559 - RNA, 17 nt, Staphylococcus aureus subsp. aureus N315
auguggguguaccaauu

SEQ ID NO: 4038560 - RNA, 17 nt, Staphylococcus aureus subsp. aureus N315
auguguaugauagaaua

SEQ ID NO: 4038561 - RNA, 22 nt, Staphylococcus aureus subsp. aureus N315
augugucaaauaggcauaauga

SEQ ID NO: 4038562 - RNA, 20 nt, Staphylococcus aureus subsp. aureus N315
augugucauaauccauucuu

SEQ ID NO: 4038563 - RNA, 22 nt, Staphylococcus aureus subsp. aureus N315
augugucauaauccauucuucu

SEQ ID NO: 4038564 - RNA, 18 nt, Staphylococcus aureus subsp. aureus N315
auguguuaaaauauauuu

SEQ ID NO: 4038565 - RNA, 15 nt, Staphylococcus aureus subsp. aureus N315
auguguuaaaccaac

SEQ ID NO: 4038566 - RNA, 24 nt, Staphylococcus aureus subsp. aureus N315
auguguuaaucaacguauauaagu

SEQ ID NO: 4038567 - RNA, 22 nt, Staphylococcus aureus subsp. aureus N315
auguguugcauuacuaucuuca

SEQ ID NO: 4038568 - RNA, 14 nt, Staphylococcus aureus subsp. aureus N315
auguguugugauau

SEQ ID NO: 4038569 - RNA, 16 nt, Staphylococcus aureus subsp. aureus N315
auguguugugauauau

SEQ ID NO: 4038570 - RNA, 17 nt, Staphylococcus aureus subsp. aureus N315
auguguugugauuauaa

SEQ ID NO: 4038571 - RNA, 18 nt, Staphylococcus aureus subsp. aureus N315
auguguuucuagcuuguu

SEQ ID NO: 4038572 - RNA, 21 nt, Staphylococcus aureus subsp. aureus N315
auguguuuucaacaguuuuaa

SEQ ID NO: 4038573 - RNA, 17 nt, Staphylococcus aureus subsp. aureus N315
auguuaaagauuauuau

SEQ ID NO: 4038574 - RNA, 17 nt, Staphylococcus aureus subsp. aureus N315
auguuaacugcaaacuu

SEQ ID NO: 4038575 - RNA, 19 nt, Staphylococcus aureus subsp. aureus N315
auguuacacaaauuaaaac

SEQ ID NO: 4038576 - RNA, 14 nt, Staphylococcus aureus subsp. aureus N315
auguuacugaugaa

SEQ ID NO: 4038577 - RNA, 21 nt, Staphylococcus aureus subsp. aureus N315
auguuagaugacuuugucaua

SEQ ID NO: 4038578 - RNA, 21 nt, Staphylococcus aureus subsp. aureus N315
auguuauauuaaacuuauaac

SEQ ID NO: 4038579 - RNA, 12 nt, Staphylococcus aureus subsp. aureus N315
auguuaucaaua

SEQ ID NO: 4038580 - RNA, 15 nt, Staphylococcus aureus subsp. aureus N315
auguuauuagauacu

SEQ ID NO: 4038581 - RNA, 15 nt, Staphylococcus aureus subsp. aureus N315
auguucaauauuuuc

SEQ ID NO: 4038582 - RNA, 16 nt, Staphylococcus aureus subsp. aureus N315
auguucagaacuacaa

SEQ ID NO: 4038583 - RNA, 17 nt, Staphylococcus aureus subsp. aureus N315
auguucagguucaaaau

SEQ ID NO: 4038584 - RNA, 20 nt, Staphylococcus aureus subsp. aureus N315
auuaauaagugcuguuacuu

SEQ ID NO: 4038585 - RNA, 16 nt, Staphylococcus aureus subsp. aureus N315
auuaauagagaaagaa

SEQ ID NO: 4038586 - RNA, 21 nt, Staphylococcus aureus subsp. aureus N315
auuaauagagaaagaauaaau

SEQ ID NO: 4038587 - RNA, 16 nt, Staphylococcus aureus subsp. aureus N315
auuaauagguuauuug

SEQ ID NO: 4038588 - RNA, 12 nt, Staphylococcus aureus subsp. aureus N315
auuaauaguaaa

SEQ ID NO: 4038589 - RNA, 17 nt, Staphylococcus aureus subsp. aureus N315
auuaauaguacagucau

SEQ ID NO: 4038590 - RNA, 17 nt, Staphylococcus aureus subsp. aureus N315
auuaauauaaauaucaa

SEQ ID NO: 4038591 - RNA, 20 nt, Staphylococcus aureus subsp. aureus N315
auuaauauaaauaucaauug

SEQ ID NO: 4038592 - RNA, 15 nt, Staphylococcus aureus subsp. aureus N315
auuaauauuagugac

SEQ ID NO: 4038593 - RNA, 15 nt, Staphylococcus aureus subsp. aureus N315
auuaaucccuucaaa

SEQ ID NO: 4038594 - RNA, 14 nt, Staphylococcus aureus subsp. aureus N315
auuaaucguauuuu

SEQ ID NO: 4038595 - RNA, 17 nt, Staphylococcus aureus subsp. aureus N315
auuaaucguauuuuuaa

SEQ ID NO: 4038596 - RNA, 16 nt, Staphylococcus aureus subsp. aureus N315
auuaaugaaauaccua

SEQ ID NO: 4038597 - RNA, 15 nt, Staphylococcus aureus subsp. aureus N315
auuaaugguauugau

SEQ ID NO: 4038598 - RNA, 14 nt, Staphylococcus aureus subsp. aureus N315
auuaauguaaugau

SEQ ID NO: 4038599 - RNA, 13 nt, Staphylococcus aureus subsp. aureus N315
auuaauguuugau

SEQ ID NO: 4038600 - RNA, 19 nt, Staphylococcus aureus subsp. aureus N315
auuaauuaaaauucucuuu

SEQ ID NO: 4038601 - RNA, 21 nt, Staphylococcus aureus subsp. aureus N315
auuaauuacuguaaauaugaa

SEQ ID NO: 4038602 - RNA, 22 nt, Staphylococcus aureus subsp. aureus N315
auuaauuacuuucauuguaaau

SEQ ID NO: 4038603 - RNA, 22 nt, Staphylococcus aureus subsp. aureus N315
auuaauuauaaguagugauuuu

SEQ ID NO: 4038604 - RNA, 17 nt, Staphylococcus aureus subsp. aureus N315
auuaauuaucuuaaguc

SEQ ID NO: 4038605 - RNA, 11 nt, Staphylococcus aureus subsp. aureus N315
auuaauuauua

SEQ ID NO: 4038606 - RNA, 17 nt, Staphylococcus aureus subsp. aureus N315
auuaauuggauuaaaua

SEQ ID NO: 4038607 - RNA, 19 nt, Staphylococcus aureus subsp. aureus N315
auuaauuguaaagcaugaa

SEQ ID NO: 4038608 - RNA, 20 nt, Staphylococcus aureus subsp. aureus N315
auuaauuuguccauccauuu

SEQ ID NO: 4038609 - RNA, 13 nt, Staphylococcus aureus subsp. aureus N315
auuaauuuucuuu

SEQ ID NO: 4038610 - RNA, 22 nt, Staphylococcus aureus subsp. aureus N315
auuaauuuucuuuuuuaauucu

SEQ ID NO: 4038611 - RNA, 19 nt, Staphylococcus aureus subsp. aureus N315
auuaauuuuguaauuagga

SEQ ID NO: 4038612 - RNA, 11 nt, Staphylococcus aureus subsp. aureus N315
auuaauuuuuc

SEQ ID NO: 4038613 - RNA, 16 nt, Staphylococcus aureus subsp. aureus N315
auuaauuuuucaaaug

SEQ ID NO: 4038614 - RNA, 17 nt, Staphylococcus aureus subsp. aureus N315
auuaauuuuucaaaugu

SEQ ID NO: 4038615 - RNA, 21 nt, Staphylococcus aureus subsp. aureus N315
auuacaaaagaaucauuuaaa

SEQ ID NO: 4038616 - RNA, 15 nt, Staphylococcus aureus subsp. aureus N315
auuacaaaaguauga

SEQ ID NO: 4038617 - RNA, 12 nt, Staphylococcus aureus subsp. aureus N315
auuacaaacauu

SEQ ID NO: 4038618 - RNA, 13 nt, Staphylococcus aureus subsp. aureus N315
auuacaaaucaug

SEQ ID NO: 4038619 - RNA, 15 nt, Staphylococcus aureus subsp. aureus N315
auuacaaaucaugac

SEQ ID NO: 4038620 - RNA, 21 nt, Staphylococcus aureus subsp. aureus N315
auuacaauaagcgcaauuaaa

SEQ ID NO: 4038621 - RNA, 19 nt, Staphylococcus aureus subsp. aureus N315
auuacacgcauuacuuuag

SEQ ID NO: 4038622 - RNA, 22 nt, Staphylococcus aureus subsp. aureus N315
auuacacuacgcugaugaauga

SEQ ID NO: 4038623 - RNA, 15 nt, Staphylococcus aureus subsp. aureus N315
auuacagaugaugcu

SEQ ID NO: 4038624 - RNA, 24 nt, Staphylococcus aureus subsp. aureus N315
auuacaggaaauccgcauaaauua

SEQ ID NO: 4038625 - RNA, 16 nt, Staphylococcus aureus subsp. aureus N315
auuacaggaauugcuu

SEQ ID NO: 4038626 - RNA, 22 nt, Staphylococcus aureus subsp. aureus N315
auuacaggaauugcuuuaaacu

SEQ ID NO: 4038627 - RNA, 16 nt, Staphylococcus aureus subsp. aureus N315
auuacauaauuuaucu

SEQ ID NO: 4038628 - RNA, 22 nt, Staphylococcus aureus subsp. aureus N315
auuacauaauuuaucugcaaaa

SEQ ID NO: 4038629 - RNA, 19 nt, Staphylococcus aureus subsp. aureus N315
auuacauauaagauagaua

SEQ ID NO: 4038630 - RNA, 23 nt, Staphylococcus aureus subsp. aureus N315
auuacaugcaccuuuacaacaua

SEQ ID NO: 4038631 - RNA, 19 nt, Staphylococcus aureus subsp. aureus N315
auuacccacaucuuuuuaa

SEQ ID NO: 4038632 - RNA, 21 nt, Staphylococcus aureus subsp. aureus N315
auuacccacaucuuuuuaaaa

SEQ ID NO: 4038633 - RNA, 22 nt, Staphylococcus aureus subsp. aureus N315
auuacccacaucuuuuuaaaag

SEQ ID NO: 4038634 - RNA, 15 nt, Staphylococcus aureus subsp. aureus N315
auuaccuuuccauuc

SEQ ID NO: 4038635 - RNA, 18 nt, Staphylococcus aureus subsp. aureus N315
auuacgcucaucaccuuu

SEQ ID NO: 4038636 - RNA, 21 nt, Staphylococcus aureus subsp. aureus N315
auuacgcugucucauuaaugu

SEQ ID NO: 4038637 - RNA, 17 nt, Staphylococcus aureus subsp. aureus N315
auuacgucauaaaauac

SEQ ID NO: 4038638 - RNA, 18 nt, Staphylococcus aureus subsp. aureus N315
auuacuaaaacaaauuca

SEQ ID NO: 4038639 - RNA, 13 nt, Staphylococcus aureus subsp. aureus N315
auuacuaaccuau

SEQ ID NO: 4038640 - RNA, 19 nt, Staphylococcus aureus subsp. aureus N315
auuacuaaccuauuaaaau

SEQ ID NO: 4038641 - RNA, 21 nt, Staphylococcus aureus subsp. aureus N315
auuacuaaccuauuaaaauaa

SEQ ID NO: 4038642 - RNA, 22 nt, Staphylococcus aureus subsp. aureus N315
auuacuaaccuauuaaaauaaa

SEQ ID NO: 4038643 - RNA, 19 nt, Staphylococcus aureus subsp. aureus N315
auuacuaacguaaagguga

SEQ ID NO: 4038644 - RNA, 16 nt, Staphylococcus aureus subsp. aureus N315
auuacuaauugaucag

SEQ ID NO: 4038645 - RNA, 19 nt, Staphylococcus aureus subsp. aureus N315
auuacuacauaauuuauca

SEQ ID NO: 4038646 - RNA, 17 nt, Staphylococcus aureus subsp. aureus N315
auuacuauaaaaaacag

SEQ ID NO: 4038647 - RNA, 15 nt, Staphylococcus aureus subsp. aureus N315
auuacucaaaauuaa

SEQ ID NO: 4038648 - RNA, 21 nt, Staphylococcus aureus subsp. aureus N315
auuacucaauuugaagauuuu

SEQ ID NO: 4038649 - RNA, 22 nt, Staphylococcus aureus subsp. aureus N315
auuacuccaauuaccaaugaau

SEQ ID NO: 4038650 - RNA, 16 nt, Staphylococcus aureus subsp. aureus N315
auuacucuuuuucuuu

SEQ ID NO: 4038651 - RNA, 22 nt, Staphylococcus aureus subsp. aureus N315
auuacuguaaaauucuauaaau

SEQ ID NO: 4038652 - RNA, 17 nt, Staphylococcus aureus subsp. aureus N315
auuacuguaaauaugaa

SEQ ID NO: 4038653 - RNA, 13 nt, Staphylococcus aureus subsp. aureus N315
auuacuuaucugu

SEQ ID NO: 4038654 - RNA, 18 nt, Staphylococcus aureus subsp. aureus N315
auuacuuauuucuuuuca

SEQ ID NO: 4038655 - RNA, 22 nt, Staphylococcus aureus subsp. aureus N315
auuacuuauuucuuuucauuau

SEQ ID NO: 4038656 - RNA, 16 nt, Staphylococcus aureus subsp. aureus N315
auuacuuccauugcuu

SEQ ID NO: 4038657 - RNA, 22 nt, Staphylococcus aureus subsp. aureus N315
auuacuugaaaauagccauauu

SEQ ID NO: 4038658 - RNA, 18 nt, Staphylococcus aureus subsp. aureus N315
auuacuuuaauuuaguga

SEQ ID NO: 4038659 - RNA, 13 nt, Staphylococcus aureus subsp. aureus N315
auuacuuuagaaa

SEQ ID NO: 4038660 - RNA, 17 nt, Staphylococcus aureus subsp. aureus N315
auuacuuuggaaauuua

SEQ ID NO: 4038661 - RNA, 21 nt, Staphylococcus aureus subsp. aureus N315
auuagaaaaggcucauuuguu

SEQ ID NO: 4038662 - RNA, 20 nt, Staphylococcus aureus subsp. aureus N315
auuagaaaauaucuuacugc

SEQ ID NO: 4038663 - RNA, 17 nt, Staphylococcus aureus subsp. aureus N315
auuagaacauuuaucgu

SEQ ID NO: 4038664 - RNA, 19 nt, Staphylococcus aureus subsp. aureus N315
auuagacguguaaauguua

SEQ ID NO: 4038665 - RNA, 13 nt, Staphylococcus aureus subsp. aureus N315
auuagauauauuu

SEQ ID NO: 4038666 - RNA, 17 nt, Staphylococcus aureus subsp. aureus N315
auuagauauauuugaaa

SEQ ID NO: 4038667 - RNA, 19 nt, Staphylococcus aureus subsp. aureus N315
auuagauauauuugaaagg

SEQ ID NO: 4038668 - RNA, 15 nt, Staphylococcus aureus subsp. aureus N315
auuagauaucuuaau

SEQ ID NO: 4038669 - RNA, 18 nt, Staphylococcus aureus subsp. aureus N315
auuagaugaaauggaaag

SEQ ID NO: 4038670 - RNA, 16 nt, Staphylococcus aureus subsp. aureus N315
auuagaugauauuuaa

SEQ ID NO: 4038671 - RNA, 15 nt, Staphylococcus aureus subsp. aureus N315
auuauuaacuuuaau

SEQ ID NO: 4038672 - RNA, 20 nt, Staphylococcus aureus subsp. aureus N315
auuauuaaggggguaauacu

SEQ ID NO: 4038673 - RNA, 16 nt, Staphylococcus aureus subsp. aureus N315
auuauuaauaaaggga

SEQ ID NO: 4038674 - RNA, 15 nt, Staphylococcus aureus subsp. aureus N315
auuauuauaauaaau

SEQ ID NO: 4038675 - RNA, 14 nt, Staphylococcus aureus subsp. aureus N315
auuauuauuaaauu

SEQ ID NO: 4038676 - RNA, 17 nt, Staphylococcus aureus subsp. aureus N315
auuauuauuaaauuaug

SEQ ID NO: 4038677 - RNA, 16 nt, Staphylococcus aureus subsp. aureus N315
auuauuauuacaauga

SEQ ID NO: 4038678 - RNA, 14 nt, Staphylococcus aureus subsp. aureus N315
auuauuauugaaau

SEQ ID NO: 4038679 - RNA, 19 nt, Staphylococcus aureus subsp. aureus N315
auuauucuuugauuaaauc

SEQ ID NO: 4038680 - RNA, 18 nt, Staphylococcus aureus subsp. aureus N315
auuauugaaacuaauaau

SEQ ID NO: 4038681 - RNA, 22 nt, Staphylococcus aureus subsp. aureus N315
auuauugaaaucgauacuaaua

SEQ ID NO: 4038682 - RNA, 15 nt, Staphylococcus aureus subsp. aureus N315
auuauuggauuugaa

SEQ ID NO: 4038683 - RNA, 18 nt, Staphylococcus aureus subsp. aureus N315
auuauugguugaaauuaa

SEQ ID NO: 4038684 - RNA, 17 nt, Staphylococcus aureus subsp. aureus N315
auuauuguaaguuggcu

SEQ ID NO: 4038685 - RNA, 18 nt, Staphylococcus aureus subsp. aureus N315
auuauugucaucauguuc

SEQ ID NO: 4038686 - RNA, 14 nt, Staphylococcus aureus subsp. aureus N315
auuauuuaaaaugc

SEQ ID NO: 4038687 - RNA, 15 nt, Staphylococcus aureus subsp. aureus N315
auuauuuaaaaugcu

SEQ ID NO: 4038688 - RNA, 16 nt, Staphylococcus aureus subsp. aureus N315
auuauuuaaaaugcuu

SEQ ID NO: 4038689 - RNA, 15 nt, Staphylococcus aureus subsp. aureus N315
auuauuuaaucuauu

SEQ ID NO: 4038690 - RNA, 22 nt, Staphylococcus aureus subsp. aureus N315
auuauuuagaauucuaaaagaa

SEQ ID NO: 4038691 - RNA, 14 nt, Staphylococcus aureus subsp. aureus N315
auuauuuauauuuu

SEQ ID NO: 4038692 - RNA, 16 nt, Staphylococcus aureus subsp. aureus N315
auuauuucauuagaaa

SEQ ID NO: 4038693 - RNA, 21 nt, Staphylococcus aureus subsp. aureus N315
auuauuucuagcauguaagcu

SEQ ID NO: 4038694 - RNA, 22 nt, Staphylococcus aureus subsp. aureus N315
auuauuucucuuuccacugcaa

SEQ ID NO: 4038695 - RNA, 23 nt, Staphylococcus aureus subsp. aureus N315
auuauuuggcucuauaucaaauu

SEQ ID NO: 4038696 - RNA, 18 nt, Staphylococcus aureus subsp. aureus N315
auuauuuuguauuuuuca

SEQ ID NO: 4038697 - RNA, 14 nt, Staphylococcus aureus subsp. aureus N315
auuauuuuuuuaaa

SEQ ID NO: 4038698 - RNA, 22 nt, Staphylococcus aureus subsp. aureus N315
auuauuuuuuuaaaucuauaua

SEQ ID NO: 4038699 - RNA, 18 nt, Staphylococcus aureus subsp. aureus N315
auucaaaauucaauauua

SEQ ID NO: 4038700 - RNA, 20 nt, Staphylococcus aureus subsp. aureus N315
auucaaaguuuucauuuaac

SEQ ID NO: 4038701 - RNA, 19 nt, Staphylococcus aureus subsp. aureus N315
auucaaauaaaucaaacuu

SEQ ID NO: 4038702 - RNA, 22 nt, Staphylococcus aureus subsp. aureus N315
auucaaauaaaugacauuuaau

SEQ ID NO: 4038703 - RNA, 12 nt, Staphylococcus aureus subsp. aureus N315
auucaaccaauu

SEQ ID NO: 4038704 - RNA, 17 nt, Staphylococcus aureus subsp. aureus N315
auucaaccaauuauuaa

SEQ ID NO: 4038705 - RNA, 17 nt, Staphylococcus aureus subsp. aureus N315
auucaacuuauuauuua

SEQ ID NO: 4038706 - RNA, 15 nt, Staphylococcus aureus subsp. aureus N315
auucaacuuuucaaa

SEQ ID NO: 4038707 - RNA, 20 nt, Staphylococcus aureus subsp. aureus N315
auucaacuuuucaaagccac

SEQ ID NO: 4038708 - RNA, 22 nt, Staphylococcus aureus subsp. aureus N315
auucaagaccaugcaaacucau

SEQ ID NO: 4038709 - RNA, 19 nt, Staphylococcus aureus subsp. aureus N315
auucaagcaucauuuuucg

SEQ ID NO: 4038710 - RNA, 15 nt, Staphylococcus aureus subsp. aureus N315
auucaauaauuauua

SEQ ID NO: 4038711 - RNA, 21 nt, Staphylococcus aureus subsp. aureus N315
auucaauacgaaguguuauaa

SEQ ID NO: 4038712 - RNA, 19 nt, Staphylococcus aureus subsp. aureus N315
auucaauauuaaucauaau

SEQ ID NO: 4038713 - RNA, 14 nt, Staphylococcus aureus subsp. aureus N315
auucaauauuuuuu

SEQ ID NO: 4038714 - RNA, 15 nt, Staphylococcus aureus subsp. aureus N315
auucaaugauuuuua

SEQ ID NO: 4038715 - RNA, 17 nt, Staphylococcus aureus subsp. aureus N315
auucaaugauuuuuaaa

SEQ ID NO: 4038716 - RNA, 21 nt, Staphylococcus aureus subsp. aureus N315
auucaauguaucaccuaauug

SEQ ID NO: 4038717 - RNA, 15 nt, Staphylococcus aureus subsp. aureus N315
auucaauguuuuaaa

SEQ ID NO: 4038718 - RNA, 16 nt, Staphylococcus aureus subsp. aureus N315
auucaauguuuuaaau

SEQ ID NO: 4038719 - RNA, 13 nt, Staphylococcus aureus subsp. aureus N315
auucaauuucuca

SEQ ID NO: 4038720 - RNA, 20 nt, Staphylococcus aureus subsp. aureus N315
auucaauuucucaccagcuc

SEQ ID NO: 4038721 - RNA, 15 nt, Staphylococcus aureus subsp. aureus N315
auucaccaauuaggu

SEQ ID NO: 4038722 - RNA, 18 nt, Staphylococcus aureus subsp. aureus N315
auucaccagguuuuuuau

SEQ ID NO: 4038723 - RNA, 18 nt, Staphylococcus aureus subsp. aureus N315
auucacgacuugauagca

SEQ ID NO: 4038724 - RNA, 19 nt, Staphylococcus aureus subsp. aureus N315
auucacgauauaacauuaa

SEQ ID NO: 4038725 - RNA, 20 nt, Staphylococcus aureus subsp. aureus N315
auucacgcguucaaauguug

SEQ ID NO: 4038726 - RNA, 18 nt, Staphylococcus aureus subsp. aureus N315
auucagucaguaaaaaua

SEQ ID NO: 4038727 - RNA, 14 nt, Staphylococcus aureus subsp. aureus N315
auucagugcaauga

SEQ ID NO: 4038728 - RNA, 14 nt, Staphylococcus aureus subsp. aureus N315
auucaguucaaaca

SEQ ID NO: 4038729 - RNA, 17 nt, Staphylococcus aureus subsp. aureus N315
auucauaagaaaaaugu

SEQ ID NO: 4038730 - RNA, 22 nt, Staphylococcus aureus subsp. aureus N315
auucauaagaaaaauguguuaa

SEQ ID NO: 4038731 - RNA, 22 nt, Staphylococcus aureus subsp. aureus N315
auucauaauuuguugauaguaa

SEQ ID NO: 4038732 - RNA, 20 nt, Staphylococcus aureus subsp. aureus N315
auucauacacugcacaucau

SEQ ID NO: 4038733 - RNA, 21 nt, Staphylococcus aureus subsp. aureus N315
auucauacacugcacaucaua

SEQ ID NO: 4038734 - RNA, 16 nt, Staphylococcus aureus subsp. aureus N315
auucauaucauuagau

SEQ ID NO: 4038735 - RNA, 14 nt, Staphylococcus aureus subsp. aureus N315
auucauaucuuuca

SEQ ID NO: 4038736 - RNA, 12 nt, Staphylococcus aureus subsp. aureus N315
auucauauuaac

SEQ ID NO: 4038737 - RNA, 16 nt, Staphylococcus aureus subsp. aureus N315
auucauauucaaauuu

SEQ ID NO: 4038738 - RNA, 14 nt, Staphylococcus aureus subsp. aureus N315
auucauauuuauau

SEQ ID NO: 4038739 - RNA, 17 nt, Staphylococcus aureus subsp. aureus N315
auucauauuuauauuua

SEQ ID NO: 4038740 - RNA, 19 nt, Staphylococcus aureus subsp. aureus N315
auucaucaauggugaccaa

SEQ ID NO: 4038741 - RNA, 15 nt, Staphylococcus aureus subsp. aureus N315
auucaucgucucacu

SEQ ID NO: 4038742 - RNA, 23 nt, Staphylococcus aureus subsp. aureus N315
auucaucuaaccuuuucaucagu

SEQ ID NO: 4038743 - RNA, 16 nt, Staphylococcus aureus subsp. aureus N315
auucaucucagcaaua

SEQ ID NO: 4038744 - RNA, 18 nt, Staphylococcus aureus subsp. aureus N315
auucaucucagcaauacu

SEQ ID NO: 4038745 - RNA, 16 nt, Staphylococcus aureus subsp. aureus N315
auucaucuguugauaa

SEQ ID NO: 4038746 - RNA, 14 nt, Staphylococcus aureus subsp. aureus N315
auucaucuuaucaa

SEQ ID NO: 4038747 - RNA, 17 nt, Staphylococcus aureus subsp. aureus N315
auucaucuuaucaagaa

SEQ ID NO: 4038748 - RNA, 14 nt, Staphylococcus aureus subsp. aureus N315
auucaucuucaaac

SEQ ID NO: 4038749 - RNA, 23 nt, Staphylococcus aureus subsp. aureus N315
auucaucuugcaaguauuuucuu

SEQ ID NO: 4038750 - RNA, 21 nt, Staphylococcus aureus subsp. aureus N315
auucaugaaucgaacuaguac

SEQ ID NO: 4038751 - RNA, 21 nt, Staphylococcus aureus subsp. aureus N315
auucaugcccgagacuauauu

SEQ ID NO: 4038752 - RNA, 22 nt, Staphylococcus aureus subsp. aureus N315
auucauggccaaauguugauaa

SEQ ID NO: 4038753 - RNA, 16 nt, Staphylococcus aureus subsp. aureus N315
auucauguaaauaguu

SEQ ID NO: 4038754 - RNA, 15 nt, Staphylococcus aureus subsp. aureus N315
auucauuaauaggau

SEQ ID NO: 4038755 - RNA, 16 nt, Staphylococcus aureus subsp. aureus N315
auucauuacaaccauu

SEQ ID NO: 4038756 - RNA, 14 nt, Staphylococcus aureus subsp. aureus N315
auucauuacauguu

SEQ ID NO: 4038757 - RNA, 19 nt, Staphylococcus aureus subsp. aureus N315
auucauuacauguuacuga

SEQ ID NO: 4038758 - RNA, 14 nt, Staphylococcus aureus subsp. aureus N315
auugaacuucuaac

SEQ ID NO: 4038759 - RNA, 14 nt, Staphylococcus aureus subsp. aureus N315
auugaauaaaugaa

SEQ ID NO: 4038760 - RNA, 19 nt, Staphylococcus aureus subsp. aureus N315
auugaauaucacuuuagau

SEQ ID NO: 4038761 - RNA, 13 nt, Staphylococcus aureus subsp. aureus N315
auugaaucaaaua

SEQ ID NO: 4038762 - RNA, 15 nt, Staphylococcus aureus subsp. aureus N315
auugaaugaaaauaa

SEQ ID NO: 4038763 - RNA, 17 nt, Staphylococcus aureus subsp. aureus N315
auugaauucucgccaac

SEQ ID NO: 4038764 - RNA, 14 nt, Staphylococcus aureus subsp. aureus N315
auugaauugaaaaa

SEQ ID NO: 4038765 - RNA, 21 nt, Staphylococcus aureus subsp. aureus N315
auugaauuguagauccaauuc

SEQ ID NO: 4038766 - RNA, 23 nt, Staphylococcus aureus subsp. aureus N315
auugacauuaaugauagcaauga

SEQ ID NO: 4038767 - RNA, 19 nt, Staphylococcus aureus subsp. aureus N315
auugacucgaccuuuauau

SEQ ID NO: 4038768 - RNA, 22 nt, Staphylococcus aureus subsp. aureus N315
auugacucgaccuuuauaugaa

SEQ ID NO: 4038769 - RNA, 18 nt, Staphylococcus aureus subsp. aureus N315
auugacuuacauuuuaau

SEQ ID NO: 4038770 - RNA, 23 nt, Staphylococcus aureus subsp. aureus N315
auugacuuacauuuuaauaaaau

SEQ ID NO: 4038771 - RNA, 13 nt, Staphylococcus aureus subsp. aureus N315
auugacuuuaauu

SEQ ID NO: 4038772 - RNA, 17 nt, Staphylococcus aureus subsp. aureus N315
auugagaaauagcaaca

SEQ ID NO: 4038773 - RNA, 21 nt, Staphylococcus aureus subsp. aureus N315
auugagaauauuaagauguau

SEQ ID NO: 4038774 - RNA, 20 nt, Staphylococcus aureus subsp. aureus N315
auugagacaacauuguugau

SEQ ID NO: 4038775 - RNA, 23 nt, Staphylococcus aureus subsp. aureus N315
auugaggaucaaaaguuguugca

SEQ ID NO: 4038776 - RNA, 16 nt, Staphylococcus aureus subsp. aureus N315
auugaguugaaaauaa

SEQ ID NO: 4038777 - RNA, 15 nt, Staphylococcus aureus subsp. aureus N315
auugauaaauuuuua

SEQ ID NO: 4038778 - RNA, 17 nt, Staphylococcus aureus subsp. aureus N315
auugauagauagaaauu

SEQ ID NO: 4038779 - RNA, 12 nt, Staphylococcus aureus subsp. aureus N315
auugauagucac

SEQ ID NO: 4038780 - RNA, 18 nt, Staphylococcus aureus subsp. aureus N315
auugauauggaucauaau

SEQ ID NO: 4038781 - RNA, 19 nt, Staphylococcus aureus subsp. aureus N315
auugaucuuuuauaaugaa

SEQ ID NO: 4038782 - RNA, 14 nt, Staphylococcus aureus subsp. aureus N315
auugaugaaaacaa

SEQ ID NO: 4038783 - RNA, 15 nt, Staphylococcus aureus subsp. aureus N315
auugaugaaaacaaa

SEQ ID NO: 4038784 - RNA, 16 nt, Staphylococcus aureus subsp. aureus N315
auugaugaaaacaaac

SEQ ID NO: 4038785 - RNA, 15 nt, Staphylococcus aureus subsp. aureus N315
auugaugaauaaaua

SEQ ID NO: 4038786 - RNA, 18 nt, Staphylococcus aureus subsp. aureus N315
auugaugucacauaugac

SEQ ID NO: 4038787 - RNA, 17 nt, Staphylococcus aureus subsp. aureus N315
auugauucuacagcauc

SEQ ID NO: 4038788 - RNA, 16 nt, Staphylococcus aureus subsp. aureus N315
auugauucuagugaaa

SEQ ID NO: 4038789 - RNA, 19 nt, Staphylococcus aureus subsp. aureus N315
auugauucuagugaaauac

SEQ ID NO: 4038790 - RNA, 22 nt, Staphylococcus aureus subsp. aureus N315
auugauuugggcgcuuuuuaau

SEQ ID NO: 4038791 - RNA, 16 nt, Staphylococcus aureus subsp. aureus N315
auugcaaaaaaacaaa

SEQ ID NO: 4038792 - RNA, 21 nt, Staphylococcus aureus subsp. aureus N315
auugcaaaaaaacaaauauua

SEQ ID NO: 4038793 - RNA, 15 nt, Staphylococcus aureus subsp. aureus N315
auugcaaaaauaaua

SEQ ID NO: 4038794 - RNA, 21 nt, Staphylococcus aureus subsp. aureus N315
auugcaaaaauaauaugaauu

SEQ ID NO: 4038795 - RNA, 22 nt, Staphylococcus aureus subsp. aureus N315
auugcaaaacuugcgcaugcuu

SEQ ID NO: 4038796 - RNA, 14 nt, Staphylococcus aureus subsp. aureus N315
auugcaaaugcaau

SEQ ID NO: 4038797 - RNA, 19 nt, Staphylococcus aureus subsp. aureus N315
auugcaaugaauaacaaga

SEQ ID NO: 4038798 - RNA, 19 nt, Staphylococcus aureus subsp. aureus N315
auugcaaugcuaucaugcc

SEQ ID NO: 4038799 - RNA, 22 nt, Staphylococcus aureus subsp. aureus N315
auugcacgucuuguaucaacau

SEQ ID NO: 4038800 - RNA, 21 nt, Staphylococcus aureus subsp. aureus N315
auugcacguuugaaugaaccu

SEQ ID NO: 4038801 - RNA, 22 nt, Staphylococcus aureus subsp. aureus N315
auugcacuaugcauaauaccaa

SEQ ID NO: 4038802 - RNA, 23 nt, Staphylococcus aureus subsp. aureus N315
auugcagguaaacggaauaacuu

SEQ ID NO: 4038803 - RNA, 19 nt, Staphylococcus aureus subsp. aureus N315
auugcauacguaaauggua

SEQ ID NO: 4038804 - RNA, 18 nt, Staphylococcus aureus subsp. aureus N315
auugccgguuaaauuauu

SEQ ID NO: 4038805 - RNA, 19 nt, Staphylococcus aureus subsp. aureus N315
auugccuaaccuguuugag

SEQ ID NO: 4038806 - RNA, 16 nt, Staphylococcus aureus subsp. aureus N315
auugcgaaaaauaauu

SEQ ID NO: 4038807 - RNA, 17 nt, Staphylococcus aureus subsp. aureus N315
auugcgugcuucacuga

SEQ ID NO: 4038808 - RNA, 17 nt, Staphylococcus aureus subsp. aureus N315
auugcuaauccauacgu

SEQ ID NO: 4038809 - RNA, 22 nt, Staphylococcus aureus subsp. aureus N315
auugcuauaagaacuaaugguu

SEQ ID NO: 4038810 - RNA, 22 nt, Staphylococcus aureus subsp. aureus N315
auugcuauauuaguauaauuua

SEQ ID NO: 4038811 - RNA, 17 nt, Staphylococcus aureus subsp. aureus N315
auugcucuaagcauuca

SEQ ID NO: 4038812 - RNA, 22 nt, Staphylococcus aureus subsp. aureus N315
auugcugacaccuauauuuuua

SEQ ID NO: 4038813 - RNA, 23 nt, Staphylococcus aureus subsp. aureus N315
auugcugccacuguagaaacaca

SEQ ID NO: 4038814 - RNA, 23 nt, Staphylococcus aureus subsp. aureus N315
auugcugcuguacaauuucgcuu

SEQ ID NO: 4038815 - RNA, 18 nt, Staphylococcus aureus subsp. aureus N315
auugcuguaaccccuugu

SEQ ID NO: 4038816 - RNA, 21 nt, Staphylococcus aureus subsp. aureus N315
auugcuugaaauuauuauuua

SEQ ID NO: 4038817 - RNA, 18 nt, Staphylococcus aureus subsp. aureus N315
auugcuuguccucuaaaa

SEQ ID NO: 4038818 - RNA, 21 nt, Staphylococcus aureus subsp. aureus N315
auugcuuguccucuaaaacau

SEQ ID NO: 4038819 - RNA, 18 nt, Staphylococcus aureus subsp. aureus N315
auugcuuuacuaauuccg

SEQ ID NO: 4038820 - RNA, 20 nt, Staphylococcus aureus subsp. aureus N315
auuggaaucaucuuuuugaa

SEQ ID NO: 4038821 - RNA, 18 nt, Staphylococcus aureus subsp. aureus N315
auuggaaucccaaugcuu

SEQ ID NO: 4038822 - RNA, 18 nt, Staphylococcus aureus subsp. aureus N315
auuggauaauuucuucuu

SEQ ID NO: 4038823 - RNA, 23 nt, Staphylococcus aureus subsp. aureus N315
auuggauuacuuccauugcuucu

SEQ ID NO: 4038824 - RNA, 20 nt, Staphylococcus aureus subsp. aureus N315
auuggauuaucgaauuagau

SEQ ID NO: 4038825 - RNA, 16 nt, Staphylococcus aureus subsp. aureus N315
auuggcaguaguugac

SEQ ID NO: 4038826 - RNA, 13 nt, Staphylococcus aureus subsp. aureus N315
auuggcauuuacg

SEQ ID NO: 4038827 - RNA, 18 nt, Staphylococcus aureus subsp. aureus N315
auuggcauuuacgaaguu

SEQ ID NO: 4038828 - RNA, 14 nt, Staphylococcus aureus subsp. aureus N315
auuggcuugcuuca

SEQ ID NO: 4038829 - RNA, 13 nt, Staphylococcus aureus subsp. aureus N315
auugggacuuauu

SEQ ID NO: 4038830 - RNA, 20 nt, Staphylococcus aureus subsp. aureus N315
auugggagcaaucaauacaa

SEQ ID NO: 4038831 - RNA, 22 nt, Staphylococcus aureus subsp. aureus N315
auuggguggucguaauuugguc

SEQ ID NO: 4038832 - RNA, 22 nt, Staphylococcus aureus subsp. aureus N315
auugguaggaggcuuuugcuuu

SEQ ID NO: 4038833 - RNA, 16 nt, Staphylococcus aureus subsp. aureus N315
auugguugauuaguuu

SEQ ID NO: 4038834 - RNA, 13 nt, Staphylococcus aureus subsp. aureus N315
auugguuucauca

SEQ ID NO: 4038835 - RNA, 15 nt, Staphylococcus aureus subsp. aureus N315
auugguuucaucaua

SEQ ID NO: 4038836 - RNA, 17 nt, Staphylococcus aureus subsp. aureus N315
auugguuuggauaaaau

SEQ ID NO: 4038837 - RNA, 16 nt, Staphylococcus aureus subsp. aureus N315
auugguuuuuagugaa

SEQ ID NO: 4038838 - RNA, 20 nt, Staphylococcus aureus subsp. aureus N315
auugguuuuuagugaaaaga

SEQ ID NO: 4038839 - RNA, 21 nt, Staphylococcus aureus subsp. aureus N315
auuguaaaaacguucaaucgu

SEQ ID NO: 4038840 - RNA, 13 nt, Staphylococcus aureus subsp. aureus N315
auuguaaaaugcu

SEQ ID NO: 4038841 - RNA, 14 nt, Staphylococcus aureus subsp. aureus N315
auuguaaaaugcuc

SEQ ID NO: 4038842 - RNA, 13 nt, Staphylococcus aureus subsp. aureus N315
auuguaaauaaaa

SEQ ID NO: 4038843 - RNA, 22 nt, Staphylococcus aureus subsp. aureus N315
auuguaaaugaucaucguauag

SEQ ID NO: 4038844 - RNA, 22 nt, Staphylococcus aureus subsp. aureus N315
auuguaagucgaaaguacccag

SEQ ID NO: 4038845 - RNA, 17 nt, Staphylococcus aureus subsp. aureus N315
auuuacaccuauaccuc

SEQ ID NO: 4038846 - RNA, 17 nt, Staphylococcus aureus subsp. aureus N315
auuuacauccaacuaaa

SEQ ID NO: 4038847 - RNA, 19 nt, Staphylococcus aureus subsp. aureus N315
auuuaccaguuugaucaua

SEQ ID NO: 4038848 - RNA, 15 nt, Staphylococcus aureus subsp. aureus N315
auuuaccuucuucua

SEQ ID NO: 4038849 - RNA, 16 nt, Staphylococcus aureus subsp. aureus N315
auuuacgguuauggug

SEQ ID NO: 4038850 - RNA, 13 nt, Staphylococcus aureus subsp. aureus N315
auuuacuucuucu

SEQ ID NO: 4038851 - RNA, 15 nt, Staphylococcus aureus subsp. aureus N315
auuuacuugauuaga

SEQ ID NO: 4038852 - RNA, 22 nt, Staphylococcus aureus subsp. aureus N315
auuuacuugauuagauuugugu

SEQ ID NO: 4038853 - RNA, 18 nt, Staphylococcus aureus subsp. aureus N315
auuuagaaacuuccaaca

SEQ ID NO: 4038854 - RNA, 21 nt, Staphylococcus aureus subsp. aureus N315
auuuagaaacuuccaacauau

SEQ ID NO: 4038855 - RNA, 20 nt, Staphylococcus aureus subsp. aureus N315
auuuagaauaaacuuuaugg

SEQ ID NO: 4038856 - RNA, 12 nt, Staphylococcus aureus subsp. aureus N315
auuuagaauaag

SEQ ID NO: 4038857 - RNA, 15 nt, Staphylococcus aureus subsp. aureus N315
auuuagauaaaaauu

SEQ ID NO: 4038858 - RNA, 17 nt, Staphylococcus aureus subsp. aureus N315
auuuagaugauucuuau

SEQ ID NO: 4038859 - RNA, 18 nt, Staphylococcus aureus subsp. aureus N315
auuuagaugauucuuauc

SEQ ID NO: 4038860 - RNA, 17 nt, Staphylococcus aureus subsp. aureus N315
auuuagaugcauaaaaa

SEQ ID NO: 4038861 - RNA, 20 nt, Staphylococcus aureus subsp. aureus N315
auuuagaugcauaaaaaaag

SEQ ID NO: 4038862 - RNA, 15 nt, Staphylococcus aureus subsp. aureus N315
auuuagauucuuuuc

SEQ ID NO: 4038863 - RNA, 18 nt, Staphylococcus aureus subsp. aureus N315
auuuagauuggucaaacu

SEQ ID NO: 4038864 - RNA, 16 nt, Staphylococcus aureus subsp. aureus N315
auuuagauuuauaacg

SEQ ID NO: 4038865 - RNA, 21 nt, Staphylococcus aureus subsp. aureus N315
auuuaggaguauccugauuua

SEQ ID NO: 4038866 - RNA, 16 nt, Staphylococcus aureus subsp. aureus N315
auuuagggauuauaac

SEQ ID NO: 4038867 - RNA, 19 nt, Staphylococcus aureus subsp. aureus N315
auuuagguaauacaucauc

SEQ ID NO: 4038868 - RNA, 17 nt, Staphylococcus aureus subsp. aureus N315
auuuaguacauagaccu

SEQ ID NO: 4038869 - RNA, 14 nt, Staphylococcus aureus subsp. aureus N315
auuuaguacauaug

SEQ ID NO: 4038870 - RNA, 15 nt, Staphylococcus aureus subsp. aureus N315
auuuaguauaaauaa

SEQ ID NO: 4038871 - RNA, 15 nt, Staphylococcus aureus subsp. aureus N315
auuuaguaucucauu

SEQ ID NO: 4038872 - RNA, 15 nt, Staphylococcus aureus subsp. aureus N315
auuuagucauuacaa

SEQ ID NO: 4038873 - RNA, 18 nt, Staphylococcus aureus subsp. aureus N315
auuuagucauuacaaauc

SEQ ID NO: 4038874 - RNA, 22 nt, Staphylococcus aureus subsp. aureus N315
auuuagugaaacaauuuguaac

SEQ ID NO: 4038875 - RNA, 13 nt, Staphylococcus aureus subsp. aureus N315
auuuaguuaaaua

SEQ ID NO: 4038876 - RNA, 19 nt, Staphylococcus aureus subsp. aureus N315
auuuaguuaauuauuuaga

SEQ ID NO: 4038877 - RNA, 17 nt, Staphylococcus aureus subsp. aureus N315
auuuaguuuuuuuaaag

SEQ ID NO: 4038878 - RNA, 15 nt, Staphylococcus aureus subsp. aureus N315
auuuauaaacaauaa

SEQ ID NO: 4038879 - RNA, 19 nt, Staphylococcus aureus subsp. aureus N315
auuuauaaacaauuacaaa

SEQ ID NO: 4038880 - RNA, 18 nt, Staphylococcus aureus subsp. aureus N315
auuuauaacauuuaagaa

SEQ ID NO: 4038881 - RNA, 14 nt, Staphylococcus aureus subsp. aureus N315
auuuauacuauaaa

SEQ ID NO: 4038882 - RNA, 16 nt, Staphylococcus aureus subsp. aureus N315
auuuauacuauaaaua

SEQ ID NO: 4038883 - RNA, 22 nt, Staphylococcus aureus subsp. aureus N315
auuuauacuauaaauacaaaua

SEQ ID NO: 4038884 - RNA, 21 nt, Staphylococcus aureus subsp. aureus N315
auuuauauagucuaugaauaa

SEQ ID NO: 4038885 - RNA, 17 nt, Staphylococcus aureus subsp. aureus N315
auuuauauuaaauacua

SEQ ID NO: 4038886 - RNA, 15 nt, Staphylococcus aureus subsp. aureus N315
auuuauauuuagaau

SEQ ID NO: 4038887 - RNA, 17 nt, Staphylococcus aureus subsp. aureus N315
auuuaucaccuuuaggc

SEQ ID NO: 4038888 - RNA, 22 nt, Staphylococcus aureus subsp. aureus N315
auuuaucaccuuuaggcaaaua

SEQ ID NO: 4038889 - RNA, 16 nt, Staphylococcus aureus subsp. aureus N315
auuuaucauacuucaa

SEQ ID NO: 4038890 - RNA, 17 nt, Staphylococcus aureus subsp. aureus N315
auuuaucgccaauuaau

SEQ ID NO: 4038891 - RNA, 16 nt, Staphylococcus aureus subsp. aureus N315
auuuaucgugaagaaa

SEQ ID NO: 4038892 - RNA, 19 nt, Staphylococcus aureus subsp. aureus N315
auuuaucgugaagaaaaaa

SEQ ID NO: 4038893 - RNA, 23 nt, Staphylococcus aureus subsp. aureus N315
auuuaucuagacucaaggaaauc

SEQ ID NO: 4038894 - RNA, 20 nt, Staphylococcus aureus subsp. aureus N315
auuuaucugcaaaaugcauu

SEQ ID NO: 4038895 - RNA, 20 nt, Staphylococcus aureus subsp. aureus N315
auuuaucuugauuuuauaaa

SEQ ID NO: 4038896 - RNA, 21 nt, Staphylococcus aureus subsp. aureus N315
auuuaucuugauuuuauaaau

SEQ ID NO: 4038897 - RNA, 21 nt, Staphylococcus aureus subsp. aureus N315
auuuaucuuuagagacuuauu

SEQ ID NO: 4038898 - RNA, 17 nt, Staphylococcus aureus subsp. aureus N315
auuuaucuuuuaaaauc

SEQ ID NO: 4038899 - RNA, 16 nt, Staphylococcus aureus subsp. aureus N315
auuuauguagauuuua

SEQ ID NO: 4038900 - RNA, 14 nt, Staphylococcus aureus subsp. aureus N315
auuuauuaaauaua

SEQ ID NO: 4038901 - RNA, 15 nt, Staphylococcus aureus subsp. aureus N315
auuuauuaacucaug

SEQ ID NO: 4038902 - RNA, 23 nt, Staphylococcus aureus subsp. aureus N315
auuuauuaguugugguuguuaau

SEQ ID NO: 4038903 - RNA, 14 nt, Staphylococcus aureus subsp. aureus N315
auuuauuauaaaau

SEQ ID NO: 4038904 - RNA, 16 nt, Staphylococcus aureus subsp. aureus N315
auuuauucuaaauaua

SEQ ID NO: 4038905 - RNA, 16 nt, Staphylococcus aureus subsp. aureus N315
auuuauuguuuuuaaa

SEQ ID NO: 4038906 - RNA, 17 nt, Staphylococcus aureus subsp. aureus N315
auuuauuguuuuuaaaa

SEQ ID NO: 4038907 - RNA, 17 nt, Staphylococcus aureus subsp. aureus N315
auuuauuuauaaaauaa

SEQ ID NO: 4038908 - RNA, 21 nt, Staphylococcus aureus subsp. aureus N315
auuuauuuauaaaauaaaaug

SEQ ID NO: 4038909 - RNA, 13 nt, Staphylococcus aureus subsp. aureus N315
auuuauuuuuaau

SEQ ID NO: 4038910 - RNA, 12 nt, Staphylococcus aureus subsp. aureus N315
auuuauuuuuga

SEQ ID NO: 4038911 - RNA, 15 nt, Staphylococcus aureus subsp. aureus N315
auuucaaaaauagcg

SEQ ID NO: 4038912 - RNA, 15 nt, Staphylococcus aureus subsp. aureus N315
auuucaaaaauagua

SEQ ID NO: 4038913 - RNA, 14 nt, Staphylococcus aureus subsp. aureus N315
auuucaacaaacau

SEQ ID NO: 4038914 - RNA, 17 nt, Staphylococcus aureus subsp. aureus N315
auuucaacaaacauaaa

SEQ ID NO: 4038915 - RNA, 13 nt, Staphylococcus aureus subsp. aureus N315
auuucaacuuaua

SEQ ID NO: 4038916 - RNA, 16 nt, Staphylococcus aureus subsp. aureus N315
auuucaacuuauaaaa

SEQ ID NO: 4038917 - RNA, 15 nt, Staphylococcus aureus subsp. aureus N315
auuucaauuaucaaa

SEQ ID NO: 4038918 - RNA, 15 nt, Staphylococcus aureus subsp. aureus N315
auuucaauuuauguu

SEQ ID NO: 4038919 - RNA, 17 nt, Staphylococcus aureus subsp. aureus N315
auuucaauuuggaaaua

SEQ ID NO: 4038920 - RNA, 23 nt, Staphylococcus aureus subsp. aureus N315
auuucaauuuggaaauaucuuac

SEQ ID NO: 4038921 - RNA, 18 nt, Staphylococcus aureus subsp. aureus N315
auuucacgcugaaauuuu

SEQ ID NO: 4038922 - RNA, 21 nt, Staphylococcus aureus subsp. aureus N315
auuucacgcugaaauuuuuua

SEQ ID NO: 4038923 - RNA, 18 nt, Staphylococcus aureus subsp. aureus N315
auuucacuugaccacuuu

SEQ ID NO: 4038924 - RNA, 14 nt, Staphylococcus aureus subsp. aureus N315
auuucacuuuaacu

SEQ ID NO: 4038925 - RNA, 15 nt, Staphylococcus aureus subsp. aureus N315
auuucacuuuaacuu

SEQ ID NO: 4038926 - RNA, 16 nt, Staphylococcus aureus subsp. aureus N315
auuucacuuuaacuuc

SEQ ID NO: 4038927 - RNA, 22 nt, Staphylococcus aureus subsp. aureus N315
auuucagaacuaugaauagaug

SEQ ID NO: 4038928 - RNA, 13 nt, Staphylococcus aureus subsp. aureus N315
auuucagcaaggu

SEQ ID NO: 4038929 - RNA, 23 nt, Staphylococcus aureus subsp. aureus N315
auuucagcaccgacaauuauaau

SEQ ID NO: 4038930 - RNA, 19 nt, Staphylococcus aureus subsp. aureus N315
auuucagcuuauuaagcuu

SEQ ID NO: 4038931 - RNA, 18 nt, Staphylococcus aureus subsp. aureus N315
auuucauagggaaauauu

SEQ ID NO: 4038932 - RNA, 11 nt, Staphylococcus aureus subsp. aureus N315
auuucaucaaa

SEQ ID NO: 4038933 - RNA, 21 nt, Staphylococcus aureus subsp. aureus N315
auuuguucaaugauuuuauaa

SEQ ID NO: 4038934 - RNA, 16 nt, Staphylococcus aureus subsp. aureus N315
auuuguuguuauuaua

SEQ ID NO: 4038935 - RNA, 24 nt, Staphylococcus aureus subsp. aureus N315
auuuguuuauuaguuauguuaguc

SEQ ID NO: 4038936 - RNA, 16 nt, Staphylococcus aureus subsp. aureus N315
auuuguuuuaaauacu

SEQ ID NO: 4038937 - RNA, 12 nt, Staphylococcus aureus subsp. aureus N315
auuuguuuuagg

SEQ ID NO: 4038938 - RNA, 16 nt, Staphylococcus aureus subsp. aureus N315
auuuuaaaaauaaaaa

SEQ ID NO: 4038939 - RNA, 19 nt, Staphylococcus aureus subsp. aureus N315
auuuuaaaaauucauaauc

SEQ ID NO: 4038940 - RNA, 16 nt, Staphylococcus aureus subsp. aureus N315
auuuuaaaagauaaau

SEQ ID NO: 4038941 - RNA, 14 nt, Staphylococcus aureus subsp. aureus N315
auuuuaaacaugaa

SEQ ID NO: 4038942 - RNA, 19 nt, Staphylococcus aureus subsp. aureus N315
auuuuaaacaugaacaauc

SEQ ID NO: 4038943 - RNA, 20 nt, Staphylococcus aureus subsp. aureus N315
auuuuaaagaaaaguuuaag

SEQ ID NO: 4038944 - RNA, 18 nt, Staphylococcus aureus subsp. aureus N315
auuuuaaauaaaaugcau

SEQ ID NO: 4038945 - RNA, 20 nt, Staphylococcus aureus subsp. aureus N315
auuuuaaauauugauauaaa

SEQ ID NO: 4038946 - RNA, 20 nt, Staphylococcus aureus subsp. aureus N315
auuuuaaaucuaauuauuca

SEQ ID NO: 4038947 - RNA, 13 nt, Staphylococcus aureus subsp. aureus N315
auuuuaaauuaca

SEQ ID NO: 4038948 - RNA, 22 nt, Staphylococcus aureus subsp. aureus N315
auuuuaaauuuaacuaugaaau

SEQ ID NO: 4038949 - RNA, 13 nt, Staphylococcus aureus subsp. aureus N315
auuuuaacuuaua

SEQ ID NO: 4038950 - RNA, 19 nt, Staphylococcus aureus subsp. aureus N315
auuuuaauauugacauuua

SEQ ID NO: 4038951 - RNA, 16 nt, Staphylococcus aureus subsp. aureus N315
auuuuaaucuauccuu

SEQ ID NO: 4038952 - RNA, 21 nt, Staphylococcus aureus subsp. aureus N315
auuuuaaucuauccuucaaaa

SEQ ID NO: 4038953 - RNA, 18 nt, Staphylococcus aureus subsp. aureus N315
auuuuaauuaauuaucau

SEQ ID NO: 4038954 - RNA, 19 nt, Staphylococcus aureus subsp. aureus N315
auuuuaauuaauuauuaua

SEQ ID NO: 4038955 - RNA, 19 nt, Staphylococcus aureus subsp. aureus N315
auuuuaccaucaaugagca

SEQ ID NO: 4038956 - RNA, 17 nt, Staphylococcus aureus subsp. aureus N315
auuuuaccauguuuuac

SEQ ID NO: 4038957 - RNA, 23 nt, Staphylococcus aureus subsp. aureus N315
auuuuaccuguuucuauauuaau

SEQ ID NO: 4038958 - RNA, 23 nt, Staphylococcus aureus subsp. aureus N315
auuuuaccuugagcagcaucaau

SEQ ID NO: 4038959 - RNA, 19 nt, Staphylococcus aureus subsp. aureus N315
auuuuacgaaaauaucauu

SEQ ID NO: 4038960 - RNA, 18 nt, Staphylococcus aureus subsp. aureus N315
auuuuaggcaauguaaug

SEQ ID NO: 4038961 - RNA, 18 nt, Staphylococcus aureus subsp. aureus N315
auuuuagguggcauuuua

SEQ ID NO: 4038962 - RNA, 21 nt, Staphylococcus aureus subsp. aureus N315
auuuuagucgucgaaaugccu

SEQ ID NO: 4038963 - RNA, 15 nt, Staphylococcus aureus subsp. aureus N315
auuuuaguucacaug

SEQ ID NO: 4038964 - RNA, 20 nt, Staphylococcus aureus subsp. aureus N315
auuuuaguucacaugaauuu

SEQ ID NO: 4038965 - RNA, 17 nt, Staphylococcus aureus subsp. aureus N315
auuuuauaaaauauauu

SEQ ID NO: 4038966 - RNA, 18 nt, Staphylococcus aureus subsp. aureus N315
auuuuauaaaauauauuu

SEQ ID NO: 4038967 - RNA, 19 nt, Staphylococcus aureus subsp. aureus N315
auuuuauaaaauauauuua

SEQ ID NO: 4038968 - RNA, 20 nt, Staphylococcus aureus subsp. aureus N315
auuuuauaaaauauauuuaa

SEQ ID NO: 4038969 - RNA, 15 nt, Staphylococcus aureus subsp. aureus N315
auuuuauaaaucaua

SEQ ID NO: 4038970 - RNA, 17 nt, Staphylococcus aureus subsp. aureus N315
auuuuauaaaucauaga

SEQ ID NO: 4038971 - RNA, 13 nt, Staphylococcus aureus subsp. aureus N315
auuuuauaagaau

SEQ ID NO: 4038972 - RNA, 22 nt, Staphylococcus aureus subsp. aureus N315
auuuuauaagaauuuaaaagag

SEQ ID NO: 4038973 - RNA, 14 nt, Staphylococcus aureus subsp. aureus N315
auuuuauauaaaaa

SEQ ID NO: 4038974 - RNA, 12 nt, Staphylococcus aureus subsp. aureus N315
auuuuauauuuu

SEQ ID NO: 4038975 - RNA, 14 nt, Staphylococcus aureus subsp. aureus N315
auuuuaucaaauuc

SEQ ID NO: 4038976 - RNA, 15 nt, Staphylococcus aureus subsp. aureus N315
auuuuaucaaauuca

SEQ ID NO: 4038977 - RNA, 22 nt, Staphylococcus aureus subsp. aureus N315
auuuuaucuaaagcuauaaaaa

SEQ ID NO: 4038978 - RNA, 12 nt, Staphylococcus aureus subsp. aureus N315
auuuuaucucuu

SEQ ID NO: 4038979 - RNA, 15 nt, Staphylococcus aureus subsp. aureus N315
auuuuaucugaaaau

SEQ ID NO: 4038980 - RNA, 13 nt, Staphylococcus aureus subsp. aureus N315
auuuuaucugaau

SEQ ID NO: 4038981 - RNA, 18 nt, Staphylococcus aureus subsp. aureus N315
auuuuaucugaaucugcu

SEQ ID NO: 4038982 - RNA, 15 nt, Staphylococcus aureus subsp. aureus N315
auuuuaugauuugau

SEQ ID NO: 4038983 - RNA, 18 nt, Staphylococcus aureus subsp. aureus N315
auuuuaugauuugauuug

SEQ ID NO: 4038984 - RNA, 14 nt, Staphylococcus aureus subsp. aureus N315
auuuuauuagaaua

SEQ ID NO: 4038985 - RNA, 21 nt, Staphylococcus aureus subsp. aureus N315
auuuuauuagguaauacuuuu

SEQ ID NO: 4038986 - RNA, 13 nt, Staphylococcus aureus subsp. aureus N315
auuuuauuauuaa

SEQ ID NO: 4038987 - RNA, 13 nt, Staphylococcus aureus subsp. aureus N315
auuuuauucuuca

SEQ ID NO: 4038988 - RNA, 23 nt, Staphylococcus aureus subsp. aureus N315
auuuuauugaguaucaugcuuuu

SEQ ID NO: 4038989 - RNA, 15 nt, Staphylococcus aureus subsp. aureus N315
auuuuauuuaaaaau

SEQ ID NO: 4038990 - RNA, 16 nt, Staphylococcus aureus subsp. aureus N315
auuuucaaaacugcca

SEQ ID NO: 4038991 - RNA, 23 nt, Staphylococcus aureus subsp. aureus N315
auuuucaaauuucuaacuuguuu

SEQ ID NO: 4038992 - RNA, 16 nt, Staphylococcus aureus subsp. aureus N315
auuuucaacacacuau

SEQ ID NO: 4038993 - RNA, 19 nt, Staphylococcus aureus subsp. aureus N315
auuuucaagaccaaauauu

SEQ ID NO: 4038994 - RNA, 20 nt, Staphylococcus aureus subsp. aureus N315
auuuucaaguaaugauauua

SEQ ID NO: 4038995 - RNA, 18 nt, Staphylococcus aureus subsp. aureus N315
auuuucaaguuuaaaaua

SEQ ID NO: 4038996 - RNA, 19 nt, Staphylococcus aureus subsp. aureus N315
auuuucaauaaauuuuaua

SEQ ID NO: 4038997 - RNA, 13 nt, Staphylococcus aureus subsp. aureus N315
auuuucaauacuu

SEQ ID NO: 4038998 - RNA, 14 nt, Staphylococcus aureus subsp. aureus N315
auuuucaauuagaa

SEQ ID NO: 4038999 - RNA, 21 nt, Staphylococcus aureus subsp. aureus N315
auuuucacaaucauagauaua

SEQ ID NO: 4039000 - RNA, 23 nt, Staphylococcus aureus subsp. aureus N315
auuuucacaaucauagauauaag

SEQ ID NO: 4039001 - RNA, 23 nt, Staphylococcus aureus subsp. aureus N315
auuuucaguuaaaauaaccauuu

SEQ ID NO: 4039002 - RNA, 15 nt, Staphylococcus aureus subsp. aureus N315
auuuucauaaacucu

SEQ ID NO: 4039003 - RNA, 13 nt, Staphylococcus aureus subsp. aureus N315
auuuucauuuuag

SEQ ID NO: 4039004 - RNA, 15 nt, Staphylococcus aureus subsp. aureus N315
auuuuccaucacaua

SEQ ID NO: 4039005 - RNA, 21 nt, Staphylococcus aureus subsp. aureus N315
auuuucuguuuaauuaaaaua

SEQ ID NO: 4039006 - RNA, 21 nt, Staphylococcus aureus subsp. aureus N315
auuuucuuagaaaaucaaguu

SEQ ID NO: 4039007 - RNA, 20 nt, Staphylococcus aureus subsp. aureus N315
auuuucuucaccaguuucug

SEQ ID NO: 4039008 - RNA, 20 nt, Staphylococcus aureus subsp. aureus N315
auuuucuuuuuuaauucuau

SEQ ID NO: 4039009 - RNA, 21 nt, Staphylococcus aureus subsp. aureus N315
auuuucuuuuuuuauggauuu

SEQ ID NO: 4039010 - RNA, 11 nt, Staphylococcus aureus subsp. aureus N315
auuuugaagaa

SEQ ID NO: 4039011 - RNA, 15 nt, Staphylococcus aureus subsp. aureus N315
auuuugaagaagugc

SEQ ID NO: 4039012 - RNA, 17 nt, Staphylococcus aureus subsp. aureus N315
auuuugaaucacauuaa

SEQ ID NO: 4039013 - RNA, 20 nt, Staphylococcus aureus subsp. aureus N315
auuuugacgccagaauaaau

SEQ ID NO: 4039014 - RNA, 20 nt, Staphylococcus aureus subsp. aureus N315
auuuugacguuuuagacaua

SEQ ID NO: 4039015 - RNA, 14 nt, Staphylococcus aureus subsp. aureus N315
auuuugaguauuug

SEQ ID NO: 4039016 - RNA, 15 nt, Staphylococcus aureus subsp. aureus N315
auuuugauauaaaaa

SEQ ID NO: 4039017 - RNA, 18 nt, Staphylococcus aureus subsp. aureus N315
auuuugauauuuuucacg

SEQ ID NO: 4039018 - RNA, 20 nt, Staphylococcus aureus subsp. aureus N315
auuuugcaauugcaaugaau

SEQ ID NO: 4039019 - RNA, 15 nt, Staphylococcus aureus subsp. aureus N315
auuuuggaacauauu

SEQ ID NO: 4039020 - RNA, 20 nt, Staphylococcus aureus subsp. aureus N315
caaaaguuauauaaauuugu

SEQ ID NO: 4039021 - RNA, 15 nt, Staphylococcus aureus subsp. aureus N315
caaaauaacauguuu

SEQ ID NO: 4039022 - RNA, 18 nt, Staphylococcus aureus subsp. aureus N315
caaaauaauagcaguuuc

SEQ ID NO: 4039023 - RNA, 24 nt, Staphylococcus aureus subsp. aureus N315
caaaauacucaacacgauagucau

SEQ ID NO: 4039024 - RNA, 12 nt, Staphylococcus aureus subsp. aureus N315
caaaauauaaaa

SEQ ID NO: 4039025 - RNA, 14 nt, Staphylococcus aureus subsp. aureus N315
caaaauauaaaauc

SEQ ID NO: 4039026 - RNA, 15 nt, Staphylococcus aureus subsp. aureus N315
caaaauauacuaaau

SEQ ID NO: 4039027 - RNA, 16 nt, Staphylococcus aureus subsp. aureus N315
caaaauauacuaaauu

SEQ ID NO: 4039028 - RNA, 20 nt, Staphylococcus aureus subsp. aureus N315
caaaauauacuaaauuugaa

SEQ ID NO: 4039029 - RNA, 19 nt, Staphylococcus aureus subsp. aureus N315
caaaaucaacccaucaugu

SEQ ID NO: 4039030 - RNA, 18 nt, Staphylococcus aureus subsp. aureus N315
caaaaucucaacagcaaa

SEQ ID NO: 4039031 - RNA, 16 nt, Staphylococcus aureus subsp. aureus N315
caaaaugguuaaaauc

SEQ ID NO: 4039032 - RNA, 17 nt, Staphylococcus aureus subsp. aureus N315
caaaauuauguaaaaaa

SEQ ID NO: 4039033 - RNA, 18 nt, Staphylococcus aureus subsp. aureus N315
caaaauuauguaaaaaau

SEQ ID NO: 4039034 - RNA, 17 nt, Staphylococcus aureus subsp. aureus N315
caaaauugaacuuugua

SEQ ID NO: 4039035 - RNA, 12 nt, Staphylococcus aureus subsp. aureus N315
caaaauugucuc

SEQ ID NO: 4039036 - RNA, 17 nt, Staphylococcus aureus subsp. aureus N315
caaaauuugaaauauac

SEQ ID NO: 4039037 - RNA, 23 nt, Staphylococcus aureus subsp. aureus N315
caaaauuugaaauauaccaacca

SEQ ID NO: 4039038 - RNA, 22 nt, Staphylococcus aureus subsp. aureus N315
caaacaaccugugauaaaaauc

SEQ ID NO: 4039039 - RNA, 12 nt, Staphylococcus aureus subsp. aureus N315
caaacaauacau

SEQ ID NO: 4039040 - RNA, 20 nt, Staphylococcus aureus subsp. aureus N315
caaacaauuuuguacauuuc

SEQ ID NO: 4039041 - RNA, 24 nt, Staphylococcus aureus subsp. aureus N315
caaacacaguacaaauaacaaaca

SEQ ID NO: 4039042 - RNA, 20 nt, Staphylococcus aureus subsp. aureus N315
caaacauuacccuuuaaacu

SEQ ID NO: 4039043 - RNA, 13 nt, Staphylococcus aureus subsp. aureus N315
caaaccaccaaaa

SEQ ID NO: 4039044 - RNA, 13 nt, Staphylococcus aureus subsp. aureus N315
caaaccuuuauau

SEQ ID NO: 4039045 - RNA, 15 nt, Staphylococcus aureus subsp. aureus N315
caaacguuauguaca

SEQ ID NO: 4039046 - RNA, 13 nt, Staphylococcus aureus subsp. aureus N315
caaacguuguuca

SEQ ID NO: 4039047 - RNA, 18 nt, Staphylococcus aureus subsp. aureus N315
caaacugccuaauacacu

SEQ ID NO: 4039048 - RNA, 17 nt, Staphylococcus aureus subsp. aureus N315
caaacuuggcaaugaaa

SEQ ID NO: 4039049 - RNA, 19 nt, Staphylococcus aureus subsp. aureus N315
caaagaaacggaaaugacu

SEQ ID NO: 4039050 - RNA, 20 nt, Staphylococcus aureus subsp. aureus N315
caaagaaagcuaauaucaau

SEQ ID NO: 4039051 - RNA, 15 nt, Staphylococcus aureus subsp. aureus N315
caaagaaaucaccag

SEQ ID NO: 4039052 - RNA, 15 nt, Staphylococcus aureus subsp. aureus N315
caaagaauuucgaaa

SEQ ID NO: 4039053 - RNA, 19 nt, Staphylococcus aureus subsp. aureus N315
caaagacauacagucaaua

SEQ ID NO: 4039054 - RNA, 18 nt, Staphylococcus aureus subsp. aureus N315
caaagaggcuuuaaaauu

SEQ ID NO: 4039055 - RNA, 19 nt, Staphylococcus aureus subsp. aureus N315
caaagauuccuguaacaag

SEQ ID NO: 4039056 - RNA, 22 nt, Staphylococcus aureus subsp. aureus N315
caaagcccuaagcucguuaauu

SEQ ID NO: 4039057 - RNA, 19 nt, Staphylococcus aureus subsp. aureus N315
caaagcuaaguuugaagga

SEQ ID NO: 4039058 - RNA, 18 nt, Staphylococcus aureus subsp. aureus N315
caaagcuauauaugaauu

SEQ ID NO: 4039059 - RNA, 17 nt, Staphylococcus aureus subsp. aureus N315
caaagcugucaacuugu

SEQ ID NO: 4039060 - RNA, 16 nt, Staphylococcus aureus subsp. aureus N315
caaagcuugauuuaac

SEQ ID NO: 4039061 - RNA, 18 nt, Staphylococcus aureus subsp. aureus N315
caaagcuugauuuaacaa

SEQ ID NO: 4039062 - RNA, 15 nt, Staphylococcus aureus subsp. aureus N315
caaaggauauugaaa

SEQ ID NO: 4039063 - RNA, 17 nt, Staphylococcus aureus subsp. aureus N315
caaagggcgaaauggau

SEQ ID NO: 4039064 - RNA, 22 nt, Staphylococcus aureus subsp. aureus N315
caaaguaacaugugcaaguaua

SEQ ID NO: 4039065 - RNA, 19 nt, Staphylococcus aureus subsp. aureus N315
caaaguaauaugagugaaa

SEQ ID NO: 4039066 - RNA, 19 nt, Staphylococcus aureus subsp. aureus N315
caaaguaccaucucuauuu

SEQ ID NO: 4039067 - RNA, 18 nt, Staphylococcus aureus subsp. aureus N315
caaaguagauauugaaug

SEQ ID NO: 4039068 - RNA, 16 nt, Staphylococcus aureus subsp. aureus N315
caaaguauauacuaau

SEQ ID NO: 4039069 - RNA, 17 nt, Staphylococcus aureus subsp. aureus N315
caaagucauuaaaugua

SEQ ID NO: 4039070 - RNA, 17 nt, Staphylococcus aureus subsp. aureus N315
caaagucucuaguaucu

SEQ ID NO: 4039071 - RNA, 16 nt, Staphylococcus aureus subsp. aureus N315
caaagugcaauuauuu

SEQ ID NO: 4039072 - RNA, 21 nt, Staphylococcus aureus subsp. aureus N315
caaaguucguaauugucuuua

SEQ ID NO: 4039073 - RNA, 19 nt, Staphylococcus aureus subsp. aureus N315
caaaguuuauacuuaauau

SEQ ID NO: 4039074 - RNA, 12 nt, Staphylococcus aureus subsp. aureus N315
caaaguuuucau

SEQ ID NO: 4039075 - RNA, 12 nt, Staphylococcus aureus subsp. aureus N315
caaauaaaauca

SEQ ID NO: 4039076 - RNA, 18 nt, Staphylococcus aureus subsp. aureus N315
caaauaaaucaaacuuuu

SEQ ID NO: 4039077 - RNA, 19 nt, Staphylococcus aureus subsp. aureus N315
caaauaaaugacauuuaau

SEQ ID NO: 4039078 - RNA, 20 nt, Staphylococcus aureus subsp. aureus N315
caaauaaauguccgacuuga

SEQ ID NO: 4039079 - RNA, 17 nt, Staphylococcus aureus subsp. aureus N315
caaauaaauuaaauuuu

SEQ ID NO: 4039080 - RNA, 18 nt, Staphylococcus aureus subsp. aureus N315
caaauaaauuaaauuuug

SEQ ID NO: 4039081 - RNA, 15 nt, Staphylococcus aureus subsp. aureus N315
caaauaacaaacauu

SEQ ID NO: 4039082 - RNA, 15 nt, Staphylococcus aureus subsp. aureus N315
caaauaacguuaaua

SEQ ID NO: 4039083 - RNA, 18 nt, Staphylococcus aureus subsp. aureus N315
caaauaaugaugcauaag

SEQ ID NO: 4039084 - RNA, 19 nt, Staphylococcus aureus subsp. aureus N315
caaauaaugugaaaaaucu

SEQ ID NO: 4039085 - RNA, 18 nt, Staphylococcus aureus subsp. aureus N315
caaauacauaaucauugu

SEQ ID NO: 4039086 - RNA, 16 nt, Staphylococcus aureus subsp. aureus N315
caaauacauuucaaaa

SEQ ID NO: 4039087 - RNA, 19 nt, Staphylococcus aureus subsp. aureus N315
caaauacgaguguuuuaau

SEQ ID NO: 4039088 - RNA, 15 nt, Staphylococcus aureus subsp. aureus N315
caaauagacaccaaa

SEQ ID NO: 4039089 - RNA, 18 nt, Staphylococcus aureus subsp. aureus N315
caaauagacaccaaaaaa

SEQ ID NO: 4039090 - RNA, 21 nt, Staphylococcus aureus subsp. aureus N315
caaauaguuaagauuuuaacu

SEQ ID NO: 4039091 - RNA, 21 nt, Staphylococcus aureus subsp. aureus N315
caaauauaauguauaaaacag

SEQ ID NO: 4039092 - RNA, 21 nt, Staphylococcus aureus subsp. aureus N315
caaauauacuugccuucaaau

SEQ ID NO: 4039093 - RNA, 17 nt, Staphylococcus aureus subsp. aureus N315
caaauaucaguaauaau

SEQ ID NO: 4039094 - RNA, 18 nt, Staphylococcus aureus subsp. aureus N315
caaauaucaguaauaaua

SEQ ID NO: 4039095 - RNA, 13 nt, Staphylococcus aureus subsp. aureus N315
caaauaugagugg

SEQ ID NO: 4039096 - RNA, 19 nt, Staphylococcus aureus subsp. aureus N315
caaauauuagaacauuuau

SEQ ID NO: 4039097 - RNA, 14 nt, Staphylococcus aureus subsp. aureus N315
caaauauuucuaaa

SEQ ID NO: 4039098 - RNA, 14 nt, Staphylococcus aureus subsp. aureus N315
caaaucaaauacau

SEQ ID NO: 4039099 - RNA, 23 nt, Staphylococcus aureus subsp. aureus N315
caaaucgauuaauuauaaguagu

SEQ ID NO: 4039100 - RNA, 20 nt, Staphylococcus aureus subsp. aureus N315
caaaucggaauaaaauaaau

SEQ ID NO: 4039101 - RNA, 23 nt, Staphylococcus aureus subsp. aureus N315
caaaucggcuauacauugauaaa

SEQ ID NO: 4039102 - RNA, 19 nt, Staphylococcus aureus subsp. aureus N315
caaaucucgucacauauaa

SEQ ID NO: 4039103 - RNA, 14 nt, Staphylococcus aureus subsp. aureus N315
caaaucuuuuaaau

SEQ ID NO: 4039104 - RNA, 20 nt, Staphylococcus aureus subsp. aureus N315
caaaugaaaaaguaaaaucu

SEQ ID NO: 4039105 - RNA, 22 nt, Staphylococcus aureus subsp. aureus N315
caaaugaaaaaguaaaaucuuu

SEQ ID NO: 4039106 - RNA, 15 nt, Staphylococcus aureus subsp. aureus N315
caaaugaaauucuuu

SEQ ID NO: 4039107 - RNA, 22 nt, Staphylococcus aureus subsp. aureus N315
caacuaauuuaaagcaucauau

SEQ ID NO: 4039108 - RNA, 21 nt, Staphylococcus aureus subsp. aureus N315
caacuacugucaauauaacau

SEQ ID NO: 4039109 - RNA, 15 nt, Staphylococcus aureus subsp. aureus N315
caacuacuuaaauua

SEQ ID NO: 4039110 - RNA, 19 nt, Staphylococcus aureus subsp. aureus N315
caacuacuuaaauuaagaa

SEQ ID NO: 4039111 - RNA, 15 nt, Staphylococcus aureus subsp. aureus N315
caacuauaugugucg

SEQ ID NO: 4039112 - RNA, 14 nt, Staphylococcus aureus subsp. aureus N315
caacucuaacagcu

SEQ ID NO: 4039113 - RNA, 16 nt, Staphylococcus aureus subsp. aureus N315
caacugaaauuuuucc

SEQ ID NO: 4039114 - RNA, 17 nt, Staphylococcus aureus subsp. aureus N315
caacugagaaaucuuaa

SEQ ID NO: 4039115 - RNA, 21 nt, Staphylococcus aureus subsp. aureus N315
caacugauaauugaugugccu

SEQ ID NO: 4039116 - RNA, 16 nt, Staphylococcus aureus subsp. aureus N315
caacugcgacaugucc

SEQ ID NO: 4039117 - RNA, 20 nt, Staphylococcus aureus subsp. aureus N315
caacuguaguggaagacaau

SEQ ID NO: 4039118 - RNA, 18 nt, Staphylococcus aureus subsp. aureus N315
caacugucgguucaucua

SEQ ID NO: 4039119 - RNA, 13 nt, Staphylococcus aureus subsp. aureus N315
caacuuaauaacc

SEQ ID NO: 4039120 - RNA, 22 nt, Staphylococcus aureus subsp. aureus N315
caacuuaauaaccauguaaaau

SEQ ID NO: 4039121 - RNA, 18 nt, Staphylococcus aureus subsp. aureus N315
caacuuaauacgauaaua

SEQ ID NO: 4039122 - RNA, 22 nt, Staphylococcus aureus subsp. aureus N315
caacuuaauacgauaauaacua

SEQ ID NO: 4039123 - RNA, 13 nt, Staphylococcus aureus subsp. aureus N315
caacuuagaauuu

SEQ ID NO: 4039124 - RNA, 16 nt, Staphylococcus aureus subsp. aureus N315
caacuuauaaaaugaa

SEQ ID NO: 4039125 - RNA, 15 nt, Staphylococcus aureus subsp. aureus N315
caacuuauaauauua

SEQ ID NO: 4039126 - RNA, 13 nt, Staphylococcus aureus subsp. aureus N315
caacuuauuauuu

SEQ ID NO: 4039127 - RNA, 15 nt, Staphylococcus aureus subsp. aureus N315
caacuuauucuucac

SEQ ID NO: 4039128 - RNA, 19 nt, Staphylococcus aureus subsp. aureus N315
caacuucacgcaaaacaau

SEQ ID NO: 4039129 - RNA, 23 nt, Staphylococcus aureus subsp. aureus N315
caacuucuucuccguauuuaccu

SEQ ID NO: 4039130 - RNA, 16 nt, Staphylococcus aureus subsp. aureus N315
caacuucuuucguuuc

SEQ ID NO: 4039131 - RNA, 19 nt, Staphylococcus aureus subsp. aureus N315
caacuugcacacuauugua

SEQ ID NO: 4039132 - RNA, 18 nt, Staphylococcus aureus subsp. aureus N315
caacuuguauuguuugua

SEQ ID NO: 4039133 - RNA, 17 nt, Staphylococcus aureus subsp. aureus N315
caacuugugguuggaag

SEQ ID NO: 4039134 - RNA, 18 nt, Staphylococcus aureus subsp. aureus N315
caacuuuaagacuuugau

SEQ ID NO: 4039135 - RNA, 19 nt, Staphylococcus aureus subsp. aureus N315
caacuuuaauuuuucauua

SEQ ID NO: 4039136 - RNA, 15 nt, Staphylococcus aureus subsp. aureus N315
caacuuuacgauaaa

SEQ ID NO: 4039137 - RNA, 14 nt, Staphylococcus aureus subsp. aureus N315
caacuuuaguuguu

SEQ ID NO: 4039138 - RNA, 22 nt, Staphylococcus aureus subsp. aureus N315
caacuuuguuuucaguaacuga

SEQ ID NO: 4039139 - RNA, 15 nt, Staphylococcus aureus subsp. aureus N315
caacuuuuagaguuu

SEQ ID NO: 4039140 - RNA, 21 nt, Staphylococcus aureus subsp. aureus N315
caacuuuuagaguuuuuauua

SEQ ID NO: 4039141 - RNA, 18 nt, Staphylococcus aureus subsp. aureus N315
caacuuuucaaagccaca

SEQ ID NO: 4039142 - RNA, 13 nt, Staphylococcus aureus subsp. aureus N315
caacuuuucauau

SEQ ID NO: 4039143 - RNA, 16 nt, Staphylococcus aureus subsp. aureus N315
caacuuuuuaauaaua

SEQ ID NO: 4039144 - RNA, 23 nt, Staphylococcus aureus subsp. aureus N315
caacuuuuuuaacagcugcaguc

SEQ ID NO: 4039145 - RNA, 19 nt, Staphylococcus aureus subsp. aureus N315
caagaaacaauucauuaau

SEQ ID NO: 4039146 - RNA, 20 nt, Staphylococcus aureus subsp. aureus N315
caagaaacaauucauuaaua

SEQ ID NO: 4039147 - RNA, 17 nt, Staphylococcus aureus subsp. aureus N315
caagaaauguuaaauua

SEQ ID NO: 4039148 - RNA, 22 nt, Staphylococcus aureus subsp. aureus N315
caagaauuauggcagauccaua

SEQ ID NO: 4039149 - RNA, 23 nt, Staphylococcus aureus subsp. aureus N315
caagaauuauggcagauccauaa

SEQ ID NO: 4039150 - RNA, 18 nt, Staphylococcus aureus subsp. aureus N315
caagaccaugcaaacuca

SEQ ID NO: 4039151 - RNA, 17 nt, Staphylococcus aureus subsp. aureus N315
caagacucccuuuuuaa

SEQ ID NO: 4039152 - RNA, 19 nt, Staphylococcus aureus subsp. aureus N315
caagacucccuuuuuaaaa

SEQ ID NO: 4039153 - RNA, 22 nt, Staphylococcus aureus subsp. aureus N315
caagacucccuuuuuaaaauac

SEQ ID NO: 4039154 - RNA, 19 nt, Staphylococcus aureus subsp. aureus N315
caagagaauuaauaauuuu

SEQ ID NO: 4039155 - RNA, 16 nt, Staphylococcus aureus subsp. aureus N315
caagagauaagaaaau

SEQ ID NO: 4039156 - RNA, 22 nt, Staphylococcus aureus subsp. aureus N315
caagagccuuguuggcuuuuuu

SEQ ID NO: 4039157 - RNA, 16 nt, Staphylococcus aureus subsp. aureus N315
caagagguaaaucugu

SEQ ID NO: 4039158 - RNA, 21 nt, Staphylococcus aureus subsp. aureus N315
caagagguaaaucuguuuaaa

SEQ ID NO: 4039159 - RNA, 14 nt, Staphylococcus aureus subsp. aureus N315
caagauaaaucauc

SEQ ID NO: 4039160 - RNA, 20 nt, Staphylococcus aureus subsp. aureus N315
caagaugcucauugcauuuc

SEQ ID NO: 4039161 - RNA, 18 nt, Staphylococcus aureus subsp. aureus N315
caagaugguauugcuuua

SEQ ID NO: 4039162 - RNA, 16 nt, Staphylococcus aureus subsp. aureus N315
caagauuaugacaaca

SEQ ID NO: 4039163 - RNA, 21 nt, Staphylococcus aureus subsp. aureus N315
caagauuaugacaacauaaca

SEQ ID NO: 4039164 - RNA, 12 nt, Staphylococcus aureus subsp. aureus N315
caagauuccauc

SEQ ID NO: 4039165 - RNA, 23 nt, Staphylococcus aureus subsp. aureus N315
caagauuccaucacgauauguug

SEQ ID NO: 4039166 - RNA, 13 nt, Staphylococcus aureus subsp. aureus N315
caagcaaucuuag

SEQ ID NO: 4039167 - RNA, 15 nt, Staphylococcus aureus subsp. aureus N315
caagccaagauaaau

SEQ ID NO: 4039168 - RNA, 22 nt, Staphylococcus aureus subsp. aureus N315
caagcuuaauaagcugaaauaa

SEQ ID NO: 4039169 - RNA, 16 nt, Staphylococcus aureus subsp. aureus N315
caagcuuuuuaggaau

SEQ ID NO: 4039170 - RNA, 14 nt, Staphylococcus aureus subsp. aureus N315
caagcuuuuuucaa

SEQ ID NO: 4039171 - RNA, 16 nt, Staphylococcus aureus subsp. aureus N315
caaggaaaucauauau

SEQ ID NO: 4039172 - RNA, 20 nt, Staphylococcus aureus subsp. aureus N315
caaggaagucaccauauuua

SEQ ID NO: 4039173 - RNA, 16 nt, Staphylococcus aureus subsp. aureus N315
caaggauguuauaaaa

SEQ ID NO: 4039174 - RNA, 18 nt, Staphylococcus aureus subsp. aureus N315
caaggauguuauaaaaug

SEQ ID NO: 4039175 - RNA, 16 nt, Staphylococcus aureus subsp. aureus N315
caaggauugaaaaaag

SEQ ID NO: 4039176 - RNA, 21 nt, Staphylococcus aureus subsp. aureus N315
caagguguucgggaauuuuuu

SEQ ID NO: 4039177 - RNA, 15 nt, Staphylococcus aureus subsp. aureus N315
caagguuuucgccaa

SEQ ID NO: 4039178 - RNA, 13 nt, Staphylococcus aureus subsp. aureus N315
caaguaaauguuu

SEQ ID NO: 4039179 - RNA, 15 nt, Staphylococcus aureus subsp. aureus N315
caaguaaauguuuua

SEQ ID NO: 4039180 - RNA, 20 nt, Staphylococcus aureus subsp. aureus N315
caaguaugagacgcauugca

SEQ ID NO: 4039181 - RNA, 14 nt, Staphylococcus aureus subsp. aureus N315
caagucauuaucca

SEQ ID NO: 4039182 - RNA, 13 nt, Staphylococcus aureus subsp. aureus N315
caaguccaaauaa

SEQ ID NO: 4039183 - RNA, 17 nt, Staphylococcus aureus subsp. aureus N315
caagucuaguucgaaca

SEQ ID NO: 4039184 - RNA, 18 nt, Staphylococcus aureus subsp. aureus N315
caagucuucuaaaaaauc

SEQ ID NO: 4039185 - RNA, 22 nt, Staphylococcus aureus subsp. aureus N315
caagucuuuacucuacacucaa

SEQ ID NO: 4039186 - RNA, 14 nt, Staphylococcus aureus subsp. aureus N315
caagugcagauguu

SEQ ID NO: 4039187 - RNA, 15 nt, Staphylococcus aureus subsp. aureus N315
caagugguaaaaaug

SEQ ID NO: 4039188 - RNA, 17 nt, Staphylococcus aureus subsp. aureus N315
caaguguaguaaaaauc

SEQ ID NO: 4039189 - RNA, 18 nt, Staphylococcus aureus subsp. aureus N315
caaguguaucgcccauac

SEQ ID NO: 4039190 - RNA, 20 nt, Staphylococcus aureus subsp. aureus N315
caagugucaaauacguauca

SEQ ID NO: 4039191 - RNA, 17 nt, Staphylococcus aureus subsp. aureus N315
caaguugcacauuauaa

SEQ ID NO: 4039192 - RNA, 19 nt, Staphylococcus aureus subsp. aureus N315
caaguugcugaauaaaaua

SEQ ID NO: 4039193 - RNA, 22 nt, Staphylococcus aureus subsp. aureus N315
caaguugcugaauaaaauauau

SEQ ID NO: 4039194 - RNA, 18 nt, Staphylococcus aureus subsp. aureus N315
caaugauugaauauuguu

SEQ ID NO: 4039195 - RNA, 14 nt, Staphylococcus aureus subsp. aureus N315
caaugauuuuauaa

SEQ ID NO: 4039196 - RNA, 15 nt, Staphylococcus aureus subsp. aureus N315
caaugauuuuuaaaa

SEQ ID NO: 4039197 - RNA, 18 nt, Staphylococcus aureus subsp. aureus N315
caaugauuuuuaaaaaua

SEQ ID NO: 4039198 - RNA, 15 nt, Staphylococcus aureus subsp. aureus N315
caaugcaaguuggcg

SEQ ID NO: 4039199 - RNA, 18 nt, Staphylococcus aureus subsp. aureus N315
caaugcgguaaaaacucu

SEQ ID NO: 4039200 - RNA, 17 nt, Staphylococcus aureus subsp. aureus N315
caaugcugauaccuaag

SEQ ID NO: 4039201 - RNA, 15 nt, Staphylococcus aureus subsp. aureus N315
caauggaucuguuac

SEQ ID NO: 4039202 - RNA, 16 nt, Staphylococcus aureus subsp. aureus N315
caauggaucuguuaca

SEQ ID NO: 4039203 - RNA, 15 nt, Staphylococcus aureus subsp. aureus N315
caauggcagaugauu

SEQ ID NO: 4039204 - RNA, 18 nt, Staphylococcus aureus subsp. aureus N315
caauggcagaugauuaug

SEQ ID NO: 4039205 - RNA, 20 nt, Staphylococcus aureus subsp. aureus N315
caauggcagaugauuauguu

SEQ ID NO: 4039206 - RNA, 13 nt, Staphylococcus aureus subsp. aureus N315
caauguauauuua

SEQ ID NO: 4039207 - RNA, 17 nt, Staphylococcus aureus subsp. aureus N315
caaugugagauauaaag

SEQ ID NO: 4039208 - RNA, 21 nt, Staphylococcus aureus subsp. aureus N315
caauguuaggugcuugguuaa

SEQ ID NO: 4039209 - RNA, 23 nt, Staphylococcus aureus subsp. aureus N315
caauguugcauccccagccauuu

SEQ ID NO: 4039210 - RNA, 23 nt, Staphylococcus aureus subsp. aureus N315
caauguuuaauuuucuaaauaua

SEQ ID NO: 4039211 - RNA, 13 nt, Staphylococcus aureus subsp. aureus N315
caauguuuuaaau

SEQ ID NO: 4039212 - RNA, 15 nt, Staphylococcus aureus subsp. aureus N315
caauuaaaacuauaa

SEQ ID NO: 4039213 - RNA, 19 nt, Staphylococcus aureus subsp. aureus N315
caauuaaaacuauaauaaa

SEQ ID NO: 4039214 - RNA, 15 nt, Staphylococcus aureus subsp. aureus N315
caauuaaagugaaua

SEQ ID NO: 4039215 - RNA, 13 nt, Staphylococcus aureus subsp. aureus N315
caauuaaaucgau

SEQ ID NO: 4039216 - RNA, 13 nt, Staphylococcus aureus subsp. aureus N315
caauuaauaaaca

SEQ ID NO: 4039217 - RNA, 20 nt, Staphylococcus aureus subsp. aureus N315
caauuacucuuuuucuuuca

SEQ ID NO: 4039218 - RNA, 23 nt, Staphylococcus aureus subsp. aureus N315
caauuagaaaacaucuuacugcu

SEQ ID NO: 4039219 - RNA, 13 nt, Staphylococcus aureus subsp. aureus N315
caauuagaaaaua

SEQ ID NO: 4039220 - RNA, 22 nt, Staphylococcus aureus subsp. aureus N315
caauuagccccaguauagaagc

SEQ ID NO: 4039221 - RNA, 12 nt, Staphylococcus aureus subsp. aureus N315
caauuaguucug

SEQ ID NO: 4039222 - RNA, 14 nt, Staphylococcus aureus subsp. aureus N315
caauuaucaaacgg

SEQ ID NO: 4039223 - RNA, 18 nt, Staphylococcus aureus subsp. aureus N315
caauuaucaacauaauau

SEQ ID NO: 4039224 - RNA, 14 nt, Staphylococcus aureus subsp. aureus N315
caauuauggauaaa

SEQ ID NO: 4039225 - RNA, 19 nt, Staphylococcus aureus subsp. aureus N315
caauuauugaaaacaaaaa

SEQ ID NO: 4039226 - RNA, 13 nt, Staphylococcus aureus subsp. aureus N315
caauuauuucauc

SEQ ID NO: 4039227 - RNA, 13 nt, Staphylococcus aureus subsp. aureus N315
caauucauaagaa

SEQ ID NO: 4039228 - RNA, 14 nt, Staphylococcus aureus subsp. aureus N315
caauuccuuggugu

SEQ ID NO: 4039229 - RNA, 15 nt, Staphylococcus aureus subsp. aureus N315
caauucgcgucauuu

SEQ ID NO: 4039230 - RNA, 17 nt, Staphylococcus aureus subsp. aureus N315
caauucggauuauauuu

SEQ ID NO: 4039231 - RNA, 20 nt, Staphylococcus aureus subsp. aureus N315
caauucucuuaucuugauuu

SEQ ID NO: 4039232 - RNA, 12 nt, Staphylococcus aureus subsp. aureus N315
caauucuucaau

SEQ ID NO: 4039233 - RNA, 15 nt, Staphylococcus aureus subsp. aureus N315
caauugaagugaaau

SEQ ID NO: 4039234 - RNA, 20 nt, Staphylococcus aureus subsp. aureus N315
caauugaaucuuuguuauau

SEQ ID NO: 4039235 - RNA, 13 nt, Staphylococcus aureus subsp. aureus N315
caauugauugcuc

SEQ ID NO: 4039236 - RNA, 12 nt, Staphylococcus aureus subsp. aureus N315
caauugcaauga

SEQ ID NO: 4039237 - RNA, 15 nt, Staphylococcus aureus subsp. aureus N315
caauugcaaugaaua

SEQ ID NO: 4039238 - RNA, 13 nt, Staphylococcus aureus subsp. aureus N315
caauuuaaauaag

SEQ ID NO: 4039239 - RNA, 19 nt, Staphylococcus aureus subsp. aureus N315
caauuuaaauaaguuacuc

SEQ ID NO: 4039240 - RNA, 15 nt, Staphylococcus aureus subsp. aureus N315
caauuuaauagacau

SEQ ID NO: 4039241 - RNA, 17 nt, Staphylococcus aureus subsp. aureus N315
caauuuaauagacauua

SEQ ID NO: 4039242 - RNA, 18 nt, Staphylococcus aureus subsp. aureus N315
caauuuaauagacauuaa

SEQ ID NO: 4039243 - RNA, 19 nt, Staphylococcus aureus subsp. aureus N315
caauuuaguauaaauaaaa

SEQ ID NO: 4039244 - RNA, 20 nt, Staphylococcus aureus subsp. aureus N315
caauuuauguaaauucaaaa

SEQ ID NO: 4039245 - RNA, 19 nt, Staphylococcus aureus subsp. aureus N315
caauuuauuaacuguguau

SEQ ID NO: 4039246 - RNA, 17 nt, Staphylococcus aureus subsp. aureus N315
caauuuauuauuaacug

SEQ ID NO: 4039247 - RNA, 15 nt, Staphylococcus aureus subsp. aureus N315
caauuucauuugaaa

SEQ ID NO: 4039248 - RNA, 12 nt, Staphylococcus aureus subsp. aureus N315
caauuucucuau

SEQ ID NO: 4039249 - RNA, 15 nt, Staphylococcus aureus subsp. aureus N315
caauuuggaaauauc

SEQ ID NO: 4039250 - RNA, 20 nt, Staphylococcus aureus subsp. aureus N315
caauuuguaacuauugaaaa

SEQ ID NO: 4039251 - RNA, 22 nt, Staphylococcus aureus subsp. aureus N315
caauuuguccuucgcuaugacc

SEQ ID NO: 4039252 - RNA, 17 nt, Staphylococcus aureus subsp. aureus N315
caauuuuaaaucuuuua

SEQ ID NO: 4039253 - RNA, 23 nt, Staphylococcus aureus subsp. aureus N315
caauuuuaccuucgcauacuuuu

SEQ ID NO: 4039254 - RNA, 21 nt, Staphylococcus aureus subsp. aureus N315
caauuuuaucugaaucugcua

SEQ ID NO: 4039255 - RNA, 23 nt, Staphylococcus aureus subsp. aureus N315
caauuuuccguguuuauuuuuau

SEQ ID NO: 4039256 - RNA, 16 nt, Staphylococcus aureus subsp. aureus N315
caauuuuuaaaaaccu

SEQ ID NO: 4039257 - RNA, 23 nt, Staphylococcus aureus subsp. aureus N315
caauuuuuaaaaaccuagggaua

SEQ ID NO: 4039258 - RNA, 14 nt, Staphylococcus aureus subsp. aureus N315
caauuuuuaacaaa

SEQ ID NO: 4039259 - RNA, 16 nt, Staphylococcus aureus subsp. aureus N315
caauuuuuaacaaaau

SEQ ID NO: 4039260 - RNA, 18 nt, Staphylococcus aureus subsp. aureus N315
caauuuuuacuaaaucau

SEQ ID NO: 4039261 - RNA, 19 nt, Staphylococcus aureus subsp. aureus N315
caauuuuucacuuauaaca

SEQ ID NO: 4039262 - RNA, 15 nt, Staphylococcus aureus subsp. aureus N315
caauuuuuucaucuu

SEQ ID NO: 4039263 - RNA, 21 nt, Staphylococcus aureus subsp. aureus N315
caauuuuuucaugauuuacua

SEQ ID NO: 4039264 - RNA, 14 nt, Staphylococcus aureus subsp. aureus N315
cacaaaaaugaaga

SEQ ID NO: 4039265 - RNA, 19 nt, Staphylococcus aureus subsp. aureus N315
cacaaagauauguuuauau

SEQ ID NO: 4039266 - RNA, 14 nt, Staphylococcus aureus subsp. aureus N315
cacaaauaaaggca

SEQ ID NO: 4039267 - RNA, 21 nt, Staphylococcus aureus subsp. aureus N315
cacaacaaucacgauuaaugu

SEQ ID NO: 4039268 - RNA, 14 nt, Staphylococcus aureus subsp. aureus N315
cacaacacauaaau

SEQ ID NO: 4039269 - RNA, 17 nt, Staphylococcus aureus subsp. aureus N315
cacaacacauaaauuaa

SEQ ID NO: 4039270 - RNA, 23 nt, Staphylococcus aureus subsp. aureus N315
cacaacauguuuggaugaacaaa

SEQ ID NO: 4039271 - RNA, 16 nt, Staphylococcus aureus subsp. aureus N315
cacaaccagucagaaa

SEQ ID NO: 4039272 - RNA, 21 nt, Staphylococcus aureus subsp. aureus N315
cacaacgauagauaucauuuu

SEQ ID NO: 4039273 - RNA, 22 nt, Staphylococcus aureus subsp. aureus N315
cacaagcaucuacaauauucaa

SEQ ID NO: 4039274 - RNA, 23 nt, Staphylococcus aureus subsp. aureus N315
cacaaguuuacagguugaauaaa

SEQ ID NO: 4039275 - RNA, 17 nt, Staphylococcus aureus subsp. aureus N315
cacaauaauccaagaua

SEQ ID NO: 4039276 - RNA, 21 nt, Staphylococcus aureus subsp. aureus N315
cacaauaccuguccaaauaaa

SEQ ID NO: 4039277 - RNA, 19 nt, Staphylococcus aureus subsp. aureus N315
cacaauauuuaccacaaau

SEQ ID NO: 4039278 - RNA, 20 nt, Staphylococcus aureus subsp. aureus N315
cacacagguaaauuuaaaau

SEQ ID NO: 4039279 - RNA, 13 nt, Staphylococcus aureus subsp. aureus N315
cacacaugauaau

SEQ ID NO: 4039280 - RNA, 15 nt, Staphylococcus aureus subsp. aureus N315
cacacaugauaauuu

SEQ ID NO: 4039281 - RNA, 18 nt, Staphylococcus aureus subsp. aureus N315
cacaccccaacucgcauu

SEQ ID NO: 4039282 - RNA, 13 nt, Staphylococcus aureus subsp. aureus N315
cacuauuuuuaaa

SEQ ID NO: 4039283 - RNA, 14 nt, Staphylococcus aureus subsp. aureus N315
cacuauuuuuaaau

SEQ ID NO: 4039284 - RNA, 17 nt, Staphylococcus aureus subsp. aureus N315
cacucaauucucuaacu

SEQ ID NO: 4039285 - RNA, 15 nt, Staphylococcus aureus subsp. aureus N315
cacucacuucaacgu

SEQ ID NO: 4039286 - RNA, 18 nt, Staphylococcus aureus subsp. aureus N315
cacucauaaccgcuucuu

SEQ ID NO: 4039287 - RNA, 19 nt, Staphylococcus aureus subsp. aureus N315
cacucauaaccgcuucuuu

SEQ ID NO: 4039288 - RNA, 20 nt, Staphylococcus aureus subsp. aureus N315
cacucauaaucaagucugca

SEQ ID NO: 4039289 - RNA, 15 nt, Staphylococcus aureus subsp. aureus N315
cacucauucaauuua

SEQ ID NO: 4039290 - RNA, 22 nt, Staphylococcus aureus subsp. aureus N315
cacuccucuauuuuaugauuug

SEQ ID NO: 4039291 - RNA, 18 nt, Staphylococcus aureus subsp. aureus N315
cacuccuuaaacaaauaa

SEQ ID NO: 4039292 - RNA, 19 nt, Staphylococcus aureus subsp. aureus N315
cacucuuacucauuuuucu

SEQ ID NO: 4039293 - RNA, 17 nt, Staphylococcus aureus subsp. aureus N315
cacugagaauuucuaau

SEQ ID NO: 4039294 - RNA, 17 nt, Staphylococcus aureus subsp. aureus N315
cacugagcaacaaaaga

SEQ ID NO: 4039295 - RNA, 14 nt, Staphylococcus aureus subsp. aureus N315
cacugcaacauuug

SEQ ID NO: 4039296 - RNA, 20 nt, Staphylococcus aureus subsp. aureus N315
cacugcacaucauaauaaau

SEQ ID NO: 4039297 - RNA, 14 nt, Staphylococcus aureus subsp. aureus N315
cacugccuuuuugu

SEQ ID NO: 4039298 - RNA, 22 nt, Staphylococcus aureus subsp. aureus N315
cacuguaacgaguccauuuucu

SEQ ID NO: 4039299 - RNA, 18 nt, Staphylococcus aureus subsp. aureus N315
cacuguuuuauaaaugaa

SEQ ID NO: 4039300 - RNA, 13 nt, Staphylococcus aureus subsp. aureus N315
cacuuaacucaaa

SEQ ID NO: 4039301 - RNA, 16 nt, Staphylococcus aureus subsp. aureus N315
cacuuaagcuuuaauc

SEQ ID NO: 4039302 - RNA, 17 nt, Staphylococcus aureus subsp. aureus N315
cacuuaauaaauaauuu

SEQ ID NO: 4039303 - RNA, 19 nt, Staphylococcus aureus subsp. aureus N315
cacuuacugugaaaauacc

SEQ ID NO: 4039304 - RNA, 14 nt, Staphylococcus aureus subsp. aureus N315
cacuuaucaucaca

SEQ ID NO: 4039305 - RNA, 14 nt, Staphylococcus aureus subsp. aureus N315
cacuucaaaagaaa

SEQ ID NO: 4039306 - RNA, 18 nt, Staphylococcus aureus subsp. aureus N315
cacuucaucuaaaugaug

SEQ ID NO: 4039307 - RNA, 17 nt, Staphylococcus aureus subsp. aureus N315
cacuuccaucaauccaa

SEQ ID NO: 4039308 - RNA, 14 nt, Staphylococcus aureus subsp. aureus N315
cacuucgccaagcc

SEQ ID NO: 4039309 - RNA, 19 nt, Staphylococcus aureus subsp. aureus N315
cacuucgccaagccaucuu

SEQ ID NO: 4039310 - RNA, 23 nt, Staphylococcus aureus subsp. aureus N315
cacuucgccaagccaucuuucuu

SEQ ID NO: 4039311 - RNA, 20 nt, Staphylococcus aureus subsp. aureus N315
cacuugaauacuuuuuaacu

SEQ ID NO: 4039312 - RNA, 17 nt, Staphylococcus aureus subsp. aureus N315
cacuugaccacuuuugu

SEQ ID NO: 4039313 - RNA, 17 nt, Staphylococcus aureus subsp. aureus N315
cacuuggauucaaauga

SEQ ID NO: 4039314 - RNA, 23 nt, Staphylococcus aureus subsp. aureus N315
cacuuggcuuaggaugaaaauau

SEQ ID NO: 4039315 - RNA, 13 nt, Staphylococcus aureus subsp. aureus N315
cacuugguacacc

SEQ ID NO: 4039316 - RNA, 19 nt, Staphylococcus aureus subsp. aureus N315
cacuuuaaacaagcaucau

SEQ ID NO: 4039317 - RNA, 16 nt, Staphylococcus aureus subsp. aureus N315
cacuuuauaauuuuug

SEQ ID NO: 4039318 - RNA, 21 nt, Staphylococcus aureus subsp. aureus N315
cacuuucaguaauuguuacua

SEQ ID NO: 4039319 - RNA, 15 nt, Staphylococcus aureus subsp. aureus N315
cacuuucuacucuga

SEQ ID NO: 4039320 - RNA, 19 nt, Staphylococcus aureus subsp. aureus N315
cacuuuuagaaucaaccgu

SEQ ID NO: 4039321 - RNA, 19 nt, Staphylococcus aureus subsp. aureus N315
cacuuuuauggagugauau

SEQ ID NO: 4039322 - RNA, 16 nt, Staphylococcus aureus subsp. aureus N315
cacuuuuguuaaaaaa

SEQ ID NO: 4039323 - RNA, 18 nt, Staphylococcus aureus subsp. aureus N315
cacuuuuguuaaaaaaug

SEQ ID NO: 4039324 - RNA, 13 nt, Staphylococcus aureus subsp. aureus N315
cacuuuuuaaacg

SEQ ID NO: 4039325 - RNA, 20 nt, Staphylococcus aureus subsp. aureus N315
cacuuuuugacauauuuuuu

SEQ ID NO: 4039326 - RNA, 18 nt, Staphylococcus aureus subsp. aureus N315
cacuuuuuuguucaauca

SEQ ID NO: 4039327 - RNA, 22 nt, Staphylococcus aureus subsp. aureus N315
cagaaaagcagucgaacaauga

SEQ ID NO: 4039328 - RNA, 17 nt, Staphylococcus aureus subsp. aureus N315
cagaaaagggcaaaaaa

SEQ ID NO: 4039329 - RNA, 20 nt, Staphylococcus aureus subsp. aureus N315
cagaaaagggcaaaaaagga

SEQ ID NO: 4039330 - RNA, 12 nt, Staphylococcus aureus subsp. aureus N315
cagaaaguugca

SEQ ID NO: 4039331 - RNA, 15 nt, Staphylococcus aureus subsp. aureus N315
cagaaauuuaauauu

SEQ ID NO: 4039332 - RNA, 21 nt, Staphylococcus aureus subsp. aureus N315
cagaaauuuaauauuguuaau

SEQ ID NO: 4039333 - RNA, 21 nt, Staphylococcus aureus subsp. aureus N315
cagaacuacaauucauaagaa

SEQ ID NO: 4039334 - RNA, 19 nt, Staphylococcus aureus subsp. aureus N315
cagaacuaugaauagauga

SEQ ID NO: 4039335 - RNA, 21 nt, Staphylococcus aureus subsp. aureus N315
cagaagaaaacuauuuuaaaa

SEQ ID NO: 4039336 - RNA, 20 nt, Staphylococcus aureus subsp. aureus N315
cagaaugaacuucucuuagu

SEQ ID NO: 4039337 - RNA, 15 nt, Staphylococcus aureus subsp. aureus N315
cagaauuucaucaaa

SEQ ID NO: 4039338 - RNA, 17 nt, Staphylococcus aureus subsp. aureus N315
cagacaaccgauauaau

SEQ ID NO: 4039339 - RNA, 23 nt, Staphylococcus aureus subsp. aureus N315
cagacgaaacacacuaaaagcug

SEQ ID NO: 4039340 - RNA, 16 nt, Staphylococcus aureus subsp. aureus N315
cagacguaucaucaaa

SEQ ID NO: 4039341 - RNA, 15 nt, Staphylococcus aureus subsp. aureus N315
cagagaaauucgaaa

SEQ ID NO: 4039342 - RNA, 16 nt, Staphylococcus aureus subsp. aureus N315
cagagaauuucgaaaa

SEQ ID NO: 4039343 - RNA, 19 nt, Staphylococcus aureus subsp. aureus N315
cagagaauuucgaaaagaa

SEQ ID NO: 4039344 - RNA, 17 nt, Staphylococcus aureus subsp. aureus N315
cagagccauaaugagag

SEQ ID NO: 4039345 - RNA, 19 nt, Staphylococcus aureus subsp. aureus N315
cagaggagcucauguuuca

SEQ ID NO: 4039346 - RNA, 16 nt, Staphylococcus aureus subsp. aureus N315
cagauaagaauauuua

SEQ ID NO: 4039347 - RNA, 18 nt, Staphylococcus aureus subsp. aureus N315
cagauaagaauauuuaag

SEQ ID NO: 4039348 - RNA, 22 nt, Staphylococcus aureus subsp. aureus N315
cagauagaaugucgauauuucu

SEQ ID NO: 4039349 - RNA, 17 nt, Staphylococcus aureus subsp. aureus N315
cagauaggaaacuuaaa

SEQ ID NO: 4039350 - RNA, 15 nt, Staphylococcus aureus subsp. aureus N315
cagauccauaaggau

SEQ ID NO: 4039351 - RNA, 21 nt, Staphylococcus aureus subsp. aureus N315
cagaucucaauccaauuaaau

SEQ ID NO: 4039352 - RNA, 13 nt, Staphylococcus aureus subsp. aureus N315
cagaugaauaaug

SEQ ID NO: 4039353 - RNA, 14 nt, Staphylococcus aureus subsp. aureus N315
cagaugaauaaugu

SEQ ID NO: 4039354 - RNA, 22 nt, Staphylococcus aureus subsp. aureus N315
cagaugaauaauguuuccauuu

SEQ ID NO: 4039355 - RNA, 21 nt, Staphylococcus aureus subsp. aureus N315
cagaugaugcuucgcaucacu

SEQ ID NO: 4039356 - RNA, 17 nt, Staphylococcus aureus subsp. aureus N315
cagauguugguucauca

SEQ ID NO: 4039357 - RNA, 18 nt, Staphylococcus aureus subsp. aureus N315
cagauguugguucaucaa

SEQ ID NO: 4039358 - RNA, 23 nt, Staphylococcus aureus subsp. aureus N315
cagauguugguucaucaaacaac

SEQ ID NO: 4039359 - RNA, 17 nt, Staphylococcus aureus subsp. aureus N315
cagauucauaucuuuca

SEQ ID NO: 4039360 - RNA, 22 nt, Staphylococcus aureus subsp. aureus N315
cagauucauaucuuucaauuaa

SEQ ID NO: 4039361 - RNA, 15 nt, Staphylococcus aureus subsp. aureus N315
cagauucuucaccaa

SEQ ID NO: 4039362 - RNA, 21 nt, Staphylococcus aureus subsp. aureus N315
cagauuuuaaaaauucauaau

SEQ ID NO: 4039363 - RNA, 13 nt, Staphylococcus aureus subsp. aureus N315
cagauuuuaagug

SEQ ID NO: 4039364 - RNA, 23 nt, Staphylococcus aureus subsp. aureus N315
cagcaaaaaauaaaucuccauua

SEQ ID NO: 4039365 - RNA, 11 nt, Staphylococcus aureus subsp. aureus N315
cagcaaauaaa

SEQ ID NO: 4039366 - RNA, 12 nt, Staphylococcus aureus subsp. aureus N315
cagcaaauaaaa

SEQ ID NO: 4039367 - RNA, 20 nt, Staphylococcus aureus subsp. aureus N315
cagcaaaugcuuaagaaauu

SEQ ID NO: 4039368 - RNA, 17 nt, Staphylococcus aureus subsp. aureus N315
cagcacagcgauuaaau

SEQ ID NO: 4039369 - RNA, 14 nt, Staphylococcus aureus subsp. aureus N315
caguuguuuuuuug

SEQ ID NO: 4039370 - RNA, 15 nt, Staphylococcus aureus subsp. aureus N315
caguuuauugaggau

SEQ ID NO: 4039371 - RNA, 18 nt, Staphylococcus aureus subsp. aureus N315
caguuuauugaggauaau

SEQ ID NO: 4039372 - RNA, 21 nt, Staphylococcus aureus subsp. aureus N315
caguuucaagugcuugguuaa

SEQ ID NO: 4039373 - RNA, 14 nt, Staphylococcus aureus subsp. aureus N315
caguuuuaaagacu

SEQ ID NO: 4039374 - RNA, 18 nt, Staphylococcus aureus subsp. aureus N315
caguuuuauuaucuuugu

SEQ ID NO: 4039375 - RNA, 12 nt, Staphylococcus aureus subsp. aureus N315
caguuuuuaaau

SEQ ID NO: 4039376 - RNA, 20 nt, Staphylococcus aureus subsp. aureus N315
cauaaaaaucauaaauaaca

SEQ ID NO: 4039377 - RNA, 18 nt, Staphylococcus aureus subsp. aureus N315
cauaaaacuuacauuaca

SEQ ID NO: 4039378 - RNA, 23 nt, Staphylococcus aureus subsp. aureus N315
cauaaaacuuacauuacauauau

SEQ ID NO: 4039379 - RNA, 16 nt, Staphylococcus aureus subsp. aureus N315
cauaaaagacagaaau

SEQ ID NO: 4039380 - RNA, 20 nt, Staphylococcus aureus subsp. aureus N315
cauaaaagacagaaauuacu

SEQ ID NO: 4039381 - RNA, 18 nt, Staphylococcus aureus subsp. aureus N315
cauaaaauaccagaugaa

SEQ ID NO: 4039382 - RNA, 21 nt, Staphylococcus aureus subsp. aureus N315
cauaaaauacgcaaaccaauc

SEQ ID NO: 4039383 - RNA, 11 nt, Staphylococcus aureus subsp. aureus N315
cauaaaaugag

SEQ ID NO: 4039384 - RNA, 22 nt, Staphylococcus aureus subsp. aureus N315
cauaaaauuaacuuaaaauuua

SEQ ID NO: 4039385 - RNA, 12 nt, Staphylococcus aureus subsp. aureus N315
cauaaaauuuaa

SEQ ID NO: 4039386 - RNA, 14 nt, Staphylococcus aureus subsp. aureus N315
cauaaaauuucugc

SEQ ID NO: 4039387 - RNA, 20 nt, Staphylococcus aureus subsp. aureus N315
cauaaacaauaacuguucuu

SEQ ID NO: 4039388 - RNA, 14 nt, Staphylococcus aureus subsp. aureus N315
cauaaaguuuauuu

SEQ ID NO: 4039389 - RNA, 20 nt, Staphylococcus aureus subsp. aureus N315
cauaaauaaacuuuaugaaa

SEQ ID NO: 4039390 - RNA, 15 nt, Staphylococcus aureus subsp. aureus N315
cauaaauacaaaaau

SEQ ID NO: 4039391 - RNA, 16 nt, Staphylococcus aureus subsp. aureus N315
cauaaauacaaaaaua

SEQ ID NO: 4039392 - RNA, 15 nt, Staphylococcus aureus subsp. aureus N315
cauaaauagugaaau

SEQ ID NO: 4039393 - RNA, 23 nt, Staphylococcus aureus subsp. aureus N315
cauaaauagugaaauuauagccu

SEQ ID NO: 4039394 - RNA, 13 nt, Staphylococcus aureus subsp. aureus N315
cauaaauauaaaa

SEQ ID NO: 4039395 - RNA, 16 nt, Staphylococcus aureus subsp. aureus N315
cauaaauauaaaauau

SEQ ID NO: 4039396 - RNA, 19 nt, Staphylococcus aureus subsp. aureus N315
cauaaauauuggaauacuc

SEQ ID NO: 4039397 - RNA, 18 nt, Staphylococcus aureus subsp. aureus N315
cauaaaucccuaaaaaaa

SEQ ID NO: 4039398 - RNA, 19 nt, Staphylococcus aureus subsp. aureus N315
cauaaaucccuaaaaaaac

SEQ ID NO: 4039399 - RNA, 23 nt, Staphylococcus aureus subsp. aureus N315
cauaaaugcuucugguucuucaa

SEQ ID NO: 4039400 - RNA, 21 nt, Staphylococcus aureus subsp. aureus N315
cauaaauuaggucauuuuuau

SEQ ID NO: 4039401 - RNA, 18 nt, Staphylococcus aureus subsp. aureus N315
cauaacaaaaacaucuac

SEQ ID NO: 4039402 - RNA, 14 nt, Staphylococcus aureus subsp. aureus N315
cauaacaaagaacc

SEQ ID NO: 4039403 - RNA, 21 nt, Staphylococcus aureus subsp. aureus N315
cauaacaauuuuguugcauga

SEQ ID NO: 4039404 - RNA, 23 nt, Staphylococcus aureus subsp. aureus N315
cauaacgacaacuugaacuaaaa

SEQ ID NO: 4039405 - RNA, 18 nt, Staphylococcus aureus subsp. aureus N315
cauaacucaaauaucuaa

SEQ ID NO: 4039406 - RNA, 18 nt, Staphylococcus aureus subsp. aureus N315
cauaacuguagcuccuaa

SEQ ID NO: 4039407 - RNA, 19 nt, Staphylococcus aureus subsp. aureus N315
cauaacuguagcuccuaaa

SEQ ID NO: 4039408 - RNA, 14 nt, Staphylococcus aureus subsp. aureus N315
cauaagaaaauacu

SEQ ID NO: 4039409 - RNA, 15 nt, Staphylococcus aureus subsp. aureus N315
cauaagaaaauacua

SEQ ID NO: 4039410 - RNA, 16 nt, Staphylococcus aureus subsp. aureus N315
cauaagccauaugcuu

SEQ ID NO: 4039411 - RNA, 22 nt, Staphylococcus aureus subsp. aureus N315
cauaagguacauaaauagugaa

SEQ ID NO: 4039412 - RNA, 17 nt, Staphylococcus aureus subsp. aureus N315
cauaaggucuuggacua

SEQ ID NO: 4039413 - RNA, 22 nt, Staphylococcus aureus subsp. aureus N315
cauaaggucuuggacuaauaau

SEQ ID NO: 4039414 - RNA, 17 nt, Staphylococcus aureus subsp. aureus N315
cauaauaaucguaaaca

SEQ ID NO: 4039415 - RNA, 21 nt, Staphylococcus aureus subsp. aureus N315
cauaauaucuuacuacuuaau

SEQ ID NO: 4039416 - RNA, 19 nt, Staphylococcus aureus subsp. aureus N315
cauaauauuucuuaccauu

SEQ ID NO: 4039417 - RNA, 15 nt, Staphylococcus aureus subsp. aureus N315
cauaaucaagucugc

SEQ ID NO: 4039418 - RNA, 16 nt, Staphylococcus aureus subsp. aureus N315
cauaaucaagucugca

SEQ ID NO: 4039419 - RNA, 22 nt, Staphylococcus aureus subsp. aureus N315
cauaaucauuaguuaugugcua

SEQ ID NO: 4039420 - RNA, 20 nt, Staphylococcus aureus subsp. aureus N315
cauaauccagccacaccaaa

SEQ ID NO: 4039421 - RNA, 17 nt, Staphylococcus aureus subsp. aureus N315
cauaauccauucuucuu

SEQ ID NO: 4039422 - RNA, 20 nt, Staphylococcus aureus subsp. aureus N315
cauaaucucuuuacaccauu

SEQ ID NO: 4039423 - RNA, 17 nt, Staphylococcus aureus subsp. aureus N315
cauaaugaauucauuca

SEQ ID NO: 4039424 - RNA, 22 nt, Staphylococcus aureus subsp. aureus N315
cauaaugacaucauguucaugu

SEQ ID NO: 4039425 - RNA, 14 nt, Staphylococcus aureus subsp. aureus N315
cauaauuaauaaca

SEQ ID NO: 4039426 - RNA, 11 nt, Staphylococcus aureus subsp. aureus N315
cauaauuuaaa

SEQ ID NO: 4039427 - RNA, 15 nt, Staphylococcus aureus subsp. aureus N315
cauaauuuaaaagau

SEQ ID NO: 4039428 - RNA, 17 nt, Staphylococcus aureus subsp. aureus N315
cauaauuuaaaagauua

SEQ ID NO: 4039429 - RNA, 23 nt, Staphylococcus aureus subsp. aureus N315
cauacacuaucauuaucaaauaa

SEQ ID NO: 4039430 - RNA, 16 nt, Staphylococcus aureus subsp. aureus N315
cauacaggaaauugaa

SEQ ID NO: 4039431 - RNA, 15 nt, Staphylococcus aureus subsp. aureus N315
cauacauaucuuuug

SEQ ID NO: 4039432 - RNA, 15 nt, Staphylococcus aureus subsp. aureus N315
cauacauaugcuaua

SEQ ID NO: 4039433 - RNA, 21 nt, Staphylococcus aureus subsp. aureus N315
cauaccaguggaaauuaugua

SEQ ID NO: 4039434 - RNA, 19 nt, Staphylococcus aureus subsp. aureus N315
cauacccauauuaaauuuu

SEQ ID NO: 4039435 - RNA, 17 nt, Staphylococcus aureus subsp. aureus N315
cauaccggcaaauaaca

SEQ ID NO: 4039436 - RNA, 20 nt, Staphylococcus aureus subsp. aureus N315
cauaccuaauaacgcauaua

SEQ ID NO: 4039437 - RNA, 14 nt, Staphylococcus aureus subsp. aureus N315
cauaccugcauauu

SEQ ID NO: 4039438 - RNA, 19 nt, Staphylococcus aureus subsp. aureus N315
cauaccuugauuauaugcu

SEQ ID NO: 4039439 - RNA, 13 nt, Staphylococcus aureus subsp. aureus N315
cauacuauaaaaa

SEQ ID NO: 4039440 - RNA, 15 nt, Staphylococcus aureus subsp. aureus N315
cauacuauaaaaauu

SEQ ID NO: 4039441 - RNA, 12 nt, Staphylococcus aureus subsp. aureus N315
cauacuucaaac

SEQ ID NO: 4039442 - RNA, 16 nt, Staphylococcus aureus subsp. aureus N315
cauacuucuauuuuau

SEQ ID NO: 4039443 - RNA, 22 nt, Staphylococcus aureus subsp. aureus N315
cauacuugucguauucuucaau

SEQ ID NO: 4039444 - RNA, 12 nt, Staphylococcus aureus subsp. aureus N315
cauagaaauuuu

SEQ ID NO: 4039445 - RNA, 16 nt, Staphylococcus aureus subsp. aureus N315
cauagacacuuaacuu

SEQ ID NO: 4039446 - RNA, 13 nt, Staphylococcus aureus subsp. aureus N315
cauagagcauuug

SEQ ID NO: 4039447 - RNA, 18 nt, Staphylococcus aureus subsp. aureus N315
cauagaugacgaucuaua

SEQ ID NO: 4039448 - RNA, 18 nt, Staphylococcus aureus subsp. aureus N315
cauagaugcauaaaaacc

SEQ ID NO: 4039449 - RNA, 13 nt, Staphylococcus aureus subsp. aureus N315
cauagaugcuuca

SEQ ID NO: 4039450 - RNA, 16 nt, Staphylococcus aureus subsp. aureus N315
cauagcauuaagauga

SEQ ID NO: 4039451 - RNA, 16 nt, Staphylococcus aureus subsp. aureus N315
cauagcuaaauaaauu

SEQ ID NO: 4039452 - RNA, 16 nt, Staphylococcus aureus subsp. aureus N315
cauagcucuucuuuuu

SEQ ID NO: 4039453 - RNA, 23 nt, Staphylococcus aureus subsp. aureus N315
cauaggcgcuguuccaaauucau

SEQ ID NO: 4039454 - RNA, 15 nt, Staphylococcus aureus subsp. aureus N315
cauaggcgcuuuuuu

SEQ ID NO: 4039455 - RNA, 21 nt, Staphylococcus aureus subsp. aureus N315
cauaggcgcuuuuuuuuauaa

SEQ ID NO: 4039456 - RNA, 19 nt, Staphylococcus aureus subsp. aureus N315
cauaggcuugccaauguga

SEQ ID NO: 4039457 - RNA, 14 nt, Staphylococcus aureus subsp. aureus N315
caucauuuguguuu

SEQ ID NO: 4039458 - RNA, 17 nt, Staphylococcus aureus subsp. aureus N315
caucauuuguguuuuua

SEQ ID NO: 4039459 - RNA, 17 nt, Staphylococcus aureus subsp. aureus N315
caucauuuucaauacuu

SEQ ID NO: 4039460 - RNA, 14 nt, Staphylococcus aureus subsp. aureus N315
cauccaauuauguu

SEQ ID NO: 4039461 - RNA, 19 nt, Staphylococcus aureus subsp. aureus N315
cauccauaaaaauacgaca

SEQ ID NO: 4039462 - RNA, 21 nt, Staphylococcus aureus subsp. aureus N315
cauccauauaugccgauugcu

SEQ ID NO: 4039463 - RNA, 21 nt, Staphylococcus aureus subsp. aureus N315
cauccaugugguucauuagca

SEQ ID NO: 4039464 - RNA, 16 nt, Staphylococcus aureus subsp. aureus N315
caucccauuaaaccac

SEQ ID NO: 4039465 - RNA, 15 nt, Staphylococcus aureus subsp. aureus N315
caucccauucaccaa

SEQ ID NO: 4039466 - RNA, 20 nt, Staphylococcus aureus subsp. aureus N315
caucccauucaccaauauua

SEQ ID NO: 4039467 - RNA, 16 nt, Staphylococcus aureus subsp. aureus N315
caucgaacaugaauga

SEQ ID NO: 4039468 - RNA, 19 nt, Staphylococcus aureus subsp. aureus N315
caucgcaaauacauaauca

SEQ ID NO: 4039469 - RNA, 18 nt, Staphylococcus aureus subsp. aureus N315
caucguaaagaucauuuu

SEQ ID NO: 4039470 - RNA, 18 nt, Staphylococcus aureus subsp. aureus N315
caucguuaucuuuaagua

SEQ ID NO: 4039471 - RNA, 13 nt, Staphylococcus aureus subsp. aureus N315
caucuaaaaugag

SEQ ID NO: 4039472 - RNA, 19 nt, Staphylococcus aureus subsp. aureus N315
caucuaaaugcacgagcaa

SEQ ID NO: 4039473 - RNA, 22 nt, Staphylococcus aureus subsp. aureus N315
caucuacaacgccaauagguuc

SEQ ID NO: 4039474 - RNA, 21 nt, Staphylococcus aureus subsp. aureus N315
caucuacaauauucaauaauu

SEQ ID NO: 4039475 - RNA, 18 nt, Staphylococcus aureus subsp. aureus N315
caucuauaacaaaaucuc

SEQ ID NO: 4039476 - RNA, 14 nt, Staphylococcus aureus subsp. aureus N315
caucuauauuuaau

SEQ ID NO: 4039477 - RNA, 20 nt, Staphylococcus aureus subsp. aureus N315
caucuauauuuaauuuugau

SEQ ID NO: 4039478 - RNA, 13 nt, Staphylococcus aureus subsp. aureus N315
caucuauguggcu

SEQ ID NO: 4039479 - RNA, 18 nt, Staphylococcus aureus subsp. aureus N315
caucuauuuaauaaugua

SEQ ID NO: 4039480 - RNA, 14 nt, Staphylococcus aureus subsp. aureus N315
caucuauuucuugu

SEQ ID NO: 4039481 - RNA, 18 nt, Staphylococcus aureus subsp. aureus N315
caucuccaccauuaauag

SEQ ID NO: 4039482 - RNA, 21 nt, Staphylococcus aureus subsp. aureus N315
caucucugcuuuaauauaauu

SEQ ID NO: 4039483 - RNA, 21 nt, Staphylococcus aureus subsp. aureus N315
caucucuuauaaguucaacca

SEQ ID NO: 4039484 - RNA, 22 nt, Staphylococcus aureus subsp. aureus N315
caucugaaaaaauuaauaauuu

SEQ ID NO: 4039485 - RNA, 21 nt, Staphylococcus aureus subsp. aureus N315
caucugaugaggcaauauuaa

SEQ ID NO: 4039486 - RNA, 15 nt, Staphylococcus aureus subsp. aureus N315
caucugcaagugcuu

SEQ ID NO: 4039487 - RNA, 18 nt, Staphylococcus aureus subsp. aureus N315
caucuguaacuaauauga

SEQ ID NO: 4039488 - RNA, 22 nt, Staphylococcus aureus subsp. aureus N315
caucuuagacgcuguuuuaaau

SEQ ID NO: 4039489 - RNA, 15 nt, Staphylococcus aureus subsp. aureus N315
caucuuaucaagaau

SEQ ID NO: 4039490 - RNA, 12 nt, Staphylococcus aureus subsp. aureus N315
caucuucaacau

SEQ ID NO: 4039491 - RNA, 23 nt, Staphylococcus aureus subsp. aureus N315
caucuucuggauagguaucacua

SEQ ID NO: 4039492 - RNA, 15 nt, Staphylococcus aureus subsp. aureus N315
caucuucuucaaaac

SEQ ID NO: 4039493 - RNA, 20 nt, Staphylococcus aureus subsp. aureus N315
caucuucuugauuguaaaua

SEQ ID NO: 4039494 - RNA, 23 nt, Staphylococcus aureus subsp. aureus N315
caucuucuugauuguaaauaaaa

SEQ ID NO: 4039495 - RNA, 18 nt, Staphylococcus aureus subsp. aureus N315
caucuugagauuuucaac

SEQ ID NO: 4039496 - RNA, 19 nt, Staphylococcus aureus subsp. aureus N315
caucuugagauuuucaaca

SEQ ID NO: 4039497 - RNA, 19 nt, Staphylococcus aureus subsp. aureus N315
caucuugcgccuuguucaa

SEQ ID NO: 4039498 - RNA, 14 nt, Staphylococcus aureus subsp. aureus N315
caucuuuaaagaaa

SEQ ID NO: 4039499 - RNA, 21 nt, Staphylococcus aureus subsp. aureus N315
caucuuuaagcccuuccccua

SEQ ID NO: 4039500 - RNA, 18 nt, Staphylococcus aureus subsp. aureus N315
caucuuuaagcuuaaaua

SEQ ID NO: 4039501 - RNA, 14 nt, Staphylococcus aureus subsp. aureus N315
caucuuuauuuaca

SEQ ID NO: 4039502 - RNA, 19 nt, Staphylococcus aureus subsp. aureus N315
caucuuucacaauuguaua

SEQ ID NO: 4039503 - RNA, 21 nt, Staphylococcus aureus subsp. aureus N315
caucuuuguaaccuaaaaaca

SEQ ID NO: 4039504 - RNA, 18 nt, Staphylococcus aureus subsp. aureus N315
caucuuuugguuuaucug

SEQ ID NO: 4039505 - RNA, 13 nt, Staphylococcus aureus subsp. aureus N315
caucuuuuuaaaa

SEQ ID NO: 4039506 - RNA, 19 nt, Staphylococcus aureus subsp. aureus N315
caucuuuuugauaauguuc

SEQ ID NO: 4039507 - RNA, 18 nt, Staphylococcus aureus subsp. aureus N315
caugaaaaggaaaaacuu

SEQ ID NO: 4039508 - RNA, 16 nt, Staphylococcus aureus subsp. aureus N315
caugaaauaaaaaaac

SEQ ID NO: 4039509 - RNA, 15 nt, Staphylococcus aureus subsp. aureus N315
caugaauaaauacaa

SEQ ID NO: 4039510 - RNA, 20 nt, Staphylococcus aureus subsp. aureus N315
caugaaucaacaauuuaaac

SEQ ID NO: 4039511 - RNA, 21 nt, Staphylococcus aureus subsp. aureus N315
caugaaucaacaauuuaaacg

SEQ ID NO: 4039512 - RNA, 18 nt, Staphylococcus aureus subsp. aureus N315
caugaaucgcauuuaaau

SEQ ID NO: 4039513 - RNA, 21 nt, Staphylococcus aureus subsp. aureus N315
caugaaucgcauuuaaauaua

SEQ ID NO: 4039514 - RNA, 23 nt, Staphylococcus aureus subsp. aureus N315
caugaaugucagucguuguaaaa

SEQ ID NO: 4039515 - RNA, 18 nt, Staphylococcus aureus subsp. aureus N315
caugaauuuuaauauauu

SEQ ID NO: 4039516 - RNA, 23 nt, Staphylococcus aureus subsp. aureus N315
caugaauuuuaauauauuuggag

SEQ ID NO: 4039517 - RNA, 20 nt, Staphylococcus aureus subsp. aureus N315
caugacauaaaacuuacauu

SEQ ID NO: 4039518 - RNA, 23 nt, Staphylococcus aureus subsp. aureus N315
caugacgaacgauagauucugau

SEQ ID NO: 4039519 - RNA, 21 nt, Staphylococcus aureus subsp. aureus N315
caugagauuauuuuuuuaaau

SEQ ID NO: 4039520 - RNA, 19 nt, Staphylococcus aureus subsp. aureus N315
caugauacugaaauuucau

SEQ ID NO: 4039521 - RNA, 12 nt, Staphylococcus aureus subsp. aureus N315
caugaugauaaa

SEQ ID NO: 4039522 - RNA, 14 nt, Staphylococcus aureus subsp. aureus N315
caugauucaugaua

SEQ ID NO: 4039523 - RNA, 17 nt, Staphylococcus aureus subsp. aureus N315
caugauucaugauaugu

SEQ ID NO: 4039524 - RNA, 12 nt, Staphylococcus aureus subsp. aureus N315
caugauuuacua

SEQ ID NO: 4039525 - RNA, 19 nt, Staphylococcus aureus subsp. aureus N315
caugcaccuuuacaacaua

SEQ ID NO: 4039526 - RNA, 16 nt, Staphylococcus aureus subsp. aureus N315
caugcacuuuauuaaa

SEQ ID NO: 4039527 - RNA, 19 nt, Staphylococcus aureus subsp. aureus N315
caugcccgagacuauauuc

SEQ ID NO: 4039528 - RNA, 15 nt, Staphylococcus aureus subsp. aureus N315
caugcgauucaaucu

SEQ ID NO: 4039529 - RNA, 17 nt, Staphylococcus aureus subsp. aureus N315
caugcgauucaaucuaa

SEQ ID NO: 4039530 - RNA, 18 nt, Staphylococcus aureus subsp. aureus N315
caugcgauugaugcguuu

SEQ ID NO: 4039531 - RNA, 15 nt, Staphylococcus aureus subsp. aureus N315
caugcuuuuaauauu

SEQ ID NO: 4039532 - RNA, 15 nt, Staphylococcus aureus subsp. aureus N315
caugggcuucugcua

SEQ ID NO: 4039533 - RNA, 19 nt, Staphylococcus aureus subsp. aureus N315
cauguaaugcuuaaaaaca

SEQ ID NO: 4039534 - RNA, 21 nt, Staphylococcus aureus subsp. aureus N315
cauguaaugcuuaaaaacaau

SEQ ID NO: 4039535 - RNA, 18 nt, Staphylococcus aureus subsp. aureus N315
cauguaccacauuuuccu

SEQ ID NO: 4039536 - RNA, 21 nt, Staphylococcus aureus subsp. aureus N315
cauguacguuuuuuuaaauac

SEQ ID NO: 4039537 - RNA, 12 nt, Staphylococcus aureus subsp. aureus N315
cauguauaaaag

SEQ ID NO: 4039538 - RNA, 14 nt, Staphylococcus aureus subsp. aureus N315
caugucaauuuuuu

SEQ ID NO: 4039539 - RNA, 18 nt, Staphylococcus aureus subsp. aureus N315
caugucuagauuuuaaau

SEQ ID NO: 4039540 - RNA, 20 nt, Staphylococcus aureus subsp. aureus N315
cauguuugauucuaaauaau

SEQ ID NO: 4039541 - RNA, 18 nt, Staphylococcus aureus subsp. aureus N315
cauguuuggaugaacaaa

SEQ ID NO: 4039542 - RNA, 21 nt, Staphylococcus aureus subsp. aureus N315
cauguuuggaugaacaaaaua

SEQ ID NO: 4039543 - RNA, 23 nt, Staphylococcus aureus subsp. aureus N315
cauguuuuguaccugcuucugua

SEQ ID NO: 4039544 - RNA, 22 nt, Staphylococcus aureus subsp. aureus N315
cauuguaaauauaguaauaaaa

SEQ ID NO: 4039545 - RNA, 14 nt, Staphylococcus aureus subsp. aureus N315
cauuguaauaccaa

SEQ ID NO: 4039546 - RNA, 15 nt, Staphylococcus aureus subsp. aureus N315
cauuguauguugaaa

SEQ ID NO: 4039547 - RNA, 17 nt, Staphylococcus aureus subsp. aureus N315
cauugucaugccuucau

SEQ ID NO: 4039548 - RNA, 22 nt, Staphylococcus aureus subsp. aureus N315
cauugucaugccuucauuagcc

SEQ ID NO: 4039549 - RNA, 16 nt, Staphylococcus aureus subsp. aureus N315
cauuguguauuguuuu

SEQ ID NO: 4039550 - RNA, 22 nt, Staphylococcus aureus subsp. aureus N315
cauuguguccauaaauauuaaa

SEQ ID NO: 4039551 - RNA, 18 nt, Staphylococcus aureus subsp. aureus N315
cauuguuauuuauacuaa

SEQ ID NO: 4039552 - RNA, 17 nt, Staphylococcus aureus subsp. aureus N315
cauuguucauacgcuca

SEQ ID NO: 4039553 - RNA, 19 nt, Staphylococcus aureus subsp. aureus N315
cauuguugauaaauggaaa

SEQ ID NO: 4039554 - RNA, 12 nt, Staphylococcus aureus subsp. aureus N315
cauuuaaaaaau

SEQ ID NO: 4039555 - RNA, 14 nt, Staphylococcus aureus subsp. aureus N315
cauuuaaaauauuu

SEQ ID NO: 4039556 - RNA, 13 nt, Staphylococcus aureus subsp. aureus N315
cauuuaaauauaa

SEQ ID NO: 4039557 - RNA, 23 nt, Staphylococcus aureus subsp. aureus N315
cauuuaauacuuuucucgauuaa

SEQ ID NO: 4039558 - RNA, 15 nt, Staphylococcus aureus subsp. aureus N315
cauuuaauccuucuc

SEQ ID NO: 4039559 - RNA, 22 nt, Staphylococcus aureus subsp. aureus N315
cauuuaauggucuaauaucaau

SEQ ID NO: 4039560 - RNA, 20 nt, Staphylococcus aureus subsp. aureus N315
cauuuaauuggaguucaucu

SEQ ID NO: 4039561 - RNA, 13 nt, Staphylococcus aureus subsp. aureus N315
cauuuacauccaa

SEQ ID NO: 4039562 - RNA, 18 nt, Staphylococcus aureus subsp. aureus N315
cauuuacuugauuagauu

SEQ ID NO: 4039563 - RNA, 18 nt, Staphylococcus aureus subsp. aureus N315
cauuuaguuaaauacaaa

SEQ ID NO: 4039564 - RNA, 19 nt, Staphylococcus aureus subsp. aureus N315
cauuuaucaacaauggaaa

SEQ ID NO: 4039565 - RNA, 15 nt, Staphylococcus aureus subsp. aureus N315
cauuuaucuaacaau

SEQ ID NO: 4039566 - RNA, 14 nt, Staphylococcus aureus subsp. aureus N315
cauuuauguagauu

SEQ ID NO: 4039567 - RNA, 20 nt, Staphylococcus aureus subsp. aureus N315
cauuuauguguuggcuuuua

SEQ ID NO: 4039568 - RNA, 22 nt, Staphylococcus aureus subsp. aureus N315
cauuuauuuucaauaaauaaac

SEQ ID NO: 4039569 - RNA, 23 nt, Staphylococcus aureus subsp. aureus N315
cauuuauuuucuuuggugaaagu

SEQ ID NO: 4039570 - RNA, 15 nt, Staphylococcus aureus subsp. aureus N315
cauuucaauauuaaa

SEQ ID NO: 4039571 - RNA, 16 nt, Staphylococcus aureus subsp. aureus N315
cauuucaauauuaaaa

SEQ ID NO: 4039572 - RNA, 13 nt, Staphylococcus aureus subsp. aureus N315
cauuucagaaaua

SEQ ID NO: 4039573 - RNA, 16 nt, Staphylococcus aureus subsp. aureus N315
cauuucagaaauacau

SEQ ID NO: 4039574 - RNA, 21 nt, Staphylococcus aureus subsp. aureus N315
cauuucgauaccuaaaauacc

SEQ ID NO: 4039575 - RNA, 19 nt, Staphylococcus aureus subsp. aureus N315
cauuugcaacaauauaaua

SEQ ID NO: 4039576 - RNA, 22 nt, Staphylococcus aureus subsp. aureus N315
cauuugcaacaauauaauauac

SEQ ID NO: 4039577 - RNA, 21 nt, Staphylococcus aureus subsp. aureus N315
cauuugcgauuucuucugcua

SEQ ID NO: 4039578 - RNA, 22 nt, Staphylococcus aureus subsp. aureus N315
cauuugcgauuucuucugcuaa

SEQ ID NO: 4039579 - RNA, 19 nt, Staphylococcus aureus subsp. aureus N315
cauuuggcguaaugauauu

SEQ ID NO: 4039580 - RNA, 15 nt, Staphylococcus aureus subsp. aureus N315
cauuugguucuucua

SEQ ID NO: 4039581 - RNA, 22 nt, Staphylococcus aureus subsp. aureus N315
cauuuguaaauauuuuuuaaaa

SEQ ID NO: 4039582 - RNA, 15 nt, Staphylococcus aureus subsp. aureus N315
cauuuguauuaauuu

SEQ ID NO: 4039583 - RNA, 17 nt, Staphylococcus aureus subsp. aureus N315
cauuugucuuaauuuuu

SEQ ID NO: 4039584 - RNA, 13 nt, Staphylococcus aureus subsp. aureus N315
cauuuguguuuuu

SEQ ID NO: 4039585 - RNA, 23 nt, Staphylococcus aureus subsp. aureus N315
cauuuguuaaauucaucuuauca

SEQ ID NO: 4039586 - RNA, 17 nt, Staphylococcus aureus subsp. aureus N315
cauuuguucugcagagu

SEQ ID NO: 4039587 - RNA, 10 nt, Staphylococcus aureus subsp. aureus N315
cauuuuaaag

SEQ ID NO: 4039588 - RNA, 14 nt, Staphylococcus aureus subsp. aureus N315
cauuuuaaauaaaa

SEQ ID NO: 4039589 - RNA, 19 nt, Staphylococcus aureus subsp. aureus N315
cauuuuaaauaaaaugcau

SEQ ID NO: 4039590 - RNA, 17 nt, Staphylococcus aureus subsp. aureus N315
cauuuuaaaucuaauua

SEQ ID NO: 4039591 - RNA, 21 nt, Staphylococcus aureus subsp. aureus N315
cauuuuaaauuuaacuaugaa

SEQ ID NO: 4039592 - RNA, 16 nt, Staphylococcus aureus subsp. aureus N315
cauuuuaauaaaauca

SEQ ID NO: 4039593 - RNA, 16 nt, Staphylococcus aureus subsp. aureus N315
cauuuuauauuuuagu

SEQ ID NO: 4039594 - RNA, 17 nt, Staphylococcus aureus subsp. aureus N315
cauuuucaaaacuagca

SEQ ID NO: 4039595 - RNA, 14 nt, Staphylococcus aureus subsp. aureus N315
cauuuucaagagga

SEQ ID NO: 4039596 - RNA, 22 nt, Staphylococcus aureus subsp. aureus N315
cauuuucauuguauguugaaag

SEQ ID NO: 4039597 - RNA, 17 nt, Staphylococcus aureus subsp. aureus N315
cauuuucauuuaauccu

SEQ ID NO: 4039598 - RNA, 12 nt, Staphylococcus aureus subsp. aureus N315
cauuuucugcuu

SEQ ID NO: 4039599 - RNA, 20 nt, Staphylococcus aureus subsp. aureus N315
cauuuugagucguagauacu

SEQ ID NO: 4039600 - RNA, 15 nt, Staphylococcus aureus subsp. aureus N315
cauuuugauuaagug

SEQ ID NO: 4039601 - RNA, 12 nt, Staphylococcus aureus subsp. aureus N315
cauuuuguuuca

SEQ ID NO: 4039602 - RNA, 11 nt, Staphylococcus aureus subsp. aureus N315
cauuuuuaaaa

SEQ ID NO: 4039603 - RNA, 19 nt, Staphylococcus aureus subsp. aureus N315
cauuuuuaaauuacuauau

SEQ ID NO: 4039604 - RNA, 21 nt, Staphylococcus aureus subsp. aureus N315
cauuuuuaauuuugacauaaa

SEQ ID NO: 4039605 - RNA, 14 nt, Staphylococcus aureus subsp. aureus N315
cauuuuuaguuaga

SEQ ID NO: 4039606 - RNA, 16 nt, Staphylococcus aureus subsp. aureus N315
cauuuuuauaaauuuu

SEQ ID NO: 4039607 - RNA, 20 nt, Staphylococcus aureus subsp. aureus N315
cauuuuuauuuaacacuuca

SEQ ID NO: 4039608 - RNA, 16 nt, Staphylococcus aureus subsp. aureus N315
cauuuuuucuaucuuc

SEQ ID NO: 4039609 - RNA, 20 nt, Staphylococcus aureus subsp. aureus N315
cauuuuuuuccaagcaucau

SEQ ID NO: 4039610 - RNA, 22 nt, Staphylococcus aureus subsp. aureus N315
ccaaaaauagauugaaaaaaua

SEQ ID NO: 4039611 - RNA, 12 nt, Staphylococcus aureus subsp. aureus N315
ccaaaaauugua

SEQ ID NO: 4039612 - RNA, 21 nt, Staphylococcus aureus subsp. aureus N315
ccaaaaauuguaaaaccuuac

SEQ ID NO: 4039613 - RNA, 15 nt, Staphylococcus aureus subsp. aureus N315
ccaaaaauuguucaa

SEQ ID NO: 4039614 - RNA, 16 nt, Staphylococcus aureus subsp. aureus N315
ccaaaacauuuuguga

SEQ ID NO: 4039615 - RNA, 21 nt, Staphylococcus aureus subsp. aureus N315
ccaaaagaaauuuaauacaau

SEQ ID NO: 4039616 - RNA, 17 nt, Staphylococcus aureus subsp. aureus N315
ccaaaaguuauauaaau

SEQ ID NO: 4039617 - RNA, 18 nt, Staphylococcus aureus subsp. aureus N315
ccaaaaugguuaaaaucg

SEQ ID NO: 4039618 - RNA, 21 nt, Staphylococcus aureus subsp. aureus N315
ccaaacaaccugugauaaaaa

SEQ ID NO: 4039619 - RNA, 20 nt, Staphylococcus aureus subsp. aureus N315
ccaaagaaacggaaaugacu

SEQ ID NO: 4039620 - RNA, 22 nt, Staphylococcus aureus subsp. aureus N315
ccaaaguaccaucucuauuuuu

SEQ ID NO: 4039621 - RNA, 20 nt, Staphylococcus aureus subsp. aureus N315
ccaaauaaauuaaauuuugu

SEQ ID NO: 4039622 - RNA, 21 nt, Staphylococcus aureus subsp. aureus N315
ccaaauaacguuaauauaauu

SEQ ID NO: 4039623 - RNA, 13 nt, Staphylococcus aureus subsp. aureus N315
ccaaauaauaucu

SEQ ID NO: 4039624 - RNA, 13 nt, Staphylococcus aureus subsp. aureus N315
ccaaauauaauuu

SEQ ID NO: 4039625 - RNA, 18 nt, Staphylococcus aureus subsp. aureus N315
ccaaauauaauuucaauu

SEQ ID NO: 4039626 - RNA, 21 nt, Staphylococcus aureus subsp. aureus N315
ccaaauauaauuucaauuuau

SEQ ID NO: 4039627 - RNA, 16 nt, Staphylococcus aureus subsp. aureus N315
ccaaauauuaaaaaca

SEQ ID NO: 4039628 - RNA, 17 nt, Staphylococcus aureus subsp. aureus N315
ccaaauauuuuaucugu

SEQ ID NO: 4039629 - RNA, 21 nt, Staphylococcus aureus subsp. aureus N315
ccaaaucggaauaaaauaaau

SEQ ID NO: 4039630 - RNA, 22 nt, Staphylococcus aureus subsp. aureus N315
ccaaauuuaggcaugucaaauc

SEQ ID NO: 4039631 - RNA, 17 nt, Staphylococcus aureus subsp. aureus N315
ccauaugugguggcuau

SEQ ID NO: 4039632 - RNA, 23 nt, Staphylococcus aureus subsp. aureus N315
ccauaugugguggcuauauaauu

SEQ ID NO: 4039633 - RNA, 20 nt, Staphylococcus aureus subsp. aureus N315
ccaucaauaccauaauuaaa

SEQ ID NO: 4039634 - RNA, 19 nt, Staphylococcus aureus subsp. aureus N315
ccaucugugucagcauuca

SEQ ID NO: 4039635 - RNA, 22 nt, Staphylococcus aureus subsp. aureus N315
ccaucuuuguaaccuaaaaaca

SEQ ID NO: 4039636 - RNA, 23 nt, Staphylococcus aureus subsp. aureus N315
ccaucuuuguaaccuaaaaacaa

SEQ ID NO: 4039637 - RNA, 18 nt, Staphylococcus aureus subsp. aureus N315
ccaugaaaaggaaaaacu

SEQ ID NO: 4039638 - RNA, 19 nt, Staphylococcus aureus subsp. aureus N315
ccaugauuagcgcaccaau

SEQ ID NO: 4039639 - RNA, 21 nt, Staphylococcus aureus subsp. aureus N315
ccaugcaaacucauuuauaaa

SEQ ID NO: 4039640 - RNA, 14 nt, Staphylococcus aureus subsp. aureus N315
ccauuaaucauuua

SEQ ID NO: 4039641 - RNA, 19 nt, Staphylococcus aureus subsp. aureus N315
ccauuacaaugcgcaauga

SEQ ID NO: 4039642 - RNA, 16 nt, Staphylococcus aureus subsp. aureus N315
ccauuauuauuuuuuu

SEQ ID NO: 4039643 - RNA, 18 nt, Staphylococcus aureus subsp. aureus N315
ccauucaaaguauauacu

SEQ ID NO: 4039644 - RNA, 16 nt, Staphylococcus aureus subsp. aureus N315
ccauucaauguuuaau

SEQ ID NO: 4039645 - RNA, 12 nt, Staphylococcus aureus subsp. aureus N315
ccauucguaaua

SEQ ID NO: 4039646 - RNA, 14 nt, Staphylococcus aureus subsp. aureus N315
ccauucugcagcga

SEQ ID NO: 4039647 - RNA, 22 nt, Staphylococcus aureus subsp. aureus N315
ccauugcacaguuucaucuuca

SEQ ID NO: 4039648 - RNA, 20 nt, Staphylococcus aureus subsp. aureus N315
ccauugcgcuucgucuuuau

SEQ ID NO: 4039649 - RNA, 20 nt, Staphylococcus aureus subsp. aureus N315
ccauuggauucuuuuguaau

SEQ ID NO: 4039650 - RNA, 22 nt, Staphylococcus aureus subsp. aureus N315
ccauuguccaacugcuuuuuau

SEQ ID NO: 4039651 - RNA, 15 nt, Staphylococcus aureus subsp. aureus N315
ccauuguuauccaaa

SEQ ID NO: 4039652 - RNA, 18 nt, Staphylococcus aureus subsp. aureus N315
ccauuuaacucaccuuua

SEQ ID NO: 4039653 - RNA, 17 nt, Staphylococcus aureus subsp. aureus N315
ccauuuaaggauuuccu

SEQ ID NO: 4039654 - RNA, 16 nt, Staphylococcus aureus subsp. aureus N315
ccauuugcaacaauau

SEQ ID NO: 4039655 - RNA, 12 nt, Staphylococcus aureus subsp. aureus N315
ccauuuuuucaa

SEQ ID NO: 4039656 - RNA, 14 nt, Staphylococcus aureus subsp. aureus N315
ccauuuuuucaaau

SEQ ID NO: 4039657 - RNA, 17 nt, Staphylococcus aureus subsp. aureus N315
ccauuuuuuuccaagca

SEQ ID NO: 4039658 - RNA, 23 nt, Staphylococcus aureus subsp. aureus N315
ccauuuuuuugacaguuuuaaau

SEQ ID NO: 4039659 - RNA, 14 nt, Staphylococcus aureus subsp. aureus N315
cccaaaaaauugua

SEQ ID NO: 4039660 - RNA, 12 nt, Staphylococcus aureus subsp. aureus N315
cccaacacagag

SEQ ID NO: 4039661 - RNA, 19 nt, Staphylococcus aureus subsp. aureus N315
cccaaccacgauaucuagc

SEQ ID NO: 4039662 - RNA, 15 nt, Staphylococcus aureus subsp. aureus N315
cccaagcccugacaa

SEQ ID NO: 4039663 - RNA, 19 nt, Staphylococcus aureus subsp. aureus N315
cccaagcccugacaauuca

SEQ ID NO: 4039664 - RNA, 20 nt, Staphylococcus aureus subsp. aureus N315
cccaagcccugacaauucau

SEQ ID NO: 4039665 - RNA, 19 nt, Staphylococcus aureus subsp. aureus N315
cccaaugcuugaauuuuau

SEQ ID NO: 4039666 - RNA, 20 nt, Staphylococcus aureus subsp. aureus N315
cccaauucggauuauauuua

SEQ ID NO: 4039667 - RNA, 12 nt, Staphylococcus aureus subsp. aureus N315
cccacaccccaa

SEQ ID NO: 4039668 - RNA, 13 nt, Staphylococcus aureus subsp. aureus N315
cccacaccccaac

SEQ ID NO: 4039669 - RNA, 14 nt, Staphylococcus aureus subsp. aureus N315
cccacaccccaacu

SEQ ID NO: 4039670 - RNA, 16 nt, Staphylococcus aureus subsp. aureus N315
cccacaucuuuuuaaa

SEQ ID NO: 4039671 - RNA, 20 nt, Staphylococcus aureus subsp. aureus N315
cccagccuauucguuugaau

SEQ ID NO: 4039672 - RNA, 22 nt, Staphylococcus aureus subsp. aureus N315
cccagcuugaccgccuaugaua

SEQ ID NO: 4039673 - RNA, 17 nt, Staphylococcus aureus subsp. aureus N315
cccauaccuacaaauau

SEQ ID NO: 4039674 - RNA, 16 nt, Staphylococcus aureus subsp. aureus N315
cccaucgcuuuuucca

SEQ ID NO: 4039675 - RNA, 21 nt, Staphylococcus aureus subsp. aureus N315
cccaucuuuuagguaauaauu

SEQ ID NO: 4039676 - RNA, 17 nt, Staphylococcus aureus subsp. aureus N315
cccauucacuacuuuuu

SEQ ID NO: 4039677 - RNA, 19 nt, Staphylococcus aureus subsp. aureus N315
cccauugcuuguccucuaa

SEQ ID NO: 4039678 - RNA, 13 nt, Staphylococcus aureus subsp. aureus N315
cccauuuuaaagu

SEQ ID NO: 4039679 - RNA, 19 nt, Staphylococcus aureus subsp. aureus N315
cccauuuuuaaaauuauga

SEQ ID NO: 4039680 - RNA, 11 nt, Staphylococcus aureus subsp. aureus N315
ccccaacacag

SEQ ID NO: 4039681 - RNA, 16 nt, Staphylococcus aureus subsp. aureus N315
ccccaacacagagaaa

SEQ ID NO: 4039682 - RNA, 16 nt, Staphylococcus aureus subsp. aureus N315
ccccaacacagagaau

SEQ ID NO: 4039683 - RNA, 23 nt, Staphylococcus aureus subsp. aureus N315
ccccaacacugagaauuucuaau

SEQ ID NO: 4039684 - RNA, 15 nt, Staphylococcus aureus subsp. aureus N315
ccccaacuugcauug

SEQ ID NO: 4039685 - RNA, 11 nt, Staphylococcus aureus subsp. aureus N315
cccccaacaca

SEQ ID NO: 4039686 - RNA, 16 nt, Staphylococcus aureus subsp. aureus N315
cccccgccacuaugug

SEQ ID NO: 4039687 - RNA, 14 nt, Staphylococcus aureus subsp. aureus N315
ccccuagcaaaaau

SEQ ID NO: 4039688 - RNA, 21 nt, Staphylococcus aureus subsp. aureus N315
ccccuagcaaaaauacuuuuu

SEQ ID NO: 4039689 - RNA, 23 nt, Staphylococcus aureus subsp. aureus N315
cccuagcaaaaauacuuuuugau

SEQ ID NO: 4039690 - RNA, 19 nt, Staphylococcus aureus subsp. aureus N315
cccuagguuuauauaucac

SEQ ID NO: 4039691 - RNA, 14 nt, Staphylococcus aureus subsp. aureus N315
cccuggaaaaugau

SEQ ID NO: 4039692 - RNA, 13 nt, Staphylococcus aureus subsp. aureus N315
cccuguaaaacca

SEQ ID NO: 4039693 - RNA, 18 nt, Staphylococcus aureus subsp. aureus N315
cccuuuuuaaaauacguu

SEQ ID NO: 4039694 - RNA, 16 nt, Staphylococcus aureus subsp. aureus N315
ccgaaaauagacugac

SEQ ID NO: 4039695 - RNA, 18 nt, Staphylococcus aureus subsp. aureus N315
ccgaaaauugcuaaaaaa

SEQ ID NO: 4039696 - RNA, 19 nt, Staphylococcus aureus subsp. aureus N315
ccgaacaucugaaaaaauu

SEQ ID NO: 4039697 - RNA, 22 nt, Staphylococcus aureus subsp. aureus N315
ccgaacaucugaaaaaauuaau

SEQ ID NO: 4039698 - RNA, 18 nt, Staphylococcus aureus subsp. aureus N315
ccgacuugauaaaaaaug

SEQ ID NO: 4039699 - RNA, 20 nt, Staphylococcus aureus subsp. aureus N315
ccgacuugauaaaaaaugaa

SEQ ID NO: 4039700 - RNA, 21 nt, Staphylococcus aureus subsp. aureus N315
ccgacuuuugauuuugaauaa

SEQ ID NO: 4039701 - RNA, 16 nt, Staphylococcus aureus subsp. aureus N315
ccgaggcuaauuuuaa

SEQ ID NO: 4039702 - RNA, 22 nt, Staphylococcus aureus subsp. aureus N315
ccgauuguuaauuuaaagucuu

SEQ ID NO: 4039703 - RNA, 20 nt, Staphylococcus aureus subsp. aureus N315
ccgauuuauuuauaaaauaa

SEQ ID NO: 4039704 - RNA, 18 nt, Staphylococcus aureus subsp. aureus N315
ccgauuuugauauaaaaa

SEQ ID NO: 4039705 - RNA, 15 nt, Staphylococcus aureus subsp. aureus N315
ccgcacuucuauauu

SEQ ID NO: 4039706 - RNA, 12 nt, Staphylococcus aureus subsp. aureus N315
ccgcuauaaaau

SEQ ID NO: 4039707 - RNA, 13 nt, Staphylococcus aureus subsp. aureus N315
ccggaaauuaaau

SEQ ID NO: 4039708 - RNA, 16 nt, Staphylococcus aureus subsp. aureus N315
ccggaacauuaaaagg

SEQ ID NO: 4039709 - RNA, 22 nt, Staphylococcus aureus subsp. aureus N315
ccguaaaaucagucauucacau

SEQ ID NO: 4039710 - RNA, 16 nt, Staphylococcus aureus subsp. aureus N315
ccguauuuuaauauug

SEQ ID NO: 4039711 - RNA, 20 nt, Staphylococcus aureus subsp. aureus N315
ccgucgaauauaauuuuuug

SEQ ID NO: 4039712 - RNA, 18 nt, Staphylococcus aureus subsp. aureus N315
ccgugaggaauaugaauu

SEQ ID NO: 4039713 - RNA, 14 nt, Staphylococcus aureus subsp. aureus N315
ccguguuuauuuuu

SEQ ID NO: 4039714 - RNA, 21 nt, Staphylococcus aureus subsp. aureus N315
ccguguuuugauuuauuaucu

SEQ ID NO: 4039715 - RNA, 12 nt, Staphylococcus aureus subsp. aureus N315
ccguuauuuuca

SEQ ID NO: 4039716 - RNA, 13 nt, Staphylococcus aureus subsp. aureus N315
ccguuauuuuuuu

SEQ ID NO: 4039717 - RNA, 14 nt, Staphylococcus aureus subsp. aureus N315
ccguuuuuuauaaa

SEQ ID NO: 4039718 - RNA, 18 nt, Staphylococcus aureus subsp. aureus N315
ccguuuuuuauaaaucau

SEQ ID NO: 4039719 - RNA, 18 nt, Staphylococcus aureus subsp. aureus N315
ccuuguuggcuuuuuuaa

SEQ ID NO: 4039720 - RNA, 12 nt, Staphylococcus aureus subsp. aureus N315
ccuuuaaaacau

SEQ ID NO: 4039721 - RNA, 13 nt, Staphylococcus aureus subsp. aureus N315
ccuuuaaaucauu

SEQ ID NO: 4039722 - RNA, 20 nt, Staphylococcus aureus subsp. aureus N315
ccuuuaaaucuacuuuguuc

SEQ ID NO: 4039723 - RNA, 22 nt, Staphylococcus aureus subsp. aureus N315
ccuuuaaauuuaccauaaccuu

SEQ ID NO: 4039724 - RNA, 22 nt, Staphylococcus aureus subsp. aureus N315
ccuuuaagaagucgaauucacc

SEQ ID NO: 4039725 - RNA, 17 nt, Staphylococcus aureus subsp. aureus N315
ccuuuaauaauauugaa

SEQ ID NO: 4039726 - RNA, 22 nt, Staphylococcus aureus subsp. aureus N315
ccuuuaauuguuaaaucaccaa

SEQ ID NO: 4039727 - RNA, 15 nt, Staphylococcus aureus subsp. aureus N315
ccuuuaccaguauca

SEQ ID NO: 4039728 - RNA, 17 nt, Staphylococcus aureus subsp. aureus N315
ccuuuacucauauugaa

SEQ ID NO: 4039729 - RNA, 17 nt, Staphylococcus aureus subsp. aureus N315
ccuuuagccaaugcuuc

SEQ ID NO: 4039730 - RNA, 15 nt, Staphylococcus aureus subsp. aureus N315
ccuuuagucauguuu

SEQ ID NO: 4039731 - RNA, 19 nt, Staphylococcus aureus subsp. aureus N315
ccuuuauauucuaauauuc

SEQ ID NO: 4039732 - RNA, 18 nt, Staphylococcus aureus subsp. aureus N315
ccuuuauauuuaguuagc

SEQ ID NO: 4039733 - RNA, 19 nt, Staphylococcus aureus subsp. aureus N315
ccuuuaugugcaucauuua

SEQ ID NO: 4039734 - RNA, 14 nt, Staphylococcus aureus subsp. aureus N315
ccuuuauuuuuaug

SEQ ID NO: 4039735 - RNA, 16 nt, Staphylococcus aureus subsp. aureus N315
ccuuucgauaaacuac

SEQ ID NO: 4039736 - RNA, 19 nt, Staphylococcus aureus subsp. aureus N315
ccuuucgauaaacuacaca

SEQ ID NO: 4039737 - RNA, 11 nt, Staphylococcus aureus subsp. aureus N315
ccuuucucuaa

SEQ ID NO: 4039738 - RNA, 22 nt, Staphylococcus aureus subsp. aureus N315
ccuuucucuaaauaauuucuca

SEQ ID NO: 4039739 - RNA, 14 nt, Staphylococcus aureus subsp. aureus N315
ccuuucuuuuucga

SEQ ID NO: 4039740 - RNA, 17 nt, Staphylococcus aureus subsp. aureus N315
ccuuugcuuaaaccuua

SEQ ID NO: 4039741 - RNA, 18 nt, Staphylococcus aureus subsp. aureus N315
ccuuugcuuaaaccuuaa

SEQ ID NO: 4039742 - RNA, 18 nt, Staphylococcus aureus subsp. aureus N315
ccuuuuaauuuaguuaua

SEQ ID NO: 4039743 - RNA, 13 nt, Staphylococcus aureus subsp. aureus N315
ccuuuuaucuuua

SEQ ID NO: 4039744 - RNA, 11 nt, Staphylococcus aureus subsp. aureus N315
ccuuuucaaau

SEQ ID NO: 4039745 - RNA, 14 nt, Staphylococcus aureus subsp. aureus N315
ccuuuugaauaauu

SEQ ID NO: 4039746 - RNA, 22 nt, Staphylococcus aureus subsp. aureus N315
ccuuuugauguuuaugacaaag

SEQ ID NO: 4039747 - RNA, 17 nt, Staphylococcus aureus subsp. aureus N315
ccuuuuugacucagaau

SEQ ID NO: 4039748 - RNA, 13 nt, Staphylococcus aureus subsp. aureus N315
ccuuuuuguaauu

SEQ ID NO: 4039749 - RNA, 12 nt, Staphylococcus aureus subsp. aureus N315
ccuuuuuuaaag

SEQ ID NO: 4039750 - RNA, 21 nt, Staphylococcus aureus subsp. aureus N315
cgaaaaaugccaacuauaccu

SEQ ID NO: 4039751 - RNA, 10 nt, Staphylococcus aureus subsp. aureus N315
cgaaaagaaa

SEQ ID NO: 4039752 - RNA, 16 nt, Staphylococcus aureus subsp. aureus N315
cgaaaaguauaugaau

SEQ ID NO: 4039753 - RNA, 22 nt, Staphylococcus aureus subsp. aureus N315
cgaaaauagcuauuaaaauaga

SEQ ID NO: 4039754 - RNA, 23 nt, Staphylococcus aureus subsp. aureus N315
cgaaaauucgcuuguaacaagcu

SEQ ID NO: 4039755 - RNA, 18 nt, Staphylococcus aureus subsp. aureus N315
cgaaaauugcuaaaaaaa

SEQ ID NO: 4039756 - RNA, 15 nt, Staphylococcus aureus subsp. aureus N315
cgaaacauuaaaaua

SEQ ID NO: 4039757 - RNA, 12 nt, Staphylococcus aureus subsp. aureus N315
cgaaaguacaag

SEQ ID NO: 4039758 - RNA, 15 nt, Staphylococcus aureus subsp. aureus N315
cgaaaguaucuauga

SEQ ID NO: 4039759 - RNA, 13 nt, Staphylococcus aureus subsp. aureus N315
cgaacaaaugaaa

SEQ ID NO: 4039760 - RNA, 14 nt, Staphylococcus aureus subsp. aureus N315
cgaacauaaauaaa

SEQ ID NO: 4039761 - RNA, 16 nt, Staphylococcus aureus subsp. aureus N315
cgaacaucugaaaaaa

SEQ ID NO: 4039762 - RNA, 21 nt, Staphylococcus aureus subsp. aureus N315
cgaacaugguaucuuuaauuu

SEQ ID NO: 4039763 - RNA, 18 nt, Staphylococcus aureus subsp. aureus N315
cgaacgauagauucugau

SEQ ID NO: 4039764 - RNA, 15 nt, Staphylococcus aureus subsp. aureus N315
cgaacuuuuguucua

SEQ ID NO: 4039765 - RNA, 16 nt, Staphylococcus aureus subsp. aureus N315
cgaagaaacauuauau

SEQ ID NO: 4039766 - RNA, 13 nt, Staphylococcus aureus subsp. aureus N315
cgaagaaugauac

SEQ ID NO: 4039767 - RNA, 21 nt, Staphylococcus aureus subsp. aureus N315
cgaagucagucaauucaaacu

SEQ ID NO: 4039768 - RNA, 12 nt, Staphylococcus aureus subsp. aureus N315
cgaaguuuaaau

SEQ ID NO: 4039769 - RNA, 22 nt, Staphylococcus aureus subsp. aureus N315
cgaauguauugcuauaagaacu

SEQ ID NO: 4039770 - RNA, 22 nt, Staphylococcus aureus subsp. aureus N315
cgaauguuccuuguuuuaaacu

SEQ ID NO: 4039771 - RNA, 14 nt, Staphylococcus aureus subsp. aureus N315
cgaauuaaaauaac

SEQ ID NO: 4039772 - RNA, 14 nt, Staphylococcus aureus subsp. aureus N315
cgaauucauuaacg

SEQ ID NO: 4039773 - RNA, 18 nt, Staphylococcus aureus subsp. aureus N315
cgaauucuccguuaauuu

SEQ ID NO: 4039774 - RNA, 15 nt, Staphylococcus aureus subsp. aureus N315
cgaauuucauaguua

SEQ ID NO: 4039775 - RNA, 18 nt, Staphylococcus aureus subsp. aureus N315
cgacaaaacuuguaauca

SEQ ID NO: 4039776 - RNA, 15 nt, Staphylococcus aureus subsp. aureus N315
cgacaauuccauaag

SEQ ID NO: 4039777 - RNA, 17 nt, Staphylococcus aureus subsp. aureus N315
cgacacguguaaaaaug

SEQ ID NO: 4039778 - RNA, 19 nt, Staphylococcus aureus subsp. aureus N315
cgacacguguaaaaaugau

SEQ ID NO: 4039779 - RNA, 18 nt, Staphylococcus aureus subsp. aureus N315
cgacaucgccaauuugau

SEQ ID NO: 4039780 - RNA, 23 nt, Staphylococcus aureus subsp. aureus N315
cgacgguauaaaaaaauuaacua

SEQ ID NO: 4039781 - RNA, 14 nt, Staphylococcus aureus subsp. aureus N315
cgacguuuaaaugc

SEQ ID NO: 4039782 - RNA, 21 nt, Staphylococcus aureus subsp. aureus N315
cgacuuuuagauuaucuuuca

SEQ ID NO: 4039783 - RNA, 18 nt, Staphylococcus aureus subsp. aureus N315
cgagaaauuagaaccauc

SEQ ID NO: 4039784 - RNA, 11 nt, Staphylococcus aureus subsp. aureus N315
cgagaaucucc

SEQ ID NO: 4039785 - RNA, 20 nt, Staphylococcus aureus subsp. aureus N315
cgagauguguccuaauaagu

SEQ ID NO: 4039786 - RNA, 16 nt, Staphylococcus aureus subsp. aureus N315
cgagcguaauggauua

SEQ ID NO: 4039787 - RNA, 20 nt, Staphylococcus aureus subsp. aureus N315
cgagcugcuucaacuacuuc

SEQ ID NO: 4039788 - RNA, 23 nt, Staphylococcus aureus subsp. aureus N315
cgagcuuagggcuuuguuuucug

SEQ ID NO: 4039789 - RNA, 20 nt, Staphylococcus aureus subsp. aureus N315
cgagcuuugcucauagauga

SEQ ID NO: 4039790 - RNA, 20 nt, Staphylococcus aureus subsp. aureus N315
cgaguguuuuaaucuuauuc

SEQ ID NO: 4039791 - RNA, 19 nt, Staphylococcus aureus subsp. aureus N315
cgaguuuguuucuaaauuc

SEQ ID NO: 4039792 - RNA, 12 nt, Staphylococcus aureus subsp. aureus N315
cgauaaaagaac

SEQ ID NO: 4039793 - RNA, 11 nt, Staphylococcus aureus subsp. aureus N315
cgauaaaugua

SEQ ID NO: 4039794 - RNA, 17 nt, Staphylococcus aureus subsp. aureus N315
cgauaagcaaaaauucu

SEQ ID NO: 4039795 - RNA, 14 nt, Staphylococcus aureus subsp. aureus N315
cgauaaguucaucg

SEQ ID NO: 4039796 - RNA, 14 nt, Staphylococcus aureus subsp. aureus N315
cgauaauaauaaga

SEQ ID NO: 4039797 - RNA, 17 nt, Staphylococcus aureus subsp. aureus N315
cgauaccaaauauauuu

SEQ ID NO: 4039798 - RNA, 15 nt, Staphylococcus aureus subsp. aureus N315
cgauacugcuuugga

SEQ ID NO: 4039799 - RNA, 12 nt, Staphylococcus aureus subsp. aureus N315
cgauacuuuuug

SEQ ID NO: 4039800 - RNA, 13 nt, Staphylococcus aureus subsp. aureus N315
cgauagauaucau

SEQ ID NO: 4039801 - RNA, 21 nt, Staphylococcus aureus subsp. aureus N315
cgauagauuuaucaccuuuag

SEQ ID NO: 4039802 - RNA, 18 nt, Staphylococcus aureus subsp. aureus N315
cgauagcucugaaaacaa

SEQ ID NO: 4039803 - RNA, 19 nt, Staphylococcus aureus subsp. aureus N315
cgauagcucugaaaacaau

SEQ ID NO: 4039804 - RNA, 14 nt, Staphylococcus aureus subsp. aureus N315
cgauaguuuauuaa

SEQ ID NO: 4039805 - RNA, 19 nt, Staphylococcus aureus subsp. aureus N315
cgauauaacauuaaaauga

SEQ ID NO: 4039806 - RNA, 19 nt, Staphylococcus aureus subsp. aureus N315
cgauaucagcuaaguuaaa

SEQ ID NO: 4039807 - RNA, 10 nt, Staphylococcus aureus subsp. aureus N315
cguaaaguuu

SEQ ID NO: 4039808 - RNA, 16 nt, Staphylococcus aureus subsp. aureus N315
cguaacaucacauaaa

SEQ ID NO: 4039809 - RNA, 18 nt, Staphylococcus aureus subsp. aureus N315
cguaacauuuaaaaaaug

SEQ ID NO: 4039810 - RNA, 19 nt, Staphylococcus aureus subsp. aureus N315
cguaacucuuuaauuuuac

SEQ ID NO: 4039811 - RNA, 18 nt, Staphylococcus aureus subsp. aureus N315
cguacaaagguaauagaa

SEQ ID NO: 4039812 - RNA, 20 nt, Staphylococcus aureus subsp. aureus N315
cguacguugauguguugcau

SEQ ID NO: 4039813 - RNA, 16 nt, Staphylococcus aureus subsp. aureus N315
cguagcuuuucauuua

SEQ ID NO: 4039814 - RNA, 14 nt, Staphylococcus aureus subsp. aureus N315
cguaguuguccauu

SEQ ID NO: 4039815 - RNA, 18 nt, Staphylococcus aureus subsp. aureus N315
cguauacuuucgaucuuc

SEQ ID NO: 4039816 - RNA, 19 nt, Staphylococcus aureus subsp. aureus N315
cguauauauauauuaaaac

SEQ ID NO: 4039817 - RNA, 20 nt, Staphylococcus aureus subsp. aureus N315
cguauauauauauuaaaaca

SEQ ID NO: 4039818 - RNA, 14 nt, Staphylococcus aureus subsp. aureus N315
cguaucaagaaaaa

SEQ ID NO: 4039819 - RNA, 14 nt, Staphylococcus aureus subsp. aureus N315
cguauugaaugaau

SEQ ID NO: 4039820 - RNA, 15 nt, Staphylococcus aureus subsp. aureus N315
cguauuuaccuucuu

SEQ ID NO: 4039821 - RNA, 17 nt, Staphylococcus aureus subsp. aureus N315
cguauuucaaauguaau

SEQ ID NO: 4039822 - RNA, 14 nt, Staphylococcus aureus subsp. aureus N315
cguauuuuaauauu

SEQ ID NO: 4039823 - RNA, 15 nt, Staphylococcus aureus subsp. aureus N315
cguauuuuaaugauu

SEQ ID NO: 4039824 - RNA, 23 nt, Staphylococcus aureus subsp. aureus N315
cgucacaugccaucuuuguaacc

SEQ ID NO: 4039825 - RNA, 14 nt, Staphylococcus aureus subsp. aureus N315
cgucacuuuauuaa

SEQ ID NO: 4039826 - RNA, 19 nt, Staphylococcus aureus subsp. aureus N315
cgucaucaaaacguuugaa

SEQ ID NO: 4039827 - RNA, 20 nt, Staphylococcus aureus subsp. aureus N315
cgucuauacuccaguuuaua

SEQ ID NO: 4039828 - RNA, 17 nt, Staphylococcus aureus subsp. aureus N315
cgucuggcacauuacug

SEQ ID NO: 4039829 - RNA, 13 nt, Staphylococcus aureus subsp. aureus N315
cgucuguuucaua

SEQ ID NO: 4039830 - RNA, 12 nt, Staphylococcus aureus subsp. aureus N315
cgucuuguaaac

SEQ ID NO: 4039831 - RNA, 16 nt, Staphylococcus aureus subsp. aureus N315
cgucuuguaaacuucu

SEQ ID NO: 4039832 - RNA, 19 nt, Staphylococcus aureus subsp. aureus N315
cgucuuuugcaaauuggaa

SEQ ID NO: 4039833 - RNA, 20 nt, Staphylococcus aureus subsp. aureus N315
cgucuuuugcaaauuggaaa

SEQ ID NO: 4039834 - RNA, 17 nt, Staphylococcus aureus subsp. aureus N315
cgugaagaaaaaaugau

SEQ ID NO: 4039835 - RNA, 19 nt, Staphylococcus aureus subsp. aureus N315
cgugaggcugggacauaaa

SEQ ID NO: 4039836 - RNA, 22 nt, Staphylococcus aureus subsp. aureus N315
cgugauuacauucuauacuuuu

SEQ ID NO: 4039837 - RNA, 14 nt, Staphylococcus aureus subsp. aureus N315
cgugcaaauaaaaa

SEQ ID NO: 4039838 - RNA, 18 nt, Staphylococcus aureus subsp. aureus N315
cgugcauuguaauaccaa

SEQ ID NO: 4039839 - RNA, 17 nt, Staphylococcus aureus subsp. aureus N315
cgugccuuaacuucaua

SEQ ID NO: 4039840 - RNA, 20 nt, Staphylococcus aureus subsp. aureus N315
cgugcuuuuaaauguauuuu

SEQ ID NO: 4039841 - RNA, 17 nt, Staphylococcus aureus subsp. aureus N315
cguggauguguuuuaau

SEQ ID NO: 4039842 - RNA, 13 nt, Staphylococcus aureus subsp. aureus N315
cgugguucccaau

SEQ ID NO: 4039843 - RNA, 23 nt, Staphylococcus aureus subsp. aureus N315
cguguaaaaaugauuauucuuuu

SEQ ID NO: 4039844 - RNA, 20 nt, Staphylococcus aureus subsp. aureus N315
cguguauacaacauguguau

SEQ ID NO: 4039845 - RNA, 12 nt, Staphylococcus aureus subsp. aureus N315
cguguguaguag

SEQ ID NO: 4039846 - RNA, 13 nt, Staphylococcus aureus subsp. aureus N315
cguguucuaaaag

SEQ ID NO: 4039847 - RNA, 17 nt, Staphylococcus aureus subsp. aureus N315
cguuaaaucacauauga

SEQ ID NO: 4039848 - RNA, 20 nt, Staphylococcus aureus subsp. aureus N315
cguuaauaaaccuacaauau

SEQ ID NO: 4039849 - RNA, 17 nt, Staphylococcus aureus subsp. aureus N315
cguuaauaauuuguuuu

SEQ ID NO: 4039850 - RNA, 17 nt, Staphylococcus aureus subsp. aureus N315
cguuaauaucaugcuua

SEQ ID NO: 4039851 - RNA, 22 nt, Staphylococcus aureus subsp. aureus N315
cguuaguauaaacguccaaaca

SEQ ID NO: 4039852 - RNA, 19 nt, Staphylococcus aureus subsp. aureus N315
cguuauaaguacaaauaau

SEQ ID NO: 4039853 - RNA, 15 nt, Staphylococcus aureus subsp. aureus N315
cguuauagauaagua

SEQ ID NO: 4039854 - RNA, 20 nt, Staphylococcus aureus subsp. aureus N315
cguuaucuuuaaguaauuca

SEQ ID NO: 4039855 - RNA, 16 nt, Staphylococcus aureus subsp. aureus N315
cguuauuuucaauaaa

SEQ ID NO: 4039856 - RNA, 21 nt, Staphylococcus aureus subsp. aureus N315
cguuauuuucaauauuugaua

SEQ ID NO: 4039857 - RNA, 19 nt, Staphylococcus aureus subsp. aureus N315
cguucaagaacaaucaaua

SEQ ID NO: 4039858 - RNA, 17 nt, Staphylococcus aureus subsp. aureus N315
cguucaauguuauuaaa

SEQ ID NO: 4039859 - RNA, 13 nt, Staphylococcus aureus subsp. aureus N315
cguucauauauuu

SEQ ID NO: 4039860 - RNA, 14 nt, Staphylococcus aureus subsp. aureus N315
cguucauauauuuu

SEQ ID NO: 4039861 - RNA, 15 nt, Staphylococcus aureus subsp. aureus N315
cguucccauucuuug

SEQ ID NO: 4039862 - RNA, 19 nt, Staphylococcus aureus subsp. aureus N315
cguucgaaguagcuuguuu

SEQ ID NO: 4039863 - RNA, 10 nt, Staphylococcus aureus subsp. aureus N315
cguucugcua

SEQ ID NO: 4039864 - RNA, 11 nt, Staphylococcus aureus subsp. aureus N315
cguucugcuaa

SEQ ID NO: 4039865 - RNA, 12 nt, Staphylococcus aureus subsp. aureus N315
cguucugcuaau

SEQ ID NO: 4039866 - RNA, 21 nt, Staphylococcus aureus subsp. aureus N315
cguucuugguauuuuuuaaau

SEQ ID NO: 4039867 - RNA, 16 nt, Staphylococcus aureus subsp. aureus N315
cguucuuguauuuccu

SEQ ID NO: 4039868 - RNA, 21 nt, Staphylococcus aureus subsp. aureus N315
cguugaauuaacaauauuaaa

SEQ ID NO: 4039869 - RNA, 16 nt, Staphylococcus aureus subsp. aureus N315
cguugaccuuguucuu

SEQ ID NO: 4039870 - RNA, 17 nt, Staphylococcus aureus subsp. aureus N315
cguugguauucaucuuc

SEQ ID NO: 4039871 - RNA, 18 nt, Staphylococcus aureus subsp. aureus N315
cguugguugugauuuguu

SEQ ID NO: 4039872 - RNA, 23 nt, Staphylococcus aureus subsp. aureus N315
cguuguaggaagaccacuauuuu

SEQ ID NO: 4039873 - RNA, 21 nt, Staphylococcus aureus subsp. aureus N315
cguuuaacaaacguuguucaa

SEQ ID NO: 4039874 - RNA, 12 nt, Staphylococcus aureus subsp. aureus N315
cguuuaauaaug

SEQ ID NO: 4039875 - RNA, 16 nt, Staphylococcus aureus subsp. aureus N315
cguuuaauaccuauga

SEQ ID NO: 4039876 - RNA, 18 nt, Staphylococcus aureus subsp. aureus N315
cguuuaccgucuuuugca

SEQ ID NO: 4039877 - RNA, 21 nt, Staphylococcus aureus subsp. aureus N315
cguuucagaaguuguuuagaa

SEQ ID NO: 4039878 - RNA, 15 nt, Staphylococcus aureus subsp. aureus N315
cguuucuguuucauc

SEQ ID NO: 4039879 - RNA, 17 nt, Staphylococcus aureus subsp. aureus N315
cguuucuguuucaucac

SEQ ID NO: 4039880 - RNA, 19 nt, Staphylococcus aureus subsp. aureus N315
cguuugaaugaaccuuuac

SEQ ID NO: 4039881 - RNA, 12 nt, Staphylococcus aureus subsp. aureus N315
cguuuguguguu

SEQ ID NO: 4039882 - RNA, 17 nt, Staphylococcus aureus subsp. aureus N315
cguuuguguguuuuaaa

SEQ ID NO: 4039883 - RNA, 12 nt, Staphylococcus aureus subsp. aureus N315
cguuuuccauga

SEQ ID NO: 4039884 - RNA, 16 nt, Staphylococcus aureus subsp. aureus N315
cguuuuccaugaguuu

SEQ ID NO: 4039885 - RNA, 13 nt, Staphylococcus aureus subsp. aureus N315
cguuuuuuuaaau

SEQ ID NO: 4039886 - RNA, 13 nt, Staphylococcus aureus subsp. aureus N315
cuaaaaaaauuaa

SEQ ID NO: 4039887 - RNA, 15 nt, Staphylococcus aureus subsp. aureus N315
cuaaaaaaauuaaaa

SEQ ID NO: 4039888 - RNA, 13 nt, Staphylococcus aureus subsp. aureus N315
cuaaaaacauaaa

SEQ ID NO: 4039889 - RNA, 13 nt, Staphylococcus aureus subsp. aureus N315
cuaaaaacuguga

SEQ ID NO: 4039890 - RNA, 21 nt, Staphylococcus aureus subsp. aureus N315
cuaaaaagcgugguucccaau

SEQ ID NO: 4039891 - RNA, 17 nt, Staphylococcus aureus subsp. aureus N315
cuaaaacaucacuugcu

SEQ ID NO: 4039892 - RNA, 20 nt, Staphylococcus aureus subsp. aureus N315
cuaaaacaugauacgugguu

SEQ ID NO: 4039893 - RNA, 21 nt, Staphylococcus aureus subsp. aureus N315
cuaaaacaugauacgugguuu

SEQ ID NO: 4039894 - RNA, 20 nt, Staphylococcus aureus subsp. aureus N315
cuaaaaccuauuccuaauaa

SEQ ID NO: 4039895 - RNA, 14 nt, Staphylococcus aureus subsp. aureus N315
cuaauagcauuugu

SEQ ID NO: 4039896 - RNA, 15 nt, Staphylococcus aureus subsp. aureus N315
cuaauaggaucaccu

SEQ ID NO: 4039897 - RNA, 15 nt, Staphylococcus aureus subsp. aureus N315
cuaauauauuaauuu

SEQ ID NO: 4039898 - RNA, 14 nt, Staphylococcus aureus subsp. aureus N315
cuaauaucaauaau

SEQ ID NO: 4039899 - RNA, 15 nt, Staphylococcus aureus subsp. aureus N315
cuaauaucaauuuuu

SEQ ID NO: 4039900 - RNA, 22 nt, Staphylococcus aureus subsp. aureus N315
cuaauaucaauuuuuacuaaau

SEQ ID NO: 4039901 - RNA, 22 nt, Staphylococcus aureus subsp. aureus N315
cuaauaucaucuuguuguucug

SEQ ID NO: 4039902 - RNA, 24 nt, Staphylococcus aureus subsp. aureus N315
cuaauauuagauaucuuaaucuaa

SEQ ID NO: 4039903 - RNA, 15 nt, Staphylococcus aureus subsp. aureus N315
cuaauauuuuaaacg

SEQ ID NO: 4039904 - RNA, 16 nt, Staphylococcus aureus subsp. aureus N315
cuaauauuuuaaacgu

SEQ ID NO: 4039905 - RNA, 12 nt, Staphylococcus aureus subsp. aureus N315
cuaaucaauacu

SEQ ID NO: 4039906 - RNA, 19 nt, Staphylococcus aureus subsp. aureus N315
cuaaucaugaaguugguuu

SEQ ID NO: 4039907 - RNA, 16 nt, Staphylococcus aureus subsp. aureus N315
cuaaucgcauuuuuua

SEQ ID NO: 4039908 - RNA, 22 nt, Staphylococcus aureus subsp. aureus N315
cuaaucguguauuauugaaacu

SEQ ID NO: 4039909 - RNA, 16 nt, Staphylococcus aureus subsp. aureus N315
cuaaucuauuuagcuu

SEQ ID NO: 4039910 - RNA, 14 nt, Staphylococcus aureus subsp. aureus N315
cuaaucucagauuu

SEQ ID NO: 4039911 - RNA, 20 nt, Staphylococcus aureus subsp. aureus N315
cuaaucuugguucagcuuua

SEQ ID NO: 4039912 - RNA, 21 nt, Staphylococcus aureus subsp. aureus N315
cuaaugagcccguuaaaaaga

SEQ ID NO: 4039913 - RNA, 22 nt, Staphylococcus aureus subsp. aureus N315
cuaaugagcccguuaaaaagac

SEQ ID NO: 4039914 - RNA, 18 nt, Staphylococcus aureus subsp. aureus N315
cuaaugauuaaaaaucaa

SEQ ID NO: 4039915 - RNA, 14 nt, Staphylococcus aureus subsp. aureus N315
cuaaugauuuauua

SEQ ID NO: 4039916 - RNA, 19 nt, Staphylococcus aureus subsp. aureus N315
cuaaugcacgugagaaacu

SEQ ID NO: 4039917 - RNA, 18 nt, Staphylococcus aureus subsp. aureus N315
cuaaugcuaauuuaacug

SEQ ID NO: 4039918 - RNA, 12 nt, Staphylococcus aureus subsp. aureus N315
cuaaugcuauau

SEQ ID NO: 4039919 - RNA, 14 nt, Staphylococcus aureus subsp. aureus N315
cuaaugcuauauua

SEQ ID NO: 4039920 - RNA, 16 nt, Staphylococcus aureus subsp. aureus N315
cuaaugcuuuaauaaa

SEQ ID NO: 4039921 - RNA, 19 nt, Staphylococcus aureus subsp. aureus N315
cuaauggcuaauacaaaac

SEQ ID NO: 4039922 - RNA, 18 nt, Staphylococcus aureus subsp. aureus N315
cuaaugguuucauaaacu

SEQ ID NO: 4039923 - RNA, 20 nt, Staphylococcus aureus subsp. aureus N315
cuaauguuaaaauaacugcu

SEQ ID NO: 4039924 - RNA, 13 nt, Staphylococcus aureus subsp. aureus N315
cuaauuauauuaa

SEQ ID NO: 4039925 - RNA, 14 nt, Staphylococcus aureus subsp. aureus N315
cuaauucgccaucu

SEQ ID NO: 4039926 - RNA, 19 nt, Staphylococcus aureus subsp. aureus N315
cuaauucgccaucuuuuuu

SEQ ID NO: 4039927 - RNA, 14 nt, Staphylococcus aureus subsp. aureus N315
cuaauucugaaauc

SEQ ID NO: 4039928 - RNA, 13 nt, Staphylococcus aureus subsp. aureus N315
cuaauucuguuuc

SEQ ID NO: 4039929 - RNA, 20 nt, Staphylococcus aureus subsp. aureus N315
cuaauucuugagcaaugucu

SEQ ID NO: 4039930 - RNA, 21 nt, Staphylococcus aureus subsp. aureus N315
cuaauugaaggccauuuuuau

SEQ ID NO: 4039931 - RNA, 16 nt, Staphylococcus aureus subsp. aureus N315
cuaauugagagaaguu

SEQ ID NO: 4039932 - RNA, 21 nt, Staphylococcus aureus subsp. aureus N315
cuaauuuaaaugauuucacuu

SEQ ID NO: 4039933 - RNA, 11 nt, Staphylococcus aureus subsp. aureus N315
cuaauuuauaa

SEQ ID NO: 4039934 - RNA, 22 nt, Staphylococcus aureus subsp. aureus N315
cuaauuucuaauacauacugau

SEQ ID NO: 4039935 - RNA, 18 nt, Staphylococcus aureus subsp. aureus N315
cuaauuucuauagaaaaa

SEQ ID NO: 4039936 - RNA, 12 nt, Staphylococcus aureus subsp. aureus N315
cuaauuuuaauu

SEQ ID NO: 4039937 - RNA, 17 nt, Staphylococcus aureus subsp. aureus N315
cuaauuuuaauuuucag

SEQ ID NO: 4039938 - RNA, 23 nt, Staphylococcus aureus subsp. aureus N315
cuaauuuugugaauuuauuuugu

SEQ ID NO: 4039939 - RNA, 13 nt, Staphylococcus aureus subsp. aureus N315
cuaauuuuuucau

SEQ ID NO: 4039940 - RNA, 23 nt, Staphylococcus aureus subsp. aureus N315
cuacaaaguuuauacuuaauaua

SEQ ID NO: 4039941 - RNA, 23 nt, Staphylococcus aureus subsp. aureus N315
cuacaacgaagaauccuaugcca

SEQ ID NO: 4039942 - RNA, 14 nt, Staphylococcus aureus subsp. aureus N315
cuacaacuucuucu

SEQ ID NO: 4039943 - RNA, 23 nt, Staphylococcus aureus subsp. aureus N315
cuacaacuucuucuccguauuua

SEQ ID NO: 4039944 - RNA, 16 nt, Staphylococcus aureus subsp. aureus N315
cuacaauauagaaaau

SEQ ID NO: 4039945 - RNA, 22 nt, Staphylococcus aureus subsp. aureus N315
cuacaaucauaccggcaaauaa

SEQ ID NO: 4039946 - RNA, 22 nt, Staphylococcus aureus subsp. aureus N315
cuacaauccuauggcgcaauuu

SEQ ID NO: 4039947 - RNA, 20 nt, Staphylococcus aureus subsp. aureus N315
cuacaauucauaagaaaaau

SEQ ID NO: 4039948 - RNA, 16 nt, Staphylococcus aureus subsp. aureus N315
cuacaauuuucucauu

SEQ ID NO: 4039949 - RNA, 14 nt, Staphylococcus aureus subsp. aureus N315
cuacaccaccugca

SEQ ID NO: 4039950 - RNA, 15 nt, Staphylococcus aureus subsp. aureus N315
cuacacggucccaag

SEQ ID NO: 4039951 - RNA, 14 nt, Staphylococcus aureus subsp. aureus N315
cuacacuguuuuau

SEQ ID NO: 4039952 - RNA, 19 nt, Staphylococcus aureus subsp. aureus N315
cuacacuguuuuauaaaug

SEQ ID NO: 4039953 - RNA, 14 nt, Staphylococcus aureus subsp. aureus N315
cuacacuuaauaua

SEQ ID NO: 4039954 - RNA, 22 nt, Staphylococcus aureus subsp. aureus N315
cuacacuuggcuuaggaugaaa

SEQ ID NO: 4039955 - RNA, 21 nt, Staphylococcus aureus subsp. aureus N315
cuacagaauggauaccuaaag

SEQ ID NO: 4039956 - RNA, 17 nt, Staphylococcus aureus subsp. aureus N315
cuacagauaaagcuucg

SEQ ID NO: 4039957 - RNA, 18 nt, Staphylococcus aureus subsp. aureus N315
cuacagauuuuaaaaauu

SEQ ID NO: 4039958 - RNA, 20 nt, Staphylococcus aureus subsp. aureus N315
cuacagauuuuaaaaauuca

SEQ ID NO: 4039959 - RNA, 13 nt, Staphylococcus aureus subsp. aureus N315
cuacagcacugaa

SEQ ID NO: 4039960 - RNA, 17 nt, Staphylococcus aureus subsp. aureus N315
cuacaggcaaugcaagu

SEQ ID NO: 4039961 - RNA, 15 nt, Staphylococcus aureus subsp. aureus N315
cuacaguguaugaug

SEQ ID NO: 4039962 - RNA, 18 nt, Staphylococcus aureus subsp. aureus N315
cuacauacaacucguuuu

SEQ ID NO: 4039963 - RNA, 15 nt, Staphylococcus aureus subsp. aureus N315
cuacauauuggcuug

SEQ ID NO: 4039964 - RNA, 16 nt, Staphylococcus aureus subsp. aureus N315
cuacaugaaucaacaa

SEQ ID NO: 4039965 - RNA, 16 nt, Staphylococcus aureus subsp. aureus N315
cuacauuaaagaaaau

SEQ ID NO: 4039966 - RNA, 20 nt, Staphylococcus aureus subsp. aureus N315
cuacauuaaagaaaauaucu

SEQ ID NO: 4039967 - RNA, 13 nt, Staphylococcus aureus subsp. aureus N315
cuaccaauaauuc

SEQ ID NO: 4039968 - RNA, 14 nt, Staphylococcus aureus subsp. aureus N315
cuaccaauaauucc

SEQ ID NO: 4039969 - RNA, 23 nt, Staphylococcus aureus subsp. aureus N315
cuaccaauacguuuccaaucuau

SEQ ID NO: 4039970 - RNA, 13 nt, Staphylococcus aureus subsp. aureus N315
cuacccuauuuua

SEQ ID NO: 4039971 - RNA, 18 nt, Staphylococcus aureus subsp. aureus N315
cuacccuugcaaauauau

SEQ ID NO: 4039972 - RNA, 23 nt, Staphylococcus aureus subsp. aureus N315
cuacgauuuucaagaccaaauau

SEQ ID NO: 4039973 - RNA, 15 nt, Staphylococcus aureus subsp. aureus N315
cuacgcccaucauca

SEQ ID NO: 4039974 - RNA, 23 nt, Staphylococcus aureus subsp. aureus N315
cuacguguguaguagcaccgauu

SEQ ID NO: 4039975 - RNA, 17 nt, Staphylococcus aureus subsp. aureus N315
cuacuaaaaaugcuuua

SEQ ID NO: 4039976 - RNA, 15 nt, Staphylococcus aureus subsp. aureus N315
cuacuaaucguugug

SEQ ID NO: 4039977 - RNA, 14 nt, Staphylococcus aureus subsp. aureus N315
cuacuauuaaauaa

SEQ ID NO: 4039978 - RNA, 23 nt, Staphylococcus aureus subsp. aureus N315
cuacugcaccgauaucauauaau

SEQ ID NO: 4039979 - RNA, 14 nt, Staphylococcus aureus subsp. aureus N315
cuacugucucaucu

SEQ ID NO: 4039980 - RNA, 24 nt, Staphylococcus aureus subsp. aureus N315
cuacuuaaauuaagaauaaucgaa

SEQ ID NO: 4039981 - RNA, 18 nt, Staphylococcus aureus subsp. aureus N315
cuacuuaauuaauaauuu

SEQ ID NO: 4039982 - RNA, 21 nt, Staphylococcus aureus subsp. aureus N315
cuaucguuuauugauagucac

SEQ ID NO: 4039983 - RNA, 14 nt, Staphylococcus aureus subsp. aureus N315
cuaucucuuuaguu

SEQ ID NO: 4039984 - RNA, 17 nt, Staphylococcus aureus subsp. aureus N315
cuaucuguaccguauuu

SEQ ID NO: 4039985 - RNA, 21 nt, Staphylococcus aureus subsp. aureus N315
cuaucuguaccguauuuuaau

SEQ ID NO: 4039986 - RNA, 14 nt, Staphylococcus aureus subsp. aureus N315
cuaucuucagauuc

SEQ ID NO: 4039987 - RNA, 23 nt, Staphylococcus aureus subsp. aureus N315
cuaugaaauuggaauagauguug

SEQ ID NO: 4039988 - RNA, 23 nt, Staphylococcus aureus subsp. aureus N315
cuaugaauuuagcaucaaaaaua

SEQ ID NO: 4039989 - RNA, 21 nt, Staphylococcus aureus subsp. aureus N315
cuaugauauauguaacauaaa

SEQ ID NO: 4039990 - RNA, 19 nt, Staphylococcus aureus subsp. aureus N315
cuauggcgcaauuuuuaac

SEQ ID NO: 4039991 - RNA, 23 nt, Staphylococcus aureus subsp. aureus N315
cuauggcgcaauuuuuaacaaaa

SEQ ID NO: 4039992 - RNA, 13 nt, Staphylococcus aureus subsp. aureus N315
cuauuaaaaccaa

SEQ ID NO: 4039993 - RNA, 19 nt, Staphylococcus aureus subsp. aureus N315
cuauuaaacauuuuugaau

SEQ ID NO: 4039994 - RNA, 13 nt, Staphylococcus aureus subsp. aureus N315
cuauuaaaggaaa

SEQ ID NO: 4039995 - RNA, 14 nt, Staphylococcus aureus subsp. aureus N315
cuauuaaugcucua

SEQ ID NO: 4039996 - RNA, 17 nt, Staphylococcus aureus subsp. aureus N315
cuauuaauuacgucaua

SEQ ID NO: 4039997 - RNA, 14 nt, Staphylococcus aureus subsp. aureus N315
cuauuaauuuacuc

SEQ ID NO: 4039998 - RNA, 22 nt, Staphylococcus aureus subsp. aureus N315
cuauuacuacauaauuuaucaa

SEQ ID NO: 4039999 - RNA, 15 nt, Staphylococcus aureus subsp. aureus N315
cuauuacuauaaaaa

SEQ ID NO: 4040000 - RNA, 20 nt, Staphylococcus aureus subsp. aureus N315
cuauuagauacauauaagaa

SEQ ID NO: 4040001 - RNA, 18 nt, Staphylococcus aureus subsp. aureus N315
cuauuaggauccaauuua

SEQ ID NO: 4040002 - RNA, 22 nt, Staphylococcus aureus subsp. aureus N315
cuauuauuauguuauaaauucu

SEQ ID NO: 4040003 - RNA, 23 nt, Staphylococcus aureus subsp. aureus N315
cuauucacgaaauuacuuuaaca

SEQ ID NO: 4040004 - RNA, 22 nt, Staphylococcus aureus subsp. aureus N315
cuauucccaaaaugauugccac

SEQ ID NO: 4040005 - RNA, 17 nt, Staphylococcus aureus subsp. aureus N315
cuauuccguuucauuga

SEQ ID NO: 4040006 - RNA, 20 nt, Staphylococcus aureus subsp. aureus N315
cuauuccuauuacuacauaa

SEQ ID NO: 4040007 - RNA, 21 nt, Staphylococcus aureus subsp. aureus N315
cuauugauauucuaaaaaauu

SEQ ID NO: 4040008 - RNA, 23 nt, Staphylococcus aureus subsp. aureus N315
cuauugauauucuaaaaaauuaa

SEQ ID NO: 4040009 - RNA, 20 nt, Staphylococcus aureus subsp. aureus N315
cuauugcagaagaaaacuau

SEQ ID NO: 4040010 - RNA, 17 nt, Staphylococcus aureus subsp. aureus N315
cuauuggucauuacuaa

SEQ ID NO: 4040011 - RNA, 19 nt, Staphylococcus aureus subsp. aureus N315
cuauugugauauaugaaau

SEQ ID NO: 4040012 - RNA, 16 nt, Staphylococcus aureus subsp. aureus N315
cuauuuaaaagacaau

SEQ ID NO: 4040013 - RNA, 14 nt, Staphylococcus aureus subsp. aureus N315
cuauuuauugagau

SEQ ID NO: 4040014 - RNA, 21 nt, Staphylococcus aureus subsp. aureus N315
cuauuucaacaaacauaaaua

SEQ ID NO: 4040015 - RNA, 22 nt, Staphylococcus aureus subsp. aureus N315
cuauuucaacaaacauaaauaa

SEQ ID NO: 4040016 - RNA, 15 nt, Staphylococcus aureus subsp. aureus N315
cuauuuuauaaaaua

SEQ ID NO: 4040017 - RNA, 16 nt, Staphylococcus aureus subsp. aureus N315
cuauuuuauacauaaa

SEQ ID NO: 4040018 - RNA, 21 nt, Staphylococcus aureus subsp. aureus N315
cuauuuuccaucacauaacua

SEQ ID NO: 4040019 - RNA, 12 nt, Staphylococcus aureus subsp. aureus N315
cuauuuuuaaau

SEQ ID NO: 4040020 - RNA, 11 nt, Staphylococcus aureus subsp. aureus N315
cuauuuuuaau

SEQ ID NO: 4040021 - RNA, 19 nt, Staphylococcus aureus subsp. aureus N315
cuauuuuucgauuuugaga

SEQ ID NO: 4040022 - RNA, 16 nt, Staphylococcus aureus subsp. aureus N315
cuauuuuugauuuaau

SEQ ID NO: 4040023 - RNA, 17 nt, Staphylococcus aureus subsp. aureus N315
cuauuuuugauuuaaua

SEQ ID NO: 4040024 - RNA, 16 nt, Staphylococcus aureus subsp. aureus N315
cucaaaaagccaacac

SEQ ID NO: 4040025 - RNA, 14 nt, Staphylococcus aureus subsp. aureus N315
cucaaaacaauuua

SEQ ID NO: 4040026 - RNA, 20 nt, Staphylococcus aureus subsp. aureus N315
cucaaaagcuguaguuucaa

SEQ ID NO: 4040027 - RNA, 19 nt, Staphylococcus aureus subsp. aureus N315
cucaaacguucaucuaauu

SEQ ID NO: 4040028 - RNA, 20 nt, Staphylococcus aureus subsp. aureus N315
cucaaagguuuacuauuaaa

SEQ ID NO: 4040029 - RNA, 17 nt, Staphylococcus aureus subsp. aureus N315
cucaacacgauagucau

SEQ ID NO: 4040030 - RNA, 12 nt, Staphylococcus aureus subsp. aureus N315
cucaacagcaaa

SEQ ID NO: 4040031 - RNA, 12 nt, Staphylococcus aureus subsp. aureus N315
cucaacauuuug

SEQ ID NO: 4040032 - RNA, 18 nt, Staphylococcus aureus subsp. aureus N315
cucaacgggaacaucaua

SEQ ID NO: 4040033 - RNA, 20 nt, Staphylococcus aureus subsp. aureus N315
cucaacgggaacaucauaau

SEQ ID NO: 4040034 - RNA, 20 nt, Staphylococcus aureus subsp. aureus N315
cucaaggaaaucauauauuu

SEQ ID NO: 4040035 - RNA, 18 nt, Staphylococcus aureus subsp. aureus N315
cucaaguaaucaagcaau

SEQ ID NO: 4040036 - RNA, 23 nt, Staphylococcus aureus subsp. aureus N315
cucaagugauuucccacgugccu

SEQ ID NO: 4040037 - RNA, 21 nt, Staphylococcus aureus subsp. aureus N315
cucaauuuaguauaaauaaaa

SEQ ID NO: 4040038 - RNA, 23 nt, Staphylococcus aureus subsp. aureus N315
cucaauuuaguauaaauaaaaau

SEQ ID NO: 4040039 - RNA, 12 nt, Staphylococcus aureus subsp. aureus N315
cucacaacugca

SEQ ID NO: 4040040 - RNA, 13 nt, Staphylococcus aureus subsp. aureus N315
cucacaugugaaa

SEQ ID NO: 4040041 - RNA, 13 nt, Staphylococcus aureus subsp. aureus N315
cucaccaaguuca

SEQ ID NO: 4040042 - RNA, 23 nt, Staphylococcus aureus subsp. aureus N315
cucaccuuuagacaauauuuuua

SEQ ID NO: 4040043 - RNA, 15 nt, Staphylococcus aureus subsp. aureus N315
cucaccuuuaucauu

SEQ ID NO: 4040044 - RNA, 17 nt, Staphylococcus aureus subsp. aureus N315
cucacgauuaauaaaau

SEQ ID NO: 4040045 - RNA, 19 nt, Staphylococcus aureus subsp. aureus N315
cucacuuggccuaaguuau

SEQ ID NO: 4040046 - RNA, 18 nt, Staphylococcus aureus subsp. aureus N315
cucagguuguuaggggcu

SEQ ID NO: 4040047 - RNA, 13 nt, Staphylococcus aureus subsp. aureus N315
cucagugcauuuu

SEQ ID NO: 4040048 - RNA, 15 nt, Staphylococcus aureus subsp. aureus N315
cucagugcauuuuuu

SEQ ID NO: 4040049 - RNA, 17 nt, Staphylococcus aureus subsp. aureus N315
cucagugcauuuuuuau

SEQ ID NO: 4040050 - RNA, 17 nt, Staphylococcus aureus subsp. aureus N315
cucauaaaauacgcaaa

SEQ ID NO: 4040051 - RNA, 13 nt, Staphylococcus aureus subsp. aureus N315
cucauaaaucaug

SEQ ID NO: 4040052 - RNA, 14 nt, Staphylococcus aureus subsp. aureus N315
cucauacaaauuuu

SEQ ID NO: 4040053 - RNA, 15 nt, Staphylococcus aureus subsp. aureus N315
cucauacaaauuuuu

SEQ ID NO: 4040054 - RNA, 16 nt, Staphylococcus aureus subsp. aureus N315
cucauaccaaaaacau

SEQ ID NO: 4040055 - RNA, 19 nt, Staphylococcus aureus subsp. aureus N315
cucauaccaaaaacauuaa

SEQ ID NO: 4040056 - RNA, 16 nt, Staphylococcus aureus subsp. aureus N315
cucauaucuauuuuuc

SEQ ID NO: 4040057 - RNA, 16 nt, Staphylococcus aureus subsp. aureus N315
cucauauugaauacuu

SEQ ID NO: 4040058 - RNA, 14 nt, Staphylococcus aureus subsp. aureus N315
cucaucauuuaaaa

SEQ ID NO: 4040059 - RNA, 22 nt, Staphylococcus aureus subsp. aureus N315
cucaucauuuaaaauuugugca

SEQ ID NO: 4040060 - RNA, 12 nt, Staphylococcus aureus subsp. aureus N315
cucaucuaauuu

SEQ ID NO: 4040061 - RNA, 18 nt, Staphylococcus aureus subsp. aureus N315
cucaucuaauuuaugaau

SEQ ID NO: 4040062 - RNA, 17 nt, Staphylococcus aureus subsp. aureus N315
cucaucuacuauuuaau

SEQ ID NO: 4040063 - RNA, 22 nt, Staphylococcus aureus subsp. aureus N315
cucaucuauuuaauaauguauc

SEQ ID NO: 4040064 - RNA, 12 nt, Staphylococcus aureus subsp. aureus N315
cucaucuucuaa

SEQ ID NO: 4040065 - RNA, 16 nt, Staphylococcus aureus subsp. aureus N315
cucauuaaccuuacau

SEQ ID NO: 4040066 - RNA, 13 nt, Staphylococcus aureus subsp. aureus N315
cucauuaauaaau

SEQ ID NO: 4040067 - RNA, 18 nt, Staphylococcus aureus subsp. aureus N315
cucauuagcgaaaacuaa

SEQ ID NO: 4040068 - RNA, 14 nt, Staphylococcus aureus subsp. aureus N315
cucauuagcgcaag

SEQ ID NO: 4040069 - RNA, 14 nt, Staphylococcus aureus subsp. aureus N315
cugacaauucaucu

SEQ ID NO: 4040070 - RNA, 22 nt, Staphylococcus aureus subsp. aureus N315
cugacucguugaccuuguucuu

SEQ ID NO: 4040071 - RNA, 12 nt, Staphylococcus aureus subsp. aureus N315
cugacuuuccac

SEQ ID NO: 4040072 - RNA, 18 nt, Staphylococcus aureus subsp. aureus N315
cugacuuuccaccagccu

SEQ ID NO: 4040073 - RNA, 19 nt, Staphylococcus aureus subsp. aureus N315
cugacuuuuaaaaaacaua

SEQ ID NO: 4040074 - RNA, 18 nt, Staphylococcus aureus subsp. aureus N315
cugagaaaaauauuucua

SEQ ID NO: 4040075 - RNA, 13 nt, Staphylococcus aureus subsp. aureus N315
cugagauugagaa

SEQ ID NO: 4040076 - RNA, 18 nt, Staphylococcus aureus subsp. aureus N315
cugaguucaauuaaauua

SEQ ID NO: 4040077 - RNA, 14 nt, Staphylococcus aureus subsp. aureus N315
cugauaaaugaauu

SEQ ID NO: 4040078 - RNA, 18 nt, Staphylococcus aureus subsp. aureus N315
cugauaauacuguuuaaa

SEQ ID NO: 4040079 - RNA, 22 nt, Staphylococcus aureus subsp. aureus N315
cugauaauacuguuuaaauaaa

SEQ ID NO: 4040080 - RNA, 22 nt, Staphylococcus aureus subsp. aureus N315
cugauaauuuuucuucuuuuuu

SEQ ID NO: 4040081 - RNA, 22 nt, Staphylococcus aureus subsp. aureus N315
cugauacagaaccaacaauaaa

SEQ ID NO: 4040082 - RNA, 18 nt, Staphylococcus aureus subsp. aureus N315
cugauauugaucugauuu

SEQ ID NO: 4040083 - RNA, 17 nt, Staphylococcus aureus subsp. aureus N315
cugaucgcauguuugua

SEQ ID NO: 4040084 - RNA, 20 nt, Staphylococcus aureus subsp. aureus N315
cugaugcuucgaauuuaaca

SEQ ID NO: 4040085 - RNA, 18 nt, Staphylococcus aureus subsp. aureus N315
cugauuauguucagaacu

SEQ ID NO: 4040086 - RNA, 19 nt, Staphylococcus aureus subsp. aureus N315
cugauucuucacuaaaaau

SEQ ID NO: 4040087 - RNA, 23 nt, Staphylococcus aureus subsp. aureus N315
cugauugcugcuguacaauuucg

SEQ ID NO: 4040088 - RNA, 19 nt, Staphylococcus aureus subsp. aureus N315
cugauugggcugauaauaa

SEQ ID NO: 4040089 - RNA, 15 nt, Staphylococcus aureus subsp. aureus N315
cugauuuuguuucaa

SEQ ID NO: 4040090 - RNA, 11 nt, Staphylococcus aureus subsp. aureus N315
cugauuuuuua

SEQ ID NO: 4040091 - RNA, 16 nt, Staphylococcus aureus subsp. aureus N315
cugcaaacacaguaca

SEQ ID NO: 4040092 - RNA, 21 nt, Staphylococcus aureus subsp. aureus N315
cugcaaacacaguacaaauaa

SEQ ID NO: 4040093 - RNA, 23 nt, Staphylococcus aureus subsp. aureus N315
cugcaaacacaguacaaauaaca

SEQ ID NO: 4040094 - RNA, 22 nt, Staphylococcus aureus subsp. aureus N315
cugcaagucguucucuuaaaua

SEQ ID NO: 4040095 - RNA, 23 nt, Staphylococcus aureus subsp. aureus N315
cugcaagucguucucuuaaauau

SEQ ID NO: 4040096 - RNA, 16 nt, Staphylococcus aureus subsp. aureus N315
cugcaaucguugaaaa

SEQ ID NO: 4040097 - RNA, 17 nt, Staphylococcus aureus subsp. aureus N315
cugcacaucauaauaaa

SEQ ID NO: 4040098 - RNA, 15 nt, Staphylococcus aureus subsp. aureus N315
cugcacauuccaucu

SEQ ID NO: 4040099 - RNA, 18 nt, Staphylococcus aureus subsp. aureus N315
cugcaccgauaucauaua

SEQ ID NO: 4040100 - RNA, 22 nt, Staphylococcus aureus subsp. aureus N315
cugcaccuaaggcuaaugauaa

SEQ ID NO: 4040101 - RNA, 22 nt, Staphylococcus aureus subsp. aureus N315
cugcagaguaaccuuucgcagc

SEQ ID NO: 4040102 - RNA, 13 nt, Staphylococcus aureus subsp. aureus N315
cugcagcaauuac

SEQ ID NO: 4040103 - RNA, 12 nt, Staphylococcus aureus subsp. aureus N315
cugcagucgcuu

SEQ ID NO: 4040104 - RNA, 15 nt, Staphylococcus aureus subsp. aureus N315
cugcaguugauugca

SEQ ID NO: 4040105 - RNA, 17 nt, Staphylococcus aureus subsp. aureus N315
cugcaugggcuucugcu

SEQ ID NO: 4040106 - RNA, 18 nt, Staphylococcus aureus subsp. aureus N315
cugccaaauauaauuuca

SEQ ID NO: 4040107 - RNA, 21 nt, Staphylococcus aureus subsp. aureus N315
cugccaaauauaauuucaauu

SEQ ID NO: 4040108 - RNA, 23 nt, Staphylococcus aureus subsp. aureus N315
cugccaauaaaaugcaauuuuuc

SEQ ID NO: 4040109 - RNA, 15 nt, Staphylococcus aureus subsp. aureus N315
cugccauauagauau

SEQ ID NO: 4040110 - RNA, 13 nt, Staphylococcus aureus subsp. aureus N315
cugccauauguuu

SEQ ID NO: 4040111 - RNA, 20 nt, Staphylococcus aureus subsp. aureus N315
cugccauuaaacgaaugauu

SEQ ID NO: 4040112 - RNA, 19 nt, Staphylococcus aureus subsp. aureus N315
cugcccuuuagucauguuu

SEQ ID NO: 4040113 - RNA, 18 nt, Staphylococcus aureus subsp. aureus N315
cugcuaaaauaaaauuaa

SEQ ID NO: 4040114 - RNA, 20 nt, Staphylococcus aureus subsp. aureus N315
cugcuaacucugaucuaaaa

SEQ ID NO: 4040115 - RNA, 14 nt, Staphylococcus aureus subsp. aureus N315
cugcuaauuuuuuc

SEQ ID NO: 4040116 - RNA, 17 nt, Staphylococcus aureus subsp. aureus N315
cugcuaguucagcuucu

SEQ ID NO: 4040117 - RNA, 14 nt, Staphylococcus aureus subsp. aureus N315
cugcuguacguuua

SEQ ID NO: 4040118 - RNA, 22 nt, Staphylococcus aureus subsp. aureus N315
cugcuguucuuuuuauuuacuc

SEQ ID NO: 4040119 - RNA, 19 nt, Staphylococcus aureus subsp. aureus N315
cugcuucaacuacuucauc

SEQ ID NO: 4040120 - RNA, 19 nt, Staphylococcus aureus subsp. aureus N315
cugcuuuuaauaucuucua

SEQ ID NO: 4040121 - RNA, 18 nt, Staphylococcus aureus subsp. aureus N315
cuggaauauuaacaccag

SEQ ID NO: 4040122 - RNA, 19 nt, Staphylococcus aureus subsp. aureus N315
cuggaauugggaaauauuu

SEQ ID NO: 4040123 - RNA, 20 nt, Staphylococcus aureus subsp. aureus N315
cuggauuuuucuuauaaaaa

SEQ ID NO: 4040124 - RNA, 15 nt, Staphylococcus aureus subsp. aureus N315
cuggcaaauugccuu

SEQ ID NO: 4040125 - RNA, 19 nt, Staphylococcus aureus subsp. aureus N315
cuggguuaccaaguaauga

SEQ ID NO: 4040126 - RNA, 20 nt, Staphylococcus aureus subsp. aureus N315
cuggguuguuauuuauauga

SEQ ID NO: 4040127 - RNA, 18 nt, Staphylococcus aureus subsp. aureus N315
cugguacauaaauaccug

SEQ ID NO: 4040128 - RNA, 17 nt, Staphylococcus aureus subsp. aureus N315
cuggucgugaggcuggg

SEQ ID NO: 4040129 - RNA, 21 nt, Staphylococcus aureus subsp. aureus N315
cuggugguaacguaaacaugg

SEQ ID NO: 4040130 - RNA, 15 nt, Staphylococcus aureus subsp. aureus N315
cugguugauaaauaa

SEQ ID NO: 4040131 - RNA, 13 nt, Staphylococcus aureus subsp. aureus N315
cuguaaaacauuc

SEQ ID NO: 4040132 - RNA, 17 nt, Staphylococcus aureus subsp. aureus N315
cuguaaaucaucauaac

SEQ ID NO: 4040133 - RNA, 20 nt, Staphylococcus aureus subsp. aureus N315
cuguaacaaagucucuagua

SEQ ID NO: 4040134 - RNA, 17 nt, Staphylococcus aureus subsp. aureus N315
cuguaacgaguccauuu

SEQ ID NO: 4040135 - RNA, 23 nt, Staphylococcus aureus subsp. aureus N315
cuguaacgaguccauuuucuuuu

SEQ ID NO: 4040136 - RNA, 16 nt, Staphylococcus aureus subsp. aureus N315
cuguaaucaauccucu

SEQ ID NO: 4040137 - RNA, 19 nt, Staphylococcus aureus subsp. aureus N315
cuguacauccacuuuauaa

SEQ ID NO: 4040138 - RNA, 19 nt, Staphylococcus aureus subsp. aureus N315
cuguaccaucacuaaagua

SEQ ID NO: 4040139 - RNA, 21 nt, Staphylococcus aureus subsp. aureus N315
cuguaccaucacuaaaguaaa

SEQ ID NO: 4040140 - RNA, 20 nt, Staphylococcus aureus subsp. aureus N315
cuguaccguauuuuaauauu

SEQ ID NO: 4040141 - RNA, 21 nt, Staphylococcus aureus subsp. aureus N315
cuguaccguuuuuuauaaauc

SEQ ID NO: 4040142 - RNA, 12 nt, Staphylococcus aureus subsp. aureus N315
cuguaccugcua

SEQ ID NO: 4040143 - RNA, 21 nt, Staphylococcus aureus subsp. aureus N315
cuguacuuugccacuuugugg

SEQ ID NO: 4040144 - RNA, 23 nt, Staphylococcus aureus subsp. aureus N315
cuguagacaauuguaguaaugaa

SEQ ID NO: 4040145 - RNA, 13 nt, Staphylococcus aureus subsp. aureus N315
cuguagauaucaa

SEQ ID NO: 4040146 - RNA, 14 nt, Staphylococcus aureus subsp. aureus N315
cuguagauaucaaa

SEQ ID NO: 4040147 - RNA, 18 nt, Staphylococcus aureus subsp. aureus N315
cuguagcgauaccuuuaa

SEQ ID NO: 4040148 - RNA, 18 nt, Staphylococcus aureus subsp. aureus N315
cuguauaguaaccuuuau

SEQ ID NO: 4040149 - RNA, 11 nt, Staphylococcus aureus subsp. aureus N315
cuguauauaua

SEQ ID NO: 4040150 - RNA, 22 nt, Staphylococcus aureus subsp. aureus N315
cuguaucaaaaucgguuugauu

SEQ ID NO: 4040151 - RNA, 20 nt, Staphylococcus aureus subsp. aureus N315
cuguaugcgguuauaucauu

SEQ ID NO: 4040152 - RNA, 12 nt, Staphylococcus aureus subsp. aureus N315
cuguauuuacua

SEQ ID NO: 4040153 - RNA, 20 nt, Staphylococcus aureus subsp. aureus N315
cugucaauauaacauugcag

SEQ ID NO: 4040154 - RNA, 13 nt, Staphylococcus aureus subsp. aureus N315
cugucauuuucug

SEQ ID NO: 4040155 - RNA, 15 nt, Staphylococcus aureus subsp. aureus N315
cugucauuuucugcu

SEQ ID NO: 4040156 - RNA, 23 nt, Staphylococcus aureus subsp. aureus N315
cuuagcacuuggauuuuaauuau

SEQ ID NO: 4040157 - RNA, 18 nt, Staphylococcus aureus subsp. aureus N315
cuuaguaaggaauauuuc

SEQ ID NO: 4040158 - RNA, 19 nt, Staphylococcus aureus subsp. aureus N315
cuuaguaguuguacuucuu

SEQ ID NO: 4040159 - RNA, 16 nt, Staphylococcus aureus subsp. aureus N315
cuuaguuugacaucua

SEQ ID NO: 4040160 - RNA, 13 nt, Staphylococcus aureus subsp. aureus N315
cuuauaaaauaaa

SEQ ID NO: 4040161 - RNA, 15 nt, Staphylococcus aureus subsp. aureus N315
cuuauaaaaugaaau

SEQ ID NO: 4040162 - RNA, 19 nt, Staphylococcus aureus subsp. aureus N315
cuuauaaaaugaaauauuu

SEQ ID NO: 4040163 - RNA, 22 nt, Staphylococcus aureus subsp. aureus N315
cuuauaaacaaaagaucgauac

SEQ ID NO: 4040164 - RNA, 17 nt, Staphylococcus aureus subsp. aureus N315
cuuauaacaaaaauugc

SEQ ID NO: 4040165 - RNA, 14 nt, Staphylococcus aureus subsp. aureus N315
cuuauaacauucuu

SEQ ID NO: 4040166 - RNA, 15 nt, Staphylococcus aureus subsp. aureus N315
cuuauaacauucuuc

SEQ ID NO: 4040167 - RNA, 17 nt, Staphylococcus aureus subsp. aureus N315
cuuauaacauucuucaa

SEQ ID NO: 4040168 - RNA, 21 nt, Staphylococcus aureus subsp. aureus N315
cuuauaacauucuucaaaaaa

SEQ ID NO: 4040169 - RNA, 17 nt, Staphylococcus aureus subsp. aureus N315
cuuauaagauauagaag

SEQ ID NO: 4040170 - RNA, 13 nt, Staphylococcus aureus subsp. aureus N315
cuuauaaguucaa

SEQ ID NO: 4040171 - RNA, 14 nt, Staphylococcus aureus subsp. aureus N315
cuuauaauauuaaa

SEQ ID NO: 4040172 - RNA, 20 nt, Staphylococcus aureus subsp. aureus N315
cuuauacacuuacaaauauu

SEQ ID NO: 4040173 - RNA, 21 nt, Staphylococcus aureus subsp. aureus N315
cuuauacguuacggcuuugua

SEQ ID NO: 4040174 - RNA, 14 nt, Staphylococcus aureus subsp. aureus N315
cuuaucaacaacaa

SEQ ID NO: 4040175 - RNA, 16 nt, Staphylococcus aureus subsp. aureus N315
cuuaucaacagcuuca

SEQ ID NO: 4040176 - RNA, 18 nt, Staphylococcus aureus subsp. aureus N315
cuuaucaacagcuucaaa

SEQ ID NO: 4040177 - RNA, 22 nt, Staphylococcus aureus subsp. aureus N315
cuuaucagcauuaaucguauuu

SEQ ID NO: 4040178 - RNA, 20 nt, Staphylococcus aureus subsp. aureus N315
cuuaucaguuugcacuucaa

SEQ ID NO: 4040179 - RNA, 14 nt, Staphylococcus aureus subsp. aureus N315
cuuaucaucacacu

SEQ ID NO: 4040180 - RNA, 18 nt, Staphylococcus aureus subsp. aureus N315
cuuaucauuucaaauaag

SEQ ID NO: 4040181 - RNA, 23 nt, Staphylococcus aureus subsp. aureus N315
cuuaucgccuggugcaggcauca

SEQ ID NO: 4040182 - RNA, 19 nt, Staphylococcus aureus subsp. aureus N315
cuuaucuaaaucuucauca

SEQ ID NO: 4040183 - RNA, 22 nt, Staphylococcus aureus subsp. aureus N315
cuuaucuguaaauaacuuaugg

SEQ ID NO: 4040184 - RNA, 13 nt, Staphylococcus aureus subsp. aureus N315
cuuaugacugcuu

SEQ ID NO: 4040185 - RNA, 15 nt, Staphylococcus aureus subsp. aureus N315
cuuaugacugcuuuu

SEQ ID NO: 4040186 - RNA, 14 nt, Staphylococcus aureus subsp. aureus N315
cuuaugagcaaagc

SEQ ID NO: 4040187 - RNA, 18 nt, Staphylococcus aureus subsp. aureus N315
cuuaugauacugauauuu

SEQ ID NO: 4040188 - RNA, 15 nt, Staphylococcus aureus subsp. aureus N315
cuuaugaugucaugu

SEQ ID NO: 4040189 - RNA, 15 nt, Staphylococcus aureus subsp. aureus N315
cuuaugcauagcucu

SEQ ID NO: 4040190 - RNA, 14 nt, Staphylococcus aureus subsp. aureus N315
cuuaugguauuuac

SEQ ID NO: 4040191 - RNA, 16 nt, Staphylococcus aureus subsp. aureus N315
cuuaugucauauacua

SEQ ID NO: 4040192 - RNA, 20 nt, Staphylococcus aureus subsp. aureus N315
cuuauguggaggacacauuu

SEQ ID NO: 4040193 - RNA, 11 nt, Staphylococcus aureus subsp. aureus N315
cuuauuaacuu

SEQ ID NO: 4040194 - RNA, 13 nt, Staphylococcus aureus subsp. aureus N315
cuuauuauuuugu

SEQ ID NO: 4040195 - RNA, 20 nt, Staphylococcus aureus subsp. aureus N315
cuuauuauuuuguauuuuuc

SEQ ID NO: 4040196 - RNA, 22 nt, Staphylococcus aureus subsp. aureus N315
cuuauuauuuuguauuuuucaa

SEQ ID NO: 4040197 - RNA, 21 nt, Staphylococcus aureus subsp. aureus N315
cuuauugauauaagauucaua

SEQ ID NO: 4040198 - RNA, 14 nt, Staphylococcus aureus subsp. aureus N315
cuuauuucuuuuca

SEQ ID NO: 4040199 - RNA, 14 nt, Staphylococcus aureus subsp. aureus N315
cuuauuuguuuauu

SEQ ID NO: 4040200 - RNA, 15 nt, Staphylococcus aureus subsp. aureus N315
cuuauuuguuuauua

SEQ ID NO: 4040201 - RNA, 16 nt, Staphylococcus aureus subsp. aureus N315
cuuauuuguuuauuag

SEQ ID NO: 4040202 - RNA, 13 nt, Staphylococcus aureus subsp. aureus N315
cuuauuuuauacg

SEQ ID NO: 4040203 - RNA, 19 nt, Staphylococcus aureus subsp. aureus N315
cuuauuuuguuuuaaaaaa

SEQ ID NO: 4040204 - RNA, 12 nt, Staphylococcus aureus subsp. aureus N315
cuuauuuuucau

SEQ ID NO: 4040205 - RNA, 17 nt, Staphylococcus aureus subsp. aureus N315
cuucaaaaaauaauagc

SEQ ID NO: 4040206 - RNA, 17 nt, Staphylococcus aureus subsp. aureus N315
cuucaaaaguuuuugga

SEQ ID NO: 4040207 - RNA, 19 nt, Staphylococcus aureus subsp. aureus N315
cuucaaaguagauauugaa

SEQ ID NO: 4040208 - RNA, 14 nt, Staphylococcus aureus subsp. aureus N315
cuucaaaguuuuca

SEQ ID NO: 4040209 - RNA, 18 nt, Staphylococcus aureus subsp. aureus N315
cuucaaaguuuucauuuu

SEQ ID NO: 4040210 - RNA, 20 nt, Staphylococcus aureus subsp. aureus N315
cuucaaaguuuucauuuuuu

SEQ ID NO: 4040211 - RNA, 23 nt, Staphylococcus aureus subsp. aureus N315
cuucaaaguuuucauuuuuucaa

SEQ ID NO: 4040212 - RNA, 14 nt, Staphylococcus aureus subsp. aureus N315
cuucaacgucaucu

SEQ ID NO: 4040213 - RNA, 22 nt, Staphylococcus aureus subsp. aureus N315
cuucaacuucgauaugauuaaa

SEQ ID NO: 4040214 - RNA, 14 nt, Staphylococcus aureus subsp. aureus N315
cuucaagugccauu

SEQ ID NO: 4040215 - RNA, 14 nt, Staphylococcus aureus subsp. aureus N315
cuucaaguuguuuu

SEQ ID NO: 4040216 - RNA, 24 nt, Staphylococcus aureus subsp. aureus N315
cuucaauauucuuaucauucauua

SEQ ID NO: 4040217 - RNA, 17 nt, Staphylococcus aureus subsp. aureus N315
cuucaaucuaccaauac

SEQ ID NO: 4040218 - RNA, 22 nt, Staphylococcus aureus subsp. aureus N315
cuucaauuuaauguauugagaa

SEQ ID NO: 4040219 - RNA, 18 nt, Staphylococcus aureus subsp. aureus N315
cuucacacuuuuagaauc

SEQ ID NO: 4040220 - RNA, 14 nt, Staphylococcus aureus subsp. aureus N315
cuucacauuuaucc

SEQ ID NO: 4040221 - RNA, 20 nt, Staphylococcus aureus subsp. aureus N315
cuucaccaacuuuuuuaaca

SEQ ID NO: 4040222 - RNA, 14 nt, Staphylococcus aureus subsp. aureus N315
cuucaccaucuuua

SEQ ID NO: 4040223 - RNA, 15 nt, Staphylococcus aureus subsp. aureus N315
cuucacuaaaaauau

SEQ ID NO: 4040224 - RNA, 17 nt, Staphylococcus aureus subsp. aureus N315
cuucacuaaaaauauau

SEQ ID NO: 4040225 - RNA, 21 nt, Staphylococcus aureus subsp. aureus N315
cuucacugaaaauuuguauaa

SEQ ID NO: 4040226 - RNA, 15 nt, Staphylococcus aureus subsp. aureus N315
cuucagguguaguag

SEQ ID NO: 4040227 - RNA, 21 nt, Staphylococcus aureus subsp. aureus N315
cuucaguuaaaucuuuaacuu

SEQ ID NO: 4040228 - RNA, 20 nt, Staphylococcus aureus subsp. aureus N315
cuucauaaucguauucauau

SEQ ID NO: 4040229 - RNA, 21 nt, Staphylococcus aureus subsp. aureus N315
cuucauagucacuuuuaacga

SEQ ID NO: 4040230 - RNA, 17 nt, Staphylococcus aureus subsp. aureus N315
cuucauauuuagguaau

SEQ ID NO: 4040231 - RNA, 21 nt, Staphylococcus aureus subsp. aureus N315
cuucaucaauaaauauugauu

SEQ ID NO: 4040232 - RNA, 13 nt, Staphylococcus aureus subsp. aureus N315
cuucaucaauaac

SEQ ID NO: 4040233 - RNA, 16 nt, Staphylococcus aureus subsp. aureus N315
cuucaucaauaacuau

SEQ ID NO: 4040234 - RNA, 15 nt, Staphylococcus aureus subsp. aureus N315
cuucaucuuuaaaga

SEQ ID NO: 4040235 - RNA, 21 nt, Staphylococcus aureus subsp. aureus N315
cuucauuaguugcauaaucaa

SEQ ID NO: 4040236 - RNA, 23 nt, Staphylococcus aureus subsp. aureus N315
cuucauuauauaauucuucaaau

SEQ ID NO: 4040237 - RNA, 18 nt, Staphylococcus aureus subsp. aureus N315
cuucauuuauaacauuua

SEQ ID NO: 4040238 - RNA, 18 nt, Staphylococcus aureus subsp. aureus N315
cuuccaacauauaaaaaa

SEQ ID NO: 4040239 - RNA, 18 nt, Staphylococcus aureus subsp. aureus N315
cuuccaaucaacuucaua

SEQ ID NO: 4040240 - RNA, 14 nt, Staphylococcus aureus subsp. aureus N315
cuuccaauuuaaaa

SEQ ID NO: 4040241 - RNA, 14 nt, Staphylococcus aureus subsp. aureus N315
cuucccaaggaagu

SEQ ID NO: 4040242 - RNA, 20 nt, Staphylococcus aureus subsp. aureus N315
cuucccaucuuuuagguaau

SEQ ID NO: 4040243 - RNA, 14 nt, Staphylococcus aureus subsp. aureus N315
cuuccgcacugccu

SEQ ID NO: 4040244 - RNA, 17 nt, Staphylococcus aureus subsp. aureus N315
cuuggauuuuuugguuu

SEQ ID NO: 4040245 - RNA, 23 nt, Staphylococcus aureus subsp. aureus N315
cuuggcaaugaaauuaccaacac

SEQ ID NO: 4040246 - RNA, 14 nt, Staphylococcus aureus subsp. aureus N315
cuuggcauuuuuuc

SEQ ID NO: 4040247 - RNA, 19 nt, Staphylococcus aureus subsp. aureus N315
cuuggccaauuaacuugau

SEQ ID NO: 4040248 - RNA, 23 nt, Staphylococcus aureus subsp. aureus N315
cuuggcggggccccaacaaaaag

SEQ ID NO: 4040249 - RNA, 13 nt, Staphylococcus aureus subsp. aureus N315
cuuggcguauuuu

SEQ ID NO: 4040250 - RNA, 20 nt, Staphylococcus aureus subsp. aureus N315
cuuggcguauuuuuuguucu

SEQ ID NO: 4040251 - RNA, 18 nt, Staphylococcus aureus subsp. aureus N315
cuugggacagaaaacaaa

SEQ ID NO: 4040252 - RNA, 13 nt, Staphylococcus aureus subsp. aureus N315
cuugguauuuuuu

SEQ ID NO: 4040253 - RNA, 17 nt, Staphylococcus aureus subsp. aureus N315
cuugguauuuuuuaaau

SEQ ID NO: 4040254 - RNA, 16 nt, Staphylococcus aureus subsp. aureus N315
cuuguaaacuucuuuu

SEQ ID NO: 4040255 - RNA, 16 nt, Staphylococcus aureus subsp. aureus N315
cuuguaaauuuaaaug

SEQ ID NO: 4040256 - RNA, 12 nt, Staphylococcus aureus subsp. aureus N315
cuuguaacaagc

SEQ ID NO: 4040257 - RNA, 22 nt, Staphylococcus aureus subsp. aureus N315
cuuguaacaagcuuuucauuuu

SEQ ID NO: 4040258 - RNA, 21 nt, Staphylococcus aureus subsp. aureus N315
cuuguaacaagcuuuuuucaa

SEQ ID NO: 4040259 - RNA, 15 nt, Staphylococcus aureus subsp. aureus N315
cuuguaauauaacaa

SEQ ID NO: 4040260 - RNA, 18 nt, Staphylococcus aureus subsp. aureus N315
cuuguaauauaacaagua

SEQ ID NO: 4040261 - RNA, 15 nt, Staphylococcus aureus subsp. aureus N315
cuuguacacauccuc

SEQ ID NO: 4040262 - RNA, 19 nt, Staphylococcus aureus subsp. aureus N315
cuuguacacauccucauaa

SEQ ID NO: 4040263 - RNA, 16 nt, Staphylococcus aureus subsp. aureus N315
cuuguacgauaacuac

SEQ ID NO: 4040264 - RNA, 18 nt, Staphylococcus aureus subsp. aureus N315
cuuguauuuccuuaauau

SEQ ID NO: 4040265 - RNA, 15 nt, Staphylococcus aureus subsp. aureus N315
cuugucaguuuuuuu

SEQ ID NO: 4040266 - RNA, 21 nt, Staphylococcus aureus subsp. aureus N315
cuugucaguuuuuuuauaagc

SEQ ID NO: 4040267 - RNA, 17 nt, Staphylococcus aureus subsp. aureus N315
cuuguccuaacgcuaau

SEQ ID NO: 4040268 - RNA, 14 nt, Staphylococcus aureus subsp. aureus N315
cuugugaaauuaga

SEQ ID NO: 4040269 - RNA, 19 nt, Staphylococcus aureus subsp. aureus N315
cuugugguuggaagucugc

SEQ ID NO: 4040270 - RNA, 14 nt, Staphylococcus aureus subsp. aureus N315
cuugugugaaauua

SEQ ID NO: 4040271 - RNA, 13 nt, Staphylococcus aureus subsp. aureus N315
cuuguuaaaauaa

SEQ ID NO: 4040272 - RNA, 23 nt, Staphylococcus aureus subsp. aureus N315
cuuguuacacaugaguuaaacga

SEQ ID NO: 4040273 - RNA, 19 nt, Staphylococcus aureus subsp. aureus N315
cuuguucuccgaucaugcc

SEQ ID NO: 4040274 - RNA, 19 nt, Staphylococcus aureus subsp. aureus N315
cuuguugggucuuguaaac

SEQ ID NO: 4040275 - RNA, 21 nt, Staphylococcus aureus subsp. aureus N315
cuuguuguucuguaaugauau

SEQ ID NO: 4040276 - RNA, 14 nt, Staphylococcus aureus subsp. aureus N315
cuuguuuuaaacuu

SEQ ID NO: 4040277 - RNA, 12 nt, Staphylococcus aureus subsp. aureus N315
cuuguuuuaaau

SEQ ID NO: 4040278 - RNA, 14 nt, Staphylococcus aureus subsp. aureus N315
cuuguuuuaaauca

SEQ ID NO: 4040279 - RNA, 22 nt, Staphylococcus aureus subsp. aureus N315
cuuuaaaacaucauucacaagu

SEQ ID NO: 4040280 - RNA, 11 nt, Staphylococcus aureus subsp. aureus N315
cuuuaaacucg

SEQ ID NO: 4040281 - RNA, 20 nt, Staphylococcus aureus subsp. aureus N315
cuuuaaacucguaaauuuua

SEQ ID NO: 4040282 - RNA, 16 nt, Staphylococcus aureus subsp. aureus N315
cuuuaaaucuacuuug

SEQ ID NO: 4040283 - RNA, 11 nt, Staphylococcus aureus subsp. aureus N315
cuuuaaaucuu

SEQ ID NO: 4040284 - RNA, 21 nt, Staphylococcus aureus subsp. aureus N315
cuuuaaaucuuguucuaauug

SEQ ID NO: 4040285 - RNA, 15 nt, Staphylococcus aureus subsp. aureus N315
cuuuaacucuugaaa

SEQ ID NO: 4040286 - RNA, 21 nt, Staphylococcus aureus subsp. aureus N315
cuuuaacuguacgauucaauu

SEQ ID NO: 4040287 - RNA, 23 nt, Staphylococcus aureus subsp. aureus N315
cuuuaacuguacgauucaauuua

SEQ ID NO: 4040288 - RNA, 17 nt, Staphylococcus aureus subsp. aureus N315
cuuuaacuucuuuuguu

SEQ ID NO: 4040289 - RNA, 19 nt, Staphylococcus aureus subsp. aureus N315
cuuuaacuucuuuuguuuu

SEQ ID NO: 4040290 - RNA, 17 nt, Staphylococcus aureus subsp. aureus N315
cuuuaacuuuaauuaaa

SEQ ID NO: 4040291 - RNA, 16 nt, Staphylococcus aureus subsp. aureus N315
cuuuaagcccuucccc

SEQ ID NO: 4040292 - RNA, 14 nt, Staphylococcus aureus subsp. aureus N315
cuuuaagcuuaaau

SEQ ID NO: 4040293 - RNA, 18 nt, Staphylococcus aureus subsp. aureus N315
cuuuaaguaauucauuug

SEQ ID NO: 4040294 - RNA, 17 nt, Staphylococcus aureus subsp. aureus N315
cuuuaaguuauuuuguc

SEQ ID NO: 4040295 - RNA, 21 nt, Staphylococcus aureus subsp. aureus N315
cuuuaauacuaccguuuuuau

SEQ ID NO: 4040296 - RNA, 19 nt, Staphylococcus aureus subsp. aureus N315
cuuuaauagcgucaaguuu

SEQ ID NO: 4040297 - RNA, 19 nt, Staphylococcus aureus subsp. aureus N315
cuuuaauauaauuauuaaa

SEQ ID NO: 4040298 - RNA, 12 nt, Staphylococcus aureus subsp. aureus N315
cuuuaauaucua

SEQ ID NO: 4040299 - RNA, 18 nt, Staphylococcus aureus subsp. aureus N315
cuuuaaucauagcauuaa

SEQ ID NO: 4040300 - RNA, 15 nt, Staphylococcus aureus subsp. aureus N315
cuuuaauuaaaguua

SEQ ID NO: 4040301 - RNA, 18 nt, Staphylococcus aureus subsp. aureus N315
cuuuaauuaaaguuaaag

SEQ ID NO: 4040302 - RNA, 14 nt, Staphylococcus aureus subsp. aureus N315
cuuuaauugucuca

SEQ ID NO: 4040303 - RNA, 19 nt, Staphylococcus aureus subsp. aureus N315
cuuuaauugucucaucauu

SEQ ID NO: 4040304 - RNA, 16 nt, Staphylococcus aureus subsp. aureus N315
cuuuaauuguuaaauc

SEQ ID NO: 4040305 - RNA, 21 nt, Staphylococcus aureus subsp. aureus N315
cuuuaauuguuaaaucaccaa

SEQ ID NO: 4040306 - RNA, 16 nt, Staphylococcus aureus subsp. aureus N315
cuuuaauuuagugaaa

SEQ ID NO: 4040307 - RNA, 19 nt, Staphylococcus aureus subsp. aureus N315
cuuuaauuuuaccaucaau

SEQ ID NO: 4040308 - RNA, 18 nt, Staphylococcus aureus subsp. aureus N315
cuuuaauuuucuugccau

SEQ ID NO: 4040309 - RNA, 20 nt, Staphylococcus aureus subsp. aureus N315
cuuuacauucuuuguauuua

SEQ ID NO: 4040310 - RNA, 15 nt, Staphylococcus aureus subsp. aureus N315
cuuuaccaauaucau

SEQ ID NO: 4040311 - RNA, 14 nt, Staphylococcus aureus subsp. aureus N315
cuuuacgauaaaua

SEQ ID NO: 4040312 - RNA, 21 nt, Staphylococcus aureus subsp. aureus N315
cuuuacuugcuuuuucaaaua

SEQ ID NO: 4040313 - RNA, 14 nt, Staphylococcus aureus subsp. aureus N315
cuuuagaaagugau

SEQ ID NO: 4040314 - RNA, 21 nt, Staphylococcus aureus subsp. aureus N315
cuuuagaaagugauucccaaa

SEQ ID NO: 4040315 - RNA, 22 nt, Staphylococcus aureus subsp. aureus N315
cuuuagaugagauuucguuaga

SEQ ID NO: 4040316 - RNA, 22 nt, Staphylococcus aureus subsp. aureus N315
cuuuagcaaaaauauuuaaacu

SEQ ID NO: 4040317 - RNA, 22 nt, Staphylococcus aureus subsp. aureus N315
cuuuagcauauucgcuuaaaaa

SEQ ID NO: 4040318 - RNA, 17 nt, Staphylococcus aureus subsp. aureus N315
cuuuaggguucauugcu

SEQ ID NO: 4040319 - RNA, 13 nt, Staphylococcus aureus subsp. aureus N315
cuuuagguaaaag

SEQ ID NO: 4040320 - RNA, 15 nt, Staphylococcus aureus subsp. aureus N315
cuuuagguaaaagag

SEQ ID NO: 4040321 - RNA, 20 nt, Staphylococcus aureus subsp. aureus N315
cuuuauaacgcuuuaauaua

SEQ ID NO: 4040322 - RNA, 18 nt, Staphylococcus aureus subsp. aureus N315
cuuuauaagcuuuuucuu

SEQ ID NO: 4040323 - RNA, 12 nt, Staphylococcus aureus subsp. aureus N315
cuuuauaugaag

SEQ ID NO: 4040324 - RNA, 14 nt, Staphylococcus aureus subsp. aureus N315
cuuuauauuuauca

SEQ ID NO: 4040325 - RNA, 20 nt, Staphylococcus aureus subsp. aureus N315
cuuuaucgaauucuucuuua

SEQ ID NO: 4040326 - RNA, 14 nt, Staphylococcus aureus subsp. aureus N315
cuuuaugauaauaa

SEQ ID NO: 4040327 - RNA, 20 nt, Staphylococcus aureus subsp. aureus N315
cuuuauggguauccuucuca

SEQ ID NO: 4040328 - RNA, 21 nt, Staphylococcus aureus subsp. aureus N315
cuuuaugugcaucauuuauau

SEQ ID NO: 4040329 - RNA, 14 nt, Staphylococcus aureus subsp. aureus N315
cuuuauuaaaaauc

SEQ ID NO: 4040330 - RNA, 14 nt, Staphylococcus aureus subsp. aureus N315
cuuuauuacuuuaa

SEQ ID NO: 4040331 - RNA, 16 nt, Staphylococcus aureus subsp. aureus N315
cuuuauuauuuaaucu

SEQ ID NO: 4040332 - RNA, 19 nt, Staphylococcus aureus subsp. aureus N315
cuuuugauccaaaguacuc

SEQ ID NO: 4040333 - RNA, 22 nt, Staphylococcus aureus subsp. aureus N315
cuuuugggaagcgucuuuuuug

SEQ ID NO: 4040334 - RNA, 13 nt, Staphylococcus aureus subsp. aureus N315
cuuuuggucuguu

SEQ ID NO: 4040335 - RNA, 15 nt, Staphylococcus aureus subsp. aureus N315
cuuuuguuuuaccau

SEQ ID NO: 4040336 - RNA, 16 nt, Staphylococcus aureus subsp. aureus N315
cuuuuuaaaaucguua

SEQ ID NO: 4040337 - RNA, 23 nt, Staphylococcus aureus subsp. aureus N315
cuuuuuaaacguacauuuuuaug

SEQ ID NO: 4040338 - RNA, 12 nt, Staphylococcus aureus subsp. aureus N315
cuuuuuaaagga

SEQ ID NO: 4040339 - RNA, 22 nt, Staphylococcus aureus subsp. aureus N315
cuuuuuaaaggaccacuuagau

SEQ ID NO: 4040340 - RNA, 14 nt, Staphylococcus aureus subsp. aureus N315
cuuuuuaaaugauu

SEQ ID NO: 4040341 - RNA, 13 nt, Staphylococcus aureus subsp. aureus N315
cuuuuuacauuuu

SEQ ID NO: 4040342 - RNA, 17 nt, Staphylococcus aureus subsp. aureus N315
cuuuuuacauuuucaaa

SEQ ID NO: 4040343 - RNA, 17 nt, Staphylococcus aureus subsp. aureus N315
cuuuuuaggaaugauag

SEQ ID NO: 4040344 - RNA, 21 nt, Staphylococcus aureus subsp. aureus N315
cuuuuuaggaaugauagauuu

SEQ ID NO: 4040345 - RNA, 12 nt, Staphylococcus aureus subsp. aureus N315
cuuuuuaggaug

SEQ ID NO: 4040346 - RNA, 17 nt, Staphylococcus aureus subsp. aureus N315
cuuuuuauaccaauaau

SEQ ID NO: 4040347 - RNA, 22 nt, Staphylococcus aureus subsp. aureus N315
cuuuuuaucaugauuaauuaaa

SEQ ID NO: 4040348 - RNA, 23 nt, Staphylococcus aureus subsp. aureus N315
cuuuuuauuuauaacuuuaaaaa

SEQ ID NO: 4040349 - RNA, 21 nt, Staphylococcus aureus subsp. aureus N315
cuuuuuauuuuaauauuuucu

SEQ ID NO: 4040350 - RNA, 21 nt, Staphylococcus aureus subsp. aureus N315
cuuuuucaaauaauauaaaac

SEQ ID NO: 4040351 - RNA, 12 nt, Staphylococcus aureus subsp. aureus N315
cuuuuucacauu

SEQ ID NO: 4040352 - RNA, 15 nt, Staphylococcus aureus subsp. aureus N315
cuuuuucacauugcc

SEQ ID NO: 4040353 - RNA, 21 nt, Staphylococcus aureus subsp. aureus N315
cuuuuucauagaacaaaaugu

SEQ ID NO: 4040354 - RNA, 13 nt, Staphylococcus aureus subsp. aureus N315
cuuuuucaucuuu

SEQ ID NO: 4040355 - RNA, 15 nt, Staphylococcus aureus subsp. aureus N315
cuuuuucuaaauaaa

SEQ ID NO: 4040356 - RNA, 19 nt, Staphylococcus aureus subsp. aureus N315
cuuuuucuguaauaauuau

SEQ ID NO: 4040357 - RNA, 12 nt, Staphylococcus aureus subsp. aureus N315
cuuuuucuuuca

SEQ ID NO: 4040358 - RNA, 16 nt, Staphylococcus aureus subsp. aureus N315
cuuuuucuuucucuaa

SEQ ID NO: 4040359 - RNA, 22 nt, Staphylococcus aureus subsp. aureus N315
cuuuuugaaauuucgacaucua

SEQ ID NO: 4040360 - RNA, 19 nt, Staphylococcus aureus subsp. aureus N315
cuuuuugacauauuuuuua

SEQ ID NO: 4040361 - RNA, 22 nt, Staphylococcus aureus subsp. aureus N315
cuuuuugacauauuuuuuaaau

SEQ ID NO: 4040362 - RNA, 17 nt, Staphylococcus aureus subsp. aureus N315
cuuuuugacucagaauc

SEQ ID NO: 4040363 - RNA, 20 nt, Staphylococcus aureus subsp. aureus N315
cuuuuugacucagaaucuua

SEQ ID NO: 4040364 - RNA, 16 nt, Staphylococcus aureus subsp. aureus N315
cuuuuugaucaacuau

SEQ ID NO: 4040365 - RNA, 22 nt, Staphylococcus aureus subsp. aureus N315
cuuuuugccuggcaacguucua

SEQ ID NO: 4040366 - RNA, 17 nt, Staphylococcus aureus subsp. aureus N315
cuuuuugcguuuuuaaa

SEQ ID NO: 4040367 - RNA, 20 nt, Staphylococcus aureus subsp. aureus N315
cuuuuugucucucaacauuu

SEQ ID NO: 4040368 - RNA, 20 nt, Staphylococcus aureus subsp. aureus N315
cuuuuuguguaucuguaaca

SEQ ID NO: 4040369 - RNA, 18 nt, Staphylococcus aureus subsp. aureus N315
cuuuuuguuaauuuuuua

SEQ ID NO: 4040370 - RNA, 14 nt, Staphylococcus aureus subsp. aureus N315
cuuuuuguuuucaa

SEQ ID NO: 4040371 - RNA, 16 nt, Staphylococcus aureus subsp. aureus N315
cuuuuuuaagaucaau

SEQ ID NO: 4040372 - RNA, 17 nt, Staphylococcus aureus subsp. aureus N315
cuuuuuuaagcuuauca

SEQ ID NO: 4040373 - RNA, 12 nt, Staphylococcus aureus subsp. aureus N315
cuuuuuuaaguu

SEQ ID NO: 4040374 - RNA, 19 nt, Staphylococcus aureus subsp. aureus N315
cuuuuuuaccagcaugaau

SEQ ID NO: 4040375 - RNA, 13 nt, Staphylococcus aureus subsp. aureus N315
cuuuuuuauauuc

SEQ ID NO: 4040376 - RNA, 16 nt, Staphylococcus aureus subsp. aureus N315
cuuuuuuuaaaucuuc

SEQ ID NO: 4040377 - RNA, 17 nt, Staphylococcus aureus subsp. aureus N315
cuuuuuuuauaaguauu

SEQ ID NO: 4040378 - RNA, 22 nt, Staphylococcus aureus subsp. aureus N315
gaaaaaauuaauaauuuuccau

SEQ ID NO: 4040379 - RNA, 12 nt, Staphylococcus aureus subsp. aureus N315
gaaaaaccaagu

SEQ ID NO: 4040380 - RNA, 19 nt, Staphylococcus aureus subsp. aureus N315
gaaaaaccugggacauuaa

SEQ ID NO: 4040381 - RNA, 18 nt, Staphylococcus aureus subsp. aureus N315
gaaaaacugcucauugug

SEQ ID NO: 4040382 - RNA, 17 nt, Staphylococcus aureus subsp. aureus N315
gaaaaacuguaaaucau

SEQ ID NO: 4040383 - RNA, 21 nt, Staphylococcus aureus subsp. aureus N315
gaaaaacuucuuaacuugaaa

SEQ ID NO: 4040384 - RNA, 14 nt, Staphylococcus aureus subsp. aureus N315
gaaaaacuuuucau

SEQ ID NO: 4040385 - RNA, 15 nt, Staphylococcus aureus subsp. aureus N315
gaaaaagaugaaaaa

SEQ ID NO: 4040386 - RNA, 18 nt, Staphylococcus aureus subsp. aureus N315
gaaaaagaugaaaaaguc

SEQ ID NO: 4040387 - RNA, 17 nt, Staphylococcus aureus subsp. aureus N315
gaaaaagcaggcaagcu

SEQ ID NO: 4040388 - RNA, 17 nt, Staphylococcus aureus subsp. aureus N315
gaaaaagcuaauucuua

SEQ ID NO: 4040389 - RNA, 14 nt, Staphylococcus aureus subsp. aureus N315
gaaaaagucuuucu

SEQ ID NO: 4040390 - RNA, 18 nt, Staphylococcus aureus subsp. aureus N315
gaaaaauuucaaaaauag

SEQ ID NO: 4040391 - RNA, 11 nt, Staphylococcus aureus subsp. aureus N315
gaaaacaauaa

SEQ ID NO: 4040392 - RNA, 22 nt, Staphylococcus aureus subsp. aureus N315
gaaaacauaaauacaaaaauau

SEQ ID NO: 4040393 - RNA, 16 nt, Staphylococcus aureus subsp. aureus N315
gaaaagaacacgauau

SEQ ID NO: 4040394 - RNA, 15 nt, Staphylococcus aureus subsp. aureus N315
gaaaagagaaacaaa

SEQ ID NO: 4040395 - RNA, 20 nt, Staphylococcus aureus subsp. aureus N315
gaaaagggaauggauuacag

SEQ ID NO: 4040396 - RNA, 20 nt, Staphylococcus aureus subsp. aureus N315
gaaaaggucaaaaaauuaau

SEQ ID NO: 4040397 - RNA, 15 nt, Staphylococcus aureus subsp. aureus N315
gaaaaguauaaauau

SEQ ID NO: 4040398 - RNA, 19 nt, Staphylococcus aureus subsp. aureus N315
gaaaagucagcuuacaaua

SEQ ID NO: 4040399 - RNA, 18 nt, Staphylococcus aureus subsp. aureus N315
gaaaagugcgauuaucag

SEQ ID NO: 4040400 - RNA, 22 nt, Staphylococcus aureus subsp. aureus N315
gaaaaguuuuuuacuuuucauc

SEQ ID NO: 4040401 - RNA, 17 nt, Staphylococcus aureus subsp. aureus N315
gaaaauaaaacaaauua

SEQ ID NO: 4040402 - RNA, 18 nt, Staphylococcus aureus subsp. aureus N315
gaaaauaagcuuguaaca

SEQ ID NO: 4040403 - RNA, 23 nt, Staphylococcus aureus subsp. aureus N315
gaaaauaagcuuguaacaagcau

SEQ ID NO: 4040404 - RNA, 10 nt, Staphylococcus aureus subsp. aureus N315
gaaaauaaua

SEQ ID NO: 4040405 - RNA, 17 nt, Staphylococcus aureus subsp. aureus N315
gaaaauacuauacugau

SEQ ID NO: 4040406 - RNA, 14 nt, Staphylococcus aureus subsp. aureus N315
gaaaauagaaagaa

SEQ ID NO: 4040407 - RNA, 18 nt, Staphylococcus aureus subsp. aureus N315
gaaaauagccauauucau

SEQ ID NO: 4040408 - RNA, 19 nt, Staphylococcus aureus subsp. aureus N315
gaaaauagcuauuaaaaua

SEQ ID NO: 4040409 - RNA, 16 nt, Staphylococcus aureus subsp. aureus N315
gaaaauaucuuacugc

SEQ ID NO: 4040410 - RNA, 13 nt, Staphylococcus aureus subsp. aureus N315
gaaaauaugauaa

SEQ ID NO: 4040411 - RNA, 15 nt, Staphylococcus aureus subsp. aureus N315
gaaaauaugauaacu

SEQ ID NO: 4040412 - RNA, 18 nt, Staphylococcus aureus subsp. aureus N315
gaaaaucucuguauugag

SEQ ID NO: 4040413 - RNA, 23 nt, Staphylococcus aureus subsp. aureus N315
gaaaaucuuuaacucuugaaaca

SEQ ID NO: 4040414 - RNA, 22 nt, Staphylococcus aureus subsp. aureus N315
gaaaaugacgauacguauauag

SEQ ID NO: 4040415 - RNA, 16 nt, Staphylococcus aureus subsp. aureus N315
gaaaaugaguacaaca

SEQ ID NO: 4040416 - RNA, 12 nt, Staphylococcus aureus subsp. aureus N315
gaaaauuaacuc

SEQ ID NO: 4040417 - RNA, 22 nt, Staphylococcus aureus subsp. aureus N315
gaaaauuacuuagcaaacaauu

SEQ ID NO: 4040418 - RNA, 21 nt, Staphylococcus aureus subsp. aureus N315
gaaaauuauuugauauuucau

SEQ ID NO: 4040419 - RNA, 17 nt, Staphylococcus aureus subsp. aureus N315
gaaaauucgcuuguaac

SEQ ID NO: 4040420 - RNA, 18 nt, Staphylococcus aureus subsp. aureus N315
gaacguguuugaauggca

SEQ ID NO: 4040421 - RNA, 19 nt, Staphylococcus aureus subsp. aureus N315
gaacguguuugaauggcaa

SEQ ID NO: 4040422 - RNA, 15 nt, Staphylococcus aureus subsp. aureus N315
gaacguuauuuucaa

SEQ ID NO: 4040423 - RNA, 22 nt, Staphylococcus aureus subsp. aureus N315
gaacuacaauucauaagaaaaa

SEQ ID NO: 4040424 - RNA, 19 nt, Staphylococcus aureus subsp. aureus N315
gaacuacgcauuuuaaaua

SEQ ID NO: 4040425 - RNA, 19 nt, Staphylococcus aureus subsp. aureus N315
gaacuaguacgaaaugcaa

SEQ ID NO: 4040426 - RNA, 15 nt, Staphylococcus aureus subsp. aureus N315
gaacuauuaaaacca

SEQ ID NO: 4040427 - RNA, 17 nt, Staphylococcus aureus subsp. aureus N315
gaacuauuaaaaccaaa

SEQ ID NO: 4040428 - RNA, 22 nt, Staphylococcus aureus subsp. aureus N315
gaacucuuuuaacccacauuaa

SEQ ID NO: 4040429 - RNA, 21 nt, Staphylococcus aureus subsp. aureus N315
gaacuuacaagucuaguucga

SEQ ID NO: 4040430 - RNA, 17 nt, Staphylococcus aureus subsp. aureus N315
gaacuuagaaaugcaau

SEQ ID NO: 4040431 - RNA, 19 nt, Staphylococcus aureus subsp. aureus N315
gaacuucuuuuuuguaucu

SEQ ID NO: 4040432 - RNA, 20 nt, Staphylococcus aureus subsp. aureus N315
gaacuuuuauuuuuuauaaa

SEQ ID NO: 4040433 - RNA, 16 nt, Staphylococcus aureus subsp. aureus N315
gaacuuuucaaacaau

SEQ ID NO: 4040434 - RNA, 14 nt, Staphylococcus aureus subsp. aureus N315
gaacuuuuguucua

SEQ ID NO: 4040435 - RNA, 14 nt, Staphylococcus aureus subsp. aureus N315
gaagaaacauuaua

SEQ ID NO: 4040436 - RNA, 15 nt, Staphylococcus aureus subsp. aureus N315
gaagaaacauuauau

SEQ ID NO: 4040437 - RNA, 16 nt, Staphylococcus aureus subsp. aureus N315
gaagaaacuuaaucaa

SEQ ID NO: 4040438 - RNA, 14 nt, Staphylococcus aureus subsp. aureus N315
gaagaaaucaucga

SEQ ID NO: 4040439 - RNA, 14 nt, Staphylococcus aureus subsp. aureus N315
gaagaauacaaaua

SEQ ID NO: 4040440 - RNA, 22 nt, Staphylococcus aureus subsp. aureus N315
gaagaauccuaugccaaauaac

SEQ ID NO: 4040441 - RNA, 18 nt, Staphylococcus aureus subsp. aureus N315
gaagaccacuauuuuuaa

SEQ ID NO: 4040442 - RNA, 20 nt, Staphylococcus aureus subsp. aureus N315
gaagaccacuauuuuuaaau

SEQ ID NO: 4040443 - RNA, 14 nt, Staphylococcus aureus subsp. aureus N315
gaagagaugaaaga

SEQ ID NO: 4040444 - RNA, 15 nt, Staphylococcus aureus subsp. aureus N315
gaagagaugaaagau

SEQ ID NO: 4040445 - RNA, 17 nt, Staphylococcus aureus subsp. aureus N315
gaagauaggauuugcac

SEQ ID NO: 4040446 - RNA, 17 nt, Staphylococcus aureus subsp. aureus N315
gaagcaaaagaugaaaa

SEQ ID NO: 4040447 - RNA, 22 nt, Staphylococcus aureus subsp. aureus N315
gaagcgcuuggauuuuuugguu

SEQ ID NO: 4040448 - RNA, 18 nt, Staphylococcus aureus subsp. aureus N315
gaagcugucuuacugcug

SEQ ID NO: 4040449 - RNA, 18 nt, Staphylococcus aureus subsp. aureus N315
gaaggaaaauaaaaacca

SEQ ID NO: 4040450 - RNA, 19 nt, Staphylococcus aureus subsp. aureus N315
gaaggaacguguucuaaaa

SEQ ID NO: 4040451 - RNA, 15 nt, Staphylococcus aureus subsp. aureus N315
gaaggauuuuagauu

SEQ ID NO: 4040452 - RNA, 16 nt, Staphylococcus aureus subsp. aureus N315
gaagggguuuuuucuu

SEQ ID NO: 4040453 - RNA, 22 nt, Staphylococcus aureus subsp. aureus N315
gaaguugcucgcgcucuucuuc

SEQ ID NO: 4040454 - RNA, 12 nt, Staphylococcus aureus subsp. aureus N315
gaaguuguuucu

SEQ ID NO: 4040455 - RNA, 23 nt, Staphylococcus aureus subsp. aureus N315
gaaguuuuuagcauuaucaucac

SEQ ID NO: 4040456 - RNA, 15 nt, Staphylococcus aureus subsp. aureus N315
gaauaaauagauaau

SEQ ID NO: 4040457 - RNA, 13 nt, Staphylococcus aureus subsp. aureus N315
gaauaaauugaua

SEQ ID NO: 4040458 - RNA, 20 nt, Staphylococcus aureus subsp. aureus N315
gaauaacguuggaaacuucu

SEQ ID NO: 4040459 - RNA, 19 nt, Staphylococcus aureus subsp. aureus N315
gaauaacuguuuaucauga

SEQ ID NO: 4040460 - RNA, 18 nt, Staphylococcus aureus subsp. aureus N315
gaauaauguuuucauugg

SEQ ID NO: 4040461 - RNA, 18 nt, Staphylococcus aureus subsp. aureus N315
gaauaauugcuaaaauau

SEQ ID NO: 4040462 - RNA, 21 nt, Staphylococcus aureus subsp. aureus N315
gaauaauuggcugaugaacuu

SEQ ID NO: 4040463 - RNA, 17 nt, Staphylococcus aureus subsp. aureus N315
gaauaauuuuaaaaaua

SEQ ID NO: 4040464 - RNA, 18 nt, Staphylococcus aureus subsp. aureus N315
gaauaauuuuaaaaauaa

SEQ ID NO: 4040465 - RNA, 15 nt, Staphylococcus aureus subsp. aureus N315
gaauacaaauauuaa

SEQ ID NO: 4040466 - RNA, 18 nt, Staphylococcus aureus subsp. aureus N315
gaauacaugaguaaaacu

SEQ ID NO: 4040467 - RNA, 14 nt, Staphylococcus aureus subsp. aureus N315
gaauacuaaaagug

SEQ ID NO: 4040468 - RNA, 18 nt, Staphylococcus aureus subsp. aureus N315
gaauacucuucaaucuac

SEQ ID NO: 4040469 - RNA, 16 nt, Staphylococcus aureus subsp. aureus N315
gaauacuuuuuaacug

SEQ ID NO: 4040470 - RNA, 23 nt, Staphylococcus aureus subsp. aureus N315
gaauauaacaacuacuuaaauua

SEQ ID NO: 4040471 - RNA, 13 nt, Staphylococcus aureus subsp. aureus N315
gaauauaacgaau

SEQ ID NO: 4040472 - RNA, 20 nt, Staphylococcus aureus subsp. aureus N315
gaauauacuaaaguucaaca

SEQ ID NO: 4040473 - RNA, 19 nt, Staphylococcus aureus subsp. aureus N315
gaauauacuuaauuuaaau

SEQ ID NO: 4040474 - RNA, 17 nt, Staphylococcus aureus subsp. aureus N315
gaauauagcugugauuu

SEQ ID NO: 4040475 - RNA, 18 nt, Staphylococcus aureus subsp. aureus N315
gaauaucuuaaagaauua

SEQ ID NO: 4040476 - RNA, 23 nt, Staphylococcus aureus subsp. aureus N315
gaauaugaauugcuuguuuuaaa

SEQ ID NO: 4040477 - RNA, 22 nt, Staphylococcus aureus subsp. aureus N315
gaauauuaacaccagauaucau

SEQ ID NO: 4040478 - RNA, 23 nt, Staphylococcus aureus subsp. aureus N315
gaauauuaacguuaguauaaacg

SEQ ID NO: 4040479 - RNA, 19 nt, Staphylococcus aureus subsp. aureus N315
gaauauuaagauguauaug

SEQ ID NO: 4040480 - RNA, 21 nt, Staphylococcus aureus subsp. aureus N315
gaauauuguauugaucuacau

SEQ ID NO: 4040481 - RNA, 23 nt, Staphylococcus aureus subsp. aureus N315
gaauauuucccuaugaaauaacu

SEQ ID NO: 4040482 - RNA, 23 nt, Staphylococcus aureus subsp. aureus N315
gaauauuugcuuuuuguguaucu

SEQ ID NO: 4040483 - RNA, 18 nt, Staphylococcus aureus subsp. aureus N315
gaaucaauugcauacgua

SEQ ID NO: 4040484 - RNA, 20 nt, Staphylococcus aureus subsp. aureus N315
gaaucacaguuauauauucc

SEQ ID NO: 4040485 - RNA, 12 nt, Staphylococcus aureus subsp. aureus N315
gaaucacauuaa

SEQ ID NO: 4040486 - RNA, 10 nt, Staphylococcus aureus subsp. aureus N315
gaaucaguau

SEQ ID NO: 4040487 - RNA, 19 nt, Staphylococcus aureus subsp. aureus N315
gaauccuaugccaaauaac

SEQ ID NO: 4040488 - RNA, 15 nt, Staphylococcus aureus subsp. aureus N315
gaaucgauauaauga

SEQ ID NO: 4040489 - RNA, 15 nt, Staphylococcus aureus subsp. aureus N315
gaaucuaaacuauaa

SEQ ID NO: 4040490 - RNA, 18 nt, Staphylococcus aureus subsp. aureus N315
gaaucuuacauugauaaa

SEQ ID NO: 4040491 - RNA, 21 nt, Staphylococcus aureus subsp. aureus N315
gaaugaaaauaagcuuguaac

SEQ ID NO: 4040492 - RNA, 13 nt, Staphylococcus aureus subsp. aureus N315
gaaugaaccuuua

SEQ ID NO: 4040493 - RNA, 14 nt, Staphylococcus aureus subsp. aureus N315
gaaugaaguaauau

SEQ ID NO: 4040494 - RNA, 18 nt, Staphylococcus aureus subsp. aureus N315
gaaugacguuaucaucuc

SEQ ID NO: 4040495 - RNA, 14 nt, Staphylococcus aureus subsp. aureus N315
gaaugauagauuua

SEQ ID NO: 4040496 - RNA, 13 nt, Staphylococcus aureus subsp. aureus N315
gaaugccuaauuu

SEQ ID NO: 4040497 - RNA, 21 nt, Staphylococcus aureus subsp. aureus N315
gaaugcgauuuccuuuagcaa

SEQ ID NO: 4040498 - RNA, 14 nt, Staphylococcus aureus subsp. aureus N315
gaauggcaaauaug

SEQ ID NO: 4040499 - RNA, 15 nt, Staphylococcus aureus subsp. aureus N315
gaaugugaugauuaa

SEQ ID NO: 4040500 - RNA, 17 nt, Staphylococcus aureus subsp. aureus N315
gaauuaaaauaacucgc

SEQ ID NO: 4040501 - RNA, 15 nt, Staphylococcus aureus subsp. aureus N315
gaauuaacaacaaau

SEQ ID NO: 4040502 - RNA, 19 nt, Staphylococcus aureus subsp. aureus N315
gaauuaacaacaaauauaa

SEQ ID NO: 4040503 - RNA, 17 nt, Staphylococcus aureus subsp. aureus N315
gaauuaagaaaaguuac

SEQ ID NO: 4040504 - RNA, 23 nt, Staphylococcus aureus subsp. aureus N315
gaauuaauaauuuuuuuccuuuc

SEQ ID NO: 4040505 - RNA, 17 nt, Staphylococcus aureus subsp. aureus N315
gaauuagauuuacgguu

SEQ ID NO: 4040506 - RNA, 20 nt, Staphylococcus aureus subsp. aureus N315
gaauuaguaaacuaauccuc

SEQ ID NO: 4040507 - RNA, 18 nt, Staphylococcus aureus subsp. aureus N315
gacuuauuuuucaucauu

SEQ ID NO: 4040508 - RNA, 15 nt, Staphylococcus aureus subsp. aureus N315
gacuucuuucaauua

SEQ ID NO: 4040509 - RNA, 15 nt, Staphylococcus aureus subsp. aureus N315
gacuugauaaaaaau

SEQ ID NO: 4040510 - RNA, 22 nt, Staphylococcus aureus subsp. aureus N315
gacuugugcgcgacguuuaaau

SEQ ID NO: 4040511 - RNA, 21 nt, Staphylococcus aureus subsp. aureus N315
gacuuuuagauuaucuuucaa

SEQ ID NO: 4040512 - RNA, 16 nt, Staphylococcus aureus subsp. aureus N315
gagaaauacuauucuu

SEQ ID NO: 4040513 - RNA, 13 nt, Staphylococcus aureus subsp. aureus N315
gagaaauuagaac

SEQ ID NO: 4040514 - RNA, 14 nt, Staphylococcus aureus subsp. aureus N315
gagaagcugucuua

SEQ ID NO: 4040515 - RNA, 12 nt, Staphylococcus aureus subsp. aureus N315
gagaaucuccau

SEQ ID NO: 4040516 - RNA, 16 nt, Staphylococcus aureus subsp. aureus N315
gagaaugugcuuguaa

SEQ ID NO: 4040517 - RNA, 17 nt, Staphylococcus aureus subsp. aureus N315
gagaaugugcuuguaac

SEQ ID NO: 4040518 - RNA, 19 nt, Staphylococcus aureus subsp. aureus N315
gagaauuucgaaaagaaau

SEQ ID NO: 4040519 - RNA, 14 nt, Staphylococcus aureus subsp. aureus N315
gagaauuuuaauua

SEQ ID NO: 4040520 - RNA, 15 nt, Staphylococcus aureus subsp. aureus N315
gagacaaguauacuu

SEQ ID NO: 4040521 - RNA, 15 nt, Staphylococcus aureus subsp. aureus N315
gagacaauaaugcac

SEQ ID NO: 4040522 - RNA, 17 nt, Staphylococcus aureus subsp. aureus N315
gagacauuuuaucugaa

SEQ ID NO: 4040523 - RNA, 15 nt, Staphylococcus aureus subsp. aureus N315
gagacuguuuuuuug

SEQ ID NO: 4040524 - RNA, 17 nt, Staphylococcus aureus subsp. aureus N315
gagagauguauaaaacu

SEQ ID NO: 4040525 - RNA, 22 nt, Staphylococcus aureus subsp. aureus N315
gagagauuauuuaaaacuugua

SEQ ID NO: 4040526 - RNA, 16 nt, Staphylococcus aureus subsp. aureus N315
gagaguaauguuccau

SEQ ID NO: 4040527 - RNA, 16 nt, Staphylococcus aureus subsp. aureus N315
gagaugaaagauacug

SEQ ID NO: 4040528 - RNA, 14 nt, Staphylococcus aureus subsp. aureus N315
gagauugagaauuc

SEQ ID NO: 4040529 - RNA, 20 nt, Staphylococcus aureus subsp. aureus N315
gagcaaagcuuuuuugcuuu

SEQ ID NO: 4040530 - RNA, 16 nt, Staphylococcus aureus subsp. aureus N315
gagcaacgauaccaaa

SEQ ID NO: 4040531 - RNA, 19 nt, Staphylococcus aureus subsp. aureus N315
gagcaagucuucuaaaaaa

SEQ ID NO: 4040532 - RNA, 14 nt, Staphylococcus aureus subsp. aureus N315
gagcaauucuucaa

SEQ ID NO: 4040533 - RNA, 14 nt, Staphylococcus aureus subsp. aureus N315
gagcacgagaaaug

SEQ ID NO: 4040534 - RNA, 15 nt, Staphylococcus aureus subsp. aureus N315
gagcacuaucuuuug

SEQ ID NO: 4040535 - RNA, 19 nt, Staphylococcus aureus subsp. aureus N315
gagcacuaucuuuugcuuc

SEQ ID NO: 4040536 - RNA, 14 nt, Staphylococcus aureus subsp. aureus N315
gagcaguauuuuuu

SEQ ID NO: 4040537 - RNA, 18 nt, Staphylococcus aureus subsp. aureus N315
gagccauuauuauuuuuu

SEQ ID NO: 4040538 - RNA, 21 nt, Staphylococcus aureus subsp. aureus N315
gagcccgagacauaaauuaau

SEQ ID NO: 4040539 - RNA, 14 nt, Staphylococcus aureus subsp. aureus N315
gagcggaagauagg

SEQ ID NO: 4040540 - RNA, 13 nt, Staphylococcus aureus subsp. aureus N315
gagcguaaaguuu

SEQ ID NO: 4040541 - RNA, 20 nt, Staphylococcus aureus subsp. aureus N315
gagcuaauaugucuagacuu

SEQ ID NO: 4040542 - RNA, 23 nt, Staphylococcus aureus subsp. aureus N315
gagcuauucauagaccuaugaau

SEQ ID NO: 4040543 - RNA, 15 nt, Staphylococcus aureus subsp. aureus N315
gagcugcuucaacua

SEQ ID NO: 4040544 - RNA, 20 nt, Staphylococcus aureus subsp. aureus N315
gagcuugggacagaaaacaa

SEQ ID NO: 4040545 - RNA, 17 nt, Staphylococcus aureus subsp. aureus N315
gagcuuuucuaaugcua

SEQ ID NO: 4040546 - RNA, 21 nt, Staphylococcus aureus subsp. aureus N315
gaggauaauuauuaggggaga

SEQ ID NO: 4040547 - RNA, 22 nt, Staphylococcus aureus subsp. aureus N315
gaggcacaguggauuacagaug

SEQ ID NO: 4040548 - RNA, 14 nt, Staphylococcus aureus subsp. aureus N315
gaggcgauaaaaga

SEQ ID NO: 4040549 - RNA, 16 nt, Staphylococcus aureus subsp. aureus N315
gaggucuccaauacuu

SEQ ID NO: 4040550 - RNA, 22 nt, Staphylococcus aureus subsp. aureus N315
gaguagcccuauuuuuaaugua

SEQ ID NO: 4040551 - RNA, 21 nt, Staphylococcus aureus subsp. aureus N315
gaguaguucggaugagaaaug

SEQ ID NO: 4040552 - RNA, 19 nt, Staphylococcus aureus subsp. aureus N315
gaguaguuucucuacuaau

SEQ ID NO: 4040553 - RNA, 13 nt, Staphylococcus aureus subsp. aureus N315
gaguauaucagcu

SEQ ID NO: 4040554 - RNA, 15 nt, Staphylococcus aureus subsp. aureus N315
gaguauauucgcuaa

SEQ ID NO: 4040555 - RNA, 18 nt, Staphylococcus aureus subsp. aureus N315
gaguaucaugcuuuuaau

SEQ ID NO: 4040556 - RNA, 21 nt, Staphylococcus aureus subsp. aureus N315
gaguauccugauuuaauguua

SEQ ID NO: 4040557 - RNA, 13 nt, Staphylococcus aureus subsp. aureus N315
gaguauuaaauuu

SEQ ID NO: 4040558 - RNA, 19 nt, Staphylococcus aureus subsp. aureus N315
gaguauuacuugaaaauag

SEQ ID NO: 4040559 - RNA, 16 nt, Staphylococcus aureus subsp. aureus N315
gaguauuuuugcguua

SEQ ID NO: 4040560 - RNA, 20 nt, Staphylococcus aureus subsp. aureus N315
gagugauuuuaaucuauccu

SEQ ID NO: 4040561 - RNA, 13 nt, Staphylococcus aureus subsp. aureus N315
gaguuaaacgaaa

SEQ ID NO: 4040562 - RNA, 12 nt, Staphylococcus aureus subsp. aureus N315
gaguuauaucuu

SEQ ID NO: 4040563 - RNA, 16 nt, Staphylococcus aureus subsp. aureus N315
gaguucaauuaaauua

SEQ ID NO: 4040564 - RNA, 17 nt, Staphylococcus aureus subsp. aureus N315
gaguucaucuuguacag

SEQ ID NO: 4040565 - RNA, 20 nt, Staphylococcus aureus subsp. aureus N315
gaguuguacuacuugauucu

SEQ ID NO: 4040566 - RNA, 21 nt, Staphylococcus aureus subsp. aureus N315
gauaaaaaauaaagucauaug

SEQ ID NO: 4040567 - RNA, 19 nt, Staphylococcus aureus subsp. aureus N315
gauaaaaauuuaugucuua

SEQ ID NO: 4040568 - RNA, 19 nt, Staphylococcus aureus subsp. aureus N315
gauaaaaccaccuaccauu

SEQ ID NO: 4040569 - RNA, 15 nt, Staphylococcus aureus subsp. aureus N315
gauaaacuacacacg

SEQ ID NO: 4040570 - RNA, 20 nt, Staphylococcus aureus subsp. aureus N315
gauaaauaaacucaccaagu

SEQ ID NO: 4040571 - RNA, 22 nt, Staphylococcus aureus subsp. aureus N315
gauaaauaugauguuaaaaaau

SEQ ID NO: 4040572 - RNA, 22 nt, Staphylococcus aureus subsp. aureus N315
gauaaauauugaacaauuuuug

SEQ ID NO: 4040573 - RNA, 14 nt, Staphylococcus aureus subsp. aureus N315
gauaaaucaucauu

SEQ ID NO: 4040574 - RNA, 16 nt, Staphylococcus aureus subsp. aureus N315
gauaaauuaauaugaa

SEQ ID NO: 4040575 - RNA, 20 nt, Staphylococcus aureus subsp. aureus N315
gauaaauucccauguauucu

SEQ ID NO: 4040576 - RNA, 20 nt, Staphylococcus aureus subsp. aureus N315
gauaaauuuuuaguuaaagu

SEQ ID NO: 4040577 - RNA, 16 nt, Staphylococcus aureus subsp. aureus N315
gauaacagcuacaaau

SEQ ID NO: 4040578 - RNA, 19 nt, Staphylococcus aureus subsp. aureus N315
gauaacagcuacaaauaau

SEQ ID NO: 4040579 - RNA, 17 nt, Staphylococcus aureus subsp. aureus N315
gauaacgagugaaaaua

SEQ ID NO: 4040580 - RNA, 23 nt, Staphylococcus aureus subsp. aureus N315
gauaagaauuaacaacaaauaua

SEQ ID NO: 4040581 - RNA, 20 nt, Staphylococcus aureus subsp. aureus N315
gauaaguuuuugaauaucua

SEQ ID NO: 4040582 - RNA, 17 nt, Staphylococcus aureus subsp. aureus N315
gauaauacuguuuaaau

SEQ ID NO: 4040583 - RNA, 20 nt, Staphylococcus aureus subsp. aureus N315
gauaauacuguuuaaauaaa

SEQ ID NO: 4040584 - RNA, 23 nt, Staphylococcus aureus subsp. aureus N315
gauaauagccauucgaugcuaaa

SEQ ID NO: 4040585 - RNA, 17 nt, Staphylococcus aureus subsp. aureus N315
gauaaucacaauacgaa

SEQ ID NO: 4040586 - RNA, 21 nt, Staphylococcus aureus subsp. aureus N315
gauaaugauaguguaugaaug

SEQ ID NO: 4040587 - RNA, 15 nt, Staphylococcus aureus subsp. aureus N315
gauaaugcaccugug

SEQ ID NO: 4040588 - RNA, 21 nt, Staphylococcus aureus subsp. aureus N315
gauaaugcaccugugauaacu

SEQ ID NO: 4040589 - RNA, 22 nt, Staphylococcus aureus subsp. aureus N315
gauaaugcauguggacguugau

SEQ ID NO: 4040590 - RNA, 19 nt, Staphylococcus aureus subsp. aureus N315
gauaauuaaaauaagauau

SEQ ID NO: 4040591 - RNA, 16 nt, Staphylococcus aureus subsp. aureus N315
gauaauucgaaaucaa

SEQ ID NO: 4040592 - RNA, 13 nt, Staphylococcus aureus subsp. aureus N315
gauaauuucuucu

SEQ ID NO: 4040593 - RNA, 19 nt, Staphylococcus aureus subsp. aureus N315
gauaauuuucaauuagaaa

SEQ ID NO: 4040594 - RNA, 23 nt, Staphylococcus aureus subsp. aureus N315
gaugacuuugucuuuaaugaaag

SEQ ID NO: 4040595 - RNA, 13 nt, Staphylococcus aureus subsp. aureus N315
gaugagaaauguu

SEQ ID NO: 4040596 - RNA, 21 nt, Staphylococcus aureus subsp. aureus N315
gaugagaaauguuaacgauag

SEQ ID NO: 4040597 - RNA, 12 nt, Staphylococcus aureus subsp. aureus N315
gaugauauucaa

SEQ ID NO: 4040598 - RNA, 15 nt, Staphylococcus aureus subsp. aureus N315
gaugauauucaacuu

SEQ ID NO: 4040599 - RNA, 17 nt, Staphylococcus aureus subsp. aureus N315
gaugauauucaacuuga

SEQ ID NO: 4040600 - RNA, 13 nt, Staphylococcus aureus subsp. aureus N315
gaugauucuuauc

SEQ ID NO: 4040601 - RNA, 18 nt, Staphylococcus aureus subsp. aureus N315
gaugauuuauaaaaacuu

SEQ ID NO: 4040602 - RNA, 14 nt, Staphylococcus aureus subsp. aureus N315
gaugcgcuucuaac

SEQ ID NO: 4040603 - RNA, 16 nt, Staphylococcus aureus subsp. aureus N315
gaugcuaaaaauauug

SEQ ID NO: 4040604 - RNA, 13 nt, Staphylococcus aureus subsp. aureus N315
gaugcuuccuuuu

SEQ ID NO: 4040605 - RNA, 16 nt, Staphylococcus aureus subsp. aureus N315
gaugcuugaauguuug

SEQ ID NO: 4040606 - RNA, 18 nt, Staphylococcus aureus subsp. aureus N315
gaugcuuuaauuaaaguu

SEQ ID NO: 4040607 - RNA, 19 nt, Staphylococcus aureus subsp. aureus N315
gaugggccccaacaaagag

SEQ ID NO: 4040608 - RNA, 16 nt, Staphylococcus aureus subsp. aureus N315
gaugguacuaaaguug

SEQ ID NO: 4040609 - RNA, 16 nt, Staphylococcus aureus subsp. aureus N315
gaugguuaaugacuau

SEQ ID NO: 4040610 - RNA, 14 nt, Staphylococcus aureus subsp. aureus N315
gaugguuaucacuu

SEQ ID NO: 4040611 - RNA, 13 nt, Staphylococcus aureus subsp. aureus N315
gaugguuuuguuu

SEQ ID NO: 4040612 - RNA, 16 nt, Staphylococcus aureus subsp. aureus N315
gaugucagacgaauca

SEQ ID NO: 4040613 - RNA, 18 nt, Staphylococcus aureus subsp. aureus N315
gaugucaugucuagauuu

SEQ ID NO: 4040614 - RNA, 20 nt, Staphylococcus aureus subsp. aureus N315
gaugucgaaaaguauaugaa

SEQ ID NO: 4040615 - RNA, 13 nt, Staphylococcus aureus subsp. aureus N315
gaugucgaaaaua

SEQ ID NO: 4040616 - RNA, 14 nt, Staphylococcus aureus subsp. aureus N315
gaugugaauguuuu

SEQ ID NO: 4040617 - RNA, 22 nt, Staphylococcus aureus subsp. aureus N315
gauguguuuuaauaauaucuuu

SEQ ID NO: 4040618 - RNA, 16 nt, Staphylococcus aureus subsp. aureus N315
gauguucacuaaaugu

SEQ ID NO: 4040619 - RNA, 17 nt, Staphylococcus aureus subsp. aureus N315
gauguuucaaaauaauu

SEQ ID NO: 4040620 - RNA, 17 nt, Staphylococcus aureus subsp. aureus N315
gauuaaaaaaucauuca

SEQ ID NO: 4040621 - RNA, 17 nt, Staphylococcus aureus subsp. aureus N315
gauuaaaagcaucuuua

SEQ ID NO: 4040622 - RNA, 12 nt, Staphylococcus aureus subsp. aureus N315
gauuaaaagugu

SEQ ID NO: 4040623 - RNA, 13 nt, Staphylococcus aureus subsp. aureus N315
gauuaaaaguguu

SEQ ID NO: 4040624 - RNA, 17 nt, Staphylococcus aureus subsp. aureus N315
gauuaaaauaugacaca

SEQ ID NO: 4040625 - RNA, 20 nt, Staphylococcus aureus subsp. aureus N315
gauuaaaguguuucaacaua

SEQ ID NO: 4040626 - RNA, 20 nt, Staphylococcus aureus subsp. aureus N315
gauuaaauucuuuucaagaa

SEQ ID NO: 4040627 - RNA, 19 nt, Staphylococcus aureus subsp. aureus N315
gauuaauccaguaaucaaa

SEQ ID NO: 4040628 - RNA, 22 nt, Staphylococcus aureus subsp. aureus N315
gauuaauccuacacggacugca

SEQ ID NO: 4040629 - RNA, 22 nt, Staphylococcus aureus subsp. aureus N315
gauuaauuaaagauuaaaauau

SEQ ID NO: 4040630 - RNA, 20 nt, Staphylococcus aureus subsp. aureus N315
gauuaauuauaaguagugau

SEQ ID NO: 4040631 - RNA, 22 nt, Staphylococcus aureus subsp. aureus N315
gauuaauuuaauugaaguaugc

SEQ ID NO: 4040632 - RNA, 18 nt, Staphylococcus aureus subsp. aureus N315
gauuacagaugaugcuuc

SEQ ID NO: 4040633 - RNA, 23 nt, Staphylococcus aureus subsp. aureus N315
gauuacagcguacuaaagaauga

SEQ ID NO: 4040634 - RNA, 17 nt, Staphylococcus aureus subsp. aureus N315
gauuacauucuauacuu

SEQ ID NO: 4040635 - RNA, 15 nt, Staphylococcus aureus subsp. aureus N315
gauuaccguuaaaaa

SEQ ID NO: 4040636 - RNA, 14 nt, Staphylococcus aureus subsp. aureus N315
gauuacgcucauau

SEQ ID NO: 4040637 - RNA, 14 nt, Staphylococcus aureus subsp. aureus N315
gauuagaugauauu

SEQ ID NO: 4040638 - RNA, 15 nt, Staphylococcus aureus subsp. aureus N315
gauuagaugauauuu

SEQ ID NO: 4040639 - RNA, 22 nt, Staphylococcus aureus subsp. aureus N315
gauuaguaauuuuuaaaucuac

SEQ ID NO: 4040640 - RNA, 16 nt, Staphylococcus aureus subsp. aureus N315
gauuauaaugauuguc

SEQ ID NO: 4040641 - RNA, 21 nt, Staphylococcus aureus subsp. aureus N315
gauuauauuuagauuuauaac

SEQ ID NO: 4040642 - RNA, 14 nt, Staphylococcus aureus subsp. aureus N315
gauuauauuuuucu

SEQ ID NO: 4040643 - RNA, 15 nt, Staphylococcus aureus subsp. aureus N315
gauuauauuuuucuu

SEQ ID NO: 4040644 - RNA, 22 nt, Staphylococcus aureus subsp. aureus N315
gauuaucugacauuguugcuaa

SEQ ID NO: 4040645 - RNA, 22 nt, Staphylococcus aureus subsp. aureus N315
gauuaucuguaauuaauccauc

SEQ ID NO: 4040646 - RNA, 20 nt, Staphylococcus aureus subsp. aureus N315
gauuaugacaacauaacaaa

SEQ ID NO: 4040647 - RNA, 22 nt, Staphylococcus aureus subsp. aureus N315
gauuauguuaaugucuuaaaau

SEQ ID NO: 4040648 - RNA, 12 nt, Staphylococcus aureus subsp. aureus N315
gauuauucuuca

SEQ ID NO: 4040649 - RNA, 18 nt, Staphylococcus aureus subsp. aureus N315
gauuauugguugaaauua

SEQ ID NO: 4040650 - RNA, 20 nt, Staphylococcus aureus subsp. aureus N315
gauuauuuaaaacuuguaaa

SEQ ID NO: 4040651 - RNA, 22 nt, Staphylococcus aureus subsp. aureus N315
gauucaaauaaaucaaacuuuu

SEQ ID NO: 4040652 - RNA, 13 nt, Staphylococcus aureus subsp. aureus N315
gauucaaaugaca

SEQ ID NO: 4040653 - RNA, 12 nt, Staphylococcus aureus subsp. aureus N315
gauucaaccuua

SEQ ID NO: 4040654 - RNA, 13 nt, Staphylococcus aureus subsp. aureus N315
gauucaaccuuaa

SEQ ID NO: 4040655 - RNA, 15 nt, Staphylococcus aureus subsp. aureus N315
gauucaccagguuuu

SEQ ID NO: 4040656 - RNA, 20 nt, Staphylococcus aureus subsp. aureus N315
gauucaggauuguagaaucu

SEQ ID NO: 4040657 - RNA, 16 nt, Staphylococcus aureus subsp. aureus N315
gauucauaaaauuuaa

SEQ ID NO: 4040658 - RNA, 17 nt, Staphylococcus aureus subsp. aureus N315
gauucauaucuuucaau

SEQ ID NO: 4040659 - RNA, 15 nt, Staphylococcus aureus subsp. aureus N315
gauucauauuuaucg

SEQ ID NO: 4040660 - RNA, 19 nt, Staphylococcus aureus subsp. aureus N315
gauucauuuaaaaaucaaa

SEQ ID NO: 4040661 - RNA, 14 nt, Staphylococcus aureus subsp. aureus N315
gauucccaaauagu

SEQ ID NO: 4040662 - RNA, 17 nt, Staphylococcus aureus subsp. aureus N315
gauucuacagcacugaa

SEQ ID NO: 4040663 - RNA, 13 nt, Staphylococcus aureus subsp. aureus N315
gauucuacagcau

SEQ ID NO: 4040664 - RNA, 12 nt, Staphylococcus aureus subsp. aureus N315
gauucuauuucu

SEQ ID NO: 4040665 - RNA, 13 nt, Staphylococcus aureus subsp. aureus N315
gauucuauuucuu

SEQ ID NO: 4040666 - RNA, 19 nt, Staphylococcus aureus subsp. aureus N315
gauucuccaguggaaauga

SEQ ID NO: 4040667 - RNA, 16 nt, Staphylococcus aureus subsp. aureus N315
gauucuuaucuuuaau

SEQ ID NO: 4040668 - RNA, 18 nt, Staphylococcus aureus subsp. aureus N315
gauucuuaucuuuaauca

SEQ ID NO: 4040669 - RNA, 14 nt, Staphylococcus aureus subsp. aureus N315
gauugaaaaaauaa

SEQ ID NO: 4040670 - RNA, 16 nt, Staphylococcus aureus subsp. aureus N315
gauugaguugaaaaua

SEQ ID NO: 4040671 - RNA, 17 nt, Staphylococcus aureus subsp. aureus N315
gauugcaaaaaaacaaa

SEQ ID NO: 4040672 - RNA, 21 nt, Staphylococcus aureus subsp. aureus N315
gauugcacguuugaaugaacc

SEQ ID NO: 4040673 - RNA, 19 nt, Staphylococcus aureus subsp. aureus N315
gauugccaccguuauaccc

SEQ ID NO: 4040674 - RNA, 22 nt, Staphylococcus aureus subsp. aureus N315
gauuggaaaguuucuccaccug

SEQ ID NO: 4040675 - RNA, 13 nt, Staphylococcus aureus subsp. aureus N315
gauuguaccagua

SEQ ID NO: 4040676 - RNA, 16 nt, Staphylococcus aureus subsp. aureus N315
gauuguaccaguaaca

SEQ ID NO: 4040677 - RNA, 17 nt, Staphylococcus aureus subsp. aureus N315
gauuguaccaguaacaa

SEQ ID NO: 4040678 - RNA, 15 nt, Staphylococcus aureus subsp. aureus N315
gauuguuaauacaac

SEQ ID NO: 4040679 - RNA, 21 nt, Staphylococcus aureus subsp. aureus N315
gauuguuuauucgguccuuug

SEQ ID NO: 4040680 - RNA, 16 nt, Staphylococcus aureus subsp. aureus N315
gauuguuucaccagcu

SEQ ID NO: 4040681 - RNA, 23 nt, Staphylococcus aureus subsp. aureus N315
gauuguuucaccagcuuguaaau

SEQ ID NO: 4040682 - RNA, 19 nt, Staphylococcus aureus subsp. aureus N315
gcacaguggauuacagaug

SEQ ID NO: 4040683 - RNA, 16 nt, Staphylococcus aureus subsp. aureus N315
gcacaucauaauaaau

SEQ ID NO: 4040684 - RNA, 16 nt, Staphylococcus aureus subsp. aureus N315
gcacauuacuguaaaa

SEQ ID NO: 4040685 - RNA, 12 nt, Staphylococcus aureus subsp. aureus N315
gcacauuccauc

SEQ ID NO: 4040686 - RNA, 18 nt, Staphylococcus aureus subsp. aureus N315
gcacauuccaucuuaaaa

SEQ ID NO: 4040687 - RNA, 18 nt, Staphylococcus aureus subsp. aureus N315
gcacauuuuuaguuagaa

SEQ ID NO: 4040688 - RNA, 14 nt, Staphylococcus aureus subsp. aureus N315
gcaccaaugacgac

SEQ ID NO: 4040689 - RNA, 21 nt, Staphylococcus aureus subsp. aureus N315
gcaccgucaaacuuaaaacua

SEQ ID NO: 4040690 - RNA, 15 nt, Staphylococcus aureus subsp. aureus N315
gcaccuccaaccgcu

SEQ ID NO: 4040691 - RNA, 20 nt, Staphylococcus aureus subsp. aureus N315
gcaccuggucguacuuucaa

SEQ ID NO: 4040692 - RNA, 15 nt, Staphylococcus aureus subsp. aureus N315
gcacgagacaauaau

SEQ ID NO: 4040693 - RNA, 16 nt, Staphylococcus aureus subsp. aureus N315
gcacgagacaauaaug

SEQ ID NO: 4040694 - RNA, 17 nt, Staphylococcus aureus subsp. aureus N315
gcacgauaaaaauaaaa

SEQ ID NO: 4040695 - RNA, 22 nt, Staphylococcus aureus subsp. aureus N315
gcacgcgugccaacaucuucaa

SEQ ID NO: 4040696 - RNA, 16 nt, Staphylococcus aureus subsp. aureus N315
gcacuaucaaugacau

SEQ ID NO: 4040697 - RNA, 14 nt, Staphylococcus aureus subsp. aureus N315
gcacugagcaacaa

SEQ ID NO: 4040698 - RNA, 18 nt, Staphylococcus aureus subsp. aureus N315
gcacuuaauaagucagcu

SEQ ID NO: 4040699 - RNA, 23 nt, Staphylococcus aureus subsp. aureus N315
gcacuuauuuggaugguaaguau

SEQ ID NO: 4040700 - RNA, 16 nt, Staphylococcus aureus subsp. aureus N315
gcacuucaaaagaaau

SEQ ID NO: 4040701 - RNA, 12 nt, Staphylococcus aureus subsp. aureus N315
gcacuuggauuu

SEQ ID NO: 4040702 - RNA, 20 nt, Staphylococcus aureus subsp. aureus N315
gcacuugguucauaaugauc

SEQ ID NO: 4040703 - RNA, 20 nt, Staphylococcus aureus subsp. aureus N315
gcacuugucucaaauuaaau

SEQ ID NO: 4040704 - RNA, 14 nt, Staphylococcus aureus subsp. aureus N315
gcacuuuauuaaaa

SEQ ID NO: 4040705 - RNA, 15 nt, Staphylococcus aureus subsp. aureus N315
gcagagaauauagau

SEQ ID NO: 4040706 - RNA, 19 nt, Staphylococcus aureus subsp. aureus N315
gcagauguugguucaucaa

SEQ ID NO: 4040707 - RNA, 15 nt, Staphylococcus aureus subsp. aureus N315
gcagauugauauaaa

SEQ ID NO: 4040708 - RNA, 16 nt, Staphylococcus aureus subsp. aureus N315
gcagcuugaucuaaau

SEQ ID NO: 4040709 - RNA, 21 nt, Staphylococcus aureus subsp. aureus N315
gcagcuugaucuaaaugaucu

SEQ ID NO: 4040710 - RNA, 13 nt, Staphylococcus aureus subsp. aureus N315
gcaggaaugauau

SEQ ID NO: 4040711 - RNA, 19 nt, Staphylococcus aureus subsp. aureus N315
gcaggcgaaccgaagcgca

SEQ ID NO: 4040712 - RNA, 22 nt, Staphylococcus aureus subsp. aureus N315
gcaguaagauaauuuucaauua

SEQ ID NO: 4040713 - RNA, 23 nt, Staphylococcus aureus subsp. aureus N315
gcaguaagauaauuuucaauuag

SEQ ID NO: 4040714 - RNA, 12 nt, Staphylococcus aureus subsp. aureus N315
gcaguauauauc

SEQ ID NO: 4040715 - RNA, 17 nt, Staphylococcus aureus subsp. aureus N315
gcagucaaacauagaua

SEQ ID NO: 4040716 - RNA, 22 nt, Staphylococcus aureus subsp. aureus N315
gcagugaucuuuuuuauauuca

SEQ ID NO: 4040717 - RNA, 14 nt, Staphylococcus aureus subsp. aureus N315
gcaguuaauaagaa

SEQ ID NO: 4040718 - RNA, 14 nt, Staphylococcus aureus subsp. aureus N315
gcaguugaaaaaga

SEQ ID NO: 4040719 - RNA, 17 nt, Staphylococcus aureus subsp. aureus N315
gcaguuucugagaagaa

SEQ ID NO: 4040720 - RNA, 23 nt, Staphylococcus aureus subsp. aureus N315
gcauaaaaaaagaacuacgcauu

SEQ ID NO: 4040721 - RNA, 15 nt, Staphylococcus aureus subsp. aureus N315
gcauaaaagccucua

SEQ ID NO: 4040722 - RNA, 14 nt, Staphylococcus aureus subsp. aureus N315
gcauaagaaauacu

SEQ ID NO: 4040723 - RNA, 14 nt, Staphylococcus aureus subsp. aureus N315
gcauaauuuuuuaa

SEQ ID NO: 4040724 - RNA, 18 nt, Staphylococcus aureus subsp. aureus N315
gcauacaggaaauugaag

SEQ ID NO: 4040725 - RNA, 17 nt, Staphylococcus aureus subsp. aureus N315
gcauacgaauuaaaaua

SEQ ID NO: 4040726 - RNA, 18 nt, Staphylococcus aureus subsp. aureus N315
gcauacgaauuaaaauaa

SEQ ID NO: 4040727 - RNA, 13 nt, Staphylococcus aureus subsp. aureus N315
gcauacguaaaug

SEQ ID NO: 4040728 - RNA, 19 nt, Staphylococcus aureus subsp. aureus N315
gcauauaaagucauacuua

SEQ ID NO: 4040729 - RNA, 22 nt, Staphylococcus aureus subsp. aureus N315
gcauauaaagucauacuuauga

SEQ ID NO: 4040730 - RNA, 16 nt, Staphylococcus aureus subsp. aureus N315
gcauauauauauagau

SEQ ID NO: 4040731 - RNA, 18 nt, Staphylococcus aureus subsp. aureus N315
gcauaucgauaaauguau

SEQ ID NO: 4040732 - RNA, 19 nt, Staphylococcus aureus subsp. aureus N315
gcauauguaauacaaaaga

SEQ ID NO: 4040733 - RNA, 19 nt, Staphylococcus aureus subsp. aureus N315
gcaucaaaaauaaaaaugc

SEQ ID NO: 4040734 - RNA, 13 nt, Staphylococcus aureus subsp. aureus N315
gcaucaaaaauga

SEQ ID NO: 4040735 - RNA, 15 nt, Staphylococcus aureus subsp. aureus N315
gcaucacaaaauugu

SEQ ID NO: 4040736 - RNA, 14 nt, Staphylococcus aureus subsp. aureus N315
gcaucccgaaaguu

SEQ ID NO: 4040737 - RNA, 15 nt, Staphylococcus aureus subsp. aureus N315
gcaucuaugauugua

SEQ ID NO: 4040738 - RNA, 18 nt, Staphylococcus aureus subsp. aureus N315
gcaucuccaaaggccaug

SEQ ID NO: 4040739 - RNA, 19 nt, Staphylococcus aureus subsp. aureus N315
gcaucuucaauauuuaaau

SEQ ID NO: 4040740 - RNA, 21 nt, Staphylococcus aureus subsp. aureus N315
gcaucuuuuacugcuucgaca

SEQ ID NO: 4040741 - RNA, 19 nt, Staphylococcus aureus subsp. aureus N315
gcaugaaucgcauuuaaau

SEQ ID NO: 4040742 - RNA, 14 nt, Staphylococcus aureus subsp. aureus N315
gcaugacagcaaau

SEQ ID NO: 4040743 - RNA, 14 nt, Staphylococcus aureus subsp. aureus N315
gcaugacuguaagu

SEQ ID NO: 4040744 - RNA, 15 nt, Staphylococcus aureus subsp. aureus N315
gcaugacuguaagua

SEQ ID NO: 4040745 - RNA, 15 nt, Staphylococcus aureus subsp. aureus N315
gcauguaaaauuaaa

SEQ ID NO: 4040746 - RNA, 17 nt, Staphylococcus aureus subsp. aureus N315
gcauguccugaauguuc

SEQ ID NO: 4040747 - RNA, 13 nt, Staphylococcus aureus subsp. aureus N315
gcauuaauuucau

SEQ ID NO: 4040748 - RNA, 15 nt, Staphylococcus aureus subsp. aureus N315
gcauuacuacaaacu

SEQ ID NO: 4040749 - RNA, 18 nt, Staphylococcus aureus subsp. aureus N315
gcauuacuaucuucauca

SEQ ID NO: 4040750 - RNA, 23 nt, Staphylococcus aureus subsp. aureus N315
gcauuauuaaggggguaauacua

SEQ ID NO: 4040751 - RNA, 14 nt, Staphylococcus aureus subsp. aureus N315
gcauuauuauaaua

SEQ ID NO: 4040752 - RNA, 15 nt, Staphylococcus aureus subsp. aureus N315
gcauucaguuaaugu

SEQ ID NO: 4040753 - RNA, 15 nt, Staphylococcus aureus subsp. aureus N315
gcauucuuccaacac

SEQ ID NO: 4040754 - RNA, 15 nt, Staphylococcus aureus subsp. aureus N315
gcauugagauggucu

SEQ ID NO: 4040755 - RNA, 20 nt, Staphylococcus aureus subsp. aureus N315
gcauuguaauaccaauuuuu

SEQ ID NO: 4040756 - RNA, 22 nt, Staphylococcus aureus subsp. aureus N315
gcauuuaaauauaaaccagcug

SEQ ID NO: 4040757 - RNA, 17 nt, Staphylococcus aureus subsp. aureus N315
gcauuuguaaacaguau

SEQ ID NO: 4040758 - RNA, 15 nt, Staphylococcus aureus subsp. aureus N315
gcauuuuaaauaaaa

SEQ ID NO: 4040759 - RNA, 13 nt, Staphylococcus aureus subsp. aureus N315
gcauuuuguuuca

SEQ ID NO: 4040760 - RNA, 14 nt, Staphylococcus aureus subsp. aureus N315
gcauuuuucaauua

SEQ ID NO: 4040761 - RNA, 21 nt, Staphylococcus aureus subsp. aureus N315
gccaaacaaccugugauaaaa

SEQ ID NO: 4040762 - RNA, 18 nt, Staphylococcus aureus subsp. aureus N315
gccaaaggcaaaauguau

SEQ ID NO: 4040763 - RNA, 17 nt, Staphylococcus aureus subsp. aureus N315
gccaaauaucaguaaua

SEQ ID NO: 4040764 - RNA, 20 nt, Staphylococcus aureus subsp. aureus N315
gccaaauaucaguaauaaua

SEQ ID NO: 4040765 - RNA, 13 nt, Staphylococcus aureus subsp. aureus N315
gccaacaguaauu

SEQ ID NO: 4040766 - RNA, 20 nt, Staphylococcus aureus subsp. aureus N315
gccaacaucuucaacauaac

SEQ ID NO: 4040767 - RNA, 14 nt, Staphylococcus aureus subsp. aureus N315
gccaauaaaauguc

SEQ ID NO: 4040768 - RNA, 17 nt, Staphylococcus aureus subsp. aureus N315
gccacaacauguuugga

SEQ ID NO: 4040769 - RNA, 14 nt, Staphylococcus aureus subsp. aureus N315
gccaccaguuucaa

SEQ ID NO: 4040770 - RNA, 20 nt, Staphylococcus aureus subsp. aureus N315
gcuagucauaauuuaaaaga

SEQ ID NO: 4040771 - RNA, 24 nt, Staphylococcus aureus subsp. aureus N315
gcuaguugaaccguaacuauauga

SEQ ID NO: 4040772 - RNA, 11 nt, Staphylococcus aureus subsp. aureus N315
gcuauaaaagu

SEQ ID NO: 4040773 - RNA, 20 nt, Staphylococcus aureus subsp. aureus N315
gcuauaaaaguacuuuaaaa

SEQ ID NO: 4040774 - RNA, 14 nt, Staphylococcus aureus subsp. aureus N315
gcuauaaaauuuug

SEQ ID NO: 4040775 - RNA, 18 nt, Staphylococcus aureus subsp. aureus N315
gcuauaaucuaucuugug

SEQ ID NO: 4040776 - RNA, 17 nt, Staphylococcus aureus subsp. aureus N315
gcuauacucauuuucug

SEQ ID NO: 4040777 - RNA, 20 nt, Staphylococcus aureus subsp. aureus N315
gcuauauuuuuguauuuaug

SEQ ID NO: 4040778 - RNA, 21 nt, Staphylococcus aureus subsp. aureus N315
gcuauauuuuuguauuuaugu

SEQ ID NO: 4040779 - RNA, 13 nt, Staphylococcus aureus subsp. aureus N315
gcuauuaaaauag

SEQ ID NO: 4040780 - RNA, 22 nt, Staphylococcus aureus subsp. aureus N315
gcuauuacuauaaaaaacagca

SEQ ID NO: 4040781 - RNA, 12 nt, Staphylococcus aureus subsp. aureus N315
gcuauuucaaca

SEQ ID NO: 4040782 - RNA, 20 nt, Staphylococcus aureus subsp. aureus N315
gcuauuucaacaaacauaaa

SEQ ID NO: 4040783 - RNA, 22 nt, Staphylococcus aureus subsp. aureus N315
gcuauuucaacaaacauaaaua

SEQ ID NO: 4040784 - RNA, 14 nt, Staphylococcus aureus subsp. aureus N315
gcuauuugauacaa

SEQ ID NO: 4040785 - RNA, 18 nt, Staphylococcus aureus subsp. aureus N315
gcuauuuuggauaauaug

SEQ ID NO: 4040786 - RNA, 23 nt, Staphylococcus aureus subsp. aureus N315
gcuauuuuggauaauaugagaca

SEQ ID NO: 4040787 - RNA, 18 nt, Staphylococcus aureus subsp. aureus N315
gcucaaucgcaucuguua

SEQ ID NO: 4040788 - RNA, 15 nt, Staphylococcus aureus subsp. aureus N315
gcucauccucauuaa

SEQ ID NO: 4040789 - RNA, 19 nt, Staphylococcus aureus subsp. aureus N315
gcucauccucauuaauaaa

SEQ ID NO: 4040790 - RNA, 12 nt, Staphylococcus aureus subsp. aureus N315
gcuccagucauu

SEQ ID NO: 4040791 - RNA, 20 nt, Staphylococcus aureus subsp. aureus N315
gcucguuaaaucacauauga

SEQ ID NO: 4040792 - RNA, 20 nt, Staphylococcus aureus subsp. aureus N315
gcucuaaacuucuauuaaua

SEQ ID NO: 4040793 - RNA, 17 nt, Staphylococcus aureus subsp. aureus N315
gcucuaauccaaaauaa

SEQ ID NO: 4040794 - RNA, 22 nt, Staphylococcus aureus subsp. aureus N315
gcucuaauucaaugauuuuuaa

SEQ ID NO: 4040795 - RNA, 15 nt, Staphylococcus aureus subsp. aureus N315
gcucuauaucaaauu

SEQ ID NO: 4040796 - RNA, 18 nt, Staphylococcus aureus subsp. aureus N315
gcucuuaaaucacuagcu

SEQ ID NO: 4040797 - RNA, 22 nt, Staphylococcus aureus subsp. aureus N315
gcucuuaauguacuuuucuguc

SEQ ID NO: 4040798 - RNA, 22 nt, Staphylococcus aureus subsp. aureus N315
gcucuuauaaagacaccuucaa

SEQ ID NO: 4040799 - RNA, 17 nt, Staphylococcus aureus subsp. aureus N315
gcucuuuuuguaugagu

SEQ ID NO: 4040800 - RNA, 23 nt, Staphylococcus aureus subsp. aureus N315
gcugaacguaaguuuaguucaaa

SEQ ID NO: 4040801 - RNA, 21 nt, Staphylococcus aureus subsp. aureus N315
gcugaaguuugaacaacaucu

SEQ ID NO: 4040802 - RNA, 14 nt, Staphylococcus aureus subsp. aureus N315
gcugauaauuuuuc

SEQ ID NO: 4040803 - RNA, 15 nt, Staphylococcus aureus subsp. aureus N315
gcugauaauuuuucu

SEQ ID NO: 4040804 - RNA, 16 nt, Staphylococcus aureus subsp. aureus N315
gcugauacauaaaaug

SEQ ID NO: 4040805 - RNA, 18 nt, Staphylococcus aureus subsp. aureus N315
gcugauacccaaucauuc

SEQ ID NO: 4040806 - RNA, 14 nt, Staphylococcus aureus subsp. aureus N315
gcugauuuuauaaa

SEQ ID NO: 4040807 - RNA, 22 nt, Staphylococcus aureus subsp. aureus N315
gcugcacauuccaucuuaaaac

SEQ ID NO: 4040808 - RNA, 15 nt, Staphylococcus aureus subsp. aureus N315
gcugcaucaauauga

SEQ ID NO: 4040809 - RNA, 15 nt, Staphylococcus aureus subsp. aureus N315
gcugcuguacaauuu

SEQ ID NO: 4040810 - RNA, 18 nt, Staphylococcus aureus subsp. aureus N315
gcuggacagcuacaauuu

SEQ ID NO: 4040811 - RNA, 18 nt, Staphylococcus aureus subsp. aureus N315
gcuguguaucaucauaau

SEQ ID NO: 4040812 - RNA, 20 nt, Staphylococcus aureus subsp. aureus N315
gcuguuaauaaaucauuagu

SEQ ID NO: 4040813 - RNA, 12 nt, Staphylococcus aureus subsp. aureus N315
gcuguucucuau

SEQ ID NO: 4040814 - RNA, 13 nt, Staphylococcus aureus subsp. aureus N315
gcuguuugauauu

SEQ ID NO: 4040815 - RNA, 14 nt, Staphylococcus aureus subsp. aureus N315
gcuguuuuauucaa

SEQ ID NO: 4040816 - RNA, 20 nt, Staphylococcus aureus subsp. aureus N315
gcuguuuuuauuauaauaga

SEQ ID NO: 4040817 - RNA, 13 nt, Staphylococcus aureus subsp. aureus N315
gcuuaaaccuuaa

SEQ ID NO: 4040818 - RNA, 15 nt, Staphylococcus aureus subsp. aureus N315
gcuuaacuuccuuuu

SEQ ID NO: 4040819 - RNA, 22 nt, Staphylococcus aureus subsp. aureus N315
gcuuaaguaagauuuaaacauc

SEQ ID NO: 4040820 - RNA, 18 nt, Staphylococcus aureus subsp. aureus N315
gcuuaauuggcaccucua

SEQ ID NO: 4040821 - RNA, 19 nt, Staphylococcus aureus subsp. aureus N315
gcuuaauuuguuuuaaaua

SEQ ID NO: 4040822 - RNA, 13 nt, Staphylococcus aureus subsp. aureus N315
gcuuagauaaauu

SEQ ID NO: 4040823 - RNA, 21 nt, Staphylococcus aureus subsp. aureus N315
gcuuagcgcaggcgcuccuac

SEQ ID NO: 4040824 - RNA, 22 nt, Staphylococcus aureus subsp. aureus N315
gcuuagcgcaggcgcuccuacu

SEQ ID NO: 4040825 - RNA, 23 nt, Staphylococcus aureus subsp. aureus N315
gcuuagggcuuuguuuucugucc

SEQ ID NO: 4040826 - RNA, 24 nt, Staphylococcus aureus subsp. aureus N315
gcuuagucaauguauauuuaacau

SEQ ID NO: 4040827 - RNA, 22 nt, Staphylococcus aureus subsp. aureus N315
gcuuauauaaacaaaaaucuac

SEQ ID NO: 4040828 - RNA, 17 nt, Staphylococcus aureus subsp. aureus N315
gcuuaucaacagcuuca

SEQ ID NO: 4040829 - RNA, 12 nt, Staphylococcus aureus subsp. aureus N315
gcuuaucauuac

SEQ ID NO: 4040830 - RNA, 16 nt, Staphylococcus aureus subsp. aureus N315
gcuuaucuguaaauaa

SEQ ID NO: 4040831 - RNA, 13 nt, Staphylococcus aureus subsp. aureus N315
gcuuauugaaaag

SEQ ID NO: 4040832 - RNA, 17 nt, Staphylococcus aureus subsp. aureus N315
gcuuauuuuuguauucu

SEQ ID NO: 4040833 - RNA, 20 nt, Staphylococcus aureus subsp. aureus N315
gcuucaguuaaaucacugcu

SEQ ID NO: 4040834 - RNA, 22 nt, Staphylococcus aureus subsp. aureus N315
gcuucauauuuagguaauacau

SEQ ID NO: 4040835 - RNA, 21 nt, Staphylococcus aureus subsp. aureus N315
gcuucauuauauaauucuuca

SEQ ID NO: 4040836 - RNA, 15 nt, Staphylococcus aureus subsp. aureus N315
gcuuccaaauguuca

SEQ ID NO: 4040837 - RNA, 18 nt, Staphylococcus aureus subsp. aureus N315
gcuuccaauuuaaaauga

SEQ ID NO: 4040838 - RNA, 17 nt, Staphylococcus aureus subsp. aureus N315
gcuuccacuucaucuaa

SEQ ID NO: 4040839 - RNA, 18 nt, Staphylococcus aureus subsp. aureus N315
gcuuccacuucaucuaaa

SEQ ID NO: 4040840 - RNA, 19 nt, Staphylococcus aureus subsp. aureus N315
gcuucgucacguaaaauau

SEQ ID NO: 4040841 - RNA, 13 nt, Staphylococcus aureus subsp. aureus N315
gcuucgucuuuau

SEQ ID NO: 4040842 - RNA, 15 nt, Staphylococcus aureus subsp. aureus N315
gcuucuaauuuuuca

SEQ ID NO: 4040843 - RNA, 16 nt, Staphylococcus aureus subsp. aureus N315
gcuucugguucuucaa

SEQ ID NO: 4040844 - RNA, 18 nt, Staphylococcus aureus subsp. aureus N315
gcuucuguguuggggccc

SEQ ID NO: 4040845 - RNA, 23 nt, Staphylococcus aureus subsp. aureus N315
gcuucuguguuggggcccacacc

SEQ ID NO: 4040846 - RNA, 13 nt, Staphylococcus aureus subsp. aureus N315
gcuucuuaaauca

SEQ ID NO: 4040847 - RNA, 19 nt, Staphylococcus aureus subsp. aureus N315
gcuucuuaucaacaacaag

SEQ ID NO: 4040848 - RNA, 16 nt, Staphylococcus aureus subsp. aureus N315
gcuugaaguuguuucu

SEQ ID NO: 4040849 - RNA, 19 nt, Staphylococcus aureus subsp. aureus N315
gcuugaccuucaguuucua

SEQ ID NO: 4040850 - RNA, 20 nt, Staphylococcus aureus subsp. aureus N315
gcuugaccuucaguuucuac

SEQ ID NO: 4040851 - RNA, 21 nt, Staphylococcus aureus subsp. aureus N315
gcuugcauccaugcugguuuu

SEQ ID NO: 4040852 - RNA, 17 nt, Staphylococcus aureus subsp. aureus N315
gcuugcggauacauauu

SEQ ID NO: 4040853 - RNA, 16 nt, Staphylococcus aureus subsp. aureus N315
gcuugcuuacaauaau

SEQ ID NO: 4040854 - RNA, 15 nt, Staphylococcus aureus subsp. aureus N315
gcuugcuucuuuccu

SEQ ID NO: 4040855 - RNA, 14 nt, Staphylococcus aureus subsp. aureus N315
gcuuggacauauac

SEQ ID NO: 4040856 - RNA, 14 nt, Staphylococcus aureus subsp. aureus N315
gcuugguuaaaguu

SEQ ID NO: 4040857 - RNA, 20 nt, Staphylococcus aureus subsp. aureus N315
ggcaaugaaauuaccaacac

SEQ ID NO: 4040858 - RNA, 20 nt, Staphylococcus aureus subsp. aureus N315
ggcacauucccguuaauauc

SEQ ID NO: 4040859 - RNA, 22 nt, Staphylococcus aureus subsp. aureus N315
ggcagcuaaaaaguauacuaaa

SEQ ID NO: 4040860 - RNA, 15 nt, Staphylococcus aureus subsp. aureus N315
ggcaggaaugauaua

SEQ ID NO: 4040861 - RNA, 16 nt, Staphylococcus aureus subsp. aureus N315
ggcauaaccuguaauu

SEQ ID NO: 4040862 - RNA, 14 nt, Staphylococcus aureus subsp. aureus N315
ggcauccauaucca

SEQ ID NO: 4040863 - RNA, 21 nt, Staphylococcus aureus subsp. aureus N315
ggcauuauauuuaguccucuu

SEQ ID NO: 4040864 - RNA, 18 nt, Staphylococcus aureus subsp. aureus N315
ggccaaauguugauaaua

SEQ ID NO: 4040865 - RNA, 13 nt, Staphylococcus aureus subsp. aureus N315
ggccaugagcucu

SEQ ID NO: 4040866 - RNA, 15 nt, Staphylococcus aureus subsp. aureus N315
ggcccacaccccaac

SEQ ID NO: 4040867 - RNA, 13 nt, Staphylococcus aureus subsp. aureus N315
ggccccaacacag

SEQ ID NO: 4040868 - RNA, 13 nt, Staphylococcus aureus subsp. aureus N315
ggcccccaacacu

SEQ ID NO: 4040869 - RNA, 20 nt, Staphylococcus aureus subsp. aureus N315
ggccgugguaugauuuuuga

SEQ ID NO: 4040870 - RNA, 17 nt, Staphylococcus aureus subsp. aureus N315
ggccuccucuuuuauuu

SEQ ID NO: 4040871 - RNA, 14 nt, Staphylococcus aureus subsp. aureus N315
ggccuuuaaugauu

SEQ ID NO: 4040872 - RNA, 14 nt, Staphylococcus aureus subsp. aureus N315
ggccuuuuuuauug

SEQ ID NO: 4040873 - RNA, 18 nt, Staphylococcus aureus subsp. aureus N315
ggcgaauagcgauuuuaa

SEQ ID NO: 4040874 - RNA, 23 nt, Staphylococcus aureus subsp. aureus N315
ggcgcuccuacuuuucaacuuua

SEQ ID NO: 4040875 - RNA, 23 nt, Staphylococcus aureus subsp. aureus N315
ggcguuucagaaguuguuuagaa

SEQ ID NO: 4040876 - RNA, 19 nt, Staphylococcus aureus subsp. aureus N315
ggcuuaauuaauaaaaaaa

SEQ ID NO: 4040877 - RNA, 17 nt, Staphylococcus aureus subsp. aureus N315
ggcuugguuauuuucaa

SEQ ID NO: 4040878 - RNA, 18 nt, Staphylococcus aureus subsp. aureus N315
ggcuuuuuuauuuuauaa

SEQ ID NO: 4040879 - RNA, 19 nt, Staphylococcus aureus subsp. aureus N315
ggcuuuuuuuauggugugg

SEQ ID NO: 4040880 - RNA, 14 nt, Staphylococcus aureus subsp. aureus N315
gggaagaccauuuu

SEQ ID NO: 4040881 - RNA, 21 nt, Staphylococcus aureus subsp. aureus N315
gggaauacagcuagcaagaau

SEQ ID NO: 4040882 - RNA, 17 nt, Staphylococcus aureus subsp. aureus N315
gggauauagaaaaggga

SEQ ID NO: 4040883 - RNA, 22 nt, Staphylococcus aureus subsp. aureus N315
gggaugggccccaacaaagaga

SEQ ID NO: 4040884 - RNA, 13 nt, Staphylococcus aureus subsp. aureus N315
gggcagaucauaa

SEQ ID NO: 4040885 - RNA, 19 nt, Staphylococcus aureus subsp. aureus N315
gggcauugagauuggaagg

SEQ ID NO: 4040886 - RNA, 11 nt, Staphylococcus aureus subsp. aureus N315
gggcccacacc

SEQ ID NO: 4040887 - RNA, 12 nt, Staphylococcus aureus subsp. aureus N315
gggccccaacac

SEQ ID NO: 4040888 - RNA, 13 nt, Staphylococcus aureus subsp. aureus N315
gggccccaacaca

SEQ ID NO: 4040889 - RNA, 15 nt, Staphylococcus aureus subsp. aureus N315
gggccccaacacaga

SEQ ID NO: 4040890 - RNA, 15 nt, Staphylococcus aureus subsp. aureus N315
gggcuuuuaugcaug

SEQ ID NO: 4040891 - RNA, 15 nt, Staphylococcus aureus subsp. aureus N315
ggggaugggccccaa

SEQ ID NO: 4040892 - RNA, 23 nt, Staphylococcus aureus subsp. aureus N315
ggggauuuuuuuauguuugggau

SEQ ID NO: 4040893 - RNA, 12 nt, Staphylococcus aureus subsp. aureus N315
ggguaauguuuu

SEQ ID NO: 4040894 - RNA, 14 nt, Staphylococcus aureus subsp. aureus N315
gggugaauuaguaa

SEQ ID NO: 4040895 - RNA, 15 nt, Staphylococcus aureus subsp. aureus N315
gggugagggccccaa

SEQ ID NO: 4040896 - RNA, 11 nt, Staphylococcus aureus subsp. aureus N315
gguaaaaaguu

SEQ ID NO: 4040897 - RNA, 18 nt, Staphylococcus aureus subsp. aureus N315
gguaaaaaugaaccauuu

SEQ ID NO: 4040898 - RNA, 17 nt, Staphylococcus aureus subsp. aureus N315
gguaaauuuaucauuuu

SEQ ID NO: 4040899 - RNA, 13 nt, Staphylococcus aureus subsp. aureus N315
gguaacuuuuuaa

SEQ ID NO: 4040900 - RNA, 18 nt, Staphylococcus aureus subsp. aureus N315
gguaagguguucuaaguu

SEQ ID NO: 4040901 - RNA, 17 nt, Staphylococcus aureus subsp. aureus N315
gguaaugauuuugcuuu

SEQ ID NO: 4040902 - RNA, 22 nt, Staphylococcus aureus subsp. aureus N315
gguaauucaccaucauauucaa

SEQ ID NO: 4040903 - RNA, 17 nt, Staphylococcus aureus subsp. aureus N315
gguacaacuaaauaugc

SEQ ID NO: 4040904 - RNA, 17 nt, Staphylococcus aureus subsp. aureus N315
gguacauaaauaccugg

SEQ ID NO: 4040905 - RNA, 21 nt, Staphylococcus aureus subsp. aureus N315
gguacauaaauagugaaauua

SEQ ID NO: 4040906 - RNA, 15 nt, Staphylococcus aureus subsp. aureus N315
gguauaaaaaaauua

SEQ ID NO: 4040907 - RNA, 18 nt, Staphylococcus aureus subsp. aureus N315
gguauaucuucauuuaaa

SEQ ID NO: 4040908 - RNA, 18 nt, Staphylococcus aureus subsp. aureus N315
gguauccuucucaucauu

SEQ ID NO: 4040909 - RNA, 15 nt, Staphylococcus aureus subsp. aureus N315
gguaugacugcaaau

SEQ ID NO: 4040910 - RNA, 18 nt, Staphylococcus aureus subsp. aureus N315
gguaugauuuuugaacca

SEQ ID NO: 4040911 - RNA, 15 nt, Staphylococcus aureus subsp. aureus N315
gguauuuaauguuuu

SEQ ID NO: 4040912 - RNA, 17 nt, Staphylococcus aureus subsp. aureus N315
ggucaacuguaguggaa

SEQ ID NO: 4040913 - RNA, 18 nt, Staphylococcus aureus subsp. aureus N315
ggucacacccauacucug

SEQ ID NO: 4040914 - RNA, 21 nt, Staphylococcus aureus subsp. aureus N315
ggucacacccauacucugggc

SEQ ID NO: 4040915 - RNA, 18 nt, Staphylococcus aureus subsp. aureus N315
ggucaucaauuggcaacg

SEQ ID NO: 4040916 - RNA, 16 nt, Staphylococcus aureus subsp. aureus N315
ggucuccaauacuuuu

SEQ ID NO: 4040917 - RNA, 22 nt, Staphylococcus aureus subsp. aureus N315
ggucuucgcaaucauuagcgaa

SEQ ID NO: 4040918 - RNA, 19 nt, Staphylococcus aureus subsp. aureus N315
ggugaaaguacuuggaaaa

SEQ ID NO: 4040919 - RNA, 17 nt, Staphylococcus aureus subsp. aureus N315
ggugaguguuucauaau

SEQ ID NO: 4040920 - RNA, 23 nt, Staphylococcus aureus subsp. aureus N315
ggugauauuugcuagucauaauu

SEQ ID NO: 4040921 - RNA, 21 nt, Staphylococcus aureus subsp. aureus N315
ggugcaauaauaaauaggaug

SEQ ID NO: 4040922 - RNA, 14 nt, Staphylococcus aureus subsp. aureus N315
gguggguauauaau

SEQ ID NO: 4040923 - RNA, 16 nt, Staphylococcus aureus subsp. aureus N315
ggugugauguacuacu

SEQ ID NO: 4040924 - RNA, 16 nt, Staphylococcus aureus subsp. aureus N315
gguguggugugaugua

SEQ ID NO: 4040925 - RNA, 17 nt, Staphylococcus aureus subsp. aureus N315
gguguugaaaaguaauu

SEQ ID NO: 4040926 - RNA, 15 nt, Staphylococcus aureus subsp. aureus N315
gguguuuaacuaaac

SEQ ID NO: 4040927 - RNA, 15 nt, Staphylococcus aureus subsp. aureus N315
gguuaccaucuuuaa

SEQ ID NO: 4040928 - RNA, 11 nt, Staphylococcus aureus subsp. aureus N315
gguuauggugu

SEQ ID NO: 4040929 - RNA, 12 nt, Staphylococcus aureus subsp. aureus N315
gguuauuugaua

SEQ ID NO: 4040930 - RNA, 13 nt, Staphylococcus aureus subsp. aureus N315
gguucaaaauugc

SEQ ID NO: 4040931 - RNA, 12 nt, Staphylococcus aureus subsp. aureus N315
gguucaucuaaa

SEQ ID NO: 4040932 - RNA, 18 nt, Staphylococcus aureus subsp. aureus N315
gguucccaauucggauua

SEQ ID NO: 4040933 - RNA, 13 nt, Staphylococcus aureus subsp. aureus N315
gguucgaaucccu

SEQ ID NO: 4040934 - RNA, 15 nt, Staphylococcus aureus subsp. aureus N315
gguucuucaauaugc

SEQ ID NO: 4040935 - RNA, 14 nt, Staphylococcus aureus subsp. aureus N315
gguuuaaaaaugcu

SEQ ID NO: 4040936 - RNA, 21 nt, Staphylococcus aureus subsp. aureus N315
gguuuaaacaguuuaauucgu

SEQ ID NO: 4040937 - RNA, 21 nt, Staphylococcus aureus subsp. aureus N315
gguuuaaucuauauauauaug

SEQ ID NO: 4040938 - RNA, 13 nt, Staphylococcus aureus subsp. aureus N315
gguuuauuuaaua

SEQ ID NO: 4040939 - RNA, 23 nt, Staphylococcus aureus subsp. aureus N315
gguuugaguaaauuaauagagaa

SEQ ID NO: 4040940 - RNA, 13 nt, Staphylococcus aureus subsp. aureus N315
guaaaaaugauua

SEQ ID NO: 4040941 - RNA, 21 nt, Staphylococcus aureus subsp. aureus N315
guaaaacauucccuuaauaau

SEQ ID NO: 4040942 - RNA, 20 nt, Staphylococcus aureus subsp. aureus N315
guaaaaccaaaucguuucau

SEQ ID NO: 4040943 - RNA, 21 nt, Staphylococcus aureus subsp. aureus N315
guaaaaccuuacccaaaaaau

SEQ ID NO: 4040944 - RNA, 13 nt, Staphylococcus aureus subsp. aureus N315
guaaaacugcaau

SEQ ID NO: 4040945 - RNA, 21 nt, Staphylococcus aureus subsp. aureus N315
guaccacauacauaucuuuug

SEQ ID NO: 4040946 - RNA, 13 nt, Staphylococcus aureus subsp. aureus N315
guaccaccccaac

SEQ ID NO: 4040947 - RNA, 21 nt, Staphylococcus aureus subsp. aureus N315
guaccacucauaaucaagucu

SEQ ID NO: 4040948 - RNA, 18 nt, Staphylococcus aureus subsp. aureus N315
guaccaucucuauuuuuu

SEQ ID NO: 4040949 - RNA, 12 nt, Staphylococcus aureus subsp. aureus N315
guaccguauuuu

SEQ ID NO: 4040950 - RNA, 13 nt, Staphylococcus aureus subsp. aureus N315
guaccuaaaauag

SEQ ID NO: 4040951 - RNA, 14 nt, Staphylococcus aureus subsp. aureus N315
guacgauucaauuu

SEQ ID NO: 4040952 - RNA, 19 nt, Staphylococcus aureus subsp. aureus N315
guacgcaauuuaauauuau

SEQ ID NO: 4040953 - RNA, 22 nt, Staphylococcus aureus subsp. aureus N315
guacgcaauuuaauauuauaag

SEQ ID NO: 4040954 - RNA, 20 nt, Staphylococcus aureus subsp. aureus N315
guacggcugcuuuaacugua

SEQ ID NO: 4040955 - RNA, 20 nt, Staphylococcus aureus subsp. aureus N315
guacgguuauuuaauaaugc

SEQ ID NO: 4040956 - RNA, 14 nt, Staphylococcus aureus subsp. aureus N315
guacguuugcauau

SEQ ID NO: 4040957 - RNA, 15 nt, Staphylococcus aureus subsp. aureus N315
guacguuuuaaauaa

SEQ ID NO: 4040958 - RNA, 20 nt, Staphylococcus aureus subsp. aureus N315
guacguuuuuuuaaauacau

SEQ ID NO: 4040959 - RNA, 17 nt, Staphylococcus aureus subsp. aureus N315
guacuaacguuuuaaag

SEQ ID NO: 4040960 - RNA, 15 nt, Staphylococcus aureus subsp. aureus N315
guacuaaucaauacu

SEQ ID NO: 4040961 - RNA, 19 nt, Staphylococcus aureus subsp. aureus N315
guacuauuaucuauccauu

SEQ ID NO: 4040962 - RNA, 21 nt, Staphylococcus aureus subsp. aureus N315
guacuguguuuagguauauaa

SEQ ID NO: 4040963 - RNA, 16 nt, Staphylococcus aureus subsp. aureus N315
guacuuaaaaauagga

SEQ ID NO: 4040964 - RNA, 21 nt, Staphylococcus aureus subsp. aureus N315
guacuuaccuuucaaauauau

SEQ ID NO: 4040965 - RNA, 15 nt, Staphylococcus aureus subsp. aureus N315
guacuuucaaauaau

SEQ ID NO: 4040966 - RNA, 22 nt, Staphylococcus aureus subsp. aureus N315
guacuuuuauguuguuauaaag

SEQ ID NO: 4040967 - RNA, 23 nt, Staphylococcus aureus subsp. aureus N315
guagaaaauagcuguuugauauu

SEQ ID NO: 4040968 - RNA, 18 nt, Staphylococcus aureus subsp. aureus N315
guagaaacacaaggaaua

SEQ ID NO: 4040969 - RNA, 15 nt, Staphylococcus aureus subsp. aureus N315
guagaaagaugugua

SEQ ID NO: 4040970 - RNA, 17 nt, Staphylococcus aureus subsp. aureus N315
guagaauuucuuuucga

SEQ ID NO: 4040971 - RNA, 19 nt, Staphylococcus aureus subsp. aureus N315
guagauaaaucgauaaaau

SEQ ID NO: 4040972 - RNA, 16 nt, Staphylococcus aureus subsp. aureus N315
guagauauugaaugga

SEQ ID NO: 4040973 - RNA, 18 nt, Staphylococcus aureus subsp. aureus N315
guagauuacuuugcuaaa

SEQ ID NO: 4040974 - RNA, 18 nt, Staphylococcus aureus subsp. aureus N315
guagauucaaauugguuu

SEQ ID NO: 4040975 - RNA, 19 nt, Staphylococcus aureus subsp. aureus N315
guagauuuauuaaauauau

SEQ ID NO: 4040976 - RNA, 17 nt, Staphylococcus aureus subsp. aureus N315
guaggaagaccacuauu

SEQ ID NO: 4040977 - RNA, 18 nt, Staphylococcus aureus subsp. aureus N315
guaggaggcuuuugcuuu

SEQ ID NO: 4040978 - RNA, 22 nt, Staphylococcus aureus subsp. aureus N315
guaggaugcuuccuuuuuguua

SEQ ID NO: 4040979 - RNA, 20 nt, Staphylococcus aureus subsp. aureus N315
guaggggagucuuauuuuua

SEQ ID NO: 4040980 - RNA, 16 nt, Staphylococcus aureus subsp. aureus N315
guaguacuauagucau

SEQ ID NO: 4040981 - RNA, 21 nt, Staphylococcus aureus subsp. aureus N315
guagucgaagaagauuaugaa

SEQ ID NO: 4040982 - RNA, 17 nt, Staphylococcus aureus subsp. aureus N315
guagugguucuuauaca

SEQ ID NO: 4040983 - RNA, 20 nt, Staphylococcus aureus subsp. aureus N315
guaguuccucgguauucaau

SEQ ID NO: 4040984 - RNA, 22 nt, Staphylococcus aureus subsp. aureus N315
guaguuggcugauagaugaaaa

SEQ ID NO: 4040985 - RNA, 23 nt, Staphylococcus aureus subsp. aureus N315
guaguuggcugauagaugaaaau

SEQ ID NO: 4040986 - RNA, 14 nt, Staphylococcus aureus subsp. aureus N315
guaguuuauaucaa

SEQ ID NO: 4040987 - RNA, 20 nt, Staphylococcus aureus subsp. aureus N315
guaguuucucuacuaauauu

SEQ ID NO: 4040988 - RNA, 14 nt, Staphylococcus aureus subsp. aureus N315
guauaaaacagaau

SEQ ID NO: 4040989 - RNA, 15 nt, Staphylococcus aureus subsp. aureus N315
guauaaauaaaaaua

SEQ ID NO: 4040990 - RNA, 18 nt, Staphylococcus aureus subsp. aureus N315
guauaaauaaaaauacau

SEQ ID NO: 4040991 - RNA, 17 nt, Staphylococcus aureus subsp. aureus N315
guauaaaugcagcugua

SEQ ID NO: 4040992 - RNA, 14 nt, Staphylococcus aureus subsp. aureus N315
guauaaccauaaug

SEQ ID NO: 4040993 - RNA, 16 nt, Staphylococcus aureus subsp. aureus N315
guauaagaaucagcua

SEQ ID NO: 4040994 - RNA, 21 nt, Staphylococcus aureus subsp. aureus N315
guauaagggguauauuaaaaa

SEQ ID NO: 4040995 - RNA, 14 nt, Staphylococcus aureus subsp. aureus N315
guauaauuaaacua

SEQ ID NO: 4040996 - RNA, 15 nt, Staphylococcus aureus subsp. aureus N315
guauaccucuuagca

SEQ ID NO: 4040997 - RNA, 20 nt, Staphylococcus aureus subsp. aureus N315
guauacuaaacuuuuuucaa

SEQ ID NO: 4040998 - RNA, 22 nt, Staphylococcus aureus subsp. aureus N315
guauagauuguauuuaauaagu

SEQ ID NO: 4040999 - RNA, 15 nt, Staphylococcus aureus subsp. aureus N315
guauaguaaccuuua

SEQ ID NO: 4041000 - RNA, 17 nt, Staphylococcus aureus subsp. aureus N315
guauauaaguuaaaauu

SEQ ID NO: 4041001 - RNA, 16 nt, Staphylococcus aureus subsp. aureus N315
guauauacaaugacag

SEQ ID NO: 4041002 - RNA, 23 nt, Staphylococcus aureus subsp. aureus N315
guauaucauccacaaucacagua

SEQ ID NO: 4041003 - RNA, 19 nt, Staphylococcus aureus subsp. aureus N315
guauaugaauuuuauaaau

SEQ ID NO: 4041004 - RNA, 22 nt, Staphylococcus aureus subsp. aureus N315
guauaugaauuuuauaaauuaa

SEQ ID NO: 4041005 - RNA, 13 nt, Staphylococcus aureus subsp. aureus N315
guauauguauaga

SEQ ID NO: 4041006 - RNA, 14 nt, Staphylococcus aureus subsp. aureus N315
guauauugaaauua

SEQ ID NO: 4041007 - RNA, 17 nt, Staphylococcus aureus subsp. aureus N315
guaucaacauuaauaaa

SEQ ID NO: 4041008 - RNA, 16 nt, Staphylococcus aureus subsp. aureus N315
guaucaucaaaguuua

SEQ ID NO: 4041009 - RNA, 20 nt, Staphylococcus aureus subsp. aureus N315
guaucauuguguccauaaau

SEQ ID NO: 4041010 - RNA, 12 nt, Staphylococcus aureus subsp. aureus N315
guaucauuuaaa

SEQ ID NO: 4041011 - RNA, 21 nt, Staphylococcus aureus subsp. aureus N315
guauccuguguaaaauaaauc

SEQ ID NO: 4041012 - RNA, 19 nt, Staphylococcus aureus subsp. aureus N315
guaucgaauuaagaaaagu

SEQ ID NO: 4041013 - RNA, 20 nt, Staphylococcus aureus subsp. aureus N315
guaucgauaguucuauauaa

SEQ ID NO: 4041014 - RNA, 17 nt, Staphylococcus aureus subsp. aureus N315
guaucgccaaucuauug

SEQ ID NO: 4041015 - RNA, 14 nt, Staphylococcus aureus subsp. aureus N315
guaucgccaucauu

SEQ ID NO: 4041016 - RNA, 23 nt, Staphylococcus aureus subsp. aureus N315
guaucuaguguucucauuauaau

SEQ ID NO: 4041017 - RNA, 14 nt, Staphylococcus aureus subsp. aureus N315
guaucuauaaaaag

SEQ ID NO: 4041018 - RNA, 16 nt, Staphylococcus aureus subsp. aureus N315
guaucuauaaaaagaa

SEQ ID NO: 4041019 - RNA, 19 nt, Staphylococcus aureus subsp. aureus N315
guaucuauacaauuaugga

SEQ ID NO: 4041020 - RNA, 19 nt, Staphylococcus aureus subsp. aureus N315
guaucuaugaaauuuuuua

SEQ ID NO: 4041021 - RNA, 20 nt, Staphylococcus aureus subsp. aureus N315
guaucucugaaaaacuucuu

SEQ ID NO: 4041022 - RNA, 22 nt, Staphylococcus aureus subsp. aureus N315
guaucucugaaaaacuucuuaa

SEQ ID NO: 4041023 - RNA, 14 nt, Staphylococcus aureus subsp. aureus N315
guaugagucaaauu

SEQ ID NO: 4041024 - RNA, 16 nt, Staphylococcus aureus subsp. aureus N315
guaugagugauagaaa

SEQ ID NO: 4041025 - RNA, 19 nt, Staphylococcus aureus subsp. aureus N315
guaugauagaauacuaaaa

SEQ ID NO: 4041026 - RNA, 21 nt, Staphylococcus aureus subsp. aureus N315
guaugauagaauacuaaaagu

SEQ ID NO: 4041027 - RNA, 13 nt, Staphylococcus aureus subsp. aureus N315
guaugauuaggau

SEQ ID NO: 4041028 - RNA, 20 nt, Staphylococcus aureus subsp. aureus N315
guaugcaucaguuaauaauu

SEQ ID NO: 4041029 - RNA, 19 nt, Staphylococcus aureus subsp. aureus N315
guaugcccucauaaaucau

SEQ ID NO: 4041030 - RNA, 14 nt, Staphylococcus aureus subsp. aureus N315
guaugcguggucua

SEQ ID NO: 4041031 - RNA, 16 nt, Staphylococcus aureus subsp. aureus N315
guauggacuaagauau

SEQ ID NO: 4041032 - RNA, 22 nt, Staphylococcus aureus subsp. aureus N315
gucuaugaauaauguuuucauu

SEQ ID NO: 4041033 - RNA, 18 nt, Staphylococcus aureus subsp. aureus N315
gucuaugucaaauugaac

SEQ ID NO: 4041034 - RNA, 21 nt, Staphylococcus aureus subsp. aureus N315
gucuauuguaaaaacguucaa

SEQ ID NO: 4041035 - RNA, 18 nt, Staphylococcus aureus subsp. aureus N315
gucucacuuaauaaauaa

SEQ ID NO: 4041036 - RNA, 20 nt, Staphylococcus aureus subsp. aureus N315
gucucauaucuauuuuucga

SEQ ID NO: 4041037 - RNA, 15 nt, Staphylococcus aureus subsp. aureus N315
gucuccaauacuuuu

SEQ ID NO: 4041038 - RNA, 12 nt, Staphylococcus aureus subsp. aureus N315
gucuccauauuu

SEQ ID NO: 4041039 - RNA, 15 nt, Staphylococcus aureus subsp. aureus N315
gucuccgugauaaau

SEQ ID NO: 4041040 - RNA, 18 nt, Staphylococcus aureus subsp. aureus N315
gucucuaaaacuuuuuca

SEQ ID NO: 4041041 - RNA, 13 nt, Staphylococcus aureus subsp. aureus N315
gucucuaguaucu

SEQ ID NO: 4041042 - RNA, 20 nt, Staphylococcus aureus subsp. aureus N315
gucugaugucgaaaauagcu

SEQ ID NO: 4041043 - RNA, 13 nt, Staphylococcus aureus subsp. aureus N315
gucuggaauaaau

SEQ ID NO: 4041044 - RNA, 11 nt, Staphylococcus aureus subsp. aureus N315
gucuuaaacau

SEQ ID NO: 4041045 - RNA, 22 nt, Staphylococcus aureus subsp. aureus N315
gucuuaacaaauuaaaaaggua

SEQ ID NO: 4041046 - RNA, 13 nt, Staphylococcus aureus subsp. aureus N315
gucuuaauucauu

SEQ ID NO: 4041047 - RNA, 18 nt, Staphylococcus aureus subsp. aureus N315
gucuuacuuuuaaauuaa

SEQ ID NO: 4041048 - RNA, 19 nt, Staphylococcus aureus subsp. aureus N315
gucuuccaaucaacuucau

SEQ ID NO: 4041049 - RNA, 14 nt, Staphylococcus aureus subsp. aureus N315
gucuucucuaucag

SEQ ID NO: 4041050 - RNA, 15 nt, Staphylococcus aureus subsp. aureus N315
gucuugaguacuaau

SEQ ID NO: 4041051 - RNA, 22 nt, Staphylococcus aureus subsp. aureus N315
gucuugaguacuaaucaauacu

SEQ ID NO: 4041052 - RNA, 22 nt, Staphylococcus aureus subsp. aureus N315
gucuugauggugguaccacaua

SEQ ID NO: 4041053 - RNA, 16 nt, Staphylococcus aureus subsp. aureus N315
gucuugugauaauucu

SEQ ID NO: 4041054 - RNA, 21 nt, Staphylococcus aureus subsp. aureus N315
gucuuuaauugucucaucauu

SEQ ID NO: 4041055 - RNA, 13 nt, Staphylococcus aureus subsp. aureus N315
gucuuucuaaguu

SEQ ID NO: 4041056 - RNA, 11 nt, Staphylococcus aureus subsp. aureus N315
gugaaaagugu

SEQ ID NO: 4041057 - RNA, 21 nt, Staphylococcus aureus subsp. aureus N315
gugaaaguauuagauauauuu

SEQ ID NO: 4041058 - RNA, 21 nt, Staphylococcus aureus subsp. aureus N315
gugaaauuagaaaaauaugau

SEQ ID NO: 4041059 - RNA, 22 nt, Staphylococcus aureus subsp. aureus N315
gugaaauuagaaaaauaugauu

SEQ ID NO: 4041060 - RNA, 14 nt, Staphylococcus aureus subsp. aureus N315
gugaacuauuaaaa

SEQ ID NO: 4041061 - RNA, 16 nt, Staphylococcus aureus subsp. aureus N315
gugaaucuaaacuaua

SEQ ID NO: 4041062 - RNA, 23 nt, Staphylococcus aureus subsp. aureus N315
gugaaucuuauuuuguuuuaaaa

SEQ ID NO: 4041063 - RNA, 22 nt, Staphylococcus aureus subsp. aureus N315
gugaauguuuucuaaaucuaac

SEQ ID NO: 4041064 - RNA, 13 nt, Staphylococcus aureus subsp. aureus N315
gugacaaacauuu

SEQ ID NO: 4041065 - RNA, 12 nt, Staphylococcus aureus subsp. aureus N315
gugacaacauua

SEQ ID NO: 4041066 - RNA, 17 nt, Staphylococcus aureus subsp. aureus N315
gugaccucagguuguua

SEQ ID NO: 4041067 - RNA, 15 nt, Staphylococcus aureus subsp. aureus N315
gugacucaaugaauu

SEQ ID NO: 4041068 - RNA, 17 nt, Staphylococcus aureus subsp. aureus N315
gugacuuuuauaauucu

SEQ ID NO: 4041069 - RNA, 22 nt, Staphylococcus aureus subsp. aureus N315
gugacuuuuauaauucuaaguc

SEQ ID NO: 4041070 - RNA, 14 nt, Staphylococcus aureus subsp. aureus N315
gugaggcaccaaug

SEQ ID NO: 4041071 - RNA, 15 nt, Staphylococcus aureus subsp. aureus N315
gugaggcccauaaau

SEQ ID NO: 4041072 - RNA, 18 nt, Staphylococcus aureus subsp. aureus N315
gugagggacgucaucaug

SEQ ID NO: 4041073 - RNA, 15 nt, Staphylococcus aureus subsp. aureus N315
gugagggccccaaca

SEQ ID NO: 4041074 - RNA, 19 nt, Staphylococcus aureus subsp. aureus N315
gugagggccccaacacaga

SEQ ID NO: 4041075 - RNA, 16 nt, Staphylococcus aureus subsp. aureus N315
gugauaaauaaugcau

SEQ ID NO: 4041076 - RNA, 12 nt, Staphylococcus aureus subsp. aureus N315
gugauaucuugc

SEQ ID NO: 4041077 - RNA, 21 nt, Staphylococcus aureus subsp. aureus N315
gugauauuaauugaaaaacca

SEQ ID NO: 4041078 - RNA, 18 nt, Staphylococcus aureus subsp. aureus N315
gugaugcuugaauguuug

SEQ ID NO: 4041079 - RNA, 14 nt, Staphylococcus aureus subsp. aureus N315
gugaugguaaauca

SEQ ID NO: 4041080 - RNA, 18 nt, Staphylococcus aureus subsp. aureus N315
gugauuacauucuauacu

SEQ ID NO: 4041081 - RNA, 13 nt, Staphylococcus aureus subsp. aureus N315
gugauucaucuau

SEQ ID NO: 4041082 - RNA, 17 nt, Staphylococcus aureus subsp. aureus N315
gugauuuaaaaaauuua

SEQ ID NO: 4041083 - RNA, 17 nt, Staphylococcus aureus subsp. aureus N315
gugauuuguuacuucua

SEQ ID NO: 4041084 - RNA, 16 nt, Staphylococcus aureus subsp. aureus N315
gugauuuuuaauaauu

SEQ ID NO: 4041085 - RNA, 18 nt, Staphylococcus aureus subsp. aureus N315
gugcaauaauaaauagga

SEQ ID NO: 4041086 - RNA, 23 nt, Staphylococcus aureus subsp. aureus N315
gugcaauauuauauuuugaauca

SEQ ID NO: 4041087 - RNA, 20 nt, Staphylococcus aureus subsp. aureus N315
gugcaauuaauguaaugaua

SEQ ID NO: 4041088 - RNA, 15 nt, Staphylococcus aureus subsp. aureus N315
gugcauucaucaaug

SEQ ID NO: 4041089 - RNA, 13 nt, Staphylococcus aureus subsp. aureus N315
gugcauuuagaug

SEQ ID NO: 4041090 - RNA, 22 nt, Staphylococcus aureus subsp. aureus N315
gugccggcuuuuucuuuuguuu

SEQ ID NO: 4041091 - RNA, 15 nt, Staphylococcus aureus subsp. aureus N315
gugccucauccuuuu

SEQ ID NO: 4041092 - RNA, 15 nt, Staphylococcus aureus subsp. aureus N315
gugccuuugcuuuuu

SEQ ID NO: 4041093 - RNA, 21 nt, Staphylococcus aureus subsp. aureus N315
gugcgcucaucuauaaauacu

SEQ ID NO: 4041094 - RNA, 15 nt, Staphylococcus aureus subsp. aureus N315
gugcgguuauuuaua

SEQ ID NO: 4041095 - RNA, 15 nt, Staphylococcus aureus subsp. aureus N315
gugcgugaagagaug

SEQ ID NO: 4041096 - RNA, 21 nt, Staphylococcus aureus subsp. aureus N315
gugcgugaagagaugaaagau

SEQ ID NO: 4041097 - RNA, 16 nt, Staphylococcus aureus subsp. aureus N315
gugcuaccuacuuguu

SEQ ID NO: 4041098 - RNA, 20 nt, Staphylococcus aureus subsp. aureus N315
gugcucuugcaauagcaaca

SEQ ID NO: 4041099 - RNA, 15 nt, Staphylococcus aureus subsp. aureus N315
gugcuguuaucaugg

SEQ ID NO: 4041100 - RNA, 21 nt, Staphylococcus aureus subsp. aureus N315
gugcuuuaaugccggucauaa

SEQ ID NO: 4041101 - RNA, 23 nt, Staphylococcus aureus subsp. aureus N315
gugcuuucaccuuugaauauagu

SEQ ID NO: 4041102 - RNA, 21 nt, Staphylococcus aureus subsp. aureus N315
gugcuuuuccauaaauauuua

SEQ ID NO: 4041103 - RNA, 12 nt, Staphylococcus aureus subsp. aureus N315
gugcuuuuucaa

SEQ ID NO: 4041104 - RNA, 20 nt, Staphylococcus aureus subsp. aureus N315
guggauuacagaugaugcuu

SEQ ID NO: 4041105 - RNA, 19 nt, Staphylococcus aureus subsp. aureus N315
guggcuuuuuuuauggugu

SEQ ID NO: 4041106 - RNA, 16 nt, Staphylococcus aureus subsp. aureus N315
guggucuauuuuauaa

SEQ ID NO: 4041107 - RNA, 13 nt, Staphylococcus aureus subsp. aureus N315
gugguguuuauau

SEQ ID NO: 4041108 - RNA, 21 nt, Staphylococcus aureus subsp. aureus N315
gugguucauuagcauuauuau

SEQ ID NO: 4041109 - RNA, 23 nt, Staphylococcus aureus subsp. aureus N315
gugguuuucuuuauuuuaaacau

SEQ ID NO: 4041110 - RNA, 20 nt, Staphylococcus aureus subsp. aureus N315
guguaacuuuaucacuguau

SEQ ID NO: 4041111 - RNA, 18 nt, Staphylococcus aureus subsp. aureus N315
guguaauaaagcaauguu

SEQ ID NO: 4041112 - RNA, 19 nt, Staphylococcus aureus subsp. aureus N315
guguagauaaaucgauaaa

SEQ ID NO: 4041113 - RNA, 21 nt, Staphylococcus aureus subsp. aureus N315
guguauauguggcacucauaa

SEQ ID NO: 4041114 - RNA, 14 nt, Staphylococcus aureus subsp. aureus N315
guguaugauagaau

SEQ ID NO: 4041115 - RNA, 15 nt, Staphylococcus aureus subsp. aureus N315
gugucacaaagaaau

SEQ ID NO: 4041116 - RNA, 16 nt, Staphylococcus aureus subsp. aureus N315
gugucauaauccauuc

SEQ ID NO: 4041117 - RNA, 14 nt, Staphylococcus aureus subsp. aureus N315
gugucaugcugaau

SEQ ID NO: 4041118 - RNA, 19 nt, Staphylococcus aureus subsp. aureus N315
gugucuaacgcuguuucaa

SEQ ID NO: 4041119 - RNA, 15 nt, Staphylococcus aureus subsp. aureus N315
gugugauuuuggaac

SEQ ID NO: 4041120 - RNA, 20 nt, Staphylococcus aureus subsp. aureus N315
guucaaauaacgcaaugucu

SEQ ID NO: 4041121 - RNA, 18 nt, Staphylococcus aureus subsp. aureus N315
guucaacuaaauuuucua

SEQ ID NO: 4041122 - RNA, 12 nt, Staphylococcus aureus subsp. aureus N315
guucaaguauau

SEQ ID NO: 4041123 - RNA, 23 nt, Staphylococcus aureus subsp. aureus N315
guucaauauuuaucaauaaauca

SEQ ID NO: 4041124 - RNA, 18 nt, Staphylococcus aureus subsp. aureus N315
guucacaacaaaguguaa

SEQ ID NO: 4041125 - RNA, 15 nt, Staphylococcus aureus subsp. aureus N315
guucacguuaucaua

SEQ ID NO: 4041126 - RNA, 16 nt, Staphylococcus aureus subsp. aureus N315
guucacuugguacacc

SEQ ID NO: 4041127 - RNA, 18 nt, Staphylococcus aureus subsp. aureus N315
guucagaacuacaauuca

SEQ ID NO: 4041128 - RNA, 12 nt, Staphylococcus aureus subsp. aureus N315
guucaguuguuu

SEQ ID NO: 4041129 - RNA, 19 nt, Staphylococcus aureus subsp. aureus N315
guucauagugguguuuaua

SEQ ID NO: 4041130 - RNA, 16 nt, Staphylococcus aureus subsp. aureus N315
guucaucaaacaacau

SEQ ID NO: 4041131 - RNA, 18 nt, Staphylococcus aureus subsp. aureus N315
guucaucaaacaacauca

SEQ ID NO: 4041132 - RNA, 18 nt, Staphylococcus aureus subsp. aureus N315
guuccaacaacuaagaua

SEQ ID NO: 4041133 - RNA, 14 nt, Staphylococcus aureus subsp. aureus N315
guucccauucuuug

SEQ ID NO: 4041134 - RNA, 15 nt, Staphylococcus aureus subsp. aureus N315
guuccguugaauuaa

SEQ ID NO: 4041135 - RNA, 14 nt, Staphylococcus aureus subsp. aureus N315
guucggaugagaaa

SEQ ID NO: 4041136 - RNA, 15 nt, Staphylococcus aureus subsp. aureus N315
guucgggaauuuuuu

SEQ ID NO: 4041137 - RNA, 12 nt, Staphylococcus aureus subsp. aureus N315
guucuaaaucuu

SEQ ID NO: 4041138 - RNA, 21 nt, Staphylococcus aureus subsp. aureus N315
guucuaaccauucguaauaaa

SEQ ID NO: 4041139 - RNA, 16 nt, Staphylococcus aureus subsp. aureus N315
guucucccuuuuaucu

SEQ ID NO: 4041140 - RNA, 17 nt, Staphylococcus aureus subsp. aureus N315
guucucguguaaaaugc

SEQ ID NO: 4041141 - RNA, 22 nt, Staphylococcus aureus subsp. aureus N315
guucugcuaaucuucucauaaa

SEQ ID NO: 4041142 - RNA, 14 nt, Staphylococcus aureus subsp. aureus N315
guucuuauaaaaaa

SEQ ID NO: 4041143 - RNA, 13 nt, Staphylococcus aureus subsp. aureus N315
guucuugagcugu

SEQ ID NO: 4041144 - RNA, 14 nt, Staphylococcus aureus subsp. aureus N315
guucuuucuuucuu

SEQ ID NO: 4041145 - RNA, 17 nt, Staphylococcus aureus subsp. aureus N315
guugaaaaccucuuuuu

SEQ ID NO: 4041146 - RNA, 15 nt, Staphylococcus aureus subsp. aureus N315
guugaagcuaauuca

SEQ ID NO: 4041147 - RNA, 19 nt, Staphylococcus aureus subsp. aureus N315
guugaauguggaacaugau

SEQ ID NO: 4041148 - RNA, 23 nt, Staphylococcus aureus subsp. aureus N315
guugacguugugucaugcugaau

SEQ ID NO: 4041149 - RNA, 16 nt, Staphylococcus aureus subsp. aureus N315
guugacuguaaaacaa

SEQ ID NO: 4041150 - RNA, 16 nt, Staphylococcus aureus subsp. aureus N315
guugauguguugcauu

SEQ ID NO: 4041151 - RNA, 19 nt, Staphylococcus aureus subsp. aureus N315
guugcaauugaagugaaau

SEQ ID NO: 4041152 - RNA, 15 nt, Staphylococcus aureus subsp. aureus N315
guugcacucuuuucu

SEQ ID NO: 4041153 - RNA, 18 nt, Staphylococcus aureus subsp. aureus N315
guugcauaaucaauuuca

SEQ ID NO: 4041154 - RNA, 21 nt, Staphylococcus aureus subsp. aureus N315
guugcugaauaaaauauaucu

SEQ ID NO: 4041155 - RNA, 22 nt, Staphylococcus aureus subsp. aureus N315
guugcuuaaucgggcuauauuu

SEQ ID NO: 4041156 - RNA, 14 nt, Staphylococcus aureus subsp. aureus N315
guugcuucuuauca

SEQ ID NO: 4041157 - RNA, 16 nt, Staphylococcus aureus subsp. aureus N315
guugcuucuuaucaac

SEQ ID NO: 4041158 - RNA, 18 nt, Staphylococcus aureus subsp. aureus N315
guuggcggggccccaaca

SEQ ID NO: 4041159 - RNA, 20 nt, Staphylococcus aureus subsp. aureus N315
guuggggaugggccccaaca

SEQ ID NO: 4041160 - RNA, 18 nt, Staphylococcus aureus subsp. aureus N315
guuggggcccacacccca

SEQ ID NO: 4041161 - RNA, 17 nt, Staphylococcus aureus subsp. aureus N315
guugguauuaauuuuuc

SEQ ID NO: 4041162 - RNA, 18 nt, Staphylococcus aureus subsp. aureus N315
guugguuuuauuaauucu

SEQ ID NO: 4041163 - RNA, 21 nt, Staphylococcus aureus subsp. aureus N315
guuguaaucauugguuucauc

SEQ ID NO: 4041164 - RNA, 22 nt, Staphylococcus aureus subsp. aureus N315
guugucacuuggauucaaauga

SEQ ID NO: 4041165 - RNA, 13 nt, Staphylococcus aureus subsp. aureus N315
guugucuuuacau

SEQ ID NO: 4041166 - RNA, 16 nt, Staphylococcus aureus subsp. aureus N315
guugugcaauaccugu

SEQ ID NO: 4041167 - RNA, 22 nt, Staphylococcus aureus subsp. aureus N315
guuguuauuuuugcuauuucaa

SEQ ID NO: 4041168 - RNA, 17 nt, Staphylococcus aureus subsp. aureus N315
guuguucccauuuuuaa

SEQ ID NO: 4041169 - RNA, 19 nt, Staphylococcus aureus subsp. aureus N315
guuguucccauuuuuaaaa

SEQ ID NO: 4041170 - RNA, 16 nt, Staphylococcus aureus subsp. aureus N315
guuguugaaauuaaau

SEQ ID NO: 4041171 - RNA, 18 nt, Staphylococcus aureus subsp. aureus N315
guuguuuuuuguuuucaa

SEQ ID NO: 4041172 - RNA, 14 nt, Staphylococcus aureus subsp. aureus N315
guuuaaaaaacuac

SEQ ID NO: 4041173 - RNA, 13 nt, Staphylococcus aureus subsp. aureus N315
guuuaaacauuuu

SEQ ID NO: 4041174 - RNA, 15 nt, Staphylococcus aureus subsp. aureus N315
guuuaaaguauaagg

SEQ ID NO: 4041175 - RNA, 13 nt, Staphylococcus aureus subsp. aureus N315
guuuaaauauuca

SEQ ID NO: 4041176 - RNA, 18 nt, Staphylococcus aureus subsp. aureus N315
guuuaaaugugcaauuag

SEQ ID NO: 4041177 - RNA, 20 nt, Staphylococcus aureus subsp. aureus N315
guuuaaaugugcaauuagaa

SEQ ID NO: 4041178 - RNA, 19 nt, Staphylococcus aureus subsp. aureus N315
guuuaaauucauuuuaagu

SEQ ID NO: 4041179 - RNA, 15 nt, Staphylococcus aureus subsp. aureus N315
guuuaacaacacuac

SEQ ID NO: 4041180 - RNA, 18 nt, Staphylococcus aureus subsp. aureus N315
guuuaacaacacuaccca

SEQ ID NO: 4041181 - RNA, 14 nt, Staphylococcus aureus subsp. aureus N315
guuuaagaauguac

SEQ ID NO: 4041182 - RNA, 17 nt, Staphylococcus aureus subsp. aureus N315
guuuaagauuuuaucuu

SEQ ID NO: 4041183 - RNA, 15 nt, Staphylococcus aureus subsp. aureus N315
guuuaaguuuuucag

SEQ ID NO: 4041184 - RNA, 15 nt, Staphylococcus aureus subsp. aureus N315
guuuaauaaugguuc

SEQ ID NO: 4041185 - RNA, 16 nt, Staphylococcus aureus subsp. aureus N315
guuuaauaaugguucu

SEQ ID NO: 4041186 - RNA, 17 nt, Staphylococcus aureus subsp. aureus N315
guuuaaucgcauuguua

SEQ ID NO: 4041187 - RNA, 19 nt, Staphylococcus aureus subsp. aureus N315
guuuaaucgcauuguuaaa

SEQ ID NO: 4041188 - RNA, 14 nt, Staphylococcus aureus subsp. aureus N315
guuuaauuaaaaua

SEQ ID NO: 4041189 - RNA, 20 nt, Staphylococcus aureus subsp. aureus N315
guuuaauuaaaauacaaauu

SEQ ID NO: 4041190 - RNA, 20 nt, Staphylococcus aureus subsp. aureus N315
guuuaauuugauuaaauuca

SEQ ID NO: 4041191 - RNA, 23 nt, Staphylococcus aureus subsp. aureus N315
guuuaauuugauuaaauucaucu

SEQ ID NO: 4041192 - RNA, 18 nt, Staphylococcus aureus subsp. aureus N315
guuuaccgucuuuugcaa

SEQ ID NO: 4041193 - RNA, 19 nt, Staphylococcus aureus subsp. aureus N315
guuuacgaucauaaauauu

SEQ ID NO: 4041194 - RNA, 15 nt, Staphylococcus aureus subsp. aureus N315
guuuacuauacuuug

SEQ ID NO: 4041195 - RNA, 14 nt, Staphylococcus aureus subsp. aureus N315
guuuagauagcucu

SEQ ID NO: 4041196 - RNA, 15 nt, Staphylococcus aureus subsp. aureus N315
guuuauaaaaaauca

SEQ ID NO: 4041197 - RNA, 20 nt, Staphylococcus aureus subsp. aureus N315
guuuauaaaaaaucaguuuu

SEQ ID NO: 4041198 - RNA, 15 nt, Staphylococcus aureus subsp. aureus N315
guuuauaaucaguuu

SEQ ID NO: 4041199 - RNA, 17 nt, Staphylococcus aureus subsp. aureus N315
guuuauauugcaaaaau

SEQ ID NO: 4041200 - RNA, 18 nt, Staphylococcus aureus subsp. aureus N315
guuuauccuuuaaaucau

SEQ ID NO: 4041201 - RNA, 19 nt, Staphylococcus aureus subsp. aureus N315
guuuaucuguaucaaaauc

SEQ ID NO: 4041202 - RNA, 20 nt, Staphylococcus aureus subsp. aureus N315
guuuaucuguugucaucaug

SEQ ID NO: 4041203 - RNA, 20 nt, Staphylococcus aureus subsp. aureus N315
guuuauuacauaauuuaucu

SEQ ID NO: 4041204 - RNA, 18 nt, Staphylococcus aureus subsp. aureus N315
guuuauuuaauaacgaag

SEQ ID NO: 4041205 - RNA, 15 nt, Staphylococcus aureus subsp. aureus N315
guuuauuuagaauaa

SEQ ID NO: 4041206 - RNA, 20 nt, Staphylococcus aureus subsp. aureus N315
guuucaaacgugauuuuauc

SEQ ID NO: 4041207 - RNA, 23 nt, Staphylococcus aureus subsp. aureus N315
guuucaacauuucagcauuugcu

SEQ ID NO: 4041208 - RNA, 15 nt, Staphylococcus aureus subsp. aureus N315
uaaaaacucuaaaag

SEQ ID NO: 4041209 - RNA, 18 nt, Staphylococcus aureus subsp. aureus N315
uaaaaacucuaaaaguug

SEQ ID NO: 4041210 - RNA, 13 nt, Staphylococcus aureus subsp. aureus N315
uaaaaacuguuca

SEQ ID NO: 4041211 - RNA, 22 nt, Staphylococcus aureus subsp. aureus N315
uaaaaagaauaugauauugauu

SEQ ID NO: 4041212 - RNA, 18 nt, Staphylococcus aureus subsp. aureus N315
uaaaaagacggugaccuu

SEQ ID NO: 4041213 - RNA, 18 nt, Staphylococcus aureus subsp. aureus N315
uaaaaagagguuuucauu

SEQ ID NO: 4041214 - RNA, 19 nt, Staphylococcus aureus subsp. aureus N315
uaaaaagagguuuucauua

SEQ ID NO: 4041215 - RNA, 17 nt, Staphylococcus aureus subsp. aureus N315
uaaaaagaucauuaaaa

SEQ ID NO: 4041216 - RNA, 15 nt, Staphylococcus aureus subsp. aureus N315
uaaaaagguacuaau

SEQ ID NO: 4041217 - RNA, 12 nt, Staphylococcus aureus subsp. aureus N315
uaaaaaguuuaa

SEQ ID NO: 4041218 - RNA, 14 nt, Staphylococcus aureus subsp. aureus N315
uaaaaauaaaaccg

SEQ ID NO: 4041219 - RNA, 17 nt, Staphylococcus aureus subsp. aureus N315
uaaaaauaggaauacau

SEQ ID NO: 4041220 - RNA, 19 nt, Staphylococcus aureus subsp. aureus N315
uaaaaauaggaauacauga

SEQ ID NO: 4041221 - RNA, 14 nt, Staphylococcus aureus subsp. aureus N315
uaaaaaucaaagag

SEQ ID NO: 4041222 - RNA, 19 nt, Staphylococcus aureus subsp. aureus N315
uaaaaaucaaagaggcaca

SEQ ID NO: 4041223 - RNA, 19 nt, Staphylococcus aureus subsp. aureus N315
uaaaaaucauaaauaacac

SEQ ID NO: 4041224 - RNA, 15 nt, Staphylococcus aureus subsp. aureus N315
uaaaaauccucacaa

SEQ ID NO: 4041225 - RNA, 15 nt, Staphylococcus aureus subsp. aureus N315
uaaaaaucucaaaau

SEQ ID NO: 4041226 - RNA, 16 nt, Staphylococcus aureus subsp. aureus N315
uaaaaaucucaaaauu

SEQ ID NO: 4041227 - RNA, 16 nt, Staphylococcus aureus subsp. aureus N315
uaaaaaucuuaugaug

SEQ ID NO: 4041228 - RNA, 18 nt, Staphylococcus aureus subsp. aureus N315
uaaaaaucuuaugauguc

SEQ ID NO: 4041229 - RNA, 14 nt, Staphylococcus aureus subsp. aureus N315
uaaaaaucuuggug

SEQ ID NO: 4041230 - RNA, 15 nt, Staphylococcus aureus subsp. aureus N315
uaaaaauuuaugucu

SEQ ID NO: 4041231 - RNA, 14 nt, Staphylococcus aureus subsp. aureus N315
uaaaaauuucaaua

SEQ ID NO: 4041232 - RNA, 15 nt, Staphylococcus aureus subsp. aureus N315
uaaaacaaauuauua

SEQ ID NO: 4041233 - RNA, 20 nt, Staphylococcus aureus subsp. aureus N315
uaaaacaaauucauauuaac

SEQ ID NO: 4041234 - RNA, 21 nt, Staphylococcus aureus subsp. aureus N315
uaaaacaaauucauauuaacu

SEQ ID NO: 4041235 - RNA, 15 nt, Staphylococcus aureus subsp. aureus N315
uaaaacaaugauuaa

SEQ ID NO: 4041236 - RNA, 19 nt, Staphylococcus aureus subsp. aureus N315
uaaaacaaugauuaaaauu

SEQ ID NO: 4041237 - RNA, 23 nt, Staphylococcus aureus subsp. aureus N315
uaaaacacggucgccaacaguaa

SEQ ID NO: 4041238 - RNA, 21 nt, Staphylococcus aureus subsp. aureus N315
uaaaacagaauuucaucaaau

SEQ ID NO: 4041239 - RNA, 18 nt, Staphylococcus aureus subsp. aureus N315
uaaaacagcaaauaaaau

SEQ ID NO: 4041240 - RNA, 20 nt, Staphylococcus aureus subsp. aureus N315
uaaaacaguaaguaauaaaa

SEQ ID NO: 4041241 - RNA, 14 nt, Staphylococcus aureus subsp. aureus N315
uaaaacaucauuca

SEQ ID NO: 4041242 - RNA, 14 nt, Staphylococcus aureus subsp. aureus N315
uaaaacauguugau

SEQ ID NO: 4041243 - RNA, 21 nt, Staphylococcus aureus subsp. aureus N315
uaaaacauucccuuaauaaua

SEQ ID NO: 4041244 - RNA, 18 nt, Staphylococcus aureus subsp. aureus N315
uaaaaccauagagcauuu

SEQ ID NO: 4041245 - RNA, 19 nt, Staphylococcus aureus subsp. aureus N315
uaaaaccgguacuuucauu

SEQ ID NO: 4041246 - RNA, 23 nt, Staphylococcus aureus subsp. aureus N315
uaaaaccuuacccaaaaaauugu

SEQ ID NO: 4041247 - RNA, 22 nt, Staphylococcus aureus subsp. aureus N315
uaaaacgacucauuauaaauga

SEQ ID NO: 4041248 - RNA, 16 nt, Staphylococcus aureus subsp. aureus N315
uaaaacgauaagaauu

SEQ ID NO: 4041249 - RNA, 15 nt, Staphylococcus aureus subsp. aureus N315
uaaaacgauaauaau

SEQ ID NO: 4041250 - RNA, 16 nt, Staphylococcus aureus subsp. aureus N315
uaaaacgauaauaaua

SEQ ID NO: 4041251 - RNA, 17 nt, Staphylococcus aureus subsp. aureus N315
uaaaacgauaauaauaa

SEQ ID NO: 4041252 - RNA, 15 nt, Staphylococcus aureus subsp. aureus N315
uaaaacuaaugauag

SEQ ID NO: 4041253 - RNA, 23 nt, Staphylococcus aureus subsp. aureus N315
uaaaacuacugauuuauugauaa

SEQ ID NO: 4041254 - RNA, 13 nt, Staphylococcus aureus subsp. aureus N315
uaaaacuuacauu

SEQ ID NO: 4041255 - RNA, 16 nt, Staphylococcus aureus subsp. aureus N315
uaaaacuuauaacuga

SEQ ID NO: 4041256 - RNA, 20 nt, Staphylococcus aureus subsp. aureus N315
uaaaacuuauaacugauaau

SEQ ID NO: 4041257 - RNA, 19 nt, Staphylococcus aureus subsp. aureus N315
uaaaacuuguaaauuuauu

SEQ ID NO: 4041258 - RNA, 20 nt, Staphylococcus aureus subsp. aureus N315
uaaaacuuguuguuauuuau

SEQ ID NO: 4041259 - RNA, 21 nt, Staphylococcus aureus subsp. aureus N315
uaaaacuuguuguuauuuauu

SEQ ID NO: 4041260 - RNA, 13 nt, Staphylococcus aureus subsp. aureus N315
uaaaacuuuuuca

SEQ ID NO: 4041261 - RNA, 19 nt, Staphylococcus aureus subsp. aureus N315
uaaaagacauccacagaau

SEQ ID NO: 4041262 - RNA, 22 nt, Staphylococcus aureus subsp. aureus N315
uaaaagagaauuuuaauuaauu

SEQ ID NO: 4041263 - RNA, 19 nt, Staphylococcus aureus subsp. aureus N315
uaaaagcaugauacucaau

SEQ ID NO: 4041264 - RNA, 19 nt, Staphylococcus aureus subsp. aureus N315
uaaaagccaucuuaccuuu

SEQ ID NO: 4041265 - RNA, 13 nt, Staphylococcus aureus subsp. aureus N315
uaaaagccucuaa

SEQ ID NO: 4041266 - RNA, 23 nt, Staphylococcus aureus subsp. aureus N315
uaaaagccucuaaugauuaaaaa

SEQ ID NO: 4041267 - RNA, 22 nt, Staphylococcus aureus subsp. aureus N315
uaaaaggaagcaucuccaauuu

SEQ ID NO: 4041268 - RNA, 22 nt, Staphylococcus aureus subsp. aureus N315
uaaaaggaaggauuuuagauuu

SEQ ID NO: 4041269 - RNA, 15 nt, Staphylococcus aureus subsp. aureus N315
uaaaaggcgaaacau

SEQ ID NO: 4041270 - RNA, 20 nt, Staphylococcus aureus subsp. aureus N315
uaaaaggcgaaacauuaaaa

SEQ ID NO: 4041271 - RNA, 17 nt, Staphylococcus aureus subsp. aureus N315
uaaaaggcuuuguuaaa

SEQ ID NO: 4041272 - RNA, 16 nt, Staphylococcus aureus subsp. aureus N315
uaaaaggggaaaucau

SEQ ID NO: 4041273 - RNA, 21 nt, Staphylococcus aureus subsp. aureus N315
uaaaaggugugggcuuuauua

SEQ ID NO: 4041274 - RNA, 17 nt, Staphylococcus aureus subsp. aureus N315
uaaaaguacuuuaaaau

SEQ ID NO: 4041275 - RNA, 17 nt, Staphylococcus aureus subsp. aureus N315
uaaaagucgauaaauau

SEQ ID NO: 4041276 - RNA, 17 nt, Staphylococcus aureus subsp. aureus N315
uaaaaguuguaauuuaa

SEQ ID NO: 4041277 - RNA, 19 nt, Staphylococcus aureus subsp. aureus N315
uaaaaguuguaauuuaaaa

SEQ ID NO: 4041278 - RNA, 20 nt, Staphylococcus aureus subsp. aureus N315
uaaaaguuguaauuuaaaau

SEQ ID NO: 4041279 - RNA, 22 nt, Staphylococcus aureus subsp. aureus N315
uaaaaguuguaauuuaaaauag

SEQ ID NO: 4041280 - RNA, 23 nt, Staphylococcus aureus subsp. aureus N315
uaaaaguuguaauuuaaaauagu

SEQ ID NO: 4041281 - RNA, 15 nt, Staphylococcus aureus subsp. aureus N315
uaaaaguuguauucu

SEQ ID NO: 4041282 - RNA, 12 nt, Staphylococcus aureus subsp. aureus N315
uaaaauaaaaaa

SEQ ID NO: 4041283 - RNA, 17 nt, Staphylococcus aureus subsp. aureus N315
uaaaauaaaaaaaugau

SEQ ID NO: 4041284 - RNA, 16 nt, Staphylococcus aureus subsp. aureus N315
uaaaauaaaaaaugca

SEQ ID NO: 4041285 - RNA, 13 nt, Staphylococcus aureus subsp. aureus N315
uaaaauaaaauua

SEQ ID NO: 4041286 - RNA, 14 nt, Staphylococcus aureus subsp. aureus N315
uaaaauaaaccacg

SEQ ID NO: 4041287 - RNA, 23 nt, Staphylococcus aureus subsp. aureus N315
uaaaauaaaccacgcacaucuaa

SEQ ID NO: 4041288 - RNA, 12 nt, Staphylococcus aureus subsp. aureus N315
uaaaauaaaucu

SEQ ID NO: 4041289 - RNA, 13 nt, Staphylococcus aureus subsp. aureus N315
uaaaauaaccauu

SEQ ID NO: 4041290 - RNA, 11 nt, Staphylococcus aureus subsp. aureus N315
uaaaauaacua

SEQ ID NO: 4041291 - RNA, 14 nt, Staphylococcus aureus subsp. aureus N315
uaaaauaacuaagu

SEQ ID NO: 4041292 - RNA, 19 nt, Staphylococcus aureus subsp. aureus N315
uaaaauaacuaagugaauu

SEQ ID NO: 4041293 - RNA, 23 nt, Staphylococcus aureus subsp. aureus N315
uaaaauaacugcuaauuuuuuca

SEQ ID NO: 4041294 - RNA, 16 nt, Staphylococcus aureus subsp. aureus N315
uaaaauaauagauaau

SEQ ID NO: 4041295 - RNA, 20 nt, Staphylococcus aureus subsp. aureus N315
uaaaccgcacuucuauauua

SEQ ID NO: 4041296 - RNA, 20 nt, Staphylococcus aureus subsp. aureus N315
uaaaccguauagucauuaca

SEQ ID NO: 4041297 - RNA, 22 nt, Staphylococcus aureus subsp. aureus N315
uaaaccuacuaauauauuaauu

SEQ ID NO: 4041298 - RNA, 14 nt, Staphylococcus aureus subsp. aureus N315
uaaaccucaacauu

SEQ ID NO: 4041299 - RNA, 19 nt, Staphylococcus aureus subsp. aureus N315
uaaaccucaacauuaaaau

SEQ ID NO: 4041300 - RNA, 19 nt, Staphylococcus aureus subsp. aureus N315
uaaaccucuaaauaaaauu

SEQ ID NO: 4041301 - RNA, 13 nt, Staphylococcus aureus subsp. aureus N315
uaaacgaucaacu

SEQ ID NO: 4041302 - RNA, 16 nt, Staphylococcus aureus subsp. aureus N315
uaaacgaucacuuggc

SEQ ID NO: 4041303 - RNA, 18 nt, Staphylococcus aureus subsp. aureus N315
uaaacggaauaacuuuuu

SEQ ID NO: 4041304 - RNA, 18 nt, Staphylococcus aureus subsp. aureus N315
uaaacguugcaccuauuu

SEQ ID NO: 4041305 - RNA, 19 nt, Staphylococcus aureus subsp. aureus N315
uaaacuaauagcauuugua

SEQ ID NO: 4041306 - RNA, 16 nt, Staphylococcus aureus subsp. aureus N315
uaaacuauaauaauug

SEQ ID NO: 4041307 - RNA, 15 nt, Staphylococcus aureus subsp. aureus N315
uaaacucauaccaaa

SEQ ID NO: 4041308 - RNA, 15 nt, Staphylococcus aureus subsp. aureus N315
uaaacuucuuuucuu

SEQ ID NO: 4041309 - RNA, 18 nt, Staphylococcus aureus subsp. aureus N315
uaaacuuuggcaaaguca

SEQ ID NO: 4041310 - RNA, 20 nt, Staphylococcus aureus subsp. aureus N315
uaaacuuuucuucaaguugu

SEQ ID NO: 4041311 - RNA, 19 nt, Staphylococcus aureus subsp. aureus N315
uaaagaaacaugauugaaa

SEQ ID NO: 4041312 - RNA, 16 nt, Staphylococcus aureus subsp. aureus N315
uaaagaaauaauuuaa

SEQ ID NO: 4041313 - RNA, 17 nt, Staphylococcus aureus subsp. aureus N315
uaaagaacuauuuuaaa

SEQ ID NO: 4041314 - RNA, 13 nt, Staphylococcus aureus subsp. aureus N315
uaaagaaugauuu

SEQ ID NO: 4041315 - RNA, 20 nt, Staphylococcus aureus subsp. aureus N315
uaaagagcaauuaaagucaa

SEQ ID NO: 4041316 - RNA, 16 nt, Staphylococcus aureus subsp. aureus N315
uaaagauaagaugguu

SEQ ID NO: 4041317 - RNA, 17 nt, Staphylococcus aureus subsp. aureus N315
uaaagauagaaugaaua

SEQ ID NO: 4041318 - RNA, 19 nt, Staphylococcus aureus subsp. aureus N315
uaaagaucauuuucaacau

SEQ ID NO: 4041319 - RNA, 18 nt, Staphylococcus aureus subsp. aureus N315
uaaagauggcugcaucaa

SEQ ID NO: 4041320 - RNA, 13 nt, Staphylococcus aureus subsp. aureus N315
uaaagcaaauuau

SEQ ID NO: 4041321 - RNA, 15 nt, Staphylococcus aureus subsp. aureus N315
uaaagcgauaauaga

SEQ ID NO: 4041322 - RNA, 21 nt, Staphylococcus aureus subsp. aureus N315
uaaagcuaacauaccuaauaa

SEQ ID NO: 4041323 - RNA, 15 nt, Staphylococcus aureus subsp. aureus N315
uaaagcuauaaaaaa

SEQ ID NO: 4041324 - RNA, 16 nt, Staphylococcus aureus subsp. aureus N315
uaaagcuuauuaaauc

SEQ ID NO: 4041325 - RNA, 21 nt, Staphylococcus aureus subsp. aureus N315
uaaagcuucgucaaugacuaa

SEQ ID NO: 4041326 - RNA, 16 nt, Staphylococcus aureus subsp. aureus N315
uaaagcuuuaguuaaa

SEQ ID NO: 4041327 - RNA, 16 nt, Staphylococcus aureus subsp. aureus N315
uaaaggaaaucaaucc

SEQ ID NO: 4041328 - RNA, 20 nt, Staphylococcus aureus subsp. aureus N315
uaaaggaagacauacucaca

SEQ ID NO: 4041329 - RNA, 14 nt, Staphylococcus aureus subsp. aureus N315
uaaaggcaacaaau

SEQ ID NO: 4041330 - RNA, 19 nt, Staphylococcus aureus subsp. aureus N315
uaaaggguguuuagauagc

SEQ ID NO: 4041331 - RNA, 18 nt, Staphylococcus aureus subsp. aureus N315
uaaagguuaaauauuuaa

SEQ ID NO: 4041332 - RNA, 15 nt, Staphylococcus aureus subsp. aureus N315
uaaaguaaauaacac

SEQ ID NO: 4041333 - RNA, 17 nt, Staphylococcus aureus subsp. aureus N315
uaaaguacuuacaaaua

SEQ ID NO: 4041334 - RNA, 18 nt, Staphylococcus aureus subsp. aureus N315
uaaaguacuuacaaauau

SEQ ID NO: 4041335 - RNA, 21 nt, Staphylococcus aureus subsp. aureus N315
uaaagucaacaucguauucuu

SEQ ID NO: 4041336 - RNA, 16 nt, Staphylococcus aureus subsp. aureus N315
uaaagucaauuuaaau

SEQ ID NO: 4041337 - RNA, 21 nt, Staphylococcus aureus subsp. aureus N315
uaaagucguaucauauauuga

SEQ ID NO: 4041338 - RNA, 15 nt, Staphylococcus aureus subsp. aureus N315
uaaagugaaauaaag

SEQ ID NO: 4041339 - RNA, 17 nt, Staphylococcus aureus subsp. aureus N315
uaaagugcguuuuucga

SEQ ID NO: 4041340 - RNA, 16 nt, Staphylococcus aureus subsp. aureus N315
uaaaguguuucaacau

SEQ ID NO: 4041341 - RNA, 12 nt, Staphylococcus aureus subsp. aureus N315
uaaaguuacaug

SEQ ID NO: 4041342 - RNA, 18 nt, Staphylococcus aureus subsp. aureus N315
uaaaguuacaugcucuuu

SEQ ID NO: 4041343 - RNA, 23 nt, Staphylococcus aureus subsp. aureus N315
uaaaguugacaauacaaaucgau

SEQ ID NO: 4041344 - RNA, 23 nt, Staphylococcus aureus subsp. aureus N315
uaaaguuuauuuauguucgauua

SEQ ID NO: 4041345 - RNA, 15 nt, Staphylococcus aureus subsp. aureus N315
uaaaguuuuguucaa

SEQ ID NO: 4041346 - RNA, 19 nt, Staphylococcus aureus subsp. aureus N315
uaaauaaaaauacauaauu

SEQ ID NO: 4041347 - RNA, 14 nt, Staphylococcus aureus subsp. aureus N315
uaaauaaaaauuau

SEQ ID NO: 4041348 - RNA, 15 nt, Staphylococcus aureus subsp. aureus N315
uaaauaaaaauuaua

SEQ ID NO: 4041349 - RNA, 13 nt, Staphylococcus aureus subsp. aureus N315
uaaauaaaacuau

SEQ ID NO: 4041350 - RNA, 23 nt, Staphylococcus aureus subsp. aureus N315
uaaauaaaaguuaccuacuacau

SEQ ID NO: 4041351 - RNA, 13 nt, Staphylococcus aureus subsp. aureus N315
uaaauaaaaugca

SEQ ID NO: 4041352 - RNA, 14 nt, Staphylococcus aureus subsp. aureus N315
uaaauaaaaugcua

SEQ ID NO: 4041353 - RNA, 14 nt, Staphylococcus aureus subsp. aureus N315
uaaauaaaauuaaa

SEQ ID NO: 4041354 - RNA, 15 nt, Staphylococcus aureus subsp. aureus N315
uaaauaaaauuaaaa

SEQ ID NO: 4041355 - RNA, 22 nt, Staphylococcus aureus subsp. aureus N315
uaaauaaaauuuuuuucauaau

SEQ ID NO: 4041356 - RNA, 15 nt, Staphylococcus aureus subsp. aureus N315
uaaauaaacaacugc

SEQ ID NO: 4041357 - RNA, 14 nt, Staphylococcus aureus subsp. aureus N315
uaaauaaacaggga

SEQ ID NO: 4041358 - RNA, 23 nt, Staphylococcus aureus subsp. aureus N315
uaaauaaacucaccaaguucacu

SEQ ID NO: 4041359 - RNA, 20 nt, Staphylococcus aureus subsp. aureus N315
uaaauaaacuuuaugaaauu

SEQ ID NO: 4041360 - RNA, 13 nt, Staphylococcus aureus subsp. aureus N315
uaaauaaaugacu

SEQ ID NO: 4041361 - RNA, 20 nt, Staphylococcus aureus subsp. aureus N315
uaaauaacaccgguacuuug

SEQ ID NO: 4041362 - RNA, 19 nt, Staphylococcus aureus subsp. aureus N315
uaaauaacaguuaauuaua

SEQ ID NO: 4041363 - RNA, 21 nt, Staphylococcus aureus subsp. aureus N315
uaaauaaccgcacuuucuauu

SEQ ID NO: 4041364 - RNA, 13 nt, Staphylococcus aureus subsp. aureus N315
uaaauaacuucgu

SEQ ID NO: 4041365 - RNA, 19 nt, Staphylococcus aureus subsp. aureus N315
uaaauaagcaaucauaaua

SEQ ID NO: 4041366 - RNA, 15 nt, Staphylococcus aureus subsp. aureus N315
uaaauaauaaguuga

SEQ ID NO: 4041367 - RNA, 23 nt, Staphylococcus aureus subsp. aureus N315
uaaauaauguugucacuuggauu

SEQ ID NO: 4041368 - RNA, 20 nt, Staphylococcus aureus subsp. aureus N315
uaaauacaaagccuuaauau

SEQ ID NO: 4041369 - RNA, 22 nt, Staphylococcus aureus subsp. aureus N315
uaaauacaaagccuuaauauca

SEQ ID NO: 4041370 - RNA, 11 nt, Staphylococcus aureus subsp. aureus N315
uaaauacaaua

SEQ ID NO: 4041371 - RNA, 19 nt, Staphylococcus aureus subsp. aureus N315
uaaauacaauuucuucauu

SEQ ID NO: 4041372 - RNA, 21 nt, Staphylococcus aureus subsp. aureus N315
uaaauacuugcucuaauucaa

SEQ ID NO: 4041373 - RNA, 21 nt, Staphylococcus aureus subsp. aureus N315
uaaauacuuuugcaucacaga

SEQ ID NO: 4041374 - RNA, 21 nt, Staphylococcus aureus subsp. aureus N315
uaaauagacugccaauaaaau

SEQ ID NO: 4041375 - RNA, 18 nt, Staphylococcus aureus subsp. aureus N315
uaaauagauaauauauag

SEQ ID NO: 4041376 - RNA, 18 nt, Staphylococcus aureus subsp. aureus N315
uaaauagcuucuuaaauc

SEQ ID NO: 4041377 - RNA, 19 nt, Staphylococcus aureus subsp. aureus N315
uaaauagcuucuuaaauca

SEQ ID NO: 4041378 - RNA, 21 nt, Staphylococcus aureus subsp. aureus N315
uaaauaggguaauagaucuau

SEQ ID NO: 4041379 - RNA, 22 nt, Staphylococcus aureus subsp. aureus N315
uaaauaguaagguuugaacucu

SEQ ID NO: 4041380 - RNA, 18 nt, Staphylococcus aureus subsp. aureus N315
uaaauaguuuuucauauu

SEQ ID NO: 4041381 - RNA, 19 nt, Staphylococcus aureus subsp. aureus N315
uaaauauaaaccagcugau

SEQ ID NO: 4041382 - RNA, 21 nt, Staphylococcus aureus subsp. aureus N315
uaaauuacccacaucuuuuua

SEQ ID NO: 4041383 - RNA, 21 nt, Staphylococcus aureus subsp. aureus N315
uaaauuacuugcacaccagug

SEQ ID NO: 4041384 - RNA, 15 nt, Staphylococcus aureus subsp. aureus N315
uaaauuauaaauagu

SEQ ID NO: 4041385 - RNA, 13 nt, Staphylococcus aureus subsp. aureus N315
uaaauuauauacc

SEQ ID NO: 4041386 - RNA, 14 nt, Staphylococcus aureus subsp. aureus N315
uaaauuauauguuu

SEQ ID NO: 4041387 - RNA, 23 nt, Staphylococcus aureus subsp. aureus N315
uaaauuauggagcggaagauagg

SEQ ID NO: 4041388 - RNA, 15 nt, Staphylococcus aureus subsp. aureus N315
uaaauuauuuauuca

SEQ ID NO: 4041389 - RNA, 14 nt, Staphylococcus aureus subsp. aureus N315
uaaauucaucuguu

SEQ ID NO: 4041390 - RNA, 13 nt, Staphylococcus aureus subsp. aureus N315
uaaauucaucuua

SEQ ID NO: 4041391 - RNA, 14 nt, Staphylococcus aureus subsp. aureus N315
uaaauucauuuuaa

SEQ ID NO: 4041392 - RNA, 17 nt, Staphylococcus aureus subsp. aureus N315
uaaauucauuuuaagug

SEQ ID NO: 4041393 - RNA, 19 nt, Staphylococcus aureus subsp. aureus N315
uaaauucccauguauucuu

SEQ ID NO: 4041394 - RNA, 20 nt, Staphylococcus aureus subsp. aureus N315
uaaauucccauguauucuua

SEQ ID NO: 4041395 - RNA, 14 nt, Staphylococcus aureus subsp. aureus N315
uaaauucuaucuau

SEQ ID NO: 4041396 - RNA, 19 nt, Staphylococcus aureus subsp. aureus N315
uaaauucuuauaaaauaaa

SEQ ID NO: 4041397 - RNA, 20 nt, Staphylococcus aureus subsp. aureus N315
uaaauucuuuucaagaaauu

SEQ ID NO: 4041398 - RNA, 20 nt, Staphylococcus aureus subsp. aureus N315
uaaauugacuuuaauugcuc

SEQ ID NO: 4041399 - RNA, 13 nt, Staphylococcus aureus subsp. aureus N315
uaaauugagaagu

SEQ ID NO: 4041400 - RNA, 18 nt, Staphylococcus aureus subsp. aureus N315
uaaauugcacgucuugua

SEQ ID NO: 4041401 - RNA, 18 nt, Staphylococcus aureus subsp. aureus N315
uaaauugcuugaaauuau

SEQ ID NO: 4041402 - RNA, 20 nt, Staphylococcus aureus subsp. aureus N315
uaaauugcuugaaauuauua

SEQ ID NO: 4041403 - RNA, 14 nt, Staphylococcus aureus subsp. aureus N315
uaaauuuaaaagaa

SEQ ID NO: 4041404 - RNA, 15 nt, Staphylococcus aureus subsp. aureus N315
uaaauuuaaaagaaa

SEQ ID NO: 4041405 - RNA, 14 nt, Staphylococcus aureus subsp. aureus N315
uaaauuuaaaauaa

SEQ ID NO: 4041406 - RNA, 16 nt, Staphylococcus aureus subsp. aureus N315
uaaauuuaaaauaaua

SEQ ID NO: 4041407 - RNA, 13 nt, Staphylococcus aureus subsp. aureus N315
uaaauuuaaaugu

SEQ ID NO: 4041408 - RNA, 22 nt, Staphylococcus aureus subsp. aureus N315
uaaauuucgauuaauugaaugc

SEQ ID NO: 4041409 - RNA, 17 nt, Staphylococcus aureus subsp. aureus N315
uaaauuucugaacauaa

SEQ ID NO: 4041410 - RNA, 14 nt, Staphylococcus aureus subsp. aureus N315
uaaauuucuucaua

SEQ ID NO: 4041411 - RNA, 22 nt, Staphylococcus aureus subsp. aureus N315
uaaauuucuucauaguucaaau

SEQ ID NO: 4041412 - RNA, 14 nt, Staphylococcus aureus subsp. aureus N315
uaaauuugaaagua

SEQ ID NO: 4041413 - RNA, 17 nt, Staphylococcus aureus subsp. aureus N315
uaaauuugaaaguaaau

SEQ ID NO: 4041414 - RNA, 18 nt, Staphylococcus aureus subsp. aureus N315
uaaauuuuaucuaaacau

SEQ ID NO: 4041415 - RNA, 20 nt, Staphylococcus aureus subsp. aureus N315
uaaauuuuaucuaaacauuu

SEQ ID NO: 4041416 - RNA, 20 nt, Staphylococcus aureus subsp. aureus N315
uaaauuuucaucauaaucug

SEQ ID NO: 4041417 - RNA, 15 nt, Staphylococcus aureus subsp. aureus N315
uaaauuuuguauaac

SEQ ID NO: 4041418 - RNA, 14 nt, Staphylococcus aureus subsp. aureus N315
uaaauuuuuaagaa

SEQ ID NO: 4041419 - RNA, 13 nt, Staphylococcus aureus subsp. aureus N315
uaacaaaaucuca

SEQ ID NO: 4041420 - RNA, 19 nt, Staphylococcus aureus subsp. aureus N315
uaacaaaaucucaacagca

SEQ ID NO: 4041421 - RNA, 20 nt, Staphylococcus aureus subsp. aureus N315
uaacaaaaucucaacagcaa

SEQ ID NO: 4041422 - RNA, 16 nt, Staphylococcus aureus subsp. aureus N315
uaacaaaauuaagaag

SEQ ID NO: 4041423 - RNA, 20 nt, Staphylococcus aureus subsp. aureus N315
uaacaaccgucccauaaaag

SEQ ID NO: 4041424 - RNA, 13 nt, Staphylococcus aureus subsp. aureus N315
uaacaagaaaaac

SEQ ID NO: 4041425 - RNA, 19 nt, Staphylococcus aureus subsp. aureus N315
uaacaagaaguaauguuaa

SEQ ID NO: 4041426 - RNA, 20 nt, Staphylococcus aureus subsp. aureus N315
uaacaagcauuuuucaauua

SEQ ID NO: 4041427 - RNA, 20 nt, Staphylococcus aureus subsp. aureus N315
uaacaagcuuuuuucaauuc

SEQ ID NO: 4041428 - RNA, 20 nt, Staphylococcus aureus subsp. aureus N315
uaacaaguacaauaauaccu

SEQ ID NO: 4041429 - RNA, 21 nt, Staphylococcus aureus subsp. aureus N315
uaacaauacgcaauuagaguu

SEQ ID NO: 4041430 - RNA, 21 nt, Staphylococcus aureus subsp. aureus N315
uaacaauacuacuuaaugacu

SEQ ID NO: 4041431 - RNA, 20 nt, Staphylococcus aureus subsp. aureus N315
uaacaauagugacuuuuaua

SEQ ID NO: 4041432 - RNA, 15 nt, Staphylococcus aureus subsp. aureus N315
uaacaauauuaaauu

SEQ ID NO: 4041433 - RNA, 20 nt, Staphylococcus aureus subsp. aureus N315
uaacaauauucguaaauccu

SEQ ID NO: 4041434 - RNA, 15 nt, Staphylococcus aureus subsp. aureus N315
uaacaauuuauuaaa

SEQ ID NO: 4041435 - RNA, 17 nt, Staphylococcus aureus subsp. aureus N315
uaacaauuuuaaaucuu

SEQ ID NO: 4041436 - RNA, 21 nt, Staphylococcus aureus subsp. aureus N315
uaacaauuuuguugcaugacu

SEQ ID NO: 4041437 - RNA, 18 nt, Staphylococcus aureus subsp. aureus N315
uaacacauucaaauaaau

SEQ ID NO: 4041438 - RNA, 21 nt, Staphylococcus aureus subsp. aureus N315
uaacacauucuuauuugaaau

SEQ ID NO: 4041439 - RNA, 16 nt, Staphylococcus aureus subsp. aureus N315
uaacaccaauugaaua

SEQ ID NO: 4041440 - RNA, 16 nt, Staphylococcus aureus subsp. aureus N315
uaacacgauaauuaua

SEQ ID NO: 4041441 - RNA, 18 nt, Staphylococcus aureus subsp. aureus N315
uaacacgcucuuuucaaa

SEQ ID NO: 4041442 - RNA, 16 nt, Staphylococcus aureus subsp. aureus N315
uaacagcuaaaaauuc

SEQ ID NO: 4041443 - RNA, 16 nt, Staphylococcus aureus subsp. aureus N315
uaacagcuacaaauaa

SEQ ID NO: 4041444 - RNA, 20 nt, Staphylococcus aureus subsp. aureus N315
uaacagcuuaauuuuauuau

SEQ ID NO: 4041445 - RNA, 23 nt, Staphylococcus aureus subsp. aureus N315
uaacauaaaaaggucuauguaca

SEQ ID NO: 4041446 - RNA, 14 nt, Staphylococcus aureus subsp. aureus N315
uaacauaccuaaua

SEQ ID NO: 4041447 - RNA, 16 nt, Staphylococcus aureus subsp. aureus N315
uaacauacuauaaaaa

SEQ ID NO: 4041448 - RNA, 18 nt, Staphylococcus aureus subsp. aureus N315
uaacauacuauaaaaauu

SEQ ID NO: 4041449 - RNA, 20 nt, Staphylococcus aureus subsp. aureus N315
uaacauacuauaaaaauuua

SEQ ID NO: 4041450 - RNA, 18 nt, Staphylococcus aureus subsp. aureus N315
uaacauagcuuaauaauu

SEQ ID NO: 4041451 - RNA, 22 nt, Staphylococcus aureus subsp. aureus N315
uaacauaucgcgcaucaaaaau

SEQ ID NO: 4041452 - RNA, 21 nt, Staphylococcus aureus subsp. aureus N315
uaacauaucgucaauuuuaau

SEQ ID NO: 4041453 - RNA, 16 nt, Staphylococcus aureus subsp. aureus N315
uaacaucaaauagaca

SEQ ID NO: 4041454 - RNA, 14 nt, Staphylococcus aureus subsp. aureus N315
uaacaucaauuacu

SEQ ID NO: 4041455 - RNA, 17 nt, Staphylococcus aureus subsp. aureus N315
uaacaucaauuacucuu

SEQ ID NO: 4041456 - RNA, 16 nt, Staphylococcus aureus subsp. aureus N315
uaacaucacauaaaau

SEQ ID NO: 4041457 - RNA, 19 nt, Staphylococcus aureus subsp. aureus N315
uaacauccugcuuauuaau

SEQ ID NO: 4041458 - RNA, 21 nt, Staphylococcus aureus subsp. aureus N315
uaacauccugcuuauuaauug

SEQ ID NO: 4041459 - RNA, 19 nt, Staphylococcus aureus subsp. aureus N315
uaacaugaccuaauauauu

SEQ ID NO: 4041460 - RNA, 21 nt, Staphylococcus aureus subsp. aureus N315
uaacauguauuuaguaucaug

SEQ ID NO: 4041461 - RNA, 23 nt, Staphylococcus aureus subsp. aureus N315
uaacauguuuguggcaccucuuu

SEQ ID NO: 4041462 - RNA, 13 nt, Staphylococcus aureus subsp. aureus N315
uaacauuagcaug

SEQ ID NO: 4041463 - RNA, 21 nt, Staphylococcus aureus subsp. aureus N315
uaacauuagcauuaaauucca

SEQ ID NO: 4041464 - RNA, 16 nt, Staphylococcus aureus subsp. aureus N315
uaacauucuucaaaaa

SEQ ID NO: 4041465 - RNA, 21 nt, Staphylococcus aureus subsp. aureus N315
uaacauucuucaaaaaauaau

SEQ ID NO: 4041466 - RNA, 20 nt, Staphylococcus aureus subsp. aureus N315
uaacauugaacgauaacaau

SEQ ID NO: 4041467 - RNA, 13 nt, Staphylococcus aureus subsp. aureus N315
uaacauuuaaaaa

SEQ ID NO: 4041468 - RNA, 14 nt, Staphylococcus aureus subsp. aureus N315
uaacauuuaaaaaa

SEQ ID NO: 4041469 - RNA, 17 nt, Staphylococcus aureus subsp. aureus N315
uaacuuguaauauaaca

SEQ ID NO: 4041470 - RNA, 16 nt, Staphylococcus aureus subsp. aureus N315
uaacuuguuuauucag

SEQ ID NO: 4041471 - RNA, 13 nt, Staphylococcus aureus subsp. aureus N315
uaacuuuaaaaau

SEQ ID NO: 4041472 - RNA, 21 nt, Staphylococcus aureus subsp. aureus N315
uaacuuuaauauaaguauaau

SEQ ID NO: 4041473 - RNA, 16 nt, Staphylococcus aureus subsp. aureus N315
uaacuuuaauuaaagc

SEQ ID NO: 4041474 - RNA, 16 nt, Staphylococcus aureus subsp. aureus N315
uaacuuucagcaccag

SEQ ID NO: 4041475 - RNA, 13 nt, Staphylococcus aureus subsp. aureus N315
uaacuuucccuac

SEQ ID NO: 4041476 - RNA, 13 nt, Staphylococcus aureus subsp. aureus N315
uaacuuucuuuug

SEQ ID NO: 4041477 - RNA, 13 nt, Staphylococcus aureus subsp. aureus N315
uaacuuuuuaaua

SEQ ID NO: 4041478 - RNA, 21 nt, Staphylococcus aureus subsp. aureus N315
uaacuuuuuaauaauuguauc

SEQ ID NO: 4041479 - RNA, 21 nt, Staphylococcus aureus subsp. aureus N315
uaagaaaaauguguuaaaaua

SEQ ID NO: 4041480 - RNA, 17 nt, Staphylococcus aureus subsp. aureus N315
uaagaaaaucauucauu

SEQ ID NO: 4041481 - RNA, 15 nt, Staphylococcus aureus subsp. aureus N315
uaagaacgagaauuu

SEQ ID NO: 4041482 - RNA, 14 nt, Staphylococcus aureus subsp. aureus N315
uaagaagaaauacu

SEQ ID NO: 4041483 - RNA, 20 nt, Staphylococcus aureus subsp. aureus N315
uaagaaugcaccaacaauag

SEQ ID NO: 4041484 - RNA, 13 nt, Staphylococcus aureus subsp. aureus N315
uaagaauuaacaa

SEQ ID NO: 4041485 - RNA, 22 nt, Staphylococcus aureus subsp. aureus N315
uaagaauuguugaucaugagac

SEQ ID NO: 4041486 - RNA, 12 nt, Staphylococcus aureus subsp. aureus N315
uaagaauuuaaa

SEQ ID NO: 4041487 - RNA, 14 nt, Staphylococcus aureus subsp. aureus N315
uaagaauuuaaaag

SEQ ID NO: 4041488 - RNA, 23 nt, Staphylococcus aureus subsp. aureus N315
uaagaccacaucgauaucuaagu

SEQ ID NO: 4041489 - RNA, 17 nt, Staphylococcus aureus subsp. aureus N315
uaagagaacuuuucaaa

SEQ ID NO: 4041490 - RNA, 20 nt, Staphylococcus aureus subsp. aureus N315
uaagagaacuuuucaaacaa

SEQ ID NO: 4041491 - RNA, 22 nt, Staphylococcus aureus subsp. aureus N315
uaagagaacuuuucaaacaaua

SEQ ID NO: 4041492 - RNA, 14 nt, Staphylococcus aureus subsp. aureus N315
uaagagauuuucuu

SEQ ID NO: 4041493 - RNA, 15 nt, Staphylococcus aureus subsp. aureus N315
uaagauagauaaauc

SEQ ID NO: 4041494 - RNA, 12 nt, Staphylococcus aureus subsp. aureus N315
uaagauauauug

SEQ ID NO: 4041495 - RNA, 14 nt, Staphylococcus aureus subsp. aureus N315
uaagaucaauauca

SEQ ID NO: 4041496 - RNA, 14 nt, Staphylococcus aureus subsp. aureus N315
uaagaugacuacaa

SEQ ID NO: 4041497 - RNA, 19 nt, Staphylococcus aureus subsp. aureus N315
uaagaugacugaaccaauc

SEQ ID NO: 4041498 - RNA, 22 nt, Staphylococcus aureus subsp. aureus N315
uaagauguauaugaauuuuaua

SEQ ID NO: 4041499 - RNA, 12 nt, Staphylococcus aureus subsp. aureus N315
uaagcaaaaauu

SEQ ID NO: 4041500 - RNA, 14 nt, Staphylococcus aureus subsp. aureus N315
uaagcaaucauaau

SEQ ID NO: 4041501 - RNA, 17 nt, Staphylococcus aureus subsp. aureus N315
uaagcaguaagaugacu

SEQ ID NO: 4041502 - RNA, 22 nt, Staphylococcus aureus subsp. aureus N315
uaagcaguaagaugacuacaac

SEQ ID NO: 4041503 - RNA, 15 nt, Staphylococcus aureus subsp. aureus N315
uaagcaguuaauaag

SEQ ID NO: 4041504 - RNA, 20 nt, Staphylococcus aureus subsp. aureus N315
uaagcaguuaauaagaaacu

SEQ ID NO: 4041505 - RNA, 15 nt, Staphylococcus aureus subsp. aureus N315
uaagcauaauucaac

SEQ ID NO: 4041506 - RNA, 20 nt, Staphylococcus aureus subsp. aureus N315
uaagcauaauucaacuuaaa

SEQ ID NO: 4041507 - RNA, 18 nt, Staphylococcus aureus subsp. aureus N315
uaagcaucacauaugucc

SEQ ID NO: 4041508 - RNA, 17 nt, Staphylococcus aureus subsp. aureus N315
uaagcauuaauguucaa

SEQ ID NO: 4041509 - RNA, 20 nt, Staphylococcus aureus subsp. aureus N315
uaagcauuaauguucaauuu

SEQ ID NO: 4041510 - RNA, 18 nt, Staphylococcus aureus subsp. aureus N315
uaagccuuuucaaacaua

SEQ ID NO: 4041511 - RNA, 21 nt, Staphylococcus aureus subsp. aureus N315
uaagcgcaauggccauuugau

SEQ ID NO: 4041512 - RNA, 23 nt, Staphylococcus aureus subsp. aureus N315
uaagcgcaauggccauuugauuu

SEQ ID NO: 4041513 - RNA, 15 nt, Staphylococcus aureus subsp. aureus N315
uaagcgcaauuaaaa

SEQ ID NO: 4041514 - RNA, 18 nt, Staphylococcus aureus subsp. aureus N315
uaagcgcaauuaaaagua

SEQ ID NO: 4041515 - RNA, 21 nt, Staphylococcus aureus subsp. aureus N315
uaagcucauuucaauauuaaa

SEQ ID NO: 4041516 - RNA, 23 nt, Staphylococcus aureus subsp. aureus N315
uaagcucguuaauuuuauuuuag

SEQ ID NO: 4041517 - RNA, 12 nt, Staphylococcus aureus subsp. aureus N315
uaagcugaaaua

SEQ ID NO: 4041518 - RNA, 21 nt, Staphylococcus aureus subsp. aureus N315
uaagcugcucgauauaugucu

SEQ ID NO: 4041519 - RNA, 19 nt, Staphylococcus aureus subsp. aureus N315
uaagcuuacgacauacuug

SEQ ID NO: 4041520 - RNA, 13 nt, Staphylococcus aureus subsp. aureus N315
uaagcuuaucaac

SEQ ID NO: 4041521 - RNA, 21 nt, Staphylococcus aureus subsp. aureus N315
uaagcuuaucaacgauuuugu

SEQ ID NO: 4041522 - RNA, 17 nt, Staphylococcus aureus subsp. aureus N315
uaagcuuguaacaagca

SEQ ID NO: 4041523 - RNA, 18 nt, Staphylococcus aureus subsp. aureus N315
uaagcuuuuucuuucucu

SEQ ID NO: 4041524 - RNA, 20 nt, Staphylococcus aureus subsp. aureus N315
uaagcuuuuucuuucucuaa

SEQ ID NO: 4041525 - RNA, 13 nt, Staphylococcus aureus subsp. aureus N315
uaaggaaaauuau

SEQ ID NO: 4041526 - RNA, 14 nt, Staphylococcus aureus subsp. aureus N315
uaaggaaccugucu

SEQ ID NO: 4041527 - RNA, 19 nt, Staphylococcus aureus subsp. aureus N315
uaaggaugauuuauuaacu

SEQ ID NO: 4041528 - RNA, 22 nt, Staphylococcus aureus subsp. aureus N315
uaaggaugauuuauuaacucau

SEQ ID NO: 4041529 - RNA, 23 nt, Staphylococcus aureus subsp. aureus N315
uaagggguauauuaaaaauuuca

SEQ ID NO: 4041530 - RNA, 23 nt, Staphylococcus aureus subsp. aureus N315
uaagguaagaccccgaaaagagg

SEQ ID NO: 4041531 - RNA, 13 nt, Staphylococcus aureus subsp. aureus N315
uaagguacauaaa

SEQ ID NO: 4041532 - RNA, 23 nt, Staphylococcus aureus subsp. aureus N315
uaagguauuucauugauaagucu

SEQ ID NO: 4041533 - RNA, 13 nt, Staphylococcus aureus subsp. aureus N315
uaaguaaaacugc

SEQ ID NO: 4041534 - RNA, 12 nt, Staphylococcus aureus subsp. aureus N315
uaaguaauucau

SEQ ID NO: 4041535 - RNA, 15 nt, Staphylococcus aureus subsp. aureus N315
uaaguacaaauaaua

SEQ ID NO: 4041536 - RNA, 17 nt, Staphylococcus aureus subsp. aureus N315
uaaguacagcauauaau

SEQ ID NO: 4041537 - RNA, 15 nt, Staphylococcus aureus subsp. aureus N315
uaaguacauaaaugc

SEQ ID NO: 4041538 - RNA, 22 nt, Staphylococcus aureus subsp. aureus N315
uaaguaguugguggaugucaug

SEQ ID NO: 4041539 - RNA, 21 nt, Staphylococcus aureus subsp. aureus N315
uaaguaguuguuauauucuag

SEQ ID NO: 4041540 - RNA, 20 nt, Staphylococcus aureus subsp. aureus N315
uaaguauaaugaugugccuc

SEQ ID NO: 4041541 - RNA, 20 nt, Staphylococcus aureus subsp. aureus N315
uaaguauaauuaaacuaaua

SEQ ID NO: 4041542 - RNA, 19 nt, Staphylococcus aureus subsp. aureus N315
uaaguaucgccaucauuca

SEQ ID NO: 4041543 - RNA, 12 nt, Staphylococcus aureus subsp. aureus N315
uaaguauucaua

SEQ ID NO: 4041544 - RNA, 20 nt, Staphylococcus aureus subsp. aureus N315
uaagucgccuaacuuuuauu

SEQ ID NO: 4041545 - RNA, 22 nt, Staphylococcus aureus subsp. aureus N315
uaagucugaugucgaaaauagc

SEQ ID NO: 4041546 - RNA, 15 nt, Staphylococcus aureus subsp. aureus N315
uaagugauaaauaau

SEQ ID NO: 4041547 - RNA, 22 nt, Staphylococcus aureus subsp. aureus N315
uaagugauuucuucauuaucaa

SEQ ID NO: 4041548 - RNA, 23 nt, Staphylococcus aureus subsp. aureus N315
uaagugauuucuucauuaucaau

SEQ ID NO: 4041549 - RNA, 21 nt, Staphylococcus aureus subsp. aureus N315
uaagugccuugccaugauuua

SEQ ID NO: 4041550 - RNA, 12 nt, Staphylococcus aureus subsp. aureus N315
uaaguuaaaaau

SEQ ID NO: 4041551 - RNA, 15 nt, Staphylococcus aureus subsp. aureus N315
uaaguuaaaaaugua

SEQ ID NO: 4041552 - RNA, 22 nt, Staphylococcus aureus subsp. aureus N315
uaaguuaaaaauguaaauaaaa

SEQ ID NO: 4041553 - RNA, 22 nt, Staphylococcus aureus subsp. aureus N315
uaaguuaaaaccuuuucaaauu

SEQ ID NO: 4041554 - RNA, 22 nt, Staphylococcus aureus subsp. aureus N315
uaaguuaauuuaucguuuagua

SEQ ID NO: 4041555 - RNA, 22 nt, Staphylococcus aureus subsp. aureus N315
uaaguuaauuuuaugucccaau

SEQ ID NO: 4041556 - RNA, 14 nt, Staphylococcus aureus subsp. aureus N315
uaauauauuacuaa

SEQ ID NO: 4041557 - RNA, 16 nt, Staphylococcus aureus subsp. aureus N315
uaauauauuauaaccc

SEQ ID NO: 4041558 - RNA, 14 nt, Staphylococcus aureus subsp. aureus N315
uaauauauuuauuu

SEQ ID NO: 4041559 - RNA, 16 nt, Staphylococcus aureus subsp. aureus N315
uaauaucaauaaugcu

SEQ ID NO: 4041560 - RNA, 17 nt, Staphylococcus aureus subsp. aureus N315
uaauaucauauucaaaa

SEQ ID NO: 4041561 - RNA, 15 nt, Staphylococcus aureus subsp. aureus N315
uaauauccugcaguu

SEQ ID NO: 4041562 - RNA, 19 nt, Staphylococcus aureus subsp. aureus N315
uaauaucuuacuacuuaau

SEQ ID NO: 4041563 - RNA, 17 nt, Staphylococcus aureus subsp. aureus N315
uaauaugaaggcuuuuu

SEQ ID NO: 4041564 - RNA, 16 nt, Staphylococcus aureus subsp. aureus N315
uaauaugaauuuagau

SEQ ID NO: 4041565 - RNA, 21 nt, Staphylococcus aureus subsp. aureus N315
uaauauuaaauugcguacuug

SEQ ID NO: 4041566 - RNA, 17 nt, Staphylococcus aureus subsp. aureus N315
uaauauuauucuuuaua

SEQ ID NO: 4041567 - RNA, 14 nt, Staphylococcus aureus subsp. aureus N315
uaauauucaacuug

SEQ ID NO: 4041568 - RNA, 17 nt, Staphylococcus aureus subsp. aureus N315
uaauauugaaaugagcu

SEQ ID NO: 4041569 - RNA, 13 nt, Staphylococcus aureus subsp. aureus N315
uaauauugaauau

SEQ ID NO: 4041570 - RNA, 19 nt, Staphylococcus aureus subsp. aureus N315
uaauauugaauauaaaaaa

SEQ ID NO: 4041571 - RNA, 17 nt, Staphylococcus aureus subsp. aureus N315
uaauauuucuuaccauu

SEQ ID NO: 4041572 - RNA, 18 nt, Staphylococcus aureus subsp. aureus N315
uaauauuucuuaccauuu

SEQ ID NO: 4041573 - RNA, 23 nt, Staphylococcus aureus subsp. aureus N315
uaaucaaaaaagacucauacaca

SEQ ID NO: 4041574 - RNA, 15 nt, Staphylococcus aureus subsp. aureus N315
uaaucaaaccaccaa

SEQ ID NO: 4041575 - RNA, 21 nt, Staphylococcus aureus subsp. aureus N315
uaaucaaaccaccaaaaauca

SEQ ID NO: 4041576 - RNA, 13 nt, Staphylococcus aureus subsp. aureus N315
uaaucaaagauuu

SEQ ID NO: 4041577 - RNA, 21 nt, Staphylococcus aureus subsp. aureus N315
uaaucaagaauauaagugauu

SEQ ID NO: 4041578 - RNA, 20 nt, Staphylococcus aureus subsp. aureus N315
uaaucaagucugcauuaauu

SEQ ID NO: 4041579 - RNA, 13 nt, Staphylococcus aureus subsp. aureus N315
uaaucacauuaau

SEQ ID NO: 4041580 - RNA, 21 nt, Staphylococcus aureus subsp. aureus N315
uaaucaccuuauugaugaaaa

SEQ ID NO: 4041581 - RNA, 21 nt, Staphylococcus aureus subsp. aureus N315
uaaucagcuauaaaaguacuu

SEQ ID NO: 4041582 - RNA, 19 nt, Staphylococcus aureus subsp. aureus N315
uaaucagugaaauaucaag

SEQ ID NO: 4041583 - RNA, 15 nt, Staphylococcus aureus subsp. aureus N315
uaaucaguuuccgca

SEQ ID NO: 4041584 - RNA, 12 nt, Staphylococcus aureus subsp. aureus N315
uaaucauaaaaa

SEQ ID NO: 4041585 - RNA, 19 nt, Staphylococcus aureus subsp. aureus N315
uaaucaugaaguugguuua

SEQ ID NO: 4041586 - RNA, 17 nt, Staphylococcus aureus subsp. aureus N315
uaaucauguaaugcuua

SEQ ID NO: 4041587 - RNA, 21 nt, Staphylococcus aureus subsp. aureus N315
uaaucauguaaugcuuaaaaa

SEQ ID NO: 4041588 - RNA, 21 nt, Staphylococcus aureus subsp. aureus N315
uaaucauuuaucuagacucaa

SEQ ID NO: 4041589 - RNA, 13 nt, Staphylococcus aureus subsp. aureus N315
uaauccauccauu

SEQ ID NO: 4041590 - RNA, 12 nt, Staphylococcus aureus subsp. aureus N315
uaauccauucuu

SEQ ID NO: 4041591 - RNA, 19 nt, Staphylococcus aureus subsp. aureus N315
uaaucccauuuuaaaguca

SEQ ID NO: 4041592 - RNA, 16 nt, Staphylococcus aureus subsp. aureus N315
uaauccccgaagcaca

SEQ ID NO: 4041593 - RNA, 21 nt, Staphylococcus aureus subsp. aureus N315
uaauccccgaagcacagaaaa

SEQ ID NO: 4041594 - RNA, 14 nt, Staphylococcus aureus subsp. aureus N315
uaaucccuucaaaa

SEQ ID NO: 4041595 - RNA, 18 nt, Staphylococcus aureus subsp. aureus N315
uaauccgauuuugauaua

SEQ ID NO: 4041596 - RNA, 16 nt, Staphylococcus aureus subsp. aureus N315
uaauccuucuccaaaa

SEQ ID NO: 4041597 - RNA, 14 nt, Staphylococcus aureus subsp. aureus N315
uaaucgauugguaa

SEQ ID NO: 4041598 - RNA, 20 nt, Staphylococcus aureus subsp. aureus N315
uaaucgauugguaaaucuac

SEQ ID NO: 4041599 - RNA, 13 nt, Staphylococcus aureus subsp. aureus N315
uaaucgcauucuu

SEQ ID NO: 4041600 - RNA, 16 nt, Staphylococcus aureus subsp. aureus N315
uaaucgguaauuacuu

SEQ ID NO: 4041601 - RNA, 18 nt, Staphylococcus aureus subsp. aureus N315
uaaucguguauuauugaa

SEQ ID NO: 4041602 - RNA, 22 nt, Staphylococcus aureus subsp. aureus N315
uaaucguuccaacaacuaagau

SEQ ID NO: 4041603 - RNA, 14 nt, Staphylococcus aureus subsp. aureus N315
uaaucguucccauu

SEQ ID NO: 4041604 - RNA, 15 nt, Staphylococcus aureus subsp. aureus N315
uaaucuauaaauggc

SEQ ID NO: 4041605 - RNA, 14 nt, Staphylococcus aureus subsp. aureus N315
uaaucucauucuuu

SEQ ID NO: 4041606 - RNA, 14 nt, Staphylococcus aureus subsp. aureus N315
uaaucugcaacgau

SEQ ID NO: 4041607 - RNA, 18 nt, Staphylococcus aureus subsp. aureus N315
uaaucugcugcuguugaa

SEQ ID NO: 4041608 - RNA, 17 nt, Staphylococcus aureus subsp. aureus N315
uaaucuggguuguaauc

SEQ ID NO: 4041609 - RNA, 20 nt, Staphylococcus aureus subsp. aureus N315
uaaucuggguuguaaucuca

SEQ ID NO: 4041610 - RNA, 17 nt, Staphylococcus aureus subsp. aureus N315
uaaucuuaggugucauc

SEQ ID NO: 4041611 - RNA, 12 nt, Staphylococcus aureus subsp. aureus N315
uaaucuuauucg

SEQ ID NO: 4041612 - RNA, 15 nt, Staphylococcus aureus subsp. aureus N315
uaaucuucucauaaa

SEQ ID NO: 4041613 - RNA, 16 nt, Staphylococcus aureus subsp. aureus N315
uaaucuucuguuuaua

SEQ ID NO: 4041614 - RNA, 16 nt, Staphylococcus aureus subsp. aureus N315
uaaucuugauuauauu

SEQ ID NO: 4041615 - RNA, 22 nt, Staphylococcus aureus subsp. aureus N315
uaaucuuguuuucauuuaaaag

SEQ ID NO: 4041616 - RNA, 18 nt, Staphylococcus aureus subsp. aureus N315
uaaucuuuaacauuuauu

SEQ ID NO: 4041617 - RNA, 22 nt, Staphylococcus aureus subsp. aureus N315
uaaucuuuaacauuuauucuuu

SEQ ID NO: 4041618 - RNA, 18 nt, Staphylococcus aureus subsp. aureus N315
uaaucuuuuuuacuaaaa

SEQ ID NO: 4041619 - RNA, 21 nt, Staphylococcus aureus subsp. aureus N315
uaaucuuuuuuacuaaaauca

SEQ ID NO: 4041620 - RNA, 21 nt, Staphylococcus aureus subsp. aureus N315
uaaugaaaugaaguuuuuagc

SEQ ID NO: 4041621 - RNA, 16 nt, Staphylococcus aureus subsp. aureus N315
uaaugaacaacaaauu

SEQ ID NO: 4041622 - RNA, 13 nt, Staphylococcus aureus subsp. aureus N315
uaaugaacaaggg

SEQ ID NO: 4041623 - RNA, 19 nt, Staphylococcus aureus subsp. aureus N315
uaaugaagguaagugcuca

SEQ ID NO: 4041624 - RNA, 17 nt, Staphylococcus aureus subsp. aureus N315
uaaugaauaauuaaaaa

SEQ ID NO: 4041625 - RNA, 13 nt, Staphylococcus aureus subsp. aureus N315
uaaugaauaguaa

SEQ ID NO: 4041626 - RNA, 17 nt, Staphylococcus aureus subsp. aureus N315
uaaugacuauaacacca

SEQ ID NO: 4041627 - RNA, 22 nt, Staphylococcus aureus subsp. aureus N315
uaaugacuucuuuauauuuauc

SEQ ID NO: 4041628 - RNA, 12 nt, Staphylococcus aureus subsp. aureus N315
uaaugagaguaa

SEQ ID NO: 4041629 - RNA, 18 nt, Staphylococcus aureus subsp. aureus N315
uaaugagcccguuaaaaa

SEQ ID NO: 4041630 - RNA, 18 nt, Staphylococcus aureus subsp. aureus N315
uaaugaguaguuucucua

SEQ ID NO: 4041631 - RNA, 16 nt, Staphylococcus aureus subsp. aureus N315
uaaugauaaauuaaag

SEQ ID NO: 4041632 - RNA, 15 nt, Staphylococcus aureus subsp. aureus N315
uaaugauagcaauga

SEQ ID NO: 4041633 - RNA, 19 nt, Staphylococcus aureus subsp. aureus N315
uaaugauaguacauuuauu

SEQ ID NO: 4041634 - RNA, 15 nt, Staphylococcus aureus subsp. aureus N315
uaaugauaguguaug

SEQ ID NO: 4041635 - RNA, 17 nt, Staphylococcus aureus subsp. aureus N315
uaaugauaguguaugaa

SEQ ID NO: 4041636 - RNA, 15 nt, Staphylococcus aureus subsp. aureus N315
uaaugaucaaguagu

SEQ ID NO: 4041637 - RNA, 13 nt, Staphylococcus aureus subsp. aureus N315
uaaugaucaucua

SEQ ID NO: 4041638 - RNA, 14 nt, Staphylococcus aureus subsp. aureus N315
uaaugaucaucuau

SEQ ID NO: 4041639 - RNA, 14 nt, Staphylococcus aureus subsp. aureus N315
uaaugaugacauca

SEQ ID NO: 4041640 - RNA, 14 nt, Staphylococcus aureus subsp. aureus N315
uaaugaugcgaugg

SEQ ID NO: 4041641 - RNA, 16 nt, Staphylococcus aureus subsp. aureus N315
uaaugauucuacagca

SEQ ID NO: 4041642 - RNA, 14 nt, Staphylococcus aureus subsp. aureus N315
uaaugauugucuua

SEQ ID NO: 4041643 - RNA, 13 nt, Staphylococcus aureus subsp. aureus N315
uaaugauuuugcu

SEQ ID NO: 4041644 - RNA, 21 nt, Staphylococcus aureus subsp. aureus N315
uaauucuaagucucuugucau

SEQ ID NO: 4041645 - RNA, 16 nt, Staphylococcus aureus subsp. aureus N315
uaauucuauuuuugau

SEQ ID NO: 4041646 - RNA, 17 nt, Staphylococcus aureus subsp. aureus N315
uaauucuauuuuugauu

SEQ ID NO: 4041647 - RNA, 20 nt, Staphylococcus aureus subsp. aureus N315
uaauucuauuuuugauuuaa

SEQ ID NO: 4041648 - RNA, 22 nt, Staphylococcus aureus subsp. aureus N315
uaauucugaaaucaguuuuuga

SEQ ID NO: 4041649 - RNA, 16 nt, Staphylococcus aureus subsp. aureus N315
uaauucugguuuaaug

SEQ ID NO: 4041650 - RNA, 13 nt, Staphylococcus aureus subsp. aureus N315
uaauucuuaaucg

SEQ ID NO: 4041651 - RNA, 20 nt, Staphylococcus aureus subsp. aureus N315
uaauucuuaaucgagugauu

SEQ ID NO: 4041652 - RNA, 23 nt, Staphylococcus aureus subsp. aureus N315
uaauucuuaaucgagugauucag

SEQ ID NO: 4041653 - RNA, 13 nt, Staphylococcus aureus subsp. aureus N315
uaauucuucauca

SEQ ID NO: 4041654 - RNA, 15 nt, Staphylococcus aureus subsp. aureus N315
uaauugaaaaaccaa

SEQ ID NO: 4041655 - RNA, 15 nt, Staphylococcus aureus subsp. aureus N315
uaauugaaaaucuaa

SEQ ID NO: 4041656 - RNA, 22 nt, Staphylococcus aureus subsp. aureus N315
uaauugaaaugauagaugcugg

SEQ ID NO: 4041657 - RNA, 17 nt, Staphylococcus aureus subsp. aureus N315
uaauugaaugaaaauaa

SEQ ID NO: 4041658 - RNA, 22 nt, Staphylococcus aureus subsp. aureus N315
uaauugaauugauuauaaugau

SEQ ID NO: 4041659 - RNA, 21 nt, Staphylococcus aureus subsp. aureus N315
uaauugagagaaguuucuaua

SEQ ID NO: 4041660 - RNA, 19 nt, Staphylococcus aureus subsp. aureus N315
uaauugaugaugaugugcu

SEQ ID NO: 4041661 - RNA, 19 nt, Staphylococcus aureus subsp. aureus N315
uaauugcauagcuaaauaa

SEQ ID NO: 4041662 - RNA, 20 nt, Staphylococcus aureus subsp. aureus N315
uaauugcauagcuaaauaaa

SEQ ID NO: 4041663 - RNA, 21 nt, Staphylococcus aureus subsp. aureus N315
uaauugcauagcuaaauaaau

SEQ ID NO: 4041664 - RNA, 19 nt, Staphylococcus aureus subsp. aureus N315
uaauugcauguaaaauuaa

SEQ ID NO: 4041665 - RNA, 21 nt, Staphylococcus aureus subsp. aureus N315
uaauugcauguaaaauuaaau

SEQ ID NO: 4041666 - RNA, 12 nt, Staphylococcus aureus subsp. aureus N315
uaauugcauuac

SEQ ID NO: 4041667 - RNA, 16 nt, Staphylococcus aureus subsp. aureus N315
uaauugcguuuaauaa

SEQ ID NO: 4041668 - RNA, 17 nt, Staphylococcus aureus subsp. aureus N315
uaauugcguuuaauaac

SEQ ID NO: 4041669 - RNA, 21 nt, Staphylococcus aureus subsp. aureus N315
uaauuggaaucaucuuuuuga

SEQ ID NO: 4041670 - RNA, 21 nt, Staphylococcus aureus subsp. aureus N315
uaauuggauugagaucuguau

SEQ ID NO: 4041671 - RNA, 21 nt, Staphylococcus aureus subsp. aureus N315
uaauuggcaccucuaccaguu

SEQ ID NO: 4041672 - RNA, 17 nt, Staphylococcus aureus subsp. aureus N315
uaauuguacuuaaaccu

SEQ ID NO: 4041673 - RNA, 23 nt, Staphylococcus aureus subsp. aureus N315
uaauuguacuuaaaccuaacaua

SEQ ID NO: 4041674 - RNA, 21 nt, Staphylococcus aureus subsp. aureus N315
uaauugucucaucauuuaaaa

SEQ ID NO: 4041675 - RNA, 14 nt, Staphylococcus aureus subsp. aureus N315
uaauugucuuuaua

SEQ ID NO: 4041676 - RNA, 15 nt, Staphylococcus aureus subsp. aureus N315
uaauugucuuuauaa

SEQ ID NO: 4041677 - RNA, 18 nt, Staphylococcus aureus subsp. aureus N315
uaauuguuaaacccucau

SEQ ID NO: 4041678 - RNA, 13 nt, Staphylococcus aureus subsp. aureus N315
uaauuguuaaauc

SEQ ID NO: 4041679 - RNA, 18 nt, Staphylococcus aureus subsp. aureus N315
uaauuguuaaaucaccaa

SEQ ID NO: 4041680 - RNA, 14 nt, Staphylococcus aureus subsp. aureus N315
uaauuuaaaauagu

SEQ ID NO: 4041681 - RNA, 14 nt, Staphylococcus aureus subsp. aureus N315
uaauuuaaagcauc

SEQ ID NO: 4041682 - RNA, 20 nt, Staphylococcus aureus subsp. aureus N315
uaauuuaaagcaucauauac

SEQ ID NO: 4041683 - RNA, 21 nt, Staphylococcus aureus subsp. aureus N315
uaauuuaaaggcauaauaacc

SEQ ID NO: 4041684 - RNA, 21 nt, Staphylococcus aureus subsp. aureus N315
uaauuuaaaucuguacuucua

SEQ ID NO: 4041685 - RNA, 20 nt, Staphylococcus aureus subsp. aureus N315
uaauuuaaaugauuucacuu

SEQ ID NO: 4041686 - RNA, 16 nt, Staphylococcus aureus subsp. aureus N315
uaauuuacaauuaauu

SEQ ID NO: 4041687 - RNA, 16 nt, Staphylococcus aureus subsp. aureus N315
uaauuuaguacucaau

SEQ ID NO: 4041688 - RNA, 15 nt, Staphylococcus aureus subsp. aureus N315
uaauuuauaaacaua

SEQ ID NO: 4041689 - RNA, 16 nt, Staphylococcus aureus subsp. aureus N315
uaauuuauugauaagc

SEQ ID NO: 4041690 - RNA, 12 nt, Staphylococcus aureus subsp. aureus N315
uaauuucaauuu

SEQ ID NO: 4041691 - RNA, 14 nt, Staphylococcus aureus subsp. aureus N315
uaauuucaauuuau

SEQ ID NO: 4041692 - RNA, 22 nt, Staphylococcus aureus subsp. aureus N315
uaauuucaauuuggaaauaucu

SEQ ID NO: 4041693 - RNA, 19 nt, Staphylococcus aureus subsp. aureus N315
uaauuucaccaguagucac

SEQ ID NO: 4041694 - RNA, 17 nt, Staphylococcus aureus subsp. aureus N315
uaauuucaguucuuaga

SEQ ID NO: 4041695 - RNA, 18 nt, Staphylococcus aureus subsp. aureus N315
uaauuucaguucuuagau

SEQ ID NO: 4041696 - RNA, 19 nt, Staphylococcus aureus subsp. aureus N315
uaauuucaguucuuagauu

SEQ ID NO: 4041697 - RNA, 16 nt, Staphylococcus aureus subsp. aureus N315
uaauuuccaauaucuu

SEQ ID NO: 4041698 - RNA, 14 nt, Staphylococcus aureus subsp. aureus N315
uaauuuccuaaaaa

SEQ ID NO: 4041699 - RNA, 22 nt, Staphylococcus aureus subsp. aureus N315
uaauuuccuaaaaacugugauu

SEQ ID NO: 4041700 - RNA, 17 nt, Staphylococcus aureus subsp. aureus N315
uaauuucuaugaaaaaa

SEQ ID NO: 4041701 - RNA, 17 nt, Staphylococcus aureus subsp. aureus N315
uaauuucuucuucugua

SEQ ID NO: 4041702 - RNA, 11 nt, Staphylococcus aureus subsp. aureus N315
uaauuugauua

SEQ ID NO: 4041703 - RNA, 20 nt, Staphylococcus aureus subsp. aureus N315
uaauuuggucauagaaauuu

SEQ ID NO: 4041704 - RNA, 17 nt, Staphylococcus aureus subsp. aureus N315
uaauuuguccauccauu

SEQ ID NO: 4041705 - RNA, 23 nt, Staphylococcus aureus subsp. aureus N315
uaauuuguccauccauuuuaggu

SEQ ID NO: 4041706 - RNA, 15 nt, Staphylococcus aureus subsp. aureus N315
uaauuuuaaaaauaa

SEQ ID NO: 4041707 - RNA, 17 nt, Staphylococcus aureus subsp. aureus N315
uaauuuuaaaaauaaaa

SEQ ID NO: 4041708 - RNA, 10 nt, Staphylococcus aureus subsp. aureus N315
uaauuuuaau

SEQ ID NO: 4041709 - RNA, 13 nt, Staphylococcus aureus subsp. aureus N315
uaauuuuacucug

SEQ ID NO: 4041710 - RNA, 16 nt, Staphylococcus aureus subsp. aureus N315
uaauuuuacucuguau

SEQ ID NO: 4041711 - RNA, 17 nt, Staphylococcus aureus subsp. aureus N315
uaauuuucaauuagaaa

SEQ ID NO: 4041712 - RNA, 21 nt, Staphylococcus aureus subsp. aureus N315
uaauuuucacuuucaaugaca

SEQ ID NO: 4041713 - RNA, 22 nt, Staphylococcus aureus subsp. aureus N315
uaauuuuccuagcguuguagga

SEQ ID NO: 4041714 - RNA, 13 nt, Staphylococcus aureus subsp. aureus N315
uaauuuucuaaau

SEQ ID NO: 4041715 - RNA, 23 nt, Staphylococcus aureus subsp. aureus N315
uaauuuucuugccaucaauuucu

SEQ ID NO: 4041716 - RNA, 16 nt, Staphylococcus aureus subsp. aureus N315
uaauuuugacauaaaa

SEQ ID NO: 4041717 - RNA, 18 nt, Staphylococcus aureus subsp. aureus N315
uaauuuugacauaaaaaa

SEQ ID NO: 4041718 - RNA, 13 nt, Staphylococcus aureus subsp. aureus N315
uaauuuuguuuca

SEQ ID NO: 4041719 - RNA, 16 nt, Staphylococcus aureus subsp. aureus N315
uaauuuuuaaaucuac

SEQ ID NO: 4041720 - RNA, 24 nt, Staphylococcus aureus subsp. aureus N315
uaauuuuuaacagcgugaauauaa

SEQ ID NO: 4041721 - RNA, 18 nt, Staphylococcus aureus subsp. aureus N315
uaauuuuuauucuguaac

SEQ ID NO: 4041722 - RNA, 12 nt, Staphylococcus aureus subsp. aureus N315
uaauuuuucauu

SEQ ID NO: 4041723 - RNA, 20 nt, Staphylococcus aureus subsp. aureus N315
uaauuuuuuauuaagacuga

SEQ ID NO: 4041724 - RNA, 18 nt, Staphylococcus aureus subsp. aureus N315
uaauuuuuugacacgucg

SEQ ID NO: 4041725 - RNA, 15 nt, Staphylococcus aureus subsp. aureus N315
uaauuuuuugugccu

SEQ ID NO: 4041726 - RNA, 13 nt, Staphylococcus aureus subsp. aureus N315
uaauuuuuuuagc

SEQ ID NO: 4041727 - RNA, 15 nt, Staphylococcus aureus subsp. aureus N315
uacaaaauugucuca

SEQ ID NO: 4041728 - RNA, 16 nt, Staphylococcus aureus subsp. aureus N315
uacaaaccuaucauca

SEQ ID NO: 4041729 - RNA, 19 nt, Staphylococcus aureus subsp. aureus N315
uacaaaccuaucaucaauc

SEQ ID NO: 4041730 - RNA, 17 nt, Staphylococcus aureus subsp. aureus N315
uacaaacuucacaucau

SEQ ID NO: 4041731 - RNA, 14 nt, Staphylococcus aureus subsp. aureus N315
uacaguuuuacuau

SEQ ID NO: 4041732 - RNA, 12 nt, Staphylococcus aureus subsp. aureus N315
uacauaaauacc

SEQ ID NO: 4041733 - RNA, 15 nt, Staphylococcus aureus subsp. aureus N315
uacauaaaucuaaua

SEQ ID NO: 4041734 - RNA, 17 nt, Staphylococcus aureus subsp. aureus N315
uacauaaaucuaauacu

SEQ ID NO: 4041735 - RNA, 21 nt, Staphylococcus aureus subsp. aureus N315
uacauaacccuaaaaugaaua

SEQ ID NO: 4041736 - RNA, 22 nt, Staphylococcus aureus subsp. aureus N315
uacauaccacacuuuaaacaag

SEQ ID NO: 4041737 - RNA, 20 nt, Staphylococcus aureus subsp. aureus N315
uacauacggcaaauucaacu

SEQ ID NO: 4041738 - RNA, 13 nt, Staphylococcus aureus subsp. aureus N315
uacauauaagaau

SEQ ID NO: 4041739 - RNA, 17 nt, Staphylococcus aureus subsp. aureus N315
uacauauaagaauuguu

SEQ ID NO: 4041740 - RNA, 14 nt, Staphylococcus aureus subsp. aureus N315
uacauauaauaugu

SEQ ID NO: 4041741 - RNA, 16 nt, Staphylococcus aureus subsp. aureus N315
uacauauaucaacaug

SEQ ID NO: 4041742 - RNA, 16 nt, Staphylococcus aureus subsp. aureus N315
uacauaugcuauauuu

SEQ ID NO: 4041743 - RNA, 16 nt, Staphylococcus aureus subsp. aureus N315
uacauauucucugcuu

SEQ ID NO: 4041744 - RNA, 14 nt, Staphylococcus aureus subsp. aureus N315
uacauauuggcuug

SEQ ID NO: 4041745 - RNA, 15 nt, Staphylococcus aureus subsp. aureus N315
uacaucaauuucuag

SEQ ID NO: 4041746 - RNA, 14 nt, Staphylococcus aureus subsp. aureus N315
uacaucauuaaaua

SEQ ID NO: 4041747 - RNA, 15 nt, Staphylococcus aureus subsp. aureus N315
uacaucauuaaauau

SEQ ID NO: 4041748 - RNA, 16 nt, Staphylococcus aureus subsp. aureus N315
uacaucauuaaauauu

SEQ ID NO: 4041749 - RNA, 17 nt, Staphylococcus aureus subsp. aureus N315
uacaugacauucauuua

SEQ ID NO: 4041750 - RNA, 15 nt, Staphylococcus aureus subsp. aureus N315
uacaugacuccaugc

SEQ ID NO: 4041751 - RNA, 14 nt, Staphylococcus aureus subsp. aureus N315
uacauguauaaaag

SEQ ID NO: 4041752 - RNA, 17 nt, Staphylococcus aureus subsp. aureus N315
uacauuacgcucaucac

SEQ ID NO: 4041753 - RNA, 14 nt, Staphylococcus aureus subsp. aureus N315
uacauuaucaagaa

SEQ ID NO: 4041754 - RNA, 17 nt, Staphylococcus aureus subsp. aureus N315
uacauugauaaaauaau

SEQ ID NO: 4041755 - RNA, 14 nt, Staphylococcus aureus subsp. aureus N315
uacauugauaaauu

SEQ ID NO: 4041756 - RNA, 16 nt, Staphylococcus aureus subsp. aureus N315
uacauuguaaauauag

SEQ ID NO: 4041757 - RNA, 22 nt, Staphylococcus aureus subsp. aureus N315
uacauuuaauggucuaauauca

SEQ ID NO: 4041758 - RNA, 16 nt, Staphylococcus aureus subsp. aureus N315
uacauuuaguacauau

SEQ ID NO: 4041759 - RNA, 21 nt, Staphylococcus aureus subsp. aureus N315
uacauuuauuuucaauaaaua

SEQ ID NO: 4041760 - RNA, 16 nt, Staphylococcus aureus subsp. aureus N315
uacauuuuaauaaaau

SEQ ID NO: 4041761 - RNA, 22 nt, Staphylococcus aureus subsp. aureus N315
uacauuuuaauaaaaucaucuu

SEQ ID NO: 4041762 - RNA, 21 nt, Staphylococcus aureus subsp. aureus N315
uacauuuugaaacaucuaaau

SEQ ID NO: 4041763 - RNA, 20 nt, Staphylococcus aureus subsp. aureus N315
uaccaaagaaaucaccagau

SEQ ID NO: 4041764 - RNA, 16 nt, Staphylococcus aureus subsp. aureus N315
uaccaaauaaauaagu

SEQ ID NO: 4041765 - RNA, 16 nt, Staphylococcus aureus subsp. aureus N315
uaccaaauaaauuaaa

SEQ ID NO: 4041766 - RNA, 14 nt, Staphylococcus aureus subsp. aureus N315
uaccaaauauauuu

SEQ ID NO: 4041767 - RNA, 22 nt, Staphylococcus aureus subsp. aureus N315
uaccaaauauauuuuuauuaau

SEQ ID NO: 4041768 - RNA, 19 nt, Staphylococcus aureus subsp. aureus N315
uaccaacaagguucuaaau

SEQ ID NO: 4041769 - RNA, 22 nt, Staphylococcus aureus subsp. aureus N315
uaccaacaagguucuaaaucuu

SEQ ID NO: 4041770 - RNA, 19 nt, Staphylococcus aureus subsp. aureus N315
uaccaaccaaaaccaaaug

SEQ ID NO: 4041771 - RNA, 22 nt, Staphylococcus aureus subsp. aureus N315
uaccaagugcuuuuuuaccagc

SEQ ID NO: 4041772 - RNA, 19 nt, Staphylococcus aureus subsp. aureus N315
uaccaaugaauaaauugau

SEQ ID NO: 4041773 - RNA, 22 nt, Staphylococcus aureus subsp. aureus N315
uaccaaugaauaaauugauauu

SEQ ID NO: 4041774 - RNA, 15 nt, Staphylococcus aureus subsp. aureus N315
uaccaauuagcauga

SEQ ID NO: 4041775 - RNA, 17 nt, Staphylococcus aureus subsp. aureus N315
uaccaauuguuucagcu

SEQ ID NO: 4041776 - RNA, 18 nt, Staphylococcus aureus subsp. aureus N315
uaccacacuuuaaacaag

SEQ ID NO: 4041777 - RNA, 16 nt, Staphylococcus aureus subsp. aureus N315
uaccacauuuuccuug

SEQ ID NO: 4041778 - RNA, 11 nt, Staphylococcus aureus subsp. aureus N315
uaccaccccaa

SEQ ID NO: 4041779 - RNA, 14 nt, Staphylococcus aureus subsp. aureus N315
uaccaccccaacuu

SEQ ID NO: 4041780 - RNA, 17 nt, Staphylococcus aureus subsp. aureus N315
uaccaccccaacuugca

SEQ ID NO: 4041781 - RNA, 19 nt, Staphylococcus aureus subsp. aureus N315
uaccaguaacaauaacacc

SEQ ID NO: 4041782 - RNA, 15 nt, Staphylococcus aureus subsp. aureus N315
uaccaguugauuuaa

SEQ ID NO: 4041783 - RNA, 14 nt, Staphylococcus aureus subsp. aureus N315
uaccauauaauucu

SEQ ID NO: 4041784 - RNA, 17 nt, Staphylococcus aureus subsp. aureus N315
uaccaucugaaucaguu

SEQ ID NO: 4041785 - RNA, 19 nt, Staphylococcus aureus subsp. aureus N315
uaccaugaugagauaaaau

SEQ ID NO: 4041786 - RNA, 22 nt, Staphylococcus aureus subsp. aureus N315
uaccaugaugagauaaaaucau

SEQ ID NO: 4041787 - RNA, 13 nt, Staphylococcus aureus subsp. aureus N315
uaccauuccaaaa

SEQ ID NO: 4041788 - RNA, 18 nt, Staphylococcus aureus subsp. aureus N315
uaccauugugaugauaau

SEQ ID NO: 4041789 - RNA, 18 nt, Staphylococcus aureus subsp. aureus N315
uacccacuuauaaacaaa

SEQ ID NO: 4041790 - RNA, 16 nt, Staphylococcus aureus subsp. aureus N315
uacccauaauuuaaau

SEQ ID NO: 4041791 - RNA, 22 nt, Staphylococcus aureus subsp. aureus N315
uacccauaauuuaaaugauauu

SEQ ID NO: 4041792 - RNA, 20 nt, Staphylococcus aureus subsp. aureus N315
uaccccuguugaauauacua

SEQ ID NO: 4041793 - RNA, 22 nt, Staphylococcus aureus subsp. aureus N315
uaccccuguugaauauacuaaa

SEQ ID NO: 4041794 - RNA, 20 nt, Staphylococcus aureus subsp. aureus N315
uaccgacaccuauacauaac

SEQ ID NO: 4041795 - RNA, 21 nt, Staphylococcus aureus subsp. aureus N315
uaccgauuguuaauuuaaagu

SEQ ID NO: 4041796 - RNA, 21 nt, Staphylococcus aureus subsp. aureus N315
uaccgcuaaaauucuuucagc

SEQ ID NO: 4041797 - RNA, 19 nt, Staphylococcus aureus subsp. aureus N315
uaccguauuuuaauauuga

SEQ ID NO: 4041798 - RNA, 18 nt, Staphylococcus aureus subsp. aureus N315
uaccgucuucucuaucag

SEQ ID NO: 4041799 - RNA, 18 nt, Staphylococcus aureus subsp. aureus N315
uaccuaaaauagaaaaau

SEQ ID NO: 4041800 - RNA, 18 nt, Staphylococcus aureus subsp. aureus N315
uaccuaaagcuaauacac

SEQ ID NO: 4041801 - RNA, 18 nt, Staphylococcus aureus subsp. aureus N315
uaccuaagcugauuaaaa

SEQ ID NO: 4041802 - RNA, 21 nt, Staphylococcus aureus subsp. aureus N315
uaccuaagcugauuaaaaugu

SEQ ID NO: 4041803 - RNA, 15 nt, Staphylococcus aureus subsp. aureus N315
uaccuaauaggauca

SEQ ID NO: 4041804 - RNA, 19 nt, Staphylococcus aureus subsp. aureus N315
uaccuacacggucccaaga

SEQ ID NO: 4041805 - RNA, 16 nt, Staphylococcus aureus subsp. aureus N315
uaccucuugauaaaau

SEQ ID NO: 4041806 - RNA, 23 nt, Staphylococcus aureus subsp. aureus N315
uaccucuuguaccgucuuaucua

SEQ ID NO: 4041807 - RNA, 17 nt, Staphylococcus aureus subsp. aureus N315
uaccuguccaaauaaau

SEQ ID NO: 4041808 - RNA, 20 nt, Staphylococcus aureus subsp. aureus N315
uaccuuaucaguguaaguuu

SEQ ID NO: 4041809 - RNA, 22 nt, Staphylococcus aureus subsp. aureus N315
uaccuucuucuacccauaauuu

SEQ ID NO: 4041810 - RNA, 18 nt, Staphylococcus aureus subsp. aureus N315
uaccuuuaauaauauuga

SEQ ID NO: 4041811 - RNA, 15 nt, Staphylococcus aureus subsp. aureus N315
uaccuuuaauaucua

SEQ ID NO: 4041812 - RNA, 14 nt, Staphylococcus aureus subsp. aureus N315
uaccuuuaauuguu

SEQ ID NO: 4041813 - RNA, 18 nt, Staphylococcus aureus subsp. aureus N315
uaccuuucaaauauaucu

SEQ ID NO: 4041814 - RNA, 19 nt, Staphylococcus aureus subsp. aureus N315
uaccuuucaaauauaucua

SEQ ID NO: 4041815 - RNA, 12 nt, Staphylococcus aureus subsp. aureus N315
uaccuuuccauu

SEQ ID NO: 4041816 - RNA, 22 nt, Staphylococcus aureus subsp. aureus N315
uaccuuugucuuuuuuaucaug

SEQ ID NO: 4041817 - RNA, 14 nt, Staphylococcus aureus subsp. aureus N315
uaccuuuuucuacc

SEQ ID NO: 4041818 - RNA, 14 nt, Staphylococcus aureus subsp. aureus N315
uacugcgcuuuuaa

SEQ ID NO: 4041819 - RNA, 15 nt, Staphylococcus aureus subsp. aureus N315
uacugcugcuuuuaa

SEQ ID NO: 4041820 - RNA, 18 nt, Staphylococcus aureus subsp. aureus N315
uacugcuucgacauugau

SEQ ID NO: 4041821 - RNA, 16 nt, Staphylococcus aureus subsp. aureus N315
uacugcuuuuuuaaau

SEQ ID NO: 4041822 - RNA, 14 nt, Staphylococcus aureus subsp. aureus N315
uacuguaaaauucu

SEQ ID NO: 4041823 - RNA, 20 nt, Staphylococcus aureus subsp. aureus N315
uacuguaaaauucuauaaau

SEQ ID NO: 4041824 - RNA, 17 nt, Staphylococcus aureus subsp. aureus N315
uacuguaguacuauagu

SEQ ID NO: 4041825 - RNA, 15 nt, Staphylococcus aureus subsp. aureus N315
uacuguauaagugcu

SEQ ID NO: 4041826 - RNA, 13 nt, Staphylococcus aureus subsp. aureus N315
uacuguauuuuaa

SEQ ID NO: 4041827 - RNA, 15 nt, Staphylococcus aureus subsp. aureus N315
uacugugaaaauacc

SEQ ID NO: 4041828 - RNA, 16 nt, Staphylococcus aureus subsp. aureus N315
uacuguuuaaauaaaa

SEQ ID NO: 4041829 - RNA, 18 nt, Staphylococcus aureus subsp. aureus N315
uacuguuuaaauaaaauu

SEQ ID NO: 4041830 - RNA, 19 nt, Staphylococcus aureus subsp. aureus N315
uacuuaaaccuaacauaac

SEQ ID NO: 4041831 - RNA, 12 nt, Staphylococcus aureus subsp. aureus N315
uacuuaauauag

SEQ ID NO: 4041832 - RNA, 14 nt, Staphylococcus aureus subsp. aureus N315
uacuuaauuuaaau

SEQ ID NO: 4041833 - RNA, 17 nt, Staphylococcus aureus subsp. aureus N315
uacuuacgccaaucaca

SEQ ID NO: 4041834 - RNA, 18 nt, Staphylococcus aureus subsp. aureus N315
uacuuacgccaaucacaa

SEQ ID NO: 4041835 - RNA, 22 nt, Staphylococcus aureus subsp. aureus N315
uacuuacugaaacuaaauuaaa

SEQ ID NO: 4041836 - RNA, 22 nt, Staphylococcus aureus subsp. aureus N315
uacuuacuuuucuaaacaacuu

SEQ ID NO: 4041837 - RNA, 19 nt, Staphylococcus aureus subsp. aureus N315
uacuuaguaaggaauauuu

SEQ ID NO: 4041838 - RNA, 15 nt, Staphylococcus aureus subsp. aureus N315
uacuuauauauucaa

SEQ ID NO: 4041839 - RNA, 18 nt, Staphylococcus aureus subsp. aureus N315
uacuuauuucaaaaauag

SEQ ID NO: 4041840 - RNA, 13 nt, Staphylococcus aureus subsp. aureus N315
uacuuauuucuuu

SEQ ID NO: 4041841 - RNA, 17 nt, Staphylococcus aureus subsp. aureus N315
uacuuauuucuuuucau

SEQ ID NO: 4041842 - RNA, 18 nt, Staphylococcus aureus subsp. aureus N315
uacuuauuucuuuucauu

SEQ ID NO: 4041843 - RNA, 19 nt, Staphylococcus aureus subsp. aureus N315
uacuuauuucuuuucauua

SEQ ID NO: 4041844 - RNA, 16 nt, Staphylococcus aureus subsp. aureus N315
uacuuccaauacuguu

SEQ ID NO: 4041845 - RNA, 14 nt, Staphylococcus aureus subsp. aureus N315
uacuuccauugcuu

SEQ ID NO: 4041846 - RNA, 12 nt, Staphylococcus aureus subsp. aureus N315
uacuucguauug

SEQ ID NO: 4041847 - RNA, 22 nt, Staphylococcus aureus subsp. aureus N315
uacuucguauugaauggcuucg

SEQ ID NO: 4041848 - RNA, 15 nt, Staphylococcus aureus subsp. aureus N315
uacuucuaauuugca

SEQ ID NO: 4041849 - RNA, 21 nt, Staphylococcus aureus subsp. aureus N315
uacuucucaauuuaguauaaa

SEQ ID NO: 4041850 - RNA, 12 nt, Staphylococcus aureus subsp. aureus N315
uacuucuucuuc

SEQ ID NO: 4041851 - RNA, 16 nt, Staphylococcus aureus subsp. aureus N315
uacuucuuuaaucgcu

SEQ ID NO: 4041852 - RNA, 16 nt, Staphylococcus aureus subsp. aureus N315
uacuucuuuggucuaa

SEQ ID NO: 4041853 - RNA, 12 nt, Staphylococcus aureus subsp. aureus N315
uacuugaagaaa

SEQ ID NO: 4041854 - RNA, 19 nt, Staphylococcus aureus subsp. aureus N315
uacuugaauaccuuuuauu

SEQ ID NO: 4041855 - RNA, 18 nt, Staphylococcus aureus subsp. aureus N315
uacuugaauuuaauaagu

SEQ ID NO: 4041856 - RNA, 20 nt, Staphylococcus aureus subsp. aureus N315
uacuugauuagauuugugug

SEQ ID NO: 4041857 - RNA, 16 nt, Staphylococcus aureus subsp. aureus N315
uacuugcacaccagug

SEQ ID NO: 4041858 - RNA, 23 nt, Staphylococcus aureus subsp. aureus N315
uacuuggaaaauacuauacugau

SEQ ID NO: 4041859 - RNA, 15 nt, Staphylococcus aureus subsp. aureus N315
uacuuguaauuaaua

SEQ ID NO: 4041860 - RNA, 16 nt, Staphylococcus aureus subsp. aureus N315
uacuugucguauucuu

SEQ ID NO: 4041861 - RNA, 18 nt, Staphylococcus aureus subsp. aureus N315
uacuugucguauucuuca

SEQ ID NO: 4041862 - RNA, 19 nt, Staphylococcus aureus subsp. aureus N315
uacuuuaacaguuguaauc

SEQ ID NO: 4041863 - RNA, 17 nt, Staphylococcus aureus subsp. aureus N315
uacuuuaauuuagugaa

SEQ ID NO: 4041864 - RNA, 23 nt, Staphylococcus aureus subsp. aureus N315
uacuuuagaaagugauucccaaa

SEQ ID NO: 4041865 - RNA, 17 nt, Staphylococcus aureus subsp. aureus N315
uacuuuauaaauaucuu

SEQ ID NO: 4041866 - RNA, 19 nt, Staphylococcus aureus subsp. aureus N315
uacuuuauuugauaauauu

SEQ ID NO: 4041867 - RNA, 16 nt, Staphylococcus aureus subsp. aureus N315
uacuuucaaacaaauc

SEQ ID NO: 4041868 - RNA, 19 nt, Staphylococcus aureus subsp. aureus N315
uacuuucacauuuucaaau

SEQ ID NO: 4041869 - RNA, 17 nt, Staphylococcus aureus subsp. aureus N315
uacuuucaccauuuacu

SEQ ID NO: 4041870 - RNA, 18 nt, Staphylococcus aureus subsp. aureus N315
uacuuucacuuuuuauau

SEQ ID NO: 4041871 - RNA, 18 nt, Staphylococcus aureus subsp. aureus N315
uacuuucgaguaauacuu

SEQ ID NO: 4041872 - RNA, 22 nt, Staphylococcus aureus subsp. aureus N315
uacuuuggcagacguaucauca

SEQ ID NO: 4041873 - RNA, 16 nt, Staphylococcus aureus subsp. aureus N315
uacuuuuauaaucuuu

SEQ ID NO: 4041874 - RNA, 15 nt, Staphylococcus aureus subsp. aureus N315
uacuuuuccuugauu

SEQ ID NO: 4041875 - RNA, 14 nt, Staphylococcus aureus subsp. aureus N315
uacuuuuucagaau

SEQ ID NO: 4041876 - RNA, 19 nt, Staphylococcus aureus subsp. aureus N315
uagaaaaagcaggcaagcu

SEQ ID NO: 4041877 - RNA, 18 nt, Staphylococcus aureus subsp. aureus N315
uagaaaaauaugauugca

SEQ ID NO: 4041878 - RNA, 15 nt, Staphylococcus aureus subsp. aureus N315
uagaaaaauuucaaa

SEQ ID NO: 4041879 - RNA, 19 nt, Staphylococcus aureus subsp. aureus N315
uagaaaaauuucaaaaaua

SEQ ID NO: 4041880 - RNA, 14 nt, Staphylococcus aureus subsp. aureus N315
uagaaaacaucuua

SEQ ID NO: 4041881 - RNA, 18 nt, Staphylococcus aureus subsp. aureus N315
uagaaaaggcucauuugu

SEQ ID NO: 4041882 - RNA, 19 nt, Staphylococcus aureus subsp. aureus N315
uagaaaagggacagaaaag

SEQ ID NO: 4041883 - RNA, 19 nt, Staphylococcus aureus subsp. aureus N315
uagaaaaguaaguaaaaua

SEQ ID NO: 4041884 - RNA, 22 nt, Staphylococcus aureus subsp. aureus N315
uagaaaauaugacgaucuucau

SEQ ID NO: 4041885 - RNA, 18 nt, Staphylococcus aureus subsp. aureus N315
uagaaaaugaguacaaca

SEQ ID NO: 4041886 - RNA, 15 nt, Staphylococcus aureus subsp. aureus N315
uagaaaccguaaaau

SEQ ID NO: 4041887 - RNA, 22 nt, Staphylococcus aureus subsp. aureus N315
uagaaacuuccaacauauaaaa

SEQ ID NO: 4041888 - RNA, 23 nt, Staphylococcus aureus subsp. aureus N315
uagaaacuuccaacauauaaaaa

SEQ ID NO: 4041889 - RNA, 15 nt, Staphylococcus aureus subsp. aureus N315
uagaaagaaauuguu

SEQ ID NO: 4041890 - RNA, 23 nt, Staphylococcus aureus subsp. aureus N315
uagaaagaauacaguuacuucag

SEQ ID NO: 4041891 - RNA, 22 nt, Staphylococcus aureus subsp. aureus N315
uagaaagcacaccuaauucaua

SEQ ID NO: 4041892 - RNA, 14 nt, Staphylococcus aureus subsp. aureus N315
uagaaauuuuaaaa

SEQ ID NO: 4041893 - RNA, 12 nt, Staphylococcus aureus subsp. aureus N315
uagaacauuuau

SEQ ID NO: 4041894 - RNA, 21 nt, Staphylococcus aureus subsp. aureus N315
uagaacgaaauaguucaaaau

SEQ ID NO: 4041895 - RNA, 18 nt, Staphylococcus aureus subsp. aureus N315
uagaagaacaauaauuga

SEQ ID NO: 4041896 - RNA, 22 nt, Staphylococcus aureus subsp. aureus N315
uagaagaacaauaauugaugaa

SEQ ID NO: 4041897 - RNA, 20 nt, Staphylococcus aureus subsp. aureus N315
uagaagcaaaagaugaaaau

SEQ ID NO: 4041898 - RNA, 23 nt, Staphylococcus aureus subsp. aureus N315
uagaagguuauuuuuuauggucu

SEQ ID NO: 4041899 - RNA, 17 nt, Staphylococcus aureus subsp. aureus N315
uagaauagucaauuaau

SEQ ID NO: 4041900 - RNA, 18 nt, Staphylococcus aureus subsp. aureus N315
uagaauagucaauuaaug

SEQ ID NO: 4041901 - RNA, 19 nt, Staphylococcus aureus subsp. aureus N315
uagaauagucaauuaauga

SEQ ID NO: 4041902 - RNA, 17 nt, Staphylococcus aureus subsp. aureus N315
uagaauaguuaccaaaa

SEQ ID NO: 4041903 - RNA, 23 nt, Staphylococcus aureus subsp. aureus N315
uagaaucuacgauuuucaagacc

SEQ ID NO: 4041904 - RNA, 23 nt, Staphylococcus aureus subsp. aureus N315
uagaaugaaaccguauuauugga

SEQ ID NO: 4041905 - RNA, 14 nt, Staphylococcus aureus subsp. aureus N315
uagcgaaaacuaaa

SEQ ID NO: 4041906 - RNA, 15 nt, Staphylococcus aureus subsp. aureus N315
uagcgauuuuaaaga

SEQ ID NO: 4041907 - RNA, 22 nt, Staphylococcus aureus subsp. aureus N315
uagcgcaagagauaagaaaaua

SEQ ID NO: 4041908 - RNA, 18 nt, Staphylococcus aureus subsp. aureus N315
uagcgcgcuuauugaaaa

SEQ ID NO: 4041909 - RNA, 21 nt, Staphylococcus aureus subsp. aureus N315
uagcgcgcuuauugaaaagau

SEQ ID NO: 4041910 - RNA, 22 nt, Staphylococcus aureus subsp. aureus N315
uagcgcucuggauuuuucuuau

SEQ ID NO: 4041911 - RNA, 15 nt, Staphylococcus aureus subsp. aureus N315
uagcguaauuauuau

SEQ ID NO: 4041912 - RNA, 22 nt, Staphylococcus aureus subsp. aureus N315
uagcguaauuauuauaauaaau

SEQ ID NO: 4041913 - RNA, 19 nt, Staphylococcus aureus subsp. aureus N315
uagcgugauuuuucauauu

SEQ ID NO: 4041914 - RNA, 19 nt, Staphylococcus aureus subsp. aureus N315
uagcguuagauaccucuug

SEQ ID NO: 4041915 - RNA, 21 nt, Staphylococcus aureus subsp. aureus N315
uagcguuagauaccucuugua

SEQ ID NO: 4041916 - RNA, 20 nt, Staphylococcus aureus subsp. aureus N315
uagcuaagauacuuuuaaau

SEQ ID NO: 4041917 - RNA, 12 nt, Staphylococcus aureus subsp. aureus N315
uagcuaaugcau

SEQ ID NO: 4041918 - RNA, 18 nt, Staphylococcus aureus subsp. aureus N315
uagcuaaugcauuauuau

SEQ ID NO: 4041919 - RNA, 17 nt, Staphylococcus aureus subsp. aureus N315
uagcuacaauuaaagug

SEQ ID NO: 4041920 - RNA, 16 nt, Staphylococcus aureus subsp. aureus N315
uagcuauauuuuugua

SEQ ID NO: 4041921 - RNA, 18 nt, Staphylococcus aureus subsp. aureus N315
uagcuauauuuuuguauu

SEQ ID NO: 4041922 - RNA, 13 nt, Staphylococcus aureus subsp. aureus N315
uagcuauuaaaau

SEQ ID NO: 4041923 - RNA, 15 nt, Staphylococcus aureus subsp. aureus N315
uagcuauuaaaauag

SEQ ID NO: 4041924 - RNA, 16 nt, Staphylococcus aureus subsp. aureus N315
uagcucaauugaaucu

SEQ ID NO: 4041925 - RNA, 14 nt, Staphylococcus aureus subsp. aureus N315
uagcucuucuuuuu

SEQ ID NO: 4041926 - RNA, 15 nt, Staphylococcus aureus subsp. aureus N315
uagcucuuuuuugau

SEQ ID NO: 4041927 - RNA, 21 nt, Staphylococcus aureus subsp. aureus N315
uagcucuuuuuugauuuggaa

SEQ ID NO: 4041928 - RNA, 16 nt, Staphylococcus aureus subsp. aureus N315
uagcuggcuuuuuaau

SEQ ID NO: 4041929 - RNA, 13 nt, Staphylococcus aureus subsp. aureus N315
uagcuuagucaau

SEQ ID NO: 4041930 - RNA, 15 nt, Staphylococcus aureus subsp. aureus N315
uagcuugaauaauau

SEQ ID NO: 4041931 - RNA, 17 nt, Staphylococcus aureus subsp. aureus N315
uagcuugaauaauauau

SEQ ID NO: 4041932 - RNA, 14 nt, Staphylococcus aureus subsp. aureus N315
uagcuuuauuauuu

SEQ ID NO: 4041933 - RNA, 22 nt, Staphylococcus aureus subsp. aureus N315
uaggaaacgguucaaaaguaaa

SEQ ID NO: 4041934 - RNA, 16 nt, Staphylococcus aureus subsp. aureus N315
uaggaauccaauuucu

SEQ ID NO: 4041935 - RNA, 12 nt, Staphylococcus aureus subsp. aureus N315
uaggacauauaa

SEQ ID NO: 4041936 - RNA, 18 nt, Staphylococcus aureus subsp. aureus N315
uaggacauauaaauguug

SEQ ID NO: 4041937 - RNA, 21 nt, Staphylococcus aureus subsp. aureus N315
uaggacauauaaauguugacu

SEQ ID NO: 4041938 - RNA, 16 nt, Staphylococcus aureus subsp. aureus N315
uaggaccucuuauuua

SEQ ID NO: 4041939 - RNA, 16 nt, Staphylococcus aureus subsp. aureus N315
uaggacuaucuauaau

SEQ ID NO: 4041940 - RNA, 19 nt, Staphylococcus aureus subsp. aureus N315
uaggauauuuuuuaauaau

SEQ ID NO: 4041941 - RNA, 21 nt, Staphylococcus aureus subsp. aureus N315
uaggaucuucuuguuuuaaau

SEQ ID NO: 4041942 - RNA, 17 nt, Staphylococcus aureus subsp. aureus N315
uaggauguucaucaaca

SEQ ID NO: 4041943 - RNA, 21 nt, Staphylococcus aureus subsp. aureus N315
uaggauuguuuuuaagucguu

SEQ ID NO: 4041944 - RNA, 17 nt, Staphylococcus aureus subsp. aureus N315
uaggauuuacaccuaua

SEQ ID NO: 4041945 - RNA, 18 nt, Staphylococcus aureus subsp. aureus N315
uaggauuuccggaacaau

SEQ ID NO: 4041946 - RNA, 16 nt, Staphylococcus aureus subsp. aureus N315
uaggcaacugcaagug

SEQ ID NO: 4041947 - RNA, 13 nt, Staphylococcus aureus subsp. aureus N315
uaggcaagguauu

SEQ ID NO: 4041948 - RNA, 17 nt, Staphylococcus aureus subsp. aureus N315
uaggcaggaaugauaua

SEQ ID NO: 4041949 - RNA, 21 nt, Staphylococcus aureus subsp. aureus N315
uaggcucuuaauguacuuuuc

SEQ ID NO: 4041950 - RNA, 23 nt, Staphylococcus aureus subsp. aureus N315
uaggggcuucuuucuaaaauaac

SEQ ID NO: 4041951 - RNA, 17 nt, Staphylococcus aureus subsp. aureus N315
uaggguauugaaauaau

SEQ ID NO: 4041952 - RNA, 15 nt, Staphylococcus aureus subsp. aureus N315
uagguauaaucauuu

SEQ ID NO: 4041953 - RNA, 12 nt, Staphylococcus aureus subsp. aureus N315
uagguuagaauu

SEQ ID NO: 4041954 - RNA, 16 nt, Staphylococcus aureus subsp. aureus N315
uagguuauuauaaaau

SEQ ID NO: 4041955 - RNA, 22 nt, Staphylococcus aureus subsp. aureus N315
uaguaaaaccuguaucuuaaau

SEQ ID NO: 4041956 - RNA, 15 nt, Staphylococcus aureus subsp. aureus N315
uaguaaacuaauccu

SEQ ID NO: 4041957 - RNA, 15 nt, Staphylococcus aureus subsp. aureus N315
uaguaacucaacauu

SEQ ID NO: 4041958 - RNA, 18 nt, Staphylococcus aureus subsp. aureus N315
uaguaacucaacauuuuu

SEQ ID NO: 4041959 - RNA, 20 nt, Staphylococcus aureus subsp. aureus N315
uaguaagagcucucguguau

SEQ ID NO: 4041960 - RNA, 19 nt, Staphylococcus aureus subsp. aureus N315
uaguaaguagaagcaaaag

SEQ ID NO: 4041961 - RNA, 20 nt, Staphylococcus aureus subsp. aureus N315
uaguaauaacaucuaaauuu

SEQ ID NO: 4041962 - RNA, 14 nt, Staphylococcus aureus subsp. aureus N315
uaguaaugauguga

SEQ ID NO: 4041963 - RNA, 19 nt, Staphylococcus aureus subsp. aureus N315
uaguaaugauuaacuuucu

SEQ ID NO: 4041964 - RNA, 17 nt, Staphylococcus aureus subsp. aureus N315
uaguaauuuuuaaaucu

SEQ ID NO: 4041965 - RNA, 17 nt, Staphylococcus aureus subsp. aureus N315
uaguacaaaauugucuc

SEQ ID NO: 4041966 - RNA, 18 nt, Staphylococcus aureus subsp. aureus N315
uaguacggcugcuuuaac

SEQ ID NO: 4041967 - RNA, 23 nt, Staphylococcus aureus subsp. aureus N315
uaguacguuugcauauccuucaa

SEQ ID NO: 4041968 - RNA, 23 nt, Staphylococcus aureus subsp. aureus N315
uaguacuaaaccgauuaauauaa

SEQ ID NO: 4041969 - RNA, 16 nt, Staphylococcus aureus subsp. aureus N315
uaguacucaauguuag

SEQ ID NO: 4041970 - RNA, 22 nt, Staphylococcus aureus subsp. aureus N315
uaguacuuugauaucuacagag

SEQ ID NO: 4041971 - RNA, 14 nt, Staphylococcus aureus subsp. aureus N315
uaguagcuagaaca

SEQ ID NO: 4041972 - RNA, 15 nt, Staphylococcus aureus subsp. aureus N315
uaguagcuugaauag

SEQ ID NO: 4041973 - RNA, 16 nt, Staphylococcus aureus subsp. aureus N315
uaguaguacacgaauu

SEQ ID NO: 4041974 - RNA, 12 nt, Staphylococcus aureus subsp. aureus N315
uaguaguguauu

SEQ ID NO: 4041975 - RNA, 19 nt, Staphylococcus aureus subsp. aureus N315
uaguaguuuauaucaaaaa

SEQ ID NO: 4041976 - RNA, 14 nt, Staphylococcus aureus subsp. aureus N315
uaguauaaauauca

SEQ ID NO: 4041977 - RNA, 15 nt, Staphylococcus aureus subsp. aureus N315
uaguauaaauaucau

SEQ ID NO: 4041978 - RNA, 15 nt, Staphylococcus aureus subsp. aureus N315
uaguauggaauaaau

SEQ ID NO: 4041979 - RNA, 19 nt, Staphylococcus aureus subsp. aureus N315
uaguauucaaaaaauauuu

SEQ ID NO: 4041980 - RNA, 18 nt, Staphylococcus aureus subsp. aureus N315
uagucaggggccccaaca

SEQ ID NO: 4041981 - RNA, 22 nt, Staphylococcus aureus subsp. aureus N315
uagucaggggccccaacacaga

SEQ ID NO: 4041982 - RNA, 14 nt, Staphylococcus aureus subsp. aureus N315
uagucauaauuuaa

SEQ ID NO: 4041983 - RNA, 17 nt, Staphylococcus aureus subsp. aureus N315
uagucauaauuuaaaag

SEQ ID NO: 4041984 - RNA, 12 nt, Staphylococcus aureus subsp. aureus N315
uagucauguuug

SEQ ID NO: 4041985 - RNA, 22 nt, Staphylococcus aureus subsp. aureus N315
uagucauguuuggcauaauaau

SEQ ID NO: 4041986 - RNA, 17 nt, Staphylococcus aureus subsp. aureus N315
uagucauuacaaaucau

SEQ ID NO: 4041987 - RNA, 16 nt, Staphylococcus aureus subsp. aureus N315
uaguccggggccccaa

SEQ ID NO: 4041988 - RNA, 17 nt, Staphylococcus aureus subsp. aureus N315
uaguccggggccccaac

SEQ ID NO: 4041989 - RNA, 23 nt, Staphylococcus aureus subsp. aureus N315
uaguccggggccccaacaaagaa

SEQ ID NO: 4041990 - RNA, 21 nt, Staphylococcus aureus subsp. aureus N315
uagucgaagaagauuaugaaa

SEQ ID NO: 4041991 - RNA, 21 nt, Staphylococcus aureus subsp. aureus N315
uagucggggccccaacacaga

SEQ ID NO: 4041992 - RNA, 18 nt, Staphylococcus aureus subsp. aureus N315
uauaacccuaaugugugg

SEQ ID NO: 4041993 - RNA, 15 nt, Staphylococcus aureus subsp. aureus N315
uauaaccuauuaaau

SEQ ID NO: 4041994 - RNA, 24 nt, Staphylococcus aureus subsp. aureus N315
uauaaccuuguucuuuacuccaaa

SEQ ID NO: 4041995 - RNA, 18 nt, Staphylococcus aureus subsp. aureus N315
uauaacgcuuuaauauaa

SEQ ID NO: 4041996 - RNA, 16 nt, Staphylococcus aureus subsp. aureus N315
uauaacucuaaauaua

SEQ ID NO: 4041997 - RNA, 13 nt, Staphylococcus aureus subsp. aureus N315
uauaacugcaugu

SEQ ID NO: 4041998 - RNA, 15 nt, Staphylococcus aureus subsp. aureus N315
uauaacuuuaaaaau

SEQ ID NO: 4041999 - RNA, 16 nt, Staphylococcus aureus subsp. aureus N315
uauaacuuuaaaaauu

SEQ ID NO: 4042000 - RNA, 18 nt, Staphylococcus aureus subsp. aureus N315
uauaacuuuaaaaauuaa

SEQ ID NO: 4042001 - RNA, 20 nt, Staphylococcus aureus subsp. aureus N315
uauaagaauuguugaucaug

SEQ ID NO: 4042002 - RNA, 22 nt, Staphylococcus aureus subsp. aureus N315
uauaagaauuguugaucaugag

SEQ ID NO: 4042003 - RNA, 21 nt, Staphylococcus aureus subsp. aureus N315
uauaagaauuuaaaagagaau

SEQ ID NO: 4042004 - RNA, 17 nt, Staphylococcus aureus subsp. aureus N315
uauaagauagauaaauc

SEQ ID NO: 4042005 - RNA, 16 nt, Staphylococcus aureus subsp. aureus N315
uauaagauucauauuu

SEQ ID NO: 4042006 - RNA, 18 nt, Staphylococcus aureus subsp. aureus N315
uauaagccuuuucaaaca

SEQ ID NO: 4042007 - RNA, 18 nt, Staphylococcus aureus subsp. aureus N315
uauaaggauguacuauaa

SEQ ID NO: 4042008 - RNA, 23 nt, Staphylococcus aureus subsp. aureus N315
uauaaggauguacuauaaauccu

SEQ ID NO: 4042009 - RNA, 16 nt, Staphylococcus aureus subsp. aureus N315
uauaaguaaauaauag

SEQ ID NO: 4042010 - RNA, 14 nt, Staphylococcus aureus subsp. aureus N315
uauaaguacaaaua

SEQ ID NO: 4042011 - RNA, 13 nt, Staphylococcus aureus subsp. aureus N315
uauaaguagcuca

SEQ ID NO: 4042012 - RNA, 14 nt, Staphylococcus aureus subsp. aureus N315
uauaaguauaauga

SEQ ID NO: 4042013 - RNA, 21 nt, Staphylococcus aureus subsp. aureus N315
uauaaguaucgccaucauuca

SEQ ID NO: 4042014 - RNA, 14 nt, Staphylococcus aureus subsp. aureus N315
uauaaguuaaaaau

SEQ ID NO: 4042015 - RNA, 18 nt, Staphylococcus aureus subsp. aureus N315
uauaaguugcauauaaaa

SEQ ID NO: 4042016 - RNA, 21 nt, Staphylococcus aureus subsp. aureus N315
uauaauaaccuaaguuaauuu

SEQ ID NO: 4042017 - RNA, 14 nt, Staphylococcus aureus subsp. aureus N315
uauaauacgugugu

SEQ ID NO: 4042018 - RNA, 21 nt, Staphylococcus aureus subsp. aureus N315
uauaauacguguguuuucuuu

SEQ ID NO: 4042019 - RNA, 21 nt, Staphylococcus aureus subsp. aureus N315
uauaauacuguauuuuaacgu

SEQ ID NO: 4042020 - RNA, 23 nt, Staphylococcus aureus subsp. aureus N315
uauaauacuguauuuuaacguca

SEQ ID NO: 4042021 - RNA, 13 nt, Staphylococcus aureus subsp. aureus N315
uauaauagagaaa

SEQ ID NO: 4042022 - RNA, 14 nt, Staphylococcus aureus subsp. aureus N315
uauaauauacacaa

SEQ ID NO: 4042023 - RNA, 20 nt, Staphylococcus aureus subsp. aureus N315
uauaaucauuuaaacgaucu

SEQ ID NO: 4042024 - RNA, 14 nt, Staphylococcus aureus subsp. aureus N315
uauaaucuaucuug

SEQ ID NO: 4042025 - RNA, 18 nt, Staphylococcus aureus subsp. aureus N315
uauaaucuaucuugugcu

SEQ ID NO: 4042026 - RNA, 21 nt, Staphylococcus aureus subsp. aureus N315
uauaauggacgguauuuucaa

SEQ ID NO: 4042027 - RNA, 14 nt, Staphylococcus aureus subsp. aureus N315
uauaauguauaaaa

SEQ ID NO: 4042028 - RNA, 15 nt, Staphylococcus aureus subsp. aureus N315
uauaauguauaaaac

SEQ ID NO: 4042029 - RNA, 13 nt, Staphylococcus aureus subsp. aureus N315
uauaauuaaacau

SEQ ID NO: 4042030 - RNA, 14 nt, Staphylococcus aureus subsp. aureus N315
uauaauuaaacuaa

SEQ ID NO: 4042031 - RNA, 13 nt, Staphylococcus aureus subsp. aureus N315
uauaauuauuaaa

SEQ ID NO: 4042032 - RNA, 14 nt, Staphylococcus aureus subsp. aureus N315
uauaauuauuaaac

SEQ ID NO: 4042033 - RNA, 15 nt, Staphylococcus aureus subsp. aureus N315
uauaauuauuaaacu

SEQ ID NO: 4042034 - RNA, 22 nt, Staphylococcus aureus subsp. aureus N315
uauaauucgucuguuucauaua

SEQ ID NO: 4042035 - RNA, 17 nt, Staphylococcus aureus subsp. aureus N315
uauaauucuaagucucu

SEQ ID NO: 4042036 - RNA, 19 nt, Staphylococcus aureus subsp. aureus N315
uauaauucuuguuugauuu

SEQ ID NO: 4042037 - RNA, 20 nt, Staphylococcus aureus subsp. aureus N315
uauaauuggcagauagaaug

SEQ ID NO: 4042038 - RNA, 10 nt, Staphylococcus aureus subsp. aureus N315
uauaauuuaa

SEQ ID NO: 4042039 - RNA, 13 nt, Staphylococcus aureus subsp. aureus N315
uauaauuuaaaga

SEQ ID NO: 4042040 - RNA, 17 nt, Staphylococcus aureus subsp. aureus N315
uauaauuuauaaaaaga

SEQ ID NO: 4042041 - RNA, 19 nt, Staphylococcus aureus subsp. aureus N315
uauaauuuauuuagcaucu

SEQ ID NO: 4042042 - RNA, 22 nt, Staphylococcus aureus subsp. aureus N315
uauaauuuauuuagcaucuuua

SEQ ID NO: 4042043 - RNA, 14 nt, Staphylococcus aureus subsp. aureus N315
uauaauuucaauuu

SEQ ID NO: 4042044 - RNA, 20 nt, Staphylococcus aureus subsp. aureus N315
uauaauuuccuaaaaacugu

SEQ ID NO: 4042045 - RNA, 15 nt, Staphylococcus aureus subsp. aureus N315
uauaauuuuaauauu

SEQ ID NO: 4042046 - RNA, 17 nt, Staphylococcus aureus subsp. aureus N315
uauaauuuuaauauuau

SEQ ID NO: 4042047 - RNA, 15 nt, Staphylococcus aureus subsp. aureus N315
uauacaaugacagca

SEQ ID NO: 4042048 - RNA, 17 nt, Staphylococcus aureus subsp. aureus N315
uauacacacuaaggaaa

SEQ ID NO: 4042049 - RNA, 16 nt, Staphylococcus aureus subsp. aureus N315
uauacacuuacaaaua

SEQ ID NO: 4042050 - RNA, 18 nt, Staphylococcus aureus subsp. aureus N315
uauacacuuuuugacaua

SEQ ID NO: 4042051 - RNA, 16 nt, Staphylococcus aureus subsp. aureus N315
uauacagguuuaauaa

SEQ ID NO: 4042052 - RNA, 18 nt, Staphylococcus aureus subsp. aureus N315
uauacaguuuuacuauaa

SEQ ID NO: 4042053 - RNA, 19 nt, Staphylococcus aureus subsp. aureus N315
uauacauaacccuaaaaug

SEQ ID NO: 4042054 - RNA, 22 nt, Staphylococcus aureus subsp. aureus N315
uauacauuuuaccuaguaacuc

SEQ ID NO: 4042055 - RNA, 17 nt, Staphylococcus aureus subsp. aureus N315
uauaccauuccaaaaau

SEQ ID NO: 4042056 - RNA, 21 nt, Staphylococcus aureus subsp. aureus N315
uauaccucuuagcacuuggau

SEQ ID NO: 4042057 - RNA, 20 nt, Staphylococcus aureus subsp. aureus N315
uauacgugcuuuaaaguugu

SEQ ID NO: 4042058 - RNA, 13 nt, Staphylococcus aureus subsp. aureus N315
uauacuaaauuga

SEQ ID NO: 4042059 - RNA, 12 nt, Staphylococcus aureus subsp. aureus N315
uauacuaaucuu

SEQ ID NO: 4042060 - RNA, 21 nt, Staphylococcus aureus subsp. aureus N315
uauacuauaaauacaaauaua

SEQ ID NO: 4042061 - RNA, 22 nt, Staphylococcus aureus subsp. aureus N315
uauacuuacugaaacuaaauua

SEQ ID NO: 4042062 - RNA, 15 nt, Staphylococcus aureus subsp. aureus N315
uauacuugaagaauc

SEQ ID NO: 4042063 - RNA, 15 nt, Staphylococcus aureus subsp. aureus N315
uauacuuuuaccauu

SEQ ID NO: 4042064 - RNA, 16 nt, Staphylococcus aureus subsp. aureus N315
uauacuuuuauagaaa

SEQ ID NO: 4042065 - RNA, 15 nt, Staphylococcus aureus subsp. aureus N315
uauacuuuuggucug

SEQ ID NO: 4042066 - RNA, 20 nt, Staphylococcus aureus subsp. aureus N315
uauacuuuuggucuguugaa

SEQ ID NO: 4042067 - RNA, 13 nt, Staphylococcus aureus subsp. aureus N315
uauacuuuuuaaa

SEQ ID NO: 4042068 - RNA, 21 nt, Staphylococcus aureus subsp. aureus N315
uauagaaaaugaguacaacau

SEQ ID NO: 4042069 - RNA, 16 nt, Staphylococcus aureus subsp. aureus N315
uauagaaaauuaacuc

SEQ ID NO: 4042070 - RNA, 17 nt, Staphylococcus aureus subsp. aureus N315
uauagaaaccaaaaaau

SEQ ID NO: 4042071 - RNA, 16 nt, Staphylococcus aureus subsp. aureus N315
uauagaccguugaaau

SEQ ID NO: 4042072 - RNA, 19 nt, Staphylococcus aureus subsp. aureus N315
uauagaccguugaaauguu

SEQ ID NO: 4042073 - RNA, 19 nt, Staphylococcus aureus subsp. aureus N315
uauagacuaacuguacuuu

SEQ ID NO: 4042074 - RNA, 16 nt, Staphylococcus aureus subsp. aureus N315
uauagagccaugaaaa

SEQ ID NO: 4042075 - RNA, 22 nt, Staphylococcus aureus subsp. aureus N315
uauagagccaugaaaaggaaaa

SEQ ID NO: 4042076 - RNA, 16 nt, Staphylococcus aureus subsp. aureus N315
uauagaggauauuuau

SEQ ID NO: 4042077 - RNA, 17 nt, Staphylococcus aureus subsp. aureus N315
uauagauaggauauuuu

SEQ ID NO: 4042078 - RNA, 19 nt, Staphylococcus aureus subsp. aureus N315
uauagauggcguaagcagu

SEQ ID NO: 4042079 - RNA, 13 nt, Staphylococcus aureus subsp. aureus N315
uauagauuaaaaa

SEQ ID NO: 4042080 - RNA, 18 nt, Staphylococcus aureus subsp. aureus N315
uaucaaauuaccauucau

SEQ ID NO: 4042081 - RNA, 12 nt, Staphylococcus aureus subsp. aureus N315
uaucaaauucau

SEQ ID NO: 4042082 - RNA, 14 nt, Staphylococcus aureus subsp. aureus N315
uaucaacauaaaau

SEQ ID NO: 4042083 - RNA, 15 nt, Staphylococcus aureus subsp. aureus N315
uaucaacauuaauaa

SEQ ID NO: 4042084 - RNA, 13 nt, Staphylococcus aureus subsp. aureus N315
uaucaagaaaaag

SEQ ID NO: 4042085 - RNA, 16 nt, Staphylococcus aureus subsp. aureus N315
uaucaagaaaaaguuu

SEQ ID NO: 4042086 - RNA, 21 nt, Staphylococcus aureus subsp. aureus N315
uaucaagaaaaaguuuuucug

SEQ ID NO: 4042087 - RNA, 19 nt, Staphylococcus aureus subsp. aureus N315
uaucaagaacuuuaaaaau

SEQ ID NO: 4042088 - RNA, 12 nt, Staphylococcus aureus subsp. aureus N315
uaucaauaaauc

SEQ ID NO: 4042089 - RNA, 17 nt, Staphylococcus aureus subsp. aureus N315
uaucaauagaugaaaau

SEQ ID NO: 4042090 - RNA, 22 nt, Staphylococcus aureus subsp. aureus N315
uaucaauagaugaaaauuuaau

SEQ ID NO: 4042091 - RNA, 19 nt, Staphylococcus aureus subsp. aureus N315
uaucaauugaaugaaguaa

SEQ ID NO: 4042092 - RNA, 21 nt, Staphylococcus aureus subsp. aureus N315
uaucaauuguugcaaaauacg

SEQ ID NO: 4042093 - RNA, 21 nt, Staphylococcus aureus subsp. aureus N315
uaucaauuucaacuuauaaaa

SEQ ID NO: 4042094 - RNA, 14 nt, Staphylococcus aureus subsp. aureus N315
uaucaauuucuauu

SEQ ID NO: 4042095 - RNA, 20 nt, Staphylococcus aureus subsp. aureus N315
uaucacaacacauaaauuaa

SEQ ID NO: 4042096 - RNA, 15 nt, Staphylococcus aureus subsp. aureus N315
uaucaccuaauugaa

SEQ ID NO: 4042097 - RNA, 16 nt, Staphylococcus aureus subsp. aureus N315
uaucaccuucaaacuu

SEQ ID NO: 4042098 - RNA, 16 nt, Staphylococcus aureus subsp. aureus N315
uaucacgagcuuuuaa

SEQ ID NO: 4042099 - RNA, 16 nt, Staphylococcus aureus subsp. aureus N315
uaucacugaaugcuaa

SEQ ID NO: 4042100 - RNA, 18 nt, Staphylococcus aureus subsp. aureus N315
uaucacuuauuauuuugu

SEQ ID NO: 4042101 - RNA, 17 nt, Staphylococcus aureus subsp. aureus N315
uaucacuuuagauaaac

SEQ ID NO: 4042102 - RNA, 17 nt, Staphylococcus aureus subsp. aureus N315
uaucacuuuucaugaug

SEQ ID NO: 4042103 - RNA, 18 nt, Staphylococcus aureus subsp. aureus N315
uaucagcgaaauuuguaa

SEQ ID NO: 4042104 - RNA, 18 nt, Staphylococcus aureus subsp. aureus N315
uaucagcuuguuucaggu

SEQ ID NO: 4042105 - RNA, 13 nt, Staphylococcus aureus subsp. aureus N315
uaucagcuuuaau

SEQ ID NO: 4042106 - RNA, 14 nt, Staphylococcus aureus subsp. aureus N315
uaucagcuuuuuca

SEQ ID NO: 4042107 - RNA, 17 nt, Staphylococcus aureus subsp. aureus N315
uaucauaaagauaagau

SEQ ID NO: 4042108 - RNA, 20 nt, Staphylococcus aureus subsp. aureus N315
uaucauaccgacaccuauac

SEQ ID NO: 4042109 - RNA, 18 nt, Staphylococcus aureus subsp. aureus N315
uaucauacuucaaacguu

SEQ ID NO: 4042110 - RNA, 22 nt, Staphylococcus aureus subsp. aureus N315
uaucauauaaugguugaauaac

SEQ ID NO: 4042111 - RNA, 19 nt, Staphylococcus aureus subsp. aureus N315
uaucauauucaaaauaacu

SEQ ID NO: 4042112 - RNA, 23 nt, Staphylococcus aureus subsp. aureus N315
uaucaucaaucguuaauuuccaa

SEQ ID NO: 4042113 - RNA, 12 nt, Staphylococcus aureus subsp. aureus N315
uaucaucaugac

SEQ ID NO: 4042114 - RNA, 12 nt, Staphylococcus aureus subsp. aureus N315
uaucaucuauuc

SEQ ID NO: 4042115 - RNA, 21 nt, Staphylococcus aureus subsp. aureus N315
uaucaugauagccgcuucauu

SEQ ID NO: 4042116 - RNA, 23 nt, Staphylococcus aureus subsp. aureus N315
uaucaugcaaaacuaaucaaauu

SEQ ID NO: 4042117 - RNA, 14 nt, Staphylococcus aureus subsp. aureus N315
uaucaugcuuuuaa

SEQ ID NO: 4042118 - RNA, 15 nt, Staphylococcus aureus subsp. aureus N315
uaucauguucuuaua

SEQ ID NO: 4042119 - RNA, 19 nt, Staphylococcus aureus subsp. aureus N315
uaucauguucuuauaaaaa

SEQ ID NO: 4042120 - RNA, 20 nt, Staphylococcus aureus subsp. aureus N315
uaucauguucuuauaaaaaa

SEQ ID NO: 4042121 - RNA, 19 nt, Staphylococcus aureus subsp. aureus N315
uaucauuaaauugcuugaa

SEQ ID NO: 4042122 - RNA, 20 nt, Staphylococcus aureus subsp. aureus N315
uaucauuacagauaauuauu

SEQ ID NO: 4042123 - RNA, 18 nt, Staphylococcus aureus subsp. aureus N315
uaucauuaucaaauaacc

SEQ ID NO: 4042124 - RNA, 20 nt, Staphylococcus aureus subsp. aureus N315
uaucauuaucaaauaaccua

SEQ ID NO: 4042125 - RNA, 20 nt, Staphylococcus aureus subsp. aureus N315
uaucauuaugcccgauaauu

SEQ ID NO: 4042126 - RNA, 23 nt, Staphylococcus aureus subsp. aureus N315
uaucauucuguguaaauauaaau

SEQ ID NO: 4042127 - RNA, 21 nt, Staphylococcus aureus subsp. aureus N315
uaucauuguguccauaaauau

SEQ ID NO: 4042128 - RNA, 16 nt, Staphylococcus aureus subsp. aureus N315
uaucauuucaaauaag

SEQ ID NO: 4042129 - RNA, 19 nt, Staphylococcus aureus subsp. aureus N315
uaucauuucaaauaagaau

SEQ ID NO: 4042130 - RNA, 23 nt, Staphylococcus aureus subsp. aureus N315
uaucauuuggcguucaacauuac

SEQ ID NO: 4042131 - RNA, 20 nt, Staphylococcus aureus subsp. aureus N315
uauccaaaauccugaaauua

SEQ ID NO: 4042132 - RNA, 16 nt, Staphylococcus aureus subsp. aureus N315
uauccaauguauaaaa

SEQ ID NO: 4042133 - RNA, 14 nt, Staphylococcus aureus subsp. aureus N315
uauccauuaugaug

SEQ ID NO: 4042134 - RNA, 21 nt, Staphylococcus aureus subsp. aureus N315
uauccgaaaauugcuaaaaaa

SEQ ID NO: 4042135 - RNA, 23 nt, Staphylococcus aureus subsp. aureus N315
uauccgaaaauugcuaaaaaaau

SEQ ID NO: 4042136 - RNA, 24 nt, Staphylococcus aureus subsp. aureus N315
uauccgcaucuuuugguuuaucug

SEQ ID NO: 4042137 - RNA, 20 nt, Staphylococcus aureus subsp. aureus N315
uauccuguuucauaugguga

SEQ ID NO: 4042138 - RNA, 13 nt, Staphylococcus aureus subsp. aureus N315
uauccuucaaaag

SEQ ID NO: 4042139 - RNA, 16 nt, Staphylococcus aureus subsp. aureus N315
uauccuucucaucauu

SEQ ID NO: 4042140 - RNA, 14 nt, Staphylococcus aureus subsp. aureus N315
uauccuuuaaauca

SEQ ID NO: 4042141 - RNA, 16 nt, Staphylococcus aureus subsp. aureus N315
uaucgacuuugucauu

SEQ ID NO: 4042142 - RNA, 13 nt, Staphylococcus aureus subsp. aureus N315
uaucgauaaaugu

SEQ ID NO: 4042143 - RNA, 17 nt, Staphylococcus aureus subsp. aureus N315
uaucgauaguucuauau

SEQ ID NO: 4042144 - RNA, 19 nt, Staphylococcus aureus subsp. aureus N315
uaucgauauagcauaaaau

SEQ ID NO: 4042145 - RNA, 22 nt, Staphylococcus aureus subsp. aureus N315
uaucgauucgauuauuuagaua

SEQ ID NO: 4042146 - RNA, 18 nt, Staphylococcus aureus subsp. aureus N315
uaucgccuaaaaauaaaa

SEQ ID NO: 4042147 - RNA, 21 nt, Staphylococcus aureus subsp. aureus N315
uaucgcuuuugaaguuggucc

SEQ ID NO: 4042148 - RNA, 17 nt, Staphylococcus aureus subsp. aureus N315
uaucguaaaaaaacguc

SEQ ID NO: 4042149 - RNA, 15 nt, Staphylococcus aureus subsp. aureus N315
uaucgucaauuuuaa

SEQ ID NO: 4042150 - RNA, 17 nt, Staphylococcus aureus subsp. aureus N315
uaucgugaagaaaaaau

SEQ ID NO: 4042151 - RNA, 15 nt, Staphylococcus aureus subsp. aureus N315
uaucguuuauugaua

SEQ ID NO: 4042152 - RNA, 16 nt, Staphylococcus aureus subsp. aureus N315
uaucuaaacaauuccc

SEQ ID NO: 4042153 - RNA, 19 nt, Staphylococcus aureus subsp. aureus N315
uaucuaaagcuauaaaaaa

SEQ ID NO: 4042154 - RNA, 11 nt, Staphylococcus aureus subsp. aureus N315
uaucuaagucg

SEQ ID NO: 4042155 - RNA, 23 nt, Staphylococcus aureus subsp. aureus N315
uaucuaaugaucaucuauauuua

SEQ ID NO: 4042156 - RNA, 20 nt, Staphylococcus aureus subsp. aureus N315
uaucuaaugggucaaugacu

SEQ ID NO: 4042157 - RNA, 18 nt, Staphylococcus aureus subsp. aureus N315
uaucuacaugguuuucac

SEQ ID NO: 4042158 - RNA, 22 nt, Staphylococcus aureus subsp. aureus N315
uaucuacgccuugaccuacuuu

SEQ ID NO: 4042159 - RNA, 12 nt, Staphylococcus aureus subsp. aureus N315
uaucuacuauuu

SEQ ID NO: 4042160 - RNA, 15 nt, Staphylococcus aureus subsp. aureus N315
uaucuacuauuuguu

SEQ ID NO: 4042161 - RNA, 19 nt, Staphylococcus aureus subsp. aureus N315
uaucuacucaaauauaaau

SEQ ID NO: 4042162 - RNA, 17 nt, Staphylococcus aureus subsp. aureus N315
uaucuaguguucucauu

SEQ ID NO: 4042163 - RNA, 18 nt, Staphylococcus aureus subsp. aureus N315
uaucuauaaaaagaauau

SEQ ID NO: 4042164 - RNA, 24 nt, Staphylococcus aureus subsp. aureus N315
uaucuauacaauuauggauaaaau

SEQ ID NO: 4042165 - RNA, 13 nt, Staphylococcus aureus subsp. aureus N315
uaucuauaugcau

SEQ ID NO: 4042166 - RNA, 15 nt, Staphylococcus aureus subsp. aureus N315
uaucuauaugcauau

SEQ ID NO: 4042167 - RNA, 14 nt, Staphylococcus aureus subsp. aureus N315
uauggcgguuugaa

SEQ ID NO: 4042168 - RNA, 21 nt, Staphylococcus aureus subsp. aureus N315
uauggucuugaguacuaauca

SEQ ID NO: 4042169 - RNA, 16 nt, Staphylococcus aureus subsp. aureus N315
uaugguguggugugau

SEQ ID NO: 4042170 - RNA, 16 nt, Staphylococcus aureus subsp. aureus N315
uaugguuguuuuccaa

SEQ ID NO: 4042171 - RNA, 22 nt, Staphylococcus aureus subsp. aureus N315
uaugguuguuuuccaauaauaa

SEQ ID NO: 4042172 - RNA, 19 nt, Staphylococcus aureus subsp. aureus N315
uaugguuuaccuaguuuua

SEQ ID NO: 4042173 - RNA, 21 nt, Staphylococcus aureus subsp. aureus N315
uaugguuuaccuaguuuuacu

SEQ ID NO: 4042174 - RNA, 13 nt, Staphylococcus aureus subsp. aureus N315
uauguaaauaaca

SEQ ID NO: 4042175 - RNA, 14 nt, Staphylococcus aureus subsp. aureus N315
uauguaacuacuau

SEQ ID NO: 4042176 - RNA, 14 nt, Staphylococcus aureus subsp. aureus N315
uauguagauuuuaa

SEQ ID NO: 4042177 - RNA, 15 nt, Staphylococcus aureus subsp. aureus N315
uauguagauuuuaau

SEQ ID NO: 4042178 - RNA, 20 nt, Staphylococcus aureus subsp. aureus N315
uaugucaaauugaacuuaua

SEQ ID NO: 4042179 - RNA, 22 nt, Staphylococcus aureus subsp. aureus N315
uaugucuagacuuauuugaaug

SEQ ID NO: 4042180 - RNA, 20 nt, Staphylococcus aureus subsp. aureus N315
uaugucuuaacaacaugauu

SEQ ID NO: 4042181 - RNA, 16 nt, Staphylococcus aureus subsp. aureus N315
uauguggauacaaacc

SEQ ID NO: 4042182 - RNA, 12 nt, Staphylococcus aureus subsp. aureus N315
uauguguauaug

SEQ ID NO: 4042183 - RNA, 20 nt, Staphylococcus aureus subsp. aureus N315
uauguguugugauauauagu

SEQ ID NO: 4042184 - RNA, 17 nt, Staphylococcus aureus subsp. aureus N315
uauguguuguguaucag

SEQ ID NO: 4042185 - RNA, 20 nt, Staphylococcus aureus subsp. aureus N315
uauguuaaugucuuaaaauu

SEQ ID NO: 4042186 - RNA, 15 nt, Staphylococcus aureus subsp. aureus N315
uauguuauaaauucu

SEQ ID NO: 4042187 - RNA, 16 nt, Staphylococcus aureus subsp. aureus N315
uauguuauguaaauaa

SEQ ID NO: 4042188 - RNA, 18 nt, Staphylococcus aureus subsp. aureus N315
uauguucgauuauucuua

SEQ ID NO: 4042189 - RNA, 15 nt, Staphylococcus aureus subsp. aureus N315
uauguugcuuaucaa

SEQ ID NO: 4042190 - RNA, 21 nt, Staphylococcus aureus subsp. aureus N315
uauguugucauaccaaauaaa

SEQ ID NO: 4042191 - RNA, 13 nt, Staphylococcus aureus subsp. aureus N315
uauguuuauauug

SEQ ID NO: 4042192 - RNA, 21 nt, Staphylococcus aureus subsp. aureus N315
uauguuugggauauagaaaag

SEQ ID NO: 4042193 - RNA, 15 nt, Staphylococcus aureus subsp. aureus N315
uauguuuuauaauaa

SEQ ID NO: 4042194 - RNA, 20 nt, Staphylococcus aureus subsp. aureus N315
uauguuuuaucaauauuagu

SEQ ID NO: 4042195 - RNA, 13 nt, Staphylococcus aureus subsp. aureus N315
uauuaaaaauccu

SEQ ID NO: 4042196 - RNA, 20 nt, Staphylococcus aureus subsp. aureus N315
uauuaaaaccaaaagaaauu

SEQ ID NO: 4042197 - RNA, 21 nt, Staphylococcus aureus subsp. aureus N315
uauuaaaagcaugauacucaa

SEQ ID NO: 4042198 - RNA, 21 nt, Staphylococcus aureus subsp. aureus N315
uauuaaaauacgguacagaua

SEQ ID NO: 4042199 - RNA, 19 nt, Staphylococcus aureus subsp. aureus N315
uauuaaaauuaaauaauga

SEQ ID NO: 4042200 - RNA, 19 nt, Staphylococcus aureus subsp. aureus N315
uauuaaacauuuuugaauu

SEQ ID NO: 4042201 - RNA, 18 nt, Staphylococcus aureus subsp. aureus N315
uauuaaacgcaauuaacc

SEQ ID NO: 4042202 - RNA, 19 nt, Staphylococcus aureus subsp. aureus N315
uauuaaacgcaauuaaccu

SEQ ID NO: 4042203 - RNA, 12 nt, Staphylococcus aureus subsp. aureus N315
uauuaaaggaaa

SEQ ID NO: 4042204 - RNA, 13 nt, Staphylococcus aureus subsp. aureus N315
uauuaaauuaugg

SEQ ID NO: 4042205 - RNA, 18 nt, Staphylococcus aureus subsp. aureus N315
uauuaaauugcguacuug

SEQ ID NO: 4042206 - RNA, 14 nt, Staphylococcus aureus subsp. aureus N315
uauuaaauuucuga

SEQ ID NO: 4042207 - RNA, 16 nt, Staphylococcus aureus subsp. aureus N315
uauuaaauuugaaagu

SEQ ID NO: 4042208 - RNA, 20 nt, Staphylococcus aureus subsp. aureus N315
uauuaaauuuuguauaaccu

SEQ ID NO: 4042209 - RNA, 17 nt, Staphylococcus aureus subsp. aureus N315
uauuaagaaauacucac

SEQ ID NO: 4042210 - RNA, 16 nt, Staphylococcus aureus subsp. aureus N315
uauuaagacugauuaa

SEQ ID NO: 4042211 - RNA, 17 nt, Staphylococcus aureus subsp. aureus N315
uauuaagacugauuaau

SEQ ID NO: 4042212 - RNA, 22 nt, Staphylococcus aureus subsp. aureus N315
uauuaaggggguaauacuauau

SEQ ID NO: 4042213 - RNA, 16 nt, Staphylococcus aureus subsp. aureus N315
uauuaagugaguuuua

SEQ ID NO: 4042214 - RNA, 20 nt, Staphylococcus aureus subsp. aureus N315
uauuaauauuagugacauuu

SEQ ID NO: 4042215 - RNA, 20 nt, Staphylococcus aureus subsp. aureus N315
uauuaauuacgucauaaaau

SEQ ID NO: 4042216 - RNA, 12 nt, Staphylococcus aureus subsp. aureus N315
uauuaauuuaau

SEQ ID NO: 4042217 - RNA, 16 nt, Staphylococcus aureus subsp. aureus N315
uauuaauuuuacguuu

SEQ ID NO: 4042218 - RNA, 18 nt, Staphylococcus aureus subsp. aureus N315
uauuaauuuuucaaaugu

SEQ ID NO: 4042219 - RNA, 19 nt, Staphylococcus aureus subsp. aureus N315
uauuaauuuuucaaauguu

SEQ ID NO: 4042220 - RNA, 15 nt, Staphylococcus aureus subsp. aureus N315
uauuacaaugaaaaa

SEQ ID NO: 4042221 - RNA, 21 nt, Staphylococcus aureus subsp. aureus N315
uauuaccauaacuuuauauau

SEQ ID NO: 4042222 - RNA, 15 nt, Staphylococcus aureus subsp. aureus N315
uauuacuauaaaaaa

SEQ ID NO: 4042223 - RNA, 19 nt, Staphylococcus aureus subsp. aureus N315
uauuacugauuguuaacga

SEQ ID NO: 4042224 - RNA, 14 nt, Staphylococcus aureus subsp. aureus N315
uauuacuuuaauuu

SEQ ID NO: 4042225 - RNA, 18 nt, Staphylococcus aureus subsp. aureus N315
uauuagccaauaaaaugu

SEQ ID NO: 4042226 - RNA, 19 nt, Staphylococcus aureus subsp. aureus N315
uauuagccaauaaaauguc

SEQ ID NO: 4042227 - RNA, 21 nt, Staphylococcus aureus subsp. aureus N315
uauuaggcuuaaauauaauga

SEQ ID NO: 4042228 - RNA, 17 nt, Staphylococcus aureus subsp. aureus N315
uauuaguuuuuacguuu

SEQ ID NO: 4042229 - RNA, 12 nt, Staphylococcus aureus subsp. aureus N315
uauuauaaaaua

SEQ ID NO: 4042230 - RNA, 15 nt, Staphylococcus aureus subsp. aureus N315
uauuauaaaauaaau

SEQ ID NO: 4042231 - RNA, 16 nt, Staphylococcus aureus subsp. aureus N315
uauuauaaaauagaag

SEQ ID NO: 4042232 - RNA, 15 nt, Staphylococcus aureus subsp. aureus N315
uauuauaaauauuuu

SEQ ID NO: 4042233 - RNA, 22 nt, Staphylococcus aureus subsp. aureus N315
uauuauaacccucguaggcaua

SEQ ID NO: 4042234 - RNA, 23 nt, Staphylococcus aureus subsp. aureus N315
uauuauaaguugcauauaaaaac

SEQ ID NO: 4042235 - RNA, 18 nt, Staphylococcus aureus subsp. aureus N315
uauuauaauaaauagacu

SEQ ID NO: 4042236 - RNA, 17 nt, Staphylococcus aureus subsp. aureus N315
uauuauaauagagaaac

SEQ ID NO: 4042237 - RNA, 19 nt, Staphylococcus aureus subsp. aureus N315
uauuauaauuguucauugg

SEQ ID NO: 4042238 - RNA, 15 nt, Staphylococcus aureus subsp. aureus N315
uauuauaauuuuguu

SEQ ID NO: 4042239 - RNA, 11 nt, Staphylococcus aureus subsp. aureus N315
uauuauagaac

SEQ ID NO: 4042240 - RNA, 14 nt, Staphylococcus aureus subsp. aureus N315
uauuauauauauuc

SEQ ID NO: 4042241 - RNA, 17 nt, Staphylococcus aureus subsp. aureus N315
uauuauauugaauugaa

SEQ ID NO: 4042242 - RNA, 15 nt, Staphylococcus aureus subsp. aureus N315
uauuauccucaaaua

SEQ ID NO: 4042243 - RNA, 19 nt, Staphylococcus aureus subsp. aureus N315
uauuauccucaaauauauu

SEQ ID NO: 4042244 - RNA, 15 nt, Staphylococcus aureus subsp. aureus N315
uauuaucuauccauu

SEQ ID NO: 4042245 - RNA, 14 nt, Staphylococcus aureus subsp. aureus N315
uauuaucuuuaauu

SEQ ID NO: 4042246 - RNA, 16 nt, Staphylococcus aureus subsp. aureus N315
uauuaugaauuauuaa

SEQ ID NO: 4042247 - RNA, 16 nt, Staphylococcus aureus subsp. aureus N315
uauuauguguauauua

SEQ ID NO: 4042248 - RNA, 14 nt, Staphylococcus aureus subsp. aureus N315
uauuauguuauaaa

SEQ ID NO: 4042249 - RNA, 15 nt, Staphylococcus aureus subsp. aureus N315
uauuauguuauaaau

SEQ ID NO: 4042250 - RNA, 16 nt, Staphylococcus aureus subsp. aureus N315
uauuauuacuuaucug

SEQ ID NO: 4042251 - RNA, 19 nt, Staphylococcus aureus subsp. aureus N315
uauuauuauaauuuuguuu

SEQ ID NO: 4042252 - RNA, 13 nt, Staphylococcus aureus subsp. aureus N315
uauuauucucuca

SEQ ID NO: 4042253 - RNA, 21 nt, Staphylococcus aureus subsp. aureus N315
uauuauugaaacuaauaauuu

SEQ ID NO: 4042254 - RNA, 12 nt, Staphylococcus aureus subsp. aureus N315
uauuauugaaau

SEQ ID NO: 4042255 - RNA, 19 nt, Staphylococcus aureus subsp. aureus N315
uauuuaaaggguguuuaga

SEQ ID NO: 4042256 - RNA, 16 nt, Staphylococcus aureus subsp. aureus N315
uauuuaaauuuuaagu

SEQ ID NO: 4042257 - RNA, 14 nt, Staphylococcus aureus subsp. aureus N315
uauuuaauguuuua

SEQ ID NO: 4042258 - RNA, 16 nt, Staphylococcus aureus subsp. aureus N315
uauuuaauguuuuagu

SEQ ID NO: 4042259 - RNA, 13 nt, Staphylococcus aureus subsp. aureus N315
uauuuaauuauuu

SEQ ID NO: 4042260 - RNA, 18 nt, Staphylococcus aureus subsp. aureus N315
uauuuaauuuuucuaaau

SEQ ID NO: 4042261 - RNA, 16 nt, Staphylococcus aureus subsp. aureus N315
uauuuacacacaugau

SEQ ID NO: 4042262 - RNA, 22 nt, Staphylococcus aureus subsp. aureus N315
uauuuacauugccacuuuugug

SEQ ID NO: 4042263 - RNA, 16 nt, Staphylococcus aureus subsp. aureus N315
uauuuaccuucuucua

SEQ ID NO: 4042264 - RNA, 14 nt, Staphylococcus aureus subsp. aureus N315
uauuuagaauaaac

SEQ ID NO: 4042265 - RNA, 16 nt, Staphylococcus aureus subsp. aureus N315
uauuuagaauauuaac

SEQ ID NO: 4042266 - RNA, 15 nt, Staphylococcus aureus subsp. aureus N315
uauuuagauugguca

SEQ ID NO: 4042267 - RNA, 21 nt, Staphylococcus aureus subsp. aureus N315
uauuuagcuugcuuacaauaa

SEQ ID NO: 4042268 - RNA, 18 nt, Staphylococcus aureus subsp. aureus N315
uauuuauaacuuuaaaaa

SEQ ID NO: 4042269 - RNA, 16 nt, Staphylococcus aureus subsp. aureus N315
uauuuauacuaaauug

SEQ ID NO: 4042270 - RNA, 17 nt, Staphylococcus aureus subsp. aureus N315
uauuuauacuauaaaua

SEQ ID NO: 4042271 - RNA, 19 nt, Staphylococcus aureus subsp. aureus N315
uauuuauacuauaaauaca

SEQ ID NO: 4042272 - RNA, 14 nt, Staphylococcus aureus subsp. aureus N315
uauuuauauuaaau

SEQ ID NO: 4042273 - RNA, 17 nt, Staphylococcus aureus subsp. aureus N315
uauuuauauuaaauacu

SEQ ID NO: 4042274 - RNA, 12 nt, Staphylococcus aureus subsp. aureus N315
uauuuaucuuua

SEQ ID NO: 4042275 - RNA, 15 nt, Staphylococcus aureus subsp. aureus N315
uauuuauguuuucua

SEQ ID NO: 4042276 - RNA, 10 nt, Staphylococcus aureus subsp. aureus N315
uauuuauuca

SEQ ID NO: 4042277 - RNA, 18 nt, Staphylococcus aureus subsp. aureus N315
uauuuauugagauagaaa

SEQ ID NO: 4042278 - RNA, 13 nt, Staphylococcus aureus subsp. aureus N315
uauuuauuuuaau

SEQ ID NO: 4042279 - RNA, 17 nt, Staphylococcus aureus subsp. aureus N315
uauuuauuuuauaauaa

SEQ ID NO: 4042280 - RNA, 13 nt, Staphylococcus aureus subsp. aureus N315
uauuuauuuugau

SEQ ID NO: 4042281 - RNA, 17 nt, Staphylococcus aureus subsp. aureus N315
uauuucaaaaauaguaa

SEQ ID NO: 4042282 - RNA, 15 nt, Staphylococcus aureus subsp. aureus N315
uauuucaacaaacau

SEQ ID NO: 4042283 - RNA, 16 nt, Staphylococcus aureus subsp. aureus N315
uauuucaacaaacaua

SEQ ID NO: 4042284 - RNA, 17 nt, Staphylococcus aureus subsp. aureus N315
uauuucaacaaacauaa

SEQ ID NO: 4042285 - RNA, 21 nt, Staphylococcus aureus subsp. aureus N315
uauuucaacaaacauaaauaa

SEQ ID NO: 4042286 - RNA, 20 nt, Staphylococcus aureus subsp. aureus N315
uauuucacacagcuucauua

SEQ ID NO: 4042287 - RNA, 14 nt, Staphylococcus aureus subsp. aureus N315
uauuucagcuuauu

SEQ ID NO: 4042288 - RNA, 14 nt, Staphylococcus aureus subsp. aureus N315
uauuucauauaugu

SEQ ID NO: 4042289 - RNA, 20 nt, Staphylococcus aureus subsp. aureus N315
uauuucgguuagucuuaauc

SEQ ID NO: 4042290 - RNA, 19 nt, Staphylococcus aureus subsp. aureus N315
uauuucuauaucuauuuau

SEQ ID NO: 4042291 - RNA, 17 nt, Staphylococcus aureus subsp. aureus N315
uauuucuauuccuucua

SEQ ID NO: 4042292 - RNA, 22 nt, Staphylococcus aureus subsp. aureus N315
uauuucugacaacuuaauagaa

SEQ ID NO: 4042293 - RNA, 16 nt, Staphylococcus aureus subsp. aureus N315
uauuucuuaccauuua

SEQ ID NO: 4042294 - RNA, 21 nt, Staphylococcus aureus subsp. aureus N315
uauuucuuuuugucauuaauc

SEQ ID NO: 4042295 - RNA, 14 nt, Staphylococcus aureus subsp. aureus N315
uauuugaaaauauu

SEQ ID NO: 4042296 - RNA, 16 nt, Staphylococcus aureus subsp. aureus N315
uauuugaaaauuucac

SEQ ID NO: 4042297 - RNA, 17 nt, Staphylococcus aureus subsp. aureus N315
uauuugaaagguaagua

SEQ ID NO: 4042298 - RNA, 16 nt, Staphylococcus aureus subsp. aureus N315
uauuugaaugcaaauc

SEQ ID NO: 4042299 - RNA, 22 nt, Staphylococcus aureus subsp. aureus N315
uauuugaaugcaaaucaaauac

SEQ ID NO: 4042300 - RNA, 15 nt, Staphylococcus aureus subsp. aureus N315
uauuugauaauauug

SEQ ID NO: 4042301 - RNA, 17 nt, Staphylococcus aureus subsp. aureus N315
uauuugauuauucuuca

SEQ ID NO: 4042302 - RNA, 14 nt, Staphylococcus aureus subsp. aureus N315
uauuugauucuauu

SEQ ID NO: 4042303 - RNA, 17 nt, Staphylococcus aureus subsp. aureus N315
uauuugauucuauuucu

SEQ ID NO: 4042304 - RNA, 16 nt, Staphylococcus aureus subsp. aureus N315
uauuuggaaguuuuca

SEQ ID NO: 4042305 - RNA, 21 nt, Staphylococcus aureus subsp. aureus N315
uauuuggaugguaaguauaau

SEQ ID NO: 4042306 - RNA, 21 nt, Staphylococcus aureus subsp. aureus N315
uauuuguagccuacaaccuuu

SEQ ID NO: 4042307 - RNA, 15 nt, Staphylococcus aureus subsp. aureus N315
uauuuguauaugcaa

SEQ ID NO: 4042308 - RNA, 12 nt, Staphylococcus aureus subsp. aureus N315
uauuuuaaaaau

SEQ ID NO: 4042309 - RNA, 12 nt, Staphylococcus aureus subsp. aureus N315
uauuuuaaacau

SEQ ID NO: 4042310 - RNA, 21 nt, Staphylococcus aureus subsp. aureus N315
uauuuuaaaccguuauauauu

SEQ ID NO: 4042311 - RNA, 22 nt, Staphylococcus aureus subsp. aureus N315
uauuuuaaugggcgauaaaagu

SEQ ID NO: 4042312 - RNA, 14 nt, Staphylococcus aureus subsp. aureus N315
uauuuuauaaaaua

SEQ ID NO: 4042313 - RNA, 20 nt, Staphylococcus aureus subsp. aureus N315
uauuuuauaagaauuuaaaa

SEQ ID NO: 4042314 - RNA, 17 nt, Staphylococcus aureus subsp. aureus N315
uauuuuauaauaaauuu

SEQ ID NO: 4042315 - RNA, 13 nt, Staphylococcus aureus subsp. aureus N315
uauuuuauacaua

SEQ ID NO: 4042316 - RNA, 23 nt, Staphylococcus aureus subsp. aureus N315
uauuuuaucaagagguaaaucug

SEQ ID NO: 4042317 - RNA, 13 nt, Staphylococcus aureus subsp. aureus N315
uauuuuaucucuu

SEQ ID NO: 4042318 - RNA, 12 nt, Staphylococcus aureus subsp. aureus N315
uauuuuaucugu

SEQ ID NO: 4042319 - RNA, 20 nt, Staphylococcus aureus subsp. aureus N315
uauuuuaugacguaauuaau

SEQ ID NO: 4042320 - RNA, 12 nt, Staphylococcus aureus subsp. aureus N315
uauuuuaugauu

SEQ ID NO: 4042321 - RNA, 13 nt, Staphylococcus aureus subsp. aureus N315
uauuuuauuuaaa

SEQ ID NO: 4042322 - RNA, 14 nt, Staphylococcus aureus subsp. aureus N315
uauuuuauuuaaaa

SEQ ID NO: 4042323 - RNA, 16 nt, Staphylococcus aureus subsp. aureus N315
uauuuucaauaaauuu

SEQ ID NO: 4042324 - RNA, 19 nt, Staphylococcus aureus subsp. aureus N315
uauuuucaauaaauuuuau

SEQ ID NO: 4042325 - RNA, 21 nt, Staphylococcus aureus subsp. aureus N315
uauuuucaauaaauuuuauau

SEQ ID NO: 4042326 - RNA, 16 nt, Staphylococcus aureus subsp. aureus N315
uauuuucaguuaaaau

SEQ ID NO: 4042327 - RNA, 18 nt, Staphylococcus aureus subsp. aureus N315
uauuuucauaaacucuua

SEQ ID NO: 4042328 - RNA, 13 nt, Staphylococcus aureus subsp. aureus N315
uauuuucauuuua

SEQ ID NO: 4042329 - RNA, 14 nt, Staphylococcus aureus subsp. aureus N315
uauuuucauuuuag

SEQ ID NO: 4042330 - RNA, 15 nt, Staphylococcus aureus subsp. aureus N315
uauuuucauuuuagu

SEQ ID NO: 4042331 - RNA, 13 nt, Staphylococcus aureus subsp. aureus N315
uauuuucucuaua

SEQ ID NO: 4042332 - RNA, 17 nt, Staphylococcus aureus subsp. aureus N315
uauuuucucuauaauuu

SEQ ID NO: 4042333 - RNA, 18 nt, Staphylococcus aureus subsp. aureus N315
uauuuucugccauaaaca

SEQ ID NO: 4042334 - RNA, 17 nt, Staphylococcus aureus subsp. aureus N315
uauuuucugcuguaugg

SEQ ID NO: 4042335 - RNA, 20 nt, Staphylococcus aureus subsp. aureus N315
uauuuucuucucaacaaauc

SEQ ID NO: 4042336 - RNA, 13 nt, Staphylococcus aureus subsp. aureus N315
uauuuucuugugu

SEQ ID NO: 4042337 - RNA, 14 nt, Staphylococcus aureus subsp. aureus N315
uauuuucuugugua

SEQ ID NO: 4042338 - RNA, 21 nt, Staphylococcus aureus subsp. aureus N315
uauuuucuuguguauuuuuau

SEQ ID NO: 4042339 - RNA, 20 nt, Staphylococcus aureus subsp. aureus N315
uauuuucuuuuucuaaauaa

SEQ ID NO: 4042340 - RNA, 17 nt, Staphylococcus aureus subsp. aureus N315
uauuuuguccagacaac

SEQ ID NO: 4042341 - RNA, 15 nt, Staphylococcus aureus subsp. aureus N315
uauuuuguuaauaag

SEQ ID NO: 4042342 - RNA, 19 nt, Staphylococcus aureus subsp. aureus N315
uauuuuguuuuaaaaaaca

SEQ ID NO: 4042343 - RNA, 20 nt, Staphylococcus aureus subsp. aureus N315
ucaacacuuucuacucugau

SEQ ID NO: 4042344 - RNA, 19 nt, Staphylococcus aureus subsp. aureus N315
ucaacagauacuucaguac

SEQ ID NO: 4042345 - RNA, 14 nt, Staphylococcus aureus subsp. aureus N315
ucaacagcaaaaaa

SEQ ID NO: 4042346 - RNA, 15 nt, Staphylococcus aureus subsp. aureus N315
ucaacagcaaaaaau

SEQ ID NO: 4042347 - RNA, 16 nt, Staphylococcus aureus subsp. aureus N315
ucaacagcaaaaaaua

SEQ ID NO: 4042348 - RNA, 22 nt, Staphylococcus aureus subsp. aureus N315
ucaacagcaaaaaauaaaucuc

SEQ ID NO: 4042349 - RNA, 18 nt, Staphylococcus aureus subsp. aureus N315
ucaacagggguaaaacuu

SEQ ID NO: 4042350 - RNA, 16 nt, Staphylococcus aureus subsp. aureus N315
ucaacaguuuuaaaga

SEQ ID NO: 4042351 - RNA, 16 nt, Staphylococcus aureus subsp. aureus N315
ucaacauaaaauuuaa

SEQ ID NO: 4042352 - RNA, 19 nt, Staphylococcus aureus subsp. aureus N315
ucaacauaacucaaauauc

SEQ ID NO: 4042353 - RNA, 13 nt, Staphylococcus aureus subsp. aureus N315
ucaacaucaucuu

SEQ ID NO: 4042354 - RNA, 17 nt, Staphylococcus aureus subsp. aureus N315
ucaacaucaucuuuaau

SEQ ID NO: 4042355 - RNA, 19 nt, Staphylococcus aureus subsp. aureus N315
ucaacaucaucuuuaauuu

SEQ ID NO: 4042356 - RNA, 16 nt, Staphylococcus aureus subsp. aureus N315
ucaacaucaugaacuu

SEQ ID NO: 4042357 - RNA, 20 nt, Staphylococcus aureus subsp. aureus N315
ucaacaucguauucuuuuaa

SEQ ID NO: 4042358 - RNA, 22 nt, Staphylococcus aureus subsp. aureus N315
ucaacauguuccgcuacaaaac

SEQ ID NO: 4042359 - RNA, 15 nt, Staphylococcus aureus subsp. aureus N315
ucaacauuaaaaugu

SEQ ID NO: 4042360 - RNA, 21 nt, Staphylococcus aureus subsp. aureus N315
ucaaccuguucuuuauuuaaa

SEQ ID NO: 4042361 - RNA, 15 nt, Staphylococcus aureus subsp. aureus N315
ucaacgccauauuua

SEQ ID NO: 4042362 - RNA, 17 nt, Staphylococcus aureus subsp. aureus N315
ucaacgccauauuuauu

SEQ ID NO: 4042363 - RNA, 19 nt, Staphylococcus aureus subsp. aureus N315
ucaacguauauaaguuaaa

SEQ ID NO: 4042364 - RNA, 15 nt, Staphylococcus aureus subsp. aureus N315
ucaacgucaucugcu

SEQ ID NO: 4042365 - RNA, 21 nt, Staphylococcus aureus subsp. aureus N315
ucaacuaauuuaaagcaucau

SEQ ID NO: 4042366 - RNA, 17 nt, Staphylococcus aureus subsp. aureus N315
ucaacuacugucaauau

SEQ ID NO: 4042367 - RNA, 13 nt, Staphylococcus aureus subsp. aureus N315
ucaacuacuucau

SEQ ID NO: 4042368 - RNA, 22 nt, Staphylococcus aureus subsp. aureus N315
ucaacuauauauaguugaucaa

SEQ ID NO: 4042369 - RNA, 19 nt, Staphylococcus aureus subsp. aureus N315
ucaacugcugcuaaaauaa

SEQ ID NO: 4042370 - RNA, 17 nt, Staphylococcus aureus subsp. aureus N315
ucaacugcuucacgauu

SEQ ID NO: 4042371 - RNA, 17 nt, Staphylococcus aureus subsp. aureus N315
ucaacuuagaauuuaca

SEQ ID NO: 4042372 - RNA, 14 nt, Staphylococcus aureus subsp. aureus N315
ucaacuuauaaaau

SEQ ID NO: 4042373 - RNA, 17 nt, Staphylococcus aureus subsp. aureus N315
ucaacuuauuauuuauc

SEQ ID NO: 4042374 - RNA, 22 nt, Staphylococcus aureus subsp. aureus N315
ucaacuucgauaugauuaaagc

SEQ ID NO: 4042375 - RNA, 22 nt, Staphylococcus aureus subsp. aureus N315
ucaacuuuaguuguuaggggcu

SEQ ID NO: 4042376 - RNA, 18 nt, Staphylococcus aureus subsp. aureus N315
ucaacuuuucaaagccac

SEQ ID NO: 4042377 - RNA, 17 nt, Staphylococcus aureus subsp. aureus N315
ucaacuuuuuaauaaua

SEQ ID NO: 4042378 - RNA, 18 nt, Staphylococcus aureus subsp. aureus N315
ucaacuuuuuaauaauac

SEQ ID NO: 4042379 - RNA, 16 nt, Staphylococcus aureus subsp. aureus N315
ucaacuuuuuuaacuu

SEQ ID NO: 4042380 - RNA, 14 nt, Staphylococcus aureus subsp. aureus N315
ucaagaaaaaguuu

SEQ ID NO: 4042381 - RNA, 19 nt, Staphylococcus aureus subsp. aureus N315
ucaagaaauucgcaagccu

SEQ ID NO: 4042382 - RNA, 10 nt, Staphylococcus aureus subsp. aureus N315
ucaagaacaa

SEQ ID NO: 4042383 - RNA, 14 nt, Staphylococcus aureus subsp. aureus N315
ucaagaacuuuaaa

SEQ ID NO: 4042384 - RNA, 15 nt, Staphylococcus aureus subsp. aureus N315
ucaagaacuuuaaaa

SEQ ID NO: 4042385 - RNA, 14 nt, Staphylococcus aureus subsp. aureus N315
ucaagaccaugcaa

SEQ ID NO: 4042386 - RNA, 20 nt, Staphylococcus aureus subsp. aureus N315
ucaagacucccuuuuuaaaa

SEQ ID NO: 4042387 - RNA, 16 nt, Staphylococcus aureus subsp. aureus N315
ucaagagguaaaucug

SEQ ID NO: 4042388 - RNA, 23 nt, Staphylococcus aureus subsp. aureus N315
ucaagauguuugcaacauauuuu

SEQ ID NO: 4042389 - RNA, 23 nt, Staphylococcus aureus subsp. aureus N315
ucaagcgcaugcuugaacuuuua

SEQ ID NO: 4042390 - RNA, 19 nt, Staphylococcus aureus subsp. aureus N315
ucaagcugagcuuuaauuu

SEQ ID NO: 4042391 - RNA, 14 nt, Staphylococcus aureus subsp. aureus N315
ucaagcuuaauaag

SEQ ID NO: 4042392 - RNA, 18 nt, Staphylococcus aureus subsp. aureus N315
ucaagcuuaauaagcuga

SEQ ID NO: 4042393 - RNA, 14 nt, Staphylococcus aureus subsp. aureus N315
ucaaggaaaucaua

SEQ ID NO: 4042394 - RNA, 17 nt, Staphylococcus aureus subsp. aureus N315
ucaagguauacacaaau

SEQ ID NO: 4042395 - RNA, 16 nt, Staphylococcus aureus subsp. aureus N315
ucaaguguaguaaaaa

SEQ ID NO: 4042396 - RNA, 20 nt, Staphylococcus aureus subsp. aureus N315
ucaaguucaccguaaucuuu

SEQ ID NO: 4042397 - RNA, 20 nt, Staphylococcus aureus subsp. aureus N315
ucaaguuggugugcaauuaa

SEQ ID NO: 4042398 - RNA, 13 nt, Staphylococcus aureus subsp. aureus N315
ucaauaaauaaac

SEQ ID NO: 4042399 - RNA, 19 nt, Staphylococcus aureus subsp. aureus N315
ucaauaaauaaacaacugc

SEQ ID NO: 4042400 - RNA, 13 nt, Staphylococcus aureus subsp. aureus N315
ucaauaaauauug

SEQ ID NO: 4042401 - RNA, 11 nt, Staphylococcus aureus subsp. aureus N315
ucaauaaauug

SEQ ID NO: 4042402 - RNA, 14 nt, Staphylococcus aureus subsp. aureus N315
ucaauaacaccuuu

SEQ ID NO: 4042403 - RNA, 16 nt, Staphylococcus aureus subsp. aureus N315
ucaauaacuauaauca

SEQ ID NO: 4042404 - RNA, 16 nt, Staphylococcus aureus subsp. aureus N315
ucaauaaggcaauuuu

SEQ ID NO: 4042405 - RNA, 12 nt, Staphylococcus aureus subsp. aureus N315
ucaauaaucuua

SEQ ID NO: 4042406 - RNA, 13 nt, Staphylococcus aureus subsp. aureus N315
ucaauaauuauua

SEQ ID NO: 4042407 - RNA, 13 nt, Staphylococcus aureus subsp. aureus N315
ucaauaauugauu

SEQ ID NO: 4042408 - RNA, 14 nt, Staphylococcus aureus subsp. aureus N315
ucaauaauuucuug

SEQ ID NO: 4042409 - RNA, 20 nt, Staphylococcus aureus subsp. aureus N315
ucaauaccauaauuaaauaa

SEQ ID NO: 4042410 - RNA, 15 nt, Staphylococcus aureus subsp. aureus N315
ucaauagaugaaaau

SEQ ID NO: 4042411 - RNA, 17 nt, Staphylococcus aureus subsp. aureus N315
ucaauagcgguuuaaaa

SEQ ID NO: 4042412 - RNA, 20 nt, Staphylococcus aureus subsp. aureus N315
ucaauagcgguuuaaaaaug

SEQ ID NO: 4042413 - RNA, 22 nt, Staphylococcus aureus subsp. aureus N315
ucaauaggaauaccacuuaauc

SEQ ID NO: 4042414 - RNA, 14 nt, Staphylococcus aureus subsp. aureus N315
ucaauaguuucaau

SEQ ID NO: 4042415 - RNA, 14 nt, Staphylococcus aureus subsp. aureus N315
ucaauauaacauug

SEQ ID NO: 4042416 - RNA, 16 nt, Staphylococcus aureus subsp. aureus N315
ucaauauaacauugca

SEQ ID NO: 4042417 - RNA, 16 nt, Staphylococcus aureus subsp. aureus N315
ucaauaucacuaucag

SEQ ID NO: 4042418 - RNA, 14 nt, Staphylococcus aureus subsp. aureus N315
ucaauaucuucuaa

SEQ ID NO: 4042419 - RNA, 18 nt, Staphylococcus aureus subsp. aureus N315
ucaauaucuucuucuaac

SEQ ID NO: 4042420 - RNA, 14 nt, Staphylococcus aureus subsp. aureus N315
ucaauaugaccuuu

SEQ ID NO: 4042421 - RNA, 13 nt, Staphylococcus aureus subsp. aureus N315
ucaauaugauaau

SEQ ID NO: 4042422 - RNA, 22 nt, Staphylococcus aureus subsp. aureus N315
ucaauauuaaucauaaugaaua

SEQ ID NO: 4042423 - RNA, 13 nt, Staphylococcus aureus subsp. aureus N315
ucaauauuuaaau

SEQ ID NO: 4042424 - RNA, 23 nt, Staphylococcus aureus subsp. aureus N315
ucaaucaacgagucauaaauaua

SEQ ID NO: 4042425 - RNA, 23 nt, Staphylococcus aureus subsp. aureus N315
ucaauccaagcaaucuuaguaca

SEQ ID NO: 4042426 - RNA, 16 nt, Staphylococcus aureus subsp. aureus N315
ucaauccuaaauuaua

SEQ ID NO: 4042427 - RNA, 21 nt, Staphylococcus aureus subsp. aureus N315
ucaauccuaaauuauaaauag

SEQ ID NO: 4042428 - RNA, 13 nt, Staphylococcus aureus subsp. aureus N315
ucaauccuuuguu

SEQ ID NO: 4042429 - RNA, 15 nt, Staphylococcus aureus subsp. aureus N315
ucaaucgcauuuugu

SEQ ID NO: 4042430 - RNA, 15 nt, Staphylococcus aureus subsp. aureus N315
ucaaugaauucauuu

SEQ ID NO: 4042431 - RNA, 16 nt, Staphylococcus aureus subsp. aureus N315
ucaccuuuuuuaacuu

SEQ ID NO: 4042432 - RNA, 22 nt, Staphylococcus aureus subsp. aureus N315
ucacgauagauuuaucaccuuu

SEQ ID NO: 4042433 - RNA, 16 nt, Staphylococcus aureus subsp. aureus N315
ucacgaucaaauuuaa

SEQ ID NO: 4042434 - RNA, 14 nt, Staphylococcus aureus subsp. aureus N315
ucacgauuaauaaa

SEQ ID NO: 4042435 - RNA, 17 nt, Staphylococcus aureus subsp. aureus N315
ucacgauuaauaaaauu

SEQ ID NO: 4042436 - RNA, 20 nt, Staphylococcus aureus subsp. aureus N315
ucacgauuaauaaaauucua

SEQ ID NO: 4042437 - RNA, 21 nt, Staphylococcus aureus subsp. aureus N315
ucacgauuacgcucauauguc

SEQ ID NO: 4042438 - RNA, 13 nt, Staphylococcus aureus subsp. aureus N315
ucacgauuuucaa

SEQ ID NO: 4042439 - RNA, 15 nt, Staphylococcus aureus subsp. aureus N315
ucacgauuuuuaaaa

SEQ ID NO: 4042440 - RNA, 16 nt, Staphylococcus aureus subsp. aureus N315
ucacgauuuuuaaaau

SEQ ID NO: 4042441 - RNA, 18 nt, Staphylococcus aureus subsp. aureus N315
ucacgauuuuuaaaaugc

SEQ ID NO: 4042442 - RNA, 13 nt, Staphylococcus aureus subsp. aureus N315
ucacgccauaauc

SEQ ID NO: 4042443 - RNA, 12 nt, Staphylococcus aureus subsp. aureus N315
ucacgcuaacau

SEQ ID NO: 4042444 - RNA, 16 nt, Staphylococcus aureus subsp. aureus N315
ucacgcuuauucgaac

SEQ ID NO: 4042445 - RNA, 22 nt, Staphylococcus aureus subsp. aureus N315
ucacgguuuacccacuuauaaa

SEQ ID NO: 4042446 - RNA, 14 nt, Staphylococcus aureus subsp. aureus N315
ucacguaaugaauc

SEQ ID NO: 4042447 - RNA, 23 nt, Staphylococcus aureus subsp. aureus N315
ucacgugcuucguuuuuaguguu

SEQ ID NO: 4042448 - RNA, 18 nt, Staphylococcus aureus subsp. aureus N315
ucacguugugcaauaccu

SEQ ID NO: 4042449 - RNA, 13 nt, Staphylococcus aureus subsp. aureus N315
ucacuaaaaauau

SEQ ID NO: 4042450 - RNA, 20 nt, Staphylococcus aureus subsp. aureus N315
ucacuaaaaauauauuucaa

SEQ ID NO: 4042451 - RNA, 17 nt, Staphylococcus aureus subsp. aureus N315
ucacuaacucaauauga

SEQ ID NO: 4042452 - RNA, 17 nt, Staphylococcus aureus subsp. aureus N315
ucacuaauggauaugau

SEQ ID NO: 4042453 - RNA, 17 nt, Staphylococcus aureus subsp. aureus N315
ucacuacaguguaugau

SEQ ID NO: 4042454 - RNA, 19 nt, Staphylococcus aureus subsp. aureus N315
ucacuaggauguucaucaa

SEQ ID NO: 4042455 - RNA, 23 nt, Staphylococcus aureus subsp. aureus N315
ucacuauagccaaaggcaaaaug

SEQ ID NO: 4042456 - RNA, 13 nt, Staphylococcus aureus subsp. aureus N315
ucacuaucagcuu

SEQ ID NO: 4042457 - RNA, 14 nt, Staphylococcus aureus subsp. aureus N315
ucacucacuucaac

SEQ ID NO: 4042458 - RNA, 23 nt, Staphylococcus aureus subsp. aureus N315
ucacuccucuauuuuaugauuug

SEQ ID NO: 4042459 - RNA, 19 nt, Staphylococcus aureus subsp. aureus N315
ucacucuguaauaaagaau

SEQ ID NO: 4042460 - RNA, 22 nt, Staphylococcus aureus subsp. aureus N315
ucacucuuacucauuuuucuug

SEQ ID NO: 4042461 - RNA, 14 nt, Staphylococcus aureus subsp. aureus N315
ucacugaaugcuaa

SEQ ID NO: 4042462 - RNA, 23 nt, Staphylococcus aureus subsp. aureus N315
ucacugaaugcuaauacuaauca

SEQ ID NO: 4042463 - RNA, 22 nt, Staphylococcus aureus subsp. aureus N315
ucacugcaaacacaguacaaau

SEQ ID NO: 4042464 - RNA, 17 nt, Staphylococcus aureus subsp. aureus N315
ucacugcacuuaugaua

SEQ ID NO: 4042465 - RNA, 17 nt, Staphylococcus aureus subsp. aureus N315
ucacugcuuucaaguaa

SEQ ID NO: 4042466 - RNA, 15 nt, Staphylococcus aureus subsp. aureus N315
ucacuguagauucaa

SEQ ID NO: 4042467 - RNA, 16 nt, Staphylococcus aureus subsp. aureus N315
ucacuguagauucaaa

SEQ ID NO: 4042468 - RNA, 17 nt, Staphylococcus aureus subsp. aureus N315
ucacuguuaaagauguc

SEQ ID NO: 4042469 - RNA, 19 nt, Staphylococcus aureus subsp. aureus N315
ucacuuaauaaauaauuuc

SEQ ID NO: 4042470 - RNA, 16 nt, Staphylococcus aureus subsp. aureus N315
ucacuuauuauuuugu

SEQ ID NO: 4042471 - RNA, 15 nt, Staphylococcus aureus subsp. aureus N315
ucacuugguacaccu

SEQ ID NO: 4042472 - RNA, 18 nt, Staphylococcus aureus subsp. aureus N315
ucacuuuaggguucauug

SEQ ID NO: 4042473 - RNA, 17 nt, Staphylococcus aureus subsp. aureus N315
ucacuuuauuaaauaac

SEQ ID NO: 4042474 - RNA, 14 nt, Staphylococcus aureus subsp. aureus N315
ucagaaauuuaaua

SEQ ID NO: 4042475 - RNA, 15 nt, Staphylococcus aureus subsp. aureus N315
ucagaacuaugaaua

SEQ ID NO: 4042476 - RNA, 20 nt, Staphylococcus aureus subsp. aureus N315
ucagaaguuguuuagaaaag

SEQ ID NO: 4042477 - RNA, 16 nt, Staphylococcus aureus subsp. aureus N315
ucagaaucaaguaauu

SEQ ID NO: 4042478 - RNA, 17 nt, Staphylococcus aureus subsp. aureus N315
ucagaaugaacuucucu

SEQ ID NO: 4042479 - RNA, 19 nt, Staphylococcus aureus subsp. aureus N315
ucagaaugaacuucucuua

SEQ ID NO: 4042480 - RNA, 14 nt, Staphylococcus aureus subsp. aureus N315
ucagaguagaaagu

SEQ ID NO: 4042481 - RNA, 19 nt, Staphylococcus aureus subsp. aureus N315
ucagauacauuaucaagaa

SEQ ID NO: 4042482 - RNA, 21 nt, Staphylococcus aureus subsp. aureus N315
ucagauagguacuuaucugaa

SEQ ID NO: 4042483 - RNA, 19 nt, Staphylococcus aureus subsp. aureus N315
ucagauauaaguagcauca

SEQ ID NO: 4042484 - RNA, 17 nt, Staphylococcus aureus subsp. aureus N315
ucagaugaauaauguuu

SEQ ID NO: 4042485 - RNA, 21 nt, Staphylococcus aureus subsp. aureus N315
ucagaugauuuaauucugguu

SEQ ID NO: 4042486 - RNA, 21 nt, Staphylococcus aureus subsp. aureus N315
ucagcauugggacauaaaauu

SEQ ID NO: 4042487 - RNA, 24 nt, Staphylococcus aureus subsp. aureus N315
ucagcgauaggcgcgaaaugaccu

SEQ ID NO: 4042488 - RNA, 14 nt, Staphylococcus aureus subsp. aureus N315
ucagcuaaauauuu

SEQ ID NO: 4042489 - RNA, 15 nt, Staphylococcus aureus subsp. aureus N315
ucagcuaaguuaaau

SEQ ID NO: 4042490 - RNA, 17 nt, Staphylococcus aureus subsp. aureus N315
ucagcuaaguuaaauau

SEQ ID NO: 4042491 - RNA, 15 nt, Staphylococcus aureus subsp. aureus N315
ucagcuaauucgucu

SEQ ID NO: 4042492 - RNA, 13 nt, Staphylococcus aureus subsp. aureus N315
ucagcuauaaaag

SEQ ID NO: 4042493 - RNA, 14 nt, Staphylococcus aureus subsp. aureus N315
ucagcugaugcuuc

SEQ ID NO: 4042494 - RNA, 15 nt, Staphylococcus aureus subsp. aureus N315
ucagcugaugcuucg

SEQ ID NO: 4042495 - RNA, 14 nt, Staphylococcus aureus subsp. aureus N315
ucagcuuuaauaau

SEQ ID NO: 4042496 - RNA, 15 nt, Staphylococcus aureus subsp. aureus N315
ucagcuuuaauaaua

SEQ ID NO: 4042497 - RNA, 14 nt, Staphylococcus aureus subsp. aureus N315
ucaggaauagaugu

SEQ ID NO: 4042498 - RNA, 22 nt, Staphylococcus aureus subsp. aureus N315
ucaggaucacguuuuucuuuaa

SEQ ID NO: 4042499 - RNA, 23 nt, Staphylococcus aureus subsp. aureus N315
ucaggaucacguuuuucuuuaaa

SEQ ID NO: 4042500 - RNA, 19 nt, Staphylococcus aureus subsp. aureus N315
ucaggggccccaacacaga

SEQ ID NO: 4042501 - RNA, 21 nt, Staphylococcus aureus subsp. aureus N315
ucaggggccccaacacagaga

SEQ ID NO: 4042502 - RNA, 16 nt, Staphylococcus aureus subsp. aureus N315
ucaggguuuaagauuu

SEQ ID NO: 4042503 - RNA, 19 nt, Staphylococcus aureus subsp. aureus N315
ucagguucaaaauugcuga

SEQ ID NO: 4042504 - RNA, 24 nt, Staphylococcus aureus subsp. aureus N315
ucaguaaaaacgaaauuguuaucu

SEQ ID NO: 4042505 - RNA, 13 nt, Staphylococcus aureus subsp. aureus N315
ucaguaauaauac

SEQ ID NO: 4042506 - RNA, 15 nt, Staphylococcus aureus subsp. aureus N315
ucaguaauaauguag

SEQ ID NO: 4042507 - RNA, 15 nt, Staphylococcus aureus subsp. aureus N315
ucaguaccauguuuu

SEQ ID NO: 4042508 - RNA, 23 nt, Staphylococcus aureus subsp. aureus N315
ucaguaggacauauaaauguuga

SEQ ID NO: 4042509 - RNA, 18 nt, Staphylococcus aureus subsp. aureus N315
ucaguauuuacuuuuccu

SEQ ID NO: 4042510 - RNA, 14 nt, Staphylococcus aureus subsp. aureus N315
ucagucaauucaaa

SEQ ID NO: 4042511 - RNA, 18 nt, Staphylococcus aureus subsp. aureus N315
ucagucaauucaaacuga

SEQ ID NO: 4042512 - RNA, 15 nt, Staphylococcus aureus subsp. aureus N315
ucagucaguaaaaau

SEQ ID NO: 4042513 - RNA, 16 nt, Staphylococcus aureus subsp. aureus N315
ucagucaguaaaaaua

SEQ ID NO: 4042514 - RNA, 21 nt, Staphylococcus aureus subsp. aureus N315
ucagucucuaaaacuuuuuca

SEQ ID NO: 4042515 - RNA, 21 nt, Staphylococcus aureus subsp. aureus N315
ucaguuaaaauaaccauuuuu

SEQ ID NO: 4042516 - RNA, 16 nt, Staphylococcus aureus subsp. aureus N315
ucaguuaaaucuuuaa

SEQ ID NO: 4042517 - RNA, 18 nt, Staphylococcus aureus subsp. aureus N315
ucaguucaaacagaaauu

SEQ ID NO: 4042518 - RNA, 19 nt, Staphylococcus aureus subsp. aureus N315
ucaucuggugcaauauuau

SEQ ID NO: 4042519 - RNA, 18 nt, Staphylococcus aureus subsp. aureus N315
ucaucuuaucaagaauau

SEQ ID NO: 4042520 - RNA, 20 nt, Staphylococcus aureus subsp. aureus N315
ucaucuuaugacugcuuuuu

SEQ ID NO: 4042521 - RNA, 16 nt, Staphylococcus aureus subsp. aureus N315
ucaucuucaauucuua

SEQ ID NO: 4042522 - RNA, 17 nt, Staphylococcus aureus subsp. aureus N315
ucaucuugagauuuuca

SEQ ID NO: 4042523 - RNA, 18 nt, Staphylococcus aureus subsp. aureus N315
ucaucuugagauuuucaa

SEQ ID NO: 4042524 - RNA, 21 nt, Staphylococcus aureus subsp. aureus N315
ucaucuugagauuuucaacac

SEQ ID NO: 4042525 - RNA, 22 nt, Staphylococcus aureus subsp. aureus N315
ucaucuugcaaguauuuucuua

SEQ ID NO: 4042526 - RNA, 20 nt, Staphylococcus aureus subsp. aureus N315
ucaucuugcgccuuguucaa

SEQ ID NO: 4042527 - RNA, 23 nt, Staphylococcus aureus subsp. aureus N315
ucaucuugcgccuuguucaauuc

SEQ ID NO: 4042528 - RNA, 14 nt, Staphylococcus aureus subsp. aureus N315
ucaucuuuauuuac

SEQ ID NO: 4042529 - RNA, 13 nt, Staphylococcus aureus subsp. aureus N315
ucaucuuucaaau

SEQ ID NO: 4042530 - RNA, 17 nt, Staphylococcus aureus subsp. aureus N315
ucaucuuucaaaugcuu

SEQ ID NO: 4042531 - RNA, 18 nt, Staphylococcus aureus subsp. aureus N315
ucaucuuucaaaugcuua

SEQ ID NO: 4042532 - RNA, 21 nt, Staphylococcus aureus subsp. aureus N315
ucaucuuucaacgcauauucu

SEQ ID NO: 4042533 - RNA, 13 nt, Staphylococcus aureus subsp. aureus N315
ucaugaaauaaaa

SEQ ID NO: 4042534 - RNA, 16 nt, Staphylococcus aureus subsp. aureus N315
ucaugaauaaauacaa

SEQ ID NO: 4042535 - RNA, 20 nt, Staphylococcus aureus subsp. aureus N315
ucaugaauaaauacaauguu

SEQ ID NO: 4042536 - RNA, 12 nt, Staphylococcus aureus subsp. aureus N315
ucaugagcacaa

SEQ ID NO: 4042537 - RNA, 17 nt, Staphylococcus aureus subsp. aureus N315
ucaugagcacaaacuaa

SEQ ID NO: 4042538 - RNA, 15 nt, Staphylococcus aureus subsp. aureus N315
ucaugauuaauuaaa

SEQ ID NO: 4042539 - RNA, 22 nt, Staphylococcus aureus subsp. aureus N315
ucaugcaaaacuaaucaaauua

SEQ ID NO: 4042540 - RNA, 16 nt, Staphylococcus aureus subsp. aureus N315
ucaugcauaagaaaua

SEQ ID NO: 4042541 - RNA, 13 nt, Staphylococcus aureus subsp. aureus N315
ucaugcauucuau

SEQ ID NO: 4042542 - RNA, 12 nt, Staphylococcus aureus subsp. aureus N315
ucaugccuucau

SEQ ID NO: 4042543 - RNA, 13 nt, Staphylococcus aureus subsp. aureus N315
ucaugccuucaug

SEQ ID NO: 4042544 - RNA, 18 nt, Staphylococcus aureus subsp. aureus N315
ucaugcuuaucuguaaau

SEQ ID NO: 4042545 - RNA, 20 nt, Staphylococcus aureus subsp. aureus N315
ucauguauauggcaucauca

SEQ ID NO: 4042546 - RNA, 14 nt, Staphylococcus aureus subsp. aureus N315
ucauguauugucca

SEQ ID NO: 4042547 - RNA, 18 nt, Staphylococcus aureus subsp. aureus N315
ucaugucuagauuuuaaa

SEQ ID NO: 4042548 - RNA, 16 nt, Staphylococcus aureus subsp. aureus N315
ucaugugucauaaucc

SEQ ID NO: 4042549 - RNA, 16 nt, Staphylococcus aureus subsp. aureus N315
ucauguucuuguaauc

SEQ ID NO: 4042550 - RNA, 18 nt, Staphylococcus aureus subsp. aureus N315
ucauguuuggcauaauaa

SEQ ID NO: 4042551 - RNA, 13 nt, Staphylococcus aureus subsp. aureus N315
ucauuaaauauuu

SEQ ID NO: 4042552 - RNA, 13 nt, Staphylococcus aureus subsp. aureus N315
ucauuaaaucuga

SEQ ID NO: 4042553 - RNA, 19 nt, Staphylococcus aureus subsp. aureus N315
ucauuaaaucugauucauu

SEQ ID NO: 4042554 - RNA, 16 nt, Staphylococcus aureus subsp. aureus N315
ucauuaaccuuacaua

SEQ ID NO: 4042555 - RNA, 14 nt, Staphylococcus aureus subsp. aureus N315
ucauuacauuuuau

SEQ ID NO: 4042556 - RNA, 10 nt, Staphylococcus aureus subsp. aureus N315
ucauuacgua

SEQ ID NO: 4042557 - RNA, 20 nt, Staphylococcus aureus subsp. aureus N315
ucauuacguaacaucacaua

SEQ ID NO: 4042558 - RNA, 16 nt, Staphylococcus aureus subsp. aureus N315
ucauuagccaaaucuu

SEQ ID NO: 4042559 - RNA, 18 nt, Staphylococcus aureus subsp. aureus N315
ucauuaguguagaaaaua

SEQ ID NO: 4042560 - RNA, 16 nt, Staphylococcus aureus subsp. aureus N315
ucauuaguuguaucag

SEQ ID NO: 4042561 - RNA, 14 nt, Staphylococcus aureus subsp. aureus N315
ucauuauaaaaugg

SEQ ID NO: 4042562 - RNA, 22 nt, Staphylococcus aureus subsp. aureus N315
ucauuauacgugcuuuaaaguu

SEQ ID NO: 4042563 - RNA, 19 nt, Staphylococcus aureus subsp. aureus N315
ucauuauagucuuaaacau

SEQ ID NO: 4042564 - RNA, 16 nt, Staphylococcus aureus subsp. aureus N315
ucauuaucaaauaacc

SEQ ID NO: 4042565 - RNA, 11 nt, Staphylococcus aureus subsp. aureus N315
ucauuaucauu

SEQ ID NO: 4042566 - RNA, 23 nt, Staphylococcus aureus subsp. aureus N315
ucauuaugcccgauaauucuaac

SEQ ID NO: 4042567 - RNA, 12 nt, Staphylococcus aureus subsp. aureus N315
ucauuauuuaaa

SEQ ID NO: 4042568 - RNA, 23 nt, Staphylococcus aureus subsp. aureus N315
ucauuauuuagaauucuaaaaga

SEQ ID NO: 4042569 - RNA, 18 nt, Staphylococcus aureus subsp. aureus N315
ucauuauuugauaaauaa

SEQ ID NO: 4042570 - RNA, 22 nt, Staphylococcus aureus subsp. aureus N315
ucauucaaguguaguaaaaauc

SEQ ID NO: 4042571 - RNA, 18 nt, Staphylococcus aureus subsp. aureus N315
ucauucacaaugauugaa

SEQ ID NO: 4042572 - RNA, 17 nt, Staphylococcus aureus subsp. aureus N315
ucauucaccuaaaaaga

SEQ ID NO: 4042573 - RNA, 12 nt, Staphylococcus aureus subsp. aureus N315
ucauucaccuug

SEQ ID NO: 4042574 - RNA, 13 nt, Staphylococcus aureus subsp. aureus N315
ucauucacuguau

SEQ ID NO: 4042575 - RNA, 17 nt, Staphylococcus aureus subsp. aureus N315
ucauucguacuuccaau

SEQ ID NO: 4042576 - RNA, 18 nt, Staphylococcus aureus subsp. aureus N315
ucauucguacuuccaaua

SEQ ID NO: 4042577 - RNA, 18 nt, Staphylococcus aureus subsp. aureus N315
ucauucuagcaucgaugu

SEQ ID NO: 4042578 - RNA, 23 nt, Staphylococcus aureus subsp. aureus N315
ucauucuguguaaauauaaauau

SEQ ID NO: 4042579 - RNA, 15 nt, Staphylococcus aureus subsp. aureus N315
ucauucuuuauagaa

SEQ ID NO: 4042580 - RNA, 18 nt, Staphylococcus aureus subsp. aureus N315
ucauugaaaauaaucuua

SEQ ID NO: 4042581 - RNA, 16 nt, Staphylococcus aureus subsp. aureus N315
ucauugaucaacauua

SEQ ID NO: 4042582 - RNA, 13 nt, Staphylococcus aureus subsp. aureus N315
ucauugaucgauu

SEQ ID NO: 4042583 - RNA, 18 nt, Staphylococcus aureus subsp. aureus N315
ucauugcuugguuugauu

SEQ ID NO: 4042584 - RNA, 23 nt, Staphylococcus aureus subsp. aureus N315
ucauuggcaauauacuuuuuaaa

SEQ ID NO: 4042585 - RNA, 16 nt, Staphylococcus aureus subsp. aureus N315
ucauugguuucaucau

SEQ ID NO: 4042586 - RNA, 20 nt, Staphylococcus aureus subsp. aureus N315
ucauuguaaauuuguuaucu

SEQ ID NO: 4042587 - RNA, 21 nt, Staphylococcus aureus subsp. aureus N315
ucauugugguauuaauuacag

SEQ ID NO: 4042588 - RNA, 12 nt, Staphylococcus aureus subsp. aureus N315
ucauuuaaaaua

SEQ ID NO: 4042589 - RNA, 13 nt, Staphylococcus aureus subsp. aureus N315
ucauuuaaaauau

SEQ ID NO: 4042590 - RNA, 15 nt, Staphylococcus aureus subsp. aureus N315
ucauuuaaaauauuu

SEQ ID NO: 4042591 - RNA, 16 nt, Staphylococcus aureus subsp. aureus N315
ucauuuaaaucaauac

SEQ ID NO: 4042592 - RNA, 19 nt, Staphylococcus aureus subsp. aureus N315
ucauuuaaaucaauacuuu

SEQ ID NO: 4042593 - RNA, 13 nt, Staphylococcus aureus subsp. aureus N315
ucauuuauaacau

SEQ ID NO: 4042594 - RNA, 20 nt, Staphylococcus aureus subsp. aureus N315
ucauuucaaauaagaaugug

SEQ ID NO: 4042595 - RNA, 17 nt, Staphylococcus aureus subsp. aureus N315
ucauuucaauauuaaaa

SEQ ID NO: 4042596 - RNA, 12 nt, Staphylococcus aureus subsp. aureus N315
ucauuucaauca

SEQ ID NO: 4042597 - RNA, 19 nt, Staphylococcus aureus subsp. aureus N315
ucauuucgauuaauuuaau

SEQ ID NO: 4042598 - RNA, 20 nt, Staphylococcus aureus subsp. aureus N315
ucauuugaacaucauuuaau

SEQ ID NO: 4042599 - RNA, 14 nt, Staphylococcus aureus subsp. aureus N315
ucauuuguauagau

SEQ ID NO: 4042600 - RNA, 17 nt, Staphylococcus aureus subsp. aureus N315
ucauuuguguuuuuaau

SEQ ID NO: 4042601 - RNA, 24 nt, Staphylococcus aureus subsp. aureus N315
ucauuuguguuuuuaauguuugcu

SEQ ID NO: 4042602 - RNA, 15 nt, Staphylococcus aureus subsp. aureus N315
ucauuuguucaucug

SEQ ID NO: 4042603 - RNA, 21 nt, Staphylococcus aureus subsp. aureus N315
ucauuuguucaucugauaauu

SEQ ID NO: 4042604 - RNA, 16 nt, Staphylococcus aureus subsp. aureus N315
ucauuuguuguuauua

SEQ ID NO: 4042605 - RNA, 23 nt, Staphylococcus aureus subsp. aureus N315
ucauuuguuguuauuauaaauau

SEQ ID NO: 4042606 - RNA, 15 nt, Staphylococcus aureus subsp. aureus N315
ucccgcuuaaaauga

SEQ ID NO: 4042607 - RNA, 15 nt, Staphylococcus aureus subsp. aureus N315
ucccguuaauaucau

SEQ ID NO: 4042608 - RNA, 16 nt, Staphylococcus aureus subsp. aureus N315
ucccuacugcaccgau

SEQ ID NO: 4042609 - RNA, 20 nt, Staphylococcus aureus subsp. aureus N315
ucccuuaaauacaauuucuu

SEQ ID NO: 4042610 - RNA, 22 nt, Staphylococcus aureus subsp. aureus N315
ucccuuaaauacaauuucuuca

SEQ ID NO: 4042611 - RNA, 14 nt, Staphylococcus aureus subsp. aureus N315
ucccuuaauaauaa

SEQ ID NO: 4042612 - RNA, 14 nt, Staphylococcus aureus subsp. aureus N315
ucccuucaacauag

SEQ ID NO: 4042613 - RNA, 14 nt, Staphylococcus aureus subsp. aureus N315
ucccuuuuuaaaau

SEQ ID NO: 4042614 - RNA, 20 nt, Staphylococcus aureus subsp. aureus N315
uccgaauucuccguuaauuu

SEQ ID NO: 4042615 - RNA, 14 nt, Staphylococcus aureus subsp. aureus N315
uccgacugcaccuc

SEQ ID NO: 4042616 - RNA, 15 nt, Staphylococcus aureus subsp. aureus N315
uccgaggcuaauuuu

SEQ ID NO: 4042617 - RNA, 14 nt, Staphylococcus aureus subsp. aureus N315
uccgauuuuuuuac

SEQ ID NO: 4042618 - RNA, 16 nt, Staphylococcus aureus subsp. aureus N315
uccgcacugccuuuuu

SEQ ID NO: 4042619 - RNA, 13 nt, Staphylococcus aureus subsp. aureus N315
uccgcauaaauua

SEQ ID NO: 4042620 - RNA, 16 nt, Staphylococcus aureus subsp. aureus N315
uccgcuuguucaacua

SEQ ID NO: 4042621 - RNA, 12 nt, Staphylococcus aureus subsp. aureus N315
uccggaacaaua

SEQ ID NO: 4042622 - RNA, 21 nt, Staphylococcus aureus subsp. aureus N315
uccggaccuuguaaauuuaaa

SEQ ID NO: 4042623 - RNA, 14 nt, Staphylococcus aureus subsp. aureus N315
uccggcugaaggga

SEQ ID NO: 4042624 - RNA, 16 nt, Staphylococcus aureus subsp. aureus N315
uccguauuuaccuucu

SEQ ID NO: 4042625 - RNA, 23 nt, Staphylococcus aureus subsp. aureus N315
uccgucgaauauaauuuuuugac

SEQ ID NO: 4042626 - RNA, 18 nt, Staphylococcus aureus subsp. aureus N315
uccguuaaaauuuuaauu

SEQ ID NO: 4042627 - RNA, 13 nt, Staphylococcus aureus subsp. aureus N315
uccguuaauuaua

SEQ ID NO: 4042628 - RNA, 23 nt, Staphylococcus aureus subsp. aureus N315
uccguugaauuaacaauauuaaa

SEQ ID NO: 4042629 - RNA, 16 nt, Staphylococcus aureus subsp. aureus N315
uccuaaauuauaaaua

SEQ ID NO: 4042630 - RNA, 14 nt, Staphylococcus aureus subsp. aureus N315
uccuaaauuauugu

SEQ ID NO: 4042631 - RNA, 18 nt, Staphylococcus aureus subsp. aureus N315
uccuaagcaucguaaaaa

SEQ ID NO: 4042632 - RNA, 19 nt, Staphylococcus aureus subsp. aureus N315
uccuaagcaucguaaaaaa

SEQ ID NO: 4042633 - RNA, 15 nt, Staphylococcus aureus subsp. aureus N315
uccuaagcuaguguu

SEQ ID NO: 4042634 - RNA, 17 nt, Staphylococcus aureus subsp. aureus N315
uccuaagucuuuuaaau

SEQ ID NO: 4042635 - RNA, 11 nt, Staphylococcus aureus subsp. aureus N315
uccuaauucuu

SEQ ID NO: 4042636 - RNA, 17 nt, Staphylococcus aureus subsp. aureus N315
uccuaauucuugagcaa

SEQ ID NO: 4042637 - RNA, 13 nt, Staphylococcus aureus subsp. aureus N315
uccuacugcuguc

SEQ ID NO: 4042638 - RNA, 13 nt, Staphylococcus aureus subsp. aureus N315
uccuacuuuucaa

SEQ ID NO: 4042639 - RNA, 15 nt, Staphylococcus aureus subsp. aureus N315
uccuaucuguaccgu

SEQ ID NO: 4042640 - RNA, 20 nt, Staphylococcus aureus subsp. aureus N315
uccuaucuguaccguauuuu

SEQ ID NO: 4042641 - RNA, 21 nt, Staphylococcus aureus subsp. aureus N315
uccuaugccaaauaacguuaa

SEQ ID NO: 4042642 - RNA, 17 nt, Staphylococcus aureus subsp. aureus N315
uccuauggcgcaauuuu

SEQ ID NO: 4042643 - RNA, 17 nt, Staphylococcus aureus subsp. aureus N315
uccuauuacuacauaau

SEQ ID NO: 4042644 - RNA, 19 nt, Staphylococcus aureus subsp. aureus N315
uccuauuacuacauaauuu

SEQ ID NO: 4042645 - RNA, 21 nt, Staphylococcus aureus subsp. aureus N315
uccuauuguuuuagcaauuug

SEQ ID NO: 4042646 - RNA, 14 nt, Staphylococcus aureus subsp. aureus N315
uccucaaauauauu

SEQ ID NO: 4042647 - RNA, 14 nt, Staphylococcus aureus subsp. aureus N315
uccucauaauuauc

SEQ ID NO: 4042648 - RNA, 16 nt, Staphylococcus aureus subsp. aureus N315
uccucauuaauaaauu

SEQ ID NO: 4042649 - RNA, 16 nt, Staphylococcus aureus subsp. aureus N315
uccuccaaagcuaagu

SEQ ID NO: 4042650 - RNA, 19 nt, Staphylococcus aureus subsp. aureus N315
uccuccuaccgcuaaaauu

SEQ ID NO: 4042651 - RNA, 15 nt, Staphylococcus aureus subsp. aureus N315
uccucgguauuuaau

SEQ ID NO: 4042652 - RNA, 19 nt, Staphylococcus aureus subsp. aureus N315
uccucgguauuuaauguuu

SEQ ID NO: 4042653 - RNA, 19 nt, Staphylococcus aureus subsp. aureus N315
uccucuaacgguauaucau

SEQ ID NO: 4042654 - RNA, 22 nt, Staphylococcus aureus subsp. aureus N315
uccucuaacgguauaucaucca

SEQ ID NO: 4042655 - RNA, 14 nt, Staphylococcus aureus subsp. aureus N315
uccucuauuguauc

SEQ ID NO: 4042656 - RNA, 22 nt, Staphylococcus aureus subsp. aureus N315
uccugcaaaauguuacacaaau

SEQ ID NO: 4042657 - RNA, 20 nt, Staphylococcus aureus subsp. aureus N315
uccugcuacaacuucuucuc

SEQ ID NO: 4042658 - RNA, 17 nt, Staphylococcus aureus subsp. aureus N315
uccuuaaacaaauaaau

SEQ ID NO: 4042659 - RNA, 16 nt, Staphylococcus aureus subsp. aureus N315
uccuuaauugcucuuc

SEQ ID NO: 4042660 - RNA, 13 nt, Staphylococcus aureus subsp. aureus N315
uccuuaccuuuua

SEQ ID NO: 4042661 - RNA, 13 nt, Staphylococcus aureus subsp. aureus N315
uccuuauuuuucg

SEQ ID NO: 4042662 - RNA, 20 nt, Staphylococcus aureus subsp. aureus N315
uccuucaauguucaauucac

SEQ ID NO: 4042663 - RNA, 14 nt, Staphylococcus aureus subsp. aureus N315
uccuucaucaauaa

SEQ ID NO: 4042664 - RNA, 20 nt, Staphylococcus aureus subsp. aureus N315
uccuucgcuaugaccaugau

SEQ ID NO: 4042665 - RNA, 22 nt, Staphylococcus aureus subsp. aureus N315
uccuucgcuaugaccaugauau

SEQ ID NO: 4042666 - RNA, 15 nt, Staphylococcus aureus subsp. aureus N315
uccuugauucuuaua

SEQ ID NO: 4042667 - RNA, 18 nt, Staphylococcus aureus subsp. aureus N315
uccuugguuauuaaaauu

SEQ ID NO: 4042668 - RNA, 19 nt, Staphylococcus aureus subsp. aureus N315
uccuugguuauuaaaauua

SEQ ID NO: 4042669 - RNA, 15 nt, Staphylococcus aureus subsp. aureus N315
uccuuuauauucuaa

SEQ ID NO: 4042670 - RNA, 15 nt, Staphylococcus aureus subsp. aureus N315
uccuuuauauuuagu

SEQ ID NO: 4042671 - RNA, 12 nt, Staphylococcus aureus subsp. aureus N315
uccuuucuuuuu

SEQ ID NO: 4042672 - RNA, 14 nt, Staphylococcus aureus subsp. aureus N315
uccuuugauguuca

SEQ ID NO: 4042673 - RNA, 23 nt, Staphylococcus aureus subsp. aureus N315
uccuuugauguucacuaaaugug

SEQ ID NO: 4042674 - RNA, 13 nt, Staphylococcus aureus subsp. aureus N315
uccuuuguuugua

SEQ ID NO: 4042675 - RNA, 20 nt, Staphylococcus aureus subsp. aureus N315
ucgaaaaacuguaaaucauc

SEQ ID NO: 4042676 - RNA, 15 nt, Staphylococcus aureus subsp. aureus N315
ucgaaaagaaauucu

SEQ ID NO: 4042677 - RNA, 20 nt, Staphylococcus aureus subsp. aureus N315
ucgaaaagaaauucuacagg

SEQ ID NO: 4042678 - RNA, 23 nt, Staphylococcus aureus subsp. aureus N315
ucgaaaagaaauucuacagguaa

SEQ ID NO: 4042679 - RNA, 19 nt, Staphylococcus aureus subsp. aureus N315
ucgaaaauagcuauuaaaa

SEQ ID NO: 4042680 - RNA, 21 nt, Staphylococcus aureus subsp. aureus N315
ucgaaaauagcuauuaaaaua

SEQ ID NO: 4042681 - RNA, 15 nt, Staphylococcus aureus subsp. aureus N315
ucgaaagccaauuaa

SEQ ID NO: 4042682 - RNA, 18 nt, Staphylococcus aureus subsp. aureus N315
ucgaaauauuuauucgcu

SEQ ID NO: 4042683 - RNA, 22 nt, Staphylococcus aureus subsp. aureus N315
ucgaaauucucuuuguuggggc

SEQ ID NO: 4042684 - RNA, 20 nt, Staphylococcus aureus subsp. aureus N315
ucgaacaaucggaagcauau

SEQ ID NO: 4042685 - RNA, 15 nt, Staphylococcus aureus subsp. aureus N315
ucgaacauaaauaaa

SEQ ID NO: 4042686 - RNA, 15 nt, Staphylococcus aureus subsp. aureus N315
ucgaacuaucaauau

SEQ ID NO: 4042687 - RNA, 16 nt, Staphylococcus aureus subsp. aureus N315
ucgaacuuuuguucua

SEQ ID NO: 4042688 - RNA, 15 nt, Staphylococcus aureus subsp. aureus N315
ucgaaguagcuuguu

SEQ ID NO: 4042689 - RNA, 14 nt, Staphylococcus aureus subsp. aureus N315
ucgaauguuucuuc

SEQ ID NO: 4042690 - RNA, 20 nt, Staphylococcus aureus subsp. aureus N315
ucgacuaauuuuucuuucag

SEQ ID NO: 4042691 - RNA, 22 nt, Staphylococcus aureus subsp. aureus N315
ucgacuaauuuuucuuucaggc

SEQ ID NO: 4042692 - RNA, 14 nt, Staphylococcus aureus subsp. aureus N315
ucgacuacaaguuu

SEQ ID NO: 4042693 - RNA, 19 nt, Staphylococcus aureus subsp. aureus N315
ucgacuacaaguuuauaau

SEQ ID NO: 4042694 - RNA, 14 nt, Staphylococcus aureus subsp. aureus N315
ucguuauagacuaa

SEQ ID NO: 4042695 - RNA, 15 nt, Staphylococcus aureus subsp. aureus N315
ucguucaagaacaau

SEQ ID NO: 4042696 - RNA, 21 nt, Staphylococcus aureus subsp. aureus N315
ucguucauauauuuuguuaau

SEQ ID NO: 4042697 - RNA, 15 nt, Staphylococcus aureus subsp. aureus N315
ucguucucuuaaaua

SEQ ID NO: 4042698 - RNA, 14 nt, Staphylococcus aureus subsp. aureus N315
ucguucuuugauua

SEQ ID NO: 4042699 - RNA, 15 nt, Staphylococcus aureus subsp. aureus N315
ucguuucgucagauu

SEQ ID NO: 4042700 - RNA, 19 nt, Staphylococcus aureus subsp. aureus N315
ucguuucuguuucaucacc

SEQ ID NO: 4042701 - RNA, 17 nt, Staphylococcus aureus subsp. aureus N315
ucguuuuuacuguaauc

SEQ ID NO: 4042702 - RNA, 13 nt, Staphylococcus aureus subsp. aureus N315
ucguuuuuccaug

SEQ ID NO: 4042703 - RNA, 18 nt, Staphylococcus aureus subsp. aureus N315
ucuaaaaaauuaaaaauu

SEQ ID NO: 4042704 - RNA, 19 nt, Staphylococcus aureus subsp. aureus N315
ucuaaaaagcggacugaaa

SEQ ID NO: 4042705 - RNA, 13 nt, Staphylococcus aureus subsp. aureus N315
ucuaaaacauguu

SEQ ID NO: 4042706 - RNA, 16 nt, Staphylococcus aureus subsp. aureus N315
ucuaaaacggaaauaa

SEQ ID NO: 4042707 - RNA, 11 nt, Staphylococcus aureus subsp. aureus N315
ucuaaaaguug

SEQ ID NO: 4042708 - RNA, 17 nt, Staphylococcus aureus subsp. aureus N315
ucuaaaaguuguaauuu

SEQ ID NO: 4042709 - RNA, 21 nt, Staphylococcus aureus subsp. aureus N315
ucuaaaaguuguaauuuaaaa

SEQ ID NO: 4042710 - RNA, 23 nt, Staphylococcus aureus subsp. aureus N315
ucuaaaauaaaacgugcaaauaa

SEQ ID NO: 4042711 - RNA, 12 nt, Staphylococcus aureus subsp. aureus N315
ucuaaaauaacu

SEQ ID NO: 4042712 - RNA, 13 nt, Staphylococcus aureus subsp. aureus N315
ucuaaacaauucc

SEQ ID NO: 4042713 - RNA, 16 nt, Staphylococcus aureus subsp. aureus N315
ucuaaacuauaauaau

SEQ ID NO: 4042714 - RNA, 18 nt, Staphylococcus aureus subsp. aureus N315
ucuaaacuucuauuaaua

SEQ ID NO: 4042715 - RNA, 21 nt, Staphylococcus aureus subsp. aureus N315
ucuaaacuucuauuaauaauu

SEQ ID NO: 4042716 - RNA, 16 nt, Staphylococcus aureus subsp. aureus N315
ucuaaagcuauaaaaa

SEQ ID NO: 4042717 - RNA, 18 nt, Staphylococcus aureus subsp. aureus N315
ucuaaauaaaauuaaaac

SEQ ID NO: 4042718 - RNA, 19 nt, Staphylococcus aureus subsp. aureus N315
ucuaaauaaaauuaaaaca

SEQ ID NO: 4042719 - RNA, 18 nt, Staphylococcus aureus subsp. aureus N315
ucuaaauaauuucucaaa

SEQ ID NO: 4042720 - RNA, 19 nt, Staphylococcus aureus subsp. aureus N315
ucuaaauauaauagaaaua

SEQ ID NO: 4042721 - RNA, 11 nt, Staphylococcus aureus subsp. aureus N315
ucuaaaucuug

SEQ ID NO: 4042722 - RNA, 22 nt, Staphylococcus aureus subsp. aureus N315
ucuaaaugcacgagcaacaucu

SEQ ID NO: 4042723 - RNA, 16 nt, Staphylococcus aureus subsp. aureus N315
ucuaacaauauauaau

SEQ ID NO: 4042724 - RNA, 14 nt, Staphylococcus aureus subsp. aureus N315
ucuaaccacuucuu

SEQ ID NO: 4042725 - RNA, 16 nt, Staphylococcus aureus subsp. aureus N315
ucuaacguuaacaaua

SEQ ID NO: 4042726 - RNA, 16 nt, Staphylococcus aureus subsp. aureus N315
ucuaacuuaccaugau

SEQ ID NO: 4042727 - RNA, 21 nt, Staphylococcus aureus subsp. aureus N315
ucuaacuuguuuauucagaua

SEQ ID NO: 4042728 - RNA, 14 nt, Staphylococcus aureus subsp. aureus N315
ucuaaguaauauaa

SEQ ID NO: 4042729 - RNA, 22 nt, Staphylococcus aureus subsp. aureus N315
ucuaaguguugaccauuaucaa

SEQ ID NO: 4042730 - RNA, 23 nt, Staphylococcus aureus subsp. aureus N315
ucuaaguuaaaaccuuuucaaau

SEQ ID NO: 4042731 - RNA, 16 nt, Staphylococcus aureus subsp. aureus N315
ucuaauacauacugau

SEQ ID NO: 4042732 - RNA, 21 nt, Staphylococcus aureus subsp. aureus N315
ucuaauacauacugauuaaac

SEQ ID NO: 4042733 - RNA, 18 nt, Staphylococcus aureus subsp. aureus N315
ucuaauacuuucaaacaa

SEQ ID NO: 4042734 - RNA, 20 nt, Staphylococcus aureus subsp. aureus N315
ucuaauacuuucaaacaaau

SEQ ID NO: 4042735 - RNA, 15 nt, Staphylococcus aureus subsp. aureus N315
ucuaauacuuucacu

SEQ ID NO: 4042736 - RNA, 18 nt, Staphylococcus aureus subsp. aureus N315
ucuaauacuuucacuuuu

SEQ ID NO: 4042737 - RNA, 22 nt, Staphylococcus aureus subsp. aureus N315
ucuaauacuuucacuuuuuaua

SEQ ID NO: 4042738 - RNA, 13 nt, Staphylococcus aureus subsp. aureus N315
ucuaauauuuugg

SEQ ID NO: 4042739 - RNA, 17 nt, Staphylococcus aureus subsp. aureus N315
ucuaaucuucacgcuua

SEQ ID NO: 4042740 - RNA, 22 nt, Staphylococcus aureus subsp. aureus N315
ucuaaugauuaaaaaucaaaga

SEQ ID NO: 4042741 - RNA, 17 nt, Staphylococcus aureus subsp. aureus N315
ucuaaugcuaauuuaac

SEQ ID NO: 4042742 - RNA, 20 nt, Staphylococcus aureus subsp. aureus N315
ucuaaugggucaaugacuga

SEQ ID NO: 4042743 - RNA, 18 nt, Staphylococcus aureus subsp. aureus N315
ucuaauuauucaugaauc

SEQ ID NO: 4042744 - RNA, 18 nt, Staphylococcus aureus subsp. aureus N315
ucuaauucaaguguauua

SEQ ID NO: 4042745 - RNA, 14 nt, Staphylococcus aureus subsp. aureus N315
ucuaauucaaugau

SEQ ID NO: 4042746 - RNA, 22 nt, Staphylococcus aureus subsp. aureus N315
ucuaauucaaugauuuuuaaaa

SEQ ID NO: 4042747 - RNA, 13 nt, Staphylococcus aureus subsp. aureus N315
ucuaauucguaau

SEQ ID NO: 4042748 - RNA, 14 nt, Staphylococcus aureus subsp. aureus N315
ucuaauucugaaau

SEQ ID NO: 4042749 - RNA, 15 nt, Staphylococcus aureus subsp. aureus N315
ucuaauuguuguaau

SEQ ID NO: 4042750 - RNA, 21 nt, Staphylococcus aureus subsp. aureus N315
ucuaauuguuguaauucuuuu

SEQ ID NO: 4042751 - RNA, 13 nt, Staphylococcus aureus subsp. aureus N315
ucuaauuucacaa

SEQ ID NO: 4042752 - RNA, 20 nt, Staphylococcus aureus subsp. aureus N315
ucuaauuugcaaaaucaacc

SEQ ID NO: 4042753 - RNA, 14 nt, Staphylococcus aureus subsp. aureus N315
ucuaauuuuccuag

SEQ ID NO: 4042754 - RNA, 19 nt, Staphylococcus aureus subsp. aureus N315
ucuacaauauuaaaauuaa

SEQ ID NO: 4042755 - RNA, 19 nt, Staphylococcus aureus subsp. aureus N315
ucuacaauauucaauaauu

SEQ ID NO: 4042756 - RNA, 12 nt, Staphylococcus aureus subsp. aureus N315
ucuacagcacug

SEQ ID NO: 4042757 - RNA, 21 nt, Staphylococcus aureus subsp. aureus N315
ucuacagcaucaccuaaagcu

SEQ ID NO: 4042758 - RNA, 18 nt, Staphylococcus aureus subsp. aureus N315
ucuacaggcaaugcaagu

SEQ ID NO: 4042759 - RNA, 22 nt, Staphylococcus aureus subsp. aureus N315
ucuacaggcaaugcaaguuggc

SEQ ID NO: 4042760 - RNA, 18 nt, Staphylococcus aureus subsp. aureus N315
ucuacagguaaugcaagu

SEQ ID NO: 4042761 - RNA, 22 nt, Staphylococcus aureus subsp. aureus N315
ucuacagguaaugcaaguuggc

SEQ ID NO: 4042762 - RNA, 15 nt, Staphylococcus aureus subsp. aureus N315
ucuacauaauuugaa

SEQ ID NO: 4042763 - RNA, 23 nt, Staphylococcus aureus subsp. aureus N315
ucuacaugaaucaacaauuuaaa

SEQ ID NO: 4042764 - RNA, 24 nt, Staphylococcus aureus subsp. aureus N315
ucuacauuaaagaaaauaucugaa

SEQ ID NO: 4042765 - RNA, 23 nt, Staphylococcus aureus subsp. aureus N315
ucuacauuauauugagacaacau

SEQ ID NO: 4042766 - RNA, 15 nt, Staphylococcus aureus subsp. aureus N315
ucuacccuugcaaau

SEQ ID NO: 4042767 - RNA, 13 nt, Staphylococcus aureus subsp. aureus N315
ucuaccuuuuaau

SEQ ID NO: 4042768 - RNA, 18 nt, Staphylococcus aureus subsp. aureus N315
ucuacgaucaaaaucaug

SEQ ID NO: 4042769 - RNA, 21 nt, Staphylococcus aureus subsp. aureus N315
ucuacuaauauucuaggcaaa

SEQ ID NO: 4042770 - RNA, 18 nt, Staphylococcus aureus subsp. aureus N315
ucuacuauuuaaucuuaa

SEQ ID NO: 4042771 - RNA, 22 nt, Staphylococcus aureus subsp. aureus N315
ucuacuauuuuuucuaauucaa

SEQ ID NO: 4042772 - RNA, 22 nt, Staphylococcus aureus subsp. aureus N315
ucuacucgaaaccagcuuacug

SEQ ID NO: 4042773 - RNA, 17 nt, Staphylococcus aureus subsp. aureus N315
ucuacuuaguaauaaga

SEQ ID NO: 4042774 - RNA, 13 nt, Staphylococcus aureus subsp. aureus N315
ucuacuuuguucu

SEQ ID NO: 4042775 - RNA, 12 nt, Staphylococcus aureus subsp. aureus N315
ucuagaauauaa

SEQ ID NO: 4042776 - RNA, 24 nt, Staphylococcus aureus subsp. aureus N315
ucuagacuuauuugaaugcaaauc

SEQ ID NO: 4042777 - RNA, 15 nt, Staphylococcus aureus subsp. aureus N315
ucuagagauaacuag

SEQ ID NO: 4042778 - RNA, 15 nt, Staphylococcus aureus subsp. aureus N315
ucuagauuauuuaaa

SEQ ID NO: 4042779 - RNA, 15 nt, Staphylococcus aureus subsp. aureus N315
ucuagauucauauuu

SEQ ID NO: 4042780 - RNA, 22 nt, Staphylococcus aureus subsp. aureus N315
ucuaguacaccucuaaguucac

SEQ ID NO: 4042781 - RNA, 12 nt, Staphylococcus aureus subsp. aureus N315
ucucuucuggag

SEQ ID NO: 4042782 - RNA, 16 nt, Staphylococcus aureus subsp. aureus N315
ucucuucugucuaaaa

SEQ ID NO: 4042783 - RNA, 15 nt, Staphylococcus aureus subsp. aureus N315
ucucuuucuuauuca

SEQ ID NO: 4042784 - RNA, 14 nt, Staphylococcus aureus subsp. aureus N315
ucucuuuucacgaa

SEQ ID NO: 4042785 - RNA, 19 nt, Staphylococcus aureus subsp. aureus N315
ucugaaaaaauuaauaauu

SEQ ID NO: 4042786 - RNA, 19 nt, Staphylococcus aureus subsp. aureus N315
ucugaaaugauacauuauu

SEQ ID NO: 4042787 - RNA, 12 nt, Staphylococcus aureus subsp. aureus N315
ucugaaucugaa

SEQ ID NO: 4042788 - RNA, 12 nt, Staphylococcus aureus subsp. aureus N315
ucugaauuuagg

SEQ ID NO: 4042789 - RNA, 20 nt, Staphylococcus aureus subsp. aureus N315
ucugacauuguugcuaaucu

SEQ ID NO: 4042790 - RNA, 22 nt, Staphylococcus aureus subsp. aureus N315
ucugacauuucaucaauaauuu

SEQ ID NO: 4042791 - RNA, 14 nt, Staphylococcus aureus subsp. aureus N315
ucugacuuuuaaaa

SEQ ID NO: 4042792 - RNA, 19 nt, Staphylococcus aureus subsp. aureus N315
ucugagaagaaauauauug

SEQ ID NO: 4042793 - RNA, 19 nt, Staphylococcus aureus subsp. aureus N315
ucugauaauucgaaaucaa

SEQ ID NO: 4042794 - RNA, 22 nt, Staphylococcus aureus subsp. aureus N315
ucugauacuucaccaucuuuaa

SEQ ID NO: 4042795 - RNA, 15 nt, Staphylococcus aureus subsp. aureus N315
ucugaucgacuaauu

SEQ ID NO: 4042796 - RNA, 20 nt, Staphylococcus aureus subsp. aureus N315
ucugaugaggcaauauuaaa

SEQ ID NO: 4042797 - RNA, 17 nt, Staphylococcus aureus subsp. aureus N315
ucugauucuucacuaaa

SEQ ID NO: 4042798 - RNA, 18 nt, Staphylococcus aureus subsp. aureus N315
ucugauuucacuucuaaa

SEQ ID NO: 4042799 - RNA, 23 nt, Staphylococcus aureus subsp. aureus N315
ucugauuucacuucuaaaacuaa

SEQ ID NO: 4042800 - RNA, 13 nt, Staphylococcus aureus subsp. aureus N315
ucugcaauuucau

SEQ ID NO: 4042801 - RNA, 19 nt, Staphylococcus aureus subsp. aureus N315
ucugcaugggcuucugcua

SEQ ID NO: 4042802 - RNA, 15 nt, Staphylococcus aureus subsp. aureus N315
ucugcccugcaaugc

SEQ ID NO: 4042803 - RNA, 21 nt, Staphylococcus aureus subsp. aureus N315
ucugcuaacucugaucuaaaa

SEQ ID NO: 4042804 - RNA, 14 nt, Staphylococcus aureus subsp. aureus N315
ucugcuacuuguug

SEQ ID NO: 4042805 - RNA, 17 nt, Staphylococcus aureus subsp. aureus N315
ucugcucuuuuuguaug

SEQ ID NO: 4042806 - RNA, 14 nt, Staphylococcus aureus subsp. aureus N315
ucugcuucuuuuaa

SEQ ID NO: 4042807 - RNA, 11 nt, Staphylococcus aureus subsp. aureus N315
ucugcuuuauu

SEQ ID NO: 4042808 - RNA, 15 nt, Staphylococcus aureus subsp. aureus N315
ucugcuuuauuuuau

SEQ ID NO: 4042809 - RNA, 13 nt, Staphylococcus aureus subsp. aureus N315
ucugcuuucgcuu

SEQ ID NO: 4042810 - RNA, 15 nt, Staphylococcus aureus subsp. aureus N315
ucuggaacuuuaaua

SEQ ID NO: 4042811 - RNA, 14 nt, Staphylococcus aureus subsp. aureus N315
ucuggcacauuacu

SEQ ID NO: 4042812 - RNA, 20 nt, Staphylococcus aureus subsp. aureus N315
ucuggcacauuacuguaaaa

SEQ ID NO: 4042813 - RNA, 17 nt, Staphylococcus aureus subsp. aureus N315
ucugguaaaaaaauaac

SEQ ID NO: 4042814 - RNA, 22 nt, Staphylococcus aureus subsp. aureus N315
ucugguauuuuaugacguaauu

SEQ ID NO: 4042815 - RNA, 20 nt, Staphylococcus aureus subsp. aureus N315
ucugguucuuuacuaaagau

SEQ ID NO: 4042816 - RNA, 15 nt, Staphylococcus aureus subsp. aureus N315
ucuguaaauaacuua

SEQ ID NO: 4042817 - RNA, 22 nt, Staphylococcus aureus subsp. aureus N315
ucuguaaauuaucuaaagaaau

SEQ ID NO: 4042818 - RNA, 22 nt, Staphylococcus aureus subsp. aureus N315
ucuguaauaugaaggcuuuuug

SEQ ID NO: 4042819 - RNA, 13 nt, Staphylococcus aureus subsp. aureus N315
ucuguaauuaauc

SEQ ID NO: 4042820 - RNA, 15 nt, Staphylococcus aureus subsp. aureus N315
ucuguaccguauuuu

SEQ ID NO: 4042821 - RNA, 20 nt, Staphylococcus aureus subsp. aureus N315
ucuguacguuuuaaauaaau

SEQ ID NO: 4042822 - RNA, 12 nt, Staphylococcus aureus subsp. aureus N315
ucuguacuucua

SEQ ID NO: 4042823 - RNA, 19 nt, Staphylococcus aureus subsp. aureus N315
ucuguagcgauaccuuuaa

SEQ ID NO: 4042824 - RNA, 21 nt, Staphylococcus aureus subsp. aureus N315
ucuguauccucgguauuuaau

SEQ ID NO: 4042825 - RNA, 14 nt, Staphylococcus aureus subsp. aureus N315
ucugucaaauugga

SEQ ID NO: 4042826 - RNA, 21 nt, Staphylococcus aureus subsp. aureus N315
ucuguccgauaucuuuuaauu

SEQ ID NO: 4042827 - RNA, 17 nt, Staphylococcus aureus subsp. aureus N315
ucugucuaaaaacauaa

SEQ ID NO: 4042828 - RNA, 14 nt, Staphylococcus aureus subsp. aureus N315
ucuguguaaauaua

SEQ ID NO: 4042829 - RNA, 15 nt, Staphylococcus aureus subsp. aureus N315
ucuguguaaauauaa

SEQ ID NO: 4042830 - RNA, 22 nt, Staphylococcus aureus subsp. aureus N315
ucuguguuggggcccacacccc

SEQ ID NO: 4042831 - RNA, 18 nt, Staphylococcus aureus subsp. aureus N315
ucuguuaacugaauuucg

SEQ ID NO: 4042832 - RNA, 19 nt, Staphylococcus aureus subsp. aureus N315
ucuguuacagguuuuaaaa

SEQ ID NO: 4042833 - RNA, 23 nt, Staphylococcus aureus subsp. aureus N315
ucuguuacagguuuuaaaauuaa

SEQ ID NO: 4042834 - RNA, 19 nt, Staphylococcus aureus subsp. aureus N315
ucuguuccucaauaggaau

SEQ ID NO: 4042835 - RNA, 20 nt, Staphylococcus aureus subsp. aureus N315
ucuguugaagucaauaauuu

SEQ ID NO: 4042836 - RNA, 16 nt, Staphylococcus aureus subsp. aureus N315
ucuguuguuucgaugg

SEQ ID NO: 4042837 - RNA, 11 nt, Staphylococcus aureus subsp. aureus N315
ucuuaaaacaa

SEQ ID NO: 4042838 - RNA, 15 nt, Staphylococcus aureus subsp. aureus N315
ucuuaaacauaacau

SEQ ID NO: 4042839 - RNA, 22 nt, Staphylococcus aureus subsp. aureus N315
ucuuaaaucacuagcuaaugca

SEQ ID NO: 4042840 - RNA, 16 nt, Staphylococcus aureus subsp. aureus N315
ucuuaacaacaugauu

SEQ ID NO: 4042841 - RNA, 18 nt, Staphylococcus aureus subsp. aureus N315
ucuuaacaacuuuaauuu

SEQ ID NO: 4042842 - RNA, 13 nt, Staphylococcus aureus subsp. aureus N315
ucuuaaguacaua

SEQ ID NO: 4042843 - RNA, 17 nt, Staphylococcus aureus subsp. aureus N315
ucuuaaucuaaaaauag

SEQ ID NO: 4042844 - RNA, 14 nt, Staphylococcus aureus subsp. aureus N315
ucuuaauguacuuu

SEQ ID NO: 4042845 - RNA, 13 nt, Staphylococcus aureus subsp. aureus N315
ucuuaauuaucau

SEQ ID NO: 4042846 - RNA, 14 nt, Staphylococcus aureus subsp. aureus N315
ucuuaauucuucug

SEQ ID NO: 4042847 - RNA, 17 nt, Staphylococcus aureus subsp. aureus N315
ucuuaccauuuauccuu

SEQ ID NO: 4042848 - RNA, 23 nt, Staphylococcus aureus subsp. aureus N315
ucuuacuacuuaauuaauaauuu

SEQ ID NO: 4042849 - RNA, 17 nt, Staphylococcus aureus subsp. aureus N315
ucuuacucauuuuucuu

SEQ ID NO: 4042850 - RNA, 18 nt, Staphylococcus aureus subsp. aureus N315
ucuuacugcaauuauuuu

SEQ ID NO: 4042851 - RNA, 21 nt, Staphylococcus aureus subsp. aureus N315
ucuuacugcugcuuuuaauau

SEQ ID NO: 4042852 - RNA, 20 nt, Staphylococcus aureus subsp. aureus N315
ucuuacugcuguucucuauu

SEQ ID NO: 4042853 - RNA, 19 nt, Staphylococcus aureus subsp. aureus N315
ucuuacugcuguuuuuuau

SEQ ID NO: 4042854 - RNA, 14 nt, Staphylococcus aureus subsp. aureus N315
ucuuagauauuauu

SEQ ID NO: 4042855 - RNA, 20 nt, Staphylococcus aureus subsp. aureus N315
ucuuagauuuucacuaauau

SEQ ID NO: 4042856 - RNA, 22 nt, Staphylococcus aureus subsp. aureus N315
ucuuagauuuucacuaauauuu

SEQ ID NO: 4042857 - RNA, 22 nt, Staphylococcus aureus subsp. aureus N315
ucuuauaaagacaccuucaaua

SEQ ID NO: 4042858 - RNA, 13 nt, Staphylococcus aureus subsp. aureus N315
ucuuauaacaaaa

SEQ ID NO: 4042859 - RNA, 17 nt, Staphylococcus aureus subsp. aureus N315
ucuuaucaagaauauaa

SEQ ID NO: 4042860 - RNA, 16 nt, Staphylococcus aureus subsp. aureus N315
ucuuaucaauuagcca

SEQ ID NO: 4042861 - RNA, 23 nt, Staphylococcus aureus subsp. aureus N315
ucuuaucgaaagaugauauauuc

SEQ ID NO: 4042862 - RNA, 16 nt, Staphylococcus aureus subsp. aureus N315
ucuuauuuguuuaauu

SEQ ID NO: 4042863 - RNA, 19 nt, Staphylococcus aureus subsp. aureus N315
ucuuauuuguuuaauuauc

SEQ ID NO: 4042864 - RNA, 18 nt, Staphylococcus aureus subsp. aureus N315
ucuuauuuuguuuuaaaa

SEQ ID NO: 4042865 - RNA, 20 nt, Staphylococcus aureus subsp. aureus N315
ucuuauuuuguuuuaaaaaa

SEQ ID NO: 4042866 - RNA, 14 nt, Staphylococcus aureus subsp. aureus N315
ucuucaaaaaauaa

SEQ ID NO: 4042867 - RNA, 14 nt, Staphylococcus aureus subsp. aureus N315
ucuucaaaacguuu

SEQ ID NO: 4042868 - RNA, 21 nt, Staphylococcus aureus subsp. aureus N315
ucuucaaaguagauauugaau

SEQ ID NO: 4042869 - RNA, 17 nt, Staphylococcus aureus subsp. aureus N315
ucuuuggucuaaagcuu

SEQ ID NO: 4042870 - RNA, 22 nt, Staphylococcus aureus subsp. aureus N315
ucuuuggucuaaagcuuauuaa

SEQ ID NO: 4042871 - RNA, 15 nt, Staphylococcus aureus subsp. aureus N315
ucuuuggugaaagua

SEQ ID NO: 4042872 - RNA, 14 nt, Staphylococcus aureus subsp. aureus N315
ucuuuguaaauuuu

SEQ ID NO: 4042873 - RNA, 19 nt, Staphylococcus aureus subsp. aureus N315
ucuuuguaaccuaaaaaca

SEQ ID NO: 4042874 - RNA, 15 nt, Staphylococcus aureus subsp. aureus N315
ucuuugucaucuuuu

SEQ ID NO: 4042875 - RNA, 19 nt, Staphylococcus aureus subsp. aureus N315
ucuuugucaucuuuugucu

SEQ ID NO: 4042876 - RNA, 18 nt, Staphylococcus aureus subsp. aureus N315
ucuuuguguuugcuuuuu

SEQ ID NO: 4042877 - RNA, 18 nt, Staphylococcus aureus subsp. aureus N315
ucuuuguugcaaugcaua

SEQ ID NO: 4042878 - RNA, 22 nt, Staphylococcus aureus subsp. aureus N315
ucuuuguuggggcccacacccc

SEQ ID NO: 4042879 - RNA, 16 nt, Staphylococcus aureus subsp. aureus N315
ucuuuguuuuuaauuu

SEQ ID NO: 4042880 - RNA, 18 nt, Staphylococcus aureus subsp. aureus N315
ucuuuguuuuuaauuuuu

SEQ ID NO: 4042881 - RNA, 16 nt, Staphylococcus aureus subsp. aureus N315
ucuuuuaaauucuuau

SEQ ID NO: 4042882 - RNA, 20 nt, Staphylococcus aureus subsp. aureus N315
ucuuuuaaauucuuauaaaa

SEQ ID NO: 4042883 - RNA, 22 nt, Staphylococcus aureus subsp. aureus N315
ucuuuuaaauucuuauaaaaua

SEQ ID NO: 4042884 - RNA, 20 nt, Staphylococcus aureus subsp. aureus N315
ucuuuuaauagaucuuugua

SEQ ID NO: 4042885 - RNA, 12 nt, Staphylococcus aureus subsp. aureus N315
ucuuuuaauucu

SEQ ID NO: 4042886 - RNA, 21 nt, Staphylococcus aureus subsp. aureus N315
ucuuuuauacauguacauuau

SEQ ID NO: 4042887 - RNA, 13 nt, Staphylococcus aureus subsp. aureus N315
ucuuuuauauuuu

SEQ ID NO: 4042888 - RNA, 17 nt, Staphylococcus aureus subsp. aureus N315
ucuuuuauauuuuuauc

SEQ ID NO: 4042889 - RNA, 22 nt, Staphylococcus aureus subsp. aureus N315
ucuuuuauauuuuuaucaucuu

SEQ ID NO: 4042890 - RNA, 15 nt, Staphylococcus aureus subsp. aureus N315
ucuuuuauuuucaua

SEQ ID NO: 4042891 - RNA, 17 nt, Staphylococcus aureus subsp. aureus N315
ucuuuucaaaaauaguc

SEQ ID NO: 4042892 - RNA, 20 nt, Staphylococcus aureus subsp. aureus N315
ucuuuuccaaaacaaaaaua

SEQ ID NO: 4042893 - RNA, 13 nt, Staphylococcus aureus subsp. aureus N315
ucuuuucgaaaau

SEQ ID NO: 4042894 - RNA, 20 nt, Staphylococcus aureus subsp. aureus N315
ucuuuucgaaaaucucugua

SEQ ID NO: 4042895 - RNA, 22 nt, Staphylococcus aureus subsp. aureus N315
ucuuuucgaaauucucuuuguu

SEQ ID NO: 4042896 - RNA, 12 nt, Staphylococcus aureus subsp. aureus N315
ucuuuucuuuga

SEQ ID NO: 4042897 - RNA, 21 nt, Staphylococcus aureus subsp. aureus N315
ucuuuugagacguuuuccaug

SEQ ID NO: 4042898 - RNA, 21 nt, Staphylococcus aureus subsp. aureus N315
ucuuuugcaaaacgcauuuca

SEQ ID NO: 4042899 - RNA, 23 nt, Staphylococcus aureus subsp. aureus N315
ucuuuugcaaauuggaaaaauaa

SEQ ID NO: 4042900 - RNA, 14 nt, Staphylococcus aureus subsp. aureus N315
ucuuuuguaauaau

SEQ ID NO: 4042901 - RNA, 12 nt, Staphylococcus aureus subsp. aureus N315
ucuuuuguuuua

SEQ ID NO: 4042902 - RNA, 13 nt, Staphylococcus aureus subsp. aureus N315
ucuuuuguuuuca

SEQ ID NO: 4042903 - RNA, 21 nt, Staphylococcus aureus subsp. aureus N315
ucuuuuguuuucacuguuuua

SEQ ID NO: 4042904 - RNA, 13 nt, Staphylococcus aureus subsp. aureus N315
ucuuuuucuaaau

SEQ ID NO: 4042905 - RNA, 17 nt, Staphylococcus aureus subsp. aureus N315
ucuuuuucuaaauaaac

SEQ ID NO: 4042906 - RNA, 17 nt, Staphylococcus aureus subsp. aureus N315
ucuuuuucuuucauaau

SEQ ID NO: 4042907 - RNA, 19 nt, Staphylococcus aureus subsp. aureus N315
ucuuuuugaucaacuauau

SEQ ID NO: 4042908 - RNA, 18 nt, Staphylococcus aureus subsp. aureus N315
ucuuuuugcguuuuuaaa

SEQ ID NO: 4042909 - RNA, 21 nt, Staphylococcus aureus subsp. aureus N315
ucuuuuugcguuuuuaaauaa

SEQ ID NO: 4042910 - RNA, 15 nt, Staphylococcus aureus subsp. aureus N315
ucuuuuuguccccag

SEQ ID NO: 4042911 - RNA, 16 nt, Staphylococcus aureus subsp. aureus N315
ucuuuuuguuguuuua

SEQ ID NO: 4042912 - RNA, 19 nt, Staphylococcus aureus subsp. aureus N315
ucuuuuuguuguuuuaauu

SEQ ID NO: 4042913 - RNA, 11 nt, Staphylococcus aureus subsp. aureus N315
ucuuuuuguuu

SEQ ID NO: 4042914 - RNA, 19 nt, Staphylococcus aureus subsp. aureus N315
ucuuuuuuauuaaguauau

SEQ ID NO: 4042915 - RNA, 15 nt, Staphylococcus aureus subsp. aureus N315
ucuuuuuuauuuaau

SEQ ID NO: 4042916 - RNA, 17 nt, Staphylococcus aureus subsp. aureus N315
ucuuuuuuauuuaauua

SEQ ID NO: 4042917 - RNA, 19 nt, Staphylococcus aureus subsp. aureus N315
ucuuuuuuauuuaauuauu

SEQ ID NO: 4042918 - RNA, 23 nt, Staphylococcus aureus subsp. aureus N315
ucuuuuuuuaacuuccuaaaauu

SEQ ID NO: 4042919 - RNA, 13 nt, Staphylococcus aureus subsp. aureus N315
ucuuuuuuuaaug

SEQ ID NO: 4042920 - RNA, 22 nt, Staphylococcus aureus subsp. aureus N315
ucuuuuuuuaauguguaaauuu

SEQ ID NO: 4042921 - RNA, 17 nt, Staphylococcus aureus subsp. aureus N315
ugaaaaagcuaauucuu

SEQ ID NO: 4042922 - RNA, 12 nt, Staphylococcus aureus subsp. aureus N315
ugaaaaaguaaa

SEQ ID NO: 4042923 - RNA, 17 nt, Staphylococcus aureus subsp. aureus N315
ugaaaaaguuucggaaa

SEQ ID NO: 4042924 - RNA, 23 nt, Staphylococcus aureus subsp. aureus N315
ugaaaaauauccuggaauauuaa

SEQ ID NO: 4042925 - RNA, 15 nt, Staphylococcus aureus subsp. aureus N315
ugaaaaauuaaaaaa

SEQ ID NO: 4042926 - RNA, 14 nt, Staphylococcus aureus subsp. aureus N315
ugaaaacauuauua

SEQ ID NO: 4042927 - RNA, 11 nt, Staphylococcus aureus subsp. aureus N315
ugaaaacuucu

SEQ ID NO: 4042928 - RNA, 13 nt, Staphylococcus aureus subsp. aureus N315
ugaaaagauaaac

SEQ ID NO: 4042929 - RNA, 20 nt, Staphylococcus aureus subsp. aureus N315
ugaaaaggacuuaguagauu

SEQ ID NO: 4042930 - RNA, 12 nt, Staphylococcus aureus subsp. aureus N315
ugaaaauaauac

SEQ ID NO: 4042931 - RNA, 19 nt, Staphylococcus aureus subsp. aureus N315
ugaaaauaaucgaacagaa

SEQ ID NO: 4042932 - RNA, 13 nt, Staphylococcus aureus subsp. aureus N315
ugaaaauaaucuu

SEQ ID NO: 4042933 - RNA, 18 nt, Staphylococcus aureus subsp. aureus N315
ugaaaauaccaagugcuu

SEQ ID NO: 4042934 - RNA, 16 nt, Staphylococcus aureus subsp. aureus N315
ugaaaauagccauauu

SEQ ID NO: 4042935 - RNA, 13 nt, Staphylococcus aureus subsp. aureus N315
ugaaaaucuuuaa

SEQ ID NO: 4042936 - RNA, 16 nt, Staphylococcus aureus subsp. aureus N315
ugaaaaucuuuaacuc

SEQ ID NO: 4042937 - RNA, 22 nt, Staphylococcus aureus subsp. aureus N315
ugaaaauuucaccgcuuucaau

SEQ ID NO: 4042938 - RNA, 20 nt, Staphylococcus aureus subsp. aureus N315
ugaaaauuuguauaaagauu

SEQ ID NO: 4042939 - RNA, 14 nt, Staphylococcus aureus subsp. aureus N315
ugaaacuaaauuaa

SEQ ID NO: 4042940 - RNA, 19 nt, Staphylococcus aureus subsp. aureus N315
ugaaacuaaauuaaaagug

SEQ ID NO: 4042941 - RNA, 18 nt, Staphylococcus aureus subsp. aureus N315
ugaaacugaguucaauua

SEQ ID NO: 4042942 - RNA, 16 nt, Staphylococcus aureus subsp. aureus N315
ugaaacuuuaauacua

SEQ ID NO: 4042943 - RNA, 19 nt, Staphylococcus aureus subsp. aureus N315
ugaaagaaaagugaaaacu

SEQ ID NO: 4042944 - RNA, 20 nt, Staphylococcus aureus subsp. aureus N315
ugaaagacugacuaauaaaa

SEQ ID NO: 4042945 - RNA, 14 nt, Staphylococcus aureus subsp. aureus N315
ugaaagauacugcu

SEQ ID NO: 4042946 - RNA, 23 nt, Staphylococcus aureus subsp. aureus N315
ugaaaggaguauuuuugcguuaa

SEQ ID NO: 4042947 - RNA, 23 nt, Staphylococcus aureus subsp. aureus N315
ugaaaguaccgguuuuucguaua

SEQ ID NO: 4042948 - RNA, 14 nt, Staphylococcus aureus subsp. aureus N315
ugaaaguaccuaaa

SEQ ID NO: 4042949 - RNA, 19 nt, Staphylococcus aureus subsp. aureus N315
ugaaaguaccuaaaauaga

SEQ ID NO: 4042950 - RNA, 20 nt, Staphylococcus aureus subsp. aureus N315
ugaaaguaccuaaaauagaa

SEQ ID NO: 4042951 - RNA, 19 nt, Staphylococcus aureus subsp. aureus N315
ugaaaguuuuugucuuaau

SEQ ID NO: 4042952 - RNA, 14 nt, Staphylococcus aureus subsp. aureus N315
ugaaauaauauaaa

SEQ ID NO: 4042953 - RNA, 19 nt, Staphylococcus aureus subsp. aureus N315
ugaaauaauauaaaaacaa

SEQ ID NO: 4042954 - RNA, 22 nt, Staphylococcus aureus subsp. aureus N315
ugaaauaccuccugauugcugc

SEQ ID NO: 4042955 - RNA, 14 nt, Staphylococcus aureus subsp. aureus N315
ugaaauagaaacua

SEQ ID NO: 4042956 - RNA, 22 nt, Staphylococcus aureus subsp. aureus N315
ugaaauaggcgcuuguaaaauu

SEQ ID NO: 4042957 - RNA, 13 nt, Staphylococcus aureus subsp. aureus N315
ugaauauagcugu

SEQ ID NO: 4042958 - RNA, 14 nt, Staphylococcus aureus subsp. aureus N315
ugaauaucuaaugc

SEQ ID NO: 4042959 - RNA, 16 nt, Staphylococcus aureus subsp. aureus N315
ugaauaugauauuaag

SEQ ID NO: 4042960 - RNA, 17 nt, Staphylococcus aureus subsp. aureus N315
ugaauauggaaaaugua

SEQ ID NO: 4042961 - RNA, 20 nt, Staphylococcus aureus subsp. aureus N315
ugaauauggaaaauguauua

SEQ ID NO: 4042962 - RNA, 23 nt, Staphylococcus aureus subsp. aureus N315
ugaauauuuuucaauuaaauguu

SEQ ID NO: 4042963 - RNA, 20 nt, Staphylococcus aureus subsp. aureus N315
ugaaucgauauaaugaaguu

SEQ ID NO: 4042964 - RNA, 21 nt, Staphylococcus aureus subsp. aureus N315
ugaaucuaaacuauaauaauu

SEQ ID NO: 4042965 - RNA, 16 nt, Staphylococcus aureus subsp. aureus N315
ugaaucuagaauauaa

SEQ ID NO: 4042966 - RNA, 13 nt, Staphylococcus aureus subsp. aureus N315
ugaaugaaccuuu

SEQ ID NO: 4042967 - RNA, 21 nt, Staphylococcus aureus subsp. aureus N315
ugaaugaaguaauauauaaaa

SEQ ID NO: 4042968 - RNA, 16 nt, Staphylococcus aureus subsp. aureus N315
ugaaugauugcauuga

SEQ ID NO: 4042969 - RNA, 17 nt, Staphylococcus aureus subsp. aureus N315
ugaauggagcaugauua

SEQ ID NO: 4042970 - RNA, 16 nt, Staphylococcus aureus subsp. aureus N315
ugaauggcaaauauga

SEQ ID NO: 4042971 - RNA, 19 nt, Staphylococcus aureus subsp. aureus N315
ugaaugggucauuaaauga

SEQ ID NO: 4042972 - RNA, 23 nt, Staphylococcus aureus subsp. aureus N315
ugaauguuggaucggcauuguaa

SEQ ID NO: 4042973 - RNA, 20 nt, Staphylococcus aureus subsp. aureus N315
ugaauguuuucuaaaucuaa

SEQ ID NO: 4042974 - RNA, 17 nt, Staphylococcus aureus subsp. aureus N315
ugaauuaaagcaucgaa

SEQ ID NO: 4042975 - RNA, 12 nt, Staphylococcus aureus subsp. aureus N315
ugaauuaacaau

SEQ ID NO: 4042976 - RNA, 18 nt, Staphylococcus aureus subsp. aureus N315
ugaauuauuuaaaaugcu

SEQ ID NO: 4042977 - RNA, 19 nt, Staphylococcus aureus subsp. aureus N315
ugaauuauuuaaaaugcuu

SEQ ID NO: 4042978 - RNA, 16 nt, Staphylococcus aureus subsp. aureus N315
ugaauucauucaauac

SEQ ID NO: 4042979 - RNA, 14 nt, Staphylococcus aureus subsp. aureus N315
ugaauucauuuuau

SEQ ID NO: 4042980 - RNA, 13 nt, Staphylococcus aureus subsp. aureus N315
ugaauugaaaaau

SEQ ID NO: 4042981 - RNA, 19 nt, Staphylococcus aureus subsp. aureus N315
ugaauugaguauuaaauuu

SEQ ID NO: 4042982 - RNA, 20 nt, Staphylococcus aureus subsp. aureus N315
ugaauugaguauuaaauuug

SEQ ID NO: 4042983 - RNA, 14 nt, Staphylococcus aureus subsp. aureus N315
ugaauugauuauaa

SEQ ID NO: 4042984 - RNA, 17 nt, Staphylococcus aureus subsp. aureus N315
ugaauugcuuguuuuaa

SEQ ID NO: 4042985 - RNA, 13 nt, Staphylococcus aureus subsp. aureus N315
ugaauuguuaguu

SEQ ID NO: 4042986 - RNA, 14 nt, Staphylococcus aureus subsp. aureus N315
ugaauuuagaugca

SEQ ID NO: 4042987 - RNA, 17 nt, Staphylococcus aureus subsp. aureus N315
ugaauuuagaugcauaa

SEQ ID NO: 4042988 - RNA, 21 nt, Staphylococcus aureus subsp. aureus N315
ugaauuuagaugcauaaaaaa

SEQ ID NO: 4042989 - RNA, 21 nt, Staphylococcus aureus subsp. aureus N315
ugaauuuagcaucaaaaauaa

SEQ ID NO: 4042990 - RNA, 23 nt, Staphylococcus aureus subsp. aureus N315
ugaauuuagcaucaaaaauaaaa

SEQ ID NO: 4042991 - RNA, 14 nt, Staphylococcus aureus subsp. aureus N315
ugaauuuauuuugu

SEQ ID NO: 4042992 - RNA, 21 nt, Staphylococcus aureus subsp. aureus N315
ugaauuuauuuuguaguuccu

SEQ ID NO: 4042993 - RNA, 14 nt, Staphylococcus aureus subsp. aureus N315
ugaauuucaaaaua

SEQ ID NO: 4042994 - RNA, 21 nt, Staphylococcus aureus subsp. aureus N315
ugaauuuuaauauauuuggag

SEQ ID NO: 4042995 - RNA, 15 nt, Staphylococcus aureus subsp. aureus N315
ugaauuuuauaaauu

SEQ ID NO: 4042996 - RNA, 24 nt, Staphylococcus aureus subsp. aureus N315
ugaauuuuauaaguauauaauuga

SEQ ID NO: 4042997 - RNA, 23 nt, Staphylococcus aureus subsp. aureus N315
ugaauuuuauuagguaauacuuu

SEQ ID NO: 4042998 - RNA, 14 nt, Staphylococcus aureus subsp. aureus N315
ugacaacauaacaa

SEQ ID NO: 4042999 - RNA, 19 nt, Staphylococcus aureus subsp. aureus N315
ugacaaguaugucaucuuc

SEQ ID NO: 4043000 - RNA, 17 nt, Staphylococcus aureus subsp. aureus N315
ugacacacccaaauuua

SEQ ID NO: 4043001 - RNA, 15 nt, Staphylococcus aureus subsp. aureus N315
ugacacauuauugaa

SEQ ID NO: 4043002 - RNA, 19 nt, Staphylococcus aureus subsp. aureus N315
ugacaccuaauaccauugu

SEQ ID NO: 4043003 - RNA, 22 nt, Staphylococcus aureus subsp. aureus N315
ugacaccuauauuuuuagcuuu

SEQ ID NO: 4043004 - RNA, 17 nt, Staphylococcus aureus subsp. aureus N315
ugacacuugugccaaca

SEQ ID NO: 4043005 - RNA, 23 nt, Staphylococcus aureus subsp. aureus N315
ugacaguuuccauaaauaaaaug

SEQ ID NO: 4043006 - RNA, 23 nt, Staphylococcus aureus subsp. aureus N315
ugacaguuuuaaaugaaacuuug

SEQ ID NO: 4043007 - RNA, 13 nt, Staphylococcus aureus subsp. aureus N315
ugacauaaaacuu

SEQ ID NO: 4043008 - RNA, 23 nt, Staphylococcus aureus subsp. aureus N315
ugacauaauccagccacaccaaa

SEQ ID NO: 4043009 - RNA, 21 nt, Staphylococcus aureus subsp. aureus N315
ugacauauuuuuuaaauuuaa

SEQ ID NO: 4043010 - RNA, 15 nt, Staphylococcus aureus subsp. aureus N315
ugacauccauacaaa

SEQ ID NO: 4043011 - RNA, 15 nt, Staphylococcus aureus subsp. aureus N315
ugacaucuauuucuu

SEQ ID NO: 4043012 - RNA, 19 nt, Staphylococcus aureus subsp. aureus N315
ugacauguguuaaaccaac

SEQ ID NO: 4043013 - RNA, 12 nt, Staphylococcus aureus subsp. aureus N315
ugacauuucuga

SEQ ID NO: 4043014 - RNA, 17 nt, Staphylococcus aureus subsp. aureus N315
ugaccauuaucaagaac

SEQ ID NO: 4043015 - RNA, 17 nt, Staphylococcus aureus subsp. aureus N315
ugaccauugucaugccu

SEQ ID NO: 4043016 - RNA, 17 nt, Staphylococcus aureus subsp. aureus N315
ugaccuacuuuuucaau

SEQ ID NO: 4043017 - RNA, 12 nt, Staphylococcus aureus subsp. aureus N315
ugaccucagguu

SEQ ID NO: 4043018 - RNA, 17 nt, Staphylococcus aureus subsp. aureus N315
ugaccuuauauuuuauu

SEQ ID NO: 4043019 - RNA, 21 nt, Staphylococcus aureus subsp. aureus N315
ugaccuuauauuuuauuuaaa

SEQ ID NO: 4043020 - RNA, 14 nt, Staphylococcus aureus subsp. aureus N315
ugaccuucaguuuc

SEQ ID NO: 4043021 - RNA, 16 nt, Staphylococcus aureus subsp. aureus N315
ugaccuucaguuucua

SEQ ID NO: 4043022 - RNA, 21 nt, Staphylococcus aureus subsp. aureus N315
ugacgaacgauagauucugau

SEQ ID NO: 4043023 - RNA, 17 nt, Staphylococcus aureus subsp. aureus N315
ugacgauuuaauuaaaa

SEQ ID NO: 4043024 - RNA, 18 nt, Staphylococcus aureus subsp. aureus N315
ugacgcgugaauuaaaaa

SEQ ID NO: 4043025 - RNA, 16 nt, Staphylococcus aureus subsp. aureus N315
ugacgcugguaauauu

SEQ ID NO: 4043026 - RNA, 16 nt, Staphylococcus aureus subsp. aureus N315
ugacgugcuuuuaaau

SEQ ID NO: 4043027 - RNA, 19 nt, Staphylococcus aureus subsp. aureus N315
ugacgugcuuuuaaaugua

SEQ ID NO: 4043028 - RNA, 19 nt, Staphylococcus aureus subsp. aureus N315
ugacguucugaucggcuuu

SEQ ID NO: 4043029 - RNA, 14 nt, Staphylococcus aureus subsp. aureus N315
ugacguugugucau

SEQ ID NO: 4043030 - RNA, 18 nt, Staphylococcus aureus subsp. aureus N315
ugacguugugucaugcug

SEQ ID NO: 4043031 - RNA, 22 nt, Staphylococcus aureus subsp. aureus N315
ugacuacucaauccuaaauuau

SEQ ID NO: 4043032 - RNA, 13 nt, Staphylococcus aureus subsp. aureus N315
ugacuagggguuu

SEQ ID NO: 4043033 - RNA, 19 nt, Staphylococcus aureus subsp. aureus N315
ugacuagggguuuuuaaua

SEQ ID NO: 4043034 - RNA, 23 nt, Staphylococcus aureus subsp. aureus N315
ugacuauuucgcuuuuuuuauuu

SEQ ID NO: 4043035 - RNA, 21 nt, Staphylococcus aureus subsp. aureus N315
ugacucggggaauuuuuaugc

SEQ ID NO: 4043036 - RNA, 18 nt, Staphylococcus aureus subsp. aureus N315
ugacugaaugagaaugug

SEQ ID NO: 4043037 - RNA, 16 nt, Staphylococcus aureus subsp. aureus N315
ugacugaauuaauauc

SEQ ID NO: 4043038 - RNA, 17 nt, Staphylococcus aureus subsp. aureus N315
ugacugagaaaaauauu

SEQ ID NO: 4043039 - RNA, 21 nt, Staphylococcus aureus subsp. aureus N315
ugacugagaaaaauauuucua

SEQ ID NO: 4043040 - RNA, 16 nt, Staphylococcus aureus subsp. aureus N315
ugacugcaaauacgag

SEQ ID NO: 4043041 - RNA, 17 nt, Staphylococcus aureus subsp. aureus N315
ugacugugaagcugugc

SEQ ID NO: 4043042 - RNA, 18 nt, Staphylococcus aureus subsp. aureus N315
ugacuuauuuuucaucau

SEQ ID NO: 4043043 - RNA, 15 nt, Staphylococcus aureus subsp. aureus N315
ugacuuccuuaguca

SEQ ID NO: 4043044 - RNA, 16 nt, Staphylococcus aureus subsp. aureus N315
ugauagcuaaugcauu

SEQ ID NO: 4043045 - RNA, 17 nt, Staphylococcus aureus subsp. aureus N315
ugauagcuaaugcauua

SEQ ID NO: 4043046 - RNA, 18 nt, Staphylococcus aureus subsp. aureus N315
ugauagcuaaugcauuau

SEQ ID NO: 4043047 - RNA, 15 nt, Staphylococcus aureus subsp. aureus N315
ugauaguacauuuau

SEQ ID NO: 4043048 - RNA, 14 nt, Staphylococcus aureus subsp. aureus N315
ugauagugaauaau

SEQ ID NO: 4043049 - RNA, 20 nt, Staphylococcus aureus subsp. aureus N315
ugauaguguaugaauggcaa

SEQ ID NO: 4043050 - RNA, 19 nt, Staphylococcus aureus subsp. aureus N315
ugauauaaaaagugaaagu

SEQ ID NO: 4043051 - RNA, 14 nt, Staphylococcus aureus subsp. aureus N315
ugauauaauagaaa

SEQ ID NO: 4043052 - RNA, 19 nt, Staphylococcus aureus subsp. aureus N315
ugauauaccuugauucauu

SEQ ID NO: 4043053 - RNA, 19 nt, Staphylococcus aureus subsp. aureus N315
ugauauacgacaaucacag

SEQ ID NO: 4043054 - RNA, 18 nt, Staphylococcus aureus subsp. aureus N315
ugauauacuugaagaaaa

SEQ ID NO: 4043055 - RNA, 17 nt, Staphylococcus aureus subsp. aureus N315
ugauauauaaccauagu

SEQ ID NO: 4043056 - RNA, 17 nt, Staphylococcus aureus subsp. aureus N315
ugauauauguaacauaa

SEQ ID NO: 4043057 - RNA, 15 nt, Staphylococcus aureus subsp. aureus N315
ugauauauucaucuc

SEQ ID NO: 4043058 - RNA, 18 nt, Staphylococcus aureus subsp. aureus N315
ugauaucacuauacaauc

SEQ ID NO: 4043059 - RNA, 22 nt, Staphylococcus aureus subsp. aureus N315
ugauauccaaagcuugauuuaa

SEQ ID NO: 4043060 - RNA, 18 nt, Staphylococcus aureus subsp. aureus N315
ugauaucugacauuucau

SEQ ID NO: 4043061 - RNA, 14 nt, Staphylococcus aureus subsp. aureus N315
ugauaucuugcuug

SEQ ID NO: 4043062 - RNA, 17 nt, Staphylococcus aureus subsp. aureus N315
ugauaugcucucuucaa

SEQ ID NO: 4043063 - RNA, 18 nt, Staphylococcus aureus subsp. aureus N315
ugauaugcucucuucaaa

SEQ ID NO: 4043064 - RNA, 16 nt, Staphylococcus aureus subsp. aureus N315
ugauauguuuccucuu

SEQ ID NO: 4043065 - RNA, 18 nt, Staphylococcus aureus subsp. aureus N315
ugauauguuuccucuuua

SEQ ID NO: 4043066 - RNA, 19 nt, Staphylococcus aureus subsp. aureus N315
ugauauucaacuugauuaa

SEQ ID NO: 4043067 - RNA, 21 nt, Staphylococcus aureus subsp. aureus N315
ugauauugaaaguguaugcau

SEQ ID NO: 4043068 - RNA, 23 nt, Staphylococcus aureus subsp. aureus N315
ugauauuucgguuagucuuaauc

SEQ ID NO: 4043069 - RNA, 23 nt, Staphylococcus aureus subsp. aureus N315
ugauauuugcuagucauaauuua

SEQ ID NO: 4043070 - RNA, 14 nt, Staphylococcus aureus subsp. aureus N315
ugaucaaaaauguu

SEQ ID NO: 4043071 - RNA, 22 nt, Staphylococcus aureus subsp. aureus N315
ugaucaaaaauguuaucuagua

SEQ ID NO: 4043072 - RNA, 14 nt, Staphylococcus aureus subsp. aureus N315
ugaucauaauucag

SEQ ID NO: 4043073 - RNA, 16 nt, Staphylococcus aureus subsp. aureus N315
ugaucauuauaaaaug

SEQ ID NO: 4043074 - RNA, 23 nt, Staphylococcus aureus subsp. aureus N315
ugaucuaaaaccauagagcauuu

SEQ ID NO: 4043075 - RNA, 19 nt, Staphylococcus aureus subsp. aureus N315
ugaucuaaaauaucaucaa

SEQ ID NO: 4043076 - RNA, 15 nt, Staphylococcus aureus subsp. aureus N315
ugaugaaaacaaaca

SEQ ID NO: 4043077 - RNA, 20 nt, Staphylococcus aureus subsp. aureus N315
ugaugaacauaccugcauau

SEQ ID NO: 4043078 - RNA, 14 nt, Staphylococcus aureus subsp. aureus N315
ugaugaacuuaaug

SEQ ID NO: 4043079 - RNA, 17 nt, Staphylococcus aureus subsp. aureus N315
ugaugaacuuaaugcuu

SEQ ID NO: 4043080 - RNA, 13 nt, Staphylococcus aureus subsp. aureus N315
ugaugaacuucua

SEQ ID NO: 4043081 - RNA, 19 nt, Staphylococcus aureus subsp. aureus N315
ugaugaagcaguuguuggu

SEQ ID NO: 4043082 - RNA, 20 nt, Staphylococcus aureus subsp. aureus N315
ugaugaaguaguuucauugc

SEQ ID NO: 4043083 - RNA, 14 nt, Staphylococcus aureus subsp. aureus N315
ugaugaaugauugc

SEQ ID NO: 4043084 - RNA, 20 nt, Staphylococcus aureus subsp. aureus N315
ugaugaaugauugcauugau

SEQ ID NO: 4043085 - RNA, 18 nt, Staphylococcus aureus subsp. aureus N315
ugaugaauuguuguacau

SEQ ID NO: 4043086 - RNA, 20 nt, Staphylococcus aureus subsp. aureus N315
ugaugaauuguuguacaugu

SEQ ID NO: 4043087 - RNA, 12 nt, Staphylococcus aureus subsp. aureus N315
ugaugacaucaa

SEQ ID NO: 4043088 - RNA, 15 nt, Staphylococcus aureus subsp. aureus N315
ugaugagauaaaauc

SEQ ID NO: 4043089 - RNA, 14 nt, Staphylococcus aureus subsp. aureus N315
ugaugauaaauuga

SEQ ID NO: 4043090 - RNA, 19 nt, Staphylococcus aureus subsp. aureus N315
ugaugauacccgcgauacu

SEQ ID NO: 4043091 - RNA, 21 nt, Staphylococcus aureus subsp. aureus N315
ugaugauuuauaaaaacuuau

SEQ ID NO: 4043092 - RNA, 16 nt, Staphylococcus aureus subsp. aureus N315
ugaugcgcuucuaacu

SEQ ID NO: 4043093 - RNA, 23 nt, Staphylococcus aureus subsp. aureus N315
ugaugcuagcuuucuuuuucauc

SEQ ID NO: 4043094 - RNA, 19 nt, Staphylococcus aureus subsp. aureus N315
ugaugcuucgaauuuaaca

SEQ ID NO: 4043095 - RNA, 19 nt, Staphylococcus aureus subsp. aureus N315
ugaugcuugaauguuugaa

SEQ ID NO: 4043096 - RNA, 16 nt, Staphylococcus aureus subsp. aureus N315
ugaugguacuaaaguu

SEQ ID NO: 4043097 - RNA, 17 nt, Staphylococcus aureus subsp. aureus N315
ugauguaacguuucuuu

SEQ ID NO: 4043098 - RNA, 15 nt, Staphylococcus aureus subsp. aureus N315
ugauguaauucuguu

SEQ ID NO: 4043099 - RNA, 16 nt, Staphylococcus aureus subsp. aureus N315
ugaugucauguauugu

SEQ ID NO: 4043100 - RNA, 13 nt, Staphylococcus aureus subsp. aureus N315
ugaugugcuaccu

SEQ ID NO: 4043101 - RNA, 16 nt, Staphylococcus aureus subsp. aureus N315
ugauguguugcauuac

SEQ ID NO: 4043102 - RNA, 23 nt, Staphylococcus aureus subsp. aureus N315
ugauuaaaaguguugacuuuauc

SEQ ID NO: 4043103 - RNA, 22 nt, Staphylococcus aureus subsp. aureus N315
ugauuaaaguguuucaacauau

SEQ ID NO: 4043104 - RNA, 20 nt, Staphylococcus aureus subsp. aureus N315
ugauuaaaucuucaagugcc

SEQ ID NO: 4043105 - RNA, 17 nt, Staphylococcus aureus subsp. aureus N315
ugauuaauuauugagaa

SEQ ID NO: 4043106 - RNA, 13 nt, Staphylococcus aureus subsp. aureus N315
ugauuacaacuua

SEQ ID NO: 4043107 - RNA, 16 nt, Staphylococcus aureus subsp. aureus N315
ugauuacaacuuauuc

SEQ ID NO: 4043108 - RNA, 18 nt, Staphylococcus aureus subsp. aureus N315
ugauuacaacuuauucuu

SEQ ID NO: 4043109 - RNA, 21 nt, Staphylococcus aureus subsp. aureus N315
ugauuacaacuuauucuucac

SEQ ID NO: 4043110 - RNA, 18 nt, Staphylococcus aureus subsp. aureus N315
ugauuacauucuauacuu

SEQ ID NO: 4043111 - RNA, 16 nt, Staphylococcus aureus subsp. aureus N315
ugauuaccaacaaggu

SEQ ID NO: 4043112 - RNA, 22 nt, Staphylococcus aureus subsp. aureus N315
ugauuagcauaccuuuauuauu

SEQ ID NO: 4043113 - RNA, 19 nt, Staphylococcus aureus subsp. aureus N315
ugauuauauuuuucuucag

SEQ ID NO: 4043114 - RNA, 16 nt, Staphylococcus aureus subsp. aureus N315
ugauuaucauuguuca

SEQ ID NO: 4043115 - RNA, 20 nt, Staphylococcus aureus subsp. aureus N315
ugauuauguucagaacuaca

SEQ ID NO: 4043116 - RNA, 22 nt, Staphylococcus aureus subsp. aureus N315
ugauucaaauaaaucaaacuuu

SEQ ID NO: 4043117 - RNA, 14 nt, Staphylococcus aureus subsp. aureus N315
ugauucaauauagu

SEQ ID NO: 4043118 - RNA, 22 nt, Staphylococcus aureus subsp. aureus N315
ugauucaccagguuuuuuauuu

SEQ ID NO: 4043119 - RNA, 19 nt, Staphylococcus aureus subsp. aureus N315
ugauucauucguacuucca

SEQ ID NO: 4043120 - RNA, 22 nt, Staphylococcus aureus subsp. aureus N315
ugauucauuucgauuaauuuaa

SEQ ID NO: 4043121 - RNA, 16 nt, Staphylococcus aureus subsp. aureus N315
ugauucguauucaaag

SEQ ID NO: 4043122 - RNA, 14 nt, Staphylococcus aureus subsp. aureus N315
ugauucuaaauaau

SEQ ID NO: 4043123 - RNA, 18 nt, Staphylococcus aureus subsp. aureus N315
ugauucuaaauaaucgaa

SEQ ID NO: 4043124 - RNA, 16 nt, Staphylococcus aureus subsp. aureus N315
ugauucucuguagaua

SEQ ID NO: 4043125 - RNA, 11 nt, Staphylococcus aureus subsp. aureus N315
ugauucuucac

SEQ ID NO: 4043126 - RNA, 14 nt, Staphylococcus aureus subsp. aureus N315
ugauugauaugguu

SEQ ID NO: 4043127 - RNA, 21 nt, Staphylococcus aureus subsp. aureus N315
ugauuggcagugaucuuuuuu

SEQ ID NO: 4043128 - RNA, 15 nt, Staphylococcus aureus subsp. aureus N315
ugauuguuaauacaa

SEQ ID NO: 4043129 - RNA, 12 nt, Staphylococcus aureus subsp. aureus N315
ugauuuaaaaaa

SEQ ID NO: 4043130 - RNA, 19 nt, Staphylococcus aureus subsp. aureus N315
ugauuuaaaauauaaauuu

SEQ ID NO: 4043131 - RNA, 21 nt, Staphylococcus aureus subsp. aureus N315
ugcauaauuaggauuaacaua

SEQ ID NO: 4043132 - RNA, 15 nt, Staphylococcus aureus subsp. aureus N315
ugcauagcuaaauaa

SEQ ID NO: 4043133 - RNA, 17 nt, Staphylococcus aureus subsp. aureus N315
ugcauagcuaaauaaau

SEQ ID NO: 4043134 - RNA, 14 nt, Staphylococcus aureus subsp. aureus N315
ugcauauauauaua

SEQ ID NO: 4043135 - RNA, 15 nt, Staphylococcus aureus subsp. aureus N315
ugcauauauauauag

SEQ ID NO: 4043136 - RNA, 12 nt, Staphylococcus aureus subsp. aureus N315
ugcauauucacg

SEQ ID NO: 4043137 - RNA, 23 nt, Staphylococcus aureus subsp. aureus N315
ugcauauugugccgcuucuacaa

SEQ ID NO: 4043138 - RNA, 17 nt, Staphylococcus aureus subsp. aureus N315
ugcaucaguuaauaauu

SEQ ID NO: 4043139 - RNA, 12 nt, Staphylococcus aureus subsp. aureus N315
ugcaucauucaa

SEQ ID NO: 4043140 - RNA, 15 nt, Staphylococcus aureus subsp. aureus N315
ugcaucccgaaaguu

SEQ ID NO: 4043141 - RNA, 19 nt, Staphylococcus aureus subsp. aureus N315
ugcaugacucacuaaucuc

SEQ ID NO: 4043142 - RNA, 19 nt, Staphylococcus aureus subsp. aureus N315
ugcaugagacuuauucaac

SEQ ID NO: 4043143 - RNA, 19 nt, Staphylococcus aureus subsp. aureus N315
ugcaugcgcaaaagcgcag

SEQ ID NO: 4043144 - RNA, 15 nt, Staphylococcus aureus subsp. aureus N315
ugcauguacaucuuu

SEQ ID NO: 4043145 - RNA, 24 nt, Staphylococcus aureus subsp. aureus N315
ugcauguccugaauguucgaagau

SEQ ID NO: 4043146 - RNA, 15 nt, Staphylococcus aureus subsp. aureus N315
ugcauguuuaaauau

SEQ ID NO: 4043147 - RNA, 17 nt, Staphylococcus aureus subsp. aureus N315
ugcauuaagugcaauaa

SEQ ID NO: 4043148 - RNA, 20 nt, Staphylococcus aureus subsp. aureus N315
ugcauuaauuucaugugcaa

SEQ ID NO: 4043149 - RNA, 18 nt, Staphylococcus aureus subsp. aureus N315
ugcauuacuacuuuauaa

SEQ ID NO: 4043150 - RNA, 22 nt, Staphylococcus aureus subsp. aureus N315
ugcauuacuacuuuauaaauau

SEQ ID NO: 4043151 - RNA, 23 nt, Staphylococcus aureus subsp. aureus N315
ugcauuacuacuuuauaaauauc

SEQ ID NO: 4043152 - RNA, 20 nt, Staphylococcus aureus subsp. aureus N315
ugcauuacuaucuucaucau

SEQ ID NO: 4043153 - RNA, 12 nt, Staphylococcus aureus subsp. aureus N315
ugcauuauuaua

SEQ ID NO: 4043154 - RNA, 20 nt, Staphylococcus aureus subsp. aureus N315
ugcauuauuauaauagcuuu

SEQ ID NO: 4043155 - RNA, 22 nt, Staphylococcus aureus subsp. aureus N315
ugcauuuagaugauucuuauca

SEQ ID NO: 4043156 - RNA, 18 nt, Staphylococcus aureus subsp. aureus N315
ugccaaaaugguuaaaau

SEQ ID NO: 4043157 - RNA, 17 nt, Staphylococcus aureus subsp. aureus N315
ugccaauauaacauuua

SEQ ID NO: 4043158 - RNA, 17 nt, Staphylococcus aureus subsp. aureus N315
ugccaauggaaguuuuu

SEQ ID NO: 4043159 - RNA, 16 nt, Staphylococcus aureus subsp. aureus N315
ugccauauguuuuaga

SEQ ID NO: 4043160 - RNA, 14 nt, Staphylococcus aureus subsp. aureus N315
ugccaucaauuucu

SEQ ID NO: 4043161 - RNA, 14 nt, Staphylococcus aureus subsp. aureus N315
ugccaucuuuguaa

SEQ ID NO: 4043162 - RNA, 20 nt, Staphylococcus aureus subsp. aureus N315
ugccauguuggcaauuguuu

SEQ ID NO: 4043163 - RNA, 18 nt, Staphylococcus aureus subsp. aureus N315
ugccauucauuaagcuuu

SEQ ID NO: 4043164 - RNA, 19 nt, Staphylococcus aureus subsp. aureus N315
ugccauuguuauccaaaac

SEQ ID NO: 4043165 - RNA, 21 nt, Staphylococcus aureus subsp. aureus N315
ugccauuuuuaaauuacuaua

SEQ ID NO: 4043166 - RNA, 20 nt, Staphylococcus aureus subsp. aureus N315
ugcccucauaaaucaugaaa

SEQ ID NO: 4043167 - RNA, 18 nt, Staphylococcus aureus subsp. aureus N315
ugccggcuuuuucuuuug

SEQ ID NO: 4043168 - RNA, 17 nt, Staphylococcus aureus subsp. aureus N315
ugccguaucuauaaaaa

SEQ ID NO: 4043169 - RNA, 23 nt, Staphylococcus aureus subsp. aureus N315
ugccguaucuauaaaaagaauau

SEQ ID NO: 4043170 - RNA, 16 nt, Staphylococcus aureus subsp. aureus N315
ugccguccauuuccau

SEQ ID NO: 4043171 - RNA, 17 nt, Staphylococcus aureus subsp. aureus N315
ugccguuauuuucaaua

SEQ ID NO: 4043172 - RNA, 15 nt, Staphylococcus aureus subsp. aureus N315
ugccguuugaagucu

SEQ ID NO: 4043173 - RNA, 23 nt, Staphylococcus aureus subsp. aureus N315
ugccguuugaagucuguuuagaa

SEQ ID NO: 4043174 - RNA, 13 nt, Staphylococcus aureus subsp. aureus N315
ugccuaauuuugu

SEQ ID NO: 4043175 - RNA, 15 nt, Staphylococcus aureus subsp. aureus N315
ugccucaauaucuuu

SEQ ID NO: 4043176 - RNA, 17 nt, Staphylococcus aureus subsp. aureus N315
ugccuuaacuucauaau

SEQ ID NO: 4043177 - RNA, 15 nt, Staphylococcus aureus subsp. aureus N315
ugccuuaucagcauu

SEQ ID NO: 4043178 - RNA, 16 nt, Staphylococcus aureus subsp. aureus N315
ugccuugucuauugua

SEQ ID NO: 4043179 - RNA, 12 nt, Staphylococcus aureus subsp. aureus N315
ugccuuucuaau

SEQ ID NO: 4043180 - RNA, 13 nt, Staphylococcus aureus subsp. aureus N315
ugccuuucucuaa

SEQ ID NO: 4043181 - RNA, 15 nt, Staphylococcus aureus subsp. aureus N315
ugccuuucucuaaau

SEQ ID NO: 4043182 - RNA, 17 nt, Staphylococcus aureus subsp. aureus N315
ugccuuuuacauuugua

SEQ ID NO: 4043183 - RNA, 13 nt, Staphylococcus aureus subsp. aureus N315
ugccuuuuuguaa

SEQ ID NO: 4043184 - RNA, 18 nt, Staphylococcus aureus subsp. aureus N315
ugccuuuuuguaauugua

SEQ ID NO: 4043185 - RNA, 20 nt, Staphylococcus aureus subsp. aureus N315
ugccuuuuuguaauuguaau

SEQ ID NO: 4043186 - RNA, 20 nt, Staphylococcus aureus subsp. aureus N315
ugcgaaacaacaaguaaaac

SEQ ID NO: 4043187 - RNA, 16 nt, Staphylococcus aureus subsp. aureus N315
ugcgaagauuuuuaac

SEQ ID NO: 4043188 - RNA, 22 nt, Staphylococcus aureus subsp. aureus N315
ugcgacaucgccaauuugauua

SEQ ID NO: 4043189 - RNA, 18 nt, Staphylococcus aureus subsp. aureus N315
ugcgauaagcaaaaauuc

SEQ ID NO: 4043190 - RNA, 23 nt, Staphylococcus aureus subsp. aureus N315
ugcgauuucuucugcuaacucug

SEQ ID NO: 4043191 - RNA, 16 nt, Staphylococcus aureus subsp. aureus N315
ugcgcaaaagcgcagg

SEQ ID NO: 4043192 - RNA, 16 nt, Staphylococcus aureus subsp. aureus N315
ugcgcuuauuuuacua

SEQ ID NO: 4043193 - RNA, 12 nt, Staphylococcus aureus subsp. aureus N315
ugcgcuuccaau

SEQ ID NO: 4043194 - RNA, 16 nt, Staphylococcus aureus subsp. aureus N315
ugcgcuuuuaauuuuu

SEQ ID NO: 4043195 - RNA, 16 nt, Staphylococcus aureus subsp. aureus N315
ugcggucuaaaugcuc

SEQ ID NO: 4043196 - RNA, 19 nt, Staphylococcus aureus subsp. aureus N315
ugcguaagguauuucauug

SEQ ID NO: 4043197 - RNA, 14 nt, Staphylococcus aureus subsp. aureus N315
ugcgucguuuauua

SEQ ID NO: 4043198 - RNA, 18 nt, Staphylococcus aureus subsp. aureus N315
ugcgugcuuaauuacaau

SEQ ID NO: 4043199 - RNA, 19 nt, Staphylococcus aureus subsp. aureus N315
ugcgugcuuaauuacaaua

SEQ ID NO: 4043200 - RNA, 16 nt, Staphylococcus aureus subsp. aureus N315
ugcguugguauucauc

SEQ ID NO: 4043201 - RNA, 19 nt, Staphylococcus aureus subsp. aureus N315
ugcguugguauucaucuuc

SEQ ID NO: 4043202 - RNA, 14 nt, Staphylococcus aureus subsp. aureus N315
ugcguuuaauuuac

SEQ ID NO: 4043203 - RNA, 20 nt, Staphylococcus aureus subsp. aureus N315
ugcguuuguguguuuuaaaa

SEQ ID NO: 4043204 - RNA, 20 nt, Staphylococcus aureus subsp. aureus N315
ugcuaaaaaguuagcaaacg

SEQ ID NO: 4043205 - RNA, 16 nt, Staphylococcus aureus subsp. aureus N315
ugcuaaaaauauugaa

SEQ ID NO: 4043206 - RNA, 16 nt, Staphylococcus aureus subsp. aureus N315
ugcuaaaauaucaaaa

SEQ ID NO: 4043207 - RNA, 21 nt, Staphylococcus aureus subsp. aureus N315
ugcuaaaguguagccaaauaa

SEQ ID NO: 4043208 - RNA, 20 nt, Staphylococcus aureus subsp. aureus N315
ugcuaacucugaucuaaaac

SEQ ID NO: 4043209 - RNA, 14 nt, Staphylococcus aureus subsp. aureus N315
ugcuaauucaagaa

SEQ ID NO: 4043210 - RNA, 17 nt, Staphylococcus aureus subsp. aureus N315
ugcuaauucaagaacag

SEQ ID NO: 4043211 - RNA, 16 nt, Staphylococcus aureus subsp. aureus N315
ugcuaauuuaacugcg

SEQ ID NO: 4043212 - RNA, 15 nt, Staphylococcus aureus subsp. aureus N315
ugcuaauuuuuucau

SEQ ID NO: 4043213 - RNA, 17 nt, Staphylococcus aureus subsp. aureus N315
ugcuacaauuuccuacc

SEQ ID NO: 4043214 - RNA, 17 nt, Staphylococcus aureus subsp. aureus N315
ugcuacaccaccugcag

SEQ ID NO: 4043215 - RNA, 20 nt, Staphylococcus aureus subsp. aureus N315
ugcuacagcacgagacaaua

SEQ ID NO: 4043216 - RNA, 20 nt, Staphylococcus aureus subsp. aureus N315
ugcuagcuuucuuuuucauc

SEQ ID NO: 4043217 - RNA, 22 nt, Staphylococcus aureus subsp. aureus N315
ugcuauauuucgguauuuuaaa

SEQ ID NO: 4043218 - RNA, 16 nt, Staphylococcus aureus subsp. aureus N315
uggaaauuuauuauaa

SEQ ID NO: 4043219 - RNA, 18 nt, Staphylococcus aureus subsp. aureus N315
uggaaauuuauuauaaaa

SEQ ID NO: 4043220 - RNA, 22 nt, Staphylococcus aureus subsp. aureus N315
uggaaauuuauuauaaaauaga

SEQ ID NO: 4043221 - RNA, 20 nt, Staphylococcus aureus subsp. aureus N315
uggaagaaugccuuuuauuu

SEQ ID NO: 4043222 - RNA, 16 nt, Staphylococcus aureus subsp. aureus N315
uggaaguuguugcuuu

SEQ ID NO: 4043223 - RNA, 21 nt, Staphylococcus aureus subsp. aureus N315
uggaauaccuaaccauaacaa

SEQ ID NO: 4043224 - RNA, 16 nt, Staphylococcus aureus subsp. aureus N315
uggaauacucuucaau

SEQ ID NO: 4043225 - RNA, 19 nt, Staphylococcus aureus subsp. aureus N315
uggaauacuugucaaaauu

SEQ ID NO: 4043226 - RNA, 11 nt, Staphylococcus aureus subsp. aureus N315
uggaaugacua

SEQ ID NO: 4043227 - RNA, 18 nt, Staphylococcus aureus subsp. aureus N315
uggacauuguaaaaugcu

SEQ ID NO: 4043228 - RNA, 17 nt, Staphylococcus aureus subsp. aureus N315
uggacuaacgucauuau

SEQ ID NO: 4043229 - RNA, 22 nt, Staphylococcus aureus subsp. aureus N315
uggacuaauaauuguccaugcc

SEQ ID NO: 4043230 - RNA, 20 nt, Staphylococcus aureus subsp. aureus N315
uggacuuauggguucaauau

SEQ ID NO: 4043231 - RNA, 14 nt, Staphylococcus aureus subsp. aureus N315
uggacuucuaucuu

SEQ ID NO: 4043232 - RNA, 16 nt, Staphylococcus aureus subsp. aureus N315
uggacuuuaaaguuaa

SEQ ID NO: 4043233 - RNA, 23 nt, Staphylococcus aureus subsp. aureus N315
uggacuuugcuguccaucgucau

SEQ ID NO: 4043234 - RNA, 15 nt, Staphylococcus aureus subsp. aureus N315
uggagaaccuuuaaa

SEQ ID NO: 4043235 - RNA, 22 nt, Staphylococcus aureus subsp. aureus N315
uggagauucucgguuuuuucgg

SEQ ID NO: 4043236 - RNA, 17 nt, Staphylococcus aureus subsp. aureus N315
uggagcggaagauagga

SEQ ID NO: 4043237 - RNA, 18 nt, Staphylococcus aureus subsp. aureus N315
uggagguccauaaucuuu

SEQ ID NO: 4043238 - RNA, 21 nt, Staphylococcus aureus subsp. aureus N315
uggaguaaagaucacacgaca

SEQ ID NO: 4043239 - RNA, 14 nt, Staphylococcus aureus subsp. aureus N315
uggauaaaaugaua

SEQ ID NO: 4043240 - RNA, 16 nt, Staphylococcus aureus subsp. aureus N315
uggauaauugcauuac

SEQ ID NO: 4043241 - RNA, 24 nt, Staphylococcus aureus subsp. aureus N315
uggauagguaacuaaaaugucuuu

SEQ ID NO: 4043242 - RNA, 15 nt, Staphylococcus aureus subsp. aureus N315
uggauaugauaacca

SEQ ID NO: 4043243 - RNA, 18 nt, Staphylococcus aureus subsp. aureus N315
uggauauuuauuuuaaua

SEQ ID NO: 4043244 - RNA, 20 nt, Staphylococcus aureus subsp. aureus N315
uggaucagguccaauucucu

SEQ ID NO: 4043245 - RNA, 13 nt, Staphylococcus aureus subsp. aureus N315
uggaucuguuaca

SEQ ID NO: 4043246 - RNA, 20 nt, Staphylococcus aureus subsp. aureus N315
uggauguaggcuuuuuuauu

SEQ ID NO: 4043247 - RNA, 22 nt, Staphylococcus aureus subsp. aureus N315
uggauguaggcuuuuuuauuau

SEQ ID NO: 4043248 - RNA, 16 nt, Staphylococcus aureus subsp. aureus N315
uggauguguuuuaaua

SEQ ID NO: 4043249 - RNA, 14 nt, Staphylococcus aureus subsp. aureus N315
uggauuacagauga

SEQ ID NO: 4043250 - RNA, 23 nt, Staphylococcus aureus subsp. aureus N315
uggauucaaaugacauuuuaaau

SEQ ID NO: 4043251 - RNA, 16 nt, Staphylococcus aureus subsp. aureus N315
uggauucucuuuauau

SEQ ID NO: 4043252 - RNA, 17 nt, Staphylococcus aureus subsp. aureus N315
uggauucuuuuguaaua

SEQ ID NO: 4043253 - RNA, 13 nt, Staphylococcus aureus subsp. aureus N315
uggauuucuuauu

SEQ ID NO: 4043254 - RNA, 18 nt, Staphylococcus aureus subsp. aureus N315
uggauuuuaacaagauaa

SEQ ID NO: 4043255 - RNA, 21 nt, Staphylococcus aureus subsp. aureus N315
uggauuuuaacaagauaacua

SEQ ID NO: 4043256 - RNA, 20 nt, Staphylococcus aureus subsp. aureus N315
uggauuuuucuuauaaaaau

SEQ ID NO: 4043257 - RNA, 19 nt, Staphylococcus aureus subsp. aureus N315
uggcaaagaauccuuaauu

SEQ ID NO: 4043258 - RNA, 20 nt, Staphylococcus aureus subsp. aureus N315
uggcaaccuuuugauguuua

SEQ ID NO: 4043259 - RNA, 23 nt, Staphylococcus aureus subsp. aureus N315
uggcaacggcacauucauaccga

SEQ ID NO: 4043260 - RNA, 15 nt, Staphylococcus aureus subsp. aureus N315
uggcaacguucuacu

SEQ ID NO: 4043261 - RNA, 20 nt, Staphylococcus aureus subsp. aureus N315
uggcaauauacuuuuuaaau

SEQ ID NO: 4043262 - RNA, 11 nt, Staphylococcus aureus subsp. aureus N315
uggcaccagua

SEQ ID NO: 4043263 - RNA, 15 nt, Staphylococcus aureus subsp. aureus N315
uggcacugcaaucag

SEQ ID NO: 4043264 - RNA, 19 nt, Staphylococcus aureus subsp. aureus N315
uggcauuauugccuaaccu

SEQ ID NO: 4043265 - RNA, 15 nt, Staphylococcus aureus subsp. aureus N315
uggcauuuuaucaug

SEQ ID NO: 4043266 - RNA, 19 nt, Staphylococcus aureus subsp. aureus N315
uggccaaccaccauaugcu

SEQ ID NO: 4043267 - RNA, 19 nt, Staphylococcus aureus subsp. aureus N315
uggccauuggauucuuuug

SEQ ID NO: 4043268 - RNA, 21 nt, Staphylococcus aureus subsp. aureus N315
uggccuuuaaugauucuacag

SEQ ID NO: 4043269 - RNA, 21 nt, Staphylococcus aureus subsp. aureus N315
uggcgacauuuguaaauauuu

SEQ ID NO: 4043270 - RNA, 18 nt, Staphylococcus aureus subsp. aureus N315
uggcgcaauuuuuaacaa

SEQ ID NO: 4043271 - RNA, 14 nt, Staphylococcus aureus subsp. aureus N315
uggcggggccccaa

SEQ ID NO: 4043272 - RNA, 17 nt, Staphylococcus aureus subsp. aureus N315
uggcgguuugaaaauga

SEQ ID NO: 4043273 - RNA, 15 nt, Staphylococcus aureus subsp. aureus N315
uggcguugcaccaag

SEQ ID NO: 4043274 - RNA, 17 nt, Staphylococcus aureus subsp. aureus N315
uggcugcaacaauuugc

SEQ ID NO: 4043275 - RNA, 15 nt, Staphylococcus aureus subsp. aureus N315
uggcugcaucaauau

SEQ ID NO: 4043276 - RNA, 19 nt, Staphylococcus aureus subsp. aureus N315
uggcuugaaguuguuucuc

SEQ ID NO: 4043277 - RNA, 14 nt, Staphylococcus aureus subsp. aureus N315
uggcuuuuuuaauu

SEQ ID NO: 4043278 - RNA, 19 nt, Staphylococcus aureus subsp. aureus N315
uggcuuuuuuuauggugug

SEQ ID NO: 4043279 - RNA, 17 nt, Staphylococcus aureus subsp. aureus N315
ugggaaauauuugaaaa

SEQ ID NO: 4043280 - RNA, 14 nt, Staphylococcus aureus subsp. aureus N315
ugggaagguaaaac

SEQ ID NO: 4043281 - RNA, 18 nt, Staphylococcus aureus subsp. aureus N315
ugggacagaaaacaaagc

SEQ ID NO: 4043282 - RNA, 12 nt, Staphylococcus aureus subsp. aureus N315
ugggacauuaau

SEQ ID NO: 4043283 - RNA, 14 nt, Staphylococcus aureus subsp. aureus N315
ugggacgacgaaau

SEQ ID NO: 4043284 - RNA, 14 nt, Staphylococcus aureus subsp. aureus N315
ugggacuuuuuaua

SEQ ID NO: 4043285 - RNA, 18 nt, Staphylococcus aureus subsp. aureus N315
ugggauauagaaaaggga

SEQ ID NO: 4043286 - RNA, 21 nt, Staphylococcus aureus subsp. aureus N315
ugggcaggugacuuuccuaau

SEQ ID NO: 4043287 - RNA, 15 nt, Staphylococcus aureus subsp. aureus N315
ugggcguucugcuaa

SEQ ID NO: 4043288 - RNA, 18 nt, Staphylococcus aureus subsp. aureus N315
uggggcccacaccccaac

SEQ ID NO: 4043289 - RNA, 23 nt, Staphylococcus aureus subsp. aureus N315
uggggugagggccccaacacaga

SEQ ID NO: 4043290 - RNA, 12 nt, Staphylococcus aureus subsp. aureus N315
uggguaaucuuu

SEQ ID NO: 4043291 - RNA, 14 nt, Staphylococcus aureus subsp. aureus N315
uggguaauguuuuu

SEQ ID NO: 4043292 - RNA, 15 nt, Staphylococcus aureus subsp. aureus N315
ugguaaaaaguuuaa

SEQ ID NO: 4043293 - RNA, 12 nt, Staphylococcus aureus subsp. aureus N315
ugguaaauuuau

SEQ ID NO: 4043294 - RNA, 23 nt, Staphylococcus aureus subsp. aureus N315
ugguaaauuuaucauuuuaagua

SEQ ID NO: 4043295 - RNA, 11 nt, Staphylococcus aureus subsp. aureus N315
ugguaauauuu

SEQ ID NO: 4043296 - RNA, 19 nt, Staphylococcus aureus subsp. aureus N315
ugguaauucaccaucauau

SEQ ID NO: 4043297 - RNA, 18 nt, Staphylococcus aureus subsp. aureus N315
ugguacauaaauaccugg

SEQ ID NO: 4043298 - RNA, 17 nt, Staphylococcus aureus subsp. aureus N315
ugguacuauuuuugacu

SEQ ID NO: 4043299 - RNA, 18 nt, Staphylococcus aureus subsp. aureus N315
ugguaugacugcaaauac

SEQ ID NO: 4043300 - RNA, 20 nt, Staphylococcus aureus subsp. aureus N315
ugguaugacugcaaauacga

SEQ ID NO: 4043301 - RNA, 18 nt, Staphylococcus aureus subsp. aureus N315
ugguauugauuauucuuu

SEQ ID NO: 4043302 - RNA, 16 nt, Staphylococcus aureus subsp. aureus N315
ugguauuuuuuuaugc

SEQ ID NO: 4043303 - RNA, 22 nt, Staphylococcus aureus subsp. aureus N315
uggucaccuacagauaaagcuu

SEQ ID NO: 4043304 - RNA, 20 nt, Staphylococcus aureus subsp. aureus N315
uggucuaaagcuuauuaaau

SEQ ID NO: 4043305 - RNA, 16 nt, Staphylococcus aureus subsp. aureus N315
uguacauuguaaauau

SEQ ID NO: 4043306 - RNA, 13 nt, Staphylococcus aureus subsp. aureus N315
uguaccaaauuug

SEQ ID NO: 4043307 - RNA, 19 nt, Staphylococcus aureus subsp. aureus N315
uguaccaauugauuuugcu

SEQ ID NO: 4043308 - RNA, 13 nt, Staphylococcus aureus subsp. aureus N315
uguaccaccccaa

SEQ ID NO: 4043309 - RNA, 14 nt, Staphylococcus aureus subsp. aureus N315
uguaccaguaacaa

SEQ ID NO: 4043310 - RNA, 19 nt, Staphylococcus aureus subsp. aureus N315
uguaccaucacuaaaguaa

SEQ ID NO: 4043311 - RNA, 20 nt, Staphylococcus aureus subsp. aureus N315
uguaccaucacuaaaguaaa

SEQ ID NO: 4043312 - RNA, 16 nt, Staphylococcus aureus subsp. aureus N315
uguaccguauuuuaau

SEQ ID NO: 4043313 - RNA, 23 nt, Staphylococcus aureus subsp. aureus N315
uguacgaccagucgcauauuuug

SEQ ID NO: 4043314 - RNA, 22 nt, Staphylococcus aureus subsp. aureus N315
uguacguuuaauaccuaugaua

SEQ ID NO: 4043315 - RNA, 15 nt, Staphylococcus aureus subsp. aureus N315
uguacguuuuuuuaa

SEQ ID NO: 4043316 - RNA, 16 nt, Staphylococcus aureus subsp. aureus N315
uguacguuuuuuuaaa

SEQ ID NO: 4043317 - RNA, 16 nt, Staphylococcus aureus subsp. aureus N315
uguacuacuugauucu

SEQ ID NO: 4043318 - RNA, 19 nt, Staphylococcus aureus subsp. aureus N315
uguacuuaaaccuaacaua

SEQ ID NO: 4043319 - RNA, 22 nt, Staphylococcus aureus subsp. aureus N315
uguacuuaaaccuaacauaacu

SEQ ID NO: 4043320 - RNA, 15 nt, Staphylococcus aureus subsp. aureus N315
uguacuucuuugguc

SEQ ID NO: 4043321 - RNA, 22 nt, Staphylococcus aureus subsp. aureus N315
uguagacaauuguaguaaugaa

SEQ ID NO: 4043322 - RNA, 21 nt, Staphylococcus aureus subsp. aureus N315
uguagcacaagauucaacuug

SEQ ID NO: 4043323 - RNA, 18 nt, Staphylococcus aureus subsp. aureus N315
uguagcaggcaacuuuua

SEQ ID NO: 4043324 - RNA, 21 nt, Staphylococcus aureus subsp. aureus N315
uguagcaggcaacuuuuauua

SEQ ID NO: 4043325 - RNA, 12 nt, Staphylococcus aureus subsp. aureus N315
uguagcuccuaa

SEQ ID NO: 4043326 - RNA, 22 nt, Staphylococcus aureus subsp. aureus N315
uguaggaagaccacuauuuuua

SEQ ID NO: 4043327 - RNA, 18 nt, Staphylococcus aureus subsp. aureus N315
uguaggcuuuuuuauuau

SEQ ID NO: 4043328 - RNA, 17 nt, Staphylococcus aureus subsp. aureus N315
uguagggggcauuauua

SEQ ID NO: 4043329 - RNA, 16 nt, Staphylococcus aureus subsp. aureus N315
uguaguacuauaguca

SEQ ID NO: 4043330 - RNA, 22 nt, Staphylococcus aureus subsp. aureus N315
uguaguaguuccguugaauuaa

SEQ ID NO: 4043331 - RNA, 21 nt, Staphylococcus aureus subsp. aureus N315
uguagugcgcuuauuuuacua

SEQ ID NO: 4043332 - RNA, 16 nt, Staphylococcus aureus subsp. aureus N315
uguagugguucuuaua

SEQ ID NO: 4043333 - RNA, 21 nt, Staphylococcus aureus subsp. aureus N315
uguaguuaagauaccuuuuuc

SEQ ID NO: 4043334 - RNA, 16 nt, Staphylococcus aureus subsp. aureus N315
uguauaaaacagaauu

SEQ ID NO: 4043335 - RNA, 21 nt, Staphylococcus aureus subsp. aureus N315
uguauaaaagauauaaacauu

SEQ ID NO: 4043336 - RNA, 20 nt, Staphylococcus aureus subsp. aureus N315
uguauaaagggcuauuugau

SEQ ID NO: 4043337 - RNA, 14 nt, Staphylococcus aureus subsp. aureus N315
uguauaaauaauaa

SEQ ID NO: 4043338 - RNA, 13 nt, Staphylococcus aureus subsp. aureus N315
uguauaaauguca

SEQ ID NO: 4043339 - RNA, 19 nt, Staphylococcus aureus subsp. aureus N315
uguauaaggauguacuaua

SEQ ID NO: 4043340 - RNA, 17 nt, Staphylococcus aureus subsp. aureus N315
uguauaccuauuccuau

SEQ ID NO: 4043341 - RNA, 17 nt, Staphylococcus aureus subsp. aureus N315
uguauagagagaaauaa

SEQ ID NO: 4043342 - RNA, 15 nt, Staphylococcus aureus subsp. aureus N315
uguauauauauguaa

SEQ ID NO: 4043343 - RNA, 22 nt, Staphylococcus aureus subsp. aureus N315
uguauauauauguaaaugaaau

SEQ ID NO: 4043344 - RNA, 15 nt, Staphylococcus aureus subsp. aureus N315
uguauauggcauuaa

SEQ ID NO: 4043345 - RNA, 17 nt, Staphylococcus aureus subsp. aureus N315
uguauauuuaacaucaa

SEQ ID NO: 4043346 - RNA, 17 nt, Staphylococcus aureus subsp. aureus N315
uguaucaucauaaucaa

SEQ ID NO: 4043347 - RNA, 20 nt, Staphylococcus aureus subsp. aureus N315
uguaucuuaaauuacuuaau

SEQ ID NO: 4043348 - RNA, 21 nt, Staphylococcus aureus subsp. aureus N315
uguaugaucaagcugagcuuu

SEQ ID NO: 4043349 - RNA, 19 nt, Staphylococcus aureus subsp. aureus N315
uguaugccgccuaauaaua

SEQ ID NO: 4043350 - RNA, 22 nt, Staphylococcus aureus subsp. aureus N315
uguauggaaaguugguuuuauu

SEQ ID NO: 4043351 - RNA, 21 nt, Staphylococcus aureus subsp. aureus N315
uguauuauugaaacuaauaau

SEQ ID NO: 4043352 - RNA, 19 nt, Staphylococcus aureus subsp. aureus N315
uguauucugaaacuuuaau

SEQ ID NO: 4043353 - RNA, 16 nt, Staphylococcus aureus subsp. aureus N315
uguauucuuagauauu

SEQ ID NO: 4043354 - RNA, 19 nt, Staphylococcus aureus subsp. aureus N315
uguauucuucuaauucuga

SEQ ID NO: 4043355 - RNA, 19 nt, Staphylococcus aureus subsp. aureus N315
uguauucuuggcguauuuu

SEQ ID NO: 4043356 - RNA, 23 nt, Staphylococcus aureus subsp. aureus N315
uguauugagaaagacuauauaac

SEQ ID NO: 4043357 - RNA, 16 nt, Staphylococcus aureus subsp. aureus N315
uguauugcuauaagaa

SEQ ID NO: 4043358 - RNA, 16 nt, Staphylococcus aureus subsp. aureus N315
uguauuguauuuuaau

SEQ ID NO: 4043359 - RNA, 16 nt, Staphylococcus aureus subsp. aureus N315
uguauuguuuguagaa

SEQ ID NO: 4043360 - RNA, 19 nt, Staphylococcus aureus subsp. aureus N315
uguauuguuuguuuuuaua

SEQ ID NO: 4043361 - RNA, 12 nt, Staphylococcus aureus subsp. aureus N315
uguauuuaaaau

SEQ ID NO: 4043362 - RNA, 12 nt, Staphylococcus aureus subsp. aureus N315
uguauuuauuac

SEQ ID NO: 4043363 - RNA, 18 nt, Staphylococcus aureus subsp. aureus N315
uguauuuauuuuuuuaaa

SEQ ID NO: 4043364 - RNA, 20 nt, Staphylococcus aureus subsp. aureus N315
uguauuuuaacgucauuuuu

SEQ ID NO: 4043365 - RNA, 18 nt, Staphylococcus aureus subsp. aureus N315
uguauuuuuacuuuuaua

SEQ ID NO: 4043366 - RNA, 21 nt, Staphylococcus aureus subsp. aureus N315
uguauuuuucuuaauuaucau

SEQ ID NO: 4043367 - RNA, 18 nt, Staphylococcus aureus subsp. aureus N315
ugucaauauaacauugca

SEQ ID NO: 4043368 - RNA, 22 nt, Staphylococcus aureus subsp. aureus N315
ugucacuuggauucaaaugaca

SEQ ID NO: 4043369 - RNA, 13 nt, Staphylococcus aureus subsp. aureus N315
ugucauaauccau

SEQ ID NO: 4043370 - RNA, 11 nt, Staphylococcus aureus subsp. aureus N315
ugucauaccuu

SEQ ID NO: 4043371 - RNA, 17 nt, Staphylococcus aureus subsp. aureus N315
ugucauaccuuuuaauu

SEQ ID NO: 4043372 - RNA, 20 nt, Staphylococcus aureus subsp. aureus N315
ugucauaguauacauaauuc

SEQ ID NO: 4043373 - RNA, 22 nt, Staphylococcus aureus subsp. aureus N315
ugucaucaccuuguuaaaauaa

SEQ ID NO: 4043374 - RNA, 18 nt, Staphylococcus aureus subsp. aureus N315
ugucaucauguucuaaug

SEQ ID NO: 4043375 - RNA, 12 nt, Staphylococcus aureus subsp. aureus N315
ugucaucgcuuu

SEQ ID NO: 4043376 - RNA, 12 nt, Staphylococcus aureus subsp. aureus N315
ugucauucuagu

SEQ ID NO: 4043377 - RNA, 18 nt, Staphylococcus aureus subsp. aureus N315
uguccaaauaaauauaaa

SEQ ID NO: 4043378 - RNA, 17 nt, Staphylococcus aureus subsp. aureus N315
uguccaauaaauugugg

SEQ ID NO: 4043379 - RNA, 14 nt, Staphylococcus aureus subsp. aureus N315
ugucccaaugcuga

SEQ ID NO: 4043380 - RNA, 19 nt, Staphylococcus aureus subsp. aureus N315
uguccgacuugauaaaaaa

SEQ ID NO: 4043381 - RNA, 14 nt, Staphylococcus aureus subsp. aureus N315
uguccgauaucuuu

SEQ ID NO: 4043382 - RNA, 15 nt, Staphylococcus aureus subsp. aureus N315
uguccguuuauagau

SEQ ID NO: 4043383 - RNA, 17 nt, Staphylococcus aureus subsp. aureus N315
uguccuaauaaguuacc

SEQ ID NO: 4043384 - RNA, 22 nt, Staphylococcus aureus subsp. aureus N315
uguccucuaaaacauguugaua

SEQ ID NO: 4043385 - RNA, 23 nt, Staphylococcus aureus subsp. aureus N315
ugucgaaaauagcuauuaaaaua

SEQ ID NO: 4043386 - RNA, 19 nt, Staphylococcus aureus subsp. aureus N315
ugucgaaauuguucuaaua

SEQ ID NO: 4043387 - RNA, 15 nt, Staphylococcus aureus subsp. aureus N315
ugucgacuuuuagau

SEQ ID NO: 4043388 - RNA, 14 nt, Staphylococcus aureus subsp. aureus N315
ugucgauauuucua

SEQ ID NO: 4043389 - RNA, 19 nt, Staphylococcus aureus subsp. aureus N315
ugucguuguacaucauuaa

SEQ ID NO: 4043390 - RNA, 14 nt, Staphylococcus aureus subsp. aureus N315
ugucuaaaaauguc

SEQ ID NO: 4043391 - RNA, 20 nt, Staphylococcus aureus subsp. aureus N315
ugucuaaucgacuuuuacaa

SEQ ID NO: 4043392 - RNA, 15 nt, Staphylococcus aureus subsp. aureus N315
uguuauguaugaaag

SEQ ID NO: 4043393 - RNA, 14 nt, Staphylococcus aureus subsp. aureus N315
uguuauuaaacgca

SEQ ID NO: 4043394 - RNA, 15 nt, Staphylococcus aureus subsp. aureus N315
uguuauuaaccauca

SEQ ID NO: 4043395 - RNA, 15 nt, Staphylococcus aureus subsp. aureus N315
uguuauugcaauaaa

SEQ ID NO: 4043396 - RNA, 22 nt, Staphylococcus aureus subsp. aureus N315
uguucaacuaaauuuucuaaau

SEQ ID NO: 4043397 - RNA, 18 nt, Staphylococcus aureus subsp. aureus N315
uguucaauacuucuuguu

SEQ ID NO: 4043398 - RNA, 14 nt, Staphylococcus aureus subsp. aureus N315
uguucacuaaaugu

SEQ ID NO: 4043399 - RNA, 19 nt, Staphylococcus aureus subsp. aureus N315
uguucaguuguuuuuuugu

SEQ ID NO: 4043400 - RNA, 21 nt, Staphylococcus aureus subsp. aureus N315
uguucaguuguuuuuuuguca

SEQ ID NO: 4043401 - RNA, 20 nt, Staphylococcus aureus subsp. aureus N315
uguucaucugauaauucgaa

SEQ ID NO: 4043402 - RNA, 18 nt, Staphylococcus aureus subsp. aureus N315
uguuccaaucuuuuuaau

SEQ ID NO: 4043403 - RNA, 19 nt, Staphylococcus aureus subsp. aureus N315
uguuccaaucuuuuuaauu

SEQ ID NO: 4043404 - RNA, 21 nt, Staphylococcus aureus subsp. aureus N315
uguuccgcuacaaaacauauu

SEQ ID NO: 4043405 - RNA, 17 nt, Staphylococcus aureus subsp. aureus N315
uguucgggaauuuuuua

SEQ ID NO: 4043406 - RNA, 22 nt, Staphylococcus aureus subsp. aureus N315
uguucuaaccauucguaauaaa

SEQ ID NO: 4043407 - RNA, 16 nt, Staphylococcus aureus subsp. aureus N315
uguucuaauuguugua

SEQ ID NO: 4043408 - RNA, 18 nt, Staphylococcus aureus subsp. aureus N315
uguucucauuauaaugau

SEQ ID NO: 4043409 - RNA, 18 nt, Staphylococcus aureus subsp. aureus N315
uguucucuauuuauacaa

SEQ ID NO: 4043410 - RNA, 18 nt, Staphylococcus aureus subsp. aureus N315
uguucugcuuuuucuuua

SEQ ID NO: 4043411 - RNA, 15 nt, Staphylococcus aureus subsp. aureus N315
uguucuuauaaaaaa

SEQ ID NO: 4043412 - RNA, 21 nt, Staphylococcus aureus subsp. aureus N315
uguucuucccacauacuuuua

SEQ ID NO: 4043413 - RNA, 18 nt, Staphylococcus aureus subsp. aureus N315
uguucuucgucaaauuca

SEQ ID NO: 4043414 - RNA, 22 nt, Staphylococcus aureus subsp. aureus N315
uguucuugaaaacaauaaauuu

SEQ ID NO: 4043415 - RNA, 22 nt, Staphylococcus aureus subsp. aureus N315
uguugacauuugaccaaguaug

SEQ ID NO: 4043416 - RNA, 18 nt, Staphylococcus aureus subsp. aureus N315
uguugaccaccugauaau

SEQ ID NO: 4043417 - RNA, 13 nt, Staphylococcus aureus subsp. aureus N315
uguugauaauagc

SEQ ID NO: 4043418 - RNA, 23 nt, Staphylococcus aureus subsp. aureus N315
uguugauaaugcuacuauuaaau

SEQ ID NO: 4043419 - RNA, 15 nt, Staphylococcus aureus subsp. aureus N315
uguugcaaaauacga

SEQ ID NO: 4043420 - RNA, 17 nt, Staphylococcus aureus subsp. aureus N315
uguugcuaaucucagau

SEQ ID NO: 4043421 - RNA, 18 nt, Staphylococcus aureus subsp. aureus N315
uguuggaauaccuuuuuc

SEQ ID NO: 4043422 - RNA, 20 nt, Staphylococcus aureus subsp. aureus N315
uguuggaauaccuuuuucua

SEQ ID NO: 4043423 - RNA, 18 nt, Staphylococcus aureus subsp. aureus N315
uguuggauucaucucagc

SEQ ID NO: 4043424 - RNA, 17 nt, Staphylococcus aureus subsp. aureus N315
uguuggggcccacaccc

SEQ ID NO: 4043425 - RNA, 15 nt, Staphylococcus aureus subsp. aureus N315
uguugggucuuguaa

SEQ ID NO: 4043426 - RNA, 21 nt, Staphylococcus aureus subsp. aureus N315
uguugucguuucuagcaacug

SEQ ID NO: 4043427 - RNA, 14 nt, Staphylococcus aureus subsp. aureus N315
uguugugaauaaaa

SEQ ID NO: 4043428 - RNA, 15 nt, Staphylococcus aureus subsp. aureus N315
uguugugcugccaaa

SEQ ID NO: 4043429 - RNA, 16 nt, Staphylococcus aureus subsp. aureus N315
uguuguuauuauaaau

SEQ ID NO: 4043430 - RNA, 11 nt, Staphylococcus aureus subsp. aureus N315
uguuguuuuaa

SEQ ID NO: 4043431 - RNA, 13 nt, Staphylococcus aureus subsp. aureus N315
uguuguuuuugau

SEQ ID NO: 4043432 - RNA, 16 nt, Staphylococcus aureus subsp. aureus N315
uguuuaaaaaacuacu

SEQ ID NO: 4043433 - RNA, 13 nt, Staphylococcus aureus subsp. aureus N315
uguuuaaaugcua

SEQ ID NO: 4043434 - RNA, 13 nt, Staphylococcus aureus subsp. aureus N315
uguuuaaauuuaa

SEQ ID NO: 4043435 - RNA, 22 nt, Staphylococcus aureus subsp. aureus N315
uguuuaagaauguacaauuuuu

SEQ ID NO: 4043436 - RNA, 16 nt, Staphylococcus aureus subsp. aureus N315
uguuuaauuaaaauac

SEQ ID NO: 4043437 - RNA, 12 nt, Staphylococcus aureus subsp. aureus N315
uguuuaauuauc

SEQ ID NO: 4043438 - RNA, 21 nt, Staphylococcus aureus subsp. aureus N315
uguuuaauuugauuaaauuca

SEQ ID NO: 4043439 - RNA, 14 nt, Staphylococcus aureus subsp. aureus N315
uguuuaauuuucua

SEQ ID NO: 4043440 - RNA, 21 nt, Staphylococcus aureus subsp. aureus N315
uguuuaccuaaaucuuuaaau

SEQ ID NO: 4043441 - RNA, 20 nt, Staphylococcus aureus subsp. aureus N315
uguuuaguauggaauaaaug

SEQ ID NO: 4043442 - RNA, 12 nt, Staphylococcus aureus subsp. aureus N315
uguuuauaucuu

SEQ ID NO: 4043443 - RNA, 17 nt, Staphylococcus aureus subsp. aureus N315
uguuuauaucuuuuaua

SEQ ID NO: 4043444 - RNA, 21 nt, Staphylococcus aureus subsp. aureus N315
uguuuaucaugaugauaaauu

SEQ ID NO: 4043445 - RNA, 22 nt, Staphylococcus aureus subsp. aureus N315
uguuuaucaugaugauaaauug

SEQ ID NO: 4043446 - RNA, 18 nt, Staphylococcus aureus subsp. aureus N315
uguuuaucuguaucaaaa

SEQ ID NO: 4043447 - RNA, 19 nt, Staphylococcus aureus subsp. aureus N315
uguuuaucuguaucaaaau

SEQ ID NO: 4043448 - RNA, 18 nt, Staphylococcus aureus subsp. aureus N315
uguuuaugacaaaguucu

SEQ ID NO: 4043449 - RNA, 22 nt, Staphylococcus aureus subsp. aureus N315
uguuuaugagcuuaauaaauug

SEQ ID NO: 4043450 - RNA, 13 nt, Staphylococcus aureus subsp. aureus N315
uguuuauucagau

SEQ ID NO: 4043451 - RNA, 16 nt, Staphylococcus aureus subsp. aureus N315
uguuuauuuagaauaa

SEQ ID NO: 4043452 - RNA, 19 nt, Staphylococcus aureus subsp. aureus N315
uguuuauuuagaauaaacu

SEQ ID NO: 4043453 - RNA, 14 nt, Staphylococcus aureus subsp. aureus N315
uguuuauuuuuaua

SEQ ID NO: 4043454 - RNA, 16 nt, Staphylococcus aureus subsp. aureus N315
uguuuauuuuuauaua

SEQ ID NO: 4043455 - RNA, 19 nt, Staphylococcus aureus subsp. aureus N315
uguuucaaaauaauuuuau

SEQ ID NO: 4043456 - RNA, 12 nt, Staphylococcus aureus subsp. aureus N315
uguuucaacaua

SEQ ID NO: 4043457 - RNA, 23 nt, Staphylococcus aureus subsp. aureus N315
uguuucaacauauuauauauauu

SEQ ID NO: 4043458 - RNA, 12 nt, Staphylococcus aureus subsp. aureus N315
uguuucagcuug

SEQ ID NO: 4043459 - RNA, 21 nt, Staphylococcus aureus subsp. aureus N315
uguuucagcuuguccauagua

SEQ ID NO: 4043460 - RNA, 17 nt, Staphylococcus aureus subsp. aureus N315
uguuucaggauaaugaa

SEQ ID NO: 4043461 - RNA, 15 nt, Staphylococcus aureus subsp. aureus N315
uguuucauauauauu

SEQ ID NO: 4043462 - RNA, 21 nt, Staphylococcus aureus subsp. aureus N315
uguuucauaugcaucaacaga

SEQ ID NO: 4043463 - RNA, 14 nt, Staphylococcus aureus subsp. aureus N315
uguuuccucuuuaa

SEQ ID NO: 4043464 - RNA, 15 nt, Staphylococcus aureus subsp. aureus N315
uguuucuaaauucuu

SEQ ID NO: 4043465 - RNA, 18 nt, Staphylococcus aureus subsp. aureus N315
uguuucuaaauucuuuuu

SEQ ID NO: 4043466 - RNA, 15 nt, Staphylococcus aureus subsp. aureus N315
uguuucuauauuaau

SEQ ID NO: 4043467 - RNA, 23 nt, Staphylococcus aureus subsp. aureus N315
uguuucuuagcuagcauguuuug

SEQ ID NO: 4043468 - RNA, 13 nt, Staphylococcus aureus subsp. aureus N315
uguuucuuguucu

SEQ ID NO: 4043469 - RNA, 22 nt, Staphylococcus aureus subsp. aureus N315
uguuucuuuacuucuuucaaaa

SEQ ID NO: 4043470 - RNA, 18 nt, Staphylococcus aureus subsp. aureus N315
uguuucuuuuauuuucau

SEQ ID NO: 4043471 - RNA, 18 nt, Staphylococcus aureus subsp. aureus N315
uguuugaauggcaaauau

SEQ ID NO: 4043472 - RNA, 19 nt, Staphylococcus aureus subsp. aureus N315
uguuugacuucaguacaau

SEQ ID NO: 4043473 - RNA, 21 nt, Staphylococcus aureus subsp. aureus N315
uguuugaugauucguauucaa

SEQ ID NO: 4043474 - RNA, 22 nt, Staphylococcus aureus subsp. aureus N315
uguuugcccugcuguuuuauuc

SEQ ID NO: 4043475 - RNA, 18 nt, Staphylococcus aureus subsp. aureus N315
uguuugggauauagaaaa

SEQ ID NO: 4043476 - RNA, 16 nt, Staphylococcus aureus subsp. aureus N315
uguuuguaagucgcuc

SEQ ID NO: 4043477 - RNA, 24 nt, Staphylococcus aureus subsp. aureus N315
uguuuguaaugucgaucuaacaau

SEQ ID NO: 4043478 - RNA, 14 nt, Staphylococcus aureus subsp. aureus N315
uguuuguuuuuaua

SEQ ID NO: 4043479 - RNA, 16 nt, Staphylococcus aureus subsp. aureus N315
uuaaauaaaaauauug

SEQ ID NO: 4043480 - RNA, 15 nt, Staphylococcus aureus subsp. aureus N315
uuaaauaagcuacua

SEQ ID NO: 4043481 - RNA, 14 nt, Staphylococcus aureus subsp. aureus N315
uuaaauaaugauaa

SEQ ID NO: 4043482 - RNA, 21 nt, Staphylococcus aureus subsp. aureus N315
uuaaauacaauuucuucauuu

SEQ ID NO: 4043483 - RNA, 16 nt, Staphylococcus aureus subsp. aureus N315
uuaaauacgccaaaua

SEQ ID NO: 4043484 - RNA, 22 nt, Staphylococcus aureus subsp. aureus N315
uuaaauacgccaaauaucagua

SEQ ID NO: 4043485 - RNA, 17 nt, Staphylococcus aureus subsp. aureus N315
uuaaauacuugcucuaa

SEQ ID NO: 4043486 - RNA, 23 nt, Staphylococcus aureus subsp. aureus N315
uuaaauauaaagacgauuuauua

SEQ ID NO: 4043487 - RNA, 20 nt, Staphylococcus aureus subsp. aureus N315
uuaaauaucaugcaaaacua

SEQ ID NO: 4043488 - RNA, 18 nt, Staphylococcus aureus subsp. aureus N315
uuaaauaugaauaaugca

SEQ ID NO: 4043489 - RNA, 21 nt, Staphylococcus aureus subsp. aureus N315
uuaaauaugacgcgugaauua

SEQ ID NO: 4043490 - RNA, 21 nt, Staphylococcus aureus subsp. aureus N315
uuaaauauggaugauauucaa

SEQ ID NO: 4043491 - RNA, 19 nt, Staphylococcus aureus subsp. aureus N315
uuaaauauugauauaaaaa

SEQ ID NO: 4043492 - RNA, 14 nt, Staphylococcus aureus subsp. aureus N315
uuaaauauuuaauu

SEQ ID NO: 4043493 - RNA, 14 nt, Staphylococcus aureus subsp. aureus N315
uuaaaucaacauca

SEQ ID NO: 4043494 - RNA, 13 nt, Staphylococcus aureus subsp. aureus N315
uuaaaucacauau

SEQ ID NO: 4043495 - RNA, 19 nt, Staphylococcus aureus subsp. aureus N315
uuaaaucacugcuuucaag

SEQ ID NO: 4043496 - RNA, 18 nt, Staphylococcus aureus subsp. aureus N315
uuaaauccgcuuguucaa

SEQ ID NO: 4043497 - RNA, 15 nt, Staphylococcus aureus subsp. aureus N315
uuaaaucuaauuauu

SEQ ID NO: 4043498 - RNA, 17 nt, Staphylococcus aureus subsp. aureus N315
uuaaaucuaauuauuca

SEQ ID NO: 4043499 - RNA, 15 nt, Staphylococcus aureus subsp. aureus N315
uuaaaucuauauaaa

SEQ ID NO: 4043500 - RNA, 22 nt, Staphylococcus aureus subsp. aureus N315
uuaaaucugcuugugugucauu

SEQ ID NO: 4043501 - RNA, 20 nt, Staphylococcus aureus subsp. aureus N315
uuaaaucuucaagugccauu

SEQ ID NO: 4043502 - RNA, 21 nt, Staphylococcus aureus subsp. aureus N315
uuaaaucuucuaguaauucuu

SEQ ID NO: 4043503 - RNA, 23 nt, Staphylococcus aureus subsp. aureus N315
uuaaaucuuuuacuaaaugaauu

SEQ ID NO: 4043504 - RNA, 21 nt, Staphylococcus aureus subsp. aureus N315
uuaaaugauauugaaagugua

SEQ ID NO: 4043505 - RNA, 14 nt, Staphylococcus aureus subsp. aureus N315
uuaaaugcaauaca

SEQ ID NO: 4043506 - RNA, 20 nt, Staphylococcus aureus subsp. aureus N315
uuaaaugcccaccauguaca

SEQ ID NO: 4043507 - RNA, 21 nt, Staphylococcus aureus subsp. aureus N315
uuaaaugcccaccauguacau

SEQ ID NO: 4043508 - RNA, 22 nt, Staphylococcus aureus subsp. aureus N315
uuaaauguacauuguaaauaua

SEQ ID NO: 4043509 - RNA, 19 nt, Staphylococcus aureus subsp. aureus N315
uuaaauguauuuuuacuuu

SEQ ID NO: 4043510 - RNA, 18 nt, Staphylococcus aureus subsp. aureus N315
uuaaaugucuuucaaaua

SEQ ID NO: 4043511 - RNA, 18 nt, Staphylococcus aureus subsp. aureus N315
uuaaaugugcaauuagaa

SEQ ID NO: 4043512 - RNA, 22 nt, Staphylococcus aureus subsp. aureus N315
uuaaauuaaagcaaauuauaua

SEQ ID NO: 4043513 - RNA, 21 nt, Staphylococcus aureus subsp. aureus N315
uuaaauuagggugaacaguua

SEQ ID NO: 4043514 - RNA, 16 nt, Staphylococcus aureus subsp. aureus N315
uuaaauuauauaccca

SEQ ID NO: 4043515 - RNA, 15 nt, Staphylococcus aureus subsp. aureus N315
uuaaauuauuuaauu

SEQ ID NO: 4043516 - RNA, 16 nt, Staphylococcus aureus subsp. aureus N315
uuaaauuauuuaauuu

SEQ ID NO: 4043517 - RNA, 14 nt, Staphylococcus aureus subsp. aureus N315
uuaaauucaucuug

SEQ ID NO: 4043518 - RNA, 13 nt, Staphylococcus aureus subsp. aureus N315
uuaaauucauuuu

SEQ ID NO: 4043519 - RNA, 22 nt, Staphylococcus aureus subsp. aureus N315
uuaaauuccaugucaauuuuuu

SEQ ID NO: 4043520 - RNA, 19 nt, Staphylococcus aureus subsp. aureus N315
uuaaauucuuauaaaauaa

SEQ ID NO: 4043521 - RNA, 21 nt, Staphylococcus aureus subsp. aureus N315
uuaaauucuuauaaaauaaaa

SEQ ID NO: 4043522 - RNA, 21 nt, Staphylococcus aureus subsp. aureus N315
uuaaauugcuugaaauuauua

SEQ ID NO: 4043523 - RNA, 13 nt, Staphylococcus aureus subsp. aureus N315
uuaaauuuaaaag

SEQ ID NO: 4043524 - RNA, 14 nt, Staphylococcus aureus subsp. aureus N315
uuaaauuuaaaaga

SEQ ID NO: 4043525 - RNA, 15 nt, Staphylococcus aureus subsp. aureus N315
uuaaauuuaaaagaa

SEQ ID NO: 4043526 - RNA, 16 nt, Staphylococcus aureus subsp. aureus N315
uuaaauuuaauuucga

SEQ ID NO: 4043527 - RNA, 14 nt, Staphylococcus aureus subsp. aureus N315
uuaaauuuauaaua

SEQ ID NO: 4043528 - RNA, 22 nt, Staphylococcus aureus subsp. aureus N315
uuaaauuuauacagcugucacu

SEQ ID NO: 4043529 - RNA, 14 nt, Staphylococcus aureus subsp. aureus N315
uuaaauuucugaac

SEQ ID NO: 4043530 - RNA, 18 nt, Staphylococcus aureus subsp. aureus N315
uuaaauuucugaacauaa

SEQ ID NO: 4043531 - RNA, 15 nt, Staphylococcus aureus subsp. aureus N315
uuaaauuugaaagua

SEQ ID NO: 4043532 - RNA, 16 nt, Staphylococcus aureus subsp. aureus N315
uuaaauuugaaaguaa

SEQ ID NO: 4043533 - RNA, 13 nt, Staphylococcus aureus subsp. aureus N315
uuaaauuuucauc

SEQ ID NO: 4043534 - RNA, 17 nt, Staphylococcus aureus subsp. aureus N315
uuaacaaaauuaagaag

SEQ ID NO: 4043535 - RNA, 20 nt, Staphylococcus aureus subsp. aureus N315
uuaacaaaauuaagaagaaa

SEQ ID NO: 4043536 - RNA, 14 nt, Staphylococcus aureus subsp. aureus N315
uuaacaacaaauau

SEQ ID NO: 4043537 - RNA, 12 nt, Staphylococcus aureus subsp. aureus N315
uuaacaacuuua

SEQ ID NO: 4043538 - RNA, 15 nt, Staphylococcus aureus subsp. aureus N315
uuaacaacuuuaauu

SEQ ID NO: 4043539 - RNA, 16 nt, Staphylococcus aureus subsp. aureus N315
uuaacaagauaacuag

SEQ ID NO: 4043540 - RNA, 21 nt, Staphylococcus aureus subsp. aureus N315
uuaacaauauucguaaauccu

SEQ ID NO: 4043541 - RNA, 20 nt, Staphylococcus aureus subsp. aureus N315
uuaacaaugcgauuaaacuc

SEQ ID NO: 4043542 - RNA, 18 nt, Staphylococcus aureus subsp. aureus N315
uuaacaauuuuaucugaa

SEQ ID NO: 4043543 - RNA, 21 nt, Staphylococcus aureus subsp. aureus N315
uuaacaauuuuaucugaaucu

SEQ ID NO: 4043544 - RNA, 21 nt, Staphylococcus aureus subsp. aureus N315
uuaacaccagauaucauaaua

SEQ ID NO: 4043545 - RNA, 15 nt, Staphylococcus aureus subsp. aureus N315
uuaacaucaauuacu

SEQ ID NO: 4043546 - RNA, 13 nt, Staphylococcus aureus subsp. aureus N315
uuaacaucugaau

SEQ ID NO: 4043547 - RNA, 19 nt, Staphylococcus aureus subsp. aureus N315
uuaaccacuccuuaaacaa

SEQ ID NO: 4043548 - RNA, 19 nt, Staphylococcus aureus subsp. aureus N315
uuaaccauacauaugcuau

SEQ ID NO: 4043549 - RNA, 21 nt, Staphylococcus aureus subsp. aureus N315
uuaaccucuaagguuaaauua

SEQ ID NO: 4043550 - RNA, 14 nt, Staphylococcus aureus subsp. aureus N315
uuaacgcaaaaaua

SEQ ID NO: 4043551 - RNA, 17 nt, Staphylococcus aureus subsp. aureus N315
uuaacgcaaaaauacuc

SEQ ID NO: 4043552 - RNA, 18 nt, Staphylococcus aureus subsp. aureus N315
uuaacguuauucauuugu

SEQ ID NO: 4043553 - RNA, 12 nt, Staphylococcus aureus subsp. aureus N315
uuaacuaaacca

SEQ ID NO: 4043554 - RNA, 15 nt, Staphylococcus aureus subsp. aureus N315
uuaacuaauagacug

SEQ ID NO: 4043555 - RNA, 18 nt, Staphylococcus aureus subsp. aureus N315
uuaacuauaaauagaaga

SEQ ID NO: 4043556 - RNA, 13 nt, Staphylococcus aureus subsp. aureus N315
uuaacuauaacaa

SEQ ID NO: 4043557 - RNA, 20 nt, Staphylococcus aureus subsp. aureus N315
uuaacugccauauagauauu

SEQ ID NO: 4043558 - RNA, 23 nt, Staphylococcus aureus subsp. aureus N315
uuaacugguugauaaauaaacuc

SEQ ID NO: 4043559 - RNA, 22 nt, Staphylococcus aureus subsp. aureus N315
uuaacuguacgauucaauuuaa

SEQ ID NO: 4043560 - RNA, 21 nt, Staphylococcus aureus subsp. aureus N315
uuaacuguaugccgccuaaua

SEQ ID NO: 4043561 - RNA, 15 nt, Staphylococcus aureus subsp. aureus N315
uuaacuuaaaauuua

SEQ ID NO: 4043562 - RNA, 19 nt, Staphylococcus aureus subsp. aureus N315
uuaacuuaaaauuuaaaua

SEQ ID NO: 4043563 - RNA, 14 nt, Staphylococcus aureus subsp. aureus N315
uuaacuucauaaua

SEQ ID NO: 4043564 - RNA, 17 nt, Staphylococcus aureus subsp. aureus N315
uuaacuucauaauauau

SEQ ID NO: 4043565 - RNA, 15 nt, Staphylococcus aureus subsp. aureus N315
uuaacuugaaauguu

SEQ ID NO: 4043566 - RNA, 14 nt, Staphylococcus aureus subsp. aureus N315
uuaauguuaaacaa

SEQ ID NO: 4043567 - RNA, 14 nt, Staphylococcus aureus subsp. aureus N315
uuaauuaaaacaug

SEQ ID NO: 4043568 - RNA, 13 nt, Staphylococcus aureus subsp. aureus N315
uuaauuaaaauac

SEQ ID NO: 4043569 - RNA, 16 nt, Staphylococcus aureus subsp. aureus N315
uuaauuaaaauucucu

SEQ ID NO: 4043570 - RNA, 21 nt, Staphylococcus aureus subsp. aureus N315
uuaauuaaaauucucuuuuaa

SEQ ID NO: 4043571 - RNA, 13 nt, Staphylococcus aureus subsp. aureus N315
uuaauuaaaguua

SEQ ID NO: 4043572 - RNA, 12 nt, Staphylococcus aureus subsp. aureus N315
uuaauuaacaaa

SEQ ID NO: 4043573 - RNA, 15 nt, Staphylococcus aureus subsp. aureus N315
uuaauuaauaauuua

SEQ ID NO: 4043574 - RNA, 22 nt, Staphylococcus aureus subsp. aureus N315
uuaauuacagcgugauucaucu

SEQ ID NO: 4043575 - RNA, 21 nt, Staphylococcus aureus subsp. aureus N315
uuaauuacaggaauugcuuua

SEQ ID NO: 4043576 - RNA, 17 nt, Staphylococcus aureus subsp. aureus N315
uuaauuacuguaaauau

SEQ ID NO: 4043577 - RNA, 19 nt, Staphylococcus aureus subsp. aureus N315
uuaauuacuguaaauauga

SEQ ID NO: 4043578 - RNA, 13 nt, Staphylococcus aureus subsp. aureus N315
uuaauuauaauaa

SEQ ID NO: 4043579 - RNA, 14 nt, Staphylococcus aureus subsp. aureus N315
uuaauuaucauaaa

SEQ ID NO: 4043580 - RNA, 19 nt, Staphylococcus aureus subsp. aureus N315
uuaauuaucauaaagauaa

SEQ ID NO: 4043581 - RNA, 12 nt, Staphylococcus aureus subsp. aureus N315
uuaauuaucauu

SEQ ID NO: 4043582 - RNA, 22 nt, Staphylococcus aureus subsp. aureus N315
uuaauuauugagaauauuuauu

SEQ ID NO: 4043583 - RNA, 15 nt, Staphylococcus aureus subsp. aureus N315
uuaauuauuuagauu

SEQ ID NO: 4043584 - RNA, 14 nt, Staphylococcus aureus subsp. aureus N315
uuaauuauuucccu

SEQ ID NO: 4043585 - RNA, 15 nt, Staphylococcus aureus subsp. aureus N315
uuaauuauuucccug

SEQ ID NO: 4043586 - RNA, 16 nt, Staphylococcus aureus subsp. aureus N315
uuaauuauuuuaaaaa

SEQ ID NO: 4043587 - RNA, 16 nt, Staphylococcus aureus subsp. aureus N315
uuaauucguuuuacua

SEQ ID NO: 4043588 - RNA, 18 nt, Staphylococcus aureus subsp. aureus N315
uuaauugaaaaaccaagu

SEQ ID NO: 4043589 - RNA, 16 nt, Staphylococcus aureus subsp. aureus N315
uuaauugaaguaugca

SEQ ID NO: 4043590 - RNA, 14 nt, Staphylococcus aureus subsp. aureus N315
uuaauugcagguaa

SEQ ID NO: 4043591 - RNA, 20 nt, Staphylococcus aureus subsp. aureus N315
uuaauugcagguaaacggaa

SEQ ID NO: 4043592 - RNA, 17 nt, Staphylococcus aureus subsp. aureus N315
uuaauugcguuuaauaa

SEQ ID NO: 4043593 - RNA, 18 nt, Staphylococcus aureus subsp. aureus N315
uuaauugcuguaaauauu

SEQ ID NO: 4043594 - RNA, 18 nt, Staphylococcus aureus subsp. aureus N315
uuaauuguuuaauaacaa

SEQ ID NO: 4043595 - RNA, 18 nt, Staphylococcus aureus subsp. aureus N315
uuaauuuaaaucuguacu

SEQ ID NO: 4043596 - RNA, 20 nt, Staphylococcus aureus subsp. aureus N315
uuaauuuaacggaaauacaa

SEQ ID NO: 4043597 - RNA, 21 nt, Staphylococcus aureus subsp. aureus N315
uuaauuuaaguaguuguuaua

SEQ ID NO: 4043598 - RNA, 18 nt, Staphylococcus aureus subsp. aureus N315
uuaauuuacaauuaauua

SEQ ID NO: 4043599 - RNA, 17 nt, Staphylococcus aureus subsp. aureus N315
uuaauuuagugaaacaa

SEQ ID NO: 4043600 - RNA, 16 nt, Staphylococcus aureus subsp. aureus N315
uuaauuucaacauuac

SEQ ID NO: 4043601 - RNA, 16 nt, Staphylococcus aureus subsp. aureus N315
uuaauuucacuuuaac

SEQ ID NO: 4043602 - RNA, 22 nt, Staphylococcus aureus subsp. aureus N315
uuaauuucacuuuaacuucuuu

SEQ ID NO: 4043603 - RNA, 13 nt, Staphylococcus aureus subsp. aureus N315
uuaauuucuggua

SEQ ID NO: 4043604 - RNA, 23 nt, Staphylococcus aureus subsp. aureus N315
uuaauuucugguaaaaaaauaac

SEQ ID NO: 4043605 - RNA, 14 nt, Staphylococcus aureus subsp. aureus N315
uuaauuuguauuua

SEQ ID NO: 4043606 - RNA, 18 nt, Staphylococcus aureus subsp. aureus N315
uuaauuuguauuuaaaau

SEQ ID NO: 4043607 - RNA, 19 nt, Staphylococcus aureus subsp. aureus N315
uuaauuuguuuuaaauacu

SEQ ID NO: 4043608 - RNA, 13 nt, Staphylococcus aureus subsp. aureus N315
uuaauuuuauuuu

SEQ ID NO: 4043609 - RNA, 14 nt, Staphylococcus aureus subsp. aureus N315
uuaauuuuauuuua

SEQ ID NO: 4043610 - RNA, 17 nt, Staphylococcus aureus subsp. aureus N315
uuaauuuucuaaauaua

SEQ ID NO: 4043611 - RNA, 16 nt, Staphylococcus aureus subsp. aureus N315
uuaauuuucuuuuuua

SEQ ID NO: 4043612 - RNA, 20 nt, Staphylococcus aureus subsp. aureus N315
uuaauuuuucauuaauacaa

SEQ ID NO: 4043613 - RNA, 19 nt, Staphylococcus aureus subsp. aureus N315
uuaauuuuucuaaaugauu

SEQ ID NO: 4043614 - RNA, 23 nt, Staphylococcus aureus subsp. aureus N315
uuacaaagugauuuaaaaaauuu

SEQ ID NO: 4043615 - RNA, 17 nt, Staphylococcus aureus subsp. aureus N315
uuacaaaguuaaccaua

SEQ ID NO: 4043616 - RNA, 22 nt, Staphylococcus aureus subsp. aureus N315
uuacaaaguuaaccauacauau

SEQ ID NO: 4043617 - RNA, 20 nt, Staphylococcus aureus subsp. aureus N315
uuacaaauguauaaauaaua

SEQ ID NO: 4043618 - RNA, 19 nt, Staphylococcus aureus subsp. aureus N315
uuacaaccuuugguuguua

SEQ ID NO: 4043619 - RNA, 14 nt, Staphylococcus aureus subsp. aureus N315
uuacaacuuauucu

SEQ ID NO: 4043620 - RNA, 18 nt, Staphylococcus aureus subsp. aureus N315
uuacaacuuuaguuguua

SEQ ID NO: 4043621 - RNA, 20 nt, Staphylococcus aureus subsp. aureus N315
uuacaacuuuaguuguuagg

SEQ ID NO: 4043622 - RNA, 12 nt, Staphylococcus aureus subsp. aureus N315
uuacaaguuguu

SEQ ID NO: 4043623 - RNA, 17 nt, Staphylococcus aureus subsp. aureus N315
uuacaaguuguucaauu

SEQ ID NO: 4043624 - RNA, 11 nt, Staphylococcus aureus subsp. aureus N315
uuacaauaagg

SEQ ID NO: 4043625 - RNA, 17 nt, Staphylococcus aureus subsp. aureus N315
uuacaauauaauuuccu

SEQ ID NO: 4043626 - RNA, 15 nt, Staphylococcus aureus subsp. aureus N315
uuacaauaugauuaa

SEQ ID NO: 4043627 - RNA, 13 nt, Staphylococcus aureus subsp. aureus N315
uuacaaugaaaaa

SEQ ID NO: 4043628 - RNA, 21 nt, Staphylococcus aureus subsp. aureus N315
uuacaaugcgguauugcaugu

SEQ ID NO: 4043629 - RNA, 16 nt, Staphylococcus aureus subsp. aureus N315
uuacacaaauuaaaac

SEQ ID NO: 4043630 - RNA, 15 nt, Staphylococcus aureus subsp. aureus N315
uuacaccuuuggcac

SEQ ID NO: 4043631 - RNA, 20 nt, Staphylococcus aureus subsp. aureus N315
uuacacuuuucuuaucaguu

SEQ ID NO: 4043632 - RNA, 16 nt, Staphylococcus aureus subsp. aureus N315
uuacagacaaacauua

SEQ ID NO: 4043633 - RNA, 13 nt, Staphylococcus aureus subsp. aureus N315
uuacagaugaugc

SEQ ID NO: 4043634 - RNA, 22 nt, Staphylococcus aureus subsp. aureus N315
uuacaggagcgagccauuauua

SEQ ID NO: 4043635 - RNA, 15 nt, Staphylococcus aureus subsp. aureus N315
uuacagucaacugcu

SEQ ID NO: 4043636 - RNA, 20 nt, Staphylococcus aureus subsp. aureus N315
uuacauaauuuaucugcaaa

SEQ ID NO: 4043637 - RNA, 21 nt, Staphylococcus aureus subsp. aureus N315
uuacaugcaccuuuacaacau

SEQ ID NO: 4043638 - RNA, 20 nt, Staphylococcus aureus subsp. aureus N315
uuacauguuacugaugaaca

SEQ ID NO: 4043639 - RNA, 21 nt, Staphylococcus aureus subsp. aureus N315
uuacauuacgcucaucaccuu

SEQ ID NO: 4043640 - RNA, 20 nt, Staphylococcus aureus subsp. aureus N315
uuacauuuggcguaaugaua

SEQ ID NO: 4043641 - RNA, 18 nt, Staphylococcus aureus subsp. aureus N315
uuacauuuuaauaaaauc

SEQ ID NO: 4043642 - RNA, 19 nt, Staphylococcus aureus subsp. aureus N315
uuacauuuuaauaaaauca

SEQ ID NO: 4043643 - RNA, 22 nt, Staphylococcus aureus subsp. aureus N315
uuacauuuuaauaaaaucaucu

SEQ ID NO: 4043644 - RNA, 11 nt, Staphylococcus aureus subsp. aureus N315
uuaccaaaauu

SEQ ID NO: 4043645 - RNA, 16 nt, Staphylococcus aureus subsp. aureus N315
uuaccaauaucaugca

SEQ ID NO: 4043646 - RNA, 23 nt, Staphylococcus aureus subsp. aureus N315
uuaccaauaucaugcaaaauaau

SEQ ID NO: 4043647 - RNA, 14 nt, Staphylococcus aureus subsp. aureus N315
uuaccaaugaauaa

SEQ ID NO: 4043648 - RNA, 21 nt, Staphylococcus aureus subsp. aureus N315
uuaccacaaauaucaauuuca

SEQ ID NO: 4043649 - RNA, 23 nt, Staphylococcus aureus subsp. aureus N315
uuaccacaaccagucagaaagaa

SEQ ID NO: 4043650 - RNA, 14 nt, Staphylococcus aureus subsp. aureus N315
uuaccaguaucauu

SEQ ID NO: 4043651 - RNA, 12 nt, Staphylococcus aureus subsp. aureus N315
uuaccaucuuua

SEQ ID NO: 4043652 - RNA, 22 nt, Staphylococcus aureus subsp. aureus N315
uuaccaugaugagauaaaauca

SEQ ID NO: 4043653 - RNA, 17 nt, Staphylococcus aureus subsp. aureus N315
uuaccauugugaauaau

SEQ ID NO: 4043654 - RNA, 21 nt, Staphylococcus aureus subsp. aureus N315
uuaguauaauuuaucuuaauc

SEQ ID NO: 4043655 - RNA, 19 nt, Staphylococcus aureus subsp. aureus N315
uuaguaucgauaguucuau

SEQ ID NO: 4043656 - RNA, 13 nt, Staphylococcus aureus subsp. aureus N315
uuagucaauguau

SEQ ID NO: 4043657 - RNA, 22 nt, Staphylococcus aureus subsp. aureus N315
uuagucaauguauauuuaacau

SEQ ID NO: 4043658 - RNA, 21 nt, Staphylococcus aureus subsp. aureus N315
uuagugauaccuuuaauuguu

SEQ ID NO: 4043659 - RNA, 15 nt, Staphylococcus aureus subsp. aureus N315
uuaguguagaaaaua

SEQ ID NO: 4043660 - RNA, 16 nt, Staphylococcus aureus subsp. aureus N315
uuagugucacaaagaa

SEQ ID NO: 4043661 - RNA, 16 nt, Staphylococcus aureus subsp. aureus N315
uuaguuugacaucuau

SEQ ID NO: 4043662 - RNA, 14 nt, Staphylococcus aureus subsp. aureus N315
uuaguuuucuuaaa

SEQ ID NO: 4043663 - RNA, 14 nt, Staphylococcus aureus subsp. aureus N315
uuaguuuuuuuaaa

SEQ ID NO: 4043664 - RNA, 12 nt, Staphylococcus aureus subsp. aureus N315
uuauaaaaaacg

SEQ ID NO: 4043665 - RNA, 14 nt, Staphylococcus aureus subsp. aureus N315
uuauaaaaaacggu

SEQ ID NO: 4043666 - RNA, 15 nt, Staphylococcus aureus subsp. aureus N315
uuauaaaaaaucagu

SEQ ID NO: 4043667 - RNA, 23 nt, Staphylococcus aureus subsp. aureus N315
uuauaaaaaaucaguuuuuaaau

SEQ ID NO: 4043668 - RNA, 15 nt, Staphylococcus aureus subsp. aureus N315
uuauaaaaacagcag

SEQ ID NO: 4043669 - RNA, 14 nt, Staphylococcus aureus subsp. aureus N315
uuauaaaaacuuau

SEQ ID NO: 4043670 - RNA, 14 nt, Staphylococcus aureus subsp. aureus N315
uuauaaaaagagau

SEQ ID NO: 4043671 - RNA, 17 nt, Staphylococcus aureus subsp. aureus N315
uuauaaaaguguaaugu

SEQ ID NO: 4043672 - RNA, 17 nt, Staphylococcus aureus subsp. aureus N315
uuauaaaaugaauaauu

SEQ ID NO: 4043673 - RNA, 23 nt, Staphylococcus aureus subsp. aureus N315
uuauaaaccuaaugcuuuaauaa

SEQ ID NO: 4043674 - RNA, 20 nt, Staphylococcus aureus subsp. aureus N315
uuauaaauagagaacagcag

SEQ ID NO: 4043675 - RNA, 14 nt, Staphylococcus aureus subsp. aureus N315
uuauaaauaucuuu

SEQ ID NO: 4043676 - RNA, 13 nt, Staphylococcus aureus subsp. aureus N315
uuauaaaucaaag

SEQ ID NO: 4043677 - RNA, 15 nt, Staphylococcus aureus subsp. aureus N315
uuauaaaucauagag

SEQ ID NO: 4043678 - RNA, 18 nt, Staphylococcus aureus subsp. aureus N315
uuauaaaucauucuuuau

SEQ ID NO: 4043679 - RNA, 21 nt, Staphylococcus aureus subsp. aureus N315
uuauaaaugaauuauuuaaaa

SEQ ID NO: 4043680 - RNA, 14 nt, Staphylococcus aureus subsp. aureus N315
uuauaaaugauuaa

SEQ ID NO: 4043681 - RNA, 18 nt, Staphylococcus aureus subsp. aureus N315
uuauaaaugauuaaagug

SEQ ID NO: 4043682 - RNA, 16 nt, Staphylococcus aureus subsp. aureus N315
uuauaacaaaaauugc

SEQ ID NO: 4043683 - RNA, 12 nt, Staphylococcus aureus subsp. aureus N315
uuauaacauuua

SEQ ID NO: 4043684 - RNA, 16 nt, Staphylococcus aureus subsp. aureus N315
uuauaaccacaccaug

SEQ ID NO: 4043685 - RNA, 15 nt, Staphylococcus aureus subsp. aureus N315
uuauaacgugcuuuu

SEQ ID NO: 4043686 - RNA, 23 nt, Staphylococcus aureus subsp. aureus N315
uuauaacucuauccaaagacaua

SEQ ID NO: 4043687 - RNA, 19 nt, Staphylococcus aureus subsp. aureus N315
uuauaagaauuuaaaagag

SEQ ID NO: 4043688 - RNA, 21 nt, Staphylococcus aureus subsp. aureus N315
uuauaagaauuuaaaagagaa

SEQ ID NO: 4043689 - RNA, 17 nt, Staphylococcus aureus subsp. aureus N315
uuauaaguaaauaauag

SEQ ID NO: 4043690 - RNA, 15 nt, Staphylococcus aureus subsp. aureus N315
uuauaaguauauaau

SEQ ID NO: 4043691 - RNA, 21 nt, Staphylococcus aureus subsp. aureus N315
uuauaaguaucgccaucauuc

SEQ ID NO: 4043692 - RNA, 13 nt, Staphylococcus aureus subsp. aureus N315
uuauaaguauuca

SEQ ID NO: 4043693 - RNA, 19 nt, Staphylococcus aureus subsp. aureus N315
uuauaaguuaaaaauguaa

SEQ ID NO: 4043694 - RNA, 22 nt, Staphylococcus aureus subsp. aureus N315
uuauaaguuaaaaauguaaaua

SEQ ID NO: 4043695 - RNA, 14 nt, Staphylococcus aureus subsp. aureus N315
uuauaaguugcaua

SEQ ID NO: 4043696 - RNA, 13 nt, Staphylococcus aureus subsp. aureus N315
uuauaauuguuca

SEQ ID NO: 4043697 - RNA, 23 nt, Staphylococcus aureus subsp. aureus N315
uuauaauuucaguaggacauaua

SEQ ID NO: 4043698 - RNA, 13 nt, Staphylococcus aureus subsp. aureus N315
uuauacaauacuu

SEQ ID NO: 4043699 - RNA, 14 nt, Staphylococcus aureus subsp. aureus N315
uuauacacuuuuug

SEQ ID NO: 4043700 - RNA, 15 nt, Staphylococcus aureus subsp. aureus N315
uuauacagugaaucu

SEQ ID NO: 4043701 - RNA, 19 nt, Staphylococcus aureus subsp. aureus N315
uuauacagugaaucuaaac

SEQ ID NO: 4043702 - RNA, 15 nt, Staphylococcus aureus subsp. aureus N315
uuauacauaaauauu

SEQ ID NO: 4043703 - RNA, 10 nt, Staphylococcus aureus subsp. aureus N315
uuauacugug

SEQ ID NO: 4043704 - RNA, 21 nt, Staphylococcus aureus subsp. aureus N315
uuauagaugacuguagaaaac

SEQ ID NO: 4043705 - RNA, 17 nt, Staphylococcus aureus subsp. aureus N315
uuauagcauuucuuuau

SEQ ID NO: 4043706 - RNA, 13 nt, Staphylococcus aureus subsp. aureus N315
uuauagccuucau

SEQ ID NO: 4043707 - RNA, 17 nt, Staphylococcus aureus subsp. aureus N315
uuauagucuuaaacaua

SEQ ID NO: 4043708 - RNA, 22 nt, Staphylococcus aureus subsp. aureus N315
uuauagugguaaaaaguuuaaa

SEQ ID NO: 4043709 - RNA, 14 nt, Staphylococcus aureus subsp. aureus N315
uuauauaaaaagaa

SEQ ID NO: 4043710 - RNA, 17 nt, Staphylococcus aureus subsp. aureus N315
uuauauaaacaaaaauc

SEQ ID NO: 4043711 - RNA, 15 nt, Staphylococcus aureus subsp. aureus N315
uuauauaaauaggca

SEQ ID NO: 4043712 - RNA, 13 nt, Staphylococcus aureus subsp. aureus N315
uuauauaaauuac

SEQ ID NO: 4043713 - RNA, 19 nt, Staphylococcus aureus subsp. aureus N315
uuauauaaauuuguaccaa

SEQ ID NO: 4043714 - RNA, 23 nt, Staphylococcus aureus subsp. aureus N315
uuauauaagucauacgcaaugau

SEQ ID NO: 4043715 - RNA, 23 nt, Staphylococcus aureus subsp. aureus N315
uuauauaagugaccgauugcacg

SEQ ID NO: 4043716 - RNA, 13 nt, Staphylococcus aureus subsp. aureus N315
uuauauaauucuu

SEQ ID NO: 4043717 - RNA, 19 nt, Staphylococcus aureus subsp. aureus N315
uuauauacuaguucaacuc

SEQ ID NO: 4043718 - RNA, 13 nt, Staphylococcus aureus subsp. aureus N315
uuauauagaaaac

SEQ ID NO: 4043719 - RNA, 17 nt, Staphylococcus aureus subsp. aureus N315
uuauauagacaguaguu

SEQ ID NO: 4043720 - RNA, 14 nt, Staphylococcus aureus subsp. aureus N315
uuauauauauuaaa

SEQ ID NO: 4043721 - RNA, 17 nt, Staphylococcus aureus subsp. aureus N315
uuauauauauuaaagua

SEQ ID NO: 4043722 - RNA, 18 nt, Staphylococcus aureus subsp. aureus N315
uuauauauauuaaaguaa

SEQ ID NO: 4043723 - RNA, 14 nt, Staphylococcus aureus subsp. aureus N315
uuauaucaaaaaau

SEQ ID NO: 4043724 - RNA, 22 nt, Staphylococcus aureus subsp. aureus N315
uuauaucuuuuauacauguaca

SEQ ID NO: 4043725 - RNA, 23 nt, Staphylococcus aureus subsp. aureus N315
uuauaugcuguuggcaaaacaau

SEQ ID NO: 4043726 - RNA, 12 nt, Staphylococcus aureus subsp. aureus N315
uuauauguuaua

SEQ ID NO: 4043727 - RNA, 19 nt, Staphylococcus aureus subsp. aureus N315
uuauauugagacaacauug

SEQ ID NO: 4043728 - RNA, 16 nt, Staphylococcus aureus subsp. aureus N315
uuauauugcaaaaaua

SEQ ID NO: 4043729 - RNA, 18 nt, Staphylococcus aureus subsp. aureus N315
uuauauugcgaaaaauaa

SEQ ID NO: 4043730 - RNA, 16 nt, Staphylococcus aureus subsp. aureus N315
uuauauuguauuuuau

SEQ ID NO: 4043731 - RNA, 16 nt, Staphylococcus aureus subsp. aureus N315
uuauauuguuaaaauu

SEQ ID NO: 4043732 - RNA, 17 nt, Staphylococcus aureus subsp. aureus N315
uuauauuuaaaugucuu

SEQ ID NO: 4043733 - RNA, 13 nt, Staphylococcus aureus subsp. aureus N315
uuauauuuuauuu

SEQ ID NO: 4043734 - RNA, 11 nt, Staphylococcus aureus subsp. aureus N315
uuauauuuucu

SEQ ID NO: 4043735 - RNA, 15 nt, Staphylococcus aureus subsp. aureus N315
uuauauuuucucaua

SEQ ID NO: 4043736 - RNA, 13 nt, Staphylococcus aureus subsp. aureus N315
uuaucaacaacaa

SEQ ID NO: 4043737 - RNA, 19 nt, Staphylococcus aureus subsp. aureus N315
uuaucaagagguaaaucug

SEQ ID NO: 4043738 - RNA, 22 nt, Staphylococcus aureus subsp. aureus N315
uuaucaauaaaucaguaguuuu

SEQ ID NO: 4043739 - RNA, 22 nt, Staphylococcus aureus subsp. aureus N315
uuaucagcauuaaucguauuuu

SEQ ID NO: 4043740 - RNA, 16 nt, Staphylococcus aureus subsp. aureus N315
uuaucagcuuuaauaa

SEQ ID NO: 4043741 - RNA, 14 nt, Staphylococcus aureus subsp. aureus N315
uuaucauuaaauug

SEQ ID NO: 4043742 - RNA, 13 nt, Staphylococcus aureus subsp. aureus N315
uuauuuaaaacuu

SEQ ID NO: 4043743 - RNA, 16 nt, Staphylococcus aureus subsp. aureus N315
uuauuuaaaacuugua

SEQ ID NO: 4043744 - RNA, 22 nt, Staphylococcus aureus subsp. aureus N315
uuauuuaaaacuuguaaauuua

SEQ ID NO: 4043745 - RNA, 14 nt, Staphylococcus aureus subsp. aureus N315
uuauuuaaaaugcu

SEQ ID NO: 4043746 - RNA, 13 nt, Staphylococcus aureus subsp. aureus N315
uuauuuaacacuu

SEQ ID NO: 4043747 - RNA, 22 nt, Staphylococcus aureus subsp. aureus N315
uuauuuacaccugcuaguucag

SEQ ID NO: 4043748 - RNA, 12 nt, Staphylococcus aureus subsp. aureus N315
uuauuuaguaca

SEQ ID NO: 4043749 - RNA, 17 nt, Staphylococcus aureus subsp. aureus N315
uuauuuauaaacaauaa

SEQ ID NO: 4043750 - RNA, 18 nt, Staphylococcus aureus subsp. aureus N315
uuauuuauacuaaauuga

SEQ ID NO: 4043751 - RNA, 12 nt, Staphylococcus aureus subsp. aureus N315
uuauuuauauuu

SEQ ID NO: 4043752 - RNA, 16 nt, Staphylococcus aureus subsp. aureus N315
uuauuuauucagcauu

SEQ ID NO: 4043753 - RNA, 15 nt, Staphylococcus aureus subsp. aureus N315
uuauuucaauuauca

SEQ ID NO: 4043754 - RNA, 17 nt, Staphylococcus aureus subsp. aureus N315
uuauuucaauuaucaaa

SEQ ID NO: 4043755 - RNA, 12 nt, Staphylococcus aureus subsp. aureus N315
uuauuucagcuu

SEQ ID NO: 4043756 - RNA, 21 nt, Staphylococcus aureus subsp. aureus N315
uuauuucuauaucuauuuauc

SEQ ID NO: 4043757 - RNA, 17 nt, Staphylococcus aureus subsp. aureus N315
uuauuugaaugcaaauc

SEQ ID NO: 4043758 - RNA, 18 nt, Staphylococcus aureus subsp. aureus N315
uuauuugauaaugauagu

SEQ ID NO: 4043759 - RNA, 21 nt, Staphylococcus aureus subsp. aureus N315
uuauuugauaaugauagugua

SEQ ID NO: 4043760 - RNA, 15 nt, Staphylococcus aureus subsp. aureus N315
uuauuugauuauucu

SEQ ID NO: 4043761 - RNA, 19 nt, Staphylococcus aureus subsp. aureus N315
uuauuugauucuauuucuu

SEQ ID NO: 4043762 - RNA, 21 nt, Staphylococcus aureus subsp. aureus N315
uuauuuggaugguaaguauaa

SEQ ID NO: 4043763 - RNA, 20 nt, Staphylococcus aureus subsp. aureus N315
uuauuuggcucuauaucaaa

SEQ ID NO: 4043764 - RNA, 20 nt, Staphylococcus aureus subsp. aureus N315
uuauuuggguaacauuagca

SEQ ID NO: 4043765 - RNA, 15 nt, Staphylococcus aureus subsp. aureus N315
uuauuuguaauuuca

SEQ ID NO: 4043766 - RNA, 13 nt, Staphylococcus aureus subsp. aureus N315
uuauuuuaucauc

SEQ ID NO: 4043767 - RNA, 21 nt, Staphylococcus aureus subsp. aureus N315
uuauuuuaucaucuauucaac

SEQ ID NO: 4043768 - RNA, 13 nt, Staphylococcus aureus subsp. aureus N315
uuauuuucaauaa

SEQ ID NO: 4043769 - RNA, 23 nt, Staphylococcus aureus subsp. aureus N315
uuauuuucaauaaauuuuauaua

SEQ ID NO: 4043770 - RNA, 19 nt, Staphylococcus aureus subsp. aureus N315
uuauuuugcaauugcaaug

SEQ ID NO: 4043771 - RNA, 11 nt, Staphylococcus aureus subsp. aureus N315
uuauuuuuaag

SEQ ID NO: 4043772 - RNA, 10 nt, Staphylococcus aureus subsp. aureus N315
uuauuuuuua

SEQ ID NO: 4043773 - RNA, 13 nt, Staphylococcus aureus subsp. aureus N315
uuauuuuuuuaaa

SEQ ID NO: 4043774 - RNA, 21 nt, Staphylococcus aureus subsp. aureus N315
uuauuuuuuuaaaucuauaua

SEQ ID NO: 4043775 - RNA, 23 nt, Staphylococcus aureus subsp. aureus N315
uucaaaaaauaauagcaaaauua

SEQ ID NO: 4043776 - RNA, 11 nt, Staphylococcus aureus subsp. aureus N315
uucaaaaauag

SEQ ID NO: 4043777 - RNA, 14 nt, Staphylococcus aureus subsp. aureus N315
uucaaaaauaguaa

SEQ ID NO: 4043778 - RNA, 19 nt, Staphylococcus aureus subsp. aureus N315
uucaaaaaucauaccacgg

SEQ ID NO: 4043779 - RNA, 15 nt, Staphylococcus aureus subsp. aureus N315
uucaaaaauuaauca

SEQ ID NO: 4043780 - RNA, 19 nt, Staphylococcus aureus subsp. aureus N315
uucaaaacguuuaauugca

SEQ ID NO: 4043781 - RNA, 22 nt, Staphylococcus aureus subsp. aureus N315
uucaaaauaguaaagugaaaua

SEQ ID NO: 4043782 - RNA, 14 nt, Staphylococcus aureus subsp. aureus N315
uucaaaaucaaauu

SEQ ID NO: 4043783 - RNA, 19 nt, Staphylococcus aureus subsp. aureus N315
uucaaaaugccaagaagac

SEQ ID NO: 4043784 - RNA, 17 nt, Staphylococcus aureus subsp. aureus N315
uucaaaauucaauauua

SEQ ID NO: 4043785 - RNA, 19 nt, Staphylococcus aureus subsp. aureus N315
uucaaaauucaauauuaau

SEQ ID NO: 4043786 - RNA, 15 nt, Staphylococcus aureus subsp. aureus N315
uucaaaauuuugacu

SEQ ID NO: 4043787 - RNA, 12 nt, Staphylococcus aureus subsp. aureus N315
uucaaacauauu

SEQ ID NO: 4043788 - RNA, 23 nt, Staphylococcus aureus subsp. aureus N315
uucaaagacacggccugcaaguc

SEQ ID NO: 4043789 - RNA, 15 nt, Staphylococcus aureus subsp. aureus N315
uucaaagacguacau

SEQ ID NO: 4043790 - RNA, 18 nt, Staphylococcus aureus subsp. aureus N315
uucaaagcgauaaaguau

SEQ ID NO: 4043791 - RNA, 19 nt, Staphylococcus aureus subsp. aureus N315
uucaaagcugucaacuugu

SEQ ID NO: 4043792 - RNA, 21 nt, Staphylococcus aureus subsp. aureus N315
uucaaaguagacauugaauaa

SEQ ID NO: 4043793 - RNA, 13 nt, Staphylococcus aureus subsp. aureus N315
uucaaauaaagau

SEQ ID NO: 4043794 - RNA, 13 nt, Staphylococcus aureus subsp. aureus N315
uucaaauaaauca

SEQ ID NO: 4043795 - RNA, 21 nt, Staphylococcus aureus subsp. aureus N315
uucaaauaaaucaaacuuuuc

SEQ ID NO: 4043796 - RNA, 21 nt, Staphylococcus aureus subsp. aureus N315
uucaaauaaaugacauuuaau

SEQ ID NO: 4043797 - RNA, 19 nt, Staphylococcus aureus subsp. aureus N315
uucaaauggacuaacguca

SEQ ID NO: 4043798 - RNA, 21 nt, Staphylococcus aureus subsp. aureus N315
uucaaauguugacuacucaau

SEQ ID NO: 4043799 - RNA, 18 nt, Staphylococcus aureus subsp. aureus N315
uucaacaaacauaaauaa

SEQ ID NO: 4043800 - RNA, 19 nt, Staphylococcus aureus subsp. aureus N315
uucaacaaacauaaauaag

SEQ ID NO: 4043801 - RNA, 17 nt, Staphylococcus aureus subsp. aureus N315
uucaacagggguaaaac

SEQ ID NO: 4043802 - RNA, 18 nt, Staphylococcus aureus subsp. aureus N315
uucaacauaacucaaaua

SEQ ID NO: 4043803 - RNA, 16 nt, Staphylococcus aureus subsp. aureus N315
uucaacauauaaauca

SEQ ID NO: 4043804 - RNA, 14 nt, Staphylococcus aureus subsp. aureus N315
uucaacauauuaua

SEQ ID NO: 4043805 - RNA, 15 nt, Staphylococcus aureus subsp. aureus N315
uucaacauuacaugc

SEQ ID NO: 4043806 - RNA, 13 nt, Staphylococcus aureus subsp. aureus N315
uucaacuacuuca

SEQ ID NO: 4043807 - RNA, 15 nt, Staphylococcus aureus subsp. aureus N315
uucaacuacuucauc

SEQ ID NO: 4043808 - RNA, 23 nt, Staphylococcus aureus subsp. aureus N315
uucaacuaguaaaucaaagauga

SEQ ID NO: 4043809 - RNA, 18 nt, Staphylococcus aureus subsp. aureus N315
uucaacuuauaaaaugaa

SEQ ID NO: 4043810 - RNA, 19 nt, Staphylococcus aureus subsp. aureus N315
uucaacuuauaaaaugaaa

SEQ ID NO: 4043811 - RNA, 18 nt, Staphylococcus aureus subsp. aureus N315
uucaacuuuaaucaaaaa

SEQ ID NO: 4043812 - RNA, 19 nt, Staphylococcus aureus subsp. aureus N315
uucaacuuuaguuguuagg

SEQ ID NO: 4043813 - RNA, 11 nt, Staphylococcus aureus subsp. aureus N315
uucaacuuuuc

SEQ ID NO: 4043814 - RNA, 16 nt, Staphylococcus aureus subsp. aureus N315
uucaacuuuuuaauaa

SEQ ID NO: 4043815 - RNA, 16 nt, Staphylococcus aureus subsp. aureus N315
uucaagaacaaucaau

SEQ ID NO: 4043816 - RNA, 14 nt, Staphylococcus aureus subsp. aureus N315
uucaagaccaugca

SEQ ID NO: 4043817 - RNA, 16 nt, Staphylococcus aureus subsp. aureus N315
uucaagagaaccaccu

SEQ ID NO: 4043818 - RNA, 14 nt, Staphylococcus aureus subsp. aureus N315
uucaagcguuucuu

SEQ ID NO: 4043819 - RNA, 15 nt, Staphylococcus aureus subsp. aureus N315
uucaaguguaguaaa

SEQ ID NO: 4043820 - RNA, 18 nt, Staphylococcus aureus subsp. aureus N315
uucaaguguaguaaaaau

SEQ ID NO: 4043821 - RNA, 13 nt, Staphylococcus aureus subsp. aureus N315
uucaaguuaugcu

SEQ ID NO: 4043822 - RNA, 14 nt, Staphylococcus aureus subsp. aureus N315
uucaaguuuaaaau

SEQ ID NO: 4043823 - RNA, 15 nt, Staphylococcus aureus subsp. aureus N315
uucaaguuuaaaaua

SEQ ID NO: 4043824 - RNA, 16 nt, Staphylococcus aureus subsp. aureus N315
uucaauaaauuuuaua

SEQ ID NO: 4043825 - RNA, 16 nt, Staphylococcus aureus subsp. aureus N315
uucaauaacaaugcag

SEQ ID NO: 4043826 - RNA, 17 nt, Staphylococcus aureus subsp. aureus N315
uucaauaaucuuaggug

SEQ ID NO: 4043827 - RNA, 23 nt, Staphylococcus aureus subsp. aureus N315
uucaauacuucuuguucgauaau

SEQ ID NO: 4043828 - RNA, 14 nt, Staphylococcus aureus subsp. aureus N315
uucaauauuaaaau

SEQ ID NO: 4043829 - RNA, 15 nt, Staphylococcus aureus subsp. aureus N315
uucaauauuaaaaua

SEQ ID NO: 4043830 - RNA, 14 nt, Staphylococcus aureus subsp. aureus N315
uucaugaacagcau

SEQ ID NO: 4043831 - RNA, 21 nt, Staphylococcus aureus subsp. aureus N315
uucaugaauaaauacaauguu

SEQ ID NO: 4043832 - RNA, 13 nt, Staphylococcus aureus subsp. aureus N315
uucaugaauaauu

SEQ ID NO: 4043833 - RNA, 18 nt, Staphylococcus aureus subsp. aureus N315
uucaugcacuuuaacaua

SEQ ID NO: 4043834 - RNA, 21 nt, Staphylococcus aureus subsp. aureus N315
uucaugcacuuuaacauaacu

SEQ ID NO: 4043835 - RNA, 16 nt, Staphylococcus aureus subsp. aureus N315
uucauguaugaaguaa

SEQ ID NO: 4043836 - RNA, 17 nt, Staphylococcus aureus subsp. aureus N315
uucaugugucacaauga

SEQ ID NO: 4043837 - RNA, 21 nt, Staphylococcus aureus subsp. aureus N315
uucauguuugauucuaaauaa

SEQ ID NO: 4043838 - RNA, 15 nt, Staphylococcus aureus subsp. aureus N315
uucauuacaaacuug

SEQ ID NO: 4043839 - RNA, 23 nt, Staphylococcus aureus subsp. aureus N315
uucauuacuuggaaauguauaug

SEQ ID NO: 4043840 - RNA, 22 nt, Staphylococcus aureus subsp. aureus N315
uucauuauagucuuaaacauaa

SEQ ID NO: 4043841 - RNA, 14 nt, Staphylococcus aureus subsp. aureus N315
uucauuaucauuaa

SEQ ID NO: 4043842 - RNA, 17 nt, Staphylococcus aureus subsp. aureus N315
uucauucguacuuccaa

SEQ ID NO: 4043843 - RNA, 23 nt, Staphylococcus aureus subsp. aureus N315
uucauucguacuuccaauacugu

SEQ ID NO: 4043844 - RNA, 14 nt, Staphylococcus aureus subsp. aureus N315
uucauugaaaauaa

SEQ ID NO: 4043845 - RNA, 13 nt, Staphylococcus aureus subsp. aureus N315
uucauugcuuggu

SEQ ID NO: 4043846 - RNA, 17 nt, Staphylococcus aureus subsp. aureus N315
uucauuguaauaauaau

SEQ ID NO: 4043847 - RNA, 16 nt, Staphylococcus aureus subsp. aureus N315
uucauuguuaaacauu

SEQ ID NO: 4043848 - RNA, 12 nt, Staphylococcus aureus subsp. aureus N315
uucauuuaacau

SEQ ID NO: 4043849 - RNA, 16 nt, Staphylococcus aureus subsp. aureus N315
uucauuugaaauaguu

SEQ ID NO: 4043850 - RNA, 15 nt, Staphylococcus aureus subsp. aureus N315
uucauuuguauuaau

SEQ ID NO: 4043851 - RNA, 13 nt, Staphylococcus aureus subsp. aureus N315
uucauuuuaagug

SEQ ID NO: 4043852 - RNA, 19 nt, Staphylococcus aureus subsp. aureus N315
uucauuuuagcaaaagcuu

SEQ ID NO: 4043853 - RNA, 14 nt, Staphylococcus aureus subsp. aureus N315
uucauuuuauaaau

SEQ ID NO: 4043854 - RNA, 17 nt, Staphylococcus aureus subsp. aureus N315
uucauuuucaaauaacu

SEQ ID NO: 4043855 - RNA, 13 nt, Staphylococcus aureus subsp. aureus N315
uucauuuuuucaa

SEQ ID NO: 4043856 - RNA, 20 nt, Staphylococcus aureus subsp. aureus N315
uucauuuuuucaaugucuac

SEQ ID NO: 4043857 - RNA, 11 nt, Staphylococcus aureus subsp. aureus N315
uuccaaaaauu

SEQ ID NO: 4043858 - RNA, 16 nt, Staphylococcus aureus subsp. aureus N315
uuccaaaaauuguaaa

SEQ ID NO: 4043859 - RNA, 13 nt, Staphylococcus aureus subsp. aureus N315
uuccaaaacaaaa

SEQ ID NO: 4043860 - RNA, 21 nt, Staphylococcus aureus subsp. aureus N315
uuccaaacacacuguugaaaa

SEQ ID NO: 4043861 - RNA, 18 nt, Staphylococcus aureus subsp. aureus N315
uuccaaagaaagcuaaua

SEQ ID NO: 4043862 - RNA, 14 nt, Staphylococcus aureus subsp. aureus N315
uuccaaauguucag

SEQ ID NO: 4043863 - RNA, 18 nt, Staphylococcus aureus subsp. aureus N315
uuccaaauugaaauuauc

SEQ ID NO: 4043864 - RNA, 17 nt, Staphylococcus aureus subsp. aureus N315
uuccaaauuugaaacaa

SEQ ID NO: 4043865 - RNA, 16 nt, Staphylococcus aureus subsp. aureus N315
uuccaacacccauaua

SEQ ID NO: 4043866 - RNA, 19 nt, Staphylococcus aureus subsp. aureus N315
uuccaagagaauuaauaau

SEQ ID NO: 4043867 - RNA, 15 nt, Staphylococcus aureus subsp. aureus N315
uuccaagcaucauug

SEQ ID NO: 4043868 - RNA, 17 nt, Staphylococcus aureus subsp. aureus N315
uuccaaguauuuucucu

SEQ ID NO: 4043869 - RNA, 23 nt, Staphylococcus aureus subsp. aureus N315
uuccaauaauaaaccuaaagaua

SEQ ID NO: 4043870 - RNA, 14 nt, Staphylococcus aureus subsp. aureus N315
uuccaauaauaaau

SEQ ID NO: 4043871 - RNA, 16 nt, Staphylococcus aureus subsp. aureus N315
uuccaauaauaaauca

SEQ ID NO: 4043872 - RNA, 18 nt, Staphylococcus aureus subsp. aureus N315
uuccaaucaacuucauau

SEQ ID NO: 4043873 - RNA, 16 nt, Staphylococcus aureus subsp. aureus N315
uuccaauuuaaaauga

SEQ ID NO: 4043874 - RNA, 23 nt, Staphylococcus aureus subsp. aureus N315
uuccacaacaaucacgauuaaug

SEQ ID NO: 4043875 - RNA, 15 nt, Staphylococcus aureus subsp. aureus N315
uuccaccagccucug

SEQ ID NO: 4043876 - RNA, 12 nt, Staphylococcus aureus subsp. aureus N315
uuccacuucauc

SEQ ID NO: 4043877 - RNA, 15 nt, Staphylococcus aureus subsp. aureus N315
uuccagacuccuaaa

SEQ ID NO: 4043878 - RNA, 17 nt, Staphylococcus aureus subsp. aureus N315
uuccauaaauaaaaugc

SEQ ID NO: 4043879 - RNA, 18 nt, Staphylococcus aureus subsp. aureus N315
uuccauauuuuuuaguaa

SEQ ID NO: 4043880 - RNA, 21 nt, Staphylococcus aureus subsp. aureus N315
uuccaucauuuguguaaauga

SEQ ID NO: 4043881 - RNA, 13 nt, Staphylococcus aureus subsp. aureus N315
uuccaugaauaag

SEQ ID NO: 4043882 - RNA, 18 nt, Staphylococcus aureus subsp. aureus N315
uuccaugaguuuacuaaa

SEQ ID NO: 4043883 - RNA, 13 nt, Staphylococcus aureus subsp. aureus N315
uuccauucauaaa

SEQ ID NO: 4043884 - RNA, 15 nt, Staphylococcus aureus subsp. aureus N315
uuccauucauaaaag

SEQ ID NO: 4043885 - RNA, 22 nt, Staphylococcus aureus subsp. aureus N315
uuccauuucgauaccuaaaaua

SEQ ID NO: 4043886 - RNA, 11 nt, Staphylococcus aureus subsp. aureus N315
uuccauuuuuu

SEQ ID NO: 4043887 - RNA, 12 nt, Staphylococcus aureus subsp. aureus N315
uucccacuuauc

SEQ ID NO: 4043888 - RNA, 22 nt, Staphylococcus aureus subsp. aureus N315
uucccaucuuuuagguaauaau

SEQ ID NO: 4043889 - RNA, 19 nt, Staphylococcus aureus subsp. aureus N315
uucccauuuuuaaaauuau

SEQ ID NO: 4043890 - RNA, 15 nt, Staphylococcus aureus subsp. aureus N315
uucccguuaauauca

SEQ ID NO: 4043891 - RNA, 23 nt, Staphylococcus aureus subsp. aureus N315
uuccgcacugccuuuuuguaauu

SEQ ID NO: 4043892 - RNA, 18 nt, Staphylococcus aureus subsp. aureus N315
uuccguugaauuaacaau

SEQ ID NO: 4043893 - RNA, 19 nt, Staphylococcus aureus subsp. aureus N315
uuccuaauggucgugcuug

SEQ ID NO: 4043894 - RNA, 19 nt, Staphylococcus aureus subsp. aureus N315
uuccuaauuauauuaauga

SEQ ID NO: 4043895 - RNA, 20 nt, Staphylococcus aureus subsp. aureus N315
uuccuccuaccgcuaaaauu

SEQ ID NO: 4043896 - RNA, 17 nt, Staphylococcus aureus subsp. aureus N315
uuccugauacaaugauu

SEQ ID NO: 4043897 - RNA, 20 nt, Staphylococcus aureus subsp. aureus N315
uuccugcuacaacuucuucu

SEQ ID NO: 4043898 - RNA, 15 nt, Staphylococcus aureus subsp. aureus N315
uucgaaaagaaauuc

SEQ ID NO: 4043899 - RNA, 17 nt, Staphylococcus aureus subsp. aureus N315
uucgaaaagaaauucua

SEQ ID NO: 4043900 - RNA, 13 nt, Staphylococcus aureus subsp. aureus N315
uucgaaaucaaau

SEQ ID NO: 4043901 - RNA, 20 nt, Staphylococcus aureus subsp. aureus N315
uucgaacgauauuuuaaaaa

SEQ ID NO: 4043902 - RNA, 17 nt, Staphylococcus aureus subsp. aureus N315
uucgaacgcuugaaaaa

SEQ ID NO: 4043903 - RNA, 14 nt, Staphylococcus aureus subsp. aureus N315
uucgaacuaucaau

SEQ ID NO: 4043904 - RNA, 12 nt, Staphylococcus aureus subsp. aureus N315
uucgaacuuuug

SEQ ID NO: 4043905 - RNA, 17 nt, Staphylococcus aureus subsp. aureus N315
uucgaagucauaugcau

SEQ ID NO: 4043906 - RNA, 16 nt, Staphylococcus aureus subsp. aureus N315
uucgaauuuaacaucu

SEQ ID NO: 4043907 - RNA, 19 nt, Staphylococcus aureus subsp. aureus N315
uucgauaccuaaaauaccc

SEQ ID NO: 4043908 - RNA, 15 nt, Staphylococcus aureus subsp. aureus N315
uucgauaguuuauua

SEQ ID NO: 4043909 - RNA, 14 nt, Staphylococcus aureus subsp. aureus N315
uucgauauuuguuu

SEQ ID NO: 4043910 - RNA, 16 nt, Staphylococcus aureus subsp. aureus N315
uucgauuauucuuaau

SEQ ID NO: 4043911 - RNA, 15 nt, Staphylococcus aureus subsp. aureus N315
uucgauucauaaaau

SEQ ID NO: 4043912 - RNA, 23 nt, Staphylococcus aureus subsp. aureus N315
uucgauucauuuaaaaaucaaag

SEQ ID NO: 4043913 - RNA, 15 nt, Staphylococcus aureus subsp. aureus N315
uucgauuguaauaac

SEQ ID NO: 4043914 - RNA, 16 nt, Staphylococcus aureus subsp. aureus N315
uucgauuuagaagaac

SEQ ID NO: 4043915 - RNA, 16 nt, Staphylococcus aureus subsp. aureus N315
uucgcagcuuuauaau

SEQ ID NO: 4043916 - RNA, 17 nt, Staphylococcus aureus subsp. aureus N315
uucgcaucacugcauau

SEQ ID NO: 4043917 - RNA, 14 nt, Staphylococcus aureus subsp. aureus N315
uucgccuaaauggu

SEQ ID NO: 4043918 - RNA, 17 nt, Staphylococcus aureus subsp. aureus N315
uucuuaaaaagcagcag

SEQ ID NO: 4043919 - RNA, 16 nt, Staphylococcus aureus subsp. aureus N315
uucuuaaaucaacauc

SEQ ID NO: 4043920 - RNA, 13 nt, Staphylococcus aureus subsp. aureus N315
uucuuaauuauca

SEQ ID NO: 4043921 - RNA, 22 nt, Staphylococcus aureus subsp. aureus N315
uucuuagauuuuauauaaaaag

SEQ ID NO: 4043922 - RNA, 22 nt, Staphylococcus aureus subsp. aureus N315
uucuuagauuuucacuaauauu

SEQ ID NO: 4043923 - RNA, 13 nt, Staphylococcus aureus subsp. aureus N315
uucuuauaaaaau

SEQ ID NO: 4043924 - RNA, 14 nt, Staphylococcus aureus subsp. aureus N315
uucuuauaaaaauc

SEQ ID NO: 4043925 - RNA, 13 nt, Staphylococcus aureus subsp. aureus N315
uucuuauaaaaua

SEQ ID NO: 4043926 - RNA, 14 nt, Staphylococcus aureus subsp. aureus N315
uucuuauaaaauaa

SEQ ID NO: 4043927 - RNA, 24 nt, Staphylococcus aureus subsp. aureus N315
uucuuaugcggucuaaaugcucua

SEQ ID NO: 4043928 - RNA, 22 nt, Staphylococcus aureus subsp. aureus N315
uucuucaaaaaauaauagcaaa

SEQ ID NO: 4043929 - RNA, 23 nt, Staphylococcus aureus subsp. aureus N315
uucuucaacaauuucaaugucug

SEQ ID NO: 4043930 - RNA, 16 nt, Staphylococcus aureus subsp. aureus N315
uucuucaccaacuuuu

SEQ ID NO: 4043931 - RNA, 14 nt, Staphylococcus aureus subsp. aureus N315
uucuucacuaaaaa

SEQ ID NO: 4043932 - RNA, 18 nt, Staphylococcus aureus subsp. aureus N315
uucuucacuaaaaauaua

SEQ ID NO: 4043933 - RNA, 18 nt, Staphylococcus aureus subsp. aureus N315
uucuucacugcuguuuuu

SEQ ID NO: 4043934 - RNA, 20 nt, Staphylococcus aureus subsp. aureus N315
uucuucacugcuguuuuuau

SEQ ID NO: 4043935 - RNA, 12 nt, Staphylococcus aureus subsp. aureus N315
uucuucaucaug

SEQ ID NO: 4043936 - RNA, 15 nt, Staphylococcus aureus subsp. aureus N315
uucuucaucuuuuau

SEQ ID NO: 4043937 - RNA, 16 nt, Staphylococcus aureus subsp. aureus N315
uucuucuaauucugaa

SEQ ID NO: 4043938 - RNA, 23 nt, Staphylococcus aureus subsp. aureus N315
uucuucuuguuuagggaauccca

SEQ ID NO: 4043939 - RNA, 14 nt, Staphylococcus aureus subsp. aureus N315
uucuugaaaaguuu

SEQ ID NO: 4043940 - RNA, 19 nt, Staphylococcus aureus subsp. aureus N315
uucuugagcuguuacacuu

SEQ ID NO: 4043941 - RNA, 14 nt, Staphylococcus aureus subsp. aureus N315
uucuugauuguaaa

SEQ ID NO: 4043942 - RNA, 15 nt, Staphylococcus aureus subsp. aureus N315
uucuuuaaauacauc

SEQ ID NO: 4043943 - RNA, 12 nt, Staphylococcus aureus subsp. aureus N315
uucuuuaacaau

SEQ ID NO: 4043944 - RNA, 13 nt, Staphylococcus aureus subsp. aureus N315
uucuuuaacaauu

SEQ ID NO: 4043945 - RNA, 22 nt, Staphylococcus aureus subsp. aureus N315
uucuuuaacaauugauugcucu

SEQ ID NO: 4043946 - RNA, 14 nt, Staphylococcus aureus subsp. aureus N315
uucuuucaggcuuu

SEQ ID NO: 4043947 - RNA, 13 nt, Staphylococcus aureus subsp. aureus N315
uucuuucauaauu

SEQ ID NO: 4043948 - RNA, 14 nt, Staphylococcus aureus subsp. aureus N315
uucuuucauaauua

SEQ ID NO: 4043949 - RNA, 16 nt, Staphylococcus aureus subsp. aureus N315
uucuuucuaaaauaac

SEQ ID NO: 4043950 - RNA, 11 nt, Staphylococcus aureus subsp. aureus N315
uucuuucucua

SEQ ID NO: 4043951 - RNA, 15 nt, Staphylococcus aureus subsp. aureus N315
uucuuugucaucuuu

SEQ ID NO: 4043952 - RNA, 17 nt, Staphylococcus aureus subsp. aureus N315
uucuuuuauaucgcuuu

SEQ ID NO: 4043953 - RNA, 17 nt, Staphylococcus aureus subsp. aureus N315
uucuuuucaaaauaaua

SEQ ID NO: 4043954 - RNA, 23 nt, Staphylococcus aureus subsp. aureus N315
uucuuuucgaaaaucucuguauu

SEQ ID NO: 4043955 - RNA, 13 nt, Staphylococcus aureus subsp. aureus N315
uucuuuuguaaua

SEQ ID NO: 4043956 - RNA, 18 nt, Staphylococcus aureus subsp. aureus N315
uucuuuuguaauaauugc

SEQ ID NO: 4043957 - RNA, 23 nt, Staphylococcus aureus subsp. aureus N315
uucuuuuguaauugaaaugauag

SEQ ID NO: 4043958 - RNA, 14 nt, Staphylococcus aureus subsp. aureus N315
uucuuuuguuuuac

SEQ ID NO: 4043959 - RNA, 15 nt, Staphylococcus aureus subsp. aureus N315
uucuuuuguuuuuau

SEQ ID NO: 4043960 - RNA, 15 nt, Staphylococcus aureus subsp. aureus N315
uucuuuuucaucuuu

SEQ ID NO: 4043961 - RNA, 13 nt, Staphylococcus aureus subsp. aureus N315
uucuuuuugcuuu

SEQ ID NO: 4043962 - RNA, 18 nt, Staphylococcus aureus subsp. aureus N315
uucuuuuuguucggcuuu

SEQ ID NO: 4043963 - RNA, 17 nt, Staphylococcus aureus subsp. aureus N315
uucuuuuuuuguuacca

SEQ ID NO: 4043964 - RNA, 18 nt, Staphylococcus aureus subsp. aureus N315
uucuuuuuuuguuaccaa

SEQ ID NO: 4043965 - RNA, 20 nt, Staphylococcus aureus subsp. aureus N315
uugaaaacaauaaauuucaa

SEQ ID NO: 4043966 - RNA, 19 nt, Staphylococcus aureus subsp. aureus N315
uugaaaaguaauuaaauac

SEQ ID NO: 4043967 - RNA, 23 nt, Staphylococcus aureus subsp. aureus N315
uugaaaauaaucgaacagaaaau

SEQ ID NO: 4043968 - RNA, 16 nt, Staphylococcus aureus subsp. aureus N315
uugaaaaucuaauccu

SEQ ID NO: 4043969 - RNA, 13 nt, Staphylococcus aureus subsp. aureus N315
uugaaaaugacgu

SEQ ID NO: 4043970 - RNA, 17 nt, Staphylococcus aureus subsp. aureus N315
uugaaacgguaucaaca

SEQ ID NO: 4043971 - RNA, 20 nt, Staphylococcus aureus subsp. aureus N315
uugaaacugaguucaauuaa

SEQ ID NO: 4043972 - RNA, 22 nt, Staphylococcus aureus subsp. aureus N315
uugaaaggaauguuuaaaaaac

SEQ ID NO: 4043973 - RNA, 13 nt, Staphylococcus aureus subsp. aureus N315
uugaaauuaaauu

SEQ ID NO: 4043974 - RNA, 15 nt, Staphylococcus aureus subsp. aureus N315
uugaaauuaauuauc

SEQ ID NO: 4043975 - RNA, 20 nt, Staphylococcus aureus subsp. aureus N315
uugaaauuauuauuuaaauu

SEQ ID NO: 4043976 - RNA, 17 nt, Staphylococcus aureus subsp. aureus N315
uugaaauuuauuauaau

SEQ ID NO: 4043977 - RNA, 19 nt, Staphylococcus aureus subsp. aureus N315
uugaacaauucuucaucau

SEQ ID NO: 4043978 - RNA, 13 nt, Staphylococcus aureus subsp. aureus N315
uugaacagauuca

SEQ ID NO: 4043979 - RNA, 17 nt, Staphylococcus aureus subsp. aureus N315
uugaacauauuauaaaa

SEQ ID NO: 4043980 - RNA, 15 nt, Staphylococcus aureus subsp. aureus N315
uugaacgauaacaau

SEQ ID NO: 4043981 - RNA, 21 nt, Staphylococcus aureus subsp. aureus N315
uugaacgauaacaauuuauua

SEQ ID NO: 4043982 - RNA, 13 nt, Staphylococcus aureus subsp. aureus N315
uugaacuucuuuu

SEQ ID NO: 4043983 - RNA, 15 nt, Staphylococcus aureus subsp. aureus N315
uugaagaauaaaaaa

SEQ ID NO: 4043984 - RNA, 19 nt, Staphylococcus aureus subsp. aureus N315
uugaagaauaaaaaaguug

SEQ ID NO: 4043985 - RNA, 18 nt, Staphylococcus aureus subsp. aureus N315
uugaagaauguuucauau

SEQ ID NO: 4043986 - RNA, 22 nt, Staphylococcus aureus subsp. aureus N315
uugaagaauguuucauaugcau

SEQ ID NO: 4043987 - RNA, 18 nt, Staphylococcus aureus subsp. aureus N315
uugaagaugcuuuaauua

SEQ ID NO: 4043988 - RNA, 20 nt, Staphylococcus aureus subsp. aureus N315
uugaagaugcuuuaauuaaa

SEQ ID NO: 4043989 - RNA, 21 nt, Staphylococcus aureus subsp. aureus N315
uugaaguuacuauauuuauua

SEQ ID NO: 4043990 - RNA, 12 nt, Staphylococcus aureus subsp. aureus N315
uugaaguuguuu

SEQ ID NO: 4043991 - RNA, 14 nt, Staphylococcus aureus subsp. aureus N315
uugaauacauguau

SEQ ID NO: 4043992 - RNA, 19 nt, Staphylococcus aureus subsp. aureus N315
uugaauacuuuauuugaua

SEQ ID NO: 4043993 - RNA, 22 nt, Staphylococcus aureus subsp. aureus N315
uugaauacuuuuuaacugguug

SEQ ID NO: 4043994 - RNA, 21 nt, Staphylococcus aureus subsp. aureus N315
uugaauagugagcguauuauu

SEQ ID NO: 4043995 - RNA, 12 nt, Staphylococcus aureus subsp. aureus N315
uugaauauaaaa

SEQ ID NO: 4043996 - RNA, 13 nt, Staphylococcus aureus subsp. aureus N315
uugaauauaaaaa

SEQ ID NO: 4043997 - RNA, 15 nt, Staphylococcus aureus subsp. aureus N315
uugaauauaaaaaac

SEQ ID NO: 4043998 - RNA, 15 nt, Staphylococcus aureus subsp. aureus N315
uugaauauaguccuu

SEQ ID NO: 4043999 - RNA, 18 nt, Staphylococcus aureus subsp. aureus N315
uugaauauaguccuuccc

SEQ ID NO: 4044000 - RNA, 23 nt, Staphylococcus aureus subsp. aureus N315
uugaauaucacuuuagauaaacu

SEQ ID NO: 4044001 - RNA, 23 nt, Staphylococcus aureus subsp. aureus N315
uugaauauggaaaauguauuauu

SEQ ID NO: 4044002 - RNA, 19 nt, Staphylococcus aureus subsp. aureus N315
uugaauauuguuguaaaug

SEQ ID NO: 4044003 - RNA, 20 nt, Staphylococcus aureus subsp. aureus N315
uugaaucauacgaauuugug

SEQ ID NO: 4044004 - RNA, 12 nt, Staphylococcus aureus subsp. aureus N315
uugaaugaaccu

SEQ ID NO: 4044005 - RNA, 18 nt, Staphylococcus aureus subsp. aureus N315
uugaaugaaccuuuacuc

SEQ ID NO: 4044006 - RNA, 21 nt, Staphylococcus aureus subsp. aureus N315
uugcauaaucaauuucaccuu

SEQ ID NO: 4044007 - RNA, 19 nt, Staphylococcus aureus subsp. aureus N315
uugcauacgaauuaaaaua

SEQ ID NO: 4044008 - RNA, 19 nt, Staphylococcus aureus subsp. aureus N315
uugcauacguaaaugguaa

SEQ ID NO: 4044009 - RNA, 13 nt, Staphylococcus aureus subsp. aureus N315
uugcauauaaaaa

SEQ ID NO: 4044010 - RNA, 15 nt, Staphylococcus aureus subsp. aureus N315
uugcauguaaaauua

SEQ ID NO: 4044011 - RNA, 14 nt, Staphylococcus aureus subsp. aureus N315
uugcauugauuuca

SEQ ID NO: 4044012 - RNA, 22 nt, Staphylococcus aureus subsp. aureus N315
uugccaaaaguuauauaaauuu

SEQ ID NO: 4044013 - RNA, 22 nt, Staphylococcus aureus subsp. aureus N315
uugccauacccauauuaaauuu

SEQ ID NO: 4044014 - RNA, 20 nt, Staphylococcus aureus subsp. aureus N315
uugccaucaauuucuguaau

SEQ ID NO: 4044015 - RNA, 18 nt, Staphylococcus aureus subsp. aureus N315
uugccuguagaauuucuu

SEQ ID NO: 4044016 - RNA, 13 nt, Staphylococcus aureus subsp. aureus N315
uugcgaaaauauc

SEQ ID NO: 4044017 - RNA, 20 nt, Staphylococcus aureus subsp. aureus N315
uugcguuuaauaacauugaa

SEQ ID NO: 4044018 - RNA, 22 nt, Staphylococcus aureus subsp. aureus N315
uugcuaaaaaaauuaaaauguu

SEQ ID NO: 4044019 - RNA, 12 nt, Staphylococcus aureus subsp. aureus N315
uugcuaaaauau

SEQ ID NO: 4044020 - RNA, 15 nt, Staphylococcus aureus subsp. aureus N315
uugcuaaaauaucaa

SEQ ID NO: 4044021 - RNA, 22 nt, Staphylococcus aureus subsp. aureus N315
uugcuaaacgcuaaaauuuccu

SEQ ID NO: 4044022 - RNA, 20 nt, Staphylococcus aureus subsp. aureus N315
uugcuaaaguguagccaaau

SEQ ID NO: 4044023 - RNA, 21 nt, Staphylococcus aureus subsp. aureus N315
uugcuaaccaucauaaauguu

SEQ ID NO: 4044024 - RNA, 16 nt, Staphylococcus aureus subsp. aureus N315
uugcuauauuaguaua

SEQ ID NO: 4044025 - RNA, 18 nt, Staphylococcus aureus subsp. aureus N315
uugcuauauuaguauaau

SEQ ID NO: 4044026 - RNA, 19 nt, Staphylococcus aureus subsp. aureus N315
uugcuaucaaacuuggcaa

SEQ ID NO: 4044027 - RNA, 19 nt, Staphylococcus aureus subsp. aureus N315
uugcucgcgcucuucuuca

SEQ ID NO: 4044028 - RNA, 20 nt, Staphylococcus aureus subsp. aureus N315
uugcucuaauccaaaauaau

SEQ ID NO: 4044029 - RNA, 21 nt, Staphylococcus aureus subsp. aureus N315
uugcucuaauccaaaauaauc

SEQ ID NO: 4044030 - RNA, 15 nt, Staphylococcus aureus subsp. aureus N315
uugcucuuuaacaau

SEQ ID NO: 4044031 - RNA, 18 nt, Staphylococcus aureus subsp. aureus N315
uugcugccaaaaaguauu

SEQ ID NO: 4044032 - RNA, 22 nt, Staphylococcus aureus subsp. aureus N315
uugcuuaaaccuuaauaaugaa

SEQ ID NO: 4044033 - RNA, 13 nt, Staphylococcus aureus subsp. aureus N315
uugcuuaacuucc

SEQ ID NO: 4044034 - RNA, 17 nt, Staphylococcus aureus subsp. aureus N315
uugcuuaacuuccuuuu

SEQ ID NO: 4044035 - RNA, 23 nt, Staphylococcus aureus subsp. aureus N315
uugcuuaaucgggcuauauuuga

SEQ ID NO: 4044036 - RNA, 14 nt, Staphylococcus aureus subsp. aureus N315
uugcuuauguuuuu

SEQ ID NO: 4044037 - RNA, 19 nt, Staphylococcus aureus subsp. aureus N315
uugcuuauuuuuguauucu

SEQ ID NO: 4044038 - RNA, 13 nt, Staphylococcus aureus subsp. aureus N315
uugcuucuguauc

SEQ ID NO: 4044039 - RNA, 17 nt, Staphylococcus aureus subsp. aureus N315
uugcuucuuaucaacaa

SEQ ID NO: 4044040 - RNA, 13 nt, Staphylococcus aureus subsp. aureus N315
uugcuugaaauua

SEQ ID NO: 4044041 - RNA, 17 nt, Staphylococcus aureus subsp. aureus N315
uugcuuggauaauugca

SEQ ID NO: 4044042 - RNA, 15 nt, Staphylococcus aureus subsp. aureus N315
uugcuuuagcucuuu

SEQ ID NO: 4044043 - RNA, 12 nt, Staphylococcus aureus subsp. aureus N315
uuggaagucugc

SEQ ID NO: 4044044 - RNA, 12 nt, Staphylococcus aureus subsp. aureus N315
uuggaaguuuuc

SEQ ID NO: 4044045 - RNA, 13 nt, Staphylococcus aureus subsp. aureus N315
uuggaauacucuu

SEQ ID NO: 4044046 - RNA, 14 nt, Staphylococcus aureus subsp. aureus N315
uuggaauagauguu

SEQ ID NO: 4044047 - RNA, 23 nt, Staphylococcus aureus subsp. aureus N315
uuggaaucaucuuuuugaaauuu

SEQ ID NO: 4044048 - RNA, 16 nt, Staphylococcus aureus subsp. aureus N315
uuggaaucccaaugcu

SEQ ID NO: 4044049 - RNA, 17 nt, Staphylococcus aureus subsp. aureus N315
uuggagcguaaaguuuu

SEQ ID NO: 4044050 - RNA, 15 nt, Staphylococcus aureus subsp. aureus N315
uuggaggugaugaga

SEQ ID NO: 4044051 - RNA, 14 nt, Staphylococcus aureus subsp. aureus N315
uuggauaaaaugau

SEQ ID NO: 4044052 - RNA, 18 nt, Staphylococcus aureus subsp. aureus N315
uuggauaauuucuucuuc

SEQ ID NO: 4044053 - RNA, 17 nt, Staphylococcus aureus subsp. aureus N315
uuggauagguaacuaaa

SEQ ID NO: 4044054 - RNA, 21 nt, Staphylococcus aureus subsp. aureus N315
uuggauagguaacuaaaaugu

SEQ ID NO: 4044055 - RNA, 23 nt, Staphylococcus aureus subsp. aureus N315
uuggaugaacaaaauaacauguu

SEQ ID NO: 4044056 - RNA, 15 nt, Staphylococcus aureus subsp. aureus N315
uuggauuuuaacaag

SEQ ID NO: 4044057 - RNA, 17 nt, Staphylococcus aureus subsp. aureus N315
uuggauuuuaacaagau

SEQ ID NO: 4044058 - RNA, 20 nt, Staphylococcus aureus subsp. aureus N315
uuggauuuuuugguuucuau

SEQ ID NO: 4044059 - RNA, 15 nt, Staphylococcus aureus subsp. aureus N315
uuggcacauaaauca

SEQ ID NO: 4044060 - RNA, 17 nt, Staphylococcus aureus subsp. aureus N315
uuggcacauaaaucaau

SEQ ID NO: 4044061 - RNA, 13 nt, Staphylococcus aureus subsp. aureus N315
uuggccauuggau

SEQ ID NO: 4044062 - RNA, 21 nt, Staphylococcus aureus subsp. aureus N315
uuggcggggccccaacacaga

SEQ ID NO: 4044063 - RNA, 18 nt, Staphylococcus aureus subsp. aureus N315
uuggcucuauaucaaauu

SEQ ID NO: 4044064 - RNA, 18 nt, Staphylococcus aureus subsp. aureus N315
uuggcuucgucaucaaca

SEQ ID NO: 4044065 - RNA, 13 nt, Staphylococcus aureus subsp. aureus N315
uuggcuugcuuca

SEQ ID NO: 4044066 - RNA, 14 nt, Staphylococcus aureus subsp. aureus N315
uugggauauagaaa

SEQ ID NO: 4044067 - RNA, 17 nt, Staphylococcus aureus subsp. aureus N315
uugggcgcuuuuuaauu

SEQ ID NO: 4044068 - RNA, 21 nt, Staphylococcus aureus subsp. aureus N315
uugggcgcuuuuuaauuugua

SEQ ID NO: 4044069 - RNA, 23 nt, Staphylococcus aureus subsp. aureus N315
uuggggaugggccccaacaaaga

SEQ ID NO: 4044070 - RNA, 18 nt, Staphylococcus aureus subsp. aureus N315
uuggggugagggccccaa

SEQ ID NO: 4044071 - RNA, 20 nt, Staphylococcus aureus subsp. aureus N315
uugguaaaaaucucaaaauu

SEQ ID NO: 4044072 - RNA, 20 nt, Staphylococcus aureus subsp. aureus N315
uugguaagcuaauuucuaau

SEQ ID NO: 4044073 - RNA, 18 nt, Staphylococcus aureus subsp. aureus N315
uugguagcauuuuagauu

SEQ ID NO: 4044074 - RNA, 20 nt, Staphylococcus aureus subsp. aureus N315
uugguauacaguuuuacuau

SEQ ID NO: 4044075 - RNA, 19 nt, Staphylococcus aureus subsp. aureus N315
uuggucaccuacagauaaa

SEQ ID NO: 4044076 - RNA, 18 nt, Staphylococcus aureus subsp. aureus N315
uuggucauagaaauuuua

SEQ ID NO: 4044077 - RNA, 12 nt, Staphylococcus aureus subsp. aureus N315
uugguuaaaguu

SEQ ID NO: 4044078 - RNA, 21 nt, Staphylococcus aureus subsp. aureus N315
uugguuaauacguuuaauaau

SEQ ID NO: 4044079 - RNA, 14 nt, Staphylococcus aureus subsp. aureus N315
uugguuacuuagua

SEQ ID NO: 4044080 - RNA, 17 nt, Staphylococcus aureus subsp. aureus N315
uugguuuagacaaccag

SEQ ID NO: 4044081 - RNA, 17 nt, Staphylococcus aureus subsp. aureus N315
uugguuucuuaacauaa

SEQ ID NO: 4044082 - RNA, 18 nt, Staphylococcus aureus subsp. aureus N315
uugguuuggauaaaauga

SEQ ID NO: 4044083 - RNA, 14 nt, Staphylococcus aureus subsp. aureus N315
uuguaaacuucuuu

SEQ ID NO: 4044084 - RNA, 18 nt, Staphylococcus aureus subsp. aureus N315
uuguaaagcaugaauagc

SEQ ID NO: 4044085 - RNA, 12 nt, Staphylococcus aureus subsp. aureus N315
uuguaaauuuaa

SEQ ID NO: 4044086 - RNA, 20 nt, Staphylococcus aureus subsp. aureus N315
uuguaaauuuauuuuuaauu

SEQ ID NO: 4044087 - RNA, 20 nt, Staphylococcus aureus subsp. aureus N315
uuguaacaagcuuuuuucaa

SEQ ID NO: 4044088 - RNA, 15 nt, Staphylococcus aureus subsp. aureus N315
uuguaacuauugaaa

SEQ ID NO: 4044089 - RNA, 21 nt, Staphylococcus aureus subsp. aureus N315
uuguaagcucaugaaucagau

SEQ ID NO: 4044090 - RNA, 19 nt, Staphylococcus aureus subsp. aureus N315
uuguaauaauugcauguaa

SEQ ID NO: 4044091 - RNA, 21 nt, Staphylococcus aureus subsp. aureus N315
uuguaaucccauuuuaaaguc

SEQ ID NO: 4044092 - RNA, 21 nt, Staphylococcus aureus subsp. aureus N315
uuguaauuagugcaaguaauu

SEQ ID NO: 4044093 - RNA, 22 nt, Staphylococcus aureus subsp. aureus N315
uuuaaaaggcgaaacauuaaaa

SEQ ID NO: 4044094 - RNA, 12 nt, Staphylococcus aureus subsp. aureus N315
uuuaaaaguaac

SEQ ID NO: 4044095 - RNA, 18 nt, Staphylococcus aureus subsp. aureus N315
uuuaaaaguaagcaccug

SEQ ID NO: 4044096 - RNA, 21 nt, Staphylococcus aureus subsp. aureus N315
uuuaaaauacgacaccaacau

SEQ ID NO: 4044097 - RNA, 21 nt, Staphylococcus aureus subsp. aureus N315
uuuaaaauaguucuuuaaauu

SEQ ID NO: 4044098 - RNA, 18 nt, Staphylococcus aureus subsp. aureus N315
uuuaaaaucucauaauaa

SEQ ID NO: 4044099 - RNA, 11 nt, Staphylococcus aureus subsp. aureus N315
uuuaaaaugcu

SEQ ID NO: 4044100 - RNA, 22 nt, Staphylococcus aureus subsp. aureus N315
uuuaaaauuauuuggcucuaua

SEQ ID NO: 4044101 - RNA, 19 nt, Staphylococcus aureus subsp. aureus N315
uuuaaaauuugugcauuca

SEQ ID NO: 4044102 - RNA, 24 nt, Staphylococcus aureus subsp. aureus N315
uuuaaaauuugugcauucaucaau

SEQ ID NO: 4044103 - RNA, 18 nt, Staphylococcus aureus subsp. aureus N315
uuuaaacauccaauuaug

SEQ ID NO: 4044104 - RNA, 21 nt, Staphylococcus aureus subsp. aureus N315
uuuaaacaugaacaaucagau

SEQ ID NO: 4044105 - RNA, 19 nt, Staphylococcus aureus subsp. aureus N315
uuuaaacgaucacuuggcu

SEQ ID NO: 4044106 - RNA, 13 nt, Staphylococcus aureus subsp. aureus N315
uuuaaacgcucau

SEQ ID NO: 4044107 - RNA, 16 nt, Staphylococcus aureus subsp. aureus N315
uuuaaacucguaaauu

SEQ ID NO: 4044108 - RNA, 15 nt, Staphylococcus aureus subsp. aureus N315
uuuaaagaaaaguuu

SEQ ID NO: 4044109 - RNA, 16 nt, Staphylococcus aureus subsp. aureus N315
uuuaaagaaaaguuua

SEQ ID NO: 4044110 - RNA, 18 nt, Staphylococcus aureus subsp. aureus N315
uuuaaagcaucauauaca

SEQ ID NO: 4044111 - RNA, 16 nt, Staphylococcus aureus subsp. aureus N315
uuuaaagcuaaauguu

SEQ ID NO: 4044112 - RNA, 22 nt, Staphylococcus aureus subsp. aureus N315
uuuaaagcuaaauguuaaugcu

SEQ ID NO: 4044113 - RNA, 16 nt, Staphylococcus aureus subsp. aureus N315
uuuaaaggcauaauaa

SEQ ID NO: 4044114 - RNA, 21 nt, Staphylococcus aureus subsp. aureus N315
uuuaaagguauugugauuuca

SEQ ID NO: 4044115 - RNA, 15 nt, Staphylococcus aureus subsp. aureus N315
uuuaaauaaaugacu

SEQ ID NO: 4044116 - RNA, 22 nt, Staphylococcus aureus subsp. aureus N315
uuuaaauaaaugacuucacauu

SEQ ID NO: 4044117 - RNA, 22 nt, Staphylococcus aureus subsp. aureus N315
uuuaaauaaucgaaaauuucag

SEQ ID NO: 4044118 - RNA, 19 nt, Staphylococcus aureus subsp. aureus N315
uuuaaaucuuguucuaauu

SEQ ID NO: 4044119 - RNA, 18 nt, Staphylococcus aureus subsp. aureus N315
uuuaaaucuuuuagcuuu

SEQ ID NO: 4044120 - RNA, 19 nt, Staphylococcus aureus subsp. aureus N315
uuuaaaugauuucacuuca

SEQ ID NO: 4044121 - RNA, 20 nt, Staphylococcus aureus subsp. aureus N315
uuuaaauguauuuuuacuuu

SEQ ID NO: 4044122 - RNA, 18 nt, Staphylococcus aureus subsp. aureus N315
uuuaaaugucuuucaaau

SEQ ID NO: 4044123 - RNA, 14 nt, Staphylococcus aureus subsp. aureus N315
uuuaaauucauuuu

SEQ ID NO: 4044124 - RNA, 20 nt, Staphylococcus aureus subsp. aureus N315
uuuaaauuuucaucauaauc

SEQ ID NO: 4044125 - RNA, 14 nt, Staphylococcus aureus subsp. aureus N315
uuuaacaaaauaua

SEQ ID NO: 4044126 - RNA, 13 nt, Staphylococcus aureus subsp. aureus N315
uuuaacaaaauua

SEQ ID NO: 4044127 - RNA, 24 nt, Staphylococcus aureus subsp. aureus N315
uuuaacaagauaacuagcaaaugc

SEQ ID NO: 4044128 - RNA, 16 nt, Staphylococcus aureus subsp. aureus N315
uuuaacacuucaguua

SEQ ID NO: 4044129 - RNA, 19 nt, Staphylococcus aureus subsp. aureus N315
uuuaacagcgugaauauaa

SEQ ID NO: 4044130 - RNA, 21 nt, Staphylococcus aureus subsp. aureus N315
uuuaacccacauuaaauauua

SEQ ID NO: 4044131 - RNA, 18 nt, Staphylococcus aureus subsp. aureus N315
uuuaacguuauucauuug

SEQ ID NO: 4044132 - RNA, 21 nt, Staphylococcus aureus subsp. aureus N315
uuuaacuauguuacuuauaua

SEQ ID NO: 4044133 - RNA, 23 nt, Staphylococcus aureus subsp. aureus N315
uuuaacucuugaaacacaaaaag

SEQ ID NO: 4044134 - RNA, 19 nt, Staphylococcus aureus subsp. aureus N315
uuuaacuucugauucuuca

SEQ ID NO: 4044135 - RNA, 17 nt, Staphylococcus aureus subsp. aureus N315
uuuaacuucuuuuguuu

SEQ ID NO: 4044136 - RNA, 18 nt, Staphylococcus aureus subsp. aureus N315
uuuaagauagguuuauuu

SEQ ID NO: 4044137 - RNA, 14 nt, Staphylococcus aureus subsp. aureus N315
uuuaagaucaauau

SEQ ID NO: 4044138 - RNA, 15 nt, Staphylococcus aureus subsp. aureus N315
uuuaagaucaauauc

SEQ ID NO: 4044139 - RNA, 12 nt, Staphylococcus aureus subsp. aureus N315
uuuaagcugcuc

SEQ ID NO: 4044140 - RNA, 13 nt, Staphylococcus aureus subsp. aureus N315
uuuaagcugcucg

SEQ ID NO: 4044141 - RNA, 15 nt, Staphylococcus aureus subsp. aureus N315
uuuaagcuuaucaac

SEQ ID NO: 4044142 - RNA, 18 nt, Staphylococcus aureus subsp. aureus N315
uuuaagucauuacguaac

SEQ ID NO: 4044143 - RNA, 19 nt, Staphylococcus aureus subsp. aureus N315
uuuaagugaugaccaauau

SEQ ID NO: 4044144 - RNA, 23 nt, Staphylococcus aureus subsp. aureus N315
uuuaaguuauuuuguccagacaa

SEQ ID NO: 4044145 - RNA, 17 nt, Staphylococcus aureus subsp. aureus N315
uuuaaguuuauaaucag

SEQ ID NO: 4044146 - RNA, 12 nt, Staphylococcus aureus subsp. aureus N315
uuuaauaaaaac

SEQ ID NO: 4044147 - RNA, 18 nt, Staphylococcus aureus subsp. aureus N315
uuuaauaaaaaccaauau

SEQ ID NO: 4044148 - RNA, 21 nt, Staphylococcus aureus subsp. aureus N315
uuuaauaaaaaccaauauuuc

SEQ ID NO: 4044149 - RNA, 23 nt, Staphylococcus aureus subsp. aureus N315
uuuaauaaaaaccaauauuucug

SEQ ID NO: 4044150 - RNA, 17 nt, Staphylococcus aureus subsp. aureus N315
uuuaauaaaaucaucuu

SEQ ID NO: 4044151 - RNA, 16 nt, Staphylococcus aureus subsp. aureus N315
uuuaauaaaucguguu

SEQ ID NO: 4044152 - RNA, 13 nt, Staphylococcus aureus subsp. aureus N315
uuuaauaacuaaa

SEQ ID NO: 4044153 - RNA, 18 nt, Staphylococcus aureus subsp. aureus N315
uuuaauaauuaaauauaa

SEQ ID NO: 4044154 - RNA, 17 nt, Staphylococcus aureus subsp. aureus N315
uuuaauagacauuaacu

SEQ ID NO: 4044155 - RNA, 12 nt, Staphylococcus aureus subsp. aureus N315
uuuaauauauuu

SEQ ID NO: 4044156 - RNA, 21 nt, Staphylococcus aureus subsp. aureus N315
uuuaauauugaaaugagcuua

SEQ ID NO: 4044157 - RNA, 15 nt, Staphylococcus aureus subsp. aureus N315
uuuaauauuuucuua

SEQ ID NO: 4044158 - RNA, 16 nt, Staphylococcus aureus subsp. aureus N315
uuuaauccuucuccaa

SEQ ID NO: 4044159 - RNA, 19 nt, Staphylococcus aureus subsp. aureus N315
uuuaaucguaacauaucag

SEQ ID NO: 4044160 - RNA, 13 nt, Staphylococcus aureus subsp. aureus N315
uuuaaucuauccu

SEQ ID NO: 4044161 - RNA, 20 nt, Staphylococcus aureus subsp. aureus N315
uuuaaugauuuuucaucaau

SEQ ID NO: 4044162 - RNA, 18 nt, Staphylococcus aureus subsp. aureus N315
uuuaaugccggucauaac

SEQ ID NO: 4044163 - RNA, 21 nt, Staphylococcus aureus subsp. aureus N315
uuuaaugggcgauaaaaguug

SEQ ID NO: 4044164 - RNA, 20 nt, Staphylococcus aureus subsp. aureus N315
uuuaauguauaaauuaguuu

SEQ ID NO: 4044165 - RNA, 12 nt, Staphylococcus aureus subsp. aureus N315
uuuaauguguaa

SEQ ID NO: 4044166 - RNA, 14 nt, Staphylococcus aureus subsp. aureus N315
uuuaauguuugcuu

SEQ ID NO: 4044167 - RNA, 13 nt, Staphylococcus aureus subsp. aureus N315
uuuaauuaaagca

SEQ ID NO: 4044168 - RNA, 14 nt, Staphylococcus aureus subsp. aureus N315
uuuaauuaaaguua

SEQ ID NO: 4044169 - RNA, 17 nt, Staphylococcus aureus subsp. aureus N315
uuuaauuaauuaucaua

SEQ ID NO: 4044170 - RNA, 23 nt, Staphylococcus aureus subsp. aureus N315
uuuaauuacagguuuaaacaucu

SEQ ID NO: 4044171 - RNA, 11 nt, Staphylococcus aureus subsp. aureus N315
uuuaauuauuu

SEQ ID NO: 4044172 - RNA, 21 nt, Staphylococcus aureus subsp. aureus N315
uuuaauuauuucccuggaaaa

SEQ ID NO: 4044173 - RNA, 14 nt, Staphylococcus aureus subsp. aureus N315
uuuaauuccaaaga

SEQ ID NO: 4044174 - RNA, 22 nt, Staphylococcus aureus subsp. aureus N315
uuuaauucuauuuuugauuuaa

SEQ ID NO: 4044175 - RNA, 16 nt, Staphylococcus aureus subsp. aureus N315
uuuaauugaaauagaa

SEQ ID NO: 4044176 - RNA, 14 nt, Staphylococcus aureus subsp. aureus N315
uuuaauugcuguaa

SEQ ID NO: 4044177 - RNA, 14 nt, Staphylococcus aureus subsp. aureus N315
uuuaauugguucuu

SEQ ID NO: 4044178 - RNA, 16 nt, Staphylococcus aureus subsp. aureus N315
uuuaauugguucuucu

SEQ ID NO: 4044179 - RNA, 19 nt, Staphylococcus aureus subsp. aureus N315
uuuaauugguucuucuuuc

SEQ ID NO: 4044180 - RNA, 12 nt, Staphylococcus aureus subsp. aureus N315
uuuaucaauauu

SEQ ID NO: 4044181 - RNA, 15 nt, Staphylococcus aureus subsp. aureus N315
uuuaucaauuucuau

SEQ ID NO: 4044182 - RNA, 21 nt, Staphylococcus aureus subsp. aureus N315
uuuaucaauuucuauuucacu

SEQ ID NO: 4044183 - RNA, 13 nt, Staphylococcus aureus subsp. aureus N315
uuuaucacuguau

SEQ ID NO: 4044184 - RNA, 19 nt, Staphylococcus aureus subsp. aureus N315
uuuaucagcgaaauuugua

SEQ ID NO: 4044185 - RNA, 22 nt, Staphylococcus aureus subsp. aureus N315
uuuaucaucaugacuauuucgc

SEQ ID NO: 4044186 - RNA, 13 nt, Staphylococcus aureus subsp. aureus N315
uuuaucauuauuu

SEQ ID NO: 4044187 - RNA, 20 nt, Staphylococcus aureus subsp. aureus N315
uuuaucauuauuugauaaau

SEQ ID NO: 4044188 - RNA, 20 nt, Staphylococcus aureus subsp. aureus N315
uuuauccgucgaauauaauu

SEQ ID NO: 4044189 - RNA, 22 nt, Staphylococcus aureus subsp. aureus N315
uuuauccuuuaaaucauugcgu

SEQ ID NO: 4044190 - RNA, 16 nt, Staphylococcus aureus subsp. aureus N315
uuuaucgaaauauuua

SEQ ID NO: 4044191 - RNA, 18 nt, Staphylococcus aureus subsp. aureus N315
uuuaucgugaagaaaaaa

SEQ ID NO: 4044192 - RNA, 19 nt, Staphylococcus aureus subsp. aureus N315
uuuaucuacauuaaagaaa

SEQ ID NO: 4044193 - RNA, 15 nt, Staphylococcus aureus subsp. aureus N315
uuuaucuaguuguuu

SEQ ID NO: 4044194 - RNA, 16 nt, Staphylococcus aureus subsp. aureus N315
uuuaucuauaugcaua

SEQ ID NO: 4044195 - RNA, 17 nt, Staphylococcus aureus subsp. aureus N315
uuuaucugaaaauauca

SEQ ID NO: 4044196 - RNA, 22 nt, Staphylococcus aureus subsp. aureus N315
uuuaucuguagaaacacuuuua

SEQ ID NO: 4044197 - RNA, 17 nt, Staphylococcus aureus subsp. aureus N315
uuuaugaagugaaauca

SEQ ID NO: 4044198 - RNA, 20 nt, Staphylococcus aureus subsp. aureus N315
uuuaugaauugaguauuaaa

SEQ ID NO: 4044199 - RNA, 22 nt, Staphylococcus aureus subsp. aureus N315
uuuaugagcuucuuuaaauaca

SEQ ID NO: 4044200 - RNA, 19 nt, Staphylococcus aureus subsp. aureus N315
uuuaugcaugcgcaaaagc

SEQ ID NO: 4044201 - RNA, 16 nt, Staphylococcus aureus subsp. aureus N315
uuuauggagugauaua

SEQ ID NO: 4044202 - RNA, 21 nt, Staphylococcus aureus subsp. aureus N315
uuuauggucuugaguacuaau

SEQ ID NO: 4044203 - RNA, 23 nt, Staphylococcus aureus subsp. aureus N315
uuuaugguguagcugaggauuuu

SEQ ID NO: 4044204 - RNA, 21 nt, Staphylococcus aureus subsp. aureus N315
uuuaugguguggugugaugua

SEQ ID NO: 4044205 - RNA, 14 nt, Staphylococcus aureus subsp. aureus N315
uuuauguauuuauu

SEQ ID NO: 4044206 - RNA, 18 nt, Staphylococcus aureus subsp. aureus N315
uuuauguuuuaauuucuu

SEQ ID NO: 4044207 - RNA, 14 nt, Staphylococcus aureus subsp. aureus N315
uuuauuaaagaaac

SEQ ID NO: 4044208 - RNA, 12 nt, Staphylococcus aureus subsp. aureus N315
uuuauuaaauaa

SEQ ID NO: 4044209 - RNA, 13 nt, Staphylococcus aureus subsp. aureus N315
uuuauuaaauaua

SEQ ID NO: 4044210 - RNA, 18 nt, Staphylococcus aureus subsp. aureus N315
uuuauuaauaaauucucu

SEQ ID NO: 4044211 - RNA, 17 nt, Staphylococcus aureus subsp. aureus N315
uuuauuaauauuaguga

SEQ ID NO: 4044212 - RNA, 21 nt, Staphylococcus aureus subsp. aureus N315
uuuauuaauggcaacuaagau

SEQ ID NO: 4044213 - RNA, 16 nt, Staphylococcus aureus subsp. aureus N315
uuuauuaauucugauu

SEQ ID NO: 4044214 - RNA, 12 nt, Staphylococcus aureus subsp. aureus N315
uuuauuacuuau

SEQ ID NO: 4044215 - RNA, 14 nt, Staphylococcus aureus subsp. aureus N315
uuuauuacuuuaau

SEQ ID NO: 4044216 - RNA, 21 nt, Staphylococcus aureus subsp. aureus N315
uuuauuacuuuaauuuaguga

SEQ ID NO: 4044217 - RNA, 14 nt, Staphylococcus aureus subsp. aureus N315
uuuauuagaaugaa

SEQ ID NO: 4044218 - RNA, 19 nt, Staphylococcus aureus subsp. aureus N315
uuuauuaguauucaaaaaa

SEQ ID NO: 4044219 - RNA, 15 nt, Staphylococcus aureus subsp. aureus N315
uuuauuauaaaauag

SEQ ID NO: 4044220 - RNA, 12 nt, Staphylococcus aureus subsp. aureus N315
uuuauuaucagc

SEQ ID NO: 4044221 - RNA, 16 nt, Staphylococcus aureus subsp. aureus N315
uuuauuaucuuuaauu

SEQ ID NO: 4044222 - RNA, 15 nt, Staphylococcus aureus subsp. aureus N315
uuuauucaaaucaua

SEQ ID NO: 4044223 - RNA, 20 nt, Staphylococcus aureus subsp. aureus N315
uuuauugagauagaaauuac

SEQ ID NO: 4044224 - RNA, 15 nt, Staphylococcus aureus subsp. aureus N315
uuuauugcaauaaca

SEQ ID NO: 4044225 - RNA, 16 nt, Staphylococcus aureus subsp. aureus N315
uuuauugccgguuaaa

SEQ ID NO: 4044226 - RNA, 13 nt, Staphylococcus aureus subsp. aureus N315
uuuauuuaacacu

SEQ ID NO: 4044227 - RNA, 22 nt, Staphylococcus aureus subsp. aureus N315
uuuauuuauaaaauaaaaugca

SEQ ID NO: 4044228 - RNA, 16 nt, Staphylococcus aureus subsp. aureus N315
uuuauuugucuuugaa

SEQ ID NO: 4044229 - RNA, 19 nt, Staphylococcus aureus subsp. aureus N315
uuuauuuucaauaaauaaa

SEQ ID NO: 4044230 - RNA, 22 nt, Staphylococcus aureus subsp. aureus N315
uuuauuuuuggauucaccaauu

SEQ ID NO: 4044231 - RNA, 11 nt, Staphylococcus aureus subsp. aureus N315
uuuauuuuuuu

SEQ ID NO: 4044232 - RNA, 15 nt, Staphylococcus aureus subsp. aureus N315
uuucaaaaccaauua

SEQ ID NO: 4044233 - RNA, 24 nt, Staphylococcus aureus subsp. aureus N315
uuucaaaacuagcaguaauauguu

SEQ ID NO: 4044234 - RNA, 14 nt, Staphylococcus aureus subsp. aureus N315
uuucaaaacugcca

SEQ ID NO: 4044235 - RNA, 13 nt, Staphylococcus aureus subsp. aureus N315
uuucaaacauauu

SEQ ID NO: 4044236 - RNA, 20 nt, Staphylococcus aureus subsp. aureus N315
uuucaaacgugauuuuauca

SEQ ID NO: 4044237 - RNA, 14 nt, Staphylococcus aureus subsp. aureus N315
uuucaaauaagaau

SEQ ID NO: 4044238 - RNA, 15 nt, Staphylococcus aureus subsp. aureus N315
uuucaaauaauauaa

SEQ ID NO: 4044239 - RNA, 13 nt, Staphylococcus aureus subsp. aureus N315
uuucaacauuacu

SEQ ID NO: 4044240 - RNA, 23 nt, Staphylococcus aureus subsp. aureus N315
uuucaacuuuugaggagauagua

SEQ ID NO: 4044241 - RNA, 14 nt, Staphylococcus aureus subsp. aureus N315
uuucaagaccaaau

SEQ ID NO: 4044242 - RNA, 15 nt, Staphylococcus aureus subsp. aureus N315
uuucaauaaauuuua

SEQ ID NO: 4044243 - RNA, 16 nt, Staphylococcus aureus subsp. aureus N315
uuucaauccuuuguuu

SEQ ID NO: 4044244 - RNA, 17 nt, Staphylococcus aureus subsp. aureus N315
uuucacaaauucuuuua

SEQ ID NO: 4044245 - RNA, 21 nt, Staphylococcus aureus subsp. aureus N315
uuucacgaauaucuuaaagaa

SEQ ID NO: 4044246 - RNA, 21 nt, Staphylococcus aureus subsp. aureus N315
uuucacgauuuuuaaaaugcu

SEQ ID NO: 4044247 - RNA, 21 nt, Staphylococcus aureus subsp. aureus N315
uuucacguagcuuuucauuua

SEQ ID NO: 4044248 - RNA, 21 nt, Staphylococcus aureus subsp. aureus N315
uuucagagauucuguuuggug

SEQ ID NO: 4044249 - RNA, 18 nt, Staphylococcus aureus subsp. aureus N315
uuucagccacugucaugu

SEQ ID NO: 4044250 - RNA, 18 nt, Staphylococcus aureus subsp. aureus N315
uuucauaauuaauaacau

SEQ ID NO: 4044251 - RNA, 22 nt, Staphylococcus aureus subsp. aureus N315
uuucauaguuauuaaaucuuuu

SEQ ID NO: 4044252 - RNA, 20 nt, Staphylococcus aureus subsp. aureus N315
uuucauaugcaucaacagau

SEQ ID NO: 4044253 - RNA, 19 nt, Staphylococcus aureus subsp. aureus N315
uuucauauucacaucuuua

SEQ ID NO: 4044254 - RNA, 14 nt, Staphylococcus aureus subsp. aureus N315
uuucaucaauauca

SEQ ID NO: 4044255 - RNA, 15 nt, Staphylococcus aureus subsp. aureus N315
uuucaucauuaguuu

SEQ ID NO: 4044256 - RNA, 16 nt, Staphylococcus aureus subsp. aureus N315
uuucaucguucauaua

SEQ ID NO: 4044257 - RNA, 18 nt, Staphylococcus aureus subsp. aureus N315
uuucaucuuucaaaugcu

SEQ ID NO: 4044258 - RNA, 15 nt, Staphylococcus aureus subsp. aureus N315
uuucaugauuuacua

SEQ ID NO: 4044259 - RNA, 20 nt, Staphylococcus aureus subsp. aureus N315
uuucauguuugauucuaaau

SEQ ID NO: 4044260 - RNA, 22 nt, Staphylococcus aureus subsp. aureus N315
uuucauuggauagguaacuaaa

SEQ ID NO: 4044261 - RNA, 14 nt, Staphylococcus aureus subsp. aureus N315
uuucauuguaauaa

SEQ ID NO: 4044262 - RNA, 17 nt, Staphylococcus aureus subsp. aureus N315
uuucauuuaauccuucu

SEQ ID NO: 4044263 - RNA, 15 nt, Staphylococcus aureus subsp. aureus N315
uuucauuuuuauccc

SEQ ID NO: 4044264 - RNA, 18 nt, Staphylococcus aureus subsp. aureus N315
uuucauuuuuucaauguc

SEQ ID NO: 4044265 - RNA, 18 nt, Staphylococcus aureus subsp. aureus N315
uuuccaaauugcaaagua

SEQ ID NO: 4044266 - RNA, 15 nt, Staphylococcus aureus subsp. aureus N315
uuuccaauaucuucu

SEQ ID NO: 4044267 - RNA, 19 nt, Staphylococcus aureus subsp. aureus N315
uuuccauaaauaaaaugcu

SEQ ID NO: 4044268 - RNA, 17 nt, Staphylococcus aureus subsp. aureus N315
uuugauaaauaaaauuu

SEQ ID NO: 4044269 - RNA, 23 nt, Staphylococcus aureus subsp. aureus N315
uuugauaaaugcgguugaugguu

SEQ ID NO: 4044270 - RNA, 19 nt, Staphylococcus aureus subsp. aureus N315
uuugauaacaauuuuaaau

SEQ ID NO: 4044271 - RNA, 22 nt, Staphylococcus aureus subsp. aureus N315
uuugauagaugauacauucuau

SEQ ID NO: 4044272 - RNA, 17 nt, Staphylococcus aureus subsp. aureus N315
uuugauaguaauaguua

SEQ ID NO: 4044273 - RNA, 17 nt, Staphylococcus aureus subsp. aureus N315
uuugauaucacuauaca

SEQ ID NO: 4044274 - RNA, 15 nt, Staphylococcus aureus subsp. aureus N315
uuugauccaaaguac

SEQ ID NO: 4044275 - RNA, 24 nt, Staphylococcus aureus subsp. aureus N315
uuugaugaucauuaguguagaaaa

SEQ ID NO: 4044276 - RNA, 16 nt, Staphylococcus aureus subsp. aureus N315
uuugauguucacuaaa

SEQ ID NO: 4044277 - RNA, 17 nt, Staphylococcus aureus subsp. aureus N315
uuugauuaguaaauaua

SEQ ID NO: 4044278 - RNA, 15 nt, Staphylococcus aureus subsp. aureus N315
uuugauucuauuucu

SEQ ID NO: 4044279 - RNA, 12 nt, Staphylococcus aureus subsp. aureus N315
uuugauugauau

SEQ ID NO: 4044280 - RNA, 15 nt, Staphylococcus aureus subsp. aureus N315
uuugauugcaaaaaa

SEQ ID NO: 4044281 - RNA, 17 nt, Staphylococcus aureus subsp. aureus N315
uuugauuuuacuugaau

SEQ ID NO: 4044282 - RNA, 13 nt, Staphylococcus aureus subsp. aureus N315
uuugauuuugaau

SEQ ID NO: 4044283 - RNA, 16 nt, Staphylococcus aureus subsp. aureus N315
uuugauuuugaauaaa

SEQ ID NO: 4044284 - RNA, 19 nt, Staphylococcus aureus subsp. aureus N315
uuugcaaauuggaaaaaua

SEQ ID NO: 4044285 - RNA, 21 nt, Staphylococcus aureus subsp. aureus N315
uuugcaacauauuuucacaau

SEQ ID NO: 4044286 - RNA, 14 nt, Staphylococcus aureus subsp. aureus N315
uuugcaaucaucug

SEQ ID NO: 4044287 - RNA, 17 nt, Staphylococcus aureus subsp. aureus N315
uuugcacaaagauaugu

SEQ ID NO: 4044288 - RNA, 21 nt, Staphylococcus aureus subsp. aureus N315
uuugcacgggugguuuuuaau

SEQ ID NO: 4044289 - RNA, 21 nt, Staphylococcus aureus subsp. aureus N315
uuugccagucauuguauaaaa

SEQ ID NO: 4044290 - RNA, 20 nt, Staphylococcus aureus subsp. aureus N315
uuugcguuuguguguuuuaa

SEQ ID NO: 4044291 - RNA, 14 nt, Staphylococcus aureus subsp. aureus N315
uuugcguuuuaauu

SEQ ID NO: 4044292 - RNA, 18 nt, Staphylococcus aureus subsp. aureus N315
uuugcuaaccaucauaaa

SEQ ID NO: 4044293 - RNA, 22 nt, Staphylococcus aureus subsp. aureus N315
uuugcucuaaacuucuauuaau

SEQ ID NO: 4044294 - RNA, 17 nt, Staphylococcus aureus subsp. aureus N315
uuugcuggcgcaaugau

SEQ ID NO: 4044295 - RNA, 20 nt, Staphylococcus aureus subsp. aureus N315
uuugcugguugcuucuuauc

SEQ ID NO: 4044296 - RNA, 17 nt, Staphylococcus aureus subsp. aureus N315
uuugcuguccacuauau

SEQ ID NO: 4044297 - RNA, 17 nt, Staphylococcus aureus subsp. aureus N315
uuugcuguuuaguuaau

SEQ ID NO: 4044298 - RNA, 23 nt, Staphylococcus aureus subsp. aureus N315
uuugcuuuagcucuuuuuugauu

SEQ ID NO: 4044299 - RNA, 19 nt, Staphylococcus aureus subsp. aureus N315
uuugcuuuggcuauuuuau

SEQ ID NO: 4044300 - RNA, 17 nt, Staphylococcus aureus subsp. aureus N315
uuuggaaaccguuuaga

SEQ ID NO: 4044301 - RNA, 22 nt, Staphylococcus aureus subsp. aureus N315
uuuggaaagaugggauuucacu

SEQ ID NO: 4044302 - RNA, 15 nt, Staphylococcus aureus subsp. aureus N315
uuuggaacauauuca

SEQ ID NO: 4044303 - RNA, 19 nt, Staphylococcus aureus subsp. aureus N315
uuuggauuucuuuuuaaaa

SEQ ID NO: 4044304 - RNA, 21 nt, Staphylococcus aureus subsp. aureus N315
uuuggauuucuuuuuaaaauc

SEQ ID NO: 4044305 - RNA, 23 nt, Staphylococcus aureus subsp. aureus N315
uuuggcaaguuaugaaaugucug

SEQ ID NO: 4044306 - RNA, 19 nt, Staphylococcus aureus subsp. aureus N315
uuugguguuuaacuaaacc

SEQ ID NO: 4044307 - RNA, 22 nt, Staphylococcus aureus subsp. aureus N315
uuugguucaaucauucacuuca

SEQ ID NO: 4044308 - RNA, 16 nt, Staphylococcus aureus subsp. aureus N315
uuugguucuucuaucu

SEQ ID NO: 4044309 - RNA, 20 nt, Staphylococcus aureus subsp. aureus N315
uuuguaagcucaugaaucag

SEQ ID NO: 4044310 - RNA, 16 nt, Staphylococcus aureus subsp. aureus N315
uuuguaauaauugcau

SEQ ID NO: 4044311 - RNA, 13 nt, Staphylococcus aureus subsp. aureus N315
uuuguaauuagga

SEQ ID NO: 4044312 - RNA, 13 nt, Staphylococcus aureus subsp. aureus N315
uuuguacauuucu

SEQ ID NO: 4044313 - RNA, 14 nt, Staphylococcus aureus subsp. aureus N315
uuuguacauuucua

SEQ ID NO: 4044314 - RNA, 15 nt, Staphylococcus aureus subsp. aureus N315
uuuguacauuucuau

SEQ ID NO: 4044315 - RNA, 21 nt, Staphylococcus aureus subsp. aureus N315
uuuguaguccuucuuugaaau

SEQ ID NO: 4044316 - RNA, 19 nt, Staphylococcus aureus subsp. aureus N315
uuuguauaccuauuccuau

SEQ ID NO: 4044317 - RNA, 16 nt, Staphylococcus aureus subsp. aureus N315
uuuguaugauaaccau

SEQ ID NO: 4044318 - RNA, 16 nt, Staphylococcus aureus subsp. aureus N315
uuuguauuuuucaaau

SEQ ID NO: 4044319 - RNA, 15 nt, Staphylococcus aureus subsp. aureus N315
uuugucuuacuaauu

SEQ ID NO: 4044320 - RNA, 17 nt, Staphylococcus aureus subsp. aureus N315
uuugucuuuuuuaucau

SEQ ID NO: 4044321 - RNA, 14 nt, Staphylococcus aureus subsp. aureus N315
uuugugggcguucu

SEQ ID NO: 4044322 - RNA, 16 nt, Staphylococcus aureus subsp. aureus N315
uuuguguaucuguaac

SEQ ID NO: 4044323 - RNA, 21 nt, Staphylococcus aureus subsp. aureus N315
uuuguuaccaaacaauacaua

SEQ ID NO: 4044324 - RNA, 15 nt, Staphylococcus aureus subsp. aureus N315
uuuguuacuucuaau

SEQ ID NO: 4044325 - RNA, 16 nt, Staphylococcus aureus subsp. aureus N315
uuuguuauaucuaauu

SEQ ID NO: 4044326 - RNA, 14 nt, Staphylococcus aureus subsp. aureus N315
uuuguucaaucacu

SEQ ID NO: 4044327 - RNA, 17 nt, Staphylococcus aureus subsp. aureus N315
uuuguucaguuaaaucu

SEQ ID NO: 4044328 - RNA, 19 nt, Staphylococcus aureus subsp. aureus N315
uuuguucuuggcucaacaa

SEQ ID NO: 4044329 - RNA, 15 nt, Staphylococcus aureus subsp. aureus N315
uuuguugguguuuag

SEQ ID NO: 4044330 - RNA, 19 nt, Staphylococcus aureus subsp. aureus N315
uuuguuguuuuaauuucac

SEQ ID NO: 4044331 - RNA, 13 nt, Staphylococcus aureus subsp. aureus N315
uuuguuucuaaau

SEQ ID NO: 4044332 - RNA, 12 nt, Staphylococcus aureus subsp. aureus N315
uuuguuuuaaaa

SEQ ID NO: 4044333 - RNA, 16 nt, Staphylococcus aureus subsp. aureus N315
uuuguuuuaaauacuu

SEQ ID NO: 4044334 - RNA, 14 nt, Staphylococcus aureus subsp. aureus N315
uuuguuuucacugu

SEQ ID NO: 4044335 - RNA, 14 nt, Staphylococcus aureus subsp. aureus N315
uuuguuuucaguaa

SEQ ID NO: 4044336 - RNA, 13 nt, Staphylococcus aureus subsp. aureus N315
uuuguuuugaaug

SEQ ID NO: 4044337 - RNA, 21 nt, Staphylococcus aureus subsp. aureus N315
uuuuaaaaaacauaccugcau

SEQ ID NO: 4044338 - RNA, 15 nt, Staphylococcus aureus subsp. aureus N315
uuuuaaaaaaugaug

SEQ ID NO: 4044339 - RNA, 19 nt, Staphylococcus aureus subsp. aureus N315
uuuuaaaaaauuuaaauaa

SEQ ID NO: 4044340 - RNA, 12 nt, Staphylococcus aureus subsp. aureus N315
uuuuaaaaaccu

SEQ ID NO: 4044341 - RNA, 15 nt, Staphylococcus aureus subsp. aureus N315
uuuuaaaaauucaua

SEQ ID NO: 4044342 - RNA, 17 nt, Staphylococcus aureus subsp. aureus N315
uuuuaaaagauaaauaa

SEQ ID NO: 4044343 - RNA, 12 nt, Staphylococcus aureus subsp. aureus N315
uuuuaaaauacg

SEQ ID NO: 4044344 - RNA, 16 nt, Staphylococcus aureus subsp. aureus N315
uuuuaaaauuaaaccu

SEQ ID NO: 4044345 - RNA, 14 nt, Staphylococcus aureus subsp. aureus N315
uuuuaaaauuauca

SEQ ID NO: 4044346 - RNA, 19 nt, Staphylococcus aureus subsp. aureus N315
uuuuaaacguacauuuuua

SEQ ID NO: 4044347 - RNA, 16 nt, Staphylococcus aureus subsp. aureus N315
uuuuaaagaaaaguuu

SEQ ID NO: 4044348 - RNA, 11 nt, Staphylococcus aureus subsp. aureus N315
uuuuaaaggac

SEQ ID NO: 4044349 - RNA, 20 nt, Staphylococcus aureus subsp. aureus N315
uuuuaaaggaccacuuagau

SEQ ID NO: 4044350 - RNA, 12 nt, Staphylococcus aureus subsp. aureus N315
uuuuaaaguaac

SEQ ID NO: 4044351 - RNA, 12 nt, Staphylococcus aureus subsp. aureus N315
uuuuaaaguuua

SEQ ID NO: 4044352 - RNA, 14 nt, Staphylococcus aureus subsp. aureus N315
uuuuaaaguuuaaa

SEQ ID NO: 4044353 - RNA, 16 nt, Staphylococcus aureus subsp. aureus N315
uuuuaaaguuuaaaua

SEQ ID NO: 4044354 - RNA, 20 nt, Staphylococcus aureus subsp. aureus N315
uuuuaaaguuuaaauauuca

SEQ ID NO: 4044355 - RNA, 13 nt, Staphylococcus aureus subsp. aureus N315
uuuuaaauuacua

SEQ ID NO: 4044356 - RNA, 18 nt, Staphylococcus aureus subsp. aureus N315
uuuuauuugauuauucuu

SEQ ID NO: 4044357 - RNA, 17 nt, Staphylococcus aureus subsp. aureus N315
uuuuauuuuaauauuuu

SEQ ID NO: 4044358 - RNA, 16 nt, Staphylococcus aureus subsp. aureus N315
uuuucaaaaauagucg

SEQ ID NO: 4044359 - RNA, 16 nt, Staphylococcus aureus subsp. aureus N315
uuuucaaaacugccaa

SEQ ID NO: 4044360 - RNA, 20 nt, Staphylococcus aureus subsp. aureus N315
uuuucaaaaucuuuaucagu

SEQ ID NO: 4044361 - RNA, 20 nt, Staphylococcus aureus subsp. aureus N315
uuuucaaacauauucauucu

SEQ ID NO: 4044362 - RNA, 22 nt, Staphylococcus aureus subsp. aureus N315
uuuucaaauugagcaguauuuu

SEQ ID NO: 4044363 - RNA, 18 nt, Staphylococcus aureus subsp. aureus N315
uuuucaacaguuuuaaag

SEQ ID NO: 4044364 - RNA, 18 nt, Staphylococcus aureus subsp. aureus N315
uuuucaacauaauauuuc

SEQ ID NO: 4044365 - RNA, 22 nt, Staphylococcus aureus subsp. aureus N315
uuuucaagaccaaauauuuuau

SEQ ID NO: 4044366 - RNA, 19 nt, Staphylococcus aureus subsp. aureus N315
uuuucaaguuuaaaauacg

SEQ ID NO: 4044367 - RNA, 15 nt, Staphylococcus aureus subsp. aureus N315
uuuucaauaaauuuu

SEQ ID NO: 4044368 - RNA, 22 nt, Staphylococcus aureus subsp. aureus N315
uuuucacgaauaucuuaaagaa

SEQ ID NO: 4044369 - RNA, 15 nt, Staphylococcus aureus subsp. aureus N315
uuuucagaaucagaa

SEQ ID NO: 4044370 - RNA, 17 nt, Staphylococcus aureus subsp. aureus N315
uuuucagagauucuguu

SEQ ID NO: 4044371 - RNA, 22 nt, Staphylococcus aureus subsp. aureus N315
uuuucagcuaauugucguucuu

SEQ ID NO: 4044372 - RNA, 20 nt, Staphylococcus aureus subsp. aureus N315
uuuucauagaacaaaaugua

SEQ ID NO: 4044373 - RNA, 17 nt, Staphylococcus aureus subsp. aureus N315
uuuucaucaguugagug

SEQ ID NO: 4044374 - RNA, 19 nt, Staphylococcus aureus subsp. aureus N315
uuuuccauaaauauuuaaa

SEQ ID NO: 4044375 - RNA, 19 nt, Staphylococcus aureus subsp. aureus N315
uuuuccauucauaaaagca

SEQ ID NO: 4044376 - RNA, 19 nt, Staphylococcus aureus subsp. aureus N315
uuuuccuaaaccucuaaau

SEQ ID NO: 4044377 - RNA, 19 nt, Staphylococcus aureus subsp. aureus N315
uuuucgaaaaucucuguau

SEQ ID NO: 4044378 - RNA, 18 nt, Staphylococcus aureus subsp. aureus N315
uuuucgaacuuuuguucu

SEQ ID NO: 4044379 - RNA, 21 nt, Staphylococcus aureus subsp. aureus N315
uuuucgaggucaucaaaaguu

SEQ ID NO: 4044380 - RNA, 13 nt, Staphylococcus aureus subsp. aureus N315
uuuucuauggcac

SEQ ID NO: 4044381 - RNA, 14 nt, Staphylococcus aureus subsp. aureus N315
uuuucuauggcaca

SEQ ID NO: 4044382 - RNA, 13 nt, Staphylococcus aureus subsp. aureus N315
uuuucuauucaaa

SEQ ID NO: 4044383 - RNA, 14 nt, Staphylococcus aureus subsp. aureus N315
uuuucuauucaaaa

SEQ ID NO: 4044384 - RNA, 23 nt, Staphylococcus aureus subsp. aureus N315
uuuucucaacaguuucuuggucu

SEQ ID NO: 4044385 - RNA, 19 nt, Staphylococcus aureus subsp. aureus N315
uuuucucgauuaauuuucu

SEQ ID NO: 4044386 - RNA, 17 nt, Staphylococcus aureus subsp. aureus N315
uuuucugccauaaacau

SEQ ID NO: 4044387 - RNA, 15 nt, Staphylococcus aureus subsp. aureus N315
uuuucugcuuucgcu

SEQ ID NO: 4044388 - RNA, 12 nt, Staphylococcus aureus subsp. aureus N315
uuuucuguaaua

SEQ ID NO: 4044389 - RNA, 19 nt, Staphylococcus aureus subsp. aureus N315
uuuucuguccaaaaagguu

SEQ ID NO: 4044390 - RNA, 11 nt, Staphylococcus aureus subsp. aureus N315
uuuucuuaauu

SEQ ID NO: 4044391 - RNA, 17 nt, Staphylococcus aureus subsp. aureus N315
uuuucuuauaaaaaucu

SEQ ID NO: 4044392 - RNA, 13 nt, Staphylococcus aureus subsp. aureus N315
uuuucuuauuuau

SEQ ID NO: 4044393 - RNA, 18 nt, Staphylococcus aureus subsp. aureus N315
uuuucuugguuugagaau

SEQ ID NO: 4044394 - RNA, 20 nt, Staphylococcus aureus subsp. aureus N315
uuuucuuuaucuauaugcau

SEQ ID NO: 4044395 - RNA, 14 nt, Staphylococcus aureus subsp. aureus N315
uuuucuuucucuaa

SEQ ID NO: 4044396 - RNA, 14 nt, Staphylococcus aureus subsp. aureus N315
uuuucuuuucaaaa

SEQ ID NO: 4044397 - RNA, 13 nt, Staphylococcus aureus subsp. aureus N315
uuuugaaauggua

SEQ ID NO: 4044398 - RNA, 14 nt, Staphylococcus aureus subsp. aureus N315
uuuugaaccuaaau

SEQ ID NO: 4044399 - RNA, 13 nt, Staphylococcus aureus subsp. aureus N315
uuuugaauuacag

SEQ ID NO: 4044400 - RNA, 19 nt, Staphylococcus aureus subsp. aureus N315
uuuugacaaauccuaauuu

SEQ ID NO: 4044401 - RNA, 19 nt, Staphylococcus aureus subsp. aureus N315
uuuugagagauuauuuaaa

SEQ ID NO: 4044402 - RNA, 12 nt, Staphylococcus aureus subsp. aureus N315
uuuugagauauu

SEQ ID NO: 4044403 - RNA, 15 nt, Staphylococcus aureus subsp. aureus N315
uuuugagcaauaaug

SEQ ID NO: 4044404 - RNA, 18 nt, Staphylococcus aureus subsp. aureus N315
uuuugauacguaaacacu

SEQ ID NO: 4044405 - RNA, 23 nt, Staphylococcus aureus subsp. aureus N315
uuuugaugugaaaauuuauucaa

SEQ ID NO: 4044406 - RNA, 9 nt, Staphylococcus aureus subsp. aureus N315
uuuugauug

SEQ ID NO: 4044407 - RNA, 20 nt, Staphylococcus aureus subsp. aureus N315
uuuugauuguuuaaacaugu

SEQ ID NO: 4044408 - RNA, 18 nt, Staphylococcus aureus subsp. aureus N315
uuuugauuuacgugcauu

SEQ ID NO: 4044409 - RNA, 14 nt, Staphylococcus aureus subsp. aureus N315
uuuugcaucacaga

SEQ ID NO: 4044410 - RNA, 21 nt, Staphylococcus aureus subsp. aureus N315
uuuugcaucacagauaaugca

SEQ ID NO: 4044411 - RNA, 18 nt, Staphylococcus aureus subsp. aureus N315
uuuugcguuuuuaaauaa

SEQ ID NO: 4044412 - RNA, 15 nt, Staphylococcus aureus subsp. aureus N315
uuuugcuauuucaac

SEQ ID NO: 4044413 - RNA, 18 nt, Staphylococcus aureus subsp. aureus N315
uuuuggaacauauucaua

SEQ ID NO: 4044414 - RNA, 17 nt, Staphylococcus aureus subsp. aureus N315
uuuuggucaaguaaaug

SEQ ID NO: 4044415 - RNA, 20 nt, Staphylococcus aureus subsp. aureus N315
uuuuggucaaguaaauguuu

SEQ ID NO: 4044416 - RNA, 13 nt, Staphylococcus aureus subsp. aureus N315
uuuugguuguucu

SEQ ID NO: 4044417 - RNA, 23 nt, Staphylococcus aureus subsp. aureus N315
uuuuguaauugaaaugauagaug

SEQ ID NO: 4044418 - RNA, 13 nt, Staphylococcus aureus subsp. aureus N315
uuuugugauuuuu

SEQ ID NO: 4044419 - RNA, 23 nt, Staphylococcus aureus subsp. aureus N315
uuuugugccucuuguguuucagc

SEQ ID NO: 4044420 - RNA, 17 nt, Staphylococcus aureus subsp. aureus N315
uuuugugccuuucucua

SEQ ID NO: 4044421 - RNA, 17 nt, Staphylococcus aureus subsp. aureus N315
uuuuguguucggaauuu

SEQ ID NO: 4044422 - RNA, 13 nt, Staphylococcus aureus subsp. aureus N315
uuuuguuaaaaaa

SEQ ID NO: 4044423 - RNA, 14 nt, Staphylococcus aureus subsp. aureus N315
uuuuguuaauuuuu

SEQ ID NO: 4044424 - RNA, 18 nt, Staphylococcus aureus subsp. aureus N315
uuuuguugcucagugcau

SEQ ID NO: 4044425 - RNA, 22 nt, Staphylococcus aureus subsp. aureus N315
uuuuguugcucagugcauuuuu

SEQ ID NO: 4044426 - RNA, 23 nt, Staphylococcus aureus subsp. aureus N315
uuuuguuucaaacgugauuuuau

SEQ ID NO: 4044427 - RNA, 12 nt, Staphylococcus aureus subsp. aureus N315
uuuuguuuugcu

SEQ ID NO: 4044428 - RNA, 17 nt, Staphylococcus aureus subsp. aureus N315
uuuuuaaaaaauuuaaa

SEQ ID NO: 4044429 - RNA, 22 nt, Staphylococcus aureus subsp. aureus N315
uuuuuaaaaaauuuaaauaaua

SEQ ID NO: 4044430 - RNA, 14 nt, Staphylococcus aureus subsp. aureus N315
uuuuuaaaaauaca

SEQ ID NO: 4044431 - RNA, 12 nt, Staphylococcus aureus subsp. aureus N315
uuuuuaaaauac

SEQ ID NO: 4044432 - RNA, 17 nt, Staphylococcus aureus subsp. aureus N315
uuuuuaaagcuggggaa

SEQ ID NO: 4044433 - RNA, 14 nt, Staphylococcus aureus subsp. aureus N315
uuuuuaaauuuaau

SEQ ID NO: 4044434 - RNA, 18 nt, Staphylococcus aureus subsp. aureus N315
uuuuuaacagcuuuuucu

SEQ ID NO: 4044435 - RNA, 23 nt, Staphylococcus aureus subsp. aureus N315
uuuuuaacuuuaacaucugaauc

SEQ ID NO: 4044436 - RNA, 14 nt, Staphylococcus aureus subsp. aureus N315
uuuuuaauaaugca

SEQ ID NO: 4044437 - RNA, 12 nt, Staphylococcus aureus subsp. aureus N315
uuuuuaauauac

SEQ ID NO: 4044438 - RNA, 17 nt, Staphylococcus aureus subsp. aureus N315
uuuuuaauuuuaucucc

SEQ ID NO: 4044439 - RNA, 20 nt, Staphylococcus aureus subsp. aureus N315
uuuuuagacauuaaaaaauc

SEQ ID NO: 4044440 - RNA, 18 nt, Staphylococcus aureus subsp. aureus N315
uuuuuagcauuaucauca

SEQ ID NO: 4044441 - RNA, 18 nt, Staphylococcus aureus subsp. aureus N315
uuuuuagccccagcaaau

SEQ ID NO: 4044442 - RNA, 19 nt, Staphylococcus aureus subsp. aureus N315
uuuuuagguuauauuuaaa

SEQ ID NO: 4044443 - RNA, 15 nt, Staphylococcus aureus subsp. aureus N315
uuuuuaguuaaagua

SEQ ID NO: 4044444 - RNA, 12 nt, Staphylococcus aureus subsp. aureus N315
aaaaaaacaaau

SEQ ID NO: 4044445 - RNA, 22 nt, Staphylococcus aureus subsp. aureus N315
aaaaaaacaaauauuagaacau

SEQ ID NO: 4044446 - RNA, 12 nt, Staphylococcus aureus subsp. aureus N315
aaaaaaaucucc

SEQ ID NO: 4044447 - RNA, 14 nt, Staphylococcus aureus subsp. aureus N315
aaaaaacaaauauu

SEQ ID NO: 4044448 - RNA, 12 nt, Staphylococcus aureus subsp. aureus N315
aaaaaacaauag

SEQ ID NO: 4044449 - RNA, 15 nt, Staphylococcus aureus subsp. aureus N315
aaaaaaccaauaauc

SEQ ID NO: 4044450 - RNA, 22 nt, Staphylococcus aureus subsp. aureus N315
aaaaaaggaugaugugaauguu

SEQ ID NO: 4044451 - RNA, 21 nt, Staphylococcus aureus subsp. aureus N315
aaaaaaguuaucugcuuuucu

SEQ ID NO: 4044452 - RNA, 17 nt, Staphylococcus aureus subsp. aureus N315
aaaaaaguugauuaaaa

SEQ ID NO: 4044453 - RNA, 23 nt, Staphylococcus aureus subsp. aureus N315
aaaaaauacuaagauuagcuaug

SEQ ID NO: 4044454 - RNA, 14 nt, Staphylococcus aureus subsp. aureus N315
aaaaaauauuuaca

SEQ ID NO: 4044455 - RNA, 18 nt, Staphylococcus aureus subsp. aureus N315
aaaaaaucaguuuuuaaa

SEQ ID NO: 4044456 - RNA, 16 nt, Staphylococcus aureus subsp. aureus N315
aaaaaaucgaacaaau

SEQ ID NO: 4044457 - RNA, 18 nt, Staphylococcus aureus subsp. aureus N315
aaaaaaucgaacaaauga

SEQ ID NO: 4044458 - RNA, 13 nt, Staphylococcus aureus subsp. aureus N315
aaaaaaucgaauu

SEQ ID NO: 4044459 - RNA, 14 nt, Staphylococcus aureus subsp. aureus N315
aaaaaaugaauguu

SEQ ID NO: 4044460 - RNA, 11 nt, Staphylococcus aureus subsp. aureus N315
aaaaaaugaua

SEQ ID NO: 4044461 - RNA, 16 nt, Staphylococcus aureus subsp. aureus N315
aaaaaauuaaaauguu

SEQ ID NO: 4044462 - RNA, 15 nt, Staphylococcus aureus subsp. aureus N315
aaaaaauuaauaauu

SEQ ID NO: 4044463 - RNA, 12 nt, Staphylococcus aureus subsp. aureus N315
aaaaaauuauua

SEQ ID NO: 4044464 - RNA, 14 nt, Staphylococcus aureus subsp. aureus N315
aaaaaauuauuaaa

SEQ ID NO: 4044465 - RNA, 12 nt, Staphylococcus aureus subsp. aureus N315
aaaaaauuuaaa

SEQ ID NO: 4044466 - RNA, 13 nt, Staphylococcus aureus subsp. aureus N315
aaaaaauuuaaau

SEQ ID NO: 4044467 - RNA, 13 nt, Staphylococcus aureus subsp. aureus N315
aaaaacaaaaaaa

SEQ ID NO: 4044468 - RNA, 19 nt, Staphylococcus aureus subsp. aureus N315
aaaaacaaaaaaaccgaac

SEQ ID NO: 4044469 - RNA, 20 nt, Staphylococcus aureus subsp. aureus N315
aaaaacgcuuuuaaaccgug

SEQ ID NO: 4044470 - RNA, 22 nt, Staphylococcus aureus subsp. aureus N315
aaaaacgguaauuucuauuuau

SEQ ID NO: 4044471 - RNA, 23 nt, Staphylococcus aureus subsp. aureus N315
aaaaacgguacagauaagaauau

SEQ ID NO: 4044472 - RNA, 20 nt, Staphylococcus aureus subsp. aureus N315
aaaaacuucuuaacuugaaa

SEQ ID NO: 4044473 - RNA, 15 nt, Staphylococcus aureus subsp. aureus N315
aaaaagaauuucgaa

SEQ ID NO: 4044474 - RNA, 21 nt, Staphylococcus aureus subsp. aureus N315
aaaaagacggugaccuuauau

SEQ ID NO: 4044475 - RNA, 13 nt, Staphylococcus aureus subsp. aureus N315
aaaaagaugaaaa

SEQ ID NO: 4044476 - RNA, 14 nt, Staphylococcus aureus subsp. aureus N315
aaaaagaugaaaaa

SEQ ID NO: 4044477 - RNA, 20 nt, Staphylococcus aureus subsp. aureus N315
aaaaagcaguaaguugauuu

SEQ ID NO: 4044478 - RNA, 15 nt, Staphylococcus aureus subsp. aureus N315
aaaaagcucaauccu

SEQ ID NO: 4044479 - RNA, 19 nt, Staphylococcus aureus subsp. aureus N315
aaaaagcugauuucuauca

SEQ ID NO: 4044480 - RNA, 19 nt, Staphylococcus aureus subsp. aureus N315
aaaaaggaagaacagcaca

SEQ ID NO: 4044481 - RNA, 21 nt, Staphylococcus aureus subsp. aureus N315
aaaaagggcaacacucggaaa

SEQ ID NO: 4044482 - RNA, 20 nt, Staphylococcus aureus subsp. aureus N315
aaaaaguaaaaucuuuaaca

SEQ ID NO: 4044483 - RNA, 15 nt, Staphylococcus aureus subsp. aureus N315
aaaaaguauuacuuu

SEQ ID NO: 4044484 - RNA, 23 nt, Staphylococcus aureus subsp. aureus N315
aaaaagucccgcuuaaaaugauu

SEQ ID NO: 4044485 - RNA, 15 nt, Staphylococcus aureus subsp. aureus N315
aaaaagucuuucucg

SEQ ID NO: 4044486 - RNA, 21 nt, Staphylococcus aureus subsp. aureus N315
aaaaagugaagauauuuauaa

SEQ ID NO: 4044487 - RNA, 14 nt, Staphylococcus aureus subsp. aureus N315
aaaaaguuucggaa

SEQ ID NO: 4044488 - RNA, 13 nt, Staphylococcus aureus subsp. aureus N315
aaaaaguuuuucu

SEQ ID NO: 4044489 - RNA, 16 nt, Staphylococcus aureus subsp. aureus N315
aaaaauaaaaccgagg

SEQ ID NO: 4044490 - RNA, 12 nt, Staphylococcus aureus subsp. aureus N315
aaaaauaaacca

SEQ ID NO: 4044491 - RNA, 20 nt, Staphylococcus aureus subsp. aureus N315
aaaaauaaagucauaugguu

SEQ ID NO: 4044492 - RNA, 16 nt, Staphylococcus aureus subsp. aureus N315
aaaaauaacuccucca

SEQ ID NO: 4044493 - RNA, 11 nt, Staphylococcus aureus subsp. aureus N315
aaaaauaauug

SEQ ID NO: 4044494 - RNA, 13 nt, Staphylococcus aureus subsp. aureus N315
aaaaauacauaau

SEQ ID NO: 4044495 - RNA, 23 nt, Staphylococcus aureus subsp. aureus N315
aaaaauagcguaauuauuauaau

SEQ ID NO: 4044496 - RNA, 15 nt, Staphylococcus aureus subsp. aureus N315
aaaaauauauuucaa

SEQ ID NO: 4044497 - RNA, 12 nt, Staphylococcus aureus subsp. aureus N315
aaaaauauguau

SEQ ID NO: 4044498 - RNA, 20 nt, Staphylococcus aureus subsp. aureus N315
aaaaauauugcguuuaauuu

SEQ ID NO: 4044499 - RNA, 14 nt, Staphylococcus aureus subsp. aureus N315
aaaaauauuuaaac

SEQ ID NO: 4044500 - RNA, 14 nt, Staphylococcus aureus subsp. aureus N315
aaaaauauuuacau

SEQ ID NO: 4044501 - RNA, 14 nt, Staphylococcus aureus subsp. aureus N315
aaaaaucaaagagg

SEQ ID NO: 4044502 - RNA, 17 nt, Staphylococcus aureus subsp. aureus N315
aaaaaucacaggaaaau

SEQ ID NO: 4044503 - RNA, 17 nt, Staphylococcus aureus subsp. aureus N315
aaaaaucacgcuaacau

SEQ ID NO: 4044504 - RNA, 22 nt, Staphylococcus aureus subsp. aureus N315
aaaaaucaguuuuuaaaucaaa

SEQ ID NO: 4044505 - RNA, 18 nt, Staphylococcus aureus subsp. aureus N315
aaaaaucauaaauaacac

SEQ ID NO: 4044506 - RNA, 23 nt, Staphylococcus aureus subsp. aureus N315
aaaaaucauucaccuaaaaagaa

SEQ ID NO: 4044507 - RNA, 20 nt, Staphylococcus aureus subsp. aureus N315
aaaaauccucacaaauuuga

SEQ ID NO: 4044508 - RNA, 21 nt, Staphylococcus aureus subsp. aureus N315
aaaaaucgaacuagacaagau

SEQ ID NO: 4044509 - RNA, 17 nt, Staphylococcus aureus subsp. aureus N315
aaaaaucgaauuuucaa

SEQ ID NO: 4044510 - RNA, 17 nt, Staphylococcus aureus subsp. aureus N315
aaaaaucggcuuucuaa

SEQ ID NO: 4044511 - RNA, 18 nt, Staphylococcus aureus subsp. aureus N315
aaaaaucuucuccaauca

SEQ ID NO: 4044512 - RNA, 16 nt, Staphylococcus aureus subsp. aureus N315
aaaaaucuuuugauag

SEQ ID NO: 4044513 - RNA, 21 nt, Staphylococcus aureus subsp. aureus N315
aaaaaugccgagauuauuaug

SEQ ID NO: 4044514 - RNA, 19 nt, Staphylococcus aureus subsp. aureus N315
aaaaaugcgcuuccaauuu

SEQ ID NO: 4044515 - RNA, 21 nt, Staphylococcus aureus subsp. aureus N315
aaaaauggugauccgccuuga

SEQ ID NO: 4044516 - RNA, 17 nt, Staphylococcus aureus subsp. aureus N315
aaaaauguaaauaaaaa

SEQ ID NO: 4044517 - RNA, 18 nt, Staphylococcus aureus subsp. aureus N315
aaaaauguaaauaaaaau

SEQ ID NO: 4044518 - RNA, 22 nt, Staphylococcus aureus subsp. aureus N315
aaaaaugucguauauguaauca

SEQ ID NO: 4044519 - RNA, 16 nt, Staphylococcus aureus subsp. aureus N315
aaaaaugugaccuuau

SEQ ID NO: 4044520 - RNA, 18 nt, Staphylococcus aureus subsp. aureus N315
aaaaauguguuaaaauau

SEQ ID NO: 4044521 - RNA, 21 nt, Staphylococcus aureus subsp. aureus N315
aaaaauguguuaaaauauauu

SEQ ID NO: 4044522 - RNA, 12 nt, Staphylococcus aureus subsp. aureus N315
aaaaauuaaaaa

SEQ ID NO: 4044523 - RNA, 16 nt, Staphylococcus aureus subsp. aureus N315
aaaaauuaaaaaacaa

SEQ ID NO: 4044524 - RNA, 17 nt, Staphylococcus aureus subsp. aureus N315
aaaaauuaaucaccuua

SEQ ID NO: 4044525 - RNA, 18 nt, Staphylococcus aureus subsp. aureus N315
aaaaauuauuaaaaaaau

SEQ ID NO: 4044526 - RNA, 13 nt, Staphylococcus aureus subsp. aureus N315
aaaaauucauaau

SEQ ID NO: 4044527 - RNA, 20 nt, Staphylococcus aureus subsp. aureus N315
aaaaauuccuagcuuuuaug

SEQ ID NO: 4044528 - RNA, 21 nt, Staphylococcus aureus subsp. aureus N315
aaaaauugcaaugcuaucaug

SEQ ID NO: 4044529 - RNA, 22 nt, Staphylococcus aureus subsp. aureus N315
aaaaauugcuauauuaguauaa

SEQ ID NO: 4044530 - RNA, 19 nt, Staphylococcus aureus subsp. aureus N315
aaaaauuguucaauauuua

SEQ ID NO: 4044531 - RNA, 16 nt, Staphylococcus aureus subsp. aureus N315
aaaaauuuaaauaaua

SEQ ID NO: 4044532 - RNA, 18 nt, Staphylococcus aureus subsp. aureus N315
aaaaauuucaaaaauagc

SEQ ID NO: 4044533 - RNA, 15 nt, Staphylococcus aureus subsp. aureus N315
aaaacaaaaaaaccg

SEQ ID NO: 4044534 - RNA, 22 nt, Staphylococcus aureus subsp. aureus N315
aaaacaaaaacgguaauuucua

SEQ ID NO: 4044535 - RNA, 15 nt, Staphylococcus aureus subsp. aureus N315
aaaacaaaaauaauc

SEQ ID NO: 4044536 - RNA, 17 nt, Staphylococcus aureus subsp. aureus N315
aaaacaaagguuuguaa

SEQ ID NO: 4044537 - RNA, 17 nt, Staphylococcus aureus subsp. aureus N315
aaaacaaauccauuaaa

SEQ ID NO: 4044538 - RNA, 12 nt, Staphylococcus aureus subsp. aureus N315
aaaacaacuugg

SEQ ID NO: 4044539 - RNA, 13 nt, Staphylococcus aureus subsp. aureus N315
aaaacaauauuga

SEQ ID NO: 4044540 - RNA, 13 nt, Staphylococcus aureus subsp. aureus N315
aaaacaaugauua

SEQ ID NO: 4044541 - RNA, 22 nt, Staphylococcus aureus subsp. aureus N315
aaaacacccugcuuaucauuac

SEQ ID NO: 4044542 - RNA, 19 nt, Staphylococcus aureus subsp. aureus N315
aaaacagaauuucaucaaa

SEQ ID NO: 4044543 - RNA, 22 nt, Staphylococcus aureus subsp. aureus N315
aaaacagaggucuucgcaauca

SEQ ID NO: 4044544 - RNA, 15 nt, Staphylococcus aureus subsp. aureus N315
aaaacagcaaauaaa

SEQ ID NO: 4044545 - RNA, 18 nt, Staphylococcus aureus subsp. aureus N315
aaaacagguggaaguguu

SEQ ID NO: 4044546 - RNA, 17 nt, Staphylococcus aureus subsp. aureus N315
aaaacauaaauacaaaa

SEQ ID NO: 4044547 - RNA, 15 nt, Staphylococcus aureus subsp. aureus N315
aaaacaucuacauca

SEQ ID NO: 4044548 - RNA, 19 nt, Staphylococcus aureus subsp. aureus N315
aaaacauucccuuaauaau

SEQ ID NO: 4044549 - RNA, 20 nt, Staphylococcus aureus subsp. aureus N315
aaaacauucccuuaauaaua

SEQ ID NO: 4044550 - RNA, 12 nt, Staphylococcus aureus subsp. aureus N315
aaaaccaaaaga

SEQ ID NO: 4044551 - RNA, 21 nt, Staphylococcus aureus subsp. aureus N315
aaaaccccuguugaacuuuag

SEQ ID NO: 4044552 - RNA, 18 nt, Staphylococcus aureus subsp. aureus N315
aaaaccgaacaucugaaa

SEQ ID NO: 4044553 - RNA, 15 nt, Staphylococcus aureus subsp. aureus N315
aaaaccgagaaucuc

SEQ ID NO: 4044554 - RNA, 20 nt, Staphylococcus aureus subsp. aureus N315
aaaaccgagaaucuccauuu

SEQ ID NO: 4044555 - RNA, 20 nt, Staphylococcus aureus subsp. aureus N315
aaaaccuauuccuaauaaau

SEQ ID NO: 4044556 - RNA, 21 nt, Staphylococcus aureus subsp. aureus N315
aaaaccuauuccuaauaaaua

SEQ ID NO: 4044557 - RNA, 14 nt, Staphylococcus aureus subsp. aureus N315
aaaaccugaaacaa

SEQ ID NO: 4044558 - RNA, 18 nt, Staphylococcus aureus subsp. aureus N315
aaaaccugggacauuaau

SEQ ID NO: 4044559 - RNA, 22 nt, Staphylococcus aureus subsp. aureus N315
aaaaccuguaucuuaaauuacu

SEQ ID NO: 4044560 - RNA, 19 nt, Staphylococcus aureus subsp. aureus N315
aaaaccuuuucaaauuaua

SEQ ID NO: 4044561 - RNA, 18 nt, Staphylococcus aureus subsp. aureus N315
aaaacgacucauuauaaa

SEQ ID NO: 4044562 - RNA, 16 nt, Staphylococcus aureus subsp. aureus N315
aaaacgauaagaauua

SEQ ID NO: 4044563 - RNA, 16 nt, Staphylococcus aureus subsp. aureus N315
aaaacgcauugcgaaa

SEQ ID NO: 4044564 - RNA, 21 nt, Staphylococcus aureus subsp. aureus N315
aaaacgugcaaauaaaaaagu

SEQ ID NO: 4044565 - RNA, 14 nt, Staphylococcus aureus subsp. aureus N315
aaaacuaaucaaau

SEQ ID NO: 4044566 - RNA, 13 nt, Staphylococcus aureus subsp. aureus N315
aaaacuaaugaua

SEQ ID NO: 4044567 - RNA, 14 nt, Staphylococcus aureus subsp. aureus N315
aaaacuacauuugg

SEQ ID NO: 4044568 - RNA, 16 nt, Staphylococcus aureus subsp. aureus N315
aaaacuauaauaaaga

SEQ ID NO: 4044569 - RNA, 18 nt, Staphylococcus aureus subsp. aureus N315
aaaacuauuuuaaaaaug

SEQ ID NO: 4044570 - RNA, 17 nt, Staphylococcus aureus subsp. aureus N315
aaaacuguaaaucauca

SEQ ID NO: 4044571 - RNA, 23 nt, Staphylococcus aureus subsp. aureus N315
aaaacuuccugcuuuuuuuauaa

SEQ ID NO: 4044572 - RNA, 22 nt, Staphylococcus aureus subsp. aureus N315
aaaacuuguaaucauaccagca

SEQ ID NO: 4044573 - RNA, 18 nt, Staphylococcus aureus subsp. aureus N315
aaaacuuguuguuauuua

SEQ ID NO: 4044574 - RNA, 17 nt, Staphylococcus aureus subsp. aureus N315
aaaagaaauaucuaccu

SEQ ID NO: 4044575 - RNA, 17 nt, Staphylococcus aureus subsp. aureus N315
aaaagaaauucuacagg

SEQ ID NO: 4044576 - RNA, 16 nt, Staphylococcus aureus subsp. aureus N315
aaaagaaauuuaauac

SEQ ID NO: 4044577 - RNA, 19 nt, Staphylococcus aureus subsp. aureus N315
aaaagaaauuuaauacaau

SEQ ID NO: 4044578 - RNA, 18 nt, Staphylococcus aureus subsp. aureus N315
aaaagaauuauucaagua

SEQ ID NO: 4044579 - RNA, 22 nt, Staphylococcus aureus subsp. aureus N315
aaaagaauuucgaaaagaaauu

SEQ ID NO: 4044580 - RNA, 16 nt, Staphylococcus aureus subsp. aureus N315
aaaagacagcaguagg

SEQ ID NO: 4044581 - RNA, 14 nt, Staphylococcus aureus subsp. aureus N315
aaaagagaauuuua

SEQ ID NO: 4044582 - RNA, 14 nt, Staphylococcus aureus subsp. aureus N315
aaaagaucgauacu

SEQ ID NO: 4044583 - RNA, 19 nt, Staphylococcus aureus subsp. aureus N315
aaaagaucgcugccauuaa

SEQ ID NO: 4044584 - RNA, 21 nt, Staphylococcus aureus subsp. aureus N315
aaaagaugguuuuguuuugcu

SEQ ID NO: 4044585 - RNA, 21 nt, Staphylococcus aureus subsp. aureus N315
aaaagauguugcucgugcauu

SEQ ID NO: 4044586 - RNA, 17 nt, Staphylococcus aureus subsp. aureus N315
aaaagcaggcaagcuau

SEQ ID NO: 4044587 - RNA, 19 nt, Staphylococcus aureus subsp. aureus N315
aaaagcagucgaacaauga

SEQ ID NO: 4044588 - RNA, 18 nt, Staphylococcus aureus subsp. aureus N315
aaaagcaugauacucaau

SEQ ID NO: 4044589 - RNA, 19 nt, Staphylococcus aureus subsp. aureus N315
aaaagccaucuuaccuuua

SEQ ID NO: 4044590 - RNA, 21 nt, Staphylococcus aureus subsp. aureus N315
aaaagcccaccuaaaaaguac

SEQ ID NO: 4044591 - RNA, 22 nt, Staphylococcus aureus subsp. aureus N315
aaaagccuacuuugucugcaau

SEQ ID NO: 4044592 - RNA, 17 nt, Staphylococcus aureus subsp. aureus N315
aaaagcggacugaaaga

SEQ ID NO: 4044593 - RNA, 14 nt, Staphylococcus aureus subsp. aureus N315
aaaaggaaaaacuu

SEQ ID NO: 4044594 - RNA, 19 nt, Staphylococcus aureus subsp. aureus N315
aaaaggcgaaacauuaaaa

SEQ ID NO: 4044595 - RNA, 16 nt, Staphylococcus aureus subsp. aureus N315
aaaaggcucauuuguu

SEQ ID NO: 4044596 - RNA, 13 nt, Staphylococcus aureus subsp. aureus N315
aaaagggcaaaaa

SEQ ID NO: 4044597 - RNA, 15 nt, Staphylococcus aureus subsp. aureus N315
aaaaggucaaaaaau

SEQ ID NO: 4044598 - RNA, 23 nt, Staphylococcus aureus subsp. aureus N315
aaaaggugugggcuuuauuauca

SEQ ID NO: 4044599 - RNA, 22 nt, Staphylococcus aureus subsp. aureus N315
aaaaguaaaaucuuuaacauuu

SEQ ID NO: 4044600 - RNA, 20 nt, Staphylococcus aureus subsp. aureus N315
aaaaguaacauacuauaaaa

SEQ ID NO: 4044601 - RNA, 14 nt, Staphylococcus aureus subsp. aureus N315
aaaaguaaguaaaa

SEQ ID NO: 4044602 - RNA, 15 nt, Staphylococcus aureus subsp. aureus N315
aaaaguaaguaaaau

SEQ ID NO: 4044603 - RNA, 21 nt, Staphylococcus aureus subsp. aureus N315
aaaaguauugccguuauuuuc

SEQ ID NO: 4044604 - RNA, 23 nt, Staphylococcus aureus subsp. aureus N315
aaaaguauugccguuauuuucaa

SEQ ID NO: 4044605 - RNA, 21 nt, Staphylococcus aureus subsp. aureus N315
aaaagucagcuuacaauaaug

SEQ ID NO: 4044606 - RNA, 22 nt, Staphylococcus aureus subsp. aureus N315
aaaagucccgcuuaaaaugauu

SEQ ID NO: 4044607 - RNA, 16 nt, Staphylococcus aureus subsp. aureus N315
aaaagucgauaaauau

SEQ ID NO: 4044608 - RNA, 18 nt, Staphylococcus aureus subsp. aureus N315
aaaaguuauauaaauuug

SEQ ID NO: 4044609 - RNA, 18 nt, Staphylococcus aureus subsp. aureus N315
aaaaguuaucugcuuuuc

SEQ ID NO: 4044610 - RNA, 21 nt, Staphylococcus aureus subsp. aureus N315
aaaaguugauuaaaaguguug

SEQ ID NO: 4044611 - RNA, 18 nt, Staphylococcus aureus subsp. aureus N315
aaaaguuguaauuuaaaa

SEQ ID NO: 4044612 - RNA, 13 nt, Staphylococcus aureus subsp. aureus N315
aaaaguuucggaa

SEQ ID NO: 4044613 - RNA, 13 nt, Staphylococcus aureus subsp. aureus N315
aaaauaaaaaaau

SEQ ID NO: 4044614 - RNA, 15 nt, Staphylococcus aureus subsp. aureus N315
aaaauaaaaaaccaa

SEQ ID NO: 4044615 - RNA, 17 nt, Staphylococcus aureus subsp. aureus N315
aaaauaaaaaaugcacu

SEQ ID NO: 4044616 - RNA, 12 nt, Staphylococcus aureus subsp. aureus N315
aaaauaaaaacc

SEQ ID NO: 4044617 - RNA, 13 nt, Staphylococcus aureus subsp. aureus N315
aaaauaaaaacuu

SEQ ID NO: 4044618 - RNA, 13 nt, Staphylococcus aureus subsp. aureus N315
aaaauaaaaccga

SEQ ID NO: 4044619 - RNA, 22 nt, Staphylococcus aureus subsp. aureus N315
aaaauaaaaccgaggaaauccu

SEQ ID NO: 4044620 - RNA, 13 nt, Staphylococcus aureus subsp. aureus N315
aaaauaaaauuaa

SEQ ID NO: 4044621 - RNA, 23 nt, Staphylococcus aureus subsp. aureus N315
aaaauaaaucauacgagaaauua

SEQ ID NO: 4044622 - RNA, 23 nt, Staphylococcus aureus subsp. aureus N315
aaaauaacauguuuguggcaccu

SEQ ID NO: 4044623 - RNA, 17 nt, Staphylococcus aureus subsp. aureus N315
aaaauaacuaagugaau

SEQ ID NO: 4044624 - RNA, 15 nt, Staphylococcus aureus subsp. aureus N315
aaaauaauagauaau

SEQ ID NO: 4044625 - RNA, 16 nt, Staphylococcus aureus subsp. aureus N315
aaaauaauagauaaua

SEQ ID NO: 4044626 - RNA, 13 nt, Staphylococcus aureus subsp. aureus N315
aaaauaauuaaau

SEQ ID NO: 4044627 - RNA, 16 nt, Staphylococcus aureus subsp. aureus N315
aaaauaauuaaauaaa

SEQ ID NO: 4044628 - RNA, 13 nt, Staphylococcus aureus subsp. aureus N315
aaaauaauuuuau

SEQ ID NO: 4044629 - RNA, 13 nt, Staphylococcus aureus subsp. aureus N315
aaaauacauaaua

SEQ ID NO: 4044630 - RNA, 14 nt, Staphylococcus aureus subsp. aureus N315
aaaauacauaauua

SEQ ID NO: 4044631 - RNA, 15 nt, Staphylococcus aureus subsp. aureus N315
aaaauacuauacuga

SEQ ID NO: 4044632 - RNA, 13 nt, Staphylococcus aureus subsp. aureus N315
aaaauagaaaaau

SEQ ID NO: 4044633 - RNA, 19 nt, Staphylococcus aureus subsp. aureus N315
aaaauagaaagaaauuguu

SEQ ID NO: 4044634 - RNA, 22 nt, Staphylococcus aureus subsp. aureus N315
aaaauagauugaaaaaauaacu

SEQ ID NO: 4044635 - RNA, 20 nt, Staphylococcus aureus subsp. aureus N315
aaaauagccauauucauauu

SEQ ID NO: 4044636 - RNA, 21 nt, Staphylococcus aureus subsp. aureus N315
aaaauagcguaauuauuauaa

SEQ ID NO: 4044637 - RNA, 16 nt, Staphylococcus aureus subsp. aureus N315
aaaauaguucuuuaaa

SEQ ID NO: 4044638 - RNA, 19 nt, Staphylococcus aureus subsp. aureus N315
aaaauaguucuuuaaauua

SEQ ID NO: 4044639 - RNA, 22 nt, Staphylococcus aureus subsp. aureus N315
aaaauaguucuuuaaauuauau

SEQ ID NO: 4044640 - RNA, 15 nt, Staphylococcus aureus subsp. aureus N315
aaaauauagcuauua

SEQ ID NO: 4044641 - RNA, 14 nt, Staphylococcus aureus subsp. aureus N315
aaaauauaugaaua

SEQ ID NO: 4044642 - RNA, 15 nt, Staphylococcus aureus subsp. aureus N315
aaaauauaugaauaa

SEQ ID NO: 4044643 - RNA, 20 nt, Staphylococcus aureus subsp. aureus N315
aaaauaucaaaauauaaaau

SEQ ID NO: 4044644 - RNA, 18 nt, Staphylococcus aureus subsp. aureus N315
aaaauaucaauuuauuau

SEQ ID NO: 4044645 - RNA, 23 nt, Staphylococcus aureus subsp. aureus N315
aaaauaucaauuuauuauuaacu

SEQ ID NO: 4044646 - RNA, 12 nt, Staphylococcus aureus subsp. aureus N315
aaaauaucauuu

SEQ ID NO: 4044647 - RNA, 14 nt, Staphylococcus aureus subsp. aureus N315
aaaauaucauuucu

SEQ ID NO: 4044648 - RNA, 19 nt, Staphylococcus aureus subsp. aureus N315
aaaauaucugaaaaaccaa

SEQ ID NO: 4044649 - RNA, 17 nt, Staphylococcus aureus subsp. aureus N315
aaaauaugauuuaaaau

SEQ ID NO: 4044650 - RNA, 20 nt, Staphylococcus aureus subsp. aureus N315
aaaauauguguuaacugaua

SEQ ID NO: 4044651 - RNA, 18 nt, Staphylococcus aureus subsp. aureus N315
aaaauauuuaaacuagua

SEQ ID NO: 4044652 - RNA, 14 nt, Staphylococcus aureus subsp. aureus N315
aaaaucaaagaggc

SEQ ID NO: 4044653 - RNA, 15 nt, Staphylococcus aureus subsp. aureus N315
aaaaucaacuuuucu

SEQ ID NO: 4044654 - RNA, 17 nt, Staphylococcus aureus subsp. aureus N315
aaaaucacgcuaacauu

SEQ ID NO: 4044655 - RNA, 14 nt, Staphylococcus aureus subsp. aureus N315
aaaaucauaaauaa

SEQ ID NO: 4044656 - RNA, 19 nt, Staphylococcus aureus subsp. aureus N315
aaaaucauccauaaaaaua

SEQ ID NO: 4044657 - RNA, 21 nt, Staphylococcus aureus subsp. aureus N315
aaaaucauccauaaaaauacg

SEQ ID NO: 4044658 - RNA, 18 nt, Staphylococcus aureus subsp. aureus N315
aaaaucaucuuaacaacu

SEQ ID NO: 4044659 - RNA, 21 nt, Staphylococcus aureus subsp. aureus N315
aaaaucaucuuaacaacuuua

SEQ ID NO: 4044660 - RNA, 21 nt, Staphylococcus aureus subsp. aureus N315
aaaauccucacaaauuugaau

SEQ ID NO: 4044661 - RNA, 15 nt, Staphylococcus aureus subsp. aureus N315
aaaauccugaaauua

SEQ ID NO: 4044662 - RNA, 22 nt, Staphylococcus aureus subsp. aureus N315
aaaaucgaacaaaugaaaaagu

SEQ ID NO: 4044663 - RNA, 23 nt, Staphylococcus aureus subsp. aureus N315
aaaaucgcaaaugcgauuuugga

SEQ ID NO: 4044664 - RNA, 19 nt, Staphylococcus aureus subsp. aureus N315
aaaaucggauuaacauuau

SEQ ID NO: 4044665 - RNA, 21 nt, Staphylococcus aureus subsp. aureus N315
aaaaucguauagauuaaaaaa

SEQ ID NO: 4044666 - RNA, 22 nt, Staphylococcus aureus subsp. aureus N315
aaaaucguauagauuaaaaaau

SEQ ID NO: 4044667 - RNA, 20 nt, Staphylococcus aureus subsp. aureus N315
aaaaucguuauaaguacaaa

SEQ ID NO: 4044668 - RNA, 20 nt, Staphylococcus aureus subsp. aureus N315
aaaaucucgacacuauacca

SEQ ID NO: 4044669 - RNA, 13 nt, Staphylococcus aureus subsp. aureus N315
aaaaucugcuuua

SEQ ID NO: 4044670 - RNA, 15 nt, Staphylococcus aureus subsp. aureus N315
aaaaugaaauauuug

SEQ ID NO: 4044671 - RNA, 17 nt, Staphylococcus aureus subsp. aureus N315
aaaaugaagaauacaaa

SEQ ID NO: 4044672 - RNA, 20 nt, Staphylococcus aureus subsp. aureus N315
aaaaugaauaauugcuaaaa

SEQ ID NO: 4044673 - RNA, 24 nt, Staphylococcus aureus subsp. aureus N315
aaaaugaauaauugcuaaaauauc

SEQ ID NO: 4044674 - RNA, 19 nt, Staphylococcus aureus subsp. aureus N315
aaaaugacgugcuuuuaaa

SEQ ID NO: 4044675 - RNA, 22 nt, Staphylococcus aureus subsp. aureus N315
aaaaugacuaccuguuggcuuu

SEQ ID NO: 4044676 - RNA, 14 nt, Staphylococcus aureus subsp. aureus N315
aaaaugaguacaac

SEQ ID NO: 4044677 - RNA, 15 nt, Staphylococcus aureus subsp. aureus N315
aaaaugaguacaaca

SEQ ID NO: 4044678 - RNA, 19 nt, Staphylococcus aureus subsp. aureus N315
aaaaugauagcuaaacauu

SEQ ID NO: 4044679 - RNA, 13 nt, Staphylococcus aureus subsp. aureus N315
aaaaugauaucug

SEQ ID NO: 4044680 - RNA, 23 nt, Staphylococcus aureus subsp. aureus N315
aaaaugauguaacguuucuuugu

SEQ ID NO: 4044681 - RNA, 14 nt, Staphylococcus aureus subsp. aureus N315
aaaaugauuauucu

SEQ ID NO: 4044682 - RNA, 21 nt, Staphylococcus aureus subsp. aureus N315
aaaaugauucuuaucuuuaau

SEQ ID NO: 4044683 - RNA, 22 nt, Staphylococcus aureus subsp. aureus N315
aaaaugauuguuuuaaguggga

SEQ ID NO: 4044684 - RNA, 13 nt, Staphylococcus aureus subsp. aureus N315
aaaaugcacugag

SEQ ID NO: 4044685 - RNA, 15 nt, Staphylococcus aureus subsp. aureus N315
aaaaugcauagcucu

SEQ ID NO: 4044686 - RNA, 18 nt, Staphylococcus aureus subsp. aureus N315
aaaaugccaacuauaccu

SEQ ID NO: 4044687 - RNA, 17 nt, Staphylococcus aureus subsp. aureus N315
aaaaugcuuuuuugaaa

SEQ ID NO: 4044688 - RNA, 17 nt, Staphylococcus aureus subsp. aureus N315
aaaauggcaucuggcaa

SEQ ID NO: 4044689 - RNA, 18 nt, Staphylococcus aureus subsp. aureus N315
aaaauggcgaaaaagcua

SEQ ID NO: 4044690 - RNA, 23 nt, Staphylococcus aureus subsp. aureus N315
aaaauggugauccgccuugauuu

SEQ ID NO: 4044691 - RNA, 20 nt, Staphylococcus aureus subsp. aureus N315
aaaaugucauuugaauccaa

SEQ ID NO: 4044692 - RNA, 15 nt, Staphylococcus aureus subsp. aureus N315
aaaauguguuaaaau

SEQ ID NO: 4044693 - RNA, 16 nt, Staphylococcus aureus subsp. aureus N315
aaaauguuaauaauga

SEQ ID NO: 4044694 - RNA, 17 nt, Staphylococcus aureus subsp. aureus N315
aaaauguuacacaaauu

SEQ ID NO: 4044695 - RNA, 19 nt, Staphylococcus aureus subsp. aureus N315
aaaauguuacacaaauuaa

SEQ ID NO: 4044696 - RNA, 14 nt, Staphylococcus aureus subsp. aureus N315
aaaauguuuaacaa

SEQ ID NO: 4044697 - RNA, 16 nt, Staphylococcus aureus subsp. aureus N315
aaaauguuuaacaaua

SEQ ID NO: 4044698 - RNA, 13 nt, Staphylococcus aureus subsp. aureus N315
aaaauuaaaaaac

SEQ ID NO: 4044699 - RNA, 17 nt, Staphylococcus aureus subsp. aureus N315
aaaauuaaaaaacaaaa

SEQ ID NO: 4044700 - RNA, 14 nt, Staphylococcus aureus subsp. aureus N315
aaaauuaaaacagc

SEQ ID NO: 4044701 - RNA, 14 nt, Staphylococcus aureus subsp. aureus N315
aaaauuaaaauguu

SEQ ID NO: 4044702 - RNA, 15 nt, Staphylococcus aureus subsp. aureus N315
aaaauuaaauaauga

SEQ ID NO: 4044703 - RNA, 22 nt, Staphylococcus aureus subsp. aureus N315
aaaauuaaauaaugauaaauua

SEQ ID NO: 4044704 - RNA, 15 nt, Staphylococcus aureus subsp. aureus N315
aaaauuaacuuaaaa

SEQ ID NO: 4044705 - RNA, 14 nt, Staphylococcus aureus subsp. aureus N315
aaaauuaaucaccu

SEQ ID NO: 4044706 - RNA, 22 nt, Staphylococcus aureus subsp. aureus N315
aaaauuacuaacguaaagguga

SEQ ID NO: 4044707 - RNA, 22 nt, Staphylococcus aureus subsp. aureus N315
aaaauuagccuaauugagagaa

SEQ ID NO: 4044708 - RNA, 11 nt, Staphylococcus aureus subsp. aureus N315
aaaauuauaug

SEQ ID NO: 4044709 - RNA, 12 nt, Staphylococcus aureus subsp. aureus N315
aaaauuaucaau

SEQ ID NO: 4044710 - RNA, 16 nt, Staphylococcus aureus subsp. aureus N315
aaaauuauguaaaaaa

SEQ ID NO: 4044711 - RNA, 12 nt, Staphylococcus aureus subsp. aureus N315
aaaauuauuaaa

SEQ ID NO: 4044712 - RNA, 15 nt, Staphylococcus aureus subsp. aureus N315
aaaauuauuaaaaaa

SEQ ID NO: 4044713 - RNA, 16 nt, Staphylococcus aureus subsp. aureus N315
aaaauuauuaaaaaaa

SEQ ID NO: 4044714 - RNA, 18 nt, Staphylococcus aureus subsp. aureus N315
aaaauuauugaauuugaa

SEQ ID NO: 4044715 - RNA, 21 nt, Staphylococcus aureus subsp. aureus N315
aaaauuauugaauuugaauaa

SEQ ID NO: 4044716 - RNA, 17 nt, Staphylococcus aureus subsp. aureus N315
aaaauuauuugauauuu

SEQ ID NO: 4044717 - RNA, 14 nt, Staphylococcus aureus subsp. aureus N315
aaaauucaauauua

SEQ ID NO: 4044718 - RNA, 19 nt, Staphylococcus aureus subsp. aureus N315
aaaauucaauauuaaucau

SEQ ID NO: 4044719 - RNA, 14 nt, Staphylococcus aureus subsp. aureus N315
aaaauucaccaacu

SEQ ID NO: 4044720 - RNA, 21 nt, Staphylococcus aureus subsp. aureus N315
aaaauuccuagcuuuuauguc

SEQ ID NO: 4044721 - RNA, 20 nt, Staphylococcus aureus subsp. aureus N315
aaaauucgcuuguaacaagc

SEQ ID NO: 4044722 - RNA, 18 nt, Staphylococcus aureus subsp. aureus N315
aaaauucuauaauuuuaa

SEQ ID NO: 4044723 - RNA, 13 nt, Staphylococcus aureus subsp. aureus N315
aaaauucucuuuu

SEQ ID NO: 4044724 - RNA, 23 nt, Staphylococcus aureus subsp. aureus N315
aaaauugaaggaaaauaaaaacc

SEQ ID NO: 4044725 - RNA, 16 nt, Staphylococcus aureus subsp. aureus N315
aaaauugaauaucacu

SEQ ID NO: 4044726 - RNA, 19 nt, Staphylococcus aureus subsp. aureus N315
aaaauugcuaaaaaaauua

SEQ ID NO: 4044727 - RNA, 15 nt, Staphylococcus aureus subsp. aureus N315
aaaauugcuauauua

SEQ ID NO: 4044728 - RNA, 17 nt, Staphylococcus aureus subsp. aureus N315
aaaauugcuauauuagu

SEQ ID NO: 4044729 - RNA, 18 nt, Staphylococcus aureus subsp. aureus N315
aaaauugcuauauuagua

SEQ ID NO: 4044730 - RNA, 22 nt, Staphylococcus aureus subsp. aureus N315
aaaauugcugacaccuauauuu

SEQ ID NO: 4044731 - RNA, 20 nt, Staphylococcus aureus subsp. aureus N315
aaaauugguuuggauaaaau

SEQ ID NO: 4044732 - RNA, 17 nt, Staphylococcus aureus subsp. aureus N315
aaaauuguaagucgaaa

SEQ ID NO: 4044733 - RNA, 16 nt, Staphylococcus aureus subsp. aureus N315
aaaauuguauagaaug

SEQ ID NO: 4044734 - RNA, 23 nt, Staphylococcus aureus subsp. aureus N315
aaaauuuaaauaauaauucauaa

SEQ ID NO: 4044735 - RNA, 19 nt, Staphylococcus aureus subsp. aureus N315
aaaauuuacaaauguauaa

SEQ ID NO: 4044736 - RNA, 16 nt, Staphylococcus aureus subsp. aureus N315
aaaauuuauucaaaau

SEQ ID NO: 4044737 - RNA, 18 nt, Staphylococcus aureus subsp. aureus N315
aaaauuuauucaaaucau

SEQ ID NO: 4044738 - RNA, 22 nt, Staphylococcus aureus subsp. aureus N315
aaaauuucauauuguuuaggau

SEQ ID NO: 4044739 - RNA, 22 nt, Staphylococcus aureus subsp. aureus N315
aaaauuugcucgugaaaagcag

SEQ ID NO: 4044740 - RNA, 13 nt, Staphylococcus aureus subsp. aureus N315
aaaauuuguauaa

SEQ ID NO: 4044741 - RNA, 16 nt, Staphylococcus aureus subsp. aureus N315
aaaauuugugcauuca

SEQ ID NO: 4044742 - RNA, 17 nt, Staphylococcus aureus subsp. aureus N315
aaaauuuuuaaaaaaau

SEQ ID NO: 4044743 - RNA, 19 nt, Staphylococcus aureus subsp. aureus N315
aaaauuuuuaaaaaaauaa

SEQ ID NO: 4044744 - RNA, 17 nt, Staphylococcus aureus subsp. aureus N315
aaacaaaaaauaucuuu

SEQ ID NO: 4044745 - RNA, 20 nt, Staphylococcus aureus subsp. aureus N315
aaacaaaaaucuacuaagug

SEQ ID NO: 4044746 - RNA, 19 nt, Staphylococcus aureus subsp. aureus N315
aaacaaagguuuguaagac

SEQ ID NO: 4044747 - RNA, 14 nt, Staphylococcus aureus subsp. aureus N315
aaacaaauaaaugu

SEQ ID NO: 4044748 - RNA, 14 nt, Staphylococcus aureus subsp. aureus N315
aaacaaauccauua

SEQ ID NO: 4044749 - RNA, 19 nt, Staphylococcus aureus subsp. aureus N315
aaacaaauuaguuugauau

SEQ ID NO: 4044750 - RNA, 15 nt, Staphylococcus aureus subsp. aureus N315
aaacaacaaguaaaa

SEQ ID NO: 4044751 - RNA, 21 nt, Staphylococcus aureus subsp. aureus N315
aaacaacaaucaaauuacaaa

SEQ ID NO: 4044752 - RNA, 15 nt, Staphylococcus aureus subsp. aureus N315
aaacaacaucgauuu

SEQ ID NO: 4044753 - RNA, 16 nt, Staphylococcus aureus subsp. aureus N315
aaacaacuucugaaac

SEQ ID NO: 4044754 - RNA, 23 nt, Staphylococcus aureus subsp. aureus N315
aaacaauacguuuucggauugaa

SEQ ID NO: 4044755 - RNA, 14 nt, Staphylococcus aureus subsp. aureus N315
aaacaaugauggga

SEQ ID NO: 4044756 - RNA, 19 nt, Staphylococcus aureus subsp. aureus N315
aaacaaugcgguaaaaacu

SEQ ID NO: 4044757 - RNA, 13 nt, Staphylococcus aureus subsp. aureus N315
aaacaauuuaaaa

SEQ ID NO: 4044758 - RNA, 22 nt, Staphylococcus aureus subsp. aureus N315
aaacaauuuguaacuauugaaa

SEQ ID NO: 4044759 - RNA, 13 nt, Staphylococcus aureus subsp. aureus N315
aaacacaaaaagg

SEQ ID NO: 4044760 - RNA, 15 nt, Staphylococcus aureus subsp. aureus N315
aaacacaaggaauau

SEQ ID NO: 4044761 - RNA, 19 nt, Staphylococcus aureus subsp. aureus N315
aaacacagacguuuuugaa

SEQ ID NO: 4044762 - RNA, 14 nt, Staphylococcus aureus subsp. aureus N315
aaacacaguacaaa

SEQ ID NO: 4044763 - RNA, 18 nt, Staphylococcus aureus subsp. aureus N315
aaacacaguacaaauaac

SEQ ID NO: 4044764 - RNA, 18 nt, Staphylococcus aureus subsp. aureus N315
aaacacucaaaauguuua

SEQ ID NO: 4044765 - RNA, 19 nt, Staphylococcus aureus subsp. aureus N315
aaacacuuuuaguuguaac

SEQ ID NO: 4044766 - RNA, 16 nt, Staphylococcus aureus subsp. aureus N315
aaacagcaguaagaua

SEQ ID NO: 4044767 - RNA, 23 nt, Staphylococcus aureus subsp. aureus N315
aaacagcaguaagauaauuuuca

SEQ ID NO: 4044768 - RNA, 19 nt, Staphylococcus aureus subsp. aureus N315
aaacagcaguaagauuauu

SEQ ID NO: 4044769 - RNA, 18 nt, Staphylococcus aureus subsp. aureus N315
aaacauaaauaagcagua

SEQ ID NO: 4044770 - RNA, 20 nt, Staphylococcus aureus subsp. aureus N315
aaacauaaauacaaaaauau

SEQ ID NO: 4044771 - RNA, 14 nt, Staphylococcus aureus subsp. aureus N315
aaacauaacaugac

SEQ ID NO: 4044772 - RNA, 15 nt, Staphylococcus aureus subsp. aureus N315
aaacauaaugacauc

SEQ ID NO: 4044773 - RNA, 17 nt, Staphylococcus aureus subsp. aureus N315
aaacauaaugacaucau

SEQ ID NO: 4044774 - RNA, 15 nt, Staphylococcus aureus subsp. aureus N315
aaacauauucauucu

SEQ ID NO: 4044775 - RNA, 15 nt, Staphylococcus aureus subsp. aureus N315
aaacauccaauuaug

SEQ ID NO: 4044776 - RNA, 20 nt, Staphylococcus aureus subsp. aureus N315
aaacaucuaaauaguuuuuc

SEQ ID NO: 4044777 - RNA, 16 nt, Staphylococcus aureus subsp. aureus N315
aaacaucuauaacaaa

SEQ ID NO: 4044778 - RNA, 17 nt, Staphylococcus aureus subsp. aureus N315
aaacaucuauaacaaaa

SEQ ID NO: 4044779 - RNA, 18 nt, Staphylococcus aureus subsp. aureus N315
aaacaucuauaacaaaau

SEQ ID NO: 4044780 - RNA, 20 nt, Staphylococcus aureus subsp. aureus N315
aaacaucuauaacaaaaucu

SEQ ID NO: 4044781 - RNA, 15 nt, Staphylococcus aureus subsp. aureus N315
aaacaugaacaauca

SEQ ID NO: 4044782 - RNA, 16 nt, Staphylococcus aureus subsp. aureus N315
aaacaugaacaaucag

SEQ ID NO: 4044783 - RNA, 21 nt, Staphylococcus aureus subsp. aureus N315
aaacaugcuuggacauauacu

SEQ ID NO: 4044784 - RNA, 20 nt, Staphylococcus aureus subsp. aureus N315
aaacaugggcaaucacuccu

SEQ ID NO: 4044785 - RNA, 23 nt, Staphylococcus aureus subsp. aureus N315
aaacaugguuuucuuuuuaucau

SEQ ID NO: 4044786 - RNA, 19 nt, Staphylococcus aureus subsp. aureus N315
aaacauguacaauuuuuaa

SEQ ID NO: 4044787 - RNA, 22 nt, Staphylococcus aureus subsp. aureus N315
aaacauguguaugaucaagcug

SEQ ID NO: 4044788 - RNA, 15 nt, Staphylococcus aureus subsp. aureus N315
aaacauguuacccua

SEQ ID NO: 4044789 - RNA, 16 nt, Staphylococcus aureus subsp. aureus N315
aaacauuaaaauaauu

SEQ ID NO: 4044790 - RNA, 23 nt, Staphylococcus aureus subsp. aureus N315
aaacauuaaucuauauaaaaacu

SEQ ID NO: 4044791 - RNA, 18 nt, Staphylococcus aureus subsp. aureus N315
aaacauuauuaagugagu

SEQ ID NO: 4044792 - RNA, 22 nt, Staphylococcus aureus subsp. aureus N315
aaacauugcuuaacuuccuuuu

SEQ ID NO: 4044793 - RNA, 15 nt, Staphylococcus aureus subsp. aureus N315
aaacauuguccguuu

SEQ ID NO: 4044794 - RNA, 23 nt, Staphylococcus aureus subsp. aureus N315
aaacauuuauauagauugccauu

SEQ ID NO: 4044795 - RNA, 22 nt, Staphylococcus aureus subsp. aureus N315
aaacauuucgguaugauauuuc

SEQ ID NO: 4044796 - RNA, 16 nt, Staphylococcus aureus subsp. aureus N315
aaacauuuuuagaauc

SEQ ID NO: 4044797 - RNA, 18 nt, Staphylococcus aureus subsp. aureus N315
aaacauuuuuagaaucaa

SEQ ID NO: 4044798 - RNA, 13 nt, Staphylococcus aureus subsp. aureus N315
aaaccaaaagaaa

SEQ ID NO: 4044799 - RNA, 20 nt, Staphylococcus aureus subsp. aureus N315
aaaccaauaauccgagucau

SEQ ID NO: 4044800 - RNA, 13 nt, Staphylococcus aureus subsp. aureus N315
aaaccaauacgaa

SEQ ID NO: 4044801 - RNA, 13 nt, Staphylococcus aureus subsp. aureus N315
aaaccaauuuuaa

SEQ ID NO: 4044802 - RNA, 14 nt, Staphylococcus aureus subsp. aureus N315
aaaccaauuuuaac

SEQ ID NO: 4044803 - RNA, 15 nt, Staphylococcus aureus subsp. aureus N315
aaaccaauuuuaacu

SEQ ID NO: 4044804 - RNA, 21 nt, Staphylococcus aureus subsp. aureus N315
aaaccauuuucaagaggacaa

SEQ ID NO: 4044805 - RNA, 17 nt, Staphylococcus aureus subsp. aureus N315
aaaccgaggaaauccuu

SEQ ID NO: 4044806 - RNA, 12 nt, Staphylococcus aureus subsp. aureus N315
aaaccgauuaau

SEQ ID NO: 4044807 - RNA, 23 nt, Staphylococcus aureus subsp. aureus N315
aaaccgcacuucuauauuaauag

SEQ ID NO: 4044808 - RNA, 16 nt, Staphylococcus aureus subsp. aureus N315
aaaccguaauuuuaau

SEQ ID NO: 4044809 - RNA, 20 nt, Staphylococcus aureus subsp. aureus N315
aaaccuaaugcuuuaauaaa

SEQ ID NO: 4044810 - RNA, 12 nt, Staphylococcus aureus subsp. aureus N315
aaaccucuaaau

SEQ ID NO: 4044811 - RNA, 20 nt, Staphylococcus aureus subsp. aureus N315
aaaccucuaaauaaaauuaa

SEQ ID NO: 4044812 - RNA, 16 nt, Staphylococcus aureus subsp. aureus N315
aaaccugggacauuaa

SEQ ID NO: 4044813 - RNA, 14 nt, Staphylococcus aureus subsp. aureus N315
aaaccuuacccaaa

SEQ ID NO: 4044814 - RNA, 20 nt, Staphylococcus aureus subsp. aureus N315
aaacgagcuggugagaaauu

SEQ ID NO: 4044815 - RNA, 19 nt, Staphylococcus aureus subsp. aureus N315
aaacgauaagaauuaacaa

SEQ ID NO: 4044816 - RNA, 21 nt, Staphylococcus aureus subsp. aureus N315
aaacgauaagaauuaacaaca

SEQ ID NO: 4044817 - RNA, 16 nt, Staphylococcus aureus subsp. aureus N315
aaacgauucauuauau

SEQ ID NO: 4044818 - RNA, 19 nt, Staphylococcus aureus subsp. aureus N315
aaacgauucauuauauggu

SEQ ID NO: 4044819 - RNA, 15 nt, Staphylococcus aureus subsp. aureus N315
aaacgccucaacacu

SEQ ID NO: 4044820 - RNA, 17 nt, Staphylococcus aureus subsp. aureus N315
aaacgccucaacacuuu

SEQ ID NO: 4044821 - RNA, 17 nt, Staphylococcus aureus subsp. aureus N315
aaacgcugauuuuauaa

SEQ ID NO: 4044822 - RNA, 20 nt, Staphylococcus aureus subsp. aureus N315
aaacgguacagauaagaaua

SEQ ID NO: 4044823 - RNA, 22 nt, Staphylococcus aureus subsp. aureus N315
aaacguaucauuuaaaauauuu

SEQ ID NO: 4044824 - RNA, 22 nt, Staphylococcus aureus subsp. aureus N315
aaacgucacuuuauuaaauaac

SEQ ID NO: 4044825 - RNA, 17 nt, Staphylococcus aureus subsp. aureus N315
aaacgugacauuuucaa

SEQ ID NO: 4044826 - RNA, 13 nt, Staphylococcus aureus subsp. aureus N315
aaacgugauuuua

SEQ ID NO: 4044827 - RNA, 21 nt, Staphylococcus aureus subsp. aureus N315
aaacgugcaaauaaaaaaguu

SEQ ID NO: 4044828 - RNA, 14 nt, Staphylococcus aureus subsp. aureus N315
aaacguuauguaca

SEQ ID NO: 4044829 - RNA, 21 nt, Staphylococcus aureus subsp. aureus N315
aaacguucaucuaauuuuccu

SEQ ID NO: 4044830 - RNA, 22 nt, Staphylococcus aureus subsp. aureus N315
aaacguugaguauuacuugaaa

SEQ ID NO: 4044831 - RNA, 18 nt, Staphylococcus aureus subsp. aureus N315
aaacuaaagguauucuau

SEQ ID NO: 4044832 - RNA, 15 nt, Staphylococcus aureus subsp. aureus N315
aaacuaaauuaaaag

SEQ ID NO: 4044833 - RNA, 15 nt, Staphylococcus aureus subsp. aureus N315
aaacuaaguuauuua

SEQ ID NO: 4044834 - RNA, 22 nt, Staphylococcus aureus subsp. aureus N315
aaacuaauaauuuguaauuccu

SEQ ID NO: 4044835 - RNA, 21 nt, Staphylococcus aureus subsp. aureus N315
aaacuaauccucacuaacuca

SEQ ID NO: 4044836 - RNA, 15 nt, Staphylococcus aureus subsp. aureus N315
aaacuacauuugguu

SEQ ID NO: 4044837 - RNA, 15 nt, Staphylococcus aureus subsp. aureus N315
aaacuacgaauucuc

SEQ ID NO: 4044838 - RNA, 15 nt, Staphylococcus aureus subsp. aureus N315
aaacuagaaaacaua

SEQ ID NO: 4044839 - RNA, 19 nt, Staphylococcus aureus subsp. aureus N315
aaacuauaauaaagauuau

SEQ ID NO: 4044840 - RNA, 18 nt, Staphylococcus aureus subsp. aureus N315
aaacuauaauaauuggaa

SEQ ID NO: 4044841 - RNA, 19 nt, Staphylococcus aureus subsp. aureus N315
aaacuauuuuaaaaaugcu

SEQ ID NO: 4044842 - RNA, 23 nt, Staphylococcus aureus subsp. aureus N315
aaacucauccauugaucuuuuau

SEQ ID NO: 4044843 - RNA, 21 nt, Staphylococcus aureus subsp. aureus N315
aaacucauuuauaaacauugu

SEQ ID NO: 4044844 - RNA, 18 nt, Staphylococcus aureus subsp. aureus N315
aaacucguaaauuuuauc

SEQ ID NO: 4044845 - RNA, 22 nt, Staphylococcus aureus subsp. aureus N315
aaacucguugcacucuuuucuc

SEQ ID NO: 4044846 - RNA, 14 nt, Staphylococcus aureus subsp. aureus N315
aaacucuuggauug

SEQ ID NO: 4044847 - RNA, 17 nt, Staphylococcus aureus subsp. aureus N315
aaacugugcaugacgau

SEQ ID NO: 4044848 - RNA, 13 nt, Staphylococcus aureus subsp. aureus N315
aaacuuaaaacua

SEQ ID NO: 4044849 - RNA, 14 nt, Staphylococcus aureus subsp. aureus N315
aaacuuaagaauac

SEQ ID NO: 4044850 - RNA, 19 nt, Staphylococcus aureus subsp. aureus N315
aaacuuaagaauacaugac

SEQ ID NO: 4044851 - RNA, 17 nt, Staphylococcus aureus subsp. aureus N315
aaacuuacauuacauau

SEQ ID NO: 4044852 - RNA, 10 nt, Staphylococcus aureus subsp. aureus N315
aaacuuauaa

SEQ ID NO: 4044853 - RNA, 18 nt, Staphylococcus aureus subsp. aureus N315
aaacuuauaaaucaaagu

SEQ ID NO: 4044854 - RNA, 15 nt, Staphylococcus aureus subsp. aureus N315
aaacuuauaacuuua

SEQ ID NO: 4044855 - RNA, 14 nt, Staphylococcus aureus subsp. aureus N315
aaacuuauuugcca

SEQ ID NO: 4044856 - RNA, 15 nt, Staphylococcus aureus subsp. aureus N315
aaacuucacaucaug

SEQ ID NO: 4044857 - RNA, 16 nt, Staphylococcus aureus subsp. aureus N315
aaacuucuaucacacg

SEQ ID NO: 4044858 - RNA, 10 nt, Staphylococcus aureus subsp. aureus N315
aaacuucuuu

SEQ ID NO: 4044859 - RNA, 19 nt, Staphylococcus aureus subsp. aureus N315
aaacuucuuuucuuugaua

SEQ ID NO: 4044860 - RNA, 19 nt, Staphylococcus aureus subsp. aureus N315
aaacuuggcaaugaaauua

SEQ ID NO: 4044861 - RNA, 17 nt, Staphylococcus aureus subsp. aureus N315
aaacuuucagagauauu

SEQ ID NO: 4044862 - RNA, 18 nt, Staphylococcus aureus subsp. aureus N315
aaacuuucguauuuuucu

SEQ ID NO: 4044863 - RNA, 20 nt, Staphylococcus aureus subsp. aureus N315
aaacuuugugugcuuuaucu

SEQ ID NO: 4044864 - RNA, 12 nt, Staphylococcus aureus subsp. aureus N315
aaagaaaaguuu

SEQ ID NO: 4044865 - RNA, 12 nt, Staphylococcus aureus subsp. aureus N315
aaagaaacauag

SEQ ID NO: 4044866 - RNA, 18 nt, Staphylococcus aureus subsp. aureus N315
aaagaaagcuaauaucaa

SEQ ID NO: 4044867 - RNA, 14 nt, Staphylococcus aureus subsp. aureus N315
aaagaaauaauuua

SEQ ID NO: 4044868 - RNA, 16 nt, Staphylococcus aureus subsp. aureus N315
aaagaaauaauuuaaa

SEQ ID NO: 4044869 - RNA, 13 nt, Staphylococcus aureus subsp. aureus N315
aaagaaaucucua

SEQ ID NO: 4044870 - RNA, 22 nt, Staphylococcus aureus subsp. aureus N315
aaagaacgucgcgaaaacguug

SEQ ID NO: 4044871 - RNA, 18 nt, Staphylococcus aureus subsp. aureus N315
aaagaaggggagaguuaa

SEQ ID NO: 4044872 - RNA, 15 nt, Staphylococcus aureus subsp. aureus N315
aaagaaucauuuaaa

SEQ ID NO: 4044873 - RNA, 16 nt, Staphylococcus aureus subsp. aureus N315
aaagaaugauuuauaa

SEQ ID NO: 4044874 - RNA, 16 nt, Staphylococcus aureus subsp. aureus N315
aaagaauuauucaagu

SEQ ID NO: 4044875 - RNA, 18 nt, Staphylococcus aureus subsp. aureus N315
aaagaauuucgaaaagaa

SEQ ID NO: 4044876 - RNA, 12 nt, Staphylococcus aureus subsp. aureus N315
aaagacagaaau

SEQ ID NO: 4044877 - RNA, 19 nt, Staphylococcus aureus subsp. aureus N315
aaagacauccacagaauua

SEQ ID NO: 4044878 - RNA, 11 nt, Staphylococcus aureus subsp. aureus N315
aaagacauuua

SEQ ID NO: 4044879 - RNA, 13 nt, Staphylococcus aureus subsp. aureus N315
aaagaccauugua

SEQ ID NO: 4044880 - RNA, 22 nt, Staphylococcus aureus subsp. aureus N315
aaagacgauuuauuaguuuuua

SEQ ID NO: 4044881 - RNA, 18 nt, Staphylococcus aureus subsp. aureus N315
aaagacguuuuuuuauaa

SEQ ID NO: 4044882 - RNA, 15 nt, Staphylococcus aureus subsp. aureus N315
aaagacuacaaguca

SEQ ID NO: 4044883 - RNA, 19 nt, Staphylococcus aureus subsp. aureus N315
aaagacuagccauaccuua

SEQ ID NO: 4044884 - RNA, 20 nt, Staphylococcus aureus subsp. aureus N315
aaagacucaauuucauuuga

SEQ ID NO: 4044885 - RNA, 16 nt, Staphylococcus aureus subsp. aureus N315
aaagacucauacacaa

SEQ ID NO: 4044886 - RNA, 19 nt, Staphylococcus aureus subsp. aureus N315
aaagacugacuaauaaaac

SEQ ID NO: 4044887 - RNA, 22 nt, Staphylococcus aureus subsp. aureus N315
aaagagaugggcuaagguuguu

SEQ ID NO: 4044888 - RNA, 15 nt, Staphylococcus aureus subsp. aureus N315
aaagaggcuuuaaaa

SEQ ID NO: 4044889 - RNA, 16 nt, Staphylococcus aureus subsp. aureus N315
aaagagguacuagaau

SEQ ID NO: 4044890 - RNA, 19 nt, Staphylococcus aureus subsp. aureus N315
aaagagguacuagaauuaa

SEQ ID NO: 4044891 - RNA, 12 nt, Staphylococcus aureus subsp. aureus N315
aaagauauaaac

SEQ ID NO: 4044892 - RNA, 14 nt, Staphylococcus aureus subsp. aureus N315
aaagauauaaacau

SEQ ID NO: 4044893 - RNA, 15 nt, Staphylococcus aureus subsp. aureus N315
aaagauauagaauuc

SEQ ID NO: 4044894 - RNA, 21 nt, Staphylococcus aureus subsp. aureus N315
aaagauauguuuauauugcaa

SEQ ID NO: 4044895 - RNA, 14 nt, Staphylococcus aureus subsp. aureus N315
aaagaucauuaaaa

SEQ ID NO: 4044896 - RNA, 17 nt, Staphylococcus aureus subsp. aureus N315
aaagaugauauauucau

SEQ ID NO: 4044897 - RNA, 18 nt, Staphylococcus aureus subsp. aureus N315
aaagaugucgaaaaguau

SEQ ID NO: 4044898 - RNA, 12 nt, Staphylococcus aureus subsp. aureus N315
aaagauuaaaau

SEQ ID NO: 4044899 - RNA, 12 nt, Staphylococcus aureus subsp. aureus N315
aaagauuauuau

SEQ ID NO: 4044900 - RNA, 15 nt, Staphylococcus aureus subsp. aureus N315
aaagauuuaagucau

SEQ ID NO: 4044901 - RNA, 15 nt, Staphylococcus aureus subsp. aureus N315
aaagcaaaggcgcac

SEQ ID NO: 4044902 - RNA, 19 nt, Staphylococcus aureus subsp. aureus N315
aaagcaaauuauauagaaa

SEQ ID NO: 4044903 - RNA, 22 nt, Staphylococcus aureus subsp. aureus N315
aaagcacccgauagcucugaaa

SEQ ID NO: 4044904 - RNA, 22 nt, Staphylococcus aureus subsp. aureus N315
aaagcacuagccguuauuuuuu

SEQ ID NO: 4044905 - RNA, 17 nt, Staphylococcus aureus subsp. aureus N315
aaagcaggcaagcuauc

SEQ ID NO: 4044906 - RNA, 21 nt, Staphylococcus aureus subsp. aureus N315
aaagcaguaagagauuuucuu

SEQ ID NO: 4044907 - RNA, 19 nt, Staphylococcus aureus subsp. aureus N315
aaagcaucuucaauauuua

SEQ ID NO: 4044908 - RNA, 21 nt, Staphylococcus aureus subsp. aureus N315
aaagcaucuucaauauuuaaa

SEQ ID NO: 4044909 - RNA, 22 nt, Staphylococcus aureus subsp. aureus N315
aaagcaugauacucaauaaaau

SEQ ID NO: 4044910 - RNA, 22 nt, Staphylococcus aureus subsp. aureus N315
aaagcccuauuguuuuuuauaa

SEQ ID NO: 4044911 - RNA, 14 nt, Staphylococcus aureus subsp. aureus N315
aaagcgaauuaucu

SEQ ID NO: 4044912 - RNA, 14 nt, Staphylococcus aureus subsp. aureus N315
aaagcgccaauaca

SEQ ID NO: 4044913 - RNA, 16 nt, Staphylococcus aureus subsp. aureus N315
aaagcggacugaaaga

SEQ ID NO: 4044914 - RNA, 14 nt, Staphylococcus aureus subsp. aureus N315
aaagcuaaugcaag

SEQ ID NO: 4044915 - RNA, 13 nt, Staphylococcus aureus subsp. aureus N315
aaagcuaauuuuu

SEQ ID NO: 4044916 - RNA, 13 nt, Staphylococcus aureus subsp. aureus N315
aaagcuauaaaaa

SEQ ID NO: 4044917 - RNA, 20 nt, Staphylococcus aureus subsp. aureus N315
aaagcuauaaaaaaucuuuu

SEQ ID NO: 4044918 - RNA, 15 nt, Staphylococcus aureus subsp. aureus N315
aaagcugauuuuuca

SEQ ID NO: 4044919 - RNA, 20 nt, Staphylococcus aureus subsp. aureus N315
aaagcuguaguuucaacuuu

SEQ ID NO: 4044920 - RNA, 14 nt, Staphylococcus aureus subsp. aureus N315
aaagcugucaacuu

SEQ ID NO: 4044921 - RNA, 16 nt, Staphylococcus aureus subsp. aureus N315
aaagcuuauuaaauca

SEQ ID NO: 4044922 - RNA, 15 nt, Staphylococcus aureus subsp. aureus N315
aaagcuucauauuua

SEQ ID NO: 4044923 - RNA, 20 nt, Staphylococcus aureus subsp. aureus N315
aaagcuucgucaaugacuaa

SEQ ID NO: 4044924 - RNA, 21 nt, Staphylococcus aureus subsp. aureus N315
aaagcuugauuuaacaaccuc

SEQ ID NO: 4044925 - RNA, 16 nt, Staphylococcus aureus subsp. aureus N315
aaagcuuuuuugcuuu

SEQ ID NO: 4044926 - RNA, 15 nt, Staphylococcus aureus subsp. aureus N315
aaaggaauguuuaaa

SEQ ID NO: 4044927 - RNA, 19 nt, Staphylococcus aureus subsp. aureus N315
aaaggaauguuuaaaaaac

SEQ ID NO: 4044928 - RNA, 20 nt, Staphylococcus aureus subsp. aureus N315
aaaggaauguuuaaaaaacu

SEQ ID NO: 4044929 - RNA, 14 nt, Staphylococcus aureus subsp. aureus N315
aaaggacuuaguag

SEQ ID NO: 4044930 - RNA, 15 nt, Staphylococcus aureus subsp. aureus N315
aaaggauauugaaaa

SEQ ID NO: 4044931 - RNA, 19 nt, Staphylococcus aureus subsp. aureus N315
aaaggauauugaaaacacg

SEQ ID NO: 4044932 - RNA, 23 nt, Staphylococcus aureus subsp. aureus N315
aaaggaugaugugaauguuuugu

SEQ ID NO: 4044933 - RNA, 20 nt, Staphylococcus aureus subsp. aureus N315
aaaggcgucuuaaauuaggg

SEQ ID NO: 4044934 - RNA, 17 nt, Staphylococcus aureus subsp. aureus N315
aaaggcuagcuaaaauu

SEQ ID NO: 4044935 - RNA, 19 nt, Staphylococcus aureus subsp. aureus N315
aaaggcuagcuaaaauuug

SEQ ID NO: 4044936 - RNA, 15 nt, Staphylococcus aureus subsp. aureus N315
aaagggaauggauua

SEQ ID NO: 4044937 - RNA, 14 nt, Staphylococcus aureus subsp. aureus N315
aaagggcaaaaaag

SEQ ID NO: 4044938 - RNA, 23 nt, Staphylococcus aureus subsp. aureus N315
aaagggcaacacucggaaacaug

SEQ ID NO: 4044939 - RNA, 18 nt, Staphylococcus aureus subsp. aureus N315
aaagggcgaaauggauuc

SEQ ID NO: 4044940 - RNA, 17 nt, Staphylococcus aureus subsp. aureus N315
aaagggcuauuugauac

SEQ ID NO: 4044941 - RNA, 16 nt, Staphylococcus aureus subsp. aureus N315
aaagguaacuuuuuaa

SEQ ID NO: 4044942 - RNA, 18 nt, Staphylococcus aureus subsp. aureus N315
aaagguaacuuuuuaacu

SEQ ID NO: 4044943 - RNA, 19 nt, Staphylococcus aureus subsp. aureus N315
aaagguauucaaauaaaca

SEQ ID NO: 4044944 - RNA, 12 nt, Staphylococcus aureus subsp. aureus N315
aaaggucaucug

SEQ ID NO: 4044945 - RNA, 14 nt, Staphylococcus aureus subsp. aureus N315
aaagguuaaauauu

SEQ ID NO: 4044946 - RNA, 23 nt, Staphylococcus aureus subsp. aureus N315
aaagguuguuuuucaucauuaaa

SEQ ID NO: 4044947 - RNA, 18 nt, Staphylococcus aureus subsp. aureus N315
aaaguaaaauauacuuga

SEQ ID NO: 4044948 - RNA, 13 nt, Staphylococcus aureus subsp. aureus N315
aaaguaaguaaaa

SEQ ID NO: 4044949 - RNA, 16 nt, Staphylococcus aureus subsp. aureus N315
aaaguaaguaaaauaa

SEQ ID NO: 4044950 - RNA, 13 nt, Staphylococcus aureus subsp. aureus N315
aaaguaaugcugu

SEQ ID NO: 4044951 - RNA, 14 nt, Staphylococcus aureus subsp. aureus N315
aaaguaauuaaaua

SEQ ID NO: 4044952 - RNA, 19 nt, Staphylococcus aureus subsp. aureus N315
aaaguacaaguugaucaaa

SEQ ID NO: 4044953 - RNA, 23 nt, Staphylococcus aureus subsp. aureus N315
aaaguacaaguugaucaaaaaug

SEQ ID NO: 4044954 - RNA, 16 nt, Staphylococcus aureus subsp. aureus N315
aaaguaccuaaaauag

SEQ ID NO: 4044955 - RNA, 17 nt, Staphylococcus aureus subsp. aureus N315
aaaguaccuaaaauaga

SEQ ID NO: 4044956 - RNA, 21 nt, Staphylococcus aureus subsp. aureus N315
aaaguaccuaaaauagaaaaa

SEQ ID NO: 4044957 - RNA, 22 nt, Staphylococcus aureus subsp. aureus N315
aaaguaccuaaaauagaaaaau

SEQ ID NO: 4044958 - RNA, 12 nt, Staphylococcus aureus subsp. aureus N315
aaaguacucaag

SEQ ID NO: 4044959 - RNA, 13 nt, Staphylococcus aureus subsp. aureus N315
aaaguacuuacaa

SEQ ID NO: 4044960 - RNA, 15 nt, Staphylococcus aureus subsp. aureus N315
aaaguacuuacaaau

SEQ ID NO: 4044961 - RNA, 14 nt, Staphylococcus aureus subsp. aureus N315
aaaguacuuuaaaa

SEQ ID NO: 4044962 - RNA, 16 nt, Staphylococcus aureus subsp. aureus N315
aaaguagaauuauuua

SEQ ID NO: 4044963 - RNA, 19 nt, Staphylococcus aureus subsp. aureus N315
aaaguagaauuauuuagaa

SEQ ID NO: 4044964 - RNA, 16 nt, Staphylococcus aureus subsp. aureus N315
aaaguagacauugaaa

SEQ ID NO: 4044965 - RNA, 13 nt, Staphylococcus aureus subsp. aureus N315
aaaguagauauug

SEQ ID NO: 4044966 - RNA, 16 nt, Staphylococcus aureus subsp. aureus N315
aaaguauaaaccaaau

SEQ ID NO: 4044967 - RNA, 15 nt, Staphylococcus aureus subsp. aureus N315
aaaguauaaauauaa

SEQ ID NO: 4044968 - RNA, 12 nt, Staphylococcus aureus subsp. aureus N315
aaaguauaaggu

SEQ ID NO: 4044969 - RNA, 14 nt, Staphylococcus aureus subsp. aureus N315
aaaguauaugaauc

SEQ ID NO: 4044970 - RNA, 15 nt, Staphylococcus aureus subsp. aureus N315
aaaguaucagucauu

SEQ ID NO: 4044971 - RNA, 22 nt, Staphylococcus aureus subsp. aureus N315
aaaguaucuaugaaauuuuuua

SEQ ID NO: 4044972 - RNA, 14 nt, Staphylococcus aureus subsp. aureus N315
aaaguauuacuuua

SEQ ID NO: 4044973 - RNA, 13 nt, Staphylococcus aureus subsp. aureus N315
aaagucaaaaaau

SEQ ID NO: 4044974 - RNA, 16 nt, Staphylococcus aureus subsp. aureus N315
aaagucaauuuaaaua

SEQ ID NO: 4044975 - RNA, 20 nt, Staphylococcus aureus subsp. aureus N315
aaagucauacuuaugagcaa

SEQ ID NO: 4044976 - RNA, 17 nt, Staphylococcus aureus subsp. aureus N315
aaagucauuaaauguac

SEQ ID NO: 4044977 - RNA, 17 nt, Staphylococcus aureus subsp. aureus N315
aaagucauuuucauuca

SEQ ID NO: 4044978 - RNA, 17 nt, Staphylococcus aureus subsp. aureus N315
aaagucguuguugaaau

SEQ ID NO: 4044979 - RNA, 20 nt, Staphylococcus aureus subsp. aureus N315
aaagucguuguugaaauuaa

SEQ ID NO: 4044980 - RNA, 24 nt, Staphylococcus aureus subsp. aureus N315
aaagucuuucucggcgauaaaaug

SEQ ID NO: 4044981 - RNA, 13 nt, Staphylococcus aureus subsp. aureus N315
aaagugaauugua

SEQ ID NO: 4044982 - RNA, 16 nt, Staphylococcus aureus subsp. aureus N315
aaagugauaauuaaaa

SEQ ID NO: 4044983 - RNA, 14 nt, Staphylococcus aureus subsp. aureus N315
aaagugauucccaa

SEQ ID NO: 4044984 - RNA, 14 nt, Staphylococcus aureus subsp. aureus N315
aaagugguuuuacu

SEQ ID NO: 4044985 - RNA, 21 nt, Staphylococcus aureus subsp. aureus N315
aaagugucuaacgcuguuuca

SEQ ID NO: 4044986 - RNA, 13 nt, Staphylococcus aureus subsp. aureus N315
aaaguguuucaac

SEQ ID NO: 4044987 - RNA, 15 nt, Staphylococcus aureus subsp. aureus N315
aaaguguuucaacau

SEQ ID NO: 4044988 - RNA, 14 nt, Staphylococcus aureus subsp. aureus N315
aaaguuaaagacua

SEQ ID NO: 4044989 - RNA, 18 nt, Staphylococcus aureus subsp. aureus N315
aaaguuacaguguaauca

SEQ ID NO: 4044990 - RNA, 17 nt, Staphylococcus aureus subsp. aureus N315
aaaguuacaugcucuuu

SEQ ID NO: 4044991 - RNA, 21 nt, Staphylococcus aureus subsp. aureus N315
aaaguuaucugcuuuucuauu

SEQ ID NO: 4044992 - RNA, 18 nt, Staphylococcus aureus subsp. aureus N315
aaaguucauuacaaacuu

SEQ ID NO: 4044993 - RNA, 15 nt, Staphylococcus aureus subsp. aureus N315
aaaguugacaauaca

SEQ ID NO: 4044994 - RNA, 18 nt, Staphylococcus aureus subsp. aureus N315
aaaguugacaauacaaau

SEQ ID NO: 4044995 - RNA, 20 nt, Staphylococcus aureus subsp. aureus N315
aaaguugguuuuauuaauuc

SEQ ID NO: 4044996 - RNA, 18 nt, Staphylococcus aureus subsp. aureus N315
aaaguuguaauuuaaaau

SEQ ID NO: 4044997 - RNA, 16 nt, Staphylococcus aureus subsp. aureus N315
aaaguuguauucugaa

SEQ ID NO: 4044998 - RNA, 20 nt, Staphylococcus aureus subsp. aureus N315
aaaguuguauucugaaacuu

SEQ ID NO: 4044999 - RNA, 21 nt, Staphylococcus aureus subsp. aureus N315
aaaguuuaauugcuguaaaua

SEQ ID NO: 4045000 - RNA, 15 nt, Staphylococcus aureus subsp. aureus N315
aaaguuucccaagca

SEQ ID NO: 4045001 - RNA, 11 nt, Staphylococcus aureus subsp. aureus N315
aaaguuuucau

SEQ ID NO: 4045002 - RNA, 22 nt, Staphylococcus aureus subsp. aureus N315
aaaguuuugaaccuaaauucca

SEQ ID NO: 4045003 - RNA, 23 nt, Staphylococcus aureus subsp. aureus N315
aaauaaaaaaacaccuucguuua

SEQ ID NO: 4045004 - RNA, 13 nt, Staphylococcus aureus subsp. aureus N315
aaauaaaaaauaa

SEQ ID NO: 4045005 - RNA, 13 nt, Staphylococcus aureus subsp. aureus N315
aaauaaaaauaca

SEQ ID NO: 4045006 - RNA, 12 nt, Staphylococcus aureus subsp. aureus N315
aaauaaaauuuu

SEQ ID NO: 4045007 - RNA, 19 nt, Staphylococcus aureus subsp. aureus N315
aaauaaacacaucuaugug

SEQ ID NO: 4045008 - RNA, 19 nt, Staphylococcus aureus subsp. aureus N315
aaauaaacucaccaaguuc

SEQ ID NO: 4045009 - RNA, 11 nt, Staphylococcus aureus subsp. aureus N315
aaauaaauaag

SEQ ID NO: 4045010 - RNA, 14 nt, Staphylococcus aureus subsp. aureus N315
aaauaaauauaaaa

SEQ ID NO: 4045011 - RNA, 12 nt, Staphylococcus aureus subsp. aureus N315
aaauaaaucucc

SEQ ID NO: 4045012 - RNA, 19 nt, Staphylococcus aureus subsp. aureus N315
aaauaaaugacauuuaaua

SEQ ID NO: 4045013 - RNA, 22 nt, Staphylococcus aureus subsp. aureus N315
aaauaaaugacuucacauuuau

SEQ ID NO: 4045014 - RNA, 15 nt, Staphylococcus aureus subsp. aureus N315
aaauaaauuaaauuu

SEQ ID NO: 4045015 - RNA, 19 nt, Staphylococcus aureus subsp. aureus N315
aaauaacguuaauauaauu

SEQ ID NO: 4045016 - RNA, 21 nt, Staphylococcus aureus subsp. aureus N315
aaauaacguuaauauaauuaa

SEQ ID NO: 4045017 - RNA, 21 nt, Staphylococcus aureus subsp. aureus N315
aaauaacuagauguucacauu

SEQ ID NO: 4045018 - RNA, 18 nt, Staphylococcus aureus subsp. aureus N315
aaauaacuguaaaacauu

SEQ ID NO: 4045019 - RNA, 20 nt, Staphylococcus aureus subsp. aureus N315
aaauaacuuuuuaaaggacc

SEQ ID NO: 4045020 - RNA, 18 nt, Staphylococcus aureus subsp. aureus N315
aaauaagcaaucauaaua

SEQ ID NO: 4045021 - RNA, 16 nt, Staphylococcus aureus subsp. aureus N315
aaauaaguaguucagc

SEQ ID NO: 4045022 - RNA, 16 nt, Staphylococcus aureus subsp. aureus N315
aaauaagugauaaaua

SEQ ID NO: 4045023 - RNA, 20 nt, Staphylococcus aureus subsp. aureus N315
aaauaagugauaaauaaugc

SEQ ID NO: 4045024 - RNA, 22 nt, Staphylococcus aureus subsp. aureus N315
aaauaauaacccgaacacaaaa

SEQ ID NO: 4045025 - RNA, 14 nt, Staphylococcus aureus subsp. aureus N315
aaauaauagcaaaa

SEQ ID NO: 4045026 - RNA, 14 nt, Staphylococcus aureus subsp. aureus N315
aaauaauauaaaaa

SEQ ID NO: 4045027 - RNA, 14 nt, Staphylococcus aureus subsp. aureus N315
aaauaauauaaaac

SEQ ID NO: 4045028 - RNA, 16 nt, Staphylococcus aureus subsp. aureus N315
aaauaauauaaaacga

SEQ ID NO: 4045029 - RNA, 22 nt, Staphylococcus aureus subsp. aureus N315
aaauaauaugaauuuagaugca

SEQ ID NO: 4045030 - RNA, 17 nt, Staphylococcus aureus subsp. aureus N315
aaauaaucccaaccauu

SEQ ID NO: 4045031 - RNA, 13 nt, Staphylococcus aureus subsp. aureus N315
aaauaaucgaaga

SEQ ID NO: 4045032 - RNA, 11 nt, Staphylococcus aureus subsp. aureus N315
aaauaaugaau

SEQ ID NO: 4045033 - RNA, 23 nt, Staphylococcus aureus subsp. aureus N315
aaauaaugauauauuacaccauu

SEQ ID NO: 4045034 - RNA, 21 nt, Staphylococcus aureus subsp. aureus N315
aaauaaugaugcauaagauuu

SEQ ID NO: 4045035 - RNA, 20 nt, Staphylococcus aureus subsp. aureus N315
aaauaaugucuuacuuuuaa

SEQ ID NO: 4045036 - RNA, 13 nt, Staphylococcus aureus subsp. aureus N315
aaauaauuaugaa

SEQ ID NO: 4045037 - RNA, 16 nt, Staphylococcus aureus subsp. aureus N315
aaauacaaaaauauag

SEQ ID NO: 4045038 - RNA, 14 nt, Staphylococcus aureus subsp. aureus N315
aaauacaaauauau

SEQ ID NO: 4045039 - RNA, 17 nt, Staphylococcus aureus subsp. aureus N315
aaauacaauuucuucau

SEQ ID NO: 4045040 - RNA, 20 nt, Staphylococcus aureus subsp. aureus N315
aaauacaauuucuucauuuu

SEQ ID NO: 4045041 - RNA, 16 nt, Staphylococcus aureus subsp. aureus N315
aaauacauaauaaaaa

SEQ ID NO: 4045042 - RNA, 14 nt, Staphylococcus aureus subsp. aureus N315
aaauacauaauuaa

SEQ ID NO: 4045043 - RNA, 16 nt, Staphylococcus aureus subsp. aureus N315
aaauacaucaauuucu

SEQ ID NO: 4045044 - RNA, 17 nt, Staphylococcus aureus subsp. aureus N315
aaauacaucaauuucua

SEQ ID NO: 4045045 - RNA, 19 nt, Staphylococcus aureus subsp. aureus N315
aaauacauccauacuucua

SEQ ID NO: 4045046 - RNA, 16 nt, Staphylococcus aureus subsp. aureus N315
aaauacaucggaauuc

SEQ ID NO: 4045047 - RNA, 23 nt, Staphylococcus aureus subsp. aureus N315
aaauaccagaugaaccaaaaaac

SEQ ID NO: 4045048 - RNA, 18 nt, Staphylococcus aureus subsp. aureus N315
aaauaccuaccacaauaa

SEQ ID NO: 4045049 - RNA, 15 nt, Staphylococcus aureus subsp. aureus N315
aaauaccucuacauu

SEQ ID NO: 4045050 - RNA, 15 nt, Staphylococcus aureus subsp. aureus N315
aaauacgcaaaccaa

SEQ ID NO: 4045051 - RNA, 20 nt, Staphylococcus aureus subsp. aureus N315
aaauacguaucaagaaaaag

SEQ ID NO: 4045052 - RNA, 15 nt, Staphylococcus aureus subsp. aureus N315
aaauacuaacaauua

SEQ ID NO: 4045053 - RNA, 15 nt, Staphylococcus aureus subsp. aureus N315
aaauacuauacugau

SEQ ID NO: 4045054 - RNA, 20 nt, Staphylococcus aureus subsp. aureus N315
aaauacuauacugaugaaaa

SEQ ID NO: 4045055 - RNA, 18 nt, Staphylococcus aureus subsp. aureus N315
aaauacuauauauaauga

SEQ ID NO: 4045056 - RNA, 16 nt, Staphylococcus aureus subsp. aureus N315
aaauacuauucuuucu

SEQ ID NO: 4045057 - RNA, 21 nt, Staphylococcus aureus subsp. aureus N315
aaauacuugaauuuaauaagu

SEQ ID NO: 4045058 - RNA, 22 nt, Staphylococcus aureus subsp. aureus N315
aaauacuuguuuaccuaaaucu

SEQ ID NO: 4045059 - RNA, 22 nt, Staphylococcus aureus subsp. aureus N315
aaauacuuuugcaucacagaua

SEQ ID NO: 4045060 - RNA, 21 nt, Staphylococcus aureus subsp. aureus N315
aaauacuuuuugaugauuuac

SEQ ID NO: 4045061 - RNA, 19 nt, Staphylococcus aureus subsp. aureus N315
aaauagaaaaauuucaaaa

SEQ ID NO: 4045062 - RNA, 16 nt, Staphylococcus aureus subsp. aureus N315
aaauagaugagaaagu

SEQ ID NO: 4045063 - RNA, 20 nt, Staphylococcus aureus subsp. aureus N315
aaauagaugagaaaguaaaa

SEQ ID NO: 4045064 - RNA, 14 nt, Staphylococcus aureus subsp. aureus N315
aaauagauugaaaa

SEQ ID NO: 4045065 - RNA, 20 nt, Staphylococcus aureus subsp. aureus N315
aaauagcguaauuauuauaa

SEQ ID NO: 4045066 - RNA, 15 nt, Staphylococcus aureus subsp. aureus N315
aaauagcuauuaaaa

SEQ ID NO: 4045067 - RNA, 16 nt, Staphylococcus aureus subsp. aureus N315
aaauagcuauuaaaau

SEQ ID NO: 4045068 - RNA, 21 nt, Staphylococcus aureus subsp. aureus N315
aaauaggcacgugcuuuggug

SEQ ID NO: 4045069 - RNA, 18 nt, Staphylococcus aureus subsp. aureus N315
aaauagucggggccccaa

SEQ ID NO: 4045070 - RNA, 18 nt, Staphylococcus aureus subsp. aureus N315
aaauaguuaagauuuuaa

SEQ ID NO: 4045071 - RNA, 17 nt, Staphylococcus aureus subsp. aureus N315
aaauaguucaaaauacu

SEQ ID NO: 4045072 - RNA, 19 nt, Staphylococcus aureus subsp. aureus N315
aaauaguucaaaauacuca

SEQ ID NO: 4045073 - RNA, 20 nt, Staphylococcus aureus subsp. aureus N315
aaauaguucaaauggacuaa

SEQ ID NO: 4045074 - RNA, 19 nt, Staphylococcus aureus subsp. aureus N315
aaauaguucuuuaaauuau

SEQ ID NO: 4045075 - RNA, 21 nt, Staphylococcus aureus subsp. aureus N315
aaauaguucuuuaaauuauau

SEQ ID NO: 4045076 - RNA, 23 nt, Staphylococcus aureus subsp. aureus N315
aaauaguuuuucauauucacauc

SEQ ID NO: 4045077 - RNA, 16 nt, Staphylococcus aureus subsp. aureus N315
aaauauaaaauccuaa

SEQ ID NO: 4045078 - RNA, 19 nt, Staphylococcus aureus subsp. aureus N315
aaauauaaaauccuaagca

SEQ ID NO: 4045079 - RNA, 15 nt, Staphylococcus aureus subsp. aureus N315
aaauauaaauaaaag

SEQ ID NO: 4045080 - RNA, 16 nt, Staphylococcus aureus subsp. aureus N315
aaauauaaccuaaaaa

SEQ ID NO: 4045081 - RNA, 21 nt, Staphylococcus aureus subsp. aureus N315
aaauauaauacuguauuuuaa

SEQ ID NO: 4045082 - RNA, 21 nt, Staphylococcus aureus subsp. aureus N315
aaauauaauagaaauaaucac

SEQ ID NO: 4045083 - RNA, 19 nt, Staphylococcus aureus subsp. aureus N315
aaauauaauguauaaaaca

SEQ ID NO: 4045084 - RNA, 15 nt, Staphylococcus aureus subsp. aureus N315
aaauauaccaaccaa

SEQ ID NO: 4045085 - RNA, 16 nt, Staphylococcus aureus subsp. aureus N315
aaauauaccaaccaaa

SEQ ID NO: 4045086 - RNA, 21 nt, Staphylococcus aureus subsp. aureus N315
aaauauacuugccuucaaauu

SEQ ID NO: 4045087 - RNA, 23 nt, Staphylococcus aureus subsp. aureus N315
aaauauacuuuuaccauugugaa

SEQ ID NO: 4045088 - RNA, 18 nt, Staphylococcus aureus subsp. aureus N315
aaauauaguaauaaaagu

SEQ ID NO: 4045089 - RNA, 22 nt, Staphylococcus aureus subsp. aureus N315
aaauauauaaggcgcucucuuu

SEQ ID NO: 4045090 - RNA, 23 nt, Staphylococcus aureus subsp. aureus N315
aaauauaucuaauacuuucacuu

SEQ ID NO: 4045091 - RNA, 12 nt, Staphylococcus aureus subsp. aureus N315
aaauauauuguc

SEQ ID NO: 4045092 - RNA, 11 nt, Staphylococcus aureus subsp. aureus N315
aaauauauuug

SEQ ID NO: 4045093 - RNA, 17 nt, Staphylococcus aureus subsp. aureus N315
aaauauauuuguaguaa

SEQ ID NO: 4045094 - RNA, 15 nt, Staphylococcus aureus subsp. aureus N315
aaauauauuuguaua

SEQ ID NO: 4045095 - RNA, 17 nt, Staphylococcus aureus subsp. aureus N315
aaauaucaguaauaaua

SEQ ID NO: 4045096 - RNA, 15 nt, Staphylococcus aureus subsp. aureus N315
aaauaucauaaaugc

SEQ ID NO: 4045097 - RNA, 19 nt, Staphylococcus aureus subsp. aureus N315
aaauaucauaccguacaaa

SEQ ID NO: 4045098 - RNA, 18 nt, Staphylococcus aureus subsp. aureus N315
aaauaucaugcaaaacua

SEQ ID NO: 4045099 - RNA, 20 nt, Staphylococcus aureus subsp. aureus N315
aaauauccuggaauauuaac

SEQ ID NO: 4045100 - RNA, 21 nt, Staphylococcus aureus subsp. aureus N315
aaauauccuggaauauuaaca

SEQ ID NO: 4045101 - RNA, 17 nt, Staphylococcus aureus subsp. aureus N315
aaauaucuaaacaauuc

SEQ ID NO: 4045102 - RNA, 20 nt, Staphylococcus aureus subsp. aureus N315
aaauaucuaccuuuuaauuu

SEQ ID NO: 4045103 - RNA, 22 nt, Staphylococcus aureus subsp. aureus N315
aaauaucuaccuuuuaauuuau

SEQ ID NO: 4045104 - RNA, 16 nt, Staphylococcus aureus subsp. aureus N315
aaauaucuuuuucuaa

SEQ ID NO: 4045105 - RNA, 18 nt, Staphylococcus aureus subsp. aureus N315
aaauaucuuuuuguuuau

SEQ ID NO: 4045106 - RNA, 15 nt, Staphylococcus aureus subsp. aureus N315
aaauaugacacauac

SEQ ID NO: 4045107 - RNA, 16 nt, Staphylococcus aureus subsp. aureus N315
aaauaugacacauaca

SEQ ID NO: 4045108 - RNA, 18 nt, Staphylococcus aureus subsp. aureus N315
aaauaugauguuaaaaaa

SEQ ID NO: 4045109 - RNA, 13 nt, Staphylococcus aureus subsp. aureus N315
aaauaugauugaa

SEQ ID NO: 4045110 - RNA, 15 nt, Staphylococcus aureus subsp. aureus N315
aaauauggauuuuga

SEQ ID NO: 4045111 - RNA, 23 nt, Staphylococcus aureus subsp. aureus N315
aaauauguaaucagguuuaaaca

SEQ ID NO: 4045112 - RNA, 21 nt, Staphylococcus aureus subsp. aureus N315
aaauauguauguuuuaucaau

SEQ ID NO: 4045113 - RNA, 12 nt, Staphylococcus aureus subsp. aureus N315
aaauauuaaaaa

SEQ ID NO: 4045114 - RNA, 15 nt, Staphylococcus aureus subsp. aureus N315
aaauauuaaauuaug

SEQ ID NO: 4045115 - RNA, 16 nt, Staphylococcus aureus subsp. aureus N315
aaauauuacuaacaac

SEQ ID NO: 4045116 - RNA, 15 nt, Staphylococcus aureus subsp. aureus N315
aaauauuauuaaauc

SEQ ID NO: 4045117 - RNA, 18 nt, Staphylococcus aureus subsp. aureus N315
aaauauuauuaaaucaaa

SEQ ID NO: 4045118 - RNA, 14 nt, Staphylococcus aureus subsp. aureus N315
aaauauugaacaau

SEQ ID NO: 4045119 - RNA, 17 nt, Staphylococcus aureus subsp. aureus N315
aaauauugaauaaucau

SEQ ID NO: 4045120 - RNA, 17 nt, Staphylococcus aureus subsp. aureus N315
aaauauugauauaaaaa

SEQ ID NO: 4045121 - RNA, 21 nt, Staphylococcus aureus subsp. aureus N315
aaauauugauucuagugaaau

SEQ ID NO: 4045122 - RNA, 15 nt, Staphylococcus aureus subsp. aureus N315
aaauauuuaaaauau

SEQ ID NO: 4045123 - RNA, 16 nt, Staphylococcus aureus subsp. aureus N315
aaauauuuaaaauauu

SEQ ID NO: 4045124 - RNA, 20 nt, Staphylococcus aureus subsp. aureus N315
aaauauuuaaccuuuaaaac

SEQ ID NO: 4045125 - RNA, 15 nt, Staphylococcus aureus subsp. aureus N315
aaauauuuaucuuua

SEQ ID NO: 4045126 - RNA, 22 nt, Staphylococcus aureus subsp. aureus N315
aaauauuucuaaaccauuuuca

SEQ ID NO: 4045127 - RNA, 12 nt, Staphylococcus aureus subsp. aureus N315
aaauauuugaaa

SEQ ID NO: 4045128 - RNA, 14 nt, Staphylococcus aureus subsp. aureus N315
aaauauuugaaaau

SEQ ID NO: 4045129 - RNA, 16 nt, Staphylococcus aureus subsp. aureus N315
aaauauuugaaaauuu

SEQ ID NO: 4045130 - RNA, 15 nt, Staphylococcus aureus subsp. aureus N315
aaauauuuuaucugu

SEQ ID NO: 4045131 - RNA, 18 nt, Staphylococcus aureus subsp. aureus N315
aaauauuuuaucuguaaa

SEQ ID NO: 4045132 - RNA, 23 nt, Staphylococcus aureus subsp. aureus N315
aaauauuuuuaauuauuuuaaaa

SEQ ID NO: 4045133 - RNA, 14 nt, Staphylococcus aureus subsp. aureus N315
aaauauuuuuucug

SEQ ID NO: 4045134 - RNA, 14 nt, Staphylococcus aureus subsp. aureus N315
aaaucaaaaauaau

SEQ ID NO: 4045135 - RNA, 21 nt, Staphylococcus aureus subsp. aureus N315
aaaucaaauauacuuuuacca

SEQ ID NO: 4045136 - RNA, 14 nt, Staphylococcus aureus subsp. aureus N315
aaaucaaauauuug

SEQ ID NO: 4045137 - RNA, 20 nt, Staphylococcus aureus subsp. aureus N315
aaaucaacaagaacuuagaa

SEQ ID NO: 4045138 - RNA, 14 nt, Staphylococcus aureus subsp. aureus N315
aaaucaacaccaac

SEQ ID NO: 4045139 - RNA, 15 nt, Staphylococcus aureus subsp. aureus N315
aaaucaacuuuucua

SEQ ID NO: 4045140 - RNA, 12 nt, Staphylococcus aureus subsp. aureus N315
aaaucaagaaau

SEQ ID NO: 4045141 - RNA, 14 nt, Staphylococcus aureus subsp. aureus N315
aaaucaaguguugu

SEQ ID NO: 4045142 - RNA, 16 nt, Staphylococcus aureus subsp. aureus N315
aaaucaauccaucaau

SEQ ID NO: 4045143 - RNA, 15 nt, Staphylococcus aureus subsp. aureus N315
aaaucacaggaaaau

SEQ ID NO: 4045144 - RNA, 20 nt, Staphylococcus aureus subsp. aureus N315
aaaucacauaugauaauuaa

SEQ ID NO: 4045145 - RNA, 12 nt, Staphylococcus aureus subsp. aureus N315
aaaucaccaaca

SEQ ID NO: 4045146 - RNA, 17 nt, Staphylococcus aureus subsp. aureus N315
aaaucaccuuuuuuaac

SEQ ID NO: 4045147 - RNA, 20 nt, Staphylococcus aureus subsp. aureus N315
aaaucaccuuuuuuaacuuu

SEQ ID NO: 4045148 - RNA, 19 nt, Staphylococcus aureus subsp. aureus N315
aaaucacugcuuucaagua

SEQ ID NO: 4045149 - RNA, 18 nt, Staphylococcus aureus subsp. aureus N315
aaaucaguuuuuaaauca

SEQ ID NO: 4045150 - RNA, 15 nt, Staphylococcus aureus subsp. aureus N315
aaaucauaaauuaua

SEQ ID NO: 4045151 - RNA, 17 nt, Staphylococcus aureus subsp. aureus N315
aaaucauacgagaaauu

SEQ ID NO: 4045152 - RNA, 16 nt, Staphylococcus aureus subsp. aureus N315
aaaucauccauaaaaa

SEQ ID NO: 4045153 - RNA, 20 nt, Staphylococcus aureus subsp. aureus N315
aaaucaucguauuucauaua

SEQ ID NO: 4045154 - RNA, 11 nt, Staphylococcus aureus subsp. aureus N315
aaaucaucuua

SEQ ID NO: 4045155 - RNA, 13 nt, Staphylococcus aureus subsp. aureus N315
aaaucaucuuaac

SEQ ID NO: 4045156 - RNA, 21 nt, Staphylococcus aureus subsp. aureus N315
aaaucaucuuaugacugcuuu

SEQ ID NO: 4045157 - RNA, 22 nt, Staphylococcus aureus subsp. aureus N315
aaaucaugacauaaaacuuaca

SEQ ID NO: 4045158 - RNA, 18 nt, Staphylococcus aureus subsp. aureus N315
aaaucauucaccuaaaaa

SEQ ID NO: 4045159 - RNA, 20 nt, Staphylococcus aureus subsp. aureus N315
aaaucauucaccuaaaaaga

SEQ ID NO: 4045160 - RNA, 14 nt, Staphylococcus aureus subsp. aureus N315
aaaucauucuuuau

SEQ ID NO: 4045161 - RNA, 15 nt, Staphylococcus aureus subsp. aureus N315
aaauccacacauuaa

SEQ ID NO: 4045162 - RNA, 22 nt, Staphylococcus aureus subsp. aureus N315
aaaucccgccgucuccauauuu

SEQ ID NO: 4045163 - RNA, 15 nt, Staphylococcus aureus subsp. aureus N315
aaaucgauaacaguu

SEQ ID NO: 4045164 - RNA, 14 nt, Staphylococcus aureus subsp. aureus N315
aaaucgauuaagaa

SEQ ID NO: 4045165 - RNA, 15 nt, Staphylococcus aureus subsp. aureus N315
aaaucgauuaauuau

SEQ ID NO: 4045166 - RNA, 15 nt, Staphylococcus aureus subsp. aureus N315
aaaucggauuaacau

SEQ ID NO: 4045167 - RNA, 16 nt, Staphylococcus aureus subsp. aureus N315
aaaucggauuaacauu

SEQ ID NO: 4045168 - RNA, 14 nt, Staphylococcus aureus subsp. aureus N315
aaaucgguuugauu

SEQ ID NO: 4045169 - RNA, 15 nt, Staphylococcus aureus subsp. aureus N315
aaaucgguuugauua

SEQ ID NO: 4045170 - RNA, 18 nt, Staphylococcus aureus subsp. aureus N315
aaaucgugcccauaugau

SEQ ID NO: 4045171 - RNA, 15 nt, Staphylococcus aureus subsp. aureus N315
aaaucguuauaagua

SEQ ID NO: 4045172 - RNA, 12 nt, Staphylococcus aureus subsp. aureus N315
aaaucguuucau

SEQ ID NO: 4045173 - RNA, 23 nt, Staphylococcus aureus subsp. aureus N315
aaaucuaauccugguauaaugga

SEQ ID NO: 4045174 - RNA, 24 nt, Staphylococcus aureus subsp. aureus N315
aaaucuaauccugguauaauggac

SEQ ID NO: 4045175 - RNA, 22 nt, Staphylococcus aureus subsp. aureus N315
aaaucuacaauauuaaaauuaa

SEQ ID NO: 4045176 - RNA, 12 nt, Staphylococcus aureus subsp. aureus N315
aaaucuauaaau

SEQ ID NO: 4045177 - RNA, 21 nt, Staphylococcus aureus subsp. aureus N315
aaaucuauaccauuccaaaaa

SEQ ID NO: 4045178 - RNA, 13 nt, Staphylococcus aureus subsp. aureus N315
aaaucuaucuacu

SEQ ID NO: 4045179 - RNA, 14 nt, Staphylococcus aureus subsp. aureus N315
aaaucuaucuacuc

SEQ ID NO: 4045180 - RNA, 16 nt, Staphylococcus aureus subsp. aureus N315
aaaucuaucuacucaa

SEQ ID NO: 4045181 - RNA, 14 nt, Staphylococcus aureus subsp. aureus N315
aaaucucaacagca

SEQ ID NO: 4045182 - RNA, 15 nt, Staphylococcus aureus subsp. aureus N315
aaaucucaacagcaa

SEQ ID NO: 4045183 - RNA, 22 nt, Staphylococcus aureus subsp. aureus N315
aaaucucauaauaauucaguaa

SEQ ID NO: 4045184 - RNA, 22 nt, Staphylococcus aureus subsp. aureus N315
aaaucucgucacauauaaauau

SEQ ID NO: 4045185 - RNA, 16 nt, Staphylococcus aureus subsp. aureus N315
aaaucucuguauugag

SEQ ID NO: 4045186 - RNA, 15 nt, Staphylococcus aureus subsp. aureus N315
aaaucugauucauua

SEQ ID NO: 4045187 - RNA, 22 nt, Staphylococcus aureus subsp. aureus N315
aaaucuguacuucuaauuugca

SEQ ID NO: 4045188 - RNA, 15 nt, Staphylococcus aureus subsp. aureus N315
aaaucuguuuaaauu

SEQ ID NO: 4045189 - RNA, 20 nt, Staphylococcus aureus subsp. aureus N315
aaaucuguuuaaauuuaaaa

SEQ ID NO: 4045190 - RNA, 19 nt, Staphylococcus aureus subsp. aureus N315
aaaucuuaaagauuuuuca

SEQ ID NO: 4045191 - RNA, 17 nt, Staphylococcus aureus subsp. aureus N315
aaaucuucaagugccau

SEQ ID NO: 4045192 - RNA, 13 nt, Staphylococcus aureus subsp. aureus N315
aaaucuucuauuu

SEQ ID NO: 4045193 - RNA, 16 nt, Staphylococcus aureus subsp. aureus N315
aaaucuucuauuuuca

SEQ ID NO: 4045194 - RNA, 22 nt, Staphylococcus aureus subsp. aureus N315
aaaucuuguuggauuuuaacaa

SEQ ID NO: 4045195 - RNA, 21 nt, Staphylococcus aureus subsp. aureus N315
aaaucuuuaaauguaucacuu

SEQ ID NO: 4045196 - RNA, 23 nt, Staphylococcus aureus subsp. aureus N315
aaaucuuuacuuguaauuaauac

SEQ ID NO: 4045197 - RNA, 14 nt, Staphylococcus aureus subsp. aureus N315
aaaucuuuuaaauu

SEQ ID NO: 4045198 - RNA, 22 nt, Staphylococcus aureus subsp. aureus N315
aaaucuuuuaaauuuaguaucu

SEQ ID NO: 4045199 - RNA, 15 nt, Staphylococcus aureus subsp. aureus N315
aaaucuuuuacuaaa

SEQ ID NO: 4045200 - RNA, 21 nt, Staphylococcus aureus subsp. aureus N315
aaaucuuuuacuaaaugaauu

SEQ ID NO: 4045201 - RNA, 16 nt, Staphylococcus aureus subsp. aureus N315
aaaucuuuuagcuuuu

SEQ ID NO: 4045202 - RNA, 20 nt, Staphylococcus aureus subsp. aureus N315
aaaucuuuuagcuuuuguaa

SEQ ID NO: 4045203 - RNA, 22 nt, Staphylococcus aureus subsp. aureus N315
aaaucuuuuagcuuuuguaaag

SEQ ID NO: 4045204 - RNA, 14 nt, Staphylococcus aureus subsp. aureus N315
aaaugaaaaaguaa

SEQ ID NO: 4045205 - RNA, 15 nt, Staphylococcus aureus subsp. aureus N315
aaaugaaacuuugug

SEQ ID NO: 4045206 - RNA, 13 nt, Staphylococcus aureus subsp. aureus N315
aaaugaaaguacc

SEQ ID NO: 4045207 - RNA, 14 nt, Staphylococcus aureus subsp. aureus N315
aaaugaaauaggcg

SEQ ID NO: 4045208 - RNA, 18 nt, Staphylococcus aureus subsp. aureus N315
aaaugaaauauuugauga

SEQ ID NO: 4045209 - RNA, 10 nt, Staphylococcus aureus subsp. aureus N315
aaaugaacca

SEQ ID NO: 4045210 - RNA, 13 nt, Staphylococcus aureus subsp. aureus N315
aaaugaaccauuu

SEQ ID NO: 4045211 - RNA, 18 nt, Staphylococcus aureus subsp. aureus N315
aaaugaagguguugaaaa

SEQ ID NO: 4045212 - RNA, 14 nt, Staphylococcus aureus subsp. aureus N315
aaaugaaguuuuua

SEQ ID NO: 4045213 - RNA, 22 nt, Staphylococcus aureus subsp. aureus N315
aaaugaaucgcuuugauuacca

SEQ ID NO: 4045214 - RNA, 14 nt, Staphylococcus aureus subsp. aureus N315
aaaugaauuauuua

SEQ ID NO: 4045215 - RNA, 15 nt, Staphylococcus aureus subsp. aureus N315
aaaugacauuuuaaa

SEQ ID NO: 4045216 - RNA, 19 nt, Staphylococcus aureus subsp. aureus N315
aaaugacgauaccuuuaau

SEQ ID NO: 4045217 - RNA, 22 nt, Staphylococcus aureus subsp. aureus N315
aaaugacgauaccuuuaauaau

SEQ ID NO: 4045218 - RNA, 20 nt, Staphylococcus aureus subsp. aureus N315
aaaugacgugcuuuuaaaug

SEQ ID NO: 4045219 - RNA, 24 nt, Staphylococcus aureus subsp. aureus N315
aaaugacgugcuuuuaaauguauu

SEQ ID NO: 4045220 - RNA, 14 nt, Staphylococcus aureus subsp. aureus N315
aaaugacugaauua

SEQ ID NO: 4045221 - RNA, 18 nt, Staphylococcus aureus subsp. aureus N315
aaaugacuucacauuuau

SEQ ID NO: 4045222 - RNA, 16 nt, Staphylococcus aureus subsp. aureus N315
aaaugagcguuccauu

SEQ ID NO: 4045223 - RNA, 12 nt, Staphylococcus aureus subsp. aureus N315
aaaugauaagaa

SEQ ID NO: 4045224 - RNA, 15 nt, Staphylococcus aureus subsp. aureus N315
aaaugauacauuauu

SEQ ID NO: 4045225 - RNA, 23 nt, Staphylococcus aureus subsp. aureus N315
aaaugauagcuaaacauuuuaua

SEQ ID NO: 4045226 - RNA, 16 nt, Staphylococcus aureus subsp. aureus N315
aaaugaucaucguaua

SEQ ID NO: 4045227 - RNA, 19 nt, Staphylococcus aureus subsp. aureus N315
aaaugaugcaguaaaacca

SEQ ID NO: 4045228 - RNA, 20 nt, Staphylococcus aureus subsp. aureus N315
aaaugauguaacguuucuuu

SEQ ID NO: 4045229 - RNA, 16 nt, Staphylococcus aureus subsp. aureus N315
aaaugauuaauaacau

SEQ ID NO: 4045230 - RNA, 13 nt, Staphylococcus aureus subsp. aureus N315
aaaugauucuuua

SEQ ID NO: 4045231 - RNA, 18 nt, Staphylococcus aureus subsp. aureus N315
aaaugauuguuuuaagug

SEQ ID NO: 4045232 - RNA, 14 nt, Staphylococcus aureus subsp. aureus N315
aaaugauuuauucu

SEQ ID NO: 4045233 - RNA, 20 nt, Staphylococcus aureus subsp. aureus N315
aaaugauuuauucuaaauau

SEQ ID NO: 4045234 - RNA, 14 nt, Staphylococcus aureus subsp. aureus N315
aaaugauuucacuu

SEQ ID NO: 4045235 - RNA, 13 nt, Staphylococcus aureus subsp. aureus N315
aaaugcaauacau

SEQ ID NO: 4045236 - RNA, 14 nt, Staphylococcus aureus subsp. aureus N315
aaaugcaauuuuuc

SEQ ID NO: 4045237 - RNA, 19 nt, Staphylococcus aureus subsp. aureus N315
aaaugcacgagcaacaucu

SEQ ID NO: 4045238 - RNA, 19 nt, Staphylococcus aureus subsp. aureus N315
aaaugcagcuguauaacca

SEQ ID NO: 4045239 - RNA, 20 nt, Staphylococcus aureus subsp. aureus N315
aaaugccgagauuauuaugu

SEQ ID NO: 4045240 - RNA, 23 nt, Staphylococcus aureus subsp. aureus N315
aaaugcuauauuuagaaugauga

SEQ ID NO: 4045241 - RNA, 14 nt, Staphylococcus aureus subsp. aureus N315
aaaugcuguuuuau

SEQ ID NO: 4045242 - RNA, 20 nt, Staphylococcus aureus subsp. aureus N315
aaaugcuuaagaaauuuuuu

SEQ ID NO: 4045243 - RNA, 20 nt, Staphylococcus aureus subsp. aureus N315
aaaugcuuaauaaaaucaaa

SEQ ID NO: 4045244 - RNA, 22 nt, Staphylococcus aureus subsp. aureus N315
aaaugcuuaauuuguuuuaaau

SEQ ID NO: 4045245 - RNA, 14 nt, Staphylococcus aureus subsp. aureus N315
aaaugcuuuaacua

SEQ ID NO: 4045246 - RNA, 15 nt, Staphylococcus aureus subsp. aureus N315
aaauggaaagacguu

SEQ ID NO: 4045247 - RNA, 22 nt, Staphylococcus aureus subsp. aureus N315
aaauggaaccacgucuuaaucg

SEQ ID NO: 4045248 - RNA, 23 nt, Staphylococcus aureus subsp. aureus N315
aaauggcaucuggcaaauugccu

SEQ ID NO: 4045249 - RNA, 16 nt, Staphylococcus aureus subsp. aureus N315
aaauggugaacuaaau

SEQ ID NO: 4045250 - RNA, 19 nt, Staphylococcus aureus subsp. aureus N315
aaauggugcgaauaauaau

SEQ ID NO: 4045251 - RNA, 21 nt, Staphylococcus aureus subsp. aureus N315
aaauggugcgaauaauaauac

SEQ ID NO: 4045252 - RNA, 19 nt, Staphylococcus aureus subsp. aureus N315
aaauguaaauaaaaauuau

SEQ ID NO: 4045253 - RNA, 15 nt, Staphylococcus aureus subsp. aureus N315
aaauguaacauuaaa

SEQ ID NO: 4045254 - RNA, 15 nt, Staphylococcus aureus subsp. aureus N315
aaauguacauuguaa

SEQ ID NO: 4045255 - RNA, 16 nt, Staphylococcus aureus subsp. aureus N315
aaauguauuaaacauu

SEQ ID NO: 4045256 - RNA, 22 nt, Staphylococcus aureus subsp. aureus N315
aaauguauuauucucucauuug

SEQ ID NO: 4045257 - RNA, 15 nt, Staphylococcus aureus subsp. aureus N315
aaauguauuuuuacu

SEQ ID NO: 4045258 - RNA, 16 nt, Staphylococcus aureus subsp. aureus N315
aaaugucaguuuugaa

SEQ ID NO: 4045259 - RNA, 21 nt, Staphylococcus aureus subsp. aureus N315
aaaugucaguuuugaagaaua

SEQ ID NO: 4045260 - RNA, 14 nt, Staphylococcus aureus subsp. aureus N315
aaaugucauuugaa

SEQ ID NO: 4045261 - RNA, 18 nt, Staphylococcus aureus subsp. aureus N315
aaaugugcaauuagaaua

SEQ ID NO: 4045262 - RNA, 19 nt, Staphylococcus aureus subsp. aureus N315
aaaugugcaauuagaauau

SEQ ID NO: 4045263 - RNA, 13 nt, Staphylococcus aureus subsp. aureus N315
aaauguuaacgau

SEQ ID NO: 4045264 - RNA, 15 nt, Staphylococcus aureus subsp. aureus N315
aaauguuacacaaau

SEQ ID NO: 4045265 - RNA, 21 nt, Staphylococcus aureus subsp. aureus N315
aaauguuacacaaauuaaaac

SEQ ID NO: 4045266 - RNA, 19 nt, Staphylococcus aureus subsp. aureus N315
aaauguuauuaaccaucau

SEQ ID NO: 4045267 - RNA, 14 nt, Staphylococcus aureus subsp. aureus N315
aaauguuauugcuu

SEQ ID NO: 4045268 - RNA, 18 nt, Staphylococcus aureus subsp. aureus N315
aaauguucagguucaaaa

SEQ ID NO: 4045269 - RNA, 17 nt, Staphylococcus aureus subsp. aureus N315
aaauguugaauguggaa

SEQ ID NO: 4045270 - RNA, 16 nt, Staphylococcus aureus subsp. aureus N315
aaauguuuaacaauaa

SEQ ID NO: 4045271 - RNA, 20 nt, Staphylococcus aureus subsp. aureus N315
aaauguuuaucaauucccug

SEQ ID NO: 4045272 - RNA, 18 nt, Staphylococcus aureus subsp. aureus N315
aaauuaaaaagguacuaa

SEQ ID NO: 4045273 - RNA, 20 nt, Staphylococcus aureus subsp. aureus N315
aaauuaaagcuagaaacaau

SEQ ID NO: 4045274 - RNA, 15 nt, Staphylococcus aureus subsp. aureus N315
aaauuaaauuuguua

SEQ ID NO: 4045275 - RNA, 11 nt, Staphylococcus aureus subsp. aureus N315
aaauuaacuag

SEQ ID NO: 4045276 - RNA, 13 nt, Staphylococcus aureus subsp. aureus N315
aaauuaacuagug

SEQ ID NO: 4045277 - RNA, 22 nt, Staphylococcus aureus subsp. aureus N315
aaauuaacuuaaaauuuaaaua

SEQ ID NO: 4045278 - RNA, 21 nt, Staphylococcus aureus subsp. aureus N315
aaauuaacuuagguuauuaua

SEQ ID NO: 4045279 - RNA, 24 nt, Staphylococcus aureus subsp. aureus N315
aaauuaacuuagguuauuauaaaa

SEQ ID NO: 4045280 - RNA, 17 nt, Staphylococcus aureus subsp. aureus N315
aaauuaagaagaaauac

SEQ ID NO: 4045281 - RNA, 13 nt, Staphylococcus aureus subsp. aureus N315
aaauuaagaauaa

SEQ ID NO: 4045282 - RNA, 15 nt, Staphylococcus aureus subsp. aureus N315
aaauuaagaauaauc

SEQ ID NO: 4045283 - RNA, 12 nt, Staphylococcus aureus subsp. aureus N315
aaauuaauaauu

SEQ ID NO: 4045284 - RNA, 17 nt, Staphylococcus aureus subsp. aureus N315
aaauuaauaugaacaaa

SEQ ID NO: 4045285 - RNA, 19 nt, Staphylococcus aureus subsp. aureus N315
aaauuaauaugaacaaaaa

SEQ ID NO: 4045286 - RNA, 12 nt, Staphylococcus aureus subsp. aureus N315
aaauuaaugaac

SEQ ID NO: 4045287 - RNA, 17 nt, Staphylococcus aureus subsp. aureus N315
aaauuacaaauuaucua

SEQ ID NO: 4045288 - RNA, 21 nt, Staphylococcus aureus subsp. aureus N315
aaauuacaacuuuuagaguuu

SEQ ID NO: 4045289 - RNA, 15 nt, Staphylococcus aureus subsp. aureus N315
aaauuacuauauuua

SEQ ID NO: 4045290 - RNA, 20 nt, Staphylococcus aureus subsp. aureus N315
aaauuacuuaauaguaacau

SEQ ID NO: 4045291 - RNA, 22 nt, Staphylococcus aureus subsp. aureus N315
aaauuacuuaauaguaacauaa

SEQ ID NO: 4045292 - RNA, 23 nt, Staphylococcus aureus subsp. aureus N315
aaauuacuuaauaguaacauaag

SEQ ID NO: 4045293 - RNA, 12 nt, Staphylococcus aureus subsp. aureus N315
aaauuagaauua

SEQ ID NO: 4045294 - RNA, 14 nt, Staphylococcus aureus subsp. aureus N315
aaauuagaugaaau

SEQ ID NO: 4045295 - RNA, 20 nt, Staphylococcus aureus subsp. aureus N315
aaauuagauuuuaugcuuua

SEQ ID NO: 4045296 - RNA, 17 nt, Staphylococcus aureus subsp. aureus N315
aaauuagggugaacagu

SEQ ID NO: 4045297 - RNA, 15 nt, Staphylococcus aureus subsp. aureus N315
aaauuagucauccaa

SEQ ID NO: 4045298 - RNA, 18 nt, Staphylococcus aureus subsp. aureus N315
aaauuagucauccaaaga

SEQ ID NO: 4045299 - RNA, 12 nt, Staphylococcus aureus subsp. aureus N315
aaauuauauaaa

SEQ ID NO: 4045300 - RNA, 18 nt, Staphylococcus aureus subsp. aureus N315
aaauuauauagaaaacua

SEQ ID NO: 4045301 - RNA, 14 nt, Staphylococcus aureus subsp. aureus N315
aaauuaucagaauc

SEQ ID NO: 4045302 - RNA, 13 nt, Staphylococcus aureus subsp. aureus N315
aaauuaucauuaa

SEQ ID NO: 4045303 - RNA, 13 nt, Staphylococcus aureus subsp. aureus N315
aaauuaugacuaa

SEQ ID NO: 4045304 - RNA, 18 nt, Staphylococcus aureus subsp. aureus N315
aaauuaugauuauauuuu

SEQ ID NO: 4045305 - RNA, 22 nt, Staphylococcus aureus subsp. aureus N315
aaauuaugauuauauuuucuca

SEQ ID NO: 4045306 - RNA, 17 nt, Staphylococcus aureus subsp. aureus N315
aaauuauugaauuugaa

SEQ ID NO: 4045307 - RNA, 19 nt, Staphylococcus aureus subsp. aureus N315
aaauuauugaauuugaaua

SEQ ID NO: 4045308 - RNA, 20 nt, Staphylococcus aureus subsp. aureus N315
aaauuauugaauuugaauaa

SEQ ID NO: 4045309 - RNA, 23 nt, Staphylococcus aureus subsp. aureus N315
aaauuauuuauucauuauagucu

SEQ ID NO: 4045310 - RNA, 13 nt, Staphylococcus aureus subsp. aureus N315
aaauuauuugaua

SEQ ID NO: 4045311 - RNA, 16 nt, Staphylococcus aureus subsp. aureus N315
aaauucaacgucauca

SEQ ID NO: 4045312 - RNA, 15 nt, Staphylococcus aureus subsp. aureus N315
aaauucaacuuuaau

SEQ ID NO: 4045313 - RNA, 15 nt, Staphylococcus aureus subsp. aureus N315
aaauucaacuuuuca

SEQ ID NO: 4045314 - RNA, 12 nt, Staphylococcus aureus subsp. aureus N315
aaauucaucuug

SEQ ID NO: 4045315 - RNA, 17 nt, Staphylococcus aureus subsp. aureus N315
aaauucauuuguauuaa

SEQ ID NO: 4045316 - RNA, 20 nt, Staphylococcus aureus subsp. aureus N315
aaauuccaagagaauuaaua

SEQ ID NO: 4045317 - RNA, 15 nt, Staphylococcus aureus subsp. aureus N315
aaauucgaaaagaaa

SEQ ID NO: 4045318 - RNA, 16 nt, Staphylococcus aureus subsp. aureus N315
aaauucgaaaagaaau

SEQ ID NO: 4045319 - RNA, 17 nt, Staphylococcus aureus subsp. aureus N315
aaauucgaaaagaaauu

SEQ ID NO: 4045320 - RNA, 16 nt, Staphylococcus aureus subsp. aureus N315
aaauucgcaagccuuc

SEQ ID NO: 4045321 - RNA, 18 nt, Staphylococcus aureus subsp. aureus N315
aaauucgcuuguaacaag

SEQ ID NO: 4045322 - RNA, 21 nt, Staphylococcus aureus subsp. aureus N315
aaauucuaaucgcauuuuuua

SEQ ID NO: 4045323 - RNA, 17 nt, Staphylococcus aureus subsp. aureus N315
aaauucuacaggcaaug

SEQ ID NO: 4045324 - RNA, 22 nt, Staphylococcus aureus subsp. aureus N315
aaauucuacaggcaaugcaagu

SEQ ID NO: 4045325 - RNA, 20 nt, Staphylococcus aureus subsp. aureus N315
aaauucuauaauuuuaauua

SEQ ID NO: 4045326 - RNA, 21 nt, Staphylococcus aureus subsp. aureus N315
aaauucuauaauuuuaauuau

SEQ ID NO: 4045327 - RNA, 14 nt, Staphylococcus aureus subsp. aureus N315
aaauucucaauuaa

SEQ ID NO: 4045328 - RNA, 12 nt, Staphylococcus aureus subsp. aureus N315
aaauucucuuuu

SEQ ID NO: 4045329 - RNA, 21 nt, Staphylococcus aureus subsp. aureus N315
aaauucucuuuuaaauucuua

SEQ ID NO: 4045330 - RNA, 17 nt, Staphylococcus aureus subsp. aureus N315
aaauucuuauaaaauaa

SEQ ID NO: 4045331 - RNA, 20 nt, Staphylococcus aureus subsp. aureus N315
aaauucuuauaaaauaaaaa

SEQ ID NO: 4045332 - RNA, 19 nt, Staphylococcus aureus subsp. aureus N315
aaauucuuuuacagcaaga

SEQ ID NO: 4045333 - RNA, 14 nt, Staphylococcus aureus subsp. aureus N315
aaauucuuuuguaa

SEQ ID NO: 4045334 - RNA, 11 nt, Staphylococcus aureus subsp. aureus N315
aaauucuuuuu

SEQ ID NO: 4045335 - RNA, 13 nt, Staphylococcus aureus subsp. aureus N315
aaauugaacuuug

SEQ ID NO: 4045336 - RNA, 17 nt, Staphylococcus aureus subsp. aureus N315
aaauugauauugcaaaa

SEQ ID NO: 4045337 - RNA, 19 nt, Staphylococcus aureus subsp. aureus N315
aaauugcuaaaaaaauuaa

SEQ ID NO: 4045338 - RNA, 19 nt, Staphylococcus aureus subsp. aureus N315
aaauugcuauauuaguaua

SEQ ID NO: 4045339 - RNA, 19 nt, Staphylococcus aureus subsp. aureus N315
aaauuggaaucccaaugcu

SEQ ID NO: 4045340 - RNA, 20 nt, Staphylococcus aureus subsp. aureus N315
aaauuggacuuauggguuca

SEQ ID NO: 4045341 - RNA, 19 nt, Staphylococcus aureus subsp. aureus N315
aaauuggauaauuucuucu

SEQ ID NO: 4045342 - RNA, 15 nt, Staphylococcus aureus subsp. aureus N315
aaauugguuuggaua

SEQ ID NO: 4045343 - RNA, 14 nt, Staphylococcus aureus subsp. aureus N315
aaauuguaugaaua

SEQ ID NO: 4045344 - RNA, 23 nt, Staphylococcus aureus subsp. aureus N315
aaauuguguugaaucaacaguuu

SEQ ID NO: 4045345 - RNA, 15 nt, Staphylococcus aureus subsp. aureus N315
aaauuguguuucuuu

SEQ ID NO: 4045346 - RNA, 22 nt, Staphylococcus aureus subsp. aureus N315
aaauuguguuucuuuuauuuuc

SEQ ID NO: 4045347 - RNA, 17 nt, Staphylococcus aureus subsp. aureus N315
aaauuguucuaauacac

SEQ ID NO: 4045348 - RNA, 20 nt, Staphylococcus aureus subsp. aureus N315
aaauuguuuacuauacuuug

SEQ ID NO: 4045349 - RNA, 16 nt, Staphylococcus aureus subsp. aureus N315
aaauuuaaaacaauga

SEQ ID NO: 4045350 - RNA, 17 nt, Staphylococcus aureus subsp. aureus N315
aaauuuaaaacaaugau

SEQ ID NO: 4045351 - RNA, 14 nt, Staphylococcus aureus subsp. aureus N315
aaauuuaaaauaau

SEQ ID NO: 4045352 - RNA, 12 nt, Staphylococcus aureus subsp. aureus N315
aaauuuaaaugu

SEQ ID NO: 4045353 - RNA, 14 nt, Staphylococcus aureus subsp. aureus N315
aaauuuaauaauac

SEQ ID NO: 4045354 - RNA, 17 nt, Staphylococcus aureus subsp. aureus N315
aaauuuaauacaauuca

SEQ ID NO: 4045355 - RNA, 18 nt, Staphylococcus aureus subsp. aureus N315
aaauuuaauacaauucaa

SEQ ID NO: 4045356 - RNA, 13 nt, Staphylococcus aureus subsp. aureus N315
aaauuuaccaguu

SEQ ID NO: 4045357 - RNA, 16 nt, Staphylococcus aureus subsp. aureus N315
aaauuuaguaucucau

SEQ ID NO: 4045358 - RNA, 13 nt, Staphylococcus aureus subsp. aureus N315
aaauuuauaauac

SEQ ID NO: 4045359 - RNA, 22 nt, Staphylococcus aureus subsp. aureus N315
aaauuuauauagucuaugaaua

SEQ ID NO: 4045360 - RNA, 14 nt, Staphylococcus aureus subsp. aureus N315
aaauuuauuauaaa

SEQ ID NO: 4045361 - RNA, 17 nt, Staphylococcus aureus subsp. aureus N315
aaauuuauuauaaaaua

SEQ ID NO: 4045362 - RNA, 14 nt, Staphylococcus aureus subsp. aureus N315
aaauuuauucaaaa

SEQ ID NO: 4045363 - RNA, 12 nt, Staphylococcus aureus subsp. aureus N315
aaauuucaaaaa

SEQ ID NO: 4045364 - RNA, 19 nt, Staphylococcus aureus subsp. aureus N315
aaauuucaccgcuuucaau

SEQ ID NO: 4045365 - RNA, 16 nt, Staphylococcus aureus subsp. aureus N315
aaauuucauaaaguuu

SEQ ID NO: 4045366 - RNA, 21 nt, Staphylococcus aureus subsp. aureus N315
aaauuuccucaccuucauuuu

SEQ ID NO: 4045367 - RNA, 19 nt, Staphylococcus aureus subsp. aureus N315
aaauuucgccucaucuaau

SEQ ID NO: 4045368 - RNA, 18 nt, Staphylococcus aureus subsp. aureus N315
aaauuucuguaaccaaaa

SEQ ID NO: 4045369 - RNA, 22 nt, Staphylococcus aureus subsp. aureus N315
aaauuuguaccaaauaaauuaa

SEQ ID NO: 4045370 - RNA, 14 nt, Staphylococcus aureus subsp. aureus N315
aaauuuuacgaaaa

SEQ ID NO: 4045371 - RNA, 19 nt, Staphylococcus aureus subsp. aureus N315
aaauuuuaucuaaacauuu

SEQ ID NO: 4045372 - RNA, 22 nt, Staphylococcus aureus subsp. aureus N315
aaauuuucuguuuaauuaaaau

SEQ ID NO: 4045373 - RNA, 12 nt, Staphylococcus aureus subsp. aureus N315
aaauuuugaaga

SEQ ID NO: 4045374 - RNA, 15 nt, Staphylococcus aureus subsp. aureus N315
aaauuuugaagaagu

SEQ ID NO: 4045375 - RNA, 20 nt, Staphylococcus aureus subsp. aureus N315
aaauuuuggaccucuugaaa

SEQ ID NO: 4045376 - RNA, 17 nt, Staphylococcus aureus subsp. aureus N315
aaauuuuuaagaagcuu

SEQ ID NO: 4045377 - RNA, 17 nt, Staphylococcus aureus subsp. aureus N315
aaauuuuuuguaaacau

SEQ ID NO: 4045378 - RNA, 18 nt, Staphylococcus aureus subsp. aureus N315
aacaaaaagguucuccac

SEQ ID NO: 4045379 - RNA, 12 nt, Staphylococcus aureus subsp. aureus N315
aacaaaagaaag

SEQ ID NO: 4045380 - RNA, 14 nt, Staphylococcus aureus subsp. aureus N315
aacaaaagaaaguu

SEQ ID NO: 4045381 - RNA, 15 nt, Staphylococcus aureus subsp. aureus N315
aacaaaagaaaguua

SEQ ID NO: 4045382 - RNA, 13 nt, Staphylococcus aureus subsp. aureus N315
aacaaaauuaaau

SEQ ID NO: 4045383 - RNA, 14 nt, Staphylococcus aureus subsp. aureus N315
aacaaaauuaaaua

SEQ ID NO: 4045384 - RNA, 22 nt, Staphylococcus aureus subsp. aureus N315
aacaaaauuaagaagaaauacu

SEQ ID NO: 4045385 - RNA, 13 nt, Staphylococcus aureus subsp. aureus N315
aacaaacauaaau

SEQ ID NO: 4045386 - RNA, 22 nt, Staphylococcus aureus subsp. aureus N315
aacaaacauuaaucuauauaaa

SEQ ID NO: 4045387 - RNA, 12 nt, Staphylococcus aureus subsp. aureus N315
aacaaagaagcu

SEQ ID NO: 4045388 - RNA, 19 nt, Staphylococcus aureus subsp. aureus N315
aacaaagucucuaguaucu

SEQ ID NO: 4045389 - RNA, 21 nt, Staphylococcus aureus subsp. aureus N315
aacaaagugcaauuauuucaa

SEQ ID NO: 4045390 - RNA, 22 nt, Staphylococcus aureus subsp. aureus N315
aacaaauauaauguauaaaaca

SEQ ID NO: 4045391 - RNA, 19 nt, Staphylococcus aureus subsp. aureus N315
aacaaauauuagaacauuu

SEQ ID NO: 4045392 - RNA, 22 nt, Staphylococcus aureus subsp. aureus N315
aacaaauauuagaacauuuauc

SEQ ID NO: 4045393 - RNA, 22 nt, Staphylococcus aureus subsp. aureus N315
aacaaauccauuaaaucaacaa

SEQ ID NO: 4045394 - RNA, 18 nt, Staphylococcus aureus subsp. aureus N315
aacaaaucuauaaauauc

SEQ ID NO: 4045395 - RNA, 17 nt, Staphylococcus aureus subsp. aureus N315
aacaaaucuuuuaaauu

SEQ ID NO: 4045396 - RNA, 19 nt, Staphylococcus aureus subsp. aureus N315
aacaaaugaaaaaguaaaa

SEQ ID NO: 4045397 - RNA, 12 nt, Staphylococcus aureus subsp. aureus N315
aacaaauuaaaa

SEQ ID NO: 4045398 - RNA, 17 nt, Staphylococcus aureus subsp. aureus N315
aacaaauucauauuaac

SEQ ID NO: 4045399 - RNA, 19 nt, Staphylococcus aureus subsp. aureus N315
aacaaauucauauuaacug

SEQ ID NO: 4045400 - RNA, 20 nt, Staphylococcus aureus subsp. aureus N315
aacaaauucauauuaacugu

SEQ ID NO: 4045401 - RNA, 15 nt, Staphylococcus aureus subsp. aureus N315
aacaacaaucaaauu

SEQ ID NO: 4045402 - RNA, 20 nt, Staphylococcus aureus subsp. aureus N315
aacaaccgucccauaaaaga

SEQ ID NO: 4045403 - RNA, 23 nt, Staphylococcus aureus subsp. aureus N315
aacaaccucugauacuucaccau

SEQ ID NO: 4045404 - RNA, 14 nt, Staphylococcus aureus subsp. aureus N315
aacaacuaaagguc

SEQ ID NO: 4045405 - RNA, 12 nt, Staphylococcus aureus subsp. aureus N315
aacaacuaagau

SEQ ID NO: 4045406 - RNA, 16 nt, Staphylococcus aureus subsp. aureus N315
aacaacuaagauauau

SEQ ID NO: 4045407 - RNA, 23 nt, Staphylococcus aureus subsp. aureus N315
aacaacuugggcaggugacuuuc

SEQ ID NO: 4045408 - RNA, 23 nt, Staphylococcus aureus subsp. aureus N315
aacaacuuuaauuuuucauuaau

SEQ ID NO: 4045409 - RNA, 15 nt, Staphylococcus aureus subsp. aureus N315
aacaacuuuguuuuc

SEQ ID NO: 4045410 - RNA, 23 nt, Staphylococcus aureus subsp. aureus N315
aacaacuuuguuuucaguaacug

SEQ ID NO: 4045411 - RNA, 17 nt, Staphylococcus aureus subsp. aureus N315
aacaagaaguuuccaac

SEQ ID NO: 4045412 - RNA, 18 nt, Staphylococcus aureus subsp. aureus N315
aacaagcauuuuucaauu

SEQ ID NO: 4045413 - RNA, 20 nt, Staphylococcus aureus subsp. aureus N315
aacaagcuuuucauuuuuau

SEQ ID NO: 4045414 - RNA, 17 nt, Staphylococcus aureus subsp. aureus N315
aacaagcuuuuuucaau

SEQ ID NO: 4045415 - RNA, 23 nt, Staphylococcus aureus subsp. aureus N315
aacaagguguucgggaauuuuuu

SEQ ID NO: 4045416 - RNA, 12 nt, Staphylococcus aureus subsp. aureus N315
aacaaguacaau

SEQ ID NO: 4045417 - RNA, 15 nt, Staphylococcus aureus subsp. aureus N315
aacaauaaaaaacca

SEQ ID NO: 4045418 - RNA, 13 nt, Staphylococcus aureus subsp. aureus N315
aacaauaauaugc

SEQ ID NO: 4045419 - RNA, 13 nt, Staphylococcus aureus subsp. aureus N315
aacaauaauugau

SEQ ID NO: 4045420 - RNA, 17 nt, Staphylococcus aureus subsp. aureus N315
aacaauacauaaugguu

SEQ ID NO: 4045421 - RNA, 19 nt, Staphylococcus aureus subsp. aureus N315
aacaauagguacaacuaaa

SEQ ID NO: 4045422 - RNA, 21 nt, Staphylococcus aureus subsp. aureus N315
aacaauagguacaacuaaaua

SEQ ID NO: 4045423 - RNA, 22 nt, Staphylococcus aureus subsp. aureus N315
aacaauagguacaacuaaauau

SEQ ID NO: 4045424 - RNA, 13 nt, Staphylococcus aureus subsp. aureus N315
aacaauauaauau

SEQ ID NO: 4045425 - RNA, 14 nt, Staphylococcus aureus subsp. aureus N315
aacaauauaauaua

SEQ ID NO: 4045426 - RNA, 20 nt, Staphylococcus aureus subsp. aureus N315
aacaauauucguaaauccuu

SEQ ID NO: 4045427 - RNA, 16 nt, Staphylococcus aureus subsp. aureus N315
aacaaucaaauuacaa

SEQ ID NO: 4045428 - RNA, 16 nt, Staphylococcus aureus subsp. aureus N315
aacaaucacaaauuca

SEQ ID NO: 4045429 - RNA, 15 nt, Staphylococcus aureus subsp. aureus N315
aacaaucagauaagu

SEQ ID NO: 4045430 - RNA, 24 nt, Staphylococcus aureus subsp. aureus N315
aacaaucggaagcauauuucuaaa

SEQ ID NO: 4045431 - RNA, 15 nt, Staphylococcus aureus subsp. aureus N315
aacaaucguuuuaau

SEQ ID NO: 4045432 - RNA, 18 nt, Staphylococcus aureus subsp. aureus N315
aacaaugaggauugugua

SEQ ID NO: 4045433 - RNA, 14 nt, Staphylococcus aureus subsp. aureus N315
aacaauucauuaau

SEQ ID NO: 4045434 - RNA, 16 nt, Staphylococcus aureus subsp. aureus N315
aacaauucuucaucau

SEQ ID NO: 4045435 - RNA, 17 nt, Staphylococcus aureus subsp. aureus N315
aacaauucuucaucaug

SEQ ID NO: 4045436 - RNA, 17 nt, Staphylococcus aureus subsp. aureus N315
aacaauugauugcucua

SEQ ID NO: 4045437 - RNA, 18 nt, Staphylococcus aureus subsp. aureus N315
aacaauuugcauaacauu

SEQ ID NO: 4045438 - RNA, 12 nt, Staphylococcus aureus subsp. aureus N315
aacaauuuuaaa

SEQ ID NO: 4045439 - RNA, 15 nt, Staphylococcus aureus subsp. aureus N315
aacaauuuuguacau

SEQ ID NO: 4045440 - RNA, 18 nt, Staphylococcus aureus subsp. aureus N315
aacacaaaaaugaagaau

SEQ ID NO: 4045441 - RNA, 12 nt, Staphylococcus aureus subsp. aureus N315
aacacaaagaau

SEQ ID NO: 4045442 - RNA, 16 nt, Staphylococcus aureus subsp. aureus N315
aacacaaauaaaggca

SEQ ID NO: 4045443 - RNA, 17 nt, Staphylococcus aureus subsp. aureus N315
aacacagacguuuuuga

SEQ ID NO: 4045444 - RNA, 23 nt, Staphylococcus aureus subsp. aureus N315
aacacagagaaauucgaaaagaa

SEQ ID NO: 4045445 - RNA, 18 nt, Staphylococcus aureus subsp. aureus N315
aacacagagaauuucgaa

SEQ ID NO: 4045446 - RNA, 18 nt, Staphylococcus aureus subsp. aureus N315
aacacauaaauuaagcau

SEQ ID NO: 4045447 - RNA, 11 nt, Staphylococcus aureus subsp. aureus N315
aacacaucuau

SEQ ID NO: 4045448 - RNA, 19 nt, Staphylococcus aureus subsp. aureus N315
aacacauucuuauuugaaa

SEQ ID NO: 4045449 - RNA, 16 nt, Staphylococcus aureus subsp. aureus N315
aacaccacacagcauu

SEQ ID NO: 4045450 - RNA, 22 nt, Staphylococcus aureus subsp. aureus N315
aacaccugguacauaaauaccu

SEQ ID NO: 4045451 - RNA, 14 nt, Staphylococcus aureus subsp. aureus N315
aacacgaacugcau

SEQ ID NO: 4045452 - RNA, 19 nt, Staphylococcus aureus subsp. aureus N315
aacacgaugagcgcauaaa

SEQ ID NO: 4045453 - RNA, 20 nt, Staphylococcus aureus subsp. aureus N315
aacacgauuugguugaacug

SEQ ID NO: 4045454 - RNA, 16 nt, Staphylococcus aureus subsp. aureus N315
aacacgcucuuuucaa

SEQ ID NO: 4045455 - RNA, 21 nt, Staphylococcus aureus subsp. aureus N315
aacacggucgccaacaguaau

SEQ ID NO: 4045456 - RNA, 18 nt, Staphylococcus aureus subsp. aureus N315
aacacugagaauuucuaa

SEQ ID NO: 4045457 - RNA, 19 nt, Staphylococcus aureus subsp. aureus N315
aacacugagaauuucuaau

SEQ ID NO: 4045458 - RNA, 13 nt, Staphylococcus aureus subsp. aureus N315
aacagcaaaaaau

SEQ ID NO: 4045459 - RNA, 14 nt, Staphylococcus aureus subsp. aureus N315
aacagcaaaaaaua

SEQ ID NO: 4045460 - RNA, 18 nt, Staphylococcus aureus subsp. aureus N315
aacagcaaaaaauaaauc

SEQ ID NO: 4045461 - RNA, 20 nt, Staphylococcus aureus subsp. aureus N315
aacagcacauuuuuaguuag

SEQ ID NO: 4045462 - RNA, 18 nt, Staphylococcus aureus subsp. aureus N315
aacagcaguaagauauuu

SEQ ID NO: 4045463 - RNA, 17 nt, Staphylococcus aureus subsp. aureus N315
aacagcauuuccuaugu

SEQ ID NO: 4045464 - RNA, 20 nt, Staphylococcus aureus subsp. aureus N315
aacagcggaauacagaugau

SEQ ID NO: 4045465 - RNA, 21 nt, Staphylococcus aureus subsp. aureus N315
aacagcggaauacagaugaug

SEQ ID NO: 4045466 - RNA, 18 nt, Staphylococcus aureus subsp. aureus N315
aacagcgugaauauaagu

SEQ ID NO: 4045467 - RNA, 13 nt, Staphylococcus aureus subsp. aureus N315
aacagcuacaaau

SEQ ID NO: 4045468 - RNA, 15 nt, Staphylococcus aureus subsp. aureus N315
aacagcuacaaauaa

SEQ ID NO: 4045469 - RNA, 15 nt, Staphylococcus aureus subsp. aureus N315
aacagcuucaaaauc

SEQ ID NO: 4045470 - RNA, 15 nt, Staphylococcus aureus subsp. aureus N315
aacagcuuuuucuac

SEQ ID NO: 4045471 - RNA, 15 nt, Staphylococcus aureus subsp. aureus N315
aacaguuaauuauac

SEQ ID NO: 4045472 - RNA, 12 nt, Staphylococcus aureus subsp. aureus N315
aacaguuuuaaa

SEQ ID NO: 4045473 - RNA, 13 nt, Staphylococcus aureus subsp. aureus N315
aacaguuuuaaag

SEQ ID NO: 4045474 - RNA, 19 nt, Staphylococcus aureus subsp. aureus N315
aacaguuuuauuaucuuug

SEQ ID NO: 4045475 - RNA, 24 nt, Staphylococcus aureus subsp. aureus N315
aacauaacaugaccuaauauauua

SEQ ID NO: 4045476 - RNA, 15 nt, Staphylococcus aureus subsp. aureus N315
aacauaacucaaaua

SEQ ID NO: 4045477 - RNA, 15 nt, Staphylococcus aureus subsp. aureus N315
aacauaauauuuuga

SEQ ID NO: 4045478 - RNA, 12 nt, Staphylococcus aureus subsp. aureus N315
aacauaaugaca

SEQ ID NO: 4045479 - RNA, 14 nt, Staphylococcus aureus subsp. aureus N315
aacauaauuuuuau

SEQ ID NO: 4045480 - RNA, 20 nt, Staphylococcus aureus subsp. aureus N315
aacauaccuaauaacgcaua

SEQ ID NO: 4045481 - RNA, 18 nt, Staphylococcus aureus subsp. aureus N315
aacauacguuauuuuuug

SEQ ID NO: 4045482 - RNA, 15 nt, Staphylococcus aureus subsp. aureus N315
aacauacuauaaaaa

SEQ ID NO: 4045483 - RNA, 18 nt, Staphylococcus aureus subsp. aureus N315
aacauagacacuuaacuu

SEQ ID NO: 4045484 - RNA, 18 nt, Staphylococcus aureus subsp. aureus N315
aacauagcuuaauaauua

SEQ ID NO: 4045485 - RNA, 18 nt, Staphylococcus aureus subsp. aureus N315
aacauauaaaaaauuauu

SEQ ID NO: 4045486 - RNA, 16 nt, Staphylococcus aureus subsp. aureus N315
aacauaucgucaauuu

SEQ ID NO: 4045487 - RNA, 20 nt, Staphylococcus aureus subsp. aureus N315
aacauaucgucaauuuuaau

SEQ ID NO: 4045488 - RNA, 16 nt, Staphylococcus aureus subsp. aureus N315
aacauauguacuauua

SEQ ID NO: 4045489 - RNA, 16 nt, Staphylococcus aureus subsp. aureus N315
aacauauuauaaaagu

SEQ ID NO: 4045490 - RNA, 13 nt, Staphylococcus aureus subsp. aureus N315
aacauauuauaua

SEQ ID NO: 4045491 - RNA, 16 nt, Staphylococcus aureus subsp. aureus N315
aacauauuauauauau

SEQ ID NO: 4045492 - RNA, 19 nt, Staphylococcus aureus subsp. aureus N315
aacauauuauauauauucc

SEQ ID NO: 4045493 - RNA, 23 nt, Staphylococcus aureus subsp. aureus N315
aacauauucaguauauguauaga

SEQ ID NO: 4045494 - RNA, 18 nt, Staphylococcus aureus subsp. aureus N315
aacauauucauaauaucg

SEQ ID NO: 4045495 - RNA, 12 nt, Staphylococcus aureus subsp. aureus N315
aacauauuuuaa

SEQ ID NO: 4045496 - RNA, 16 nt, Staphylococcus aureus subsp. aureus N315
aacaucacauaaaaua

SEQ ID NO: 4045497 - RNA, 14 nt, Staphylococcus aureus subsp. aureus N315
aacaucacuugcug

SEQ ID NO: 4045498 - RNA, 20 nt, Staphylococcus aureus subsp. aureus N315
aacaucgauuuaucauuauu

SEQ ID NO: 4045499 - RNA, 19 nt, Staphylococcus aureus subsp. aureus N315
aacaucuaaauaguuuuuc

SEQ ID NO: 4045500 - RNA, 17 nt, Staphylococcus aureus subsp. aureus N315
aacaucuauaacaaaau

SEQ ID NO: 4045501 - RNA, 14 nt, Staphylococcus aureus subsp. aureus N315
aacaucugaaaaaa

SEQ ID NO: 4045502 - RNA, 17 nt, Staphylococcus aureus subsp. aureus N315
aacaucugaaaaaauua

SEQ ID NO: 4045503 - RNA, 13 nt, Staphylococcus aureus subsp. aureus N315
aacaucuucaaca

SEQ ID NO: 4045504 - RNA, 20 nt, Staphylococcus aureus subsp. aureus N315
aacaugaaugauauugauuu

SEQ ID NO: 4045505 - RNA, 16 nt, Staphylococcus aureus subsp. aureus N315
aacaugauacugaaau

SEQ ID NO: 4045506 - RNA, 20 nt, Staphylococcus aureus subsp. aureus N315
aacaugauucaugauauguu

SEQ ID NO: 4045507 - RNA, 23 nt, Staphylococcus aureus subsp. aureus N315
aacauguacaauuuuuaaaaacc

SEQ ID NO: 4045508 - RNA, 15 nt, Staphylococcus aureus subsp. aureus N315
aacauguauuuagua

SEQ ID NO: 4045509 - RNA, 20 nt, Staphylococcus aureus subsp. aureus N315
aacauguuccgcuacaaaac

SEQ ID NO: 4045510 - RNA, 13 nt, Staphylococcus aureus subsp. aureus N315
aacauguucguua

SEQ ID NO: 4045511 - RNA, 15 nt, Staphylococcus aureus subsp. aureus N315
aacauguucguuaua

SEQ ID NO: 4045512 - RNA, 21 nt, Staphylococcus aureus subsp. aureus N315
aacauguugauaaaaaggauc

SEQ ID NO: 4045513 - RNA, 12 nt, Staphylococcus aureus subsp. aureus N315
aacauuaaaaau

SEQ ID NO: 4045514 - RNA, 18 nt, Staphylococcus aureus subsp. aureus N315
aacauuaaaauaauuaaa

SEQ ID NO: 4045515 - RNA, 20 nt, Staphylococcus aureus subsp. aureus N315
aacauuaaaauaauuaaaua

SEQ ID NO: 4045516 - RNA, 13 nt, Staphylococcus aureus subsp. aureus N315
aacauuaaaaugu

SEQ ID NO: 4045517 - RNA, 14 nt, Staphylococcus aureus subsp. aureus N315
aacauuaauaaaua

SEQ ID NO: 4045518 - RNA, 17 nt, Staphylococcus aureus subsp. aureus N315
aacauuacccuuuaaac

SEQ ID NO: 4045519 - RNA, 18 nt, Staphylococcus aureus subsp. aureus N315
aacauuacccuuuaaacu

SEQ ID NO: 4045520 - RNA, 20 nt, Staphylococcus aureus subsp. aureus N315
aacauuacuaauugaucagc

SEQ ID NO: 4045521 - RNA, 18 nt, Staphylococcus aureus subsp. aureus N315
aacauuaggauguucagc

SEQ ID NO: 4045522 - RNA, 14 nt, Staphylococcus aureus subsp. aureus N315
aacauuauuuuugu

SEQ ID NO: 4045523 - RNA, 19 nt, Staphylococcus aureus subsp. aureus N315
aacauucuucaaaaaauaa

SEQ ID NO: 4045524 - RNA, 20 nt, Staphylococcus aureus subsp. aureus N315
aacauucuucaaaaaauaau

SEQ ID NO: 4045525 - RNA, 20 nt, Staphylococcus aureus subsp. aureus N315
aacauugagauuaucuuuag

SEQ ID NO: 4045526 - RNA, 19 nt, Staphylococcus aureus subsp. aureus N315
aacauugauuauuguucca

SEQ ID NO: 4045527 - RNA, 16 nt, Staphylococcus aureus subsp. aureus N315
aacauuuaagaaacgu

SEQ ID NO: 4045528 - RNA, 19 nt, Staphylococcus aureus subsp. aureus N315
aacauuuaucgugaagaaa

SEQ ID NO: 4045529 - RNA, 19 nt, Staphylococcus aureus subsp. aureus N315
aacauuuauucuuucucua

SEQ ID NO: 4045530 - RNA, 13 nt, Staphylococcus aureus subsp. aureus N315
aacauuugucaua

SEQ ID NO: 4045531 - RNA, 22 nt, Staphylococcus aureus subsp. aureus N315
aacauuuguuggaagccuucaa

SEQ ID NO: 4045532 - RNA, 20 nt, Staphylococcus aureus subsp. aureus N315
aacauuuucuuauuugauuc

SEQ ID NO: 4045533 - RNA, 21 nt, Staphylococcus aureus subsp. aureus N315
aacauuuucuuauuugauucu

SEQ ID NO: 4045534 - RNA, 22 nt, Staphylococcus aureus subsp. aureus N315
aacauuuugauacguaaacacu

SEQ ID NO: 4045535 - RNA, 22 nt, Staphylococcus aureus subsp. aureus N315
aacauuuugccccucauucaca

SEQ ID NO: 4045536 - RNA, 11 nt, Staphylococcus aureus subsp. aureus N315
aacauuuuuag

SEQ ID NO: 4045537 - RNA, 20 nt, Staphylococcus aureus subsp. aureus N315
aaccaaaagaaauuuaauac

SEQ ID NO: 4045538 - RNA, 18 nt, Staphylococcus aureus subsp. aureus N315
aaccaaaccauaaguaaa

SEQ ID NO: 4045539 - RNA, 17 nt, Staphylococcus aureus subsp. aureus N315
aaccaauuauuaaagcu

SEQ ID NO: 4045540 - RNA, 16 nt, Staphylococcus aureus subsp. aureus N315
aaccaccaaaaaucau

SEQ ID NO: 4045541 - RNA, 22 nt, Staphylococcus aureus subsp. aureus N315
aaccaccaucccauuaaaccac

SEQ ID NO: 4045542 - RNA, 15 nt, Staphylococcus aureus subsp. aureus N315
aaccaccugauaaua

SEQ ID NO: 4045543 - RNA, 13 nt, Staphylococcus aureus subsp. aureus N315
aaccacgauaucu

SEQ ID NO: 4045544 - RNA, 17 nt, Staphylococcus aureus subsp. aureus N315
aaccacgucuuaaucgg

SEQ ID NO: 4045545 - RNA, 16 nt, Staphylococcus aureus subsp. aureus N315
aaccagcuaaaccauc

SEQ ID NO: 4045546 - RNA, 19 nt, Staphylococcus aureus subsp. aureus N315
aaccagcuaaaccaucugu

SEQ ID NO: 4045547 - RNA, 18 nt, Staphylococcus aureus subsp. aureus N315
aaccagcuaacaaaagug

SEQ ID NO: 4045548 - RNA, 16 nt, Staphylococcus aureus subsp. aureus N315
aaccagcuaaccaaau

SEQ ID NO: 4045549 - RNA, 18 nt, Staphylococcus aureus subsp. aureus N315
aaccagcuaaccaaauaa

SEQ ID NO: 4045550 - RNA, 22 nt, Staphylococcus aureus subsp. aureus N315
aaccagcuuacugcuuuuuuau

SEQ ID NO: 4045551 - RNA, 21 nt, Staphylococcus aureus subsp. aureus N315
aaccauacucuaacuuaccau

SEQ ID NO: 4045552 - RNA, 15 nt, Staphylococcus aureus subsp. aureus N315
aaccaucauaaaugu

SEQ ID NO: 4045553 - RNA, 12 nt, Staphylococcus aureus subsp. aureus N315
aaccaucugugu

SEQ ID NO: 4045554 - RNA, 23 nt, Staphylococcus aureus subsp. aureus N315
aaccaucugugucagcauucaua

SEQ ID NO: 4045555 - RNA, 13 nt, Staphylococcus aureus subsp. aureus N315
aaccauucguaau

SEQ ID NO: 4045556 - RNA, 19 nt, Staphylococcus aureus subsp. aureus N315
aaccauugaaugaauccca

SEQ ID NO: 4045557 - RNA, 21 nt, Staphylococcus aureus subsp. aureus N315
aaccauugaaugaaucccaua

SEQ ID NO: 4045558 - RNA, 14 nt, Staphylococcus aureus subsp. aureus N315
aaccauuuaaaaau

SEQ ID NO: 4045559 - RNA, 16 nt, Staphylococcus aureus subsp. aureus N315
aaccauuuaaaaauug

SEQ ID NO: 4045560 - RNA, 14 nt, Staphylococcus aureus subsp. aureus N315
aacccacauuaaau

SEQ ID NO: 4045561 - RNA, 22 nt, Staphylococcus aureus subsp. aureus N315
aacccuaauguguggauuuaau

SEQ ID NO: 4045562 - RNA, 15 nt, Staphylococcus aureus subsp. aureus N315
aaccgaagcgcagug

SEQ ID NO: 4045563 - RNA, 21 nt, Staphylococcus aureus subsp. aureus N315
aaccgaagcgcagugaccuca

SEQ ID NO: 4045564 - RNA, 21 nt, Staphylococcus aureus subsp. aureus N315
aaccgccaacuaauguuaaaa

SEQ ID NO: 4045565 - RNA, 22 nt, Staphylococcus aureus subsp. aureus N315
aaccgcuacaauuauaaaugau

SEQ ID NO: 4045566 - RNA, 17 nt, Staphylococcus aureus subsp. aureus N315
aaccgcuuaauucuuca

SEQ ID NO: 4045567 - RNA, 18 nt, Staphylococcus aureus subsp. aureus N315
aaccguaacuauaugaaa

SEQ ID NO: 4045568 - RNA, 14 nt, Staphylococcus aureus subsp. aureus N315
aaccuaaaaacaaa

SEQ ID NO: 4045569 - RNA, 17 nt, Staphylococcus aureus subsp. aureus N315
aaccuaaagauaauauu

SEQ ID NO: 4045570 - RNA, 13 nt, Staphylococcus aureus subsp. aureus N315
aaccuaaauucca

SEQ ID NO: 4045571 - RNA, 16 nt, Staphylococcus aureus subsp. aureus N315
aaccuaaugcuuuaau

SEQ ID NO: 4045572 - RNA, 23 nt, Staphylococcus aureus subsp. aureus N315
aaccuagggauaauuuuauugac

SEQ ID NO: 4045573 - RNA, 18 nt, Staphylococcus aureus subsp. aureus N315
aaccucuaaauaaaauua

SEQ ID NO: 4045574 - RNA, 22 nt, Staphylococcus aureus subsp. aureus N315
aaccugagccauaacugaauaa

SEQ ID NO: 4045575 - RNA, 24 nt, Staphylococcus aureus subsp. aureus N315
aaccuuccccuucauauuuugccu

SEQ ID NO: 4045576 - RNA, 20 nt, Staphylococcus aureus subsp. aureus N315
aaccuugauuuaauuuuuaa

SEQ ID NO: 4045577 - RNA, 11 nt, Staphylococcus aureus subsp. aureus N315
aaccuuuaaaa

SEQ ID NO: 4045578 - RNA, 13 nt, Staphylococcus aureus subsp. aureus N315
aaccuuuaaaagu

SEQ ID NO: 4045579 - RNA, 15 nt, Staphylococcus aureus subsp. aureus N315
aaccuuuaaaaguaa

SEQ ID NO: 4045580 - RNA, 21 nt, Staphylococcus aureus subsp. aureus N315
aaccuuugguuguuaggggcu

SEQ ID NO: 4045581 - RNA, 16 nt, Staphylococcus aureus subsp. aureus N315
aaccuuuucaaauuau

SEQ ID NO: 4045582 - RNA, 22 nt, Staphylococcus aureus subsp. aureus N315
aacgaaucgccuacuauaaaua

SEQ ID NO: 4045583 - RNA, 18 nt, Staphylococcus aureus subsp. aureus N315
aacgauaagaauuaacaa

SEQ ID NO: 4045584 - RNA, 18 nt, Staphylococcus aureus subsp. aureus N315
aacgauaccaaauauauu

SEQ ID NO: 4045585 - RNA, 23 nt, Staphylococcus aureus subsp. aureus N315
aacgauagauucugauacagaac

SEQ ID NO: 4045586 - RNA, 17 nt, Staphylococcus aureus subsp. aureus N315
aacgaucacuuggcuua

SEQ ID NO: 4045587 - RNA, 17 nt, Staphylococcus aureus subsp. aureus N315
aacgaugcuacuuaaag

SEQ ID NO: 4045588 - RNA, 18 nt, Staphylococcus aureus subsp. aureus N315
aacgcacuaucaaugaca

SEQ ID NO: 4045589 - RNA, 17 nt, Staphylococcus aureus subsp. aureus N315
aacgcauauucuauugu

SEQ ID NO: 4045590 - RNA, 13 nt, Staphylococcus aureus subsp. aureus N315
aacgcauuucaug

SEQ ID NO: 4045591 - RNA, 18 nt, Staphylococcus aureus subsp. aureus N315
aacgcucaacuauauaua

SEQ ID NO: 4045592 - RNA, 20 nt, Staphylococcus aureus subsp. aureus N315
aacgcuugaaaaauuuuacu

SEQ ID NO: 4045593 - RNA, 17 nt, Staphylococcus aureus subsp. aureus N315
aacgcuuuauuacuuua

SEQ ID NO: 4045594 - RNA, 22 nt, Staphylococcus aureus subsp. aureus N315
aacgcuuugcagauugauauaa

SEQ ID NO: 4045595 - RNA, 20 nt, Staphylococcus aureus subsp. aureus N315
aacgguacagauaagaauau

SEQ ID NO: 4045596 - RNA, 19 nt, Staphylococcus aureus subsp. aureus N315
aacguacaauguauuaccu

SEQ ID NO: 4045597 - RNA, 15 nt, Staphylococcus aureus subsp. aureus N315
aacguacauuuauga

SEQ ID NO: 4045598 - RNA, 21 nt, Staphylococcus aureus subsp. aureus N315
aacguacuguguaauaccaau

SEQ ID NO: 4045599 - RNA, 12 nt, Staphylococcus aureus subsp. aureus N315
aacgucacuuua

SEQ ID NO: 4045600 - RNA, 14 nt, Staphylococcus aureus subsp. aureus N315
aacgucauuuuuaa

SEQ ID NO: 4045601 - RNA, 13 nt, Staphylococcus aureus subsp. aureus N315
aacguccaaacac

SEQ ID NO: 4045602 - RNA, 18 nt, Staphylococcus aureus subsp. aureus N315
aacguuauucguuaacaa

SEQ ID NO: 4045603 - RNA, 14 nt, Staphylococcus aureus subsp. aureus N315
aacguucacuuggu

SEQ ID NO: 4045604 - RNA, 17 nt, Staphylococcus aureus subsp. aureus N315
aacguucauauaugaua

SEQ ID NO: 4045605 - RNA, 18 nt, Staphylococcus aureus subsp. aureus N315
aacguucauauaugauaa

SEQ ID NO: 4045606 - RNA, 23 nt, Staphylococcus aureus subsp. aureus N315
aacguugccauacccauauuaaa

SEQ ID NO: 4045607 - RNA, 15 nt, Staphylococcus aureus subsp. aureus N315
aacguuugaagaaug

SEQ ID NO: 4045608 - RNA, 12 nt, Staphylococcus aureus subsp. aureus N315
aacguuuucacu

SEQ ID NO: 4045609 - RNA, 13 nt, Staphylococcus aureus subsp. aureus N315
aacguuuucacuu

SEQ ID NO: 4045610 - RNA, 20 nt, Staphylococcus aureus subsp. aureus N315
aacuaaaacgauaauaauaa

SEQ ID NO: 4045611 - RNA, 11 nt, Staphylococcus aureus subsp. aureus N315
aacuaaaaugu

SEQ ID NO: 4045612 - RNA, 17 nt, Staphylococcus aureus subsp. aureus N315
aacuaaaaugucuuuga

SEQ ID NO: 4045613 - RNA, 14 nt, Staphylococcus aureus subsp. aureus N315
aacuaaauguagac

SEQ ID NO: 4045614 - RNA, 13 nt, Staphylococcus aureus subsp. aureus N315
aacuaaauuaaaa

SEQ ID NO: 4045615 - RNA, 16 nt, Staphylococcus aureus subsp. aureus N315
aacuaacuaauaacuc

SEQ ID NO: 4045616 - RNA, 12 nt, Staphylococcus aureus subsp. aureus N315
aacuaagauaua

SEQ ID NO: 4045617 - RNA, 18 nt, Staphylococcus aureus subsp. aureus N315
aacuaagugaauuaucua

SEQ ID NO: 4045618 - RNA, 15 nt, Staphylococcus aureus subsp. aureus N315
aacuaauaauuugua

SEQ ID NO: 4045619 - RNA, 17 nt, Staphylococcus aureus subsp. aureus N315
aacuaauagcauuugua

SEQ ID NO: 4045620 - RNA, 14 nt, Staphylococcus aureus subsp. aureus N315
aacuaaugucgcac

SEQ ID NO: 4045621 - RNA, 21 nt, Staphylococcus aureus subsp. aureus N315
aacuaauuuaaagcaucauau

SEQ ID NO: 4045622 - RNA, 22 nt, Staphylococcus aureus subsp. aureus N315
aacuaauuuaaagcaucauaua

SEQ ID NO: 4045623 - RNA, 13 nt, Staphylococcus aureus subsp. aureus N315
aacuacaauucau

SEQ ID NO: 4045624 - RNA, 18 nt, Staphylococcus aureus subsp. aureus N315
aacuacaauucauaagaa

SEQ ID NO: 4045625 - RNA, 23 nt, Staphylococcus aureus subsp. aureus N315
aacuacaauucauaagaaaaaug

SEQ ID NO: 4045626 - RNA, 20 nt, Staphylococcus aureus subsp. aureus N315
aacuacgauaccggcaacug

SEQ ID NO: 4045627 - RNA, 16 nt, Staphylococcus aureus subsp. aureus N315
aacuacgcauuuuaaa

SEQ ID NO: 4045628 - RNA, 15 nt, Staphylococcus aureus subsp. aureus N315
aacuacuauuaguau

SEQ ID NO: 4045629 - RNA, 18 nt, Staphylococcus aureus subsp. aureus N315
aacuacuuaaauuaagaa

SEQ ID NO: 4045630 - RNA, 13 nt, Staphylococcus aureus subsp. aureus N315
aacuacuucauca

SEQ ID NO: 4045631 - RNA, 17 nt, Staphylococcus aureus subsp. aureus N315
aacuagaaaacauaaau

SEQ ID NO: 4045632 - RNA, 14 nt, Staphylococcus aureus subsp. aureus N315
aacuauaacaauag

SEQ ID NO: 4045633 - RNA, 19 nt, Staphylococcus aureus subsp. aureus N315
aacuauaaccuauuaaauc

SEQ ID NO: 4045634 - RNA, 18 nt, Staphylococcus aureus subsp. aureus N315
aacuauaauaaagauuau

SEQ ID NO: 4045635 - RNA, 19 nt, Staphylococcus aureus subsp. aureus N315
aacuauaauaaagauuaua

SEQ ID NO: 4045636 - RNA, 17 nt, Staphylococcus aureus subsp. aureus N315
aacuauaauaauuggaa

SEQ ID NO: 4045637 - RNA, 14 nt, Staphylococcus aureus subsp. aureus N315
aacuauaaucauua

SEQ ID NO: 4045638 - RNA, 22 nt, Staphylococcus aureus subsp. aureus N315
aacuaucgauacuaaacgauaa

SEQ ID NO: 4045639 - RNA, 21 nt, Staphylococcus aureus subsp. aureus N315
aacuaucuacaccauuaucgc

SEQ ID NO: 4045640 - RNA, 16 nt, Staphylococcus aureus subsp. aureus N315
aacuaugaauagauga

SEQ ID NO: 4045641 - RNA, 18 nt, Staphylococcus aureus subsp. aureus N315
aacuauguuacuuauaua

SEQ ID NO: 4045642 - RNA, 22 nt, Staphylococcus aureus subsp. aureus N315
aacuauguuacuuauauauuca

SEQ ID NO: 4045643 - RNA, 23 nt, Staphylococcus aureus subsp. aureus N315
aacuauuaaaaccaaaagaaauu

SEQ ID NO: 4045644 - RNA, 19 nt, Staphylococcus aureus subsp. aureus N315
aacuauuaauggcaccaua

SEQ ID NO: 4045645 - RNA, 14 nt, Staphylococcus aureus subsp. aureus N315
aacuauugaaaaua

SEQ ID NO: 4045646 - RNA, 17 nt, Staphylococcus aureus subsp. aureus N315
aacucaaaaagccaaca

SEQ ID NO: 4045647 - RNA, 13 nt, Staphylococcus aureus subsp. aureus N315
aacucaacauuuu

SEQ ID NO: 4045648 - RNA, 15 nt, Staphylococcus aureus subsp. aureus N315
aacucaauaugauaa

SEQ ID NO: 4045649 - RNA, 16 nt, Staphylococcus aureus subsp. aureus N315
aacucauacaaauuuu

SEQ ID NO: 4045650 - RNA, 16 nt, Staphylococcus aureus subsp. aureus N315
aacucauaccaaaaac

SEQ ID NO: 4045651 - RNA, 17 nt, Staphylococcus aureus subsp. aureus N315
aacucauccauugaucu

SEQ ID NO: 4045652 - RNA, 21 nt, Staphylococcus aureus subsp. aureus N315
aacucaugcauaagaaauacu

SEQ ID NO: 4045653 - RNA, 15 nt, Staphylococcus aureus subsp. aureus N315
aacucauuuauaaac

SEQ ID NO: 4045654 - RNA, 21 nt, Staphylococcus aureus subsp. aureus N315
aacucguugcacucuuuucuc

SEQ ID NO: 4045655 - RNA, 18 nt, Staphylococcus aureus subsp. aureus N315
aacucuaaaaguuguaau

SEQ ID NO: 4045656 - RNA, 16 nt, Staphylococcus aureus subsp. aureus N315
aacucuaaauauaaua

SEQ ID NO: 4045657 - RNA, 24 nt, Staphylococcus aureus subsp. aureus N315
aacucuaaauauaauagaaauaau

SEQ ID NO: 4045658 - RNA, 14 nt, Staphylococcus aureus subsp. aureus N315
aacucugagcacuu

SEQ ID NO: 4045659 - RNA, 17 nt, Staphylococcus aureus subsp. aureus N315
aacucugauauugaucu

SEQ ID NO: 4045660 - RNA, 22 nt, Staphylococcus aureus subsp. aureus N315
aacucugauauugaucugauuu

SEQ ID NO: 4045661 - RNA, 20 nt, Staphylococcus aureus subsp. aureus N315
aacucuuggauugccccuaa

SEQ ID NO: 4045662 - RNA, 21 nt, Staphylococcus aureus subsp. aureus N315
aacucuuuuaacccacauuaa

SEQ ID NO: 4045663 - RNA, 13 nt, Staphylococcus aureus subsp. aureus N315
aacugaauuucgu

SEQ ID NO: 4045664 - RNA, 18 nt, Staphylococcus aureus subsp. aureus N315
aacugaccuaacaauuug

SEQ ID NO: 4045665 - RNA, 21 nt, Staphylococcus aureus subsp. aureus N315
aacugaguucaauuaaauuau

SEQ ID NO: 4045666 - RNA, 23 nt, Staphylococcus aureus subsp. aureus N315
aacugauaauacuguuuaaauaa

SEQ ID NO: 4045667 - RNA, 15 nt, Staphylococcus aureus subsp. aureus N315
aacugauaauugaug

SEQ ID NO: 4045668 - RNA, 17 nt, Staphylococcus aureus subsp. aureus N315
aacugaucauuuucauu

SEQ ID NO: 4045669 - RNA, 13 nt, Staphylococcus aureus subsp. aureus N315
aacugauuuuguu

SEQ ID NO: 4045670 - RNA, 17 nt, Staphylococcus aureus subsp. aureus N315
aacugauuuuguuucaa

SEQ ID NO: 4045671 - RNA, 18 nt, Staphylococcus aureus subsp. aureus N315
aacugcaaacuugauuca

SEQ ID NO: 4045672 - RNA, 14 nt, Staphylococcus aureus subsp. aureus N315
aacugcauaaaagc

SEQ ID NO: 4045673 - RNA, 15 nt, Staphylococcus aureus subsp. aureus N315
aacugcauauaaagu

SEQ ID NO: 4045674 - RNA, 20 nt, Staphylococcus aureus subsp. aureus N315
aacugcauguacaucuuuag

SEQ ID NO: 4045675 - RNA, 22 nt, Staphylococcus aureus subsp. aureus N315
aacugccaaaaugguuaaaauc

SEQ ID NO: 4045676 - RNA, 14 nt, Staphylococcus aureus subsp. aureus N315
aacugcuaauuuuu

SEQ ID NO: 4045677 - RNA, 18 nt, Staphylococcus aureus subsp. aureus N315
aacugcugcuaaaauaaa

SEQ ID NO: 4045678 - RNA, 19 nt, Staphylococcus aureus subsp. aureus N315
aacugcugcuaaaauaaaa

SEQ ID NO: 4045679 - RNA, 17 nt, Staphylococcus aureus subsp. aureus N315
aacugcuuuuuauuaug

SEQ ID NO: 4045680 - RNA, 18 nt, Staphylococcus aureus subsp. aureus N315
aacuggaacuuacaaguc

SEQ ID NO: 4045681 - RNA, 14 nt, Staphylococcus aureus subsp. aureus N315
aacugggauauaga

SEQ ID NO: 4045682 - RNA, 23 nt, Staphylococcus aureus subsp. aureus N315
aacuguaacgugaggcccauaaa

SEQ ID NO: 4045683 - RNA, 23 nt, Staphylococcus aureus subsp. aureus N315
aacuguaugccgccuaauaauaa

SEQ ID NO: 4045684 - RNA, 20 nt, Staphylococcus aureus subsp. aureus N315
aacugugauauuaauugaaa

SEQ ID NO: 4045685 - RNA, 17 nt, Staphylococcus aureus subsp. aureus N315
aacuguuaaacucauac

SEQ ID NO: 4045686 - RNA, 23 nt, Staphylococcus aureus subsp. aureus N315
aacuguucuuucgucuuguaaac

SEQ ID NO: 4045687 - RNA, 23 nt, Staphylococcus aureus subsp. aureus N315
aacuuaaaaaugaaaugaaguau

SEQ ID NO: 4045688 - RNA, 15 nt, Staphylococcus aureus subsp. aureus N315
aacuuaaaauuuaaa

SEQ ID NO: 4045689 - RNA, 17 nt, Staphylococcus aureus subsp. aureus N315
aacuuaaucaagcuagc

SEQ ID NO: 4045690 - RNA, 13 nt, Staphylococcus aureus subsp. aureus N315
aacuuacauuaca

SEQ ID NO: 4045691 - RNA, 15 nt, Staphylococcus aureus subsp. aureus N315
aacuuaccaugauga

SEQ ID NO: 4045692 - RNA, 22 nt, Staphylococcus aureus subsp. aureus N315
aacuuaccaugaugagauaaaa

SEQ ID NO: 4045693 - RNA, 20 nt, Staphylococcus aureus subsp. aureus N315
aacuuauaaaaugaaauauu

SEQ ID NO: 4045694 - RNA, 12 nt, Staphylococcus aureus subsp. aureus N315
aacuuauaauau

SEQ ID NO: 4045695 - RNA, 15 nt, Staphylococcus aureus subsp. aureus N315
aacuuauuauuuauc

SEQ ID NO: 4045696 - RNA, 18 nt, Staphylococcus aureus subsp. aureus N315
aacuucacgcaaaacaau

SEQ ID NO: 4045697 - RNA, 16 nt, Staphylococcus aureus subsp. aureus N315
aacuucauaauauauc

SEQ ID NO: 4045698 - RNA, 17 nt, Staphylococcus aureus subsp. aureus N315
aacuuccaacauauaaa

SEQ ID NO: 4045699 - RNA, 21 nt, Staphylococcus aureus subsp. aureus N315
aacuuccuaaaauuuacaaau

SEQ ID NO: 4045700 - RNA, 14 nt, Staphylococcus aureus subsp. aureus N315
aacuucuaacaccu

SEQ ID NO: 4045701 - RNA, 15 nt, Staphylococcus aureus subsp. aureus N315
aacuucuauuaagaa

SEQ ID NO: 4045702 - RNA, 18 nt, Staphylococcus aureus subsp. aureus N315
aacuucuauuaagaaaua

SEQ ID NO: 4045703 - RNA, 22 nt, Staphylococcus aureus subsp. aureus N315
aacuucugaaacgccucaacac

SEQ ID NO: 4045704 - RNA, 16 nt, Staphylococcus aureus subsp. aureus N315
aacuucugauucuuca

SEQ ID NO: 4045705 - RNA, 18 nt, Staphylococcus aureus subsp. aureus N315
aacuucugauucuucacu

SEQ ID NO: 4045706 - RNA, 17 nt, Staphylococcus aureus subsp. aureus N315
aacuugaucauuauaaa

SEQ ID NO: 4045707 - RNA, 20 nt, Staphylococcus aureus subsp. aureus N315
aacuugauuauguaauucua

SEQ ID NO: 4045708 - RNA, 16 nt, Staphylococcus aureus subsp. aureus N315
aacuugcgccugcuaa

SEQ ID NO: 4045709 - RNA, 16 nt, Staphylococcus aureus subsp. aureus N315
aacuuggcaaugaaau

SEQ ID NO: 4045710 - RNA, 17 nt, Staphylococcus aureus subsp. aureus N315
aacuuguauuguuugua

SEQ ID NO: 4045711 - RNA, 20 nt, Staphylococcus aureus subsp. aureus N315
aacuugugauauauaaccau

SEQ ID NO: 4045712 - RNA, 23 nt, Staphylococcus aureus subsp. aureus N315
aacuuguuguuauuuauuugauu

SEQ ID NO: 4045713 - RNA, 17 nt, Staphylococcus aureus subsp. aureus N315
aacuuuaagcugucaua

SEQ ID NO: 4045714 - RNA, 14 nt, Staphylococcus aureus subsp. aureus N315
aacuuuaauaccag

SEQ ID NO: 4045715 - RNA, 19 nt, Staphylococcus aureus subsp. aureus N315
aacuuuaauuuuucauuaa

SEQ ID NO: 4045716 - RNA, 17 nt, Staphylococcus aureus subsp. aureus N315
aacuuuaguauauucaa

SEQ ID NO: 4045717 - RNA, 19 nt, Staphylococcus aureus subsp. aureus N315
aacuuuaguauauucaaca

SEQ ID NO: 4045718 - RNA, 15 nt, Staphylococcus aureus subsp. aureus N315
aacuuuaguuguuag

SEQ ID NO: 4045719 - RNA, 20 nt, Staphylococcus aureus subsp. aureus N315
aacuuuaguuguuaggggcu

SEQ ID NO: 4045720 - RNA, 20 nt, Staphylococcus aureus subsp. aureus N315
aacuuucacucauauuacuu

SEQ ID NO: 4045721 - RNA, 23 nt, Staphylococcus aureus subsp. aureus N315
aacuuucagcaccagaacaauuc

SEQ ID NO: 4045722 - RNA, 17 nt, Staphylococcus aureus subsp. aureus N315
aacuuucguauuuuucu

SEQ ID NO: 4045723 - RNA, 19 nt, Staphylococcus aureus subsp. aureus N315
aacuuugucuguauuauua

SEQ ID NO: 4045724 - RNA, 23 nt, Staphylococcus aureus subsp. aureus N315
aacuuugucuguauuauuauaau

SEQ ID NO: 4045725 - RNA, 13 nt, Staphylococcus aureus subsp. aureus N315
aacuuuuacuuuc

SEQ ID NO: 4045726 - RNA, 16 nt, Staphylococcus aureus subsp. aureus N315
aacuuuuauugccaua

SEQ ID NO: 4045727 - RNA, 20 nt, Staphylococcus aureus subsp. aureus N315
aacuuuuauugccauaaagu

SEQ ID NO: 4045728 - RNA, 13 nt, Staphylococcus aureus subsp. aureus N315
aacuuuucaaaca

SEQ ID NO: 4045729 - RNA, 21 nt, Staphylococcus aureus subsp. aureus N315
aacuuuucaaacaauacaguu

SEQ ID NO: 4045730 - RNA, 15 nt, Staphylococcus aureus subsp. aureus N315
aacuuuucaaagcca

SEQ ID NO: 4045731 - RNA, 17 nt, Staphylococcus aureus subsp. aureus N315
aacuuuucaaagccaca

SEQ ID NO: 4045732 - RNA, 22 nt, Staphylococcus aureus subsp. aureus N315
aacuuuucagcaguugcacaaa

SEQ ID NO: 4045733 - RNA, 16 nt, Staphylococcus aureus subsp. aureus N315
aacuuuuccuuguugg

SEQ ID NO: 4045734 - RNA, 19 nt, Staphylococcus aureus subsp. aureus N315
aacuuuuuaacugccauau

SEQ ID NO: 4045735 - RNA, 22 nt, Staphylococcus aureus subsp. aureus N315
aacuuuuuaauaauuguaucgu

SEQ ID NO: 4045736 - RNA, 13 nt, Staphylococcus aureus subsp. aureus N315
aacuuuuuuaaca

SEQ ID NO: 4045737 - RNA, 15 nt, Staphylococcus aureus subsp. aureus N315
aacuuuuuuaacuuu

SEQ ID NO: 4045738 - RNA, 14 nt, Staphylococcus aureus subsp. aureus N315
aagaaaaaaugaua

SEQ ID NO: 4045739 - RNA, 21 nt, Staphylococcus aureus subsp. aureus N315
aagaaaaagugauaauuaaaa

SEQ ID NO: 4045740 - RNA, 22 nt, Staphylococcus aureus subsp. aureus N315
aagaaaaagugauaauuaaaau

SEQ ID NO: 4045741 - RNA, 21 nt, Staphylococcus aureus subsp. aureus N315
aagaaaaauguguuaaaauau

SEQ ID NO: 4045742 - RNA, 21 nt, Staphylococcus aureus subsp. aureus N315
aagaaaaauuuucuugguuug

SEQ ID NO: 4045743 - RNA, 18 nt, Staphylococcus aureus subsp. aureus N315
aagaaaaguauaaauaua

SEQ ID NO: 4045744 - RNA, 13 nt, Staphylococcus aureus subsp. aureus N315
aagaaaauacuaa

SEQ ID NO: 4045745 - RNA, 19 nt, Staphylococcus aureus subsp. aureus N315
aagaaaccuuuuuucucuu

SEQ ID NO: 4045746 - RNA, 17 nt, Staphylococcus aureus subsp. aureus N315
aagaaauaauuuaaagg

SEQ ID NO: 4045747 - RNA, 21 nt, Staphylococcus aureus subsp. aureus N315
aagaaauacuaauuucuauag

SEQ ID NO: 4045748 - RNA, 20 nt, Staphylococcus aureus subsp. aureus N315
aagaaauacuugaauuuaau

SEQ ID NO: 4045749 - RNA, 16 nt, Staphylococcus aureus subsp. aureus N315
aagaaauauauugucg

SEQ ID NO: 4045750 - RNA, 14 nt, Staphylococcus aureus subsp. aureus N315
aagaaaucaacaac

SEQ ID NO: 4045751 - RNA, 15 nt, Staphylococcus aureus subsp. aureus N315
aagaaauguuaaauu

SEQ ID NO: 4045752 - RNA, 18 nt, Staphylococcus aureus subsp. aureus N315
aagaaauguuaaauuaaa

SEQ ID NO: 4045753 - RNA, 13 nt, Staphylococcus aureus subsp. aureus N315
aagaaauuaaagu

SEQ ID NO: 4045754 - RNA, 17 nt, Staphylococcus aureus subsp. aureus N315
aagaaauucgcaagccu

SEQ ID NO: 4045755 - RNA, 13 nt, Staphylococcus aureus subsp. aureus N315
aagaaauucuaca

SEQ ID NO: 4045756 - RNA, 22 nt, Staphylococcus aureus subsp. aureus N315
aagaaauucuacaggcaaugca

SEQ ID NO: 4045757 - RNA, 13 nt, Staphylococcus aureus subsp. aureus N315
aagaaauuguguu

SEQ ID NO: 4045758 - RNA, 14 nt, Staphylococcus aureus subsp. aureus N315
aagaaauuuuuucu

SEQ ID NO: 4045759 - RNA, 22 nt, Staphylococcus aureus subsp. aureus N315
aagaacaguauguggauacaaa

SEQ ID NO: 4045760 - RNA, 16 nt, Staphylococcus aureus subsp. aureus N315
aagaacuuagaaaugc

SEQ ID NO: 4045761 - RNA, 22 nt, Staphylococcus aureus subsp. aureus N315
aagaagauuaugaaaacauuau

SEQ ID NO: 4045762 - RNA, 21 nt, Staphylococcus aureus subsp. aureus N315
aagaaggaugaguuuaaaaau

SEQ ID NO: 4045763 - RNA, 18 nt, Staphylococcus aureus subsp. aureus N315
aagaaguauguuuuauac

SEQ ID NO: 4045764 - RNA, 13 nt, Staphylococcus aureus subsp. aureus N315
aagaauaaauguu

SEQ ID NO: 4045765 - RNA, 13 nt, Staphylococcus aureus subsp. aureus N315
aagaauaacuauu

SEQ ID NO: 4045766 - RNA, 17 nt, Staphylococcus aureus subsp. aureus N315
aagaauacaaauauuaa

SEQ ID NO: 4045767 - RNA, 15 nt, Staphylococcus aureus subsp. aureus N315
aagaauauaacgaau

SEQ ID NO: 4045768 - RNA, 16 nt, Staphylococcus aureus subsp. aureus N315
aagaauauaagugauu

SEQ ID NO: 4045769 - RNA, 15 nt, Staphylococcus aureus subsp. aureus N315
aagaauaugauauug

SEQ ID NO: 4045770 - RNA, 14 nt, Staphylococcus aureus subsp. aureus N315
aagaauauuuaagu

SEQ ID NO: 4045771 - RNA, 22 nt, Staphylococcus aureus subsp. aureus N315
aagaaucagcuaaauauuuuac

SEQ ID NO: 4045772 - RNA, 16 nt, Staphylococcus aureus subsp. aureus N315
aagaaugauuuauaaa

SEQ ID NO: 4045773 - RNA, 17 nt, Staphylococcus aureus subsp. aureus N315
aagaaugcgaagauuuu

SEQ ID NO: 4045774 - RNA, 18 nt, Staphylococcus aureus subsp. aureus N315
aagaauguuucauaugca

SEQ ID NO: 4045775 - RNA, 13 nt, Staphylococcus aureus subsp. aureus N315
aagaauuauucaa

SEQ ID NO: 4045776 - RNA, 16 nt, Staphylococcus aureus subsp. aureus N315
aagaauuauucaagua

SEQ ID NO: 4045777 - RNA, 17 nt, Staphylococcus aureus subsp. aureus N315
aagaauuguugaucaug

SEQ ID NO: 4045778 - RNA, 16 nt, Staphylococcus aureus subsp. aureus N315
aagaauuuaaaagaga

SEQ ID NO: 4045779 - RNA, 17 nt, Staphylococcus aureus subsp. aureus N315
aagaauuucgaaaagaa

SEQ ID NO: 4045780 - RNA, 19 nt, Staphylococcus aureus subsp. aureus N315
aagaauuucgaaaagaaau

SEQ ID NO: 4045781 - RNA, 19 nt, Staphylococcus aureus subsp. aureus N315
aagacauacagucaauaca

SEQ ID NO: 4045782 - RNA, 21 nt, Staphylococcus aureus subsp. aureus N315
aagacauacucacaaaaaaca

SEQ ID NO: 4045783 - RNA, 16 nt, Staphylococcus aureus subsp. aureus N315
aagaccaaauauuuua

SEQ ID NO: 4045784 - RNA, 22 nt, Staphylococcus aureus subsp. aureus N315
aagaccaaauauuuuaucugua

SEQ ID NO: 4045785 - RNA, 13 nt, Staphylococcus aureus subsp. aureus N315
aagaccauuuuau

SEQ ID NO: 4045786 - RNA, 14 nt, Staphylococcus aureus subsp. aureus N315
aagaccauuuuaua

SEQ ID NO: 4045787 - RNA, 16 nt, Staphylococcus aureus subsp. aureus N315
aagaccccgaaaagag

SEQ ID NO: 4045788 - RNA, 21 nt, Staphylococcus aureus subsp. aureus N315
aagaccguauccuguguaaaa

SEQ ID NO: 4045789 - RNA, 16 nt, Staphylococcus aureus subsp. aureus N315
aagacucaauuucauu

SEQ ID NO: 4045790 - RNA, 22 nt, Staphylococcus aureus subsp. aureus N315
aagacucccuuuuuaaaauacg

SEQ ID NO: 4045791 - RNA, 12 nt, Staphylococcus aureus subsp. aureus N315
aagacuucccua

SEQ ID NO: 4045792 - RNA, 21 nt, Staphylococcus aureus subsp. aureus N315
aagacuucccuauauguaggg

SEQ ID NO: 4045793 - RNA, 18 nt, Staphylococcus aureus subsp. aureus N315
aagagaacuuuucaaaca

SEQ ID NO: 4045794 - RNA, 14 nt, Staphylococcus aureus subsp. aureus N315
aagagaauuuuaau

SEQ ID NO: 4045795 - RNA, 22 nt, Staphylococcus aureus subsp. aureus N315
aagagauuuucuucauugaaaa

SEQ ID NO: 4045796 - RNA, 20 nt, Staphylococcus aureus subsp. aureus N315
aagagcaagugucaaauacg

SEQ ID NO: 4045797 - RNA, 14 nt, Staphylococcus aureus subsp. aureus N315
aagagcaauuaaag

SEQ ID NO: 4045798 - RNA, 21 nt, Staphylococcus aureus subsp. aureus N315
aagagcaauuaaagucaauuu

SEQ ID NO: 4045799 - RNA, 21 nt, Staphylococcus aureus subsp. aureus N315
aagaggcgccacaacauguuu

SEQ ID NO: 4045800 - RNA, 19 nt, Staphylococcus aureus subsp. aureus N315
aagagguauacaguuaugc

SEQ ID NO: 4045801 - RNA, 15 nt, Staphylococcus aureus subsp. aureus N315
aagauaaacaagcca

SEQ ID NO: 4045802 - RNA, 20 nt, Staphylococcus aureus subsp. aureus N315
aagauaaacaagccaagaua

SEQ ID NO: 4045803 - RNA, 13 nt, Staphylococcus aureus subsp. aureus N315
aagauaaauaaaa

SEQ ID NO: 4045804 - RNA, 22 nt, Staphylococcus aureus subsp. aureus N315
aagauaagaugguuugaguaaa

SEQ ID NO: 4045805 - RNA, 15 nt, Staphylococcus aureus subsp. aureus N315
aagauaauuuucaau

SEQ ID NO: 4045806 - RNA, 21 nt, Staphylococcus aureus subsp. aureus N315
aagauacaggcugauuuuuua

SEQ ID NO: 4045807 - RNA, 22 nt, Staphylococcus aureus subsp. aureus N315
aagauagagcccuuagcaauau

SEQ ID NO: 4045808 - RNA, 20 nt, Staphylococcus aureus subsp. aureus N315
aagauaggauuugcaccuau

SEQ ID NO: 4045809 - RNA, 20 nt, Staphylococcus aureus subsp. aureus N315
aagauagguuuauuucugac

SEQ ID NO: 4045810 - RNA, 15 nt, Staphylococcus aureus subsp. aureus N315
aagauauaaggaaaa

SEQ ID NO: 4045811 - RNA, 20 nt, Staphylococcus aureus subsp. aureus N315
aagauauauaacuaugguca

SEQ ID NO: 4045812 - RNA, 13 nt, Staphylococcus aureus subsp. aureus N315
aagauauccauua

SEQ ID NO: 4045813 - RNA, 14 nt, Staphylococcus aureus subsp. aureus N315
aagauauuuccaaa

SEQ ID NO: 4045814 - RNA, 21 nt, Staphylococcus aureus subsp. aureus N315
aagaucacacgacauguaggu

SEQ ID NO: 4045815 - RNA, 20 nt, Staphylococcus aureus subsp. aureus N315
aagaucauuuucaacauaau

SEQ ID NO: 4045816 - RNA, 16 nt, Staphylococcus aureus subsp. aureus N315
aagaucgauacuuuuu

SEQ ID NO: 4045817 - RNA, 19 nt, Staphylococcus aureus subsp. aureus N315
aagaugauuauucucuuua

SEQ ID NO: 4045818 - RNA, 18 nt, Staphylococcus aureus subsp. aureus N315
aagaugccucaguuagaa

SEQ ID NO: 4045819 - RNA, 15 nt, Staphylococcus aureus subsp. aureus N315
aagaugcucauugca

SEQ ID NO: 4045820 - RNA, 15 nt, Staphylococcus aureus subsp. aureus N315
aagaugcuuuaauua

SEQ ID NO: 4045821 - RNA, 18 nt, Staphylococcus aureus subsp. aureus N315
aagaugcuuuaauuaaag

SEQ ID NO: 4045822 - RNA, 20 nt, Staphylococcus aureus subsp. aureus N315
aagaugcuuuaauuaaaguu

SEQ ID NO: 4045823 - RNA, 21 nt, Staphylococcus aureus subsp. aureus N315
aagaugcuuuaauuaaaguua

SEQ ID NO: 4045824 - RNA, 22 nt, Staphylococcus aureus subsp. aureus N315
aagaugguuugaguaaauuaau

SEQ ID NO: 4045825 - RNA, 18 nt, Staphylococcus aureus subsp. aureus N315
aagaugguuuuguuuugc

SEQ ID NO: 4045826 - RNA, 21 nt, Staphylococcus aureus subsp. aureus N315
aagauguauaugaauuuuaua

SEQ ID NO: 4045827 - RNA, 16 nt, Staphylococcus aureus subsp. aureus N315
aagauguguugaaacu

SEQ ID NO: 4045828 - RNA, 21 nt, Staphylococcus aureus subsp. aureus N315
aagauguuugcaacauauuuu

SEQ ID NO: 4045829 - RNA, 17 nt, Staphylococcus aureus subsp. aureus N315
aagauuagaugauauuu

SEQ ID NO: 4045830 - RNA, 19 nt, Staphylococcus aureus subsp. aureus N315
aagauuagcuaugaagaaa

SEQ ID NO: 4045831 - RNA, 14 nt, Staphylococcus aureus subsp. aureus N315
aagauuauuauuac

SEQ ID NO: 4045832 - RNA, 19 nt, Staphylococcus aureus subsp. aureus N315
aagauuauuugcgauauca

SEQ ID NO: 4045833 - RNA, 15 nt, Staphylococcus aureus subsp. aureus N315
aagauucaacuuguu

SEQ ID NO: 4045834 - RNA, 12 nt, Staphylococcus aureus subsp. aureus N315
aagauuuaaguc

SEQ ID NO: 4045835 - RNA, 17 nt, Staphylococcus aureus subsp. aureus N315
aagauuuaauaaagugu

SEQ ID NO: 4045836 - RNA, 13 nt, Staphylococcus aureus subsp. aureus N315
aagauuuguaaca

SEQ ID NO: 4045837 - RNA, 20 nt, Staphylococcus aureus subsp. aureus N315
aagauuuguagcuugaauaa

SEQ ID NO: 4045838 - RNA, 23 nt, Staphylococcus aureus subsp. aureus N315
aagauuuguagcuugaauaauau

SEQ ID NO: 4045839 - RNA, 14 nt, Staphylococcus aureus subsp. aureus N315
aagcaaaagaugaa

SEQ ID NO: 4045840 - RNA, 20 nt, Staphylococcus aureus subsp. aureus N315
aagcaaauuaguaugacuua

SEQ ID NO: 4045841 - RNA, 17 nt, Staphylococcus aureus subsp. aureus N315
aagcaacauaugauuug

SEQ ID NO: 4045842 - RNA, 18 nt, Staphylococcus aureus subsp. aureus N315
aagcaaucuuaguacaaa

SEQ ID NO: 4045843 - RNA, 23 nt, Staphylococcus aureus subsp. aureus N315
aagcacgugguugguuaccaucu

SEQ ID NO: 4045844 - RNA, 16 nt, Staphylococcus aureus subsp. aureus N315
aagcaguuguugguuu

SEQ ID NO: 4045845 - RNA, 15 nt, Staphylococcus aureus subsp. aureus N315
aagcauaccuacaga

SEQ ID NO: 4045846 - RNA, 17 nt, Staphylococcus aureus subsp. aureus N315
aagcauaccuacagaau

SEQ ID NO: 4045847 - RNA, 14 nt, Staphylococcus aureus subsp. aureus N315
aagcauauuucuaa

SEQ ID NO: 4045848 - RNA, 14 nt, Staphylococcus aureus subsp. aureus N315
aagcaucauauaca

SEQ ID NO: 4045849 - RNA, 17 nt, Staphylococcus aureus subsp. aureus N315
aagcaucauauacauac

SEQ ID NO: 4045850 - RNA, 17 nt, Staphylococcus aureus subsp. aureus N315
aagcaucguaaaaaaca

SEQ ID NO: 4045851 - RNA, 19 nt, Staphylococcus aureus subsp. aureus N315
aagcaucguaaaaaacaaa

SEQ ID NO: 4045852 - RNA, 18 nt, Staphylococcus aureus subsp. aureus N315
aagcaucuccaauuuaau

SEQ ID NO: 4045853 - RNA, 22 nt, Staphylococcus aureus subsp. aureus N315
aagcaugacacucauucaauuu

SEQ ID NO: 4045854 - RNA, 20 nt, Staphylococcus aureus subsp. aureus N315
aagcaugauacucaauaaaa

SEQ ID NO: 4045855 - RNA, 14 nt, Staphylococcus aureus subsp. aureus N315
aagccaagauaaau

SEQ ID NO: 4045856 - RNA, 14 nt, Staphylococcus aureus subsp. aureus N315
aagccaucuuucuu

SEQ ID NO: 4045857 - RNA, 16 nt, Staphylococcus aureus subsp. aureus N315
aagccaugauuuagau

SEQ ID NO: 4045858 - RNA, 16 nt, Staphylococcus aureus subsp. aureus N315
aagccuucaauaguuu

SEQ ID NO: 4045859 - RNA, 17 nt, Staphylococcus aureus subsp. aureus N315
aagccuucaauaguuuc

SEQ ID NO: 4045860 - RNA, 20 nt, Staphylococcus aureus subsp. aureus N315
aagcgacgauuggaaaguuu

SEQ ID NO: 4045861 - RNA, 19 nt, Staphylococcus aureus subsp. aureus N315
aagcgauaaaguaugagug

SEQ ID NO: 4045862 - RNA, 20 nt, Staphylococcus aureus subsp. aureus N315
aagcgauuuccaucauuugu

SEQ ID NO: 4045863 - RNA, 18 nt, Staphylococcus aureus subsp. aureus N315
aagcgcaggcgaaccgaa

SEQ ID NO: 4045864 - RNA, 12 nt, Staphylococcus aureus subsp. aureus N315
aagcgcagugac

SEQ ID NO: 4045865 - RNA, 15 nt, Staphylococcus aureus subsp. aureus N315
aagcgcagugaccuc

SEQ ID NO: 4045866 - RNA, 19 nt, Staphylococcus aureus subsp. aureus N315
aagcgccugucucauuagc

SEQ ID NO: 4045867 - RNA, 16 nt, Staphylococcus aureus subsp. aureus N315
aagcguaugauguugu

SEQ ID NO: 4045868 - RNA, 23 nt, Staphylococcus aureus subsp. aureus N315
aagcgucuuuuuuguaugaguuc

SEQ ID NO: 4045869 - RNA, 20 nt, Staphylococcus aureus subsp. aureus N315
aagcuaaauguuaaugcuuc

SEQ ID NO: 4045870 - RNA, 19 nt, Staphylococcus aureus subsp. aureus N315
aagcuauaaaaaaucuuuu

SEQ ID NO: 4045871 - RNA, 21 nt, Staphylococcus aureus subsp. aureus N315
aagcuauaaaaaaucuuuuga

SEQ ID NO: 4045872 - RNA, 17 nt, Staphylococcus aureus subsp. aureus N315
aagcuaucguaaacaac

SEQ ID NO: 4045873 - RNA, 17 nt, Staphylococcus aureus subsp. aureus N315
aagcuaucuucagauuc

SEQ ID NO: 4045874 - RNA, 18 nt, Staphylococcus aureus subsp. aureus N315
aagcucaauaaauuauga

SEQ ID NO: 4045875 - RNA, 15 nt, Staphylococcus aureus subsp. aureus N315
aagcucaugaaucag

SEQ ID NO: 4045876 - RNA, 20 nt, Staphylococcus aureus subsp. aureus N315
aagcucauuucaauauuaaa

SEQ ID NO: 4045877 - RNA, 13 nt, Staphylococcus aureus subsp. aureus N315
aagcucccauuaa

SEQ ID NO: 4045878 - RNA, 17 nt, Staphylococcus aureus subsp. aureus N315
aagcugacuuuccacca

SEQ ID NO: 4045879 - RNA, 15 nt, Staphylococcus aureus subsp. aureus N315
aagcugagcuuuaau

SEQ ID NO: 4045880 - RNA, 17 nt, Staphylococcus aureus subsp. aureus N315
aagcugaugugacaaag

SEQ ID NO: 4045881 - RNA, 14 nt, Staphylococcus aureus subsp. aureus N315
aagcugauuaaaau

SEQ ID NO: 4045882 - RNA, 22 nt, Staphylococcus aureus subsp. aureus N315
aagcugauuucuaucaaauaau

SEQ ID NO: 4045883 - RNA, 17 nt, Staphylococcus aureus subsp. aureus N315
aagcugcaauuaugcca

SEQ ID NO: 4045884 - RNA, 20 nt, Staphylococcus aureus subsp. aureus N315
aagcugcgauauaacuaaaa

SEQ ID NO: 4045885 - RNA, 14 nt, Staphylococcus aureus subsp. aureus N315
aagcugucauaccu

SEQ ID NO: 4045886 - RNA, 23 nt, Staphylococcus aureus subsp. aureus N315
aagcugucuuacugcuguuuuua

SEQ ID NO: 4045887 - RNA, 15 nt, Staphylococcus aureus subsp. aureus N315
aagcuuuaguuaaau

SEQ ID NO: 4045888 - RNA, 23 nt, Staphylococcus aureus subsp. aureus N315
aagcuuuuacgccuucuuuauaa

SEQ ID NO: 4045889 - RNA, 16 nt, Staphylococcus aureus subsp. aureus N315
aagcuuuuucuuucuc

SEQ ID NO: 4045890 - RNA, 20 nt, Staphylococcus aureus subsp. aureus N315
aagcuuuuucuuucucuaac

SEQ ID NO: 4045891 - RNA, 22 nt, Staphylococcus aureus subsp. aureus N315
aaggaacguguucuaaaaguug

SEQ ID NO: 4045892 - RNA, 11 nt, Staphylococcus aureus subsp. aureus N315
aaggaagaaca

SEQ ID NO: 4045893 - RNA, 21 nt, Staphylococcus aureus subsp. aureus N315
aaggaagucaccauauuuaac

SEQ ID NO: 4045894 - RNA, 22 nt, Staphylococcus aureus subsp. aureus N315
aaggaaucguaaagcuguuggu

SEQ ID NO: 4045895 - RNA, 22 nt, Staphylococcus aureus subsp. aureus N315
aaggaauguauucuaagaguug

SEQ ID NO: 4045896 - RNA, 19 nt, Staphylococcus aureus subsp. aureus N315
aaggaucauguuccccauu

SEQ ID NO: 4045897 - RNA, 15 nt, Staphylococcus aureus subsp. aureus N315
aaggaugaguuuaaa

SEQ ID NO: 4045898 - RNA, 22 nt, Staphylococcus aureus subsp. aureus N315
aaggauguacuauaaauccuaa

SEQ ID NO: 4045899 - RNA, 16 nt, Staphylococcus aureus subsp. aureus N315
aaggauguuauaaaau

SEQ ID NO: 4045900 - RNA, 14 nt, Staphylococcus aureus subsp. aureus N315
aaggauugaaaaaa

SEQ ID NO: 4045901 - RNA, 16 nt, Staphylococcus aureus subsp. aureus N315
aaggccauuuguagac

SEQ ID NO: 4045902 - RNA, 14 nt, Staphylococcus aureus subsp. aureus N315
aaggccugcaucac

SEQ ID NO: 4045903 - RNA, 16 nt, Staphylococcus aureus subsp. aureus N315
aaggcgaaacauuaaa

SEQ ID NO: 4045904 - RNA, 16 nt, Staphylococcus aureus subsp. aureus N315
aaggcgcucucuuuuu

SEQ ID NO: 4045905 - RNA, 18 nt, Staphylococcus aureus subsp. aureus N315
aaggcgcucucuuuuuag

SEQ ID NO: 4045906 - RNA, 21 nt, Staphylococcus aureus subsp. aureus N315
aaggcuagcuaaaauuugcuc

SEQ ID NO: 4045907 - RNA, 16 nt, Staphylococcus aureus subsp. aureus N315
aagggagcauuucacu

SEQ ID NO: 4045908 - RNA, 15 nt, Staphylococcus aureus subsp. aureus N315
aagggagguauauac

SEQ ID NO: 4045909 - RNA, 20 nt, Staphylococcus aureus subsp. aureus N315
aagggaucggucuugaaaac

SEQ ID NO: 4045910 - RNA, 21 nt, Staphylococcus aureus subsp. aureus N315
aagggaucggucuugaaaacc

SEQ ID NO: 4045911 - RNA, 20 nt, Staphylococcus aureus subsp. aureus N315
aagggaucguucuuugauua

SEQ ID NO: 4045912 - RNA, 13 nt, Staphylococcus aureus subsp. aureus N315
aagguacauaaau

SEQ ID NO: 4045913 - RNA, 17 nt, Staphylococcus aureus subsp. aureus N315
aagguacuuauuucaaa

SEQ ID NO: 4045914 - RNA, 15 nt, Staphylococcus aureus subsp. aureus N315
aagguauucuauuuu

SEQ ID NO: 4045915 - RNA, 16 nt, Staphylococcus aureus subsp. aureus N315
aaggucaaaaaauuaa

SEQ ID NO: 4045916 - RNA, 18 nt, Staphylococcus aureus subsp. aureus N315
aaggucaccuuuaaauuu

SEQ ID NO: 4045917 - RNA, 20 nt, Staphylococcus aureus subsp. aureus N315
aaggucaccuuuaaauuuac

SEQ ID NO: 4045918 - RNA, 15 nt, Staphylococcus aureus subsp. aureus N315
aaggugauugaacaa

SEQ ID NO: 4045919 - RNA, 16 nt, Staphylococcus aureus subsp. aureus N315
aaggugauugaacaau

SEQ ID NO: 4045920 - RNA, 22 nt, Staphylococcus aureus subsp. aureus N315
aagguuguuuuucaucauuaaa

SEQ ID NO: 4045921 - RNA, 23 nt, Staphylococcus aureus subsp. aureus N315
aagguuguuuuucaucauuaaaa

SEQ ID NO: 4045922 - RNA, 14 nt, Staphylococcus aureus subsp. aureus N315
aaguaaaagcuuuc

SEQ ID NO: 4045923 - RNA, 14 nt, Staphylococcus aureus subsp. aureus N315
aaguaaaaguuuug

SEQ ID NO: 4045924 - RNA, 14 nt, Staphylococcus aureus subsp. aureus N315
aaguaaaauaaaaa

SEQ ID NO: 4045925 - RNA, 22 nt, Staphylococcus aureus subsp. aureus N315
aaguaaagggagguauauacaa

SEQ ID NO: 4045926 - RNA, 21 nt, Staphylococcus aureus subsp. aureus N315
aaguaaauguuuuauguauuu

SEQ ID NO: 4045927 - RNA, 20 nt, Staphylococcus aureus subsp. aureus N315
aaguaacauacuauaaaaau

SEQ ID NO: 4045928 - RNA, 13 nt, Staphylococcus aureus subsp. aureus N315
aaguaacucaagu

SEQ ID NO: 4045929 - RNA, 16 nt, Staphylococcus aureus subsp. aureus N315
aaguaacucaagugau

SEQ ID NO: 4045930 - RNA, 19 nt, Staphylococcus aureus subsp. aureus N315
aaguaagcagagccauaau

SEQ ID NO: 4045931 - RNA, 12 nt, Staphylococcus aureus subsp. aureus N315
aaguaaguaaaa

SEQ ID NO: 4045932 - RNA, 13 nt, Staphylococcus aureus subsp. aureus N315
aaguaaguaaaau

SEQ ID NO: 4045933 - RNA, 14 nt, Staphylococcus aureus subsp. aureus N315
aaguaaguaaaaua

SEQ ID NO: 4045934 - RNA, 19 nt, Staphylococcus aureus subsp. aureus N315
aaguaauaaaauaaaaaaa

SEQ ID NO: 4045935 - RNA, 15 nt, Staphylococcus aureus subsp. aureus N315
aaguaauaauauaaa

SEQ ID NO: 4045936 - RNA, 20 nt, Staphylococcus aureus subsp. aureus N315
aaguaauaauauaaauaaaa

SEQ ID NO: 4045937 - RNA, 22 nt, Staphylococcus aureus subsp. aureus N315
aaguaauccccgaagcacagaa

SEQ ID NO: 4045938 - RNA, 24 nt, Staphylococcus aureus subsp. aureus N315
aaguaaugcuguacuauauucaau

SEQ ID NO: 4045939 - RNA, 23 nt, Staphylococcus aureus subsp. aureus N315
aaguaauggauugauaauagcuu

SEQ ID NO: 4045940 - RNA, 13 nt, Staphylococcus aureus subsp. aureus N315
aaguaauuaaaua

SEQ ID NO: 4045941 - RNA, 14 nt, Staphylococcus aureus subsp. aureus N315
aaguacauaaaugc

SEQ ID NO: 4045942 - RNA, 21 nt, Staphylococcus aureus subsp. aureus N315
aaguacauaaaugcuaaaagu

SEQ ID NO: 4045943 - RNA, 19 nt, Staphylococcus aureus subsp. aureus N315
aaguaccuaaaauagaaaa

SEQ ID NO: 4045944 - RNA, 21 nt, Staphylococcus aureus subsp. aureus N315
aaguacgacgguauaaaaaaa

SEQ ID NO: 4045945 - RNA, 14 nt, Staphylococcus aureus subsp. aureus N315
aaguacgcaauuua

SEQ ID NO: 4045946 - RNA, 17 nt, Staphylococcus aureus subsp. aureus N315
aaguacuucggugcuug

SEQ ID NO: 4045947 - RNA, 14 nt, Staphylococcus aureus subsp. aureus N315
aaguacuuuaccac

SEQ ID NO: 4045948 - RNA, 16 nt, Staphylococcus aureus subsp. aureus N315
aaguagacauugaaag

SEQ ID NO: 4045949 - RNA, 14 nt, Staphylococcus aureus subsp. aureus N315
aaguagauauugaa

SEQ ID NO: 4045950 - RNA, 21 nt, Staphylococcus aureus subsp. aureus N315
aaguagucgaagaagauuaug

SEQ ID NO: 4045951 - RNA, 17 nt, Staphylococcus aureus subsp. aureus N315
aaguaguggauaaucac

SEQ ID NO: 4045952 - RNA, 18 nt, Staphylococcus aureus subsp. aureus N315
aaguaguuguuauauucu

SEQ ID NO: 4045953 - RNA, 18 nt, Staphylococcus aureus subsp. aureus N315
aaguauaagguugaagaa

SEQ ID NO: 4045954 - RNA, 19 nt, Staphylococcus aureus subsp. aureus N315
aaguauaaguagcucaaaa

SEQ ID NO: 4045955 - RNA, 17 nt, Staphylococcus aureus subsp. aureus N315
aaguauacuaaacuuuu

SEQ ID NO: 4045956 - RNA, 16 nt, Staphylococcus aureus subsp. aureus N315
aaguauauaauugauu

SEQ ID NO: 4045957 - RNA, 14 nt, Staphylococcus aureus subsp. aureus N315
aaguauaucuuuga

SEQ ID NO: 4045958 - RNA, 20 nt, Staphylococcus aureus subsp. aureus N315
aaguauauugcuuauguaca

SEQ ID NO: 4045959 - RNA, 19 nt, Staphylococcus aureus subsp. aureus N315
aaguaucgccaaucuauug

SEQ ID NO: 4045960 - RNA, 23 nt, Staphylococcus aureus subsp. aureus N315
aaguaucgccaaucuauugcaau

SEQ ID NO: 4045961 - RNA, 17 nt, Staphylococcus aureus subsp. aureus N315
aaguaucggugauuuaa

SEQ ID NO: 4045962 - RNA, 18 nt, Staphylococcus aureus subsp. aureus N315
aaguaucuaugaaauuuu

SEQ ID NO: 4045963 - RNA, 19 nt, Staphylococcus aureus subsp. aureus N315
aaguaucugugaauaugcu

SEQ ID NO: 4045964 - RNA, 21 nt, Staphylococcus aureus subsp. aureus N315
aaguaucugugaauaugcuuu

SEQ ID NO: 4045965 - RNA, 22 nt, Staphylococcus aureus subsp. aureus N315
aaguauggcgaaauguuuugga

SEQ ID NO: 4045966 - RNA, 14 nt, Staphylococcus aureus subsp. aureus N315
aaguauuagauaua

SEQ ID NO: 4045967 - RNA, 15 nt, Staphylococcus aureus subsp. aureus N315
aaguauuagauauau

SEQ ID NO: 4045968 - RNA, 17 nt, Staphylococcus aureus subsp. aureus N315
aaguauuagauauauuu

SEQ ID NO: 4045969 - RNA, 14 nt, Staphylococcus aureus subsp. aureus N315
aaguauuaugauug

SEQ ID NO: 4045970 - RNA, 17 nt, Staphylococcus aureus subsp. aureus N315
aaguauuaugauugcuu

SEQ ID NO: 4045971 - RNA, 23 nt, Staphylococcus aureus subsp. aureus N315
aaguauuaugauugcuuauuuau

SEQ ID NO: 4045972 - RNA, 17 nt, Staphylococcus aureus subsp. aureus N315
aagucaauaauuuuauc

SEQ ID NO: 4045973 - RNA, 22 nt, Staphylococcus aureus subsp. aureus N315
aagucacaguaucuucaguuau

SEQ ID NO: 4045974 - RNA, 22 nt, Staphylococcus aureus subsp. aureus N315
aagucaguuaacggcguauuca

SEQ ID NO: 4045975 - RNA, 16 nt, Staphylococcus aureus subsp. aureus N315
aagucauuaaauguac

SEQ ID NO: 4045976 - RNA, 22 nt, Staphylococcus aureus subsp. aureus N315
aagucauuaaauguacauugua

SEQ ID NO: 4045977 - RNA, 12 nt, Staphylococcus aureus subsp. aureus N315
aagucgaaagua

SEQ ID NO: 4045978 - RNA, 20 nt, Staphylococcus aureus subsp. aureus N315
aagucgcucuagacauuaca

SEQ ID NO: 4045979 - RNA, 18 nt, Staphylococcus aureus subsp. aureus N315
aagucuaauguuggaaaa

SEQ ID NO: 4045980 - RNA, 19 nt, Staphylococcus aureus subsp. aureus N315
aagucuaguucgaacacac

SEQ ID NO: 4045981 - RNA, 18 nt, Staphylococcus aureus subsp. aureus N315
aagucucuugucauuuca

SEQ ID NO: 4045982 - RNA, 22 nt, Staphylococcus aureus subsp. aureus N315
aagucucuuuugauaaauuccc

SEQ ID NO: 4045983 - RNA, 17 nt, Staphylococcus aureus subsp. aureus N315
aagucugaugucgaaaa

SEQ ID NO: 4045984 - RNA, 20 nt, Staphylococcus aureus subsp. aureus N315
aagucugcugguaacucuuc

SEQ ID NO: 4045985 - RNA, 21 nt, Staphylococcus aureus subsp. aureus N315
aagucuguugguuuaucagcu

SEQ ID NO: 4045986 - RNA, 21 nt, Staphylococcus aureus subsp. aureus N315
aagucuucaucuuuaaagaaa

SEQ ID NO: 4045987 - RNA, 23 nt, Staphylococcus aureus subsp. aureus N315
aagucuuuaauagcgucaaguuu

SEQ ID NO: 4045988 - RNA, 19 nt, Staphylococcus aureus subsp. aureus N315
aagucuuuacucuacacuc

SEQ ID NO: 4045989 - RNA, 20 nt, Staphylococcus aureus subsp. aureus N315
aagugaaaguauuagauaua

SEQ ID NO: 4045990 - RNA, 12 nt, Staphylococcus aureus subsp. aureus N315
aagugaaaucau

SEQ ID NO: 4045991 - RNA, 17 nt, Staphylococcus aureus subsp. aureus N315
aagugaagauauuuaua

SEQ ID NO: 4045992 - RNA, 18 nt, Staphylococcus aureus subsp. aureus N315
aagugaagauauuuauaa

SEQ ID NO: 4045993 - RNA, 15 nt, Staphylococcus aureus subsp. aureus N315
aagugacaacauuau

SEQ ID NO: 4045994 - RNA, 23 nt, Staphylococcus aureus subsp. aureus N315
aagugacuuaauaucauauucaa

SEQ ID NO: 4045995 - RNA, 18 nt, Staphylococcus aureus subsp. aureus N315
aagugaguaacauuugcu

SEQ ID NO: 4045996 - RNA, 15 nt, Staphylococcus aureus subsp. aureus N315
aagugaugaccaaua

SEQ ID NO: 4045997 - RNA, 21 nt, Staphylococcus aureus subsp. aureus N315
aagugauuuaaaaaauuuaau

SEQ ID NO: 4045998 - RNA, 22 nt, Staphylococcus aureus subsp. aureus N315
aagugauuucuucauuaucaau

SEQ ID NO: 4045999 - RNA, 18 nt, Staphylococcus aureus subsp. aureus N315
aagugauuugccaaaagu

SEQ ID NO: 4046000 - RNA, 22 nt, Staphylococcus aureus subsp. aureus N315
aagugcagauguugguucauca

SEQ ID NO: 4046001 - RNA, 19 nt, Staphylococcus aureus subsp. aureus N315
aagugccuugccaugauuu

SEQ ID NO: 4046002 - RNA, 22 nt, Staphylococcus aureus subsp. aureus N315
aagugcgggggauuauuuauau

SEQ ID NO: 4046003 - RNA, 16 nt, Staphylococcus aureus subsp. aureus N315
aagugcgguuuaaucu

SEQ ID NO: 4046004 - RNA, 16 nt, Staphylococcus aureus subsp. aureus N315
aagugcuguuacuucu

SEQ ID NO: 4046005 - RNA, 20 nt, Staphylococcus aureus subsp. aureus N315
aagugcuugauuaacauuuu

SEQ ID NO: 4046006 - RNA, 17 nt, Staphylococcus aureus subsp. aureus N315
aagugcuugguuaaagu

SEQ ID NO: 4046007 - RNA, 23 nt, Staphylococcus aureus subsp. aureus N315
aaguggaagguacuuauuucaaa

SEQ ID NO: 4046008 - RNA, 15 nt, Staphylococcus aureus subsp. aureus N315
aaguggcaaacauuu

SEQ ID NO: 4046009 - RNA, 20 nt, Staphylococcus aureus subsp. aureus N315
aagugguuuuacugcuucaa

SEQ ID NO: 4046010 - RNA, 14 nt, Staphylococcus aureus subsp. aureus N315
aaguguaaaugaaa

SEQ ID NO: 4046011 - RNA, 16 nt, Staphylococcus aureus subsp. aureus N315
aaguguugaggcguuu

SEQ ID NO: 4046012 - RNA, 15 nt, Staphylococcus aureus subsp. aureus N315
aaguguuucaacaua

SEQ ID NO: 4046013 - RNA, 16 nt, Staphylococcus aureus subsp. aureus N315
aaguguuucaacauau

SEQ ID NO: 4046014 - RNA, 20 nt, Staphylococcus aureus subsp. aureus N315
aaguguuucaacauauuaua

SEQ ID NO: 4046015 - RNA, 12 nt, Staphylococcus aureus subsp. aureus N315
aaguuaaaaccu

SEQ ID NO: 4046016 - RNA, 13 nt, Staphylococcus aureus subsp. aureus N315
aaguuaagucgcc

SEQ ID NO: 4046017 - RNA, 20 nt, Staphylococcus aureus subsp. aureus N315
aaguuaaucagaaaagcagu

SEQ ID NO: 4046018 - RNA, 17 nt, Staphylococcus aureus subsp. aureus N315
aaguuaauuauguauuu

SEQ ID NO: 4046019 - RNA, 18 nt, Staphylococcus aureus subsp. aureus N315
aaguuaggcgacuuaacu

SEQ ID NO: 4046020 - RNA, 15 nt, Staphylococcus aureus subsp. aureus N315
aaguuauauaaauuu

SEQ ID NO: 4046021 - RNA, 18 nt, Staphylococcus aureus subsp. aureus N315
aaguuauuuggauauuua

SEQ ID NO: 4046022 - RNA, 12 nt, Staphylococcus aureus subsp. aureus N315
aaguuauuuugu

SEQ ID NO: 4046023 - RNA, 19 nt, Staphylococcus aureus subsp. aureus N315
aaguucaaccauaugacuu

SEQ ID NO: 4046024 - RNA, 23 nt, Staphylococcus aureus subsp. aureus N315
aaguucaucguuaucuuuaagua

SEQ ID NO: 4046025 - RNA, 13 nt, Staphylococcus aureus subsp. aureus N315
aaguucuagauua

SEQ ID NO: 4046026 - RNA, 15 nt, Staphylococcus aureus subsp. aureus N315
aaguucuagauuauu

SEQ ID NO: 4046027 - RNA, 14 nt, Staphylococcus aureus subsp. aureus N315
aaguugaaaaccuc

SEQ ID NO: 4046028 - RNA, 15 nt, Staphylococcus aureus subsp. aureus N315
aaguugacaauacaa

SEQ ID NO: 4046029 - RNA, 14 nt, Staphylococcus aureus subsp. aureus N315
aaguugauuaaaag

SEQ ID NO: 4046030 - RNA, 17 nt, Staphylococcus aureus subsp. aureus N315
aaguugcacauuauaaa

SEQ ID NO: 4046031 - RNA, 15 nt, Staphylococcus aureus subsp. aureus N315
aaguugcauauaaaa

SEQ ID NO: 4046032 - RNA, 16 nt, Staphylococcus aureus subsp. aureus N315
aaguugcauauaaaaa

SEQ ID NO: 4046033 - RNA, 16 nt, Staphylococcus aureus subsp. aureus N315
aaguugcugaauaaaa

SEQ ID NO: 4046034 - RNA, 18 nt, Staphylococcus aureus subsp. aureus N315
aaguugcugaauaaaaua

SEQ ID NO: 4046035 - RNA, 18 nt, Staphylococcus aureus subsp. aureus N315
aaguuggcuggcccccaa

SEQ ID NO: 4046036 - RNA, 14 nt, Staphylococcus aureus subsp. aureus N315
aaguuggugugcaa

SEQ ID NO: 4046037 - RNA, 15 nt, Staphylococcus aureus subsp. aureus N315
aaguuguaauuuaaa

SEQ ID NO: 4046038 - RNA, 19 nt, Staphylococcus aureus subsp. aureus N315
aaguuguggucuaaccauc

SEQ ID NO: 4046039 - RNA, 15 nt, Staphylococcus aureus subsp. aureus N315
aaguuguucaauugu

SEQ ID NO: 4046040 - RNA, 23 nt, Staphylococcus aureus subsp. aureus N315
aaguuuaaucguauuagccaaua

SEQ ID NO: 4046041 - RNA, 19 nt, Staphylococcus aureus subsp. aureus N315
aaguuuacagguugaauaa

SEQ ID NO: 4046042 - RNA, 14 nt, Staphylococcus aureus subsp. aureus N315
aaguuuauuuaugu

SEQ ID NO: 4046043 - RNA, 22 nt, Staphylococcus aureus subsp. aureus N315
aaguuucgcagcuuuauaaugu

SEQ ID NO: 4046044 - RNA, 21 nt, Staphylococcus aureus subsp. aureus N315
aaguuugguuucuuaacauaa

SEQ ID NO: 4046045 - RNA, 23 nt, Staphylococcus aureus subsp. aureus N315
aaguuuguauauucuuuuuaacu

SEQ ID NO: 4046046 - RNA, 19 nt, Staphylococcus aureus subsp. aureus N315
aaguuugucuuugaacaua

SEQ ID NO: 4046047 - RNA, 20 nt, Staphylococcus aureus subsp. aureus N315
aaguuugucuuugaacauau

SEQ ID NO: 4046048 - RNA, 18 nt, Staphylococcus aureus subsp. aureus N315
aaguuuuagcuuguuguu

SEQ ID NO: 4046049 - RNA, 19 nt, Staphylococcus aureus subsp. aureus N315
aaguuuucagagauucugu

SEQ ID NO: 4046050 - RNA, 13 nt, Staphylococcus aureus subsp. aureus N315
aaguuuucauuua

SEQ ID NO: 4046051 - RNA, 13 nt, Staphylococcus aureus subsp. aureus N315
aaguuuuugaaua

SEQ ID NO: 4046052 - RNA, 21 nt, Staphylococcus aureus subsp. aureus N315
aauaaaaaaaucacgcuaaca

SEQ ID NO: 4046053 - RNA, 13 nt, Staphylococcus aureus subsp. aureus N315
aauaaaaaaccaa

SEQ ID NO: 4046054 - RNA, 15 nt, Staphylococcus aureus subsp. aureus N315
aauaaaaaaugcacu

SEQ ID NO: 4046055 - RNA, 18 nt, Staphylococcus aureus subsp. aureus N315
aauaaaaaccagcuaaca

SEQ ID NO: 4046056 - RNA, 17 nt, Staphylococcus aureus subsp. aureus N315
aauaaaaacuucuauca

SEQ ID NO: 4046057 - RNA, 15 nt, Staphylococcus aureus subsp. aureus N315
aauaaaaauacauaa

SEQ ID NO: 4046058 - RNA, 12 nt, Staphylococcus aureus subsp. aureus N315
aauaaaaaugcc

SEQ ID NO: 4046059 - RNA, 19 nt, Staphylococcus aureus subsp. aureus N315
aauaaaaauuauauaaauu

SEQ ID NO: 4046060 - RNA, 19 nt, Staphylococcus aureus subsp. aureus N315
aauaaaaccgguacuuuca

SEQ ID NO: 4046061 - RNA, 14 nt, Staphylococcus aureus subsp. aureus N315
aauaaaacuuauaa

SEQ ID NO: 4046062 - RNA, 18 nt, Staphylococcus aureus subsp. aureus N315
aauaaaaggcuuuguuaa

SEQ ID NO: 4046063 - RNA, 18 nt, Staphylococcus aureus subsp. aureus N315
aauaaaagucgauaaaua

SEQ ID NO: 4046064 - RNA, 13 nt, Staphylococcus aureus subsp. aureus N315
aauaaaauauauc

SEQ ID NO: 4046065 - RNA, 15 nt, Staphylococcus aureus subsp. aureus N315
aauaaaauauaucuu

SEQ ID NO: 4046066 - RNA, 16 nt, Staphylococcus aureus subsp. aureus N315
aauaaaauauaucuua

SEQ ID NO: 4046067 - RNA, 14 nt, Staphylococcus aureus subsp. aureus N315
aauaaaaucaaagc

SEQ ID NO: 4046068 - RNA, 14 nt, Staphylococcus aureus subsp. aureus N315
aauaaaaucaucuu

SEQ ID NO: 4046069 - RNA, 12 nt, Staphylococcus aureus subsp. aureus N315
aauaaaaugaug

SEQ ID NO: 4046070 - RNA, 15 nt, Staphylococcus aureus subsp. aureus N315
aauaaaaugcuacaa

SEQ ID NO: 4046071 - RNA, 13 nt, Staphylococcus aureus subsp. aureus N315
aauaaaauuaaaa

SEQ ID NO: 4046072 - RNA, 22 nt, Staphylococcus aureus subsp. aureus N315
aauaaacaacugcaauagcuau

SEQ ID NO: 4046073 - RNA, 18 nt, Staphylococcus aureus subsp. aureus N315
aauaaaccuacaauauag

SEQ ID NO: 4046074 - RNA, 21 nt, Staphylococcus aureus subsp. aureus N315
aauaaaccuacaauauagaaa

SEQ ID NO: 4046075 - RNA, 18 nt, Staphylococcus aureus subsp. aureus N315
aauaaacuuuaugaaauu

SEQ ID NO: 4046076 - RNA, 18 nt, Staphylococcus aureus subsp. aureus N315
aauaaagcaauguugcau

SEQ ID NO: 4046077 - RNA, 22 nt, Staphylococcus aureus subsp. aureus N315
aauaaagcguccucuugugaaa

SEQ ID NO: 4046078 - RNA, 22 nt, Staphylococcus aureus subsp. aureus N315
aauaaagcugauuuuucauuga

SEQ ID NO: 4046079 - RNA, 17 nt, Staphylococcus aureus subsp. aureus N315
aauaaaggcaacaaaua

SEQ ID NO: 4046080 - RNA, 19 nt, Staphylococcus aureus subsp. aureus N315
aauaaagggaguccguuaa

SEQ ID NO: 4046081 - RNA, 12 nt, Staphylococcus aureus subsp. aureus N315
aauaaauaacuu

SEQ ID NO: 4046082 - RNA, 14 nt, Staphylococcus aureus subsp. aureus N315
aauaaauacaaugu

SEQ ID NO: 4046083 - RNA, 17 nt, Staphylococcus aureus subsp. aureus N315
aauaaauagauaauaua

SEQ ID NO: 4046084 - RNA, 21 nt, Staphylococcus aureus subsp. aureus N315
aauaaauaggaugaaaaagau

SEQ ID NO: 4046085 - RNA, 18 nt, Staphylococcus aureus subsp. aureus N315
aauaaaucacgccauaau

SEQ ID NO: 4046086 - RNA, 20 nt, Staphylococcus aureus subsp. aureus N315
aauaaaucaguaguuuuaaa

SEQ ID NO: 4046087 - RNA, 13 nt, Staphylococcus aureus subsp. aureus N315
aauaaaucauacg

SEQ ID NO: 4046088 - RNA, 20 nt, Staphylococcus aureus subsp. aureus N315
aauaaaucauacgagaaauu

SEQ ID NO: 4046089 - RNA, 14 nt, Staphylococcus aureus subsp. aureus N315
aauaaaucuaucua

SEQ ID NO: 4046090 - RNA, 17 nt, Staphylococcus aureus subsp. aureus N315
aauaaaucuccauuaau

SEQ ID NO: 4046091 - RNA, 17 nt, Staphylococcus aureus subsp. aureus N315
aauaaaugacauuuaau

SEQ ID NO: 4046092 - RNA, 21 nt, Staphylococcus aureus subsp. aureus N315
aauaaaugacuucacauuuau

SEQ ID NO: 4046093 - RNA, 13 nt, Staphylococcus aureus subsp. aureus N315
aauaaauguuaaa

SEQ ID NO: 4046094 - RNA, 13 nt, Staphylococcus aureus subsp. aureus N315
aauaaauuaaauu

SEQ ID NO: 4046095 - RNA, 14 nt, Staphylococcus aureus subsp. aureus N315
aauaaauuaaauuu

SEQ ID NO: 4046096 - RNA, 21 nt, Staphylococcus aureus subsp. aureus N315
aauaaauuaugaaagugaauu

SEQ ID NO: 4046097 - RNA, 18 nt, Staphylococcus aureus subsp. aureus N315
aauaaauuguaugaauaa

SEQ ID NO: 4046098 - RNA, 19 nt, Staphylococcus aureus subsp. aureus N315
aauaaauuguaugaauaau

SEQ ID NO: 4046099 - RNA, 13 nt, Staphylococcus aureus subsp. aureus N315
aauaaauuuuaua

SEQ ID NO: 4046100 - RNA, 17 nt, Staphylococcus aureus subsp. aureus N315
aauaaauuuugcgaaaa

SEQ ID NO: 4046101 - RNA, 17 nt, Staphylococcus aureus subsp. aureus N315
aauaacaaaauuaaaua

SEQ ID NO: 4046102 - RNA, 15 nt, Staphylococcus aureus subsp. aureus N315
aauaacaccaauuga

SEQ ID NO: 4046103 - RNA, 18 nt, Staphylococcus aureus subsp. aureus N315
aauaacaccuuucauuug

SEQ ID NO: 4046104 - RNA, 23 nt, Staphylococcus aureus subsp. aureus N315
aauaacaccuuucauuuggaaac

SEQ ID NO: 4046105 - RNA, 17 nt, Staphylococcus aureus subsp. aureus N315
aauaacacgauuugguu

SEQ ID NO: 4046106 - RNA, 19 nt, Staphylococcus aureus subsp. aureus N315
aauaacauccccaaaaaua

SEQ ID NO: 4046107 - RNA, 15 nt, Staphylococcus aureus subsp. aureus N315
aauaacaucuaaauu

SEQ ID NO: 4046108 - RNA, 21 nt, Staphylococcus aureus subsp. aureus N315
aauaaccaccaucccauuaaa

SEQ ID NO: 4046109 - RNA, 14 nt, Staphylococcus aureus subsp. aureus N315
aauaaccauguaaa

SEQ ID NO: 4046110 - RNA, 23 nt, Staphylococcus aureus subsp. aureus N315
aauaaccauguaaaauuagcaag

SEQ ID NO: 4046111 - RNA, 20 nt, Staphylococcus aureus subsp. aureus N315
aauaaccauuuuuucaaauu

SEQ ID NO: 4046112 - RNA, 18 nt, Staphylococcus aureus subsp. aureus N315
aauaaccgcuuaauucuu

SEQ ID NO: 4046113 - RNA, 19 nt, Staphylococcus aureus subsp. aureus N315
aauaaccuagguuaaagau

SEQ ID NO: 4046114 - RNA, 17 nt, Staphylococcus aureus subsp. aureus N315
aauaaccuuuaaaacau

SEQ ID NO: 4046115 - RNA, 23 nt, Staphylococcus aureus subsp. aureus N315
aauaaccuuuaaaacaucauuca

SEQ ID NO: 4046116 - RNA, 22 nt, Staphylococcus aureus subsp. aureus N315
aauaacuagauguucacauucu

SEQ ID NO: 4046117 - RNA, 20 nt, Staphylococcus aureus subsp. aureus N315
aauaacuggcaaaucaaaca

SEQ ID NO: 4046118 - RNA, 20 nt, Staphylococcus aureus subsp. aureus N315
aauaagagaacuuuucaaac

SEQ ID NO: 4046119 - RNA, 11 nt, Staphylococcus aureus subsp. aureus N315
aauaagauuau

SEQ ID NO: 4046120 - RNA, 15 nt, Staphylococcus aureus subsp. aureus N315
aauaagcgcaauuaa

SEQ ID NO: 4046121 - RNA, 19 nt, Staphylococcus aureus subsp. aureus N315
aauaagcgcaauuaaaagu

SEQ ID NO: 4046122 - RNA, 19 nt, Staphylococcus aureus subsp. aureus N315
aauaagcuuguaacaagca

SEQ ID NO: 4046123 - RNA, 15 nt, Staphylococcus aureus subsp. aureus N315
aauaaguaauaauuu

SEQ ID NO: 4046124 - RNA, 11 nt, Staphylococcus aureus subsp. aureus N315
aauaaguaugg

SEQ ID NO: 4046125 - RNA, 19 nt, Staphylococcus aureus subsp. aureus N315
aauaagugguuguucccau

SEQ ID NO: 4046126 - RNA, 19 nt, Staphylococcus aureus subsp. aureus N315
aauaaguugaauauaaaaa

SEQ ID NO: 4046127 - RNA, 14 nt, Staphylococcus aureus subsp. aureus N315
aauaaguugucauc

SEQ ID NO: 4046128 - RNA, 12 nt, Staphylococcus aureus subsp. aureus N315
aauaauaaaaua

SEQ ID NO: 4046129 - RNA, 13 nt, Staphylococcus aureus subsp. aureus N315
aauaauaaaauag

SEQ ID NO: 4046130 - RNA, 20 nt, Staphylococcus aureus subsp. aureus N315
aauaauaaaccuaaagauau

SEQ ID NO: 4046131 - RNA, 18 nt, Staphylococcus aureus subsp. aureus N315
aauaauacgcuugauaaa

SEQ ID NO: 4046132 - RNA, 14 nt, Staphylococcus aureus subsp. aureus N315
aauaauacuacaua

SEQ ID NO: 4046133 - RNA, 16 nt, Staphylococcus aureus subsp. aureus N315
aauaauacuacauaua

SEQ ID NO: 4046134 - RNA, 14 nt, Staphylococcus aureus subsp. aureus N315
aauaauagcaaaau

SEQ ID NO: 4046135 - RNA, 22 nt, Staphylococcus aureus subsp. aureus N315
aauaauaggauaccacaucgca

SEQ ID NO: 4046136 - RNA, 19 nt, Staphylococcus aureus subsp. aureus N315
aauaauauaaaaacaaaag

SEQ ID NO: 4046137 - RNA, 16 nt, Staphylococcus aureus subsp. aureus N315
aauaauauaaaacgau

SEQ ID NO: 4046138 - RNA, 20 nt, Staphylococcus aureus subsp. aureus N315
aauaauauaaauaaaagcca

SEQ ID NO: 4046139 - RNA, 16 nt, Staphylococcus aureus subsp. aureus N315
aauaauaucaccuuuu

SEQ ID NO: 4046140 - RNA, 19 nt, Staphylococcus aureus subsp. aureus N315
aauaauaugccauaguaau

SEQ ID NO: 4046141 - RNA, 12 nt, Staphylococcus aureus subsp. aureus N315
aauaaucaaacc

SEQ ID NO: 4046142 - RNA, 17 nt, Staphylococcus aureus subsp. aureus N315
aauaaucauccauauau

SEQ ID NO: 4046143 - RNA, 23 nt, Staphylococcus aureus subsp. aureus N315
aauaaucccaaccauucuaccag

SEQ ID NO: 4046144 - RNA, 18 nt, Staphylococcus aureus subsp. aureus N315
aauaauccgagucauacu

SEQ ID NO: 4046145 - RNA, 18 nt, Staphylococcus aureus subsp. aureus N315
aauaaucgaacagaaaau

SEQ ID NO: 4046146 - RNA, 18 nt, Staphylococcus aureus subsp. aureus N315
aauaaucgaacauaaaua

SEQ ID NO: 4046147 - RNA, 19 nt, Staphylococcus aureus subsp. aureus N315
aauaaucggacugauggaa

SEQ ID NO: 4046148 - RNA, 20 nt, Staphylococcus aureus subsp. aureus N315
aauaaucgguaauuacuugu

SEQ ID NO: 4046149 - RNA, 19 nt, Staphylococcus aureus subsp. aureus N315
aauaaugacgagaauuaaa

SEQ ID NO: 4046150 - RNA, 23 nt, Staphylococcus aureus subsp. aureus N315
aauaaugggaauuguauuagcaa

SEQ ID NO: 4046151 - RNA, 16 nt, Staphylococcus aureus subsp. aureus N315
aauaaugucuuacuuu

SEQ ID NO: 4046152 - RNA, 20 nt, Staphylococcus aureus subsp. aureus N315
aauaaugucuuacuuuuaaa

SEQ ID NO: 4046153 - RNA, 18 nt, Staphylococcus aureus subsp. aureus N315
aauaaugugaaaaaucuu

SEQ ID NO: 4046154 - RNA, 17 nt, Staphylococcus aureus subsp. aureus N315
aauaaugugucaaauag

SEQ ID NO: 4046155 - RNA, 11 nt, Staphylococcus aureus subsp. aureus N315
aauaauguuuc

SEQ ID NO: 4046156 - RNA, 12 nt, Staphylococcus aureus subsp. aureus N315
aauaauuaaaua

SEQ ID NO: 4046157 - RNA, 17 nt, Staphylococcus aureus subsp. aureus N315
aauaauuaaauaaaaau

SEQ ID NO: 4046158 - RNA, 15 nt, Staphylococcus aureus subsp. aureus N315
aauaauuacuaaccu

SEQ ID NO: 4046159 - RNA, 16 nt, Staphylococcus aureus subsp. aureus N315
aauaauuagauuuaaa

SEQ ID NO: 4046160 - RNA, 12 nt, Staphylococcus aureus subsp. aureus N315
aauaauuauuaa

SEQ ID NO: 4046161 - RNA, 18 nt, Staphylococcus aureus subsp. aureus N315
aauaauucauaaaugcuu

SEQ ID NO: 4046162 - RNA, 16 nt, Staphylococcus aureus subsp. aureus N315
aauaauugcuaaaaua

SEQ ID NO: 4046163 - RNA, 19 nt, Staphylococcus aureus subsp. aureus N315
aauaauugcuuuagaaagu

SEQ ID NO: 4046164 - RNA, 20 nt, Staphylococcus aureus subsp. aureus N315
aauaauuggaaucaucuuuu

SEQ ID NO: 4046165 - RNA, 11 nt, Staphylococcus aureus subsp. aureus N315
aauaauugucc

SEQ ID NO: 4046166 - RNA, 15 nt, Staphylococcus aureus subsp. aureus N315
aauaauuuaacuaau

SEQ ID NO: 4046167 - RNA, 22 nt, Staphylococcus aureus subsp. aureus N315
aauaauuucaguucuuagauuu

SEQ ID NO: 4046168 - RNA, 17 nt, Staphylococcus aureus subsp. aureus N315
aauaauuuguaauuccu

SEQ ID NO: 4046169 - RNA, 16 nt, Staphylococcus aureus subsp. aureus N315
aauaauuuuaaaaaua

SEQ ID NO: 4046170 - RNA, 20 nt, Staphylococcus aureus subsp. aureus N315
aauaauuuuaaaaauaaaaa

SEQ ID NO: 4046171 - RNA, 14 nt, Staphylococcus aureus subsp. aureus N315
aauaauuuugauau

SEQ ID NO: 4046172 - RNA, 12 nt, Staphylococcus aureus subsp. aureus N315
aauaauuuuguu

SEQ ID NO: 4046173 - RNA, 23 nt, Staphylococcus aureus subsp. aureus N315
aauaauuuuuuuccuuucuuuuu

SEQ ID NO: 4046174 - RNA, 23 nt, Staphylococcus aureus subsp. aureus N315
aauacaaaccuaucaucaaucgu

SEQ ID NO: 4046175 - RNA, 16 nt, Staphylococcus aureus subsp. aureus N315
aauacaaauauaucua

SEQ ID NO: 4046176 - RNA, 15 nt, Staphylococcus aureus subsp. aureus N315
aauacaaauauuaag

SEQ ID NO: 4046177 - RNA, 16 nt, Staphylococcus aureus subsp. aureus N315
aauacaaauauuaagu

SEQ ID NO: 4046178 - RNA, 13 nt, Staphylococcus aureus subsp. aureus N315
aauacaaccauca

SEQ ID NO: 4046179 - RNA, 14 nt, Staphylococcus aureus subsp. aureus N315
aauacaagucuuua

SEQ ID NO: 4046180 - RNA, 16 nt, Staphylococcus aureus subsp. aureus N315
aauacaagucuuuacu

SEQ ID NO: 4046181 - RNA, 12 nt, Staphylococcus aureus subsp. aureus N315
aauacaauucaa

SEQ ID NO: 4046182 - RNA, 20 nt, Staphylococcus aureus subsp. aureus N315
aauacaauuucuucauuuuc

SEQ ID NO: 4046183 - RNA, 21 nt, Staphylococcus aureus subsp. aureus N315
aauacaauuucuucauuuuca

SEQ ID NO: 4046184 - RNA, 21 nt, Staphylococcus aureus subsp. aureus N315
aauacacgaucaguugaguca

SEQ ID NO: 4046185 - RNA, 12 nt, Staphylococcus aureus subsp. aureus N315
aauacacuugau

SEQ ID NO: 4046186 - RNA, 16 nt, Staphylococcus aureus subsp. aureus N315
aauacacuugauaaaa

SEQ ID NO: 4046187 - RNA, 18 nt, Staphylococcus aureus subsp. aureus N315
aauacacuugauaaaacu

SEQ ID NO: 4046188 - RNA, 19 nt, Staphylococcus aureus subsp. aureus N315
aauacacuugauaaaacua

SEQ ID NO: 4046189 - RNA, 11 nt, Staphylococcus aureus subsp. aureus N315
aauacagauga

SEQ ID NO: 4046190 - RNA, 13 nt, Staphylococcus aureus subsp. aureus N315
aauacauacugau

SEQ ID NO: 4046191 - RNA, 17 nt, Staphylococcus aureus subsp. aureus N315
aauacauacugauuaaa

SEQ ID NO: 4046192 - RNA, 21 nt, Staphylococcus aureus subsp. aureus N315
aauacauacugauuaaacugu

SEQ ID NO: 4046193 - RNA, 18 nt, Staphylococcus aureus subsp. aureus N315
aauacauagguucaucuu

SEQ ID NO: 4046194 - RNA, 17 nt, Staphylococcus aureus subsp. aureus N315
aauacaucuaauaaaua

SEQ ID NO: 4046195 - RNA, 19 nt, Staphylococcus aureus subsp. aureus N315
aauacaugugggauaucuu

SEQ ID NO: 4046196 - RNA, 17 nt, Staphylococcus aureus subsp. aureus N315
aauacauuaauauaaau

SEQ ID NO: 4046197 - RNA, 17 nt, Staphylococcus aureus subsp. aureus N315
aauacauuauguucuuc

SEQ ID NO: 4046198 - RNA, 16 nt, Staphylococcus aureus subsp. aureus N315
aauacauuucaaaaaa

SEQ ID NO: 4046199 - RNA, 17 nt, Staphylococcus aureus subsp. aureus N315
aauacauuucaaaaaaa

SEQ ID NO: 4046200 - RNA, 13 nt, Staphylococcus aureus subsp. aureus N315
aauaccaauugcu

SEQ ID NO: 4046201 - RNA, 14 nt, Staphylococcus aureus subsp. aureus N315
aauaccaauugcuu

SEQ ID NO: 4046202 - RNA, 16 nt, Staphylococcus aureus subsp. aureus N315
aauaccacuuaaucgu

SEQ ID NO: 4046203 - RNA, 17 nt, Staphylococcus aureus subsp. aureus N315
aauaccauaauuaaaua

SEQ ID NO: 4046204 - RNA, 19 nt, Staphylococcus aureus subsp. aureus N315
aauaccauugugaugauaa

SEQ ID NO: 4046205 - RNA, 16 nt, Staphylococcus aureus subsp. aureus N315
aauaccccaaauagug

SEQ ID NO: 4046206 - RNA, 18 nt, Staphylococcus aureus subsp. aureus N315
aauacccuacuauauauc

SEQ ID NO: 4046207 - RNA, 23 nt, Staphylococcus aureus subsp. aureus N315
aauaccgaauaauuuugauauag

SEQ ID NO: 4046208 - RNA, 18 nt, Staphylococcus aureus subsp. aureus N315
aauaccgccuacuguuuc

SEQ ID NO: 4046209 - RNA, 17 nt, Staphylococcus aureus subsp. aureus N315
aauaccuaaccauaaca

SEQ ID NO: 4046210 - RNA, 22 nt, Staphylococcus aureus subsp. aureus N315
aauaccuaugauauaugcugca

SEQ ID NO: 4046211 - RNA, 18 nt, Staphylococcus aureus subsp. aureus N315
aauaccucuacauuauau

SEQ ID NO: 4046212 - RNA, 15 nt, Staphylococcus aureus subsp. aureus N315
aauaccuuuuucuaa

SEQ ID NO: 4046213 - RNA, 21 nt, Staphylococcus aureus subsp. aureus N315
aauacgaaguguuauaaauag

SEQ ID NO: 4046214 - RNA, 13 nt, Staphylococcus aureus subsp. aureus N315
aauacgaaguuuc

SEQ ID NO: 4046215 - RNA, 16 nt, Staphylococcus aureus subsp. aureus N315
aauacgaauuucauag

SEQ ID NO: 4046216 - RNA, 16 nt, Staphylococcus aureus subsp. aureus N315
aauacgauaauaacua

SEQ ID NO: 4046217 - RNA, 14 nt, Staphylococcus aureus subsp. aureus N315
aauacgcaaaccaa

SEQ ID NO: 4046218 - RNA, 21 nt, Staphylococcus aureus subsp. aureus N315
aauacgccaaauaucaguaau

SEQ ID NO: 4046219 - RNA, 22 nt, Staphylococcus aureus subsp. aureus N315
aauacguaucaagaaaaaguuu

SEQ ID NO: 4046220 - RNA, 17 nt, Staphylococcus aureus subsp. aureus N315
aauacguguguuuucuu

SEQ ID NO: 4046221 - RNA, 20 nt, Staphylococcus aureus subsp. aureus N315
aauacguguguuuucuuuuc

SEQ ID NO: 4046222 - RNA, 19 nt, Staphylococcus aureus subsp. aureus N315
aauacguuuaauaaugguu

SEQ ID NO: 4046223 - RNA, 20 nt, Staphylococcus aureus subsp. aureus N315
aauacguuuaauaaugguuc

SEQ ID NO: 4046224 - RNA, 23 nt, Staphylococcus aureus subsp. aureus N315
aauacguuuauccuuuaaaucau

SEQ ID NO: 4046225 - RNA, 18 nt, Staphylococcus aureus subsp. aureus N315
aauacuaacugaagacac

SEQ ID NO: 4046226 - RNA, 14 nt, Staphylococcus aureus subsp. aureus N315
aauacuaagauuag

SEQ ID NO: 4046227 - RNA, 16 nt, Staphylococcus aureus subsp. aureus N315
aauacuaagauuagcu

SEQ ID NO: 4046228 - RNA, 19 nt, Staphylococcus aureus subsp. aureus N315
aauacuaagauuagcuaug

SEQ ID NO: 4046229 - RNA, 14 nt, Staphylococcus aureus subsp. aureus N315
aauacuaaucaaag

SEQ ID NO: 4046230 - RNA, 18 nt, Staphylococcus aureus subsp. aureus N315
aauacuaaucaaagaaaa

SEQ ID NO: 4046231 - RNA, 20 nt, Staphylococcus aureus subsp. aureus N315
aauacuaauuucuauagaaa

SEQ ID NO: 4046232 - RNA, 20 nt, Staphylococcus aureus subsp. aureus N315
aauacuaccguuuuuauaua

SEQ ID NO: 4046233 - RNA, 21 nt, Staphylococcus aureus subsp. aureus N315
aauacuacuguugacauuuga

SEQ ID NO: 4046234 - RNA, 24 nt, Staphylococcus aureus subsp. aureus N315
aauacuacuuaaugacuucuuuau

SEQ ID NO: 4046235 - RNA, 18 nt, Staphylococcus aureus subsp. aureus N315
aauacuauacugaugaaa

SEQ ID NO: 4046236 - RNA, 12 nt, Staphylococcus aureus subsp. aureus N315
aauacucacauu

SEQ ID NO: 4046237 - RNA, 14 nt, Staphylococcus aureus subsp. aureus N315
aauacucaguuuau

SEQ ID NO: 4046238 - RNA, 18 nt, Staphylococcus aureus subsp. aureus N315
aauacucccgcauuauua

SEQ ID NO: 4046239 - RNA, 16 nt, Staphylococcus aureus subsp. aureus N315
aauacucccuucaaca

SEQ ID NO: 4046240 - RNA, 13 nt, Staphylococcus aureus subsp. aureus N315
aauacucuucaau

SEQ ID NO: 4046241 - RNA, 16 nt, Staphylococcus aureus subsp. aureus N315
aauacuguauuuuaac

SEQ ID NO: 4046242 - RNA, 21 nt, Staphylococcus aureus subsp. aureus N315
aauacuguauuuuaacgucau

SEQ ID NO: 4046243 - RNA, 19 nt, Staphylococcus aureus subsp. aureus N315
aauacuguuuaaauaaaau

SEQ ID NO: 4046244 - RNA, 19 nt, Staphylococcus aureus subsp. aureus N315
aauacuucuuguucgauaa

SEQ ID NO: 4046245 - RNA, 13 nt, Staphylococcus aureus subsp. aureus N315
aauacuugaaaga

SEQ ID NO: 4046246 - RNA, 19 nt, Staphylococcus aureus subsp. aureus N315
aauacuugaauuuaauaag

SEQ ID NO: 4046247 - RNA, 20 nt, Staphylococcus aureus subsp. aureus N315
aauacuuucaaacaaaucuu

SEQ ID NO: 4046248 - RNA, 16 nt, Staphylococcus aureus subsp. aureus N315
aauacuuucacuuuuu

SEQ ID NO: 4046249 - RNA, 17 nt, Staphylococcus aureus subsp. aureus N315
aauacuuucacuuuuua

SEQ ID NO: 4046250 - RNA, 18 nt, Staphylococcus aureus subsp. aureus N315
aauacuuucacuuuuuau

SEQ ID NO: 4046251 - RNA, 22 nt, Staphylococcus aureus subsp. aureus N315
aauacuuucacuuuuuauauca

SEQ ID NO: 4046252 - RNA, 14 nt, Staphylococcus aureus subsp. aureus N315
aauacuuuucucga

SEQ ID NO: 4046253 - RNA, 13 nt, Staphylococcus aureus subsp. aureus N315
aauacuuuuuaac

SEQ ID NO: 4046254 - RNA, 14 nt, Staphylococcus aureus subsp. aureus N315
aauacuuuuuaacu

SEQ ID NO: 4046255 - RNA, 15 nt, Staphylococcus aureus subsp. aureus N315
aauacuuuuuaacug

SEQ ID NO: 4046256 - RNA, 17 nt, Staphylococcus aureus subsp. aureus N315
aauacuuuuuaacuggu

SEQ ID NO: 4046257 - RNA, 13 nt, Staphylococcus aureus subsp. aureus N315
aauacuuuuuaua

SEQ ID NO: 4046258 - RNA, 15 nt, Staphylococcus aureus subsp. aureus N315
aauacuuuuuauaua

SEQ ID NO: 4046259 - RNA, 21 nt, Staphylococcus aureus subsp. aureus N315
aauagaaaaauuucaaaaaua

SEQ ID NO: 4046260 - RNA, 12 nt, Staphylococcus aureus subsp. aureus N315
aauagaaauaau

SEQ ID NO: 4046261 - RNA, 22 nt, Staphylococcus aureus subsp. aureus N315
aauagaaaugacgauaccuuua

SEQ ID NO: 4046262 - RNA, 15 nt, Staphylococcus aureus subsp. aureus N315
aauagaacgaaauag

SEQ ID NO: 4046263 - RNA, 20 nt, Staphylococcus aureus subsp. aureus N315
aauagaagguuauuuuuuau

SEQ ID NO: 4046264 - RNA, 23 nt, Staphylococcus aureus subsp. aureus N315
aauagaaucuaaggccauuugua

SEQ ID NO: 4046265 - RNA, 19 nt, Staphylococcus aureus subsp. aureus N315
aauagacugccaauaaaau

SEQ ID NO: 4046266 - RNA, 14 nt, Staphylococcus aureus subsp. aureus N315
aauagagaaagaau

SEQ ID NO: 4046267 - RNA, 16 nt, Staphylococcus aureus subsp. aureus N315
aauagauaaugcaccu

SEQ ID NO: 4046268 - RNA, 22 nt, Staphylococcus aureus subsp. aureus N315
aauagcagggugcuaaauuuac

SEQ ID NO: 4046269 - RNA, 22 nt, Staphylococcus aureus subsp. aureus N315
aauagcaguuucugagaagaaa

SEQ ID NO: 4046270 - RNA, 13 nt, Staphylococcus aureus subsp. aureus N315
aauagcauuugua

SEQ ID NO: 4046271 - RNA, 15 nt, Staphylococcus aureus subsp. aureus N315
aauagcgauuuuaaa

SEQ ID NO: 4046272 - RNA, 20 nt, Staphylococcus aureus subsp. aureus N315
aauagcgauuuuaaagaaaa

SEQ ID NO: 4046273 - RNA, 21 nt, Staphylococcus aureus subsp. aureus N315
aauagcgauuuuaaagaaaag

SEQ ID NO: 4046274 - RNA, 17 nt, Staphylococcus aureus subsp. aureus N315
aauagcgguuuaaaaau

SEQ ID NO: 4046275 - RNA, 18 nt, Staphylococcus aureus subsp. aureus N315
aauagcuauaacucuaaa

SEQ ID NO: 4046276 - RNA, 21 nt, Staphylococcus aureus subsp. aureus N315
aauagcuauaacucuaaauau

SEQ ID NO: 4046277 - RNA, 17 nt, Staphylococcus aureus subsp. aureus N315
aauagcuauauuuaaaa

SEQ ID NO: 4046278 - RNA, 17 nt, Staphylococcus aureus subsp. aureus N315
aauagcuauauuuuugu

SEQ ID NO: 4046279 - RNA, 23 nt, Staphylococcus aureus subsp. aureus N315
aauagcuauauuuuuguauuuau

SEQ ID NO: 4046280 - RNA, 15 nt, Staphylococcus aureus subsp. aureus N315
aauagcuauuaaaau

SEQ ID NO: 4046281 - RNA, 12 nt, Staphylococcus aureus subsp. aureus N315
aauagcugcaau

SEQ ID NO: 4046282 - RNA, 19 nt, Staphylococcus aureus subsp. aureus N315
aauagcuuucguuucuuuu

SEQ ID NO: 4046283 - RNA, 22 nt, Staphylococcus aureus subsp. aureus N315
aauagcuuucguuucuuuuaua

SEQ ID NO: 4046284 - RNA, 13 nt, Staphylococcus aureus subsp. aureus N315
aauaggaauacca

SEQ ID NO: 4046285 - RNA, 15 nt, Staphylococcus aureus subsp. aureus N315
aauaggcaggaauga

SEQ ID NO: 4046286 - RNA, 20 nt, Staphylococcus aureus subsp. aureus N315
aauaggcaggaaugauauac

SEQ ID NO: 4046287 - RNA, 21 nt, Staphylococcus aureus subsp. aureus N315
aauaggcgcuuguaaaauuuu

SEQ ID NO: 4046288 - RNA, 19 nt, Staphylococcus aureus subsp. aureus N315
aauagguacaacuaaauau

SEQ ID NO: 4046289 - RNA, 14 nt, Staphylococcus aureus subsp. aureus N315
aauaggucgcugug

SEQ ID NO: 4046290 - RNA, 20 nt, Staphylococcus aureus subsp. aureus N315
aauagguuauuugauaauga

SEQ ID NO: 4046291 - RNA, 20 nt, Staphylococcus aureus subsp. aureus N315
aauagguucauuauuuaaau

SEQ ID NO: 4046292 - RNA, 14 nt, Staphylococcus aureus subsp. aureus N315
aauaguaaagugaa

SEQ ID NO: 4046293 - RNA, 15 nt, Staphylococcus aureus subsp. aureus N315
aauaguaaagugaaa

SEQ ID NO: 4046294 - RNA, 19 nt, Staphylococcus aureus subsp. aureus N315
aauaguaacauaagauaca

SEQ ID NO: 4046295 - RNA, 17 nt, Staphylococcus aureus subsp. aureus N315
aauaguaaugaugugaa

SEQ ID NO: 4046296 - RNA, 20 nt, Staphylococcus aureus subsp. aureus N315
aauaguagccuagauaccaa

SEQ ID NO: 4046297 - RNA, 18 nt, Staphylococcus aureus subsp. aureus N315
aauagucaauuaaugaua

SEQ ID NO: 4046298 - RNA, 12 nt, Staphylococcus aureus subsp. aureus N315
aauagugugcaa

SEQ ID NO: 4046299 - RNA, 19 nt, Staphylococcus aureus subsp. aureus N315
aauaguuaaaguagaaccu

SEQ ID NO: 4046300 - RNA, 15 nt, Staphylococcus aureus subsp. aureus N315
aauaguuaagauuuu

SEQ ID NO: 4046301 - RNA, 17 nt, Staphylococcus aureus subsp. aureus N315
aauaguucuuuaaauua

SEQ ID NO: 4046302 - RNA, 18 nt, Staphylococcus aureus subsp. aureus N315
aauaguucuuuaaauuau

SEQ ID NO: 4046303 - RNA, 21 nt, Staphylococcus aureus subsp. aureus N315
aauaguucuuuaaauuauaua

SEQ ID NO: 4046304 - RNA, 14 nt, Staphylococcus aureus subsp. aureus N315
aauaguuuuucaua

SEQ ID NO: 4046305 - RNA, 13 nt, Staphylococcus aureus subsp. aureus N315
aauauaaaaaaga

SEQ ID NO: 4046306 - RNA, 14 nt, Staphylococcus aureus subsp. aureus N315
aauauaaaaaagau

SEQ ID NO: 4046307 - RNA, 20 nt, Staphylococcus aureus subsp. aureus N315
aauauaaaaagugaagauau

SEQ ID NO: 4046308 - RNA, 18 nt, Staphylococcus aureus subsp. aureus N315
aauauaaaaggaagcauc

SEQ ID NO: 4046309 - RNA, 12 nt, Staphylococcus aureus subsp. aureus N315
aauauaaaauaa

SEQ ID NO: 4046310 - RNA, 14 nt, Staphylococcus aureus subsp. aureus N315
aauauaaauuuuga

SEQ ID NO: 4046311 - RNA, 21 nt, Staphylococcus aureus subsp. aureus N315
aauauaacaacuacuuaaauu

SEQ ID NO: 4046312 - RNA, 23 nt, Staphylococcus aureus subsp. aureus N315
aauauaacuucuauuaagaaaua

SEQ ID NO: 4046313 - RNA, 16 nt, Staphylococcus aureus subsp. aureus N315
aauauaaguaaucaua

SEQ ID NO: 4046314 - RNA, 13 nt, Staphylococcus aureus subsp. aureus N315
aauauaauagaaa

SEQ ID NO: 4046315 - RNA, 15 nt, Staphylococcus aureus subsp. aureus N315
aauauaauagaaaua

SEQ ID NO: 4046316 - RNA, 18 nt, Staphylococcus aureus subsp. aureus N315
aauauaauagaaauaauc

SEQ ID NO: 4046317 - RNA, 13 nt, Staphylococcus aureus subsp. aureus N315
aauauaauauaca

SEQ ID NO: 4046318 - RNA, 20 nt, Staphylococcus aureus subsp. aureus N315
aauauaauauacacaaaaag

SEQ ID NO: 4046319 - RNA, 13 nt, Staphylococcus aureus subsp. aureus N315
aauauaaugaucc

SEQ ID NO: 4046320 - RNA, 14 nt, Staphylococcus aureus subsp. aureus N315
aauauaauguauaa

SEQ ID NO: 4046321 - RNA, 20 nt, Staphylococcus aureus subsp. aureus N315
aauauaauguauaaaacaga

SEQ ID NO: 4046322 - RNA, 23 nt, Staphylococcus aureus subsp. aureus N315
aauauaauuaaacauuuagauuu

SEQ ID NO: 4046323 - RNA, 18 nt, Staphylococcus aureus subsp. aureus N315
aauauaauuaauuuugua

SEQ ID NO: 4046324 - RNA, 13 nt, Staphylococcus aureus subsp. aureus N315
aauauaauuauua

SEQ ID NO: 4046325 - RNA, 13 nt, Staphylococcus aureus subsp. aureus N315
aauauaauuuuuu

SEQ ID NO: 4046326 - RNA, 12 nt, Staphylococcus aureus subsp. aureus N315
aauauacaauag

SEQ ID NO: 4046327 - RNA, 15 nt, Staphylococcus aureus subsp. aureus N315
aauauacacaaaaag

SEQ ID NO: 4046328 - RNA, 23 nt, Staphylococcus aureus subsp. aureus N315
aauauacacaaaaagacuuccaa

SEQ ID NO: 4046329 - RNA, 15 nt, Staphylococcus aureus subsp. aureus N315
aauauacuaaaguuc

SEQ ID NO: 4046330 - RNA, 22 nt, Staphylococcus aureus subsp. aureus N315
aauauacuugaagcaucgauuu

SEQ ID NO: 4046331 - RNA, 11 nt, Staphylococcus aureus subsp. aureus N315
aauauacuuuu

SEQ ID NO: 4046332 - RNA, 21 nt, Staphylococcus aureus subsp. aureus N315
aauauagaagugcgguuuaau

SEQ ID NO: 4046333 - RNA, 15 nt, Staphylococcus aureus subsp. aureus N315
aauauagauuuugua

SEQ ID NO: 4046334 - RNA, 18 nt, Staphylococcus aureus subsp. aureus N315
aauauagcuauuacuaua

SEQ ID NO: 4046335 - RNA, 22 nt, Staphylococcus aureus subsp. aureus N315
aauauagcuauuacuauaaaaa

SEQ ID NO: 4046336 - RNA, 22 nt, Staphylococcus aureus subsp. aureus N315
aauauagcugugauuugaucaa

SEQ ID NO: 4046337 - RNA, 16 nt, Staphylococcus aureus subsp. aureus N315
aauauaggcacauucc

SEQ ID NO: 4046338 - RNA, 15 nt, Staphylococcus aureus subsp. aureus N315
aauauaguaauaaaa

SEQ ID NO: 4046339 - RNA, 14 nt, Staphylococcus aureus subsp. aureus N315
aauauaguaauugu

SEQ ID NO: 4046340 - RNA, 22 nt, Staphylococcus aureus subsp. aureus N315
aauauauaaggcgcucucuuuu

SEQ ID NO: 4046341 - RNA, 21 nt, Staphylococcus aureus subsp. aureus N315
aauauauccugccaauauauu

SEQ ID NO: 4046342 - RNA, 23 nt, Staphylococcus aureus subsp. aureus N315
aauauauccugccaauauauuca

SEQ ID NO: 4046343 - RNA, 13 nt, Staphylococcus aureus subsp. aureus N315
aauauauguauaa

SEQ ID NO: 4046344 - RNA, 16 nt, Staphylococcus aureus subsp. aureus N315
aauauauguauaacau

SEQ ID NO: 4046345 - RNA, 22 nt, Staphylococcus aureus subsp. aureus N315
aauauauucggcaaaagauguu

SEQ ID NO: 4046346 - RNA, 20 nt, Staphylococcus aureus subsp. aureus N315
aauauauugucgacuuuuag

SEQ ID NO: 4046347 - RNA, 12 nt, Staphylococcus aureus subsp. aureus N315
aauauauuuaau

SEQ ID NO: 4046348 - RNA, 16 nt, Staphylococcus aureus subsp. aureus N315
aauauauuuaauuaca

SEQ ID NO: 4046349 - RNA, 16 nt, Staphylococcus aureus subsp. aureus N315
aauauauuuauuuuug

SEQ ID NO: 4046350 - RNA, 13 nt, Staphylococcus aureus subsp. aureus N315
aauaucaaaauau

SEQ ID NO: 4046351 - RNA, 14 nt, Staphylococcus aureus subsp. aureus N315
aauaucaaaauaua

SEQ ID NO: 4046352 - RNA, 22 nt, Staphylococcus aureus subsp. aureus N315
aauaucaauuuauuauuaacug

SEQ ID NO: 4046353 - RNA, 22 nt, Staphylococcus aureus subsp. aureus N315
aauaucagguacaaauggaaua

SEQ ID NO: 4046354 - RNA, 16 nt, Staphylococcus aureus subsp. aureus N315
aauaucauauucaaaa

SEQ ID NO: 4046355 - RNA, 23 nt, Staphylococcus aureus subsp. aureus N315
aauaucauauucaaaauaacuua

SEQ ID NO: 4046356 - RNA, 15 nt, Staphylococcus aureus subsp. aureus N315
aauaucauauuugaa

SEQ ID NO: 4046357 - RNA, 20 nt, Staphylococcus aureus subsp. aureus N315
aauaucaucauuuaaauauu

SEQ ID NO: 4046358 - RNA, 12 nt, Staphylococcus aureus subsp. aureus N315
aauauccaaaau

SEQ ID NO: 4046359 - RNA, 20 nt, Staphylococcus aureus subsp. aureus N315
aauaucgauuuuggcacaua

SEQ ID NO: 4046360 - RNA, 16 nt, Staphylococcus aureus subsp. aureus N315
aauaucuaaacaauuc

SEQ ID NO: 4046361 - RNA, 24 nt, Staphylococcus aureus subsp. aureus N315
aauaucuaauucuguuucaaagcu

SEQ ID NO: 4046362 - RNA, 17 nt, Staphylococcus aureus subsp. aureus N315
aauaucuaccuuuuaau

SEQ ID NO: 4046363 - RNA, 15 nt, Staphylococcus aureus subsp. aureus N315
aauaucugucaaagg

SEQ ID NO: 4046364 - RNA, 22 nt, Staphylococcus aureus subsp. aureus N315
aauaucuguugcauuaagugca

SEQ ID NO: 4046365 - RNA, 17 nt, Staphylococcus aureus subsp. aureus N315
aauaucuuaaagaauua

SEQ ID NO: 4046366 - RNA, 23 nt, Staphylococcus aureus subsp. aureus N315
aauaucuuacugcuguuuuuuau

SEQ ID NO: 4046367 - RNA, 13 nt, Staphylococcus aureus subsp. aureus N315
aauaucuucuuua

SEQ ID NO: 4046368 - RNA, 13 nt, Staphylococcus aureus subsp. aureus N315
aauaucuugucau

SEQ ID NO: 4046369 - RNA, 23 nt, Staphylococcus aureus subsp. aureus N315
aauaugaacaaaaaauaaaaacu

SEQ ID NO: 4046370 - RNA, 16 nt, Staphylococcus aureus subsp. aureus N315
aauaugaauaaugcaa

SEQ ID NO: 4046371 - RNA, 22 nt, Staphylococcus aureus subsp. aureus N315
aauaugaaucuagaauauaaca

SEQ ID NO: 4046372 - RNA, 20 nt, Staphylococcus aureus subsp. aureus N315
aauaugacgaucuucaugaa

SEQ ID NO: 4046373 - RNA, 16 nt, Staphylococcus aureus subsp. aureus N315
aauaugagauuaucug

SEQ ID NO: 4046374 - RNA, 12 nt, Staphylococcus aureus subsp. aureus N315
aauaugauauua

SEQ ID NO: 4046375 - RNA, 21 nt, Staphylococcus aureus subsp. aureus N315
aauaugauccuuuaaugcuuu

SEQ ID NO: 4046376 - RNA, 17 nt, Staphylococcus aureus subsp. aureus N315
aauaugauuaauaaagu

SEQ ID NO: 4046377 - RNA, 22 nt, Staphylococcus aureus subsp. aureus N315
aauaugauugcaaauuaucauu

SEQ ID NO: 4046378 - RNA, 15 nt, Staphylococcus aureus subsp. aureus N315
aauaugcccccuaau

SEQ ID NO: 4046379 - RNA, 23 nt, Staphylococcus aureus subsp. aureus N315
aauauggaauuucauauaaugaa

SEQ ID NO: 4046380 - RNA, 15 nt, Staphylococcus aureus subsp. aureus N315
aauauguguuaacug

SEQ ID NO: 4046381 - RNA, 18 nt, Staphylococcus aureus subsp. aureus N315
aauauuaaaauuaaaacu

SEQ ID NO: 4046382 - RNA, 14 nt, Staphylococcus aureus subsp. aureus N315
aauauuaaauucau

SEQ ID NO: 4046383 - RNA, 16 nt, Staphylococcus aureus subsp. aureus N315
aauauuaaauucaucu

SEQ ID NO: 4046384 - RNA, 14 nt, Staphylococcus aureus subsp. aureus N315
aauauuaacaccag

SEQ ID NO: 4046385 - RNA, 18 nt, Staphylococcus aureus subsp. aureus N315
aauauuaauauaaaauaa

SEQ ID NO: 4046386 - RNA, 13 nt, Staphylococcus aureus subsp. aureus N315
aauauuaaugaau

SEQ ID NO: 4046387 - RNA, 14 nt, Staphylococcus aureus subsp. aureus N315
aauauuacuuuauc

SEQ ID NO: 4046388 - RNA, 19 nt, Staphylococcus aureus subsp. aureus N315
aauauuacuuuaucucauu

SEQ ID NO: 4046389 - RNA, 17 nt, Staphylococcus aureus subsp. aureus N315
aauauuagaacauuuau

SEQ ID NO: 4046390 - RNA, 13 nt, Staphylococcus aureus subsp. aureus N315
aauauuauuuuua

SEQ ID NO: 4046391 - RNA, 16 nt, Staphylococcus aureus subsp. aureus N315
aauauucaauaauuca

SEQ ID NO: 4046392 - RNA, 17 nt, Staphylococcus aureus subsp. aureus N315
aauauucacgacuugau

SEQ ID NO: 4046393 - RNA, 20 nt, Staphylococcus aureus subsp. aureus N315
aauauucgauacauaaaaca

SEQ ID NO: 4046394 - RNA, 22 nt, Staphylococcus aureus subsp. aureus N315
aauauucuaugcucuacgaagu

SEQ ID NO: 4046395 - RNA, 19 nt, Staphylococcus aureus subsp. aureus N315
aauauucuuaucauucauu

SEQ ID NO: 4046396 - RNA, 15 nt, Staphylococcus aureus subsp. aureus N315
aauauugaacaauuu

SEQ ID NO: 4046397 - RNA, 18 nt, Staphylococcus aureus subsp. aureus N315
aauauugaacaauuuuug

SEQ ID NO: 4046398 - RNA, 18 nt, Staphylococcus aureus subsp. aureus N315
aauauugaagaugcuuua

SEQ ID NO: 4046399 - RNA, 17 nt, Staphylococcus aureus subsp. aureus N315
aauauugaauaaucauc

SEQ ID NO: 4046400 - RNA, 19 nt, Staphylococcus aureus subsp. aureus N315
aauauugaauauaaaaaac

SEQ ID NO: 4046401 - RNA, 14 nt, Staphylococcus aureus subsp. aureus N315
aauauugacauuua

SEQ ID NO: 4046402 - RNA, 14 nt, Staphylococcus aureus subsp. aureus N315
aauauugaugaaua

SEQ ID NO: 4046403 - RNA, 17 nt, Staphylococcus aureus subsp. aureus N315
aauauuuaaauuuuaag

SEQ ID NO: 4046404 - RNA, 18 nt, Staphylococcus aureus subsp. aureus N315
aauauuuaaauuuuaagu

SEQ ID NO: 4046405 - RNA, 18 nt, Staphylococcus aureus subsp. aureus N315
aauauuuaaccuuuaaaa

SEQ ID NO: 4046406 - RNA, 14 nt, Staphylococcus aureus subsp. aureus N315
aauauuuaaguuuc

SEQ ID NO: 4046407 - RNA, 14 nt, Staphylococcus aureus subsp. aureus N315
aauauuuaccacaa

SEQ ID NO: 4046408 - RNA, 21 nt, Staphylococcus aureus subsp. aureus N315
aauauuuagauuggucaaacu

SEQ ID NO: 4046409 - RNA, 17 nt, Staphylococcus aureus subsp. aureus N315
aauauuuauauuaaaua

SEQ ID NO: 4046410 - RNA, 19 nt, Staphylococcus aureus subsp. aureus N315
aauauuuauauuaaauacu

SEQ ID NO: 4046411 - RNA, 22 nt, Staphylococcus aureus subsp. aureus N315
aauauuuauauuaaauacuaua

SEQ ID NO: 4046412 - RNA, 21 nt, Staphylococcus aureus subsp. aureus N315
aauauuuaucaauaaaucagu

SEQ ID NO: 4046413 - RNA, 19 nt, Staphylococcus aureus subsp. aureus N315
aauauuucccuaugaaaua

SEQ ID NO: 4046414 - RNA, 20 nt, Staphylococcus aureus subsp. aureus N315
aauauuucccuaugaaauaa

SEQ ID NO: 4046415 - RNA, 17 nt, Staphylococcus aureus subsp. aureus N315
aauauuucuaaaccauu

SEQ ID NO: 4046416 - RNA, 21 nt, Staphylococcus aureus subsp. aureus N315
aauauuucuaaaccauuuuca

SEQ ID NO: 4046417 - RNA, 21 nt, Staphylococcus aureus subsp. aureus N315
aauauuucuuagauacucacu

SEQ ID NO: 4046418 - RNA, 15 nt, Staphylococcus aureus subsp. aureus N315
aauauuugaaaauuu

SEQ ID NO: 4046419 - RNA, 12 nt, Staphylococcus aureus subsp. aureus N315
aauauuugauaa

SEQ ID NO: 4046420 - RNA, 22 nt, Staphylococcus aureus subsp. aureus N315
aauauuugauaaguagaaaaua

SEQ ID NO: 4046421 - RNA, 17 nt, Staphylococcus aureus subsp. aureus N315
aauauuuuacaaaauau

SEQ ID NO: 4046422 - RNA, 22 nt, Staphylococcus aureus subsp. aureus N315
aauauuuucauguccaucuuuu

SEQ ID NO: 4046423 - RNA, 22 nt, Staphylococcus aureus subsp. aureus N315
aauauuuucuuagaaaaucaag

SEQ ID NO: 4046424 - RNA, 20 nt, Staphylococcus aureus subsp. aureus N315
aauauuuuuacauauuuaua

SEQ ID NO: 4046425 - RNA, 23 nt, Staphylococcus aureus subsp. aureus N315
aauauuuuuguugcaauugccuu

SEQ ID NO: 4046426 - RNA, 13 nt, Staphylococcus aureus subsp. aureus N315
aauauuuuuuaaa

SEQ ID NO: 4046427 - RNA, 17 nt, Staphylococcus aureus subsp. aureus N315
aauauuuuuuaaaauga

SEQ ID NO: 4046428 - RNA, 15 nt, Staphylococcus aureus subsp. aureus N315
aaucaaaaaagacau

SEQ ID NO: 4046429 - RNA, 13 nt, Staphylococcus aureus subsp. aureus N315
aaucaaaaauaau

SEQ ID NO: 4046430 - RNA, 23 nt, Staphylococcus aureus subsp. aureus N315
aaucaaaaauaauuaugaaaagu

SEQ ID NO: 4046431 - RNA, 21 nt, Staphylococcus aureus subsp. aureus N315
aaucaaagaggaacagcggaa

SEQ ID NO: 4046432 - RNA, 21 nt, Staphylococcus aureus subsp. aureus N315
aaucaaagaggcuuuaaaauu

SEQ ID NO: 4046433 - RNA, 22 nt, Staphylococcus aureus subsp. aureus N315
aaucaaagauuuauaaauguuu

SEQ ID NO: 4046434 - RNA, 23 nt, Staphylococcus aureus subsp. aureus N315
aaucaaagggcuucgauucauaa

SEQ ID NO: 4046435 - RNA, 22 nt, Staphylococcus aureus subsp. aureus N315
aaucaaaguucguaauugucuu

SEQ ID NO: 4046436 - RNA, 14 nt, Staphylococcus aureus subsp. aureus N315
aaucaaauacauca

SEQ ID NO: 4046437 - RNA, 20 nt, Staphylococcus aureus subsp. aureus N315
aaucaaauuagucauccaaa

SEQ ID NO: 4046438 - RNA, 20 nt, Staphylococcus aureus subsp. aureus N315
aaucaacaagaacuuagaaa

SEQ ID NO: 4046439 - RNA, 17 nt, Staphylococcus aureus subsp. aureus N315
aaucaacaguuuuauua

SEQ ID NO: 4046440 - RNA, 12 nt, Staphylococcus aureus subsp. aureus N315
aaucaacaucau

SEQ ID NO: 4046441 - RNA, 21 nt, Staphylococcus aureus subsp. aureus N315
aaucaacaucaucuuuaauuu

SEQ ID NO: 4046442 - RNA, 16 nt, Staphylococcus aureus subsp. aureus N315
aaucaaccuuugcuaa

SEQ ID NO: 4046443 - RNA, 19 nt, Staphylococcus aureus subsp. aureus N315
aaucaacguauauaaguua

SEQ ID NO: 4046444 - RNA, 22 nt, Staphylococcus aureus subsp. aureus N315
aaucaacguauauaaguuaaaa

SEQ ID NO: 4046445 - RNA, 22 nt, Staphylococcus aureus subsp. aureus N315
aaucaacuuagaauuuacaagu

SEQ ID NO: 4046446 - RNA, 23 nt, Staphylococcus aureus subsp. aureus N315
aaucaacuuuuuguuaauuuuuu

SEQ ID NO: 4046447 - RNA, 12 nt, Staphylococcus aureus subsp. aureus N315
aaucaagaauau

SEQ ID NO: 4046448 - RNA, 19 nt, Staphylococcus aureus subsp. aureus N315
aaucaagcaaugcaugcuu

SEQ ID NO: 4046449 - RNA, 18 nt, Staphylococcus aureus subsp. aureus N315
aaucaagucugcauuaau

SEQ ID NO: 4046450 - RNA, 12 nt, Staphylococcus aureus subsp. aureus N315
aaucaauacuaa

SEQ ID NO: 4046451 - RNA, 17 nt, Staphylococcus aureus subsp. aureus N315
aaucaauccaucaauac

SEQ ID NO: 4046452 - RNA, 13 nt, Staphylococcus aureus subsp. aureus N315
aaucaauuauuga

SEQ ID NO: 4046453 - RNA, 18 nt, Staphylococcus aureus subsp. aureus N315
aaucaauugcauacguaa

SEQ ID NO: 4046454 - RNA, 18 nt, Staphylococcus aureus subsp. aureus N315
aaucacaaauucaacuuu

SEQ ID NO: 4046455 - RNA, 14 nt, Staphylococcus aureus subsp. aureus N315
aaucacauaugaua

SEQ ID NO: 4046456 - RNA, 22 nt, Staphylococcus aureus subsp. aureus N315
aaucacauuaauuggauuaaau

SEQ ID NO: 4046457 - RNA, 18 nt, Staphylococcus aureus subsp. aureus N315
aaucaccucaauaugagu

SEQ ID NO: 4046458 - RNA, 22 nt, Staphylococcus aureus subsp. aureus N315
aaucaccuuauugaugaaaaca

SEQ ID NO: 4046459 - RNA, 17 nt, Staphylococcus aureus subsp. aureus N315
aaucaccuuuuuuaacu

SEQ ID NO: 4046460 - RNA, 15 nt, Staphylococcus aureus subsp. aureus N315
aaucacgauuuucaa

SEQ ID NO: 4046461 - RNA, 14 nt, Staphylococcus aureus subsp. aureus N315
aaucacgcuaacau

SEQ ID NO: 4046462 - RNA, 23 nt, Staphylococcus aureus subsp. aureus N315
aaucacuaucuguuguuauauaa

SEQ ID NO: 4046463 - RNA, 21 nt, Staphylococcus aureus subsp. aureus N315
aaucacuccucuauuuuauga

SEQ ID NO: 4046464 - RNA, 15 nt, Staphylococcus aureus subsp. aureus N315
aaucacugcuuucaa

SEQ ID NO: 4046465 - RNA, 21 nt, Staphylococcus aureus subsp. aureus N315
aaucacuuggcgacauuugua

SEQ ID NO: 4046466 - RNA, 23 nt, Staphylococcus aureus subsp. aureus N315
aaucacuuggcgacauuuguaaa

SEQ ID NO: 4046467 - RNA, 18 nt, Staphylococcus aureus subsp. aureus N315
aaucagaaggcuguucug

SEQ ID NO: 4046468 - RNA, 20 nt, Staphylococcus aureus subsp. aureus N315
aaucagaaggcuguucugga

SEQ ID NO: 4046469 - RNA, 18 nt, Staphylococcus aureus subsp. aureus N315
aaucagaugauuuaauuc

SEQ ID NO: 4046470 - RNA, 17 nt, Staphylococcus aureus subsp. aureus N315
aaucagcuuuuucacau

SEQ ID NO: 4046471 - RNA, 19 nt, Staphylococcus aureus subsp. aureus N315
aaucagguuuaaacaguuu

SEQ ID NO: 4046472 - RNA, 22 nt, Staphylococcus aureus subsp. aureus N315
aaucagguuuaaacaguuuaau

SEQ ID NO: 4046473 - RNA, 17 nt, Staphylococcus aureus subsp. aureus N315
aaucaguaauaucaagg

SEQ ID NO: 4046474 - RNA, 19 nt, Staphylococcus aureus subsp. aureus N315
aaucaguaguuuuaaaagu

SEQ ID NO: 4046475 - RNA, 21 nt, Staphylococcus aureus subsp. aureus N315
aaucaguauaaucagcaaugu

SEQ ID NO: 4046476 - RNA, 16 nt, Staphylococcus aureus subsp. aureus N315
aaucagucauucacau

SEQ ID NO: 4046477 - RNA, 16 nt, Staphylococcus aureus subsp. aureus N315
aaucagugaaauauca

SEQ ID NO: 4046478 - RNA, 20 nt, Staphylococcus aureus subsp. aureus N315
aaucagugaaauaucaagau

SEQ ID NO: 4046479 - RNA, 15 nt, Staphylococcus aureus subsp. aureus N315
aaucaguuuuugaau

SEQ ID NO: 4046480 - RNA, 21 nt, Staphylococcus aureus subsp. aureus N315
aaucauaauacuucucaauuu

SEQ ID NO: 4046481 - RNA, 13 nt, Staphylococcus aureus subsp. aureus N315
aaucauaaugaau

SEQ ID NO: 4046482 - RNA, 23 nt, Staphylococcus aureus subsp. aureus N315
aaucauaaugaauaauuaaaaaa

SEQ ID NO: 4046483 - RNA, 23 nt, Staphylococcus aureus subsp. aureus N315
aaucauaccggcaaauaacaaug

SEQ ID NO: 4046484 - RNA, 20 nt, Staphylococcus aureus subsp. aureus N315
aaucauacgagaaauuagaa

SEQ ID NO: 4046485 - RNA, 20 nt, Staphylococcus aureus subsp. aureus N315
aaucauagaggcacagugga

SEQ ID NO: 4046486 - RNA, 20 nt, Staphylococcus aureus subsp. aureus N315
aaucauagcaacaucggcac

SEQ ID NO: 4046487 - RNA, 16 nt, Staphylococcus aureus subsp. aureus N315
aaucauagcauuaaga

SEQ ID NO: 4046488 - RNA, 17 nt, Staphylococcus aureus subsp. aureus N315
aaucauagcauuaagau

SEQ ID NO: 4046489 - RNA, 12 nt, Staphylococcus aureus subsp. aureus N315
aaucaucacaca

SEQ ID NO: 4046490 - RNA, 19 nt, Staphylococcus aureus subsp. aureus N315
aaucaucacacauaaaugu

SEQ ID NO: 4046491 - RNA, 12 nt, Staphylococcus aureus subsp. aureus N315
aaucaucauugc

SEQ ID NO: 4046492 - RNA, 16 nt, Staphylococcus aureus subsp. aureus N315
aaucauccauaaaaau

SEQ ID NO: 4046493 - RNA, 18 nt, Staphylococcus aureus subsp. aureus N315
aaucaucguauuucauau

SEQ ID NO: 4046494 - RNA, 15 nt, Staphylococcus aureus subsp. aureus N315
aaucaucuuuuugaa

SEQ ID NO: 4046495 - RNA, 17 nt, Staphylococcus aureus subsp. aureus N315
aaucaugaaauaaaaaa

SEQ ID NO: 4046496 - RNA, 21 nt, Staphylococcus aureus subsp. aureus N315
aaucaugaaauaaaaaaacac

SEQ ID NO: 4046497 - RNA, 22 nt, Staphylococcus aureus subsp. aureus N315
aaucaugaaauaaaaaaacacc

SEQ ID NO: 4046498 - RNA, 23 nt, Staphylococcus aureus subsp. aureus N315
aaucauguaaugcuuaaaaacaa

SEQ ID NO: 4046499 - RNA, 13 nt, Staphylococcus aureus subsp. aureus N315
aaucauuauagca

SEQ ID NO: 4046500 - RNA, 14 nt, Staphylococcus aureus subsp. aureus N315
aaucauucacuuca

SEQ ID NO: 4046501 - RNA, 21 nt, Staphylococcus aureus subsp. aureus N315
aaucauucauggccaaauguu

SEQ ID NO: 4046502 - RNA, 15 nt, Staphylococcus aureus subsp. aureus N315
aaucauucguuuaau

SEQ ID NO: 4046503 - RNA, 21 nt, Staphylococcus aureus subsp. aureus N315
aaucauucuuuauagaaacca

SEQ ID NO: 4046504 - RNA, 18 nt, Staphylococcus aureus subsp. aureus N315
aaucauugguuucaucau

SEQ ID NO: 4046505 - RNA, 12 nt, Staphylococcus aureus subsp. aureus N315
aaucauuuaaau

SEQ ID NO: 4046506 - RNA, 16 nt, Staphylococcus aureus subsp. aureus N315
aaucauuuauguagau

SEQ ID NO: 4046507 - RNA, 23 nt, Staphylococcus aureus subsp. aureus N315
aaucauuuguguauaaaugucau

SEQ ID NO: 4046508 - RNA, 21 nt, Staphylococcus aureus subsp. aureus N315
aauccaaaaucuuuacuugua

SEQ ID NO: 4046509 - RNA, 18 nt, Staphylococcus aureus subsp. aureus N315
aauccaagauauauaacu

SEQ ID NO: 4046510 - RNA, 16 nt, Staphylococcus aureus subsp. aureus N315
aauccaagcaaucuua

SEQ ID NO: 4046511 - RNA, 17 nt, Staphylococcus aureus subsp. aureus N315
aauccaagcaaucuuag

SEQ ID NO: 4046512 - RNA, 17 nt, Staphylococcus aureus subsp. aureus N315
aauccaauauacaaugc

SEQ ID NO: 4046513 - RNA, 18 nt, Staphylococcus aureus subsp. aureus N315
aauccaauuaaauauuua

SEQ ID NO: 4046514 - RNA, 21 nt, Staphylococcus aureus subsp. aureus N315
aauccagccacaccaaauugg

SEQ ID NO: 4046515 - RNA, 13 nt, Staphylococcus aureus subsp. aureus N315
aauccaguaauca

SEQ ID NO: 4046516 - RNA, 23 nt, Staphylococcus aureus subsp. aureus N315
aauccaucaauaccauaauuaaa

SEQ ID NO: 4046517 - RNA, 19 nt, Staphylococcus aureus subsp. aureus N315
aauccaucuaauucaaugu

SEQ ID NO: 4046518 - RNA, 18 nt, Staphylococcus aureus subsp. aureus N315
aauccauucuucuuguuu

SEQ ID NO: 4046519 - RNA, 22 nt, Staphylococcus aureus subsp. aureus N315
aaucccaaguuacaauaucaua

SEQ ID NO: 4046520 - RNA, 23 nt, Staphylococcus aureus subsp. aureus N315
aaucccauaccuacaaauaugua

SEQ ID NO: 4046521 - RNA, 18 nt, Staphylococcus aureus subsp. aureus N315
aaucccaucgcuuuuucc

SEQ ID NO: 4046522 - RNA, 20 nt, Staphylococcus aureus subsp. aureus N315
aaucccuucaaaauuuugac

SEQ ID NO: 4046523 - RNA, 21 nt, Staphylococcus aureus subsp. aureus N315
aauccgauucacucuguaaua

SEQ ID NO: 4046524 - RNA, 20 nt, Staphylococcus aureus subsp. aureus N315
aauccgauuuugauauaaaa

SEQ ID NO: 4046525 - RNA, 22 nt, Staphylococcus aureus subsp. aureus N315
aauccucacaaauuugaauaua

SEQ ID NO: 4046526 - RNA, 13 nt, Staphylococcus aureus subsp. aureus N315
aauccucacuaac

SEQ ID NO: 4046527 - RNA, 23 nt, Staphylococcus aureus subsp. aureus N315
aauccucaguuauaccauauuua

SEQ ID NO: 4046528 - RNA, 21 nt, Staphylococcus aureus subsp. aureus N315
aauccucuaacgguauaucau

SEQ ID NO: 4046529 - RNA, 17 nt, Staphylococcus aureus subsp. aureus N315
aauccuuggaaacgaua

SEQ ID NO: 4046530 - RNA, 20 nt, Staphylococcus aureus subsp. aureus N315
aauccuuuauauuuaguuag

SEQ ID NO: 4046531 - RNA, 17 nt, Staphylococcus aureus subsp. aureus N315
aauccuuuguuuguaag

SEQ ID NO: 4046532 - RNA, 12 nt, Staphylococcus aureus subsp. aureus N315
aaucgaaaauau

SEQ ID NO: 4046533 - RNA, 17 nt, Staphylococcus aureus subsp. aureus N315
aaucgaaaauaucaauu

SEQ ID NO: 4046534 - RNA, 14 nt, Staphylococcus aureus subsp. aureus N315
aaucgaacagaaaa

SEQ ID NO: 4046535 - RNA, 20 nt, Staphylococcus aureus subsp. aureus N315
aaucgaagggcggucaauuu

SEQ ID NO: 4046536 - RNA, 14 nt, Staphylococcus aureus subsp. aureus N315
aaucgauaacaguu

SEQ ID NO: 4046537 - RNA, 15 nt, Staphylococcus aureus subsp. aureus N315
aaucgauauaaugaa

SEQ ID NO: 4046538 - RNA, 16 nt, Staphylococcus aureus subsp. aureus N315
aaucgcagcaaugaca

SEQ ID NO: 4046539 - RNA, 14 nt, Staphylococcus aureus subsp. aureus N315
aaucgccauugucc

SEQ ID NO: 4046540 - RNA, 23 nt, Staphylococcus aureus subsp. aureus N315
aaucgcuucgguuaacuguucua

SEQ ID NO: 4046541 - RNA, 18 nt, Staphylococcus aureus subsp. aureus N315
aaucggaauaaaauaaau

SEQ ID NO: 4046542 - RNA, 19 nt, Staphylococcus aureus subsp. aureus N315
aaucggacagaggagcuca

SEQ ID NO: 4046543 - RNA, 20 nt, Staphylococcus aureus subsp. aureus N315
aaucguaacauaucagcuuu

SEQ ID NO: 4046544 - RNA, 17 nt, Staphylococcus aureus subsp. aureus N315
aaucguauuuuuaagcu

SEQ ID NO: 4046545 - RNA, 14 nt, Staphylococcus aureus subsp. aureus N315
aaucguuaaggaaa

SEQ ID NO: 4046546 - RNA, 17 nt, Staphylococcus aureus subsp. aureus N315
aaucguuuuuacuguaa

SEQ ID NO: 4046547 - RNA, 16 nt, Staphylococcus aureus subsp. aureus N315
aaucuaaacuauaaua

SEQ ID NO: 4046548 - RNA, 19 nt, Staphylococcus aureus subsp. aureus N315
aaucuaaggccauuuguag

SEQ ID NO: 4046549 - RNA, 14 nt, Staphylococcus aureus subsp. aureus N315
aaucuaauacauac

SEQ ID NO: 4046550 - RNA, 18 nt, Staphylococcus aureus subsp. aureus N315
aaucuaauccugguauaa

SEQ ID NO: 4046551 - RNA, 12 nt, Staphylococcus aureus subsp. aureus N315
aaucuacaauau

SEQ ID NO: 4046552 - RNA, 15 nt, Staphylococcus aureus subsp. aureus N315
aaucuauaccauucc

SEQ ID NO: 4046553 - RNA, 13 nt, Staphylococcus aureus subsp. aureus N315
aaucuauauaaag

SEQ ID NO: 4046554 - RNA, 21 nt, Staphylococcus aureus subsp. aureus N315
aaucuauauaaaguugacaau

SEQ ID NO: 4046555 - RNA, 12 nt, Staphylococcus aureus subsp. aureus N315
aaucuauauaua

SEQ ID NO: 4046556 - RNA, 14 nt, Staphylococcus aureus subsp. aureus N315
aaucuauugcaaua

SEQ ID NO: 4046557 - RNA, 16 nt, Staphylococcus aureus subsp. aureus N315
aaucuauugugauaua

SEQ ID NO: 4046558 - RNA, 13 nt, Staphylococcus aureus subsp. aureus N315
aaucuauuuuaaa

SEQ ID NO: 4046559 - RNA, 16 nt, Staphylococcus aureus subsp. aureus N315
aaucuauuuuaaacuc

SEQ ID NO: 4046560 - RNA, 19 nt, Staphylococcus aureus subsp. aureus N315
aaucuauuuucugccauaa

SEQ ID NO: 4046561 - RNA, 19 nt, Staphylococcus aureus subsp. aureus N315
aaucucaacagcaaaaaau

SEQ ID NO: 4046562 - RNA, 16 nt, Staphylococcus aureus subsp. aureus N315
aaucucauaauaauuc

SEQ ID NO: 4046563 - RNA, 17 nt, Staphylococcus aureus subsp. aureus N315
aaucucauucuuuaaua

SEQ ID NO: 4046564 - RNA, 18 nt, Staphylococcus aureus subsp. aureus N315
aaucuccauuaaucauuu

SEQ ID NO: 4046565 - RNA, 22 nt, Staphylococcus aureus subsp. aureus N315
aaucuccauuuaaggauuuccu

SEQ ID NO: 4046566 - RNA, 23 nt, Staphylococcus aureus subsp. aureus N315
aaucuccuugcucaugagcacaa

SEQ ID NO: 4046567 - RNA, 20 nt, Staphylococcus aureus subsp. aureus N315
aaucucgucacauauaaaua

SEQ ID NO: 4046568 - RNA, 16 nt, Staphylococcus aureus subsp. aureus N315
aaucucuuuacaccau

SEQ ID NO: 4046569 - RNA, 16 nt, Staphylococcus aureus subsp. aureus N315
aaucugauucauuaaa

SEQ ID NO: 4046570 - RNA, 15 nt, Staphylococcus aureus subsp. aureus N315
aaucugcaaaugccu

SEQ ID NO: 4046571 - RNA, 19 nt, Staphylococcus aureus subsp. aureus N315
aaucugcaacgauuuuaaa

SEQ ID NO: 4046572 - RNA, 20 nt, Staphylococcus aureus subsp. aureus N315
aaucugcaacgauuuuaaaa

SEQ ID NO: 4046573 - RNA, 21 nt, Staphylococcus aureus subsp. aureus N315
aaucugcuuuauuuuaucauc

SEQ ID NO: 4046574 - RNA, 20 nt, Staphylococcus aureus subsp. aureus N315
aaucuguacuucuaauuugc

SEQ ID NO: 4046575 - RNA, 21 nt, Staphylococcus aureus subsp. aureus N315
aaucuguuuaaauuuaaaaga

SEQ ID NO: 4046576 - RNA, 14 nt, Staphylococcus aureus subsp. aureus N315
aaucuuaauugucu

SEQ ID NO: 4046577 - RNA, 17 nt, Staphylococcus aureus subsp. aureus N315
aaucuuaguacaaaauu

SEQ ID NO: 4046578 - RNA, 18 nt, Staphylococcus aureus subsp. aureus N315
aaucuuaguacaaaauug

SEQ ID NO: 4046579 - RNA, 22 nt, Staphylococcus aureus subsp. aureus N315
aaucuuauuuuguuuuaaaaaa

SEQ ID NO: 4046580 - RNA, 23 nt, Staphylococcus aureus subsp. aureus N315
aaucuuauuuuguuuuaaaaaac

SEQ ID NO: 4046581 - RNA, 17 nt, Staphylococcus aureus subsp. aureus N315
aaucuucauuaauuaca

SEQ ID NO: 4046582 - RNA, 15 nt, Staphylococcus aureus subsp. aureus N315
aaucuucuauuuuca

SEQ ID NO: 4046583 - RNA, 20 nt, Staphylococcus aureus subsp. aureus N315
aaucuugauuauauuuuucu

SEQ ID NO: 4046584 - RNA, 17 nt, Staphylococcus aureus subsp. aureus N315
aaucuuguucuaauugu

SEQ ID NO: 4046585 - RNA, 21 nt, Staphylococcus aureus subsp. aureus N315
aaucuuguugaacucugauau

SEQ ID NO: 4046586 - RNA, 18 nt, Staphylococcus aureus subsp. aureus N315
aaucuuguuggauuuuaa

SEQ ID NO: 4046587 - RNA, 19 nt, Staphylococcus aureus subsp. aureus N315
aaucuuuacuuguaauuaa

SEQ ID NO: 4046588 - RNA, 14 nt, Staphylococcus aureus subsp. aureus N315
aaucuuuaucaguu

SEQ ID NO: 4046589 - RNA, 14 nt, Staphylococcus aureus subsp. aureus N315
aaucuuuauuaaua

SEQ ID NO: 4046590 - RNA, 13 nt, Staphylococcus aureus subsp. aureus N315
aaucuuuguuaua

SEQ ID NO: 4046591 - RNA, 20 nt, Staphylococcus aureus subsp. aureus N315
aaucuuuguuauauuuuuag

SEQ ID NO: 4046592 - RNA, 12 nt, Staphylococcus aureus subsp. aureus N315
aaucuuuuaacu

SEQ ID NO: 4046593 - RNA, 13 nt, Staphylococcus aureus subsp. aureus N315
aaucuuuuaacuu

SEQ ID NO: 4046594 - RNA, 21 nt, Staphylococcus aureus subsp. aureus N315
aaucuuuugagacguuuucca

SEQ ID NO: 4046595 - RNA, 18 nt, Staphylococcus aureus subsp. aureus N315
aaugaaaacagguggaag

SEQ ID NO: 4046596 - RNA, 18 nt, Staphylococcus aureus subsp. aureus N315
aaugaaaauaagcuugua

SEQ ID NO: 4046597 - RNA, 18 nt, Staphylococcus aureus subsp. aureus N315
aaugaaaccguauuauug

SEQ ID NO: 4046598 - RNA, 19 nt, Staphylococcus aureus subsp. aureus N315
aaugaaaguaccuaaaaua

SEQ ID NO: 4046599 - RNA, 20 nt, Staphylococcus aureus subsp. aureus N315
aaugaaaguaccuaaaauag

SEQ ID NO: 4046600 - RNA, 23 nt, Staphylococcus aureus subsp. aureus N315
aaugaaaguaccuaaaauagaaa

SEQ ID NO: 4046601 - RNA, 20 nt, Staphylococcus aureus subsp. aureus N315
aaugaaaugaaguauggaag

SEQ ID NO: 4046602 - RNA, 17 nt, Staphylococcus aureus subsp. aureus N315
aaugaaccagcuaacca

SEQ ID NO: 4046603 - RNA, 18 nt, Staphylococcus aureus subsp. aureus N315
aaugaaccagcuaaccaa

SEQ ID NO: 4046604 - RNA, 20 nt, Staphylococcus aureus subsp. aureus N315
aaugaaccagcuaaccaaau

SEQ ID NO: 4046605 - RNA, 23 nt, Staphylococcus aureus subsp. aureus N315
aaugaaccuuuacucauauugaa

SEQ ID NO: 4046606 - RNA, 18 nt, Staphylococcus aureus subsp. aureus N315
aaugaacuucucuuaguu

SEQ ID NO: 4046607 - RNA, 12 nt, Staphylococcus aureus subsp. aureus N315
aaugaagaauac

SEQ ID NO: 4046608 - RNA, 18 nt, Staphylococcus aureus subsp. aureus N315
aaugaagaauacaaauau

SEQ ID NO: 4046609 - RNA, 18 nt, Staphylococcus aureus subsp. aureus N315
aaugaaguaauauauaaa

SEQ ID NO: 4046610 - RNA, 21 nt, Staphylococcus aureus subsp. aureus N315
aaugaaguaauauauaaaagu

SEQ ID NO: 4046611 - RNA, 15 nt, Staphylococcus aureus subsp. aureus N315
aaugaauaauuaaaa

SEQ ID NO: 4046612 - RNA, 14 nt, Staphylococcus aureus subsp. aureus N315
aaugaauaauucca

SEQ ID NO: 4046613 - RNA, 12 nt, Staphylococcus aureus subsp. aureus N315
aaugaauaauug

SEQ ID NO: 4046614 - RNA, 21 nt, Staphylococcus aureus subsp. aureus N315
aaugaauaauugcuaaaauau

SEQ ID NO: 4046615 - RNA, 19 nt, Staphylococcus aureus subsp. aureus N315
aaugaauaguaaucagcuu

SEQ ID NO: 4046616 - RNA, 16 nt, Staphylococcus aureus subsp. aureus N315
aaugaaugaagacgaa

SEQ ID NO: 4046617 - RNA, 13 nt, Staphylococcus aureus subsp. aureus N315
aaugaauguuaag

SEQ ID NO: 4046618 - RNA, 19 nt, Staphylococcus aureus subsp. aureus N315
aaugaauuauuuaaaaugc

SEQ ID NO: 4046619 - RNA, 17 nt, Staphylococcus aureus subsp. aureus N315
aaugaauucuauccuaa

SEQ ID NO: 4046620 - RNA, 12 nt, Staphylococcus aureus subsp. aureus N315
aaugaauugcuu

SEQ ID NO: 4046621 - RNA, 21 nt, Staphylococcus aureus subsp. aureus N315
aaugacagcagacuucuuuca

SEQ ID NO: 4046622 - RNA, 17 nt, Staphylococcus aureus subsp. aureus N315
aaugacauccauacaaa

SEQ ID NO: 4046623 - RNA, 21 nt, Staphylococcus aureus subsp. aureus N315
aaugacauuuaauacuuuucu

SEQ ID NO: 4046624 - RNA, 15 nt, Staphylococcus aureus subsp. aureus N315
aaugaccauugucau

SEQ ID NO: 4046625 - RNA, 20 nt, Staphylococcus aureus subsp. aureus N315
aaugaccauugucaugccuu

SEQ ID NO: 4046626 - RNA, 15 nt, Staphylococcus aureus subsp. aureus N315
aaugaccuggaauau

SEQ ID NO: 4046627 - RNA, 18 nt, Staphylococcus aureus subsp. aureus N315
aaugacuaugcaaaugaa

SEQ ID NO: 4046628 - RNA, 19 nt, Staphylococcus aureus subsp. aureus N315
aaugacuaugcaaaugaaa

SEQ ID NO: 4046629 - RNA, 14 nt, Staphylococcus aureus subsp. aureus N315
aaugacugaauuaa

SEQ ID NO: 4046630 - RNA, 16 nt, Staphylococcus aureus subsp. aureus N315
aaugacugagaaaaau

SEQ ID NO: 4046631 - RNA, 20 nt, Staphylococcus aureus subsp. aureus N315
aaugacuucuuuauauuuau

SEQ ID NO: 4046632 - RNA, 15 nt, Staphylococcus aureus subsp. aureus N315
aaugagaaugugcuu

SEQ ID NO: 4046633 - RNA, 19 nt, Staphylococcus aureus subsp. aureus N315
aaugagcaucuugucuagu

SEQ ID NO: 4046634 - RNA, 18 nt, Staphylococcus aureus subsp. aureus N315
aaugagcuuuucuaaugc

SEQ ID NO: 4046635 - RNA, 14 nt, Staphylococcus aureus subsp. aureus N315
aaugaguacaacau

SEQ ID NO: 4046636 - RNA, 14 nt, Staphylococcus aureus subsp. aureus N315
aaugauaauuuaau

SEQ ID NO: 4046637 - RNA, 19 nt, Staphylococcus aureus subsp. aureus N315
aaugauagaugcuggcuua

SEQ ID NO: 4046638 - RNA, 15 nt, Staphylococcus aureus subsp. aureus N315
aaugauagcuaaaca

SEQ ID NO: 4046639 - RNA, 20 nt, Staphylococcus aureus subsp. aureus N315
aaugauagcuaaacauuuua

SEQ ID NO: 4046640 - RNA, 17 nt, Staphylococcus aureus subsp. aureus N315
aaugauagugaauaaug

SEQ ID NO: 4046641 - RNA, 20 nt, Staphylococcus aureus subsp. aureus N315
aaugauauacuugaagaaaa

SEQ ID NO: 4046642 - RNA, 10 nt, Staphylococcus aureus subsp. aureus N315
aaugauauua

SEQ ID NO: 4046643 - RNA, 23 nt, Staphylococcus aureus subsp. aureus N315
aaugaugaguauacuuacugaaa

SEQ ID NO: 4046644 - RNA, 21 nt, Staphylococcus aureus subsp. aureus N315
aaugaugcacuaaauuagcaa

SEQ ID NO: 4046645 - RNA, 21 nt, Staphylococcus aureus subsp. aureus N315
aaugaugcauaagauuuugaa

SEQ ID NO: 4046646 - RNA, 17 nt, Staphylococcus aureus subsp. aureus N315
aaugauuaaaaaucaaa

SEQ ID NO: 4046647 - RNA, 21 nt, Staphylococcus aureus subsp. aureus N315
aaugauuacuuuaagauuauu

SEQ ID NO: 4046648 - RNA, 22 nt, Staphylococcus aureus subsp. aureus N315
aaugauucuuaucuuuaaucaa

SEQ ID NO: 4046649 - RNA, 22 nt, Staphylococcus aureus subsp. aureus N315
aaugauugaauauuguuguaaa

SEQ ID NO: 4046650 - RNA, 20 nt, Staphylococcus aureus subsp. aureus N315
aaugauugacgauuuaauua

SEQ ID NO: 4046651 - RNA, 17 nt, Staphylococcus aureus subsp. aureus N315
aaugauugcauugauuu

SEQ ID NO: 4046652 - RNA, 15 nt, Staphylococcus aureus subsp. aureus N315
aaugauuugugguaa

SEQ ID NO: 4046653 - RNA, 19 nt, Staphylococcus aureus subsp. aureus N315
aaugauuugugguaaucau

SEQ ID NO: 4046654 - RNA, 13 nt, Staphylococcus aureus subsp. aureus N315
aaugauuuugcuu

SEQ ID NO: 4046655 - RNA, 14 nt, Staphylococcus aureus subsp. aureus N315
aaugauuuugcuuu

SEQ ID NO: 4046656 - RNA, 19 nt, Staphylococcus aureus subsp. aureus N315
aaugcaaaucaaauacauc

SEQ ID NO: 4046657 - RNA, 20 nt, Staphylococcus aureus subsp. aureus N315
aaugcaaaucucgucacaua

SEQ ID NO: 4046658 - RNA, 15 nt, Staphylococcus aureus subsp. aureus N315
aaugcaacuugauca

SEQ ID NO: 4046659 - RNA, 16 nt, Staphylococcus aureus subsp. aureus N315
aaugcaacuugaucau

SEQ ID NO: 4046660 - RNA, 21 nt, Staphylococcus aureus subsp. aureus N315
aaugcaaguuggcggggcccc

SEQ ID NO: 4046661 - RNA, 17 nt, Staphylococcus aureus subsp. aureus N315
aaugcaauacauuaaua

SEQ ID NO: 4046662 - RNA, 21 nt, Staphylococcus aureus subsp. aureus N315
aaugcaauacauuaauauaaa

SEQ ID NO: 4046663 - RNA, 16 nt, Staphylococcus aureus subsp. aureus N315
aaugcaccugugauaa

SEQ ID NO: 4046664 - RNA, 20 nt, Staphylococcus aureus subsp. aureus N315
aaugcacgagcaacaucuuu

SEQ ID NO: 4046665 - RNA, 21 nt, Staphylococcus aureus subsp. aureus N315
aaugcacgagcaacaucuuuu

SEQ ID NO: 4046666 - RNA, 23 nt, Staphylococcus aureus subsp. aureus N315
aaugcagauucuucaccaacuuu

SEQ ID NO: 4046667 - RNA, 20 nt, Staphylococcus aureus subsp. aureus N315
aaugcagcuguauaaccaua

SEQ ID NO: 4046668 - RNA, 19 nt, Staphylococcus aureus subsp. aureus N315
aaugcauccaaauauuaaa

SEQ ID NO: 4046669 - RNA, 21 nt, Staphylococcus aureus subsp. aureus N315
aaugcauguggacguugaucu

SEQ ID NO: 4046670 - RNA, 16 nt, Staphylococcus aureus subsp. aureus N315
aaugcauugcacuugu

SEQ ID NO: 4046671 - RNA, 13 nt, Staphylococcus aureus subsp. aureus N315
aaugccauaccug

SEQ ID NO: 4046672 - RNA, 20 nt, Staphylococcus aureus subsp. aureus N315
aaugccauuguuauccaaaa

SEQ ID NO: 4046673 - RNA, 21 nt, Staphylococcus aureus subsp. aureus N315
aaugccauuguuauccaaaac

SEQ ID NO: 4046674 - RNA, 23 nt, Staphylococcus aureus subsp. aureus N315
aaugccauuguuauccaaaacau

SEQ ID NO: 4046675 - RNA, 16 nt, Staphylococcus aureus subsp. aureus N315
aaugcgacaucgccaa

SEQ ID NO: 4046676 - RNA, 13 nt, Staphylococcus aureus subsp. aureus N315
aaugcgcaaugaa

SEQ ID NO: 4046677 - RNA, 21 nt, Staphylococcus aureus subsp. aureus N315
aaugcguggauguguuuuaau

SEQ ID NO: 4046678 - RNA, 17 nt, Staphylococcus aureus subsp. aureus N315
aaugcuaaaaguauaaa

SEQ ID NO: 4046679 - RNA, 19 nt, Staphylococcus aureus subsp. aureus N315
aaugcuaauacuaaucaaa

SEQ ID NO: 4046680 - RNA, 15 nt, Staphylococcus aureus subsp. aureus N315
aaugcuacaauuucc

SEQ ID NO: 4046681 - RNA, 12 nt, Staphylococcus aureus subsp. aureus N315
aaugcuauauuu

SEQ ID NO: 4046682 - RNA, 20 nt, Staphylococcus aureus subsp. aureus N315
aaugcuauauuuagaaugau

SEQ ID NO: 4046683 - RNA, 22 nt, Staphylococcus aureus subsp. aureus N315
aaugcuauauuuagaaugauga

SEQ ID NO: 4046684 - RNA, 19 nt, Staphylococcus aureus subsp. aureus N315
aaugcucccuucaaaguag

SEQ ID NO: 4046685 - RNA, 19 nt, Staphylococcus aureus subsp. aureus N315
aaugcucuauauauccauu

SEQ ID NO: 4046686 - RNA, 15 nt, Staphylococcus aureus subsp. aureus N315
aaugcuguacuauau

SEQ ID NO: 4046687 - RNA, 16 nt, Staphylococcus aureus subsp. aureus N315
aaugcuuaaaaacaau

SEQ ID NO: 4046688 - RNA, 16 nt, Staphylococcus aureus subsp. aureus N315
aaugcuucaaauguaa

SEQ ID NO: 4046689 - RNA, 14 nt, Staphylococcus aureus subsp. aureus N315
aauggaguauauca

SEQ ID NO: 4046690 - RNA, 20 nt, Staphylococcus aureus subsp. aureus N315
aauggauuuggucaaguuuu

SEQ ID NO: 4046691 - RNA, 20 nt, Staphylococcus aureus subsp. aureus N315
aauggcaauuaaaacuauaa

SEQ ID NO: 4046692 - RNA, 14 nt, Staphylococcus aureus subsp. aureus N315
aauggcaccauacu

SEQ ID NO: 4046693 - RNA, 19 nt, Staphylococcus aureus subsp. aureus N315
aauggcaccauacuucguu

SEQ ID NO: 4046694 - RNA, 16 nt, Staphylococcus aureus subsp. aureus N315
aauggcacuuaauaua

SEQ ID NO: 4046695 - RNA, 13 nt, Staphylococcus aureus subsp. aureus N315
aauggccauuuga

SEQ ID NO: 4046696 - RNA, 20 nt, Staphylococcus aureus subsp. aureus N315
aauggcuaauacaaaacaaa

SEQ ID NO: 4046697 - RNA, 22 nt, Staphylococcus aureus subsp. aureus N315
aaugggaauuguauuagcaauu

SEQ ID NO: 4046698 - RNA, 18 nt, Staphylococcus aureus subsp. aureus N315
aaugggcgauaaaaguug

SEQ ID NO: 4046699 - RNA, 15 nt, Staphylococcus aureus subsp. aureus N315
aaugggcgugccauu

SEQ ID NO: 4046700 - RNA, 14 nt, Staphylococcus aureus subsp. aureus N315
aaugguaaguaugg

SEQ ID NO: 4046701 - RNA, 19 nt, Staphylococcus aureus subsp. aureus N315
aaugguuucauaaacugaa

SEQ ID NO: 4046702 - RNA, 14 nt, Staphylococcus aureus subsp. aureus N315
aauguaacauuaaa

SEQ ID NO: 4046703 - RNA, 21 nt, Staphylococcus aureus subsp. aureus N315
aauguaacauuaaaaauaaaa

SEQ ID NO: 4046704 - RNA, 16 nt, Staphylococcus aureus subsp. aureus N315
aauguaaugauacaaa

SEQ ID NO: 4046705 - RNA, 18 nt, Staphylococcus aureus subsp. aureus N315
aauguacauuguaaauau

SEQ ID NO: 4046706 - RNA, 15 nt, Staphylococcus aureus subsp. aureus N315
aauguacuaggaccu

SEQ ID NO: 4046707 - RNA, 22 nt, Staphylococcus aureus subsp. aureus N315
aauguacuuuucugucuguaaa

SEQ ID NO: 4046708 - RNA, 17 nt, Staphylococcus aureus subsp. aureus N315
aauguauaaauaauaaa

SEQ ID NO: 4046709 - RNA, 13 nt, Staphylococcus aureus subsp. aureus N315
aauguaucauuuc

SEQ ID NO: 4046710 - RNA, 13 nt, Staphylococcus aureus subsp. aureus N315
aauguaugauaua

SEQ ID NO: 4046711 - RNA, 23 nt, Staphylococcus aureus subsp. aureus N315
aauguauuauucucucauuugua

SEQ ID NO: 4046712 - RNA, 22 nt, Staphylococcus aureus subsp. aureus N315
aauguauucuucuaauucugaa

SEQ ID NO: 4046713 - RNA, 20 nt, Staphylococcus aureus subsp. aureus N315
aauguauuuuuacuuuuaua

SEQ ID NO: 4046714 - RNA, 21 nt, Staphylococcus aureus subsp. aureus N315
aauguauuuuuacuuuuauaa

SEQ ID NO: 4046715 - RNA, 23 nt, Staphylococcus aureus subsp. aureus N315
aaugucauagccuauuuaaaaga

SEQ ID NO: 4046716 - RNA, 20 nt, Staphylococcus aureus subsp. aureus N315
aauguccgacuugauaaaaa

SEQ ID NO: 4046717 - RNA, 22 nt, Staphylococcus aureus subsp. aureus N315
aauguccgacuugauaaaaaau

SEQ ID NO: 4046718 - RNA, 18 nt, Staphylococcus aureus subsp. aureus N315
aaugucgauauuucuagu

SEQ ID NO: 4046719 - RNA, 22 nt, Staphylococcus aureus subsp. aureus N315
aaugucgaucuaacaauugcag

SEQ ID NO: 4046720 - RNA, 22 nt, Staphylococcus aureus subsp. aureus N315
aaugucgcacuauaaaauucac

SEQ ID NO: 4046721 - RNA, 21 nt, Staphylococcus aureus subsp. aureus N315
aaugucguauauguaaucaga

SEQ ID NO: 4046722 - RNA, 15 nt, Staphylococcus aureus subsp. aureus N315
aaugucuaaaaaugu

SEQ ID NO: 4046723 - RNA, 16 nt, Staphylococcus aureus subsp. aureus N315
aaugucucuuuucacg

SEQ ID NO: 4046724 - RNA, 15 nt, Staphylococcus aureus subsp. aureus N315
aaugucuuacuuguc

SEQ ID NO: 4046725 - RNA, 14 nt, Staphylococcus aureus subsp. aureus N315
aaugucuucauaau

SEQ ID NO: 4046726 - RNA, 14 nt, Staphylococcus aureus subsp. aureus N315
aaugucuuucaaau

SEQ ID NO: 4046727 - RNA, 22 nt, Staphylococcus aureus subsp. aureus N315
aaugugagauacguuauuucaa

SEQ ID NO: 4046728 - RNA, 15 nt, Staphylococcus aureus subsp. aureus N315
aaugugagauauaaa

SEQ ID NO: 4046729 - RNA, 17 nt, Staphylococcus aureus subsp. aureus N315
aaugugagauauaaagg

SEQ ID NO: 4046730 - RNA, 14 nt, Staphylococcus aureus subsp. aureus N315
aaugugaugauuaa

SEQ ID NO: 4046731 - RNA, 15 nt, Staphylococcus aureus subsp. aureus N315
aaugugaugauuaau

SEQ ID NO: 4046732 - RNA, 16 nt, Staphylococcus aureus subsp. aureus N315
aaugugauuuucuuuc

SEQ ID NO: 4046733 - RNA, 23 nt, Staphylococcus aureus subsp. aureus N315
aaugugauuuucuuucauaaauu

SEQ ID NO: 4046734 - RNA, 22 nt, Staphylococcus aureus subsp. aureus N315
aauguguaugguuuuguacaua

SEQ ID NO: 4046735 - RNA, 21 nt, Staphylococcus aureus subsp. aureus N315
aauguguggauuuaauuuuua

SEQ ID NO: 4046736 - RNA, 15 nt, Staphylococcus aureus subsp. aureus N315
aauguguuaaaauau

SEQ ID NO: 4046737 - RNA, 18 nt, Staphylococcus aureus subsp. aureus N315
aauguguuaauacuucau

SEQ ID NO: 4046738 - RNA, 23 nt, Staphylococcus aureus subsp. aureus N315
aauguguuaauacuucauauccu

SEQ ID NO: 4046739 - RNA, 19 nt, Staphylococcus aureus subsp. aureus N315
aauguuaaacacucaaaau

SEQ ID NO: 4046740 - RNA, 14 nt, Staphylococcus aureus subsp. aureus N315
aauguuaaagauua

SEQ ID NO: 4046741 - RNA, 16 nt, Staphylococcus aureus subsp. aureus N315
aauguuaaagauuauu

SEQ ID NO: 4046742 - RNA, 17 nt, Staphylococcus aureus subsp. aureus N315
aauguuaaagauuauua

SEQ ID NO: 4046743 - RNA, 17 nt, Staphylococcus aureus subsp. aureus N315
aauguuaaauucuaaaa

SEQ ID NO: 4046744 - RNA, 17 nt, Staphylococcus aureus subsp. aureus N315
aauguuaacugcaaacu

SEQ ID NO: 4046745 - RNA, 21 nt, Staphylococcus aureus subsp. aureus N315
aauguuaacugcaaacuugau

SEQ ID NO: 4046746 - RNA, 18 nt, Staphylococcus aureus subsp. aureus N315
aauguuacacaaauuaaa

SEQ ID NO: 4046747 - RNA, 19 nt, Staphylococcus aureus subsp. aureus N315
aauguuacacaaauuaaaa

SEQ ID NO: 4046748 - RNA, 14 nt, Staphylococcus aureus subsp. aureus N315
aauguuaggugaaa

SEQ ID NO: 4046749 - RNA, 14 nt, Staphylococcus aureus subsp. aureus N315
aauguuaucuugcu

SEQ ID NO: 4046750 - RNA, 14 nt, Staphylococcus aureus subsp. aureus N315
aauguuauuagaua

SEQ ID NO: 4046751 - RNA, 21 nt, Staphylococcus aureus subsp. aureus N315
aauguuauugcuuauuuuugu

SEQ ID NO: 4046752 - RNA, 22 nt, Staphylococcus aureus subsp. aureus N315
aauguuauugcuuauuuuugua

SEQ ID NO: 4046753 - RNA, 23 nt, Staphylococcus aureus subsp. aureus N315
aauguuguuugcggcuuccucuc

SEQ ID NO: 4046754 - RNA, 14 nt, Staphylococcus aureus subsp. aureus N315
aauguuuaaaaaac

SEQ ID NO: 4046755 - RNA, 20 nt, Staphylococcus aureus subsp. aureus N315
aauguuuaauuuucuaaaua

SEQ ID NO: 4046756 - RNA, 15 nt, Staphylococcus aureus subsp. aureus N315
aauguuuauaucuuu

SEQ ID NO: 4046757 - RNA, 14 nt, Staphylococcus aureus subsp. aureus N315
aauguuucagaacu

SEQ ID NO: 4046758 - RNA, 23 nt, Staphylococcus aureus subsp. aureus N315
aauguuugaagugauuugccaaa

SEQ ID NO: 4046759 - RNA, 12 nt, Staphylococcus aureus subsp. aureus N315
aauguuugcuuu

SEQ ID NO: 4046760 - RNA, 13 nt, Staphylococcus aureus subsp. aureus N315
aauguuuuaaauu

SEQ ID NO: 4046761 - RNA, 12 nt, Staphylococcus aureus subsp. aureus N315
aauguuuuaugu

SEQ ID NO: 4046762 - RNA, 18 nt, Staphylococcus aureus subsp. aureus N315
aauguuuuauguauuuau

SEQ ID NO: 4046763 - RNA, 23 nt, Staphylococcus aureus subsp. aureus N315
aauguuuucagccacugucaugu

SEQ ID NO: 4046764 - RNA, 18 nt, Staphylococcus aureus subsp. aureus N315
aauguuuuugauaguaau

SEQ ID NO: 4046765 - RNA, 20 nt, Staphylococcus aureus subsp. aureus N315
aauuaaaacagcaaauaaaa

SEQ ID NO: 4046766 - RNA, 17 nt, Staphylococcus aureus subsp. aureus N315
aauuaaaacaugacaac

SEQ ID NO: 4046767 - RNA, 15 nt, Staphylococcus aureus subsp. aureus N315
aauuaaaauguuaau

SEQ ID NO: 4046768 - RNA, 20 nt, Staphylococcus aureus subsp. aureus N315
aauuaaacauuuagauuuca

SEQ ID NO: 4046769 - RNA, 20 nt, Staphylococcus aureus subsp. aureus N315
aauuaaacgcucaacuauau

SEQ ID NO: 4046770 - RNA, 17 nt, Staphylococcus aureus subsp. aureus N315
aauuaaacuuaagaaua

SEQ ID NO: 4046771 - RNA, 18 nt, Staphylococcus aureus subsp. aureus N315
aauuaaagauuaaaauau

SEQ ID NO: 4046772 - RNA, 13 nt, Staphylococcus aureus subsp. aureus N315
aauuaaagugaau

SEQ ID NO: 4046773 - RNA, 14 nt, Staphylococcus aureus subsp. aureus N315
aauuaaaguuaaag

SEQ ID NO: 4046774 - RNA, 16 nt, Staphylococcus aureus subsp. aureus N315
aauuaaauaaaaauau

SEQ ID NO: 4046775 - RNA, 13 nt, Staphylococcus aureus subsp. aureus N315
aauuaaauaauga

SEQ ID NO: 4046776 - RNA, 15 nt, Staphylococcus aureus subsp. aureus N315
aauuaaaucgauuaa

SEQ ID NO: 4046777 - RNA, 13 nt, Staphylococcus aureus subsp. aureus N315
aauuaaauguuua

SEQ ID NO: 4046778 - RNA, 17 nt, Staphylococcus aureus subsp. aureus N315
aauuaacaacaaauaua

SEQ ID NO: 4046779 - RNA, 16 nt, Staphylococcus aureus subsp. aureus N315
aauuaacaauauuaaa

SEQ ID NO: 4046780 - RNA, 18 nt, Staphylococcus aureus subsp. aureus N315
aauuaaccuugauuuaau

SEQ ID NO: 4046781 - RNA, 20 nt, Staphylococcus aureus subsp. aureus N315
aauuaacuagugccucuuuu

SEQ ID NO: 4046782 - RNA, 16 nt, Staphylococcus aureus subsp. aureus N315
aauuaacuaguguaau

SEQ ID NO: 4046783 - RNA, 19 nt, Staphylococcus aureus subsp. aureus N315
aauuaacuauacuuuuaua

SEQ ID NO: 4046784 - RNA, 22 nt, Staphylococcus aureus subsp. aureus N315
aauuaacuuaaaauuuaaauau

SEQ ID NO: 4046785 - RNA, 14 nt, Staphylococcus aureus subsp. aureus N315
aauuaacuugauau

SEQ ID NO: 4046786 - RNA, 12 nt, Staphylococcus aureus subsp. aureus N315
aauuaagaaaag

SEQ ID NO: 4046787 - RNA, 12 nt, Staphylococcus aureus subsp. aureus N315
aauuaauaaaaa

SEQ ID NO: 4046788 - RNA, 15 nt, Staphylococcus aureus subsp. aureus N315
aauuaauaauuuuuu

SEQ ID NO: 4046789 - RNA, 15 nt, Staphylococcus aureus subsp. aureus N315
aauuaauacaucaau

SEQ ID NO: 4046790 - RNA, 17 nt, Staphylococcus aureus subsp. aureus N315
aauuaauacaucaauau

SEQ ID NO: 4046791 - RNA, 23 nt, Staphylococcus aureus subsp. aureus N315
aauuaauacaucaauaucuucua

SEQ ID NO: 4046792 - RNA, 16 nt, Staphylococcus aureus subsp. aureus N315
aauuaauauccaaaau

SEQ ID NO: 4046793 - RNA, 16 nt, Staphylococcus aureus subsp. aureus N315
aauuaaucaauuuaau

SEQ ID NO: 4046794 - RNA, 23 nt, Staphylococcus aureus subsp. aureus N315
aauuaaucaccuuauugaugaaa

SEQ ID NO: 4046795 - RNA, 13 nt, Staphylococcus aureus subsp. aureus N315
aauuaauuaaaau

SEQ ID NO: 4046796 - RNA, 14 nt, Staphylococcus aureus subsp. aureus N315
aauuaauuaaaauu

SEQ ID NO: 4046797 - RNA, 20 nt, Staphylococcus aureus subsp. aureus N315
aauuaauuacuuucauugua

SEQ ID NO: 4046798 - RNA, 19 nt, Staphylococcus aureus subsp. aureus N315
aauuaauuaucauaaagau

SEQ ID NO: 4046799 - RNA, 21 nt, Staphylococcus aureus subsp. aureus N315
aauuaauuccuggugcaauaa

SEQ ID NO: 4046800 - RNA, 20 nt, Staphylococcus aureus subsp. aureus N315
aauuaauucgccuaaauggu

SEQ ID NO: 4046801 - RNA, 12 nt, Staphylococcus aureus subsp. aureus N315
aauuaauuuugu

SEQ ID NO: 4046802 - RNA, 21 nt, Staphylococcus aureus subsp. aureus N315
aauuacagcgugauucaucua

SEQ ID NO: 4046803 - RNA, 17 nt, Staphylococcus aureus subsp. aureus N315
aauuacaggaauugcuu

SEQ ID NO: 4046804 - RNA, 18 nt, Staphylococcus aureus subsp. aureus N315
aauuacagguuuaaacau

SEQ ID NO: 4046805 - RNA, 23 nt, Staphylococcus aureus subsp. aureus N315
aauuacagguuuaaacaucuaua

SEQ ID NO: 4046806 - RNA, 21 nt, Staphylococcus aureus subsp. aureus N315
aauuacauuacgcucaucacc

SEQ ID NO: 4046807 - RNA, 17 nt, Staphylococcus aureus subsp. aureus N315
aauuaccaaugaauaaa

SEQ ID NO: 4046808 - RNA, 21 nt, Staphylococcus aureus subsp. aureus N315
aauuaccguuuauuucgugga

SEQ ID NO: 4046809 - RNA, 14 nt, Staphylococcus aureus subsp. aureus N315
aauuacgacaagaa

SEQ ID NO: 4046810 - RNA, 16 nt, Staphylococcus aureus subsp. aureus N315
aauuacgacaagaauu

SEQ ID NO: 4046811 - RNA, 19 nt, Staphylococcus aureus subsp. aureus N315
aauuacuaaccuaaagaua

SEQ ID NO: 4046812 - RNA, 14 nt, Staphylococcus aureus subsp. aureus N315
aauuacucuuuuuc

SEQ ID NO: 4046813 - RNA, 20 nt, Staphylococcus aureus subsp. aureus N315
aauuacuguaaauaugaacu

SEQ ID NO: 4046814 - RNA, 17 nt, Staphylococcus aureus subsp. aureus N315
aauuacuuaauaguaac

SEQ ID NO: 4046815 - RNA, 17 nt, Staphylococcus aureus subsp. aureus N315
aauuacuuagcaaacaa

SEQ ID NO: 4046816 - RNA, 19 nt, Staphylococcus aureus subsp. aureus N315
aauuagaaaaauaugauug

SEQ ID NO: 4046817 - RNA, 12 nt, Staphylococcus aureus subsp. aureus N315
aauuagaaaaua

SEQ ID NO: 4046818 - RNA, 19 nt, Staphylococcus aureus subsp. aureus N315
aauuagaaccaucauucau

SEQ ID NO: 4046819 - RNA, 17 nt, Staphylococcus aureus subsp. aureus N315
aauuagaugaaauggaa

SEQ ID NO: 4046820 - RNA, 21 nt, Staphylococcus aureus subsp. aureus N315
aauuagauuuuaugcuuuacu

SEQ ID NO: 4046821 - RNA, 21 nt, Staphylococcus aureus subsp. aureus N315
aauuaggaauccaauuucucu

SEQ ID NO: 4046822 - RNA, 16 nt, Staphylococcus aureus subsp. aureus N315
aauuaggauuaacaua

SEQ ID NO: 4046823 - RNA, 19 nt, Staphylococcus aureus subsp. aureus N315
aauuagggugaacaguuag

SEQ ID NO: 4046824 - RNA, 23 nt, Staphylococcus aureus subsp. aureus N315
aauuagguauaguguuugacaag

SEQ ID NO: 4046825 - RNA, 22 nt, Staphylococcus aureus subsp. aureus N315
aauuaguaaacuaauccucacu

SEQ ID NO: 4046826 - RNA, 18 nt, Staphylococcus aureus subsp. aureus N315
aauuagucccauuaacac

SEQ ID NO: 4046827 - RNA, 18 nt, Staphylococcus aureus subsp. aureus N315
aauuaguucguguuugaa

SEQ ID NO: 4046828 - RNA, 16 nt, Staphylococcus aureus subsp. aureus N315
aauuauaaaugauuaa

SEQ ID NO: 4046829 - RNA, 17 nt, Staphylococcus aureus subsp. aureus N315
aauuauaaaugauuaaa

SEQ ID NO: 4046830 - RNA, 14 nt, Staphylococcus aureus subsp. aureus N315
aauuauaauaaaac

SEQ ID NO: 4046831 - RNA, 22 nt, Staphylococcus aureus subsp. aureus N315
aauuauaauaaaacuugugaua

SEQ ID NO: 4046832 - RNA, 21 nt, Staphylococcus aureus subsp. aureus N315
aauuauacguuacuaaacuuu

SEQ ID NO: 4046833 - RNA, 15 nt, Staphylococcus aureus subsp. aureus N315
aauuauagccuucau

SEQ ID NO: 4046834 - RNA, 23 nt, Staphylococcus aureus subsp. aureus N315
aauuauaguuucgucuacuauuu

SEQ ID NO: 4046835 - RNA, 22 nt, Staphylococcus aureus subsp. aureus N315
aauuauauagaaaacuagaacu

SEQ ID NO: 4046836 - RNA, 13 nt, Staphylococcus aureus subsp. aureus N315
aauuauauuaaug

SEQ ID NO: 4046837 - RNA, 20 nt, Staphylococcus aureus subsp. aureus N315
aauuaucagaaucaaguaau

SEQ ID NO: 4046838 - RNA, 15 nt, Staphylococcus aureus subsp. aureus N315
aauuaucauaaagau

SEQ ID NO: 4046839 - RNA, 17 nt, Staphylococcus aureus subsp. aureus N315
aauuaucauaaagauaa

SEQ ID NO: 4046840 - RNA, 14 nt, Staphylococcus aureus subsp. aureus N315
aauuaucauauaaa

SEQ ID NO: 4046841 - RNA, 19 nt, Staphylococcus aureus subsp. aureus N315
aauuaucauuaaauugcuu

SEQ ID NO: 4046842 - RNA, 18 nt, Staphylococcus aureus subsp. aureus N315
aauuauccuacugcuguc

SEQ ID NO: 4046843 - RNA, 13 nt, Staphylococcus aureus subsp. aureus N315
aauuaucuauaua

SEQ ID NO: 4046844 - RNA, 16 nt, Staphylococcus aureus subsp. aureus N315
aauuaucuuaagucau

SEQ ID NO: 4046845 - RNA, 23 nt, Staphylococcus aureus subsp. aureus N315
aauuaugauuauauuuucucaua

SEQ ID NO: 4046846 - RNA, 15 nt, Staphylococcus aureus subsp. aureus N315
aauuauggagcggaa

SEQ ID NO: 4046847 - RNA, 22 nt, Staphylococcus aureus subsp. aureus N315
aauuauggagcggaagauagga

SEQ ID NO: 4046848 - RNA, 19 nt, Staphylococcus aureus subsp. aureus N315
aauuauggcagauccauaa

SEQ ID NO: 4046849 - RNA, 15 nt, Staphylococcus aureus subsp. aureus N315
aauuauguaaaaaau

SEQ ID NO: 4046850 - RNA, 22 nt, Staphylococcus aureus subsp. aureus N315
aauuauuaaagcuaucuucaga

SEQ ID NO: 4046851 - RNA, 16 nt, Staphylococcus aureus subsp. aureus N315
aauuauuaauuuaauc

SEQ ID NO: 4046852 - RNA, 18 nt, Staphylococcus aureus subsp. aureus N315
aauuauuaauuuaaucca

SEQ ID NO: 4046853 - RNA, 12 nt, Staphylococcus aureus subsp. aureus N315
aauuauuauaau

SEQ ID NO: 4046854 - RNA, 13 nt, Staphylococcus aureus subsp. aureus N315
aauuauuauaaua

SEQ ID NO: 4046855 - RNA, 16 nt, Staphylococcus aureus subsp. aureus N315
aauuauuuaaaaugcu

SEQ ID NO: 4046856 - RNA, 11 nt, Staphylococcus aureus subsp. aureus N315
aauuauuuaau

SEQ ID NO: 4046857 - RNA, 19 nt, Staphylococcus aureus subsp. aureus N315
aauuauuuaauuuuucuaa

SEQ ID NO: 4046858 - RNA, 15 nt, Staphylococcus aureus subsp. aureus N315
aauuauuuagaaacu

SEQ ID NO: 4046859 - RNA, 16 nt, Staphylococcus aureus subsp. aureus N315
aauuauuuagaaacuu

SEQ ID NO: 4046860 - RNA, 24 nt, Staphylococcus aureus subsp. aureus N315
aauuauuuauucauuauagucuua

SEQ ID NO: 4046861 - RNA, 14 nt, Staphylococcus aureus subsp. aureus N315
aauuauuucaauua

SEQ ID NO: 4046862 - RNA, 23 nt, Staphylococcus aureus subsp. aureus N315
aauuauuucccuggaaaaugauu

SEQ ID NO: 4046863 - RNA, 20 nt, Staphylococcus aureus subsp. aureus N315
aauuauuucucuuuccacug

SEQ ID NO: 4046864 - RNA, 14 nt, Staphylococcus aureus subsp. aureus N315
aauuauuugauauu

SEQ ID NO: 4046865 - RNA, 20 nt, Staphylococcus aureus subsp. aureus N315
aauuauuuucucgauacaaa

SEQ ID NO: 4046866 - RNA, 15 nt, Staphylococcus aureus subsp. aureus N315
aauuauuuuucaaau

SEQ ID NO: 4046867 - RNA, 21 nt, Staphylococcus aureus subsp. aureus N315
aauuauuuuucucaacaguuu

SEQ ID NO: 4046868 - RNA, 12 nt, Staphylococcus aureus subsp. aureus N315
aauucaacuuuu

SEQ ID NO: 4046869 - RNA, 13 nt, Staphylococcus aureus subsp. aureus N315
aauucaagaacag

SEQ ID NO: 4046870 - RNA, 16 nt, Staphylococcus aureus subsp. aureus N315
aauucaauaaucuuag

SEQ ID NO: 4046871 - RNA, 17 nt, Staphylococcus aureus subsp. aureus N315
aauucaauauuaaucau

SEQ ID NO: 4046872 - RNA, 20 nt, Staphylococcus aureus subsp. aureus N315
aauucaaugauuuuuaaaaa

SEQ ID NO: 4046873 - RNA, 15 nt, Staphylococcus aureus subsp. aureus N315
aauucacgagcugcu

SEQ ID NO: 4046874 - RNA, 15 nt, Staphylococcus aureus subsp. aureus N315
aauucagaugaauaa

SEQ ID NO: 4046875 - RNA, 21 nt, Staphylococcus aureus subsp. aureus N315
aauucaggauggaaugauacg

SEQ ID NO: 4046876 - RNA, 23 nt, Staphylococcus aureus subsp. aureus N315
aauucaguaaucuuguuuucauu

SEQ ID NO: 4046877 - RNA, 17 nt, Staphylococcus aureus subsp. aureus N315
aauucauaagaaaaaug

SEQ ID NO: 4046878 - RNA, 14 nt, Staphylococcus aureus subsp. aureus N315
aauucauucaauac

SEQ ID NO: 4046879 - RNA, 20 nt, Staphylococcus aureus subsp. aureus N315
aauucauuuuauaaaucaaa

SEQ ID NO: 4046880 - RNA, 21 nt, Staphylococcus aureus subsp. aureus N315
aauucauuuuauaaaucaaag

SEQ ID NO: 4046881 - RNA, 17 nt, Staphylococcus aureus subsp. aureus N315
aauuccaaagaaagcua

SEQ ID NO: 4046882 - RNA, 14 nt, Staphylococcus aureus subsp. aureus N315
aauucccaaccuuc

SEQ ID NO: 4046883 - RNA, 21 nt, Staphylococcus aureus subsp. aureus N315
aauuccucuggaacuuuaaua

SEQ ID NO: 4046884 - RNA, 21 nt, Staphylococcus aureus subsp. aureus N315
aauuccuggugcaauaauaaa

SEQ ID NO: 4046885 - RNA, 18 nt, Staphylococcus aureus subsp. aureus N315
aauucgacucaaacaaua

SEQ ID NO: 4046886 - RNA, 15 nt, Staphylococcus aureus subsp. aureus N315
aauucgccaucuuuu

SEQ ID NO: 4046887 - RNA, 21 nt, Staphylococcus aureus subsp. aureus N315
aauucgccuaaaugguuuuga

SEQ ID NO: 4046888 - RNA, 22 nt, Staphylococcus aureus subsp. aureus N315
aauucgccuaaaugguuuugaa

SEQ ID NO: 4046889 - RNA, 19 nt, Staphylococcus aureus subsp. aureus N315
aauucgucuguuucauaua

SEQ ID NO: 4046890 - RNA, 13 nt, Staphylococcus aureus subsp. aureus N315
aauucguugauuu

SEQ ID NO: 4046891 - RNA, 22 nt, Staphylococcus aureus subsp. aureus N315
aauucguuuuacuacugucuca

SEQ ID NO: 4046892 - RNA, 19 nt, Staphylococcus aureus subsp. aureus N315
aauucguuuugcuaaccau

SEQ ID NO: 4046893 - RNA, 20 nt, Staphylococcus aureus subsp. aureus N315
aauucguuuugcuaaccauc

SEQ ID NO: 4046894 - RNA, 14 nt, Staphylococcus aureus subsp. aureus N315
aauucuaaaagaau

SEQ ID NO: 4046895 - RNA, 16 nt, Staphylococcus aureus subsp. aureus N315
aauucuaaaagaauua

SEQ ID NO: 4046896 - RNA, 19 nt, Staphylococcus aureus subsp. aureus N315
aauucuacagguaaugcaa

SEQ ID NO: 4046897 - RNA, 11 nt, Staphylococcus aureus subsp. aureus N315
aauucuauuuu

SEQ ID NO: 4046898 - RNA, 13 nt, Staphylococcus aureus subsp. aureus N315
aauucuauuuuug

SEQ ID NO: 4046899 - RNA, 19 nt, Staphylococcus aureus subsp. aureus N315
aauucuauuuuugauuuaa

SEQ ID NO: 4046900 - RNA, 20 nt, Staphylococcus aureus subsp. aureus N315
aauucuauuuuugauuuaau

SEQ ID NO: 4046901 - RNA, 18 nt, Staphylococcus aureus subsp. aureus N315
aauucucuaacuuuacca

SEQ ID NO: 4046902 - RNA, 12 nt, Staphylococcus aureus subsp. aureus N315
aauucucuuauc

SEQ ID NO: 4046903 - RNA, 13 nt, Staphylococcus aureus subsp. aureus N315
aauucucuuaucu

SEQ ID NO: 4046904 - RNA, 19 nt, Staphylococcus aureus subsp. aureus N315
aauucucuuaucuugauuu

SEQ ID NO: 4046905 - RNA, 22 nt, Staphylococcus aureus subsp. aureus N315
aauucucuuaucuugauuuaaa

SEQ ID NO: 4046906 - RNA, 23 nt, Staphylococcus aureus subsp. aureus N315
aauucucuuaucuugauuuaaac

SEQ ID NO: 4046907 - RNA, 21 nt, Staphylococcus aureus subsp. aureus N315
aauucucuuuguuggggccca

SEQ ID NO: 4046908 - RNA, 20 nt, Staphylococcus aureus subsp. aureus N315
aauucucuuuuaaauucuua

SEQ ID NO: 4046909 - RNA, 17 nt, Staphylococcus aureus subsp. aureus N315
aauucugaaaucaguuu

SEQ ID NO: 4046910 - RNA, 14 nt, Staphylococcus aureus subsp. aureus N315
aauucugguuuaau

SEQ ID NO: 4046911 - RNA, 20 nt, Staphylococcus aureus subsp. aureus N315
aauucugguuuaaugagcuu

SEQ ID NO: 4046912 - RNA, 17 nt, Staphylococcus aureus subsp. aureus N315
aauucugugagguaaaa

SEQ ID NO: 4046913 - RNA, 23 nt, Staphylococcus aureus subsp. aureus N315
aauucuuaaucgagugauucagg

SEQ ID NO: 4046914 - RNA, 15 nt, Staphylococcus aureus subsp. aureus N315
aauucuuauaaaaua

SEQ ID NO: 4046915 - RNA, 21 nt, Staphylococcus aureus subsp. aureus N315
aauucuucaauuucauuuuug

SEQ ID NO: 4046916 - RNA, 12 nt, Staphylococcus aureus subsp. aureus N315
aauucuucauca

SEQ ID NO: 4046917 - RNA, 22 nt, Staphylococcus aureus subsp. aureus N315
aauucuucaucaauaacuauaa

SEQ ID NO: 4046918 - RNA, 16 nt, Staphylococcus aureus subsp. aureus N315
aauucuucaucuucuu

SEQ ID NO: 4046919 - RNA, 21 nt, Staphylococcus aureus subsp. aureus N315
aauucuucaucuucuucaaaa

SEQ ID NO: 4046920 - RNA, 16 nt, Staphylococcus aureus subsp. aureus N315
aauucuuguuugauuu

SEQ ID NO: 4046921 - RNA, 16 nt, Staphylococcus aureus subsp. aureus N315
aauucuuuuacagcaa

SEQ ID NO: 4046922 - RNA, 13 nt, Staphylococcus aureus subsp. aureus N315
aauucuuuuguaa

SEQ ID NO: 4046923 - RNA, 18 nt, Staphylococcus aureus subsp. aureus N315
aauucuuuuucagcuaau

SEQ ID NO: 4046924 - RNA, 13 nt, Staphylococcus aureus subsp. aureus N315
aauugaaaugaua

SEQ ID NO: 4046925 - RNA, 15 nt, Staphylococcus aureus subsp. aureus N315
aauugaaauuaacug

SEQ ID NO: 4046926 - RNA, 18 nt, Staphylococcus aureus subsp. aureus N315
aauugaaauuaacuguau

SEQ ID NO: 4046927 - RNA, 14 nt, Staphylococcus aureus subsp. aureus N315
aauugaauaucacu

SEQ ID NO: 4046928 - RNA, 15 nt, Staphylococcus aureus subsp. aureus N315
aauugaaugaaaaua

SEQ ID NO: 4046929 - RNA, 18 nt, Staphylococcus aureus subsp. aureus N315
aauugacgcauuaaugau

SEQ ID NO: 4046930 - RNA, 22 nt, Staphylococcus aureus subsp. aureus N315
aauugacucaaagauauacuua

SEQ ID NO: 4046931 - RNA, 19 nt, Staphylococcus aureus subsp. aureus N315
aauugacuuuaauugcucu

SEQ ID NO: 4046932 - RNA, 20 nt, Staphylococcus aureus subsp. aureus N315
aauugagagaaguuucuaua

SEQ ID NO: 4046933 - RNA, 16 nt, Staphylococcus aureus subsp. aureus N315
aauugaguauuaaauu

SEQ ID NO: 4046934 - RNA, 19 nt, Staphylococcus aureus subsp. aureus N315
aauugaguauuaaauuugu

SEQ ID NO: 4046935 - RNA, 14 nt, Staphylococcus aureus subsp. aureus N315
aauugaugauuacu

SEQ ID NO: 4046936 - RNA, 20 nt, Staphylococcus aureus subsp. aureus N315
aauugauucucuguagauau

SEQ ID NO: 4046937 - RNA, 14 nt, Staphylococcus aureus subsp. aureus N315
aauugauugucaua

SEQ ID NO: 4046938 - RNA, 18 nt, Staphylococcus aureus subsp. aureus N315
aauugcaaugaauaacaa

SEQ ID NO: 4046939 - RNA, 15 nt, Staphylococcus aureus subsp. aureus N315
aauugcaauggcaac

SEQ ID NO: 4046940 - RNA, 19 nt, Staphylococcus aureus subsp. aureus N315
aauugcauacguaaauggu

SEQ ID NO: 4046941 - RNA, 19 nt, Staphylococcus aureus subsp. aureus N315
aauugcauguaaaauuaaa

SEQ ID NO: 4046942 - RNA, 20 nt, Staphylococcus aureus subsp. aureus N315
aauugcauguaaaauuaaau

SEQ ID NO: 4046943 - RNA, 15 nt, Staphylococcus aureus subsp. aureus N315
aauugcuaaaaaaau

SEQ ID NO: 4046944 - RNA, 20 nt, Staphylococcus aureus subsp. aureus N315
aauugcuauauuaguauaau

SEQ ID NO: 4046945 - RNA, 22 nt, Staphylococcus aureus subsp. aureus N315
aauugcuauauuaguauaauuu

SEQ ID NO: 4046946 - RNA, 16 nt, Staphylococcus aureus subsp. aureus N315
aauugcucuuuaacaa

SEQ ID NO: 4046947 - RNA, 19 nt, Staphylococcus aureus subsp. aureus N315
aauugcugacaccuauauu

SEQ ID NO: 4046948 - RNA, 21 nt, Staphylococcus aureus subsp. aureus N315
aauugcuugaaauuauuauuu

SEQ ID NO: 4046949 - RNA, 13 nt, Staphylococcus aureus subsp. aureus N315
aauugcuuguucu

SEQ ID NO: 4046950 - RNA, 17 nt, Staphylococcus aureus subsp. aureus N315
aauugcuuguucuuucu

SEQ ID NO: 4046951 - RNA, 22 nt, Staphylococcus aureus subsp. aureus N315
aauugcuuguuuuaaaugaccu

SEQ ID NO: 4046952 - RNA, 18 nt, Staphylococcus aureus subsp. aureus N315
aauuggauaauuucuucu

SEQ ID NO: 4046953 - RNA, 22 nt, Staphylococcus aureus subsp. aureus N315
aauuggauuaucgaauuagauu

SEQ ID NO: 4046954 - RNA, 14 nt, Staphylococcus aureus subsp. aureus N315
aauuggauugagau

SEQ ID NO: 4046955 - RNA, 23 nt, Staphylococcus aureus subsp. aureus N315
aauuggcaccucuaccaguucaa

SEQ ID NO: 4046956 - RNA, 16 nt, Staphylococcus aureus subsp. aureus N315
aauuggcagauagaau

SEQ ID NO: 4046957 - RNA, 14 nt, Staphylococcus aureus subsp. aureus N315
aauugggaaauauu

SEQ ID NO: 4046958 - RNA, 16 nt, Staphylococcus aureus subsp. aureus N315
aauugggaaauauuug

SEQ ID NO: 4046959 - RNA, 19 nt, Staphylococcus aureus subsp. aureus N315
aauugggaaauauuugaaa

SEQ ID NO: 4046960 - RNA, 20 nt, Staphylococcus aureus subsp. aureus N315
aauugguuuggauaaaauga

SEQ ID NO: 4046961 - RNA, 22 nt, Staphylococcus aureus subsp. aureus N315
aauugguuuggauaaaaugaua

SEQ ID NO: 4046962 - RNA, 14 nt, Staphylococcus aureus subsp. aureus N315
aauugguuuucaug

SEQ ID NO: 4046963 - RNA, 23 nt, Staphylococcus aureus subsp. aureus N315
aauugguuuuuagugaaaagaac

SEQ ID NO: 4046964 - RNA, 17 nt, Staphylococcus aureus subsp. aureus N315
aauuguaaagcaugaau

SEQ ID NO: 4046965 - RNA, 12 nt, Staphylococcus aureus subsp. aureus N315
aauuguaaaucu

SEQ ID NO: 4046966 - RNA, 20 nt, Staphylococcus aureus subsp. aureus N315
aauuguaaucuauuuucugc

SEQ ID NO: 4046967 - RNA, 17 nt, Staphylococcus aureus subsp. aureus N315
aauuguacuuaaaccua

SEQ ID NO: 4046968 - RNA, 18 nt, Staphylococcus aureus subsp. aureus N315
aauuguagauccaauucc

SEQ ID NO: 4046969 - RNA, 16 nt, Staphylococcus aureus subsp. aureus N315
aauuguaguaaugaag

SEQ ID NO: 4046970 - RNA, 11 nt, Staphylococcus aureus subsp. aureus N315
aauuguauaaa

SEQ ID NO: 4046971 - RNA, 13 nt, Staphylococcus aureus subsp. aureus N315
aauuguauagaau

SEQ ID NO: 4046972 - RNA, 14 nt, Staphylococcus aureus subsp. aureus N315
aauuguauuagcaa

SEQ ID NO: 4046973 - RNA, 12 nt, Staphylococcus aureus subsp. aureus N315
aauuguauuuuc

SEQ ID NO: 4046974 - RNA, 20 nt, Staphylococcus aureus subsp. aureus N315
aauugucuagguuagaauua

SEQ ID NO: 4046975 - RNA, 14 nt, Staphylococcus aureus subsp. aureus N315
aauugucucaucau

SEQ ID NO: 4046976 - RNA, 20 nt, Staphylococcus aureus subsp. aureus N315
aauugucucaucauuuaaaa

SEQ ID NO: 4046977 - RNA, 23 nt, Staphylococcus aureus subsp. aureus N315
aauugucucaucauuuaaaauuu

SEQ ID NO: 4046978 - RNA, 20 nt, Staphylococcus aureus subsp. aureus N315
aauuguggagaucuaacaau

SEQ ID NO: 4046979 - RNA, 16 nt, Staphylococcus aureus subsp. aureus N315
aauuguguugaaucaa

SEQ ID NO: 4046980 - RNA, 12 nt, Staphylococcus aureus subsp. aureus N315
aauuguguuucu

SEQ ID NO: 4046981 - RNA, 19 nt, Staphylococcus aureus subsp. aureus N315
aauuguguuucuuucauag

SEQ ID NO: 4046982 - RNA, 13 nt, Staphylococcus aureus subsp. aureus N315
aauuguuaaaccc

SEQ ID NO: 4046983 - RNA, 17 nt, Staphylococcus aureus subsp. aureus N315
aauuguuaaaucaccaa

SEQ ID NO: 4046984 - RNA, 16 nt, Staphylococcus aureus subsp. aureus N315
aauuguuacuaguucu

SEQ ID NO: 4046985 - RNA, 19 nt, Staphylococcus aureus subsp. aureus N315
aauuguucuaauacaccaa

SEQ ID NO: 4046986 - RNA, 23 nt, Staphylococcus aureus subsp. aureus N315
aauuguucuaauacaccaaaucc

SEQ ID NO: 4046987 - RNA, 17 nt, Staphylococcus aureus subsp. aureus N315
aauuguuguacauguau

SEQ ID NO: 4046988 - RNA, 16 nt, Staphylococcus aureus subsp. aureus N315
aauuuaaaaagcagua

SEQ ID NO: 4046989 - RNA, 12 nt, Staphylococcus aureus subsp. aureus N315
aauuuaaaacaa

SEQ ID NO: 4046990 - RNA, 16 nt, Staphylococcus aureus subsp. aureus N315
aauuuaaaacaaugau

SEQ ID NO: 4046991 - RNA, 19 nt, Staphylococcus aureus subsp. aureus N315
aauuuaaaacaaugauuaa

SEQ ID NO: 4046992 - RNA, 20 nt, Staphylococcus aureus subsp. aureus N315
aauuuaaaacaaugauuaaa

SEQ ID NO: 4046993 - RNA, 21 nt, Staphylococcus aureus subsp. aureus N315
aauuuaaaacaaugauuaaaa

SEQ ID NO: 4046994 - RNA, 15 nt, Staphylococcus aureus subsp. aureus N315
aauuuaaaagaaaaa

SEQ ID NO: 4046995 - RNA, 15 nt, Staphylococcus aureus subsp. aureus N315
aauuuaaaagagaau

SEQ ID NO: 4046996 - RNA, 13 nt, Staphylococcus aureus subsp. aureus N315
aauuuaaaauaau

SEQ ID NO: 4046997 - RNA, 15 nt, Staphylococcus aureus subsp. aureus N315
aauuuaaacgcacua

SEQ ID NO: 4046998 - RNA, 23 nt, Staphylococcus aureus subsp. aureus N315
aauuuaaacgcacuauuuuuaua

SEQ ID NO: 4046999 - RNA, 18 nt, Staphylococcus aureus subsp. aureus N315
aauuuaaagcaucauaua

SEQ ID NO: 4047000 - RNA, 16 nt, Staphylococcus aureus subsp. aureus N315
aauuuaaaggcauaau

SEQ ID NO: 4047001 - RNA, 20 nt, Staphylococcus aureus subsp. aureus N315
aauuuaaagucuucaucuuu

SEQ ID NO: 4047002 - RNA, 10 nt, Staphylococcus aureus subsp. aureus N315
aauuuaaaug

SEQ ID NO: 4047003 - RNA, 15 nt, Staphylococcus aureus subsp. aureus N315
aauuuaaaugcuuaa

SEQ ID NO: 4047004 - RNA, 19 nt, Staphylococcus aureus subsp. aureus N315
aauuuaaaugcuuaauuug

SEQ ID NO: 4047005 - RNA, 14 nt, Staphylococcus aureus subsp. aureus N315
aauuuaacaucuuu

SEQ ID NO: 4047006 - RNA, 17 nt, Staphylococcus aureus subsp. aureus N315
aauuuaacguguaauga

SEQ ID NO: 4047007 - RNA, 20 nt, Staphylococcus aureus subsp. aureus N315
aauuuaacguuauucauuug

SEQ ID NO: 4047008 - RNA, 17 nt, Staphylococcus aureus subsp. aureus N315
aauuuaacguuuugaug

SEQ ID NO: 4047009 - RNA, 16 nt, Staphylococcus aureus subsp. aureus N315
aauuuaacuaugaaau

SEQ ID NO: 4047010 - RNA, 13 nt, Staphylococcus aureus subsp. aureus N315
aauuuaauaauua

SEQ ID NO: 4047011 - RNA, 16 nt, Staphylococcus aureus subsp. aureus N315
aauuuaauaauuaaau

SEQ ID NO: 4047012 - RNA, 18 nt, Staphylococcus aureus subsp. aureus N315
aauuuaauagacauuaac

SEQ ID NO: 4047013 - RNA, 15 nt, Staphylococcus aureus subsp. aureus N315
aauuuaauauuauaa

SEQ ID NO: 4047014 - RNA, 15 nt, Staphylococcus aureus subsp. aureus N315
aauuuaauguuuuca

SEQ ID NO: 4047015 - RNA, 15 nt, Staphylococcus aureus subsp. aureus N315
aauuuacgaaaguag

SEQ ID NO: 4047016 - RNA, 12 nt, Staphylococcus aureus subsp. aureus N315
aauuuagaugca

SEQ ID NO: 4047017 - RNA, 15 nt, Staphylococcus aureus subsp. aureus N315
aauuuagaugcauaa

SEQ ID NO: 4047018 - RNA, 15 nt, Staphylococcus aureus subsp. aureus N315
aauuuagcaaauauu

SEQ ID NO: 4047019 - RNA, 19 nt, Staphylococcus aureus subsp. aureus N315
aauuuagcaucaaaaauaa

SEQ ID NO: 4047020 - RNA, 18 nt, Staphylococcus aureus subsp. aureus N315
aauuuaguacucaauguu

SEQ ID NO: 4047021 - RNA, 21 nt, Staphylococcus aureus subsp. aureus N315
aauuuaguauaaauaaaaaua

SEQ ID NO: 4047022 - RNA, 15 nt, Staphylococcus aureus subsp. aureus N315
aauuuagucauuaca

SEQ ID NO: 4047023 - RNA, 18 nt, Staphylococcus aureus subsp. aureus N315
aauuuagugaaacaauuu

SEQ ID NO: 4047024 - RNA, 20 nt, Staphylococcus aureus subsp. aureus N315
aauuuaguucaccauuucgu

SEQ ID NO: 4047025 - RNA, 17 nt, Staphylococcus aureus subsp. aureus N315
aauuuauaaaaagagau

SEQ ID NO: 4047026 - RNA, 15 nt, Staphylococcus aureus subsp. aureus N315
aauuuaucaauuucu

SEQ ID NO: 4047027 - RNA, 18 nt, Staphylococcus aureus subsp. aureus N315
aauuuaucaauuucuauu

SEQ ID NO: 4047028 - RNA, 15 nt, Staphylococcus aureus subsp. aureus N315
aauuuaucugcaaaa

SEQ ID NO: 4047029 - RNA, 14 nt, Staphylococcus aureus subsp. aureus N315
aauuuaucuuaauc

SEQ ID NO: 4047030 - RNA, 12 nt, Staphylococcus aureus subsp. aureus N315
aauuuauuauaa

SEQ ID NO: 4047031 - RNA, 13 nt, Staphylococcus aureus subsp. aureus N315
aauuuauuauaaa

SEQ ID NO: 4047032 - RNA, 16 nt, Staphylococcus aureus subsp. aureus N315
aauuuauuauaaaaua

SEQ ID NO: 4047033 - RNA, 22 nt, Staphylococcus aureus subsp. aureus N315
aauuuauuauaaaauagaagua

SEQ ID NO: 4047034 - RNA, 13 nt, Staphylococcus aureus subsp. aureus N315
aauuuauucaaaa

SEQ ID NO: 4047035 - RNA, 21 nt, Staphylococcus aureus subsp. aureus N315
aauuucaacuuauaaaaugaa

SEQ ID NO: 4047036 - RNA, 21 nt, Staphylococcus aureus subsp. aureus N315
aauuucaagguauacacaaau

SEQ ID NO: 4047037 - RNA, 15 nt, Staphylococcus aureus subsp. aureus N315
aauuucaaugucugc

SEQ ID NO: 4047038 - RNA, 15 nt, Staphylococcus aureus subsp. aureus N315
aauuucaauuuaugu

SEQ ID NO: 4047039 - RNA, 17 nt, Staphylococcus aureus subsp. aureus N315
aauuucaauuuggaaau

SEQ ID NO: 4047040 - RNA, 23 nt, Staphylococcus aureus subsp. aureus N315
aauuucaauuuggaaauaucuua

SEQ ID NO: 4047041 - RNA, 17 nt, Staphylococcus aureus subsp. aureus N315
aauuucaccuuguaaau

SEQ ID NO: 4047042 - RNA, 21 nt, Staphylococcus aureus subsp. aureus N315
aauuucacgcugaaauuuuuu

SEQ ID NO: 4047043 - RNA, 14 nt, Staphylococcus aureus subsp. aureus N315
aauuucaguaccau

SEQ ID NO: 4047044 - RNA, 19 nt, Staphylococcus aureus subsp. aureus N315
aauuucaguaccauguuuu

SEQ ID NO: 4047045 - RNA, 21 nt, Staphylococcus aureus subsp. aureus N315
aauuucaguaggacauauaaa

SEQ ID NO: 4047046 - RNA, 23 nt, Staphylococcus aureus subsp. aureus N315
aauuucaguaucauguucuuaua

SEQ ID NO: 4047047 - RNA, 19 nt, Staphylococcus aureus subsp. aureus N315
aauuucauaguuaucgauu

SEQ ID NO: 4047048 - RNA, 20 nt, Staphylococcus aureus subsp. aureus N315
aauuucauaguuaucgauuu

SEQ ID NO: 4047049 - RNA, 16 nt, Staphylococcus aureus subsp. aureus N315
aauuucaucaaaucca

SEQ ID NO: 4047050 - RNA, 14 nt, Staphylococcus aureus subsp. aureus N315
aauuucaugugcaa

SEQ ID NO: 4047051 - RNA, 17 nt, Staphylococcus aureus subsp. aureus N315
aauuucauuuuugauaa

SEQ ID NO: 4047052 - RNA, 16 nt, Staphylococcus aureus subsp. aureus N315
aauuuccaauaucuuc

SEQ ID NO: 4047053 - RNA, 18 nt, Staphylococcus aureus subsp. aureus N315
aauuuccaauaucuucuu

SEQ ID NO: 4047054 - RNA, 14 nt, Staphylococcus aureus subsp. aureus N315
aauuuccuaaaaac

SEQ ID NO: 4047055 - RNA, 14 nt, Staphylococcus aureus subsp. aureus N315
aauuucgaaaagaa

SEQ ID NO: 4047056 - RNA, 15 nt, Staphylococcus aureus subsp. aureus N315
aauuucgaaaagaaa

SEQ ID NO: 4047057 - RNA, 19 nt, Staphylococcus aureus subsp. aureus N315
aauuucgaaaagaaauucu

SEQ ID NO: 4047058 - RNA, 21 nt, Staphylococcus aureus subsp. aureus N315
aauuucgacaucuagaugaaa

SEQ ID NO: 4047059 - RNA, 23 nt, Staphylococcus aureus subsp. aureus N315
aauuucgacaucuagaugaaauu

SEQ ID NO: 4047060 - RNA, 14 nt, Staphylococcus aureus subsp. aureus N315
aauuucgcaguagc

SEQ ID NO: 4047061 - RNA, 14 nt, Staphylococcus aureus subsp. aureus N315
aauuucuaauuaaa

SEQ ID NO: 4047062 - RNA, 19 nt, Staphylococcus aureus subsp. aureus N315
aauuucuauagaaaaagua

SEQ ID NO: 4047063 - RNA, 14 nt, Staphylococcus aureus subsp. aureus N315
aauuucuaugaaaa

SEQ ID NO: 4047064 - RNA, 17 nt, Staphylococcus aureus subsp. aureus N315
aauuucuaugaaaaaaa

SEQ ID NO: 4047065 - RNA, 12 nt, Staphylococcus aureus subsp. aureus N315
aauuucuauuua

SEQ ID NO: 4047066 - RNA, 23 nt, Staphylococcus aureus subsp. aureus N315
aauuucuauuuauugagauagaa

SEQ ID NO: 4047067 - RNA, 14 nt, Staphylococcus aureus subsp. aureus N315
aauuucuuuaaagu

SEQ ID NO: 4047068 - RNA, 16 nt, Staphylococcus aureus subsp. aureus N315
aauuucuuuaaagucu

SEQ ID NO: 4047069 - RNA, 17 nt, Staphylococcus aureus subsp. aureus N315
aauuugaagauuuuguu

SEQ ID NO: 4047070 - RNA, 17 nt, Staphylococcus aureus subsp. aureus N315
aauuugaggauacauaa

SEQ ID NO: 4047071 - RNA, 19 nt, Staphylococcus aureus subsp. aureus N315
aauuugaggauacauaaau

SEQ ID NO: 4047072 - RNA, 12 nt, Staphylococcus aureus subsp. aureus N315
aauuugauuaaa

SEQ ID NO: 4047073 - RNA, 16 nt, Staphylococcus aureus subsp. aureus N315
aauuuggucauauaaa

SEQ ID NO: 4047074 - RNA, 17 nt, Staphylococcus aureus subsp. aureus N315
aauuugguuaacauccu

SEQ ID NO: 4047075 - RNA, 21 nt, Staphylococcus aureus subsp. aureus N315
aauuuguaacuauugaaaaua

SEQ ID NO: 4047076 - RNA, 14 nt, Staphylococcus aureus subsp. aureus N315
aauuuguaauuccu

SEQ ID NO: 4047077 - RNA, 16 nt, Staphylococcus aureus subsp. aureus N315
aauuuguauaaagauu

SEQ ID NO: 4047078 - RNA, 21 nt, Staphylococcus aureus subsp. aureus N315
aauuuguauaaagauuuaagu

SEQ ID NO: 4047079 - RNA, 14 nt, Staphylococcus aureus subsp. aureus N315
aauuuguauuuaaa

SEQ ID NO: 4047080 - RNA, 15 nt, Staphylococcus aureus subsp. aureus N315
aauuuguauuuaaaa

SEQ ID NO: 4047081 - RNA, 17 nt, Staphylococcus aureus subsp. aureus N315
aauuuguccauccauuu

SEQ ID NO: 4047082 - RNA, 19 nt, Staphylococcus aureus subsp. aureus N315
aauuugugcauucaucaau

SEQ ID NO: 4047083 - RNA, 17 nt, Staphylococcus aureus subsp. aureus N315
aauuuguguucaaauca

SEQ ID NO: 4047084 - RNA, 20 nt, Staphylococcus aureus subsp. aureus N315
aauuuguguucaaaucacaa

SEQ ID NO: 4047085 - RNA, 21 nt, Staphylococcus aureus subsp. aureus N315
aauuuuaaauauugauauaaa

SEQ ID NO: 4047086 - RNA, 11 nt, Staphylococcus aureus subsp. aureus N315
aauuuuaaauc

SEQ ID NO: 4047087 - RNA, 14 nt, Staphylococcus aureus subsp. aureus N315
aauuuuaaguuaau

SEQ ID NO: 4047088 - RNA, 22 nt, Staphylococcus aureus subsp. aureus N315
aauuuuaauuaauuaucauaaa

SEQ ID NO: 4047089 - RNA, 15 nt, Staphylococcus aureus subsp. aureus N315
aauuuuaccaucaau

SEQ ID NO: 4047090 - RNA, 12 nt, Staphylococcus aureus subsp. aureus N315
aauuuuaccaug

SEQ ID NO: 4047091 - RNA, 22 nt, Staphylococcus aureus subsp. aureus N315
aauuuuaucuaaagcuauaaaa

SEQ ID NO: 4047092 - RNA, 17 nt, Staphylococcus aureus subsp. aureus N315
aauuuuauuagguaaua

SEQ ID NO: 4047093 - RNA, 22 nt, Staphylococcus aureus subsp. aureus N315
aauuuuccguguuuauuuuuau

SEQ ID NO: 4047094 - RNA, 15 nt, Staphylococcus aureus subsp. aureus N315
aauuuucuaaauaua

SEQ ID NO: 4047095 - RNA, 16 nt, Staphylococcus aureus subsp. aureus N315
aauuuucuguccaaaa

SEQ ID NO: 4047096 - RNA, 19 nt, Staphylococcus aureus subsp. aureus N315
aauuuucuguuuaauuaaa

SEQ ID NO: 4047097 - RNA, 21 nt, Staphylococcus aureus subsp. aureus N315
aauuuucuguuuaauuaaaau

SEQ ID NO: 4047098 - RNA, 12 nt, Staphylococcus aureus subsp. aureus N315
aauuuucuuuuu

SEQ ID NO: 4047099 - RNA, 12 nt, Staphylococcus aureus subsp. aureus N315
aauuuugaagaa

SEQ ID NO: 4047100 - RNA, 20 nt, Staphylococcus aureus subsp. aureus N315
aauuuugacgcucagguaua

SEQ ID NO: 4047101 - RNA, 13 nt, Staphylococcus aureus subsp. aureus N315
aauuuugauauag

SEQ ID NO: 4047102 - RNA, 19 nt, Staphylococcus aureus subsp. aureus N315
aauuuuuaaaucuacaaua

SEQ ID NO: 4047103 - RNA, 17 nt, Staphylococcus aureus subsp. aureus N315
aauuuuuaacaaaauau

SEQ ID NO: 4047104 - RNA, 21 nt, Staphylococcus aureus subsp. aureus N315
aauuuuuaacaaaauauacua

SEQ ID NO: 4047105 - RNA, 16 nt, Staphylococcus aureus subsp. aureus N315
aauuuuuauuuuuagu

SEQ ID NO: 4047106 - RNA, 13 nt, Staphylococcus aureus subsp. aureus N315
aauuuuucauuaa

SEQ ID NO: 4047107 - RNA, 20 nt, Staphylococcus aureus subsp. aureus N315
aauuuuucuaaaugauuuau

SEQ ID NO: 4047108 - RNA, 21 nt, Staphylococcus aureus subsp. aureus N315
aauuuuucuucuuuuuuaucu

SEQ ID NO: 4047109 - RNA, 17 nt, Staphylococcus aureus subsp. aureus N315
aauuuuugggaagaaua

SEQ ID NO: 4047110 - RNA, 20 nt, Staphylococcus aureus subsp. aureus N315
acaaaaaauaucuuuuuguu

SEQ ID NO: 4047111 - RNA, 14 nt, Staphylococcus aureus subsp. aureus N315
acaaaaaauuguaa

SEQ ID NO: 4047112 - RNA, 22 nt, Staphylococcus aureus subsp. aureus N315
acaaaaagaauuucgaaaagaa

SEQ ID NO: 4047113 - RNA, 16 nt, Staphylococcus aureus subsp. aureus N315
acaaaaauaaaccaug

SEQ ID NO: 4047114 - RNA, 17 nt, Staphylococcus aureus subsp. aureus N315
acaaaaauauagcuauu

SEQ ID NO: 4047115 - RNA, 13 nt, Staphylococcus aureus subsp. aureus N315
acaaaaaugaaga

SEQ ID NO: 4047116 - RNA, 20 nt, Staphylococcus aureus subsp. aureus N315
acaaaacaaauccauuaaau

SEQ ID NO: 4047117 - RNA, 22 nt, Staphylococcus aureus subsp. aureus N315
acaaaacaaauccauuaaauca

SEQ ID NO: 4047118 - RNA, 12 nt, Staphylococcus aureus subsp. aureus N315
acaaaacauauu

SEQ ID NO: 4047119 - RNA, 10 nt, Staphylococcus aureus subsp. aureus N315
acaaaagaaa

SEQ ID NO: 4047120 - RNA, 19 nt, Staphylococcus aureus subsp. aureus N315
acaaaaguaugauuuguuu

SEQ ID NO: 4047121 - RNA, 16 nt, Staphylococcus aureus subsp. aureus N315
acaaaauaacauguuu

SEQ ID NO: 4047122 - RNA, 22 nt, Staphylococcus aureus subsp. aureus N315
acaaaaucucaacagcaaaaaa

SEQ ID NO: 4047123 - RNA, 18 nt, Staphylococcus aureus subsp. aureus N315
acaaaauugucucacuug

SEQ ID NO: 4047124 - RNA, 15 nt, Staphylococcus aureus subsp. aureus N315
acaaacaaaagcacc

SEQ ID NO: 4047125 - RNA, 21 nt, Staphylococcus aureus subsp. aureus N315
acaaacauuacccuuuaaacu

SEQ ID NO: 4047126 - RNA, 20 nt, Staphylococcus aureus subsp. aureus N315
acaaagaauuucgaaaagaa

SEQ ID NO: 4047127 - RNA, 22 nt, Staphylococcus aureus subsp. aureus N315
acaaagaauuucgaaaagaaau

SEQ ID NO: 4047128 - RNA, 23 nt, Staphylococcus aureus subsp. aureus N315
acaaagaauuucgaaaagaaauu

SEQ ID NO: 4047129 - RNA, 17 nt, Staphylococcus aureus subsp. aureus N315
acaaagauauguuuaua

SEQ ID NO: 4047130 - RNA, 19 nt, Staphylococcus aureus subsp. aureus N315
acaaagcucaauaaauuau

SEQ ID NO: 4047131 - RNA, 21 nt, Staphylococcus aureus subsp. aureus N315
acaaaggauuauuaacuuuaa

SEQ ID NO: 4047132 - RNA, 19 nt, Staphylococcus aureus subsp. aureus N315
acaaagucauuuucauuca

SEQ ID NO: 4047133 - RNA, 19 nt, Staphylococcus aureus subsp. aureus N315
acaaagugauuuaaaaaau

SEQ ID NO: 4047134 - RNA, 23 nt, Staphylococcus aureus subsp. aureus N315
acaaagugauuuaaaaaauuuaa

SEQ ID NO: 4047135 - RNA, 16 nt, Staphylococcus aureus subsp. aureus N315
acaaauaacaaacauu

SEQ ID NO: 4047136 - RNA, 23 nt, Staphylococcus aureus subsp. aureus N315
acaaauauaauguauaaaacaga

SEQ ID NO: 4047137 - RNA, 23 nt, Staphylococcus aureus subsp. aureus N315
acaaauauacuugccuucaaauu

SEQ ID NO: 4047138 - RNA, 13 nt, Staphylococcus aureus subsp. aureus N315
acaaauaucaauu

SEQ ID NO: 4047139 - RNA, 14 nt, Staphylococcus aureus subsp. aureus N315
acaaauauuucuaa

SEQ ID NO: 4047140 - RNA, 20 nt, Staphylococcus aureus subsp. aureus N315
acaaaucaugacauaaaacu

SEQ ID NO: 4047141 - RNA, 16 nt, Staphylococcus aureus subsp. aureus N315
acaaaucuauaaauau

SEQ ID NO: 4047142 - RNA, 15 nt, Staphylococcus aureus subsp. aureus N315
acaaauguauaaaua

SEQ ID NO: 4047143 - RNA, 16 nt, Staphylococcus aureus subsp. aureus N315
acaaauguauaaauaa

SEQ ID NO: 4047144 - RNA, 18 nt, Staphylococcus aureus subsp. aureus N315
acaaauguauaaauaaua

SEQ ID NO: 4047145 - RNA, 18 nt, Staphylococcus aureus subsp. aureus N315
acaaauuaaaaagguacu

SEQ ID NO: 4047146 - RNA, 12 nt, Staphylococcus aureus subsp. aureus N315
acaaauuauuaa

SEQ ID NO: 4047147 - RNA, 15 nt, Staphylococcus aureus subsp. aureus N315
acaaauucaacuuuu

SEQ ID NO: 4047148 - RNA, 19 nt, Staphylococcus aureus subsp. aureus N315
acaaauuugaauauacuua

SEQ ID NO: 4047149 - RNA, 23 nt, Staphylococcus aureus subsp. aureus N315
acaaauuugaauauacuuaauuu

SEQ ID NO: 4047150 - RNA, 14 nt, Staphylococcus aureus subsp. aureus N315
acaacacauaaauu

SEQ ID NO: 4047151 - RNA, 21 nt, Staphylococcus aureus subsp. aureus N315
acaacaucgauuuaucauuau

SEQ ID NO: 4047152 - RNA, 18 nt, Staphylococcus aureus subsp. aureus N315
acaacaugauuucuucuc

SEQ ID NO: 4047153 - RNA, 11 nt, Staphylococcus aureus subsp. aureus N315
acaacauguuu

SEQ ID NO: 4047154 - RNA, 13 nt, Staphylococcus aureus subsp. aureus N315
acaaccaucagca

SEQ ID NO: 4047155 - RNA, 17 nt, Staphylococcus aureus subsp. aureus N315
acaacuaauaacaaaua

SEQ ID NO: 4047156 - RNA, 17 nt, Staphylococcus aureus subsp. aureus N315
acaacucguuuuuccau

SEQ ID NO: 4047157 - RNA, 20 nt, Staphylococcus aureus subsp. aureus N315
acaacuucacgcaaaacaau

SEQ ID NO: 4047158 - RNA, 21 nt, Staphylococcus aureus subsp. aureus N315
acaacuuuguuuucaguaacu

SEQ ID NO: 4047159 - RNA, 17 nt, Staphylococcus aureus subsp. aureus N315
acaagaacuuagaaaug

SEQ ID NO: 4047160 - RNA, 19 nt, Staphylococcus aureus subsp. aureus N315
acaagauucauacacugca

SEQ ID NO: 4047161 - RNA, 16 nt, Staphylococcus aureus subsp. aureus N315
acaagccaagauaaau

SEQ ID NO: 4047162 - RNA, 21 nt, Staphylococcus aureus subsp. aureus N315
acaagccaagauaaaucauca

SEQ ID NO: 4047163 - RNA, 14 nt, Staphylococcus aureus subsp. aureus N315
acaaggauugaaaa

SEQ ID NO: 4047164 - RNA, 20 nt, Staphylococcus aureus subsp. aureus N315
acaagguaugaaauaacaau

SEQ ID NO: 4047165 - RNA, 14 nt, Staphylococcus aureus subsp. aureus N315
acaaguauaaaugc

SEQ ID NO: 4047166 - RNA, 20 nt, Staphylococcus aureus subsp. aureus N315
acaaguauaaaugcagcugu

SEQ ID NO: 4047167 - RNA, 18 nt, Staphylococcus aureus subsp. aureus N315
acaaguauacuugaagaa

SEQ ID NO: 4047168 - RNA, 13 nt, Staphylococcus aureus subsp. aureus N315
acaagucauuauc

SEQ ID NO: 4047169 - RNA, 16 nt, Staphylococcus aureus subsp. aureus N315
acaagucauuauccaa

SEQ ID NO: 4047170 - RNA, 23 nt, Staphylococcus aureus subsp. aureus N315
acaagucuaguucgaacacacac

SEQ ID NO: 4047171 - RNA, 20 nt, Staphylococcus aureus subsp. aureus N315
acaagucuuauuuguuuaau

SEQ ID NO: 4047172 - RNA, 18 nt, Staphylococcus aureus subsp. aureus N315
acaagucuuuacucuaca

SEQ ID NO: 4047173 - RNA, 22 nt, Staphylococcus aureus subsp. aureus N315
acaagucuuuacucuacacuca

SEQ ID NO: 4047174 - RNA, 16 nt, Staphylococcus aureus subsp. aureus N315
acaaguugcugaauaa

SEQ ID NO: 4047175 - RNA, 19 nt, Staphylococcus aureus subsp. aureus N315
acaaguugcugaauaaaau

SEQ ID NO: 4047176 - RNA, 21 nt, Staphylococcus aureus subsp. aureus N315
acaaguuuacagguugaauaa

SEQ ID NO: 4047177 - RNA, 15 nt, Staphylococcus aureus subsp. aureus N315
acaauaaaaaaccaa

SEQ ID NO: 4047178 - RNA, 14 nt, Staphylococcus aureus subsp. aureus N315
acaauaacaccugu

SEQ ID NO: 4047179 - RNA, 17 nt, Staphylococcus aureus subsp. aureus N315
acaauaacuguucuuuc

SEQ ID NO: 4047180 - RNA, 15 nt, Staphylococcus aureus subsp. aureus N315
acaauacauaauggu

SEQ ID NO: 4047181 - RNA, 17 nt, Staphylococcus aureus subsp. aureus N315
acaauacgaaaucaaaa

SEQ ID NO: 4047182 - RNA, 22 nt, Staphylococcus aureus subsp. aureus N315
acaauacgaaaucaaaaauaau

SEQ ID NO: 4047183 - RNA, 19 nt, Staphylococcus aureus subsp. aureus N315
acaauauaauuuccuaaaa

SEQ ID NO: 4047184 - RNA, 21 nt, Staphylococcus aureus subsp. aureus N315
acaauaugaauuggauguaau

SEQ ID NO: 4047185 - RNA, 15 nt, Staphylococcus aureus subsp. aureus N315
acaauauuaaaauua

SEQ ID NO: 4047186 - RNA, 18 nt, Staphylococcus aureus subsp. aureus N315
acaauauuaaaauuaaaa

SEQ ID NO: 4047187 - RNA, 19 nt, Staphylococcus aureus subsp. aureus N315
acaauauuaaaauuaaaac

SEQ ID NO: 4047188 - RNA, 21 nt, Staphylococcus aureus subsp. aureus N315
acaauauucguaaauccuuua

SEQ ID NO: 4047189 - RNA, 24 nt, Staphylococcus aureus subsp. aureus N315
acaaucaaauuacaaauuaucuag

SEQ ID NO: 4047190 - RNA, 21 nt, Staphylococcus aureus subsp. aureus N315
acaaucaacuuagaauuuaca

SEQ ID NO: 4047191 - RNA, 14 nt, Staphylococcus aureus subsp. aureus N315
acaaucacagcaau

SEQ ID NO: 4047192 - RNA, 18 nt, Staphylococcus aureus subsp. aureus N315
acaaucacagcaauaaua

SEQ ID NO: 4047193 - RNA, 19 nt, Staphylococcus aureus subsp. aureus N315
acaaucacagcaauaauaa

SEQ ID NO: 4047194 - RNA, 14 nt, Staphylococcus aureus subsp. aureus N315
acaaucacgauuaa

SEQ ID NO: 4047195 - RNA, 15 nt, Staphylococcus aureus subsp. aureus N315
acaaucagauaaguu

SEQ ID NO: 4047196 - RNA, 24 nt, Staphylococcus aureus subsp. aureus N315
acaaucagauaaguuacuagcauu

SEQ ID NO: 4047197 - RNA, 17 nt, Staphylococcus aureus subsp. aureus N315
acaaucggaagcauauu

SEQ ID NO: 4047198 - RNA, 19 nt, Staphylococcus aureus subsp. aureus N315
acaaucguuuuaaugccug

SEQ ID NO: 4047199 - RNA, 20 nt, Staphylococcus aureus subsp. aureus N315
acaaucuuaucauaaucuuc

SEQ ID NO: 4047200 - RNA, 22 nt, Staphylococcus aureus subsp. aureus N315
acaaucuuguagggaagauuug

SEQ ID NO: 4047201 - RNA, 18 nt, Staphylococcus aureus subsp. aureus N315
acaaugaauuguuaguuu

SEQ ID NO: 4047202 - RNA, 16 nt, Staphylococcus aureus subsp. aureus N315
acaaugaauuucuaau

SEQ ID NO: 4047203 - RNA, 14 nt, Staphylococcus aureus subsp. aureus N315
acaaugauuaaaau

SEQ ID NO: 4047204 - RNA, 13 nt, Staphylococcus aureus subsp. aureus N315
acaaugcagcugu

SEQ ID NO: 4047205 - RNA, 15 nt, Staphylococcus aureus subsp. aureus N315
acaaugcagcuguau

SEQ ID NO: 4047206 - RNA, 18 nt, Staphylococcus aureus subsp. aureus N315
acaaugcauccaaauauu

SEQ ID NO: 4047207 - RNA, 20 nt, Staphylococcus aureus subsp. aureus N315
acaaugcauccaaauauuaa

SEQ ID NO: 4047208 - RNA, 13 nt, Staphylococcus aureus subsp. aureus N315
acaaugcgcaaug

SEQ ID NO: 4047209 - RNA, 20 nt, Staphylococcus aureus subsp. aureus N315
acaaugcgguaaaaacucuu

SEQ ID NO: 4047210 - RNA, 15 nt, Staphylococcus aureus subsp. aureus N315
acaauuaaagugaau

SEQ ID NO: 4047211 - RNA, 16 nt, Staphylococcus aureus subsp. aureus N315
acaauuaaagugaaua

SEQ ID NO: 4047212 - RNA, 13 nt, Staphylococcus aureus subsp. aureus N315
acaauuaauuacu

SEQ ID NO: 4047213 - RNA, 15 nt, Staphylococcus aureus subsp. aureus N315
acaauuauaauaaaa

SEQ ID NO: 4047214 - RNA, 14 nt, Staphylococcus aureus subsp. aureus N315
acaauucaagacca

SEQ ID NO: 4047215 - RNA, 17 nt, Staphylococcus aureus subsp. aureus N315
acaauucauaagaaaaa

SEQ ID NO: 4047216 - RNA, 14 nt, Staphylococcus aureus subsp. aureus N315
acaauucauuaaua

SEQ ID NO: 4047217 - RNA, 18 nt, Staphylococcus aureus subsp. aureus N315
acaauuccccaaagccuu

SEQ ID NO: 4047218 - RNA, 22 nt, Staphylococcus aureus subsp. aureus N315
acaauugauugcucuaagcauu

SEQ ID NO: 4047219 - RNA, 15 nt, Staphylococcus aureus subsp. aureus N315
acaauugcuaaucca

SEQ ID NO: 4047220 - RNA, 16 nt, Staphylococcus aureus subsp. aureus N315
acaauugcuaauccau

SEQ ID NO: 4047221 - RNA, 14 nt, Staphylococcus aureus subsp. aureus N315
acaauuguaguaau

SEQ ID NO: 4047222 - RNA, 18 nt, Staphylococcus aureus subsp. aureus N315
acaauuuaaaaagcagua

SEQ ID NO: 4047223 - RNA, 17 nt, Staphylococcus aureus subsp. aureus N315
acaauuuaaacgcacua

SEQ ID NO: 4047224 - RNA, 15 nt, Staphylococcus aureus subsp. aureus N315
acaauuuagaugagu

SEQ ID NO: 4047225 - RNA, 20 nt, Staphylococcus aureus subsp. aureus N315
acaauuuagcaaauauuucu

SEQ ID NO: 4047226 - RNA, 13 nt, Staphylococcus aureus subsp. aureus N315
acaauuucaaugu

SEQ ID NO: 4047227 - RNA, 22 nt, Staphylococcus aureus subsp. aureus N315
acaauuuguaacuauugaaaau

SEQ ID NO: 4047228 - RNA, 22 nt, Staphylococcus aureus subsp. aureus N315
acaauuuuccuuccaauaauaa

SEQ ID NO: 4047229 - RNA, 16 nt, Staphylococcus aureus subsp. aureus N315
acaauuuucucauuaa

SEQ ID NO: 4047230 - RNA, 15 nt, Staphylococcus aureus subsp. aureus N315
acaauuuuguacauu

SEQ ID NO: 4047231 - RNA, 15 nt, Staphylococcus aureus subsp. aureus N315
acaauuuuuaaaaac

SEQ ID NO: 4047232 - RNA, 18 nt, Staphylococcus aureus subsp. aureus N315
acaauuuuugggaagaau

SEQ ID NO: 4047233 - RNA, 22 nt, Staphylococcus aureus subsp. aureus N315
acacaaagaauuucgaaaagaa

SEQ ID NO: 4047234 - RNA, 18 nt, Staphylococcus aureus subsp. aureus N315
acacaaaggauauugaaa

SEQ ID NO: 4047235 - RNA, 23 nt, Staphylococcus aureus subsp. aureus N315
acacaaauaaaggcaacaaauau

SEQ ID NO: 4047236 - RNA, 22 nt, Staphylococcus aureus subsp. aureus N315
acacaaauuuuuuguaaacaug

SEQ ID NO: 4047237 - RNA, 14 nt, Staphylococcus aureus subsp. aureus N315
acacaacgauagau

SEQ ID NO: 4047238 - RNA, 18 nt, Staphylococcus aureus subsp. aureus N315
acacaaugcccuuaaagc

SEQ ID NO: 4047239 - RNA, 19 nt, Staphylococcus aureus subsp. aureus N315
acacaaugcccuuaaagca

SEQ ID NO: 4047240 - RNA, 19 nt, Staphylococcus aureus subsp. aureus N315
acacacaugauaauuuuua

SEQ ID NO: 4047241 - RNA, 14 nt, Staphylococcus aureus subsp. aureus N315
acacacuaaaagcu

SEQ ID NO: 4047242 - RNA, 23 nt, Staphylococcus aureus subsp. aureus N315
acacacuauuauagcuagcuaag

SEQ ID NO: 4047243 - RNA, 21 nt, Staphylococcus aureus subsp. aureus N315
acacacuguugaaaaugacua

SEQ ID NO: 4047244 - RNA, 23 nt, Staphylococcus aureus subsp. aureus N315
acacagaagcugacgaaaaguca

SEQ ID NO: 4047245 - RNA, 22 nt, Staphylococcus aureus subsp. aureus N315
acacagagaaauucgaaaagaa

SEQ ID NO: 4047246 - RNA, 14 nt, Staphylococcus aureus subsp. aureus N315
acacagguaaauuu

SEQ ID NO: 4047247 - RNA, 20 nt, Staphylococcus aureus subsp. aureus N315
acacagguaaauuuaaaaua

SEQ ID NO: 4047248 - RNA, 21 nt, Staphylococcus aureus subsp. aureus N315
acacagguaaauuuaaaauaa

SEQ ID NO: 4047249 - RNA, 13 nt, Staphylococcus aureus subsp. aureus N315
acacaguacaaau

SEQ ID NO: 4047250 - RNA, 13 nt, Staphylococcus aureus subsp. aureus N315
acacauaaauuaa

SEQ ID NO: 4047251 - RNA, 13 nt, Staphylococcus aureus subsp. aureus N315
acacaucacuaua

SEQ ID NO: 4047252 - RNA, 21 nt, Staphylococcus aureus subsp. aureus N315
acacauccucauaauuaucau

SEQ ID NO: 4047253 - RNA, 16 nt, Staphylococcus aureus subsp. aureus N315
acacaugcacuuuauu

SEQ ID NO: 4047254 - RNA, 21 nt, Staphylococcus aureus subsp. aureus N315
acacauuauugaaauuuuuaa

SEQ ID NO: 4047255 - RNA, 13 nt, Staphylococcus aureus subsp. aureus N315
acaccaacauauu

SEQ ID NO: 4047256 - RNA, 19 nt, Staphylococcus aureus subsp. aureus N315
acaccacuuaggauaaacu

SEQ ID NO: 4047257 - RNA, 20 nt, Staphylococcus aureus subsp. aureus N315
acaccauuguuauagcguuu

SEQ ID NO: 4047258 - RNA, 12 nt, Staphylococcus aureus subsp. aureus N315
acaccccaacuu

SEQ ID NO: 4047259 - RNA, 15 nt, Staphylococcus aureus subsp. aureus N315
acaccuauaccucau

SEQ ID NO: 4047260 - RNA, 15 nt, Staphylococcus aureus subsp. aureus N315
acaccuauaccucgu

SEQ ID NO: 4047261 - RNA, 17 nt, Staphylococcus aureus subsp. aureus N315
acaccuucaauaucugu

SEQ ID NO: 4047262 - RNA, 21 nt, Staphylococcus aureus subsp. aureus N315
acacgaguauuaucacauaga

SEQ ID NO: 4047263 - RNA, 17 nt, Staphylococcus aureus subsp. aureus N315
acacgcauuacuuuaga

SEQ ID NO: 4047264 - RNA, 19 nt, Staphylococcus aureus subsp. aureus N315
acacgcauuacuuuagaaa

SEQ ID NO: 4047265 - RNA, 14 nt, Staphylococcus aureus subsp. aureus N315
acacguguaaaaau

SEQ ID NO: 4047266 - RNA, 17 nt, Staphylococcus aureus subsp. aureus N315
acacguguaaaaaugau

SEQ ID NO: 4047267 - RNA, 21 nt, Staphylococcus aureus subsp. aureus N315
acacguguauuguauuuuaau

SEQ ID NO: 4047268 - RNA, 19 nt, Staphylococcus aureus subsp. aureus N315
acacuaaaaccuauuccua

SEQ ID NO: 4047269 - RNA, 21 nt, Staphylococcus aureus subsp. aureus N315
acacuagucuuuuuauuuuaa

SEQ ID NO: 4047270 - RNA, 12 nt, Staphylococcus aureus subsp. aureus N315
acacuauuauag

SEQ ID NO: 4047271 - RNA, 16 nt, Staphylococcus aureus subsp. aureus N315
acacucggaaacaugu

SEQ ID NO: 4047272 - RNA, 17 nt, Staphylococcus aureus subsp. aureus N315
acacugagaauuucuaa

SEQ ID NO: 4047273 - RNA, 15 nt, Staphylococcus aureus subsp. aureus N315
acacugcacaucaua

SEQ ID NO: 4047274 - RNA, 17 nt, Staphylococcus aureus subsp. aureus N315
acacugcacaucauaau

SEQ ID NO: 4047275 - RNA, 22 nt, Staphylococcus aureus subsp. aureus N315
acacuguuuuauaaaugaauua

SEQ ID NO: 4047276 - RNA, 22 nt, Staphylococcus aureus subsp. aureus N315
acacuucaacauauaaaucauu

SEQ ID NO: 4047277 - RNA, 13 nt, Staphylococcus aureus subsp. aureus N315
acacuugauaaaa

SEQ ID NO: 4047278 - RNA, 16 nt, Staphylococcus aureus subsp. aureus N315
acacuugauaaaacua

SEQ ID NO: 4047279 - RNA, 15 nt, Staphylococcus aureus subsp. aureus N315
acacuugauuaucau

SEQ ID NO: 4047280 - RNA, 20 nt, Staphylococcus aureus subsp. aureus N315
acacuuggcuuaggaugaaa

SEQ ID NO: 4047281 - RNA, 12 nt, Staphylococcus aureus subsp. aureus N315
acagaaaacaaa

SEQ ID NO: 4047282 - RNA, 22 nt, Staphylococcus aureus subsp. aureus N315
acagaaaaucguuauaaguaca

SEQ ID NO: 4047283 - RNA, 14 nt, Staphylococcus aureus subsp. aureus N315
acagaauuucauca

SEQ ID NO: 4047284 - RNA, 16 nt, Staphylococcus aureus subsp. aureus N315
acagaauuucaucaaa

SEQ ID NO: 4047285 - RNA, 18 nt, Staphylococcus aureus subsp. aureus N315
acagaauuucaucaaauc

SEQ ID NO: 4047286 - RNA, 13 nt, Staphylococcus aureus subsp. aureus N315
acagacaaacauu

SEQ ID NO: 4047287 - RNA, 14 nt, Staphylococcus aureus subsp. aureus N315
acagacaaacauua

SEQ ID NO: 4047288 - RNA, 22 nt, Staphylococcus aureus subsp. aureus N315
acagagaaauucgaaaagaaau

SEQ ID NO: 4047289 - RNA, 22 nt, Staphylococcus aureus subsp. aureus N315
acagagaaucaauuauugaaaa

SEQ ID NO: 4047290 - RNA, 15 nt, Staphylococcus aureus subsp. aureus N315
acagauaaagcuucg

SEQ ID NO: 4047291 - RNA, 17 nt, Staphylococcus aureus subsp. aureus N315
acagauaaguaauaaua

SEQ ID NO: 4047292 - RNA, 16 nt, Staphylococcus aureus subsp. aureus N315
acagaugaugcuucgc

SEQ ID NO: 4047293 - RNA, 16 nt, Staphylococcus aureus subsp. aureus N315
acagaugaugcuucuc

SEQ ID NO: 4047294 - RNA, 23 nt, Staphylococcus aureus subsp. aureus N315
acagauuuaccucuugauaaaau

SEQ ID NO: 4047295 - RNA, 19 nt, Staphylococcus aureus subsp. aureus N315
acagcaaaaaauaaaucuc

SEQ ID NO: 4047296 - RNA, 14 nt, Staphylococcus aureus subsp. aureus N315
acagcaaauaaaau

SEQ ID NO: 4047297 - RNA, 17 nt, Staphylococcus aureus subsp. aureus N315
acagcacgagacaauaa

SEQ ID NO: 4047298 - RNA, 22 nt, Staphylococcus aureus subsp. aureus N315
acagcaguaagacgauuucaau

SEQ ID NO: 4047299 - RNA, 20 nt, Staphylococcus aureus subsp. aureus N315
acagcauuuccuaugugcug

SEQ ID NO: 4047300 - RNA, 16 nt, Staphylococcus aureus subsp. aureus N315
acagccgaggcaauau

SEQ ID NO: 4047301 - RNA, 13 nt, Staphylococcus aureus subsp. aureus N315
acagcuucaaaau

SEQ ID NO: 4047302 - RNA, 13 nt, Staphylococcus aureus subsp. aureus N315
acagcuucauuaa

SEQ ID NO: 4047303 - RNA, 14 nt, Staphylococcus aureus subsp. aureus N315
acagcuuuuucuac

SEQ ID NO: 4047304 - RNA, 15 nt, Staphylococcus aureus subsp. aureus N315
acagggguaaaacuu

SEQ ID NO: 4047305 - RNA, 20 nt, Staphylococcus aureus subsp. aureus N315
acagguaaauuuaaaauaau

SEQ ID NO: 4047306 - RNA, 17 nt, Staphylococcus aureus subsp. aureus N315
acaggugcuuacuuuua

SEQ ID NO: 4047307 - RNA, 15 nt, Staphylococcus aureus subsp. aureus N315
acagguuuaaacauc

SEQ ID NO: 4047308 - RNA, 17 nt, Staphylococcus aureus subsp. aureus N315
acaguacaaauaacaaa

SEQ ID NO: 4047309 - RNA, 20 nt, Staphylococcus aureus subsp. aureus N315
acaguacacuaaguuuucuu

SEQ ID NO: 4047310 - RNA, 22 nt, Staphylococcus aureus subsp. aureus N315
acaguaguuaauugaaugaaaa

SEQ ID NO: 4047311 - RNA, 14 nt, Staphylococcus aureus subsp. aureus N315
acaguaucuucagu

SEQ ID NO: 4047312 - RNA, 18 nt, Staphylococcus aureus subsp. aureus N315
acaguaugauuaggauua

SEQ ID NO: 4047313 - RNA, 15 nt, Staphylococcus aureus subsp. aureus N315
acagucaacugcugc

SEQ ID NO: 4047314 - RNA, 18 nt, Staphylococcus aureus subsp. aureus N315
acagucauaaauugauuu

SEQ ID NO: 4047315 - RNA, 17 nt, Staphylococcus aureus subsp. aureus N315
acagugacugauucacc

SEQ ID NO: 4047316 - RNA, 17 nt, Staphylococcus aureus subsp. aureus N315
acaguggauuacagaug

SEQ ID NO: 4047317 - RNA, 19 nt, Staphylococcus aureus subsp. aureus N315
acaguguaugaugaacuua

SEQ ID NO: 4047318 - RNA, 23 nt, Staphylococcus aureus subsp. aureus N315
acaguuacuuucgcuugcaaaga

SEQ ID NO: 4047319 - RNA, 14 nt, Staphylococcus aureus subsp. aureus N315
acaguuauauauuc

SEQ ID NO: 4047320 - RNA, 20 nt, Staphylococcus aureus subsp. aureus N315
acaguuaugccugaagcgcu

SEQ ID NO: 4047321 - RNA, 22 nt, Staphylococcus aureus subsp. aureus N315
acaguucuauagguuuauaaaa

SEQ ID NO: 4047322 - RNA, 20 nt, Staphylococcus aureus subsp. aureus N315
acaguuucuuggucugcugu

SEQ ID NO: 4047323 - RNA, 22 nt, Staphylococcus aureus subsp. aureus N315
acaguuucuuggucugcuguau

SEQ ID NO: 4047324 - RNA, 19 nt, Staphylococcus aureus subsp. aureus N315
acaguuuuaaaugaaacuu

SEQ ID NO: 4047325 - RNA, 14 nt, Staphylococcus aureus subsp. aureus N315
acauaaaacuuaca

SEQ ID NO: 4047326 - RNA, 13 nt, Staphylococcus aureus subsp. aureus N315
acauaaaauuuaa

SEQ ID NO: 4047327 - RNA, 14 nt, Staphylococcus aureus subsp. aureus N315
acauaaaauuuaaa

SEQ ID NO: 4047328 - RNA, 14 nt, Staphylococcus aureus subsp. aureus N315
acauaaauaaacuu

SEQ ID NO: 4047329 - RNA, 22 nt, Staphylococcus aureus subsp. aureus N315
acauaaauaagcaguaagauga

SEQ ID NO: 4047330 - RNA, 16 nt, Staphylococcus aureus subsp. aureus N315
acauaaauacaaaaau

SEQ ID NO: 4047331 - RNA, 17 nt, Staphylococcus aureus subsp. aureus N315
acauaaauacaaaaaua

SEQ ID NO: 4047332 - RNA, 18 nt, Staphylococcus aureus subsp. aureus N315
acauaaaugcuaaaagua

SEQ ID NO: 4047333 - RNA, 18 nt, Staphylococcus aureus subsp. aureus N315
acauaaauuaagcaugac

SEQ ID NO: 4047334 - RNA, 14 nt, Staphylococcus aureus subsp. aureus N315
acauaacacaaguu

SEQ ID NO: 4047335 - RNA, 19 nt, Staphylococcus aureus subsp. aureus N315
acauaaccuaauucgccau

SEQ ID NO: 4047336 - RNA, 18 nt, Staphylococcus aureus subsp. aureus N315
acauaagaugauuuagac

SEQ ID NO: 4047337 - RNA, 16 nt, Staphylococcus aureus subsp. aureus N315
acauaaucauugugua

SEQ ID NO: 4047338 - RNA, 22 nt, Staphylococcus aureus subsp. aureus N315
acauaaucauuguguauuguuu

SEQ ID NO: 4047339 - RNA, 21 nt, Staphylococcus aureus subsp. aureus N315
acauaauccagccacaccaaa

SEQ ID NO: 4047340 - RNA, 18 nt, Staphylococcus aureus subsp. aureus N315
acauaauuuaucaauuuc

SEQ ID NO: 4047341 - RNA, 20 nt, Staphylococcus aureus subsp. aureus N315
acauaauuuaucaauuucua

SEQ ID NO: 4047342 - RNA, 16 nt, Staphylococcus aureus subsp. aureus N315
acauaauuuaucugca

SEQ ID NO: 4047343 - RNA, 16 nt, Staphylococcus aureus subsp. aureus N315
acauaauuuuuauuua

SEQ ID NO: 4047344 - RNA, 18 nt, Staphylococcus aureus subsp. aureus N315
acauaauuuuuauuuaca

SEQ ID NO: 4047345 - RNA, 16 nt, Staphylococcus aureus subsp. aureus N315
acauacaccuucagau

SEQ ID NO: 4047346 - RNA, 16 nt, Staphylococcus aureus subsp. aureus N315
acauacagucaauaca

SEQ ID NO: 4047347 - RNA, 21 nt, Staphylococcus aureus subsp. aureus N315
acauaccacacuuuaaacaag

SEQ ID NO: 4047348 - RNA, 19 nt, Staphylococcus aureus subsp. aureus N315
acauaccaguggaaauuau

SEQ ID NO: 4047349 - RNA, 22 nt, Staphylococcus aureus subsp. aureus N315
acauaccaguggaaauuaugua

SEQ ID NO: 4047350 - RNA, 15 nt, Staphylococcus aureus subsp. aureus N315
acauacugauuaaac

SEQ ID NO: 4047351 - RNA, 14 nt, Staphylococcus aureus subsp. aureus N315
acauagaaaagcag

SEQ ID NO: 4047352 - RNA, 22 nt, Staphylococcus aureus subsp. aureus N315
acauagaauaacgucauauguu

SEQ ID NO: 4047353 - RNA, 16 nt, Staphylococcus aureus subsp. aureus N315
acauagaguaauuuua

SEQ ID NO: 4047354 - RNA, 17 nt, Staphylococcus aureus subsp. aureus N315
acauagaguaauuuuac

SEQ ID NO: 4047355 - RNA, 19 nt, Staphylococcus aureus subsp. aureus N315
acauagguauaaucauuua

SEQ ID NO: 4047356 - RNA, 18 nt, Staphylococcus aureus subsp. aureus N315
acauauaaaaaauuauua

SEQ ID NO: 4047357 - RNA, 19 nt, Staphylococcus aureus subsp. aureus N315
acauauaaaaaauuauuaa

SEQ ID NO: 4047358 - RNA, 13 nt, Staphylococcus aureus subsp. aureus N315
acauauaagaauu

SEQ ID NO: 4047359 - RNA, 18 nt, Staphylococcus aureus subsp. aureus N315
acauaucgucaauuuuaa

SEQ ID NO: 4047360 - RNA, 15 nt, Staphylococcus aureus subsp. aureus N315
acauaugacuuuauu

SEQ ID NO: 4047361 - RNA, 14 nt, Staphylococcus aureus subsp. aureus N315
acauaugcagugac

SEQ ID NO: 4047362 - RNA, 21 nt, Staphylococcus aureus subsp. aureus N315
acauauguuguuucuaaugcu

SEQ ID NO: 4047363 - RNA, 15 nt, Staphylococcus aureus subsp. aureus N315
acauauuauaaaagu

SEQ ID NO: 4047364 - RNA, 14 nt, Staphylococcus aureus subsp. aureus N315
acauauuauauaua

SEQ ID NO: 4047365 - RNA, 18 nt, Staphylococcus aureus subsp. aureus N315
acauauucaguauaugua

SEQ ID NO: 4047366 - RNA, 17 nt, Staphylococcus aureus subsp. aureus N315
acauauuuuaacuauga

SEQ ID NO: 4047367 - RNA, 18 nt, Staphylococcus aureus subsp. aureus N315
acaucaaauagacaccaa

SEQ ID NO: 4047368 - RNA, 19 nt, Staphylococcus aureus subsp. aureus N315
acaucaaauagacaccaaa

SEQ ID NO: 4047369 - RNA, 22 nt, Staphylococcus aureus subsp. aureus N315
acaucaaauagacaccaaaaaa

SEQ ID NO: 4047370 - RNA, 20 nt, Staphylococcus aureus subsp. aureus N315
acaucaaauuuuucgacauc

SEQ ID NO: 4047371 - RNA, 13 nt, Staphylococcus aureus subsp. aureus N315
acaucaauaucuu

SEQ ID NO: 4047372 - RNA, 15 nt, Staphylococcus aureus subsp. aureus N315
acaucaauaucuucu

SEQ ID NO: 4047373 - RNA, 21 nt, Staphylococcus aureus subsp. aureus N315
acaucacuauacgcaaucauu

SEQ ID NO: 4047374 - RNA, 14 nt, Staphylococcus aureus subsp. aureus N315
acaucacuugcugu

SEQ ID NO: 4047375 - RNA, 21 nt, Staphylococcus aureus subsp. aureus N315
acaucauaauaaaucuaucua

SEQ ID NO: 4047376 - RNA, 22 nt, Staphylococcus aureus subsp. aureus N315
acaucauaauaaaucuaucuac

SEQ ID NO: 4047377 - RNA, 23 nt, Staphylococcus aureus subsp. aureus N315
acaucaugugucuuccaaucaac

SEQ ID NO: 4047378 - RNA, 22 nt, Staphylococcus aureus subsp. aureus N315
acaucauugauagauagaaauu

SEQ ID NO: 4047379 - RNA, 22 nt, Staphylococcus aureus subsp. aureus N315
acauccaauuauguuuaucuac

SEQ ID NO: 4047380 - RNA, 21 nt, Staphylococcus aureus subsp. aureus N315
acauccacuuuauaauuuuug

SEQ ID NO: 4047381 - RNA, 15 nt, Staphylococcus aureus subsp. aureus N315
acauccccaaaaaua

SEQ ID NO: 4047382 - RNA, 19 nt, Staphylococcus aureus subsp. aureus N315
acauccccaaaaauagauu

SEQ ID NO: 4047383 - RNA, 19 nt, Staphylococcus aureus subsp. aureus N315
acaucgcauaauaucuuac

SEQ ID NO: 4047384 - RNA, 16 nt, Staphylococcus aureus subsp. aureus N315
acaucuaaauuugcca

SEQ ID NO: 4047385 - RNA, 14 nt, Staphylococcus aureus subsp. aureus N315
acaucuaauaaaua

SEQ ID NO: 4047386 - RNA, 18 nt, Staphylococcus aureus subsp. aureus N315
acaucuacaucaaauuuu

SEQ ID NO: 4047387 - RNA, 22 nt, Staphylococcus aureus subsp. aureus N315
acaucuagaugaaauuguguug

SEQ ID NO: 4047388 - RNA, 19 nt, Staphylococcus aureus subsp. aureus N315
acaucuauaacaaaaucuc

SEQ ID NO: 4047389 - RNA, 21 nt, Staphylococcus aureus subsp. aureus N315
acaucuauguggcuacuugaa

SEQ ID NO: 4047390 - RNA, 14 nt, Staphylococcus aureus subsp. aureus N315
acaucugaaaaaau

SEQ ID NO: 4047391 - RNA, 17 nt, Staphylococcus aureus subsp. aureus N315
acaucuucauguaugaa

SEQ ID NO: 4047392 - RNA, 17 nt, Staphylococcus aureus subsp. aureus N315
acaucuuuuguuguuuu

SEQ ID NO: 4047393 - RNA, 13 nt, Staphylococcus aureus subsp. aureus N315
acaucuuuuuaaa

SEQ ID NO: 4047394 - RNA, 20 nt, Staphylococcus aureus subsp. aureus N315
acaucuuuuuaaaaggugug

SEQ ID NO: 4047395 - RNA, 15 nt, Staphylococcus aureus subsp. aureus N315
acaucuuuuugauaa

SEQ ID NO: 4047396 - RNA, 16 nt, Staphylococcus aureus subsp. aureus N315
acaugaauuuuaauau

SEQ ID NO: 4047397 - RNA, 22 nt, Staphylococcus aureus subsp. aureus N315
acaugacauucauuuaguuaaa

SEQ ID NO: 4047398 - RNA, 23 nt, Staphylococcus aureus subsp. aureus N315
acaugaggaucaacugaaauuuu

SEQ ID NO: 4047399 - RNA, 12 nt, Staphylococcus aureus subsp. aureus N315
acaugauaauuu

SEQ ID NO: 4047400 - RNA, 17 nt, Staphylococcus aureus subsp. aureus N315
acaugauacugaaauuu

SEQ ID NO: 4047401 - RNA, 19 nt, Staphylococcus aureus subsp. aureus N315
acaugauucaugauauguu

SEQ ID NO: 4047402 - RNA, 19 nt, Staphylococcus aureus subsp. aureus N315
acaugcaccuuuacaacau

SEQ ID NO: 4047403 - RNA, 19 nt, Staphylococcus aureus subsp. aureus N315
acaugcacuuuauuaaaaa

SEQ ID NO: 4047404 - RNA, 23 nt, Staphylococcus aureus subsp. aureus N315
acaugcacuuuauuaaaaauccu

SEQ ID NO: 4047405 - RNA, 14 nt, Staphylococcus aureus subsp. aureus N315
acaugguaucuuua

SEQ ID NO: 4047406 - RNA, 16 nt, Staphylococcus aureus subsp. aureus N315
acaugguuuucaccag

SEQ ID NO: 4047407 - RNA, 13 nt, Staphylococcus aureus subsp. aureus N315
acauguacaauuu

SEQ ID NO: 4047408 - RNA, 13 nt, Staphylococcus aureus subsp. aureus N315
acauguacauuau

SEQ ID NO: 4047409 - RNA, 20 nt, Staphylococcus aureus subsp. aureus N315
acauguacguuuuuuuaaau

SEQ ID NO: 4047410 - RNA, 18 nt, Staphylococcus aureus subsp. aureus N315
acauguauuggccaaaca

SEQ ID NO: 4047411 - RNA, 20 nt, Staphylococcus aureus subsp. aureus N315
acauguuacugaugaacaua

SEQ ID NO: 4047412 - RNA, 16 nt, Staphylococcus aureus subsp. aureus N315
acauguuccgcuacaa

SEQ ID NO: 4047413 - RNA, 19 nt, Staphylococcus aureus subsp. aureus N315
acauuaaaaugauaucuga

SEQ ID NO: 4047414 - RNA, 21 nt, Staphylococcus aureus subsp. aureus N315
acauuaaaauguguuuucaac

SEQ ID NO: 4047415 - RNA, 12 nt, Staphylococcus aureus subsp. aureus N315
acauuaaauauu

SEQ ID NO: 4047416 - RNA, 15 nt, Staphylococcus aureus subsp. aureus N315
acauuaaucuauaua

SEQ ID NO: 4047417 - RNA, 17 nt, Staphylococcus aureus subsp. aureus N315
acauuaauuggauuaaa

SEQ ID NO: 4047418 - RNA, 16 nt, Staphylococcus aureus subsp. aureus N315
acauuagcaugauaaa

SEQ ID NO: 4047419 - RNA, 16 nt, Staphylococcus aureus subsp. aureus N315
acauuaucaagaauaa

SEQ ID NO: 4047420 - RNA, 13 nt, Staphylococcus aureus subsp. aureus N315
acauuauugaaau

SEQ ID NO: 4047421 - RNA, 21 nt, Staphylococcus aureus subsp. aureus N315
acauuauuguaaguuggcuua

SEQ ID NO: 4047422 - RNA, 12 nt, Staphylococcus aureus subsp. aureus N315
acauuauuuaua

SEQ ID NO: 4047423 - RNA, 21 nt, Staphylococcus aureus subsp. aureus N315
acauucaaauaaaugacauuu

SEQ ID NO: 4047424 - RNA, 20 nt, Staphylococcus aureus subsp. aureus N315
acauucagugcaaugauagc

SEQ ID NO: 4047425 - RNA, 21 nt, Staphylococcus aureus subsp. aureus N315
acauucauuuaguuaaauaca

SEQ ID NO: 4047426 - RNA, 12 nt, Staphylococcus aureus subsp. aureus N315
acauuccaucuu

SEQ ID NO: 4047427 - RNA, 15 nt, Staphylococcus aureus subsp. aureus N315
acauuccaucuuaaa

SEQ ID NO: 4047428 - RNA, 20 nt, Staphylococcus aureus subsp. aureus N315
acauucccguuaauaucaug

SEQ ID NO: 4047429 - RNA, 19 nt, Staphylococcus aureus subsp. aureus N315
acauucuucaaaaaauaau

SEQ ID NO: 4047430 - RNA, 18 nt, Staphylococcus aureus subsp. aureus N315
acauucuugaauaaauuu

SEQ ID NO: 4047431 - RNA, 22 nt, Staphylococcus aureus subsp. aureus N315
acauugaacgauaacaauuuau

SEQ ID NO: 4047432 - RNA, 13 nt, Staphylococcus aureus subsp. aureus N315
acauugaauaaau

SEQ ID NO: 4047433 - RNA, 18 nt, Staphylococcus aureus subsp. aureus N315
acauugagauuaucuuua

SEQ ID NO: 4047434 - RNA, 16 nt, Staphylococcus aureus subsp. aureus N315
acauugauaaaauaau

SEQ ID NO: 4047435 - RNA, 17 nt, Staphylococcus aureus subsp. aureus N315
acauugaugucaauuuc

SEQ ID NO: 4047436 - RNA, 15 nt, Staphylococcus aureus subsp. aureus N315
acauuguaaaaugcu

SEQ ID NO: 4047437 - RNA, 22 nt, Staphylococcus aureus subsp. aureus N315
acauuguaaaaugcucccuuca

SEQ ID NO: 4047438 - RNA, 21 nt, Staphylococcus aureus subsp. aureus N315
acauuguaaauauaguaauaa

SEQ ID NO: 4047439 - RNA, 22 nt, Staphylococcus aureus subsp. aureus N315
acauugugaaaguuuuugucuu

SEQ ID NO: 4047440 - RNA, 12 nt, Staphylococcus aureus subsp. aureus N315
acauuuaaaaaa

SEQ ID NO: 4047441 - RNA, 18 nt, Staphylococcus aureus subsp. aureus N315
acauuuaaaaaaugcgcu

SEQ ID NO: 4047442 - RNA, 14 nt, Staphylococcus aureus subsp. aureus N315
acauuuaauacuuu

SEQ ID NO: 4047443 - RNA, 14 nt, Staphylococcus aureus subsp. aureus N315
acauuuacauccaa

SEQ ID NO: 4047444 - RNA, 20 nt, Staphylococcus aureus subsp. aureus N315
acauuuaggagccuagaaca

SEQ ID NO: 4047445 - RNA, 20 nt, Staphylococcus aureus subsp. aureus N315
acauuuaucgugaagaaaaa

SEQ ID NO: 4047446 - RNA, 22 nt, Staphylococcus aureus subsp. aureus N315
acauuuaucgugaagaaaaaau

SEQ ID NO: 4047447 - RNA, 17 nt, Staphylococcus aureus subsp. aureus N315
acauuuauucuuucucu

SEQ ID NO: 4047448 - RNA, 20 nt, Staphylococcus aureus subsp. aureus N315
acauuuauucuuucucuauu

SEQ ID NO: 4047449 - RNA, 21 nt, Staphylococcus aureus subsp. aureus N315
acauuuauucuuucucuauua

SEQ ID NO: 4047450 - RNA, 14 nt, Staphylococcus aureus subsp. aureus N315
acauuuauuuucaa

SEQ ID NO: 4047451 - RNA, 17 nt, Staphylococcus aureus subsp. aureus N315
acauuucagcauuugcu

SEQ ID NO: 4047452 - RNA, 12 nt, Staphylococcus aureus subsp. aureus N315
acauuucccauu

SEQ ID NO: 4047453 - RNA, 23 nt, Staphylococcus aureus subsp. aureus N315
acauuucccauuuaucuaacaau

SEQ ID NO: 4047454 - RNA, 14 nt, Staphylococcus aureus subsp. aureus N315
acauuucuauacaa

SEQ ID NO: 4047455 - RNA, 18 nt, Staphylococcus aureus subsp. aureus N315
acauuucugaugcuagcu

SEQ ID NO: 4047456 - RNA, 20 nt, Staphylococcus aureus subsp. aureus N315
acauuugaccaaguaugaga

SEQ ID NO: 4047457 - RNA, 19 nt, Staphylococcus aureus subsp. aureus N315
acauuugguggagaaccuu

SEQ ID NO: 4047458 - RNA, 15 nt, Staphylococcus aureus subsp. aureus N315
acauuugguucuucu

SEQ ID NO: 4047459 - RNA, 12 nt, Staphylococcus aureus subsp. aureus N315
acauuugucaua

SEQ ID NO: 4047460 - RNA, 14 nt, Staphylococcus aureus subsp. aureus N315
acauuuuaaaucua

SEQ ID NO: 4047461 - RNA, 22 nt, Staphylococcus aureus subsp. aureus N315
acauuuuaaaucuaauuauuca

SEQ ID NO: 4047462 - RNA, 15 nt, Staphylococcus aureus subsp. aureus N315
acauuuuaauaaaau

SEQ ID NO: 4047463 - RNA, 17 nt, Staphylococcus aureus subsp. aureus N315
acauuuuaucugaaaau

SEQ ID NO: 4047464 - RNA, 18 nt, Staphylococcus aureus subsp. aureus N315
acauuuuaucugaaaaua

SEQ ID NO: 4047465 - RNA, 17 nt, Staphylococcus aureus subsp. aureus N315
acauuuucaaaaccaau

SEQ ID NO: 4047466 - RNA, 19 nt, Staphylococcus aureus subsp. aureus N315
acauuuugccccucauuca

SEQ ID NO: 4047467 - RNA, 15 nt, Staphylococcus aureus subsp. aureus N315
acauuuuugaauuua

SEQ ID NO: 4047468 - RNA, 21 nt, Staphylococcus aureus subsp. aureus N315
acauuuuugaauuuaauacua

SEQ ID NO: 4047469 - RNA, 16 nt, Staphylococcus aureus subsp. aureus N315
acauuuuugugcaaaa

SEQ ID NO: 4047470 - RNA, 15 nt, Staphylococcus aureus subsp. aureus N315
accaaaaaucaucca

SEQ ID NO: 4047471 - RNA, 17 nt, Staphylococcus aureus subsp. aureus N315
accaaagaaaucaccag

SEQ ID NO: 4047472 - RNA, 22 nt, Staphylococcus aureus subsp. aureus N315
accaaauaaauaagugauaaau

SEQ ID NO: 4047473 - RNA, 15 nt, Staphylococcus aureus subsp. aureus N315
accaaauaaauuaaa

SEQ ID NO: 4047474 - RNA, 19 nt, Staphylococcus aureus subsp. aureus N315
accaaaucggaauaaaaua

SEQ ID NO: 4047475 - RNA, 15 nt, Staphylococcus aureus subsp. aureus N315
accaacaacuuuguu

SEQ ID NO: 4047476 - RNA, 22 nt, Staphylococcus aureus subsp. aureus N315
accaacaauugcacuuggugau

SEQ ID NO: 4047477 - RNA, 17 nt, Staphylococcus aureus subsp. aureus N315
accaacaccuaauauuu

SEQ ID NO: 4047478 - RNA, 18 nt, Staphylococcus aureus subsp. aureus N315
accaacaccuaauauuuu

SEQ ID NO: 4047479 - RNA, 19 nt, Staphylococcus aureus subsp. aureus N315
accaaccaaaaccaaauga

SEQ ID NO: 4047480 - RNA, 21 nt, Staphylococcus aureus subsp. aureus N315
accaacugucgguucaucuaa

SEQ ID NO: 4047481 - RNA, 12 nt, Staphylococcus aureus subsp. aureus N315
accaacuuuuuu

SEQ ID NO: 4047482 - RNA, 16 nt, Staphylococcus aureus subsp. aureus N315
accaagauuccaucac

SEQ ID NO: 4047483 - RNA, 24 nt, Staphylococcus aureus subsp. aureus N315
accaagugcuuuuuuaccagcaug

SEQ ID NO: 4047484 - RNA, 11 nt, Staphylococcus aureus subsp. aureus N315
accaaucgaag

SEQ ID NO: 4047485 - RNA, 20 nt, Staphylococcus aureus subsp. aureus N315
accaaugauagugaauaaug

SEQ ID NO: 4047486 - RNA, 16 nt, Staphylococcus aureus subsp. aureus N315
accaaugauuguuaau

SEQ ID NO: 4047487 - RNA, 12 nt, Staphylococcus aureus subsp. aureus N315
accaauuagcau

SEQ ID NO: 4047488 - RNA, 13 nt, Staphylococcus aureus subsp. aureus N315
accaauuagcaug

SEQ ID NO: 4047489 - RNA, 15 nt, Staphylococcus aureus subsp. aureus N315
accaauuagcaugac

SEQ ID NO: 4047490 - RNA, 15 nt, Staphylococcus aureus subsp. aureus N315
accaauugaaauuaa

SEQ ID NO: 4047491 - RNA, 16 nt, Staphylococcus aureus subsp. aureus N315
accaauugaaauuaac

SEQ ID NO: 4047492 - RNA, 18 nt, Staphylococcus aureus subsp. aureus N315
accaauuuuaacuuauau

SEQ ID NO: 4047493 - RNA, 14 nt, Staphylococcus aureus subsp. aureus N315
accacaaccaguca

SEQ ID NO: 4047494 - RNA, 12 nt, Staphylococcus aureus subsp. aureus N315
accacaacuucu

SEQ ID NO: 4047495 - RNA, 13 nt, Staphylococcus aureus subsp. aureus N315
accacacagcauu

SEQ ID NO: 4047496 - RNA, 23 nt, Staphylococcus aureus subsp. aureus N315
accacaccaugcugcacauucca

SEQ ID NO: 4047497 - RNA, 17 nt, Staphylococcus aureus subsp. aureus N315
accacacuuuaaacaag

SEQ ID NO: 4047498 - RNA, 23 nt, Staphylococcus aureus subsp. aureus N315
accacacuuuaaacaagcaucau

SEQ ID NO: 4047499 - RNA, 15 nt, Staphylococcus aureus subsp. aureus N315
accaccccaacuugc

SEQ ID NO: 4047500 - RNA, 19 nt, Staphylococcus aureus subsp. aureus N315
accacuauaauuucuuaau

SEQ ID NO: 4047501 - RNA, 15 nt, Staphylococcus aureus subsp. aureus N315
accacuauuuuuaaa

SEQ ID NO: 4047502 - RNA, 19 nt, Staphylococcus aureus subsp. aureus N315
accacuggccuuuaaugau

SEQ ID NO: 4047503 - RNA, 14 nt, Staphylococcus aureus subsp. aureus N315
accacuucuucacc

SEQ ID NO: 4047504 - RNA, 17 nt, Staphylococcus aureus subsp. aureus N315
accacuucuucaccugc

SEQ ID NO: 4047505 - RNA, 16 nt, Staphylococcus aureus subsp. aureus N315
accacuugaauacuuu

SEQ ID NO: 4047506 - RNA, 21 nt, Staphylococcus aureus subsp. aureus N315
accacuugaauacuuuuuaac

SEQ ID NO: 4047507 - RNA, 15 nt, Staphylococcus aureus subsp. aureus N315
accacuuuuguuaaa

SEQ ID NO: 4047508 - RNA, 21 nt, Staphylococcus aureus subsp. aureus N315
accacuuuuguuaaaaaaugg

SEQ ID NO: 4047509 - RNA, 22 nt, Staphylococcus aureus subsp. aureus N315
accacuuuuucuguaauaauua

SEQ ID NO: 4047510 - RNA, 20 nt, Staphylococcus aureus subsp. aureus N315
accagccucuguguuggggc

SEQ ID NO: 4047511 - RNA, 15 nt, Staphylococcus aureus subsp. aureus N315
accagcuaacaaaag

SEQ ID NO: 4047512 - RNA, 18 nt, Staphylococcus aureus subsp. aureus N315
accagcuaaccaaauaau

SEQ ID NO: 4047513 - RNA, 17 nt, Staphylococcus aureus subsp. aureus N315
accaguagcuaaugcaa

SEQ ID NO: 4047514 - RNA, 17 nt, Staphylococcus aureus subsp. aureus N315
accaguuugaucauaau

SEQ ID NO: 4047515 - RNA, 16 nt, Staphylococcus aureus subsp. aureus N315
accauaauuaaauaac

SEQ ID NO: 4047516 - RNA, 16 nt, Staphylococcus aureus subsp. aureus N315
accauaguaauaaaau

SEQ ID NO: 4047517 - RNA, 20 nt, Staphylococcus aureus subsp. aureus N315
accauauuuaugguguagcu

SEQ ID NO: 4047518 - RNA, 18 nt, Staphylococcus aureus subsp. aureus N315
accauauuuuuagaaaag

SEQ ID NO: 4047519 - RNA, 19 nt, Staphylococcus aureus subsp. aureus N315
accaucaacgccauauuua

SEQ ID NO: 4047520 - RNA, 14 nt, Staphylococcus aureus subsp. aureus N315
accaucauaaaugu

SEQ ID NO: 4047521 - RNA, 14 nt, Staphylococcus aureus subsp. aureus N315
accaucaugacagc

SEQ ID NO: 4047522 - RNA, 16 nt, Staphylococcus aureus subsp. aureus N315
accaucauucauaugg

SEQ ID NO: 4047523 - RNA, 21 nt, Staphylococcus aureus subsp. aureus N315
accaucuucuugauuguaaau

SEQ ID NO: 4047524 - RNA, 19 nt, Staphylococcus aureus subsp. aureus N315
accaucuuuaauacgaauu

SEQ ID NO: 4047525 - RNA, 22 nt, Staphylococcus aureus subsp. aureus N315
accaucuuuaauacgaauuuca

SEQ ID NO: 4047526 - RNA, 17 nt, Staphylococcus aureus subsp. aureus N315
accaugagaaaccgcuu

SEQ ID NO: 4047527 - RNA, 22 nt, Staphylococcus aureus subsp. aureus N315
accaugaugagauaaaaucaua

SEQ ID NO: 4047528 - RNA, 16 nt, Staphylococcus aureus subsp. aureus N315
accaugcaaacucauu

SEQ ID NO: 4047529 - RNA, 18 nt, Staphylococcus aureus subsp. aureus N315
accaugcaaacucauuua

SEQ ID NO: 4047530 - RNA, 18 nt, Staphylococcus aureus subsp. aureus N315
accauggcgauuccaauc

SEQ ID NO: 4047531 - RNA, 14 nt, Staphylococcus aureus subsp. aureus N315
accauuaauaguaa

SEQ ID NO: 4047532 - RNA, 15 nt, Staphylococcus aureus subsp. aureus N315
accauuaauuacaua

SEQ ID NO: 4047533 - RNA, 22 nt, Staphylococcus aureus subsp. aureus N315
accauucaucgucucacuuaau

SEQ ID NO: 4047534 - RNA, 14 nt, Staphylococcus aureus subsp. aureus N315
accauuccaaaaau

SEQ ID NO: 4047535 - RNA, 18 nt, Staphylococcus aureus subsp. aureus N315
accauuccaaaaauugua

SEQ ID NO: 4047536 - RNA, 14 nt, Staphylococcus aureus subsp. aureus N315
accauugaaugaau

SEQ ID NO: 4047537 - RNA, 19 nt, Staphylococcus aureus subsp. aureus N315
accauugcacaguuucauc

SEQ ID NO: 4047538 - RNA, 17 nt, Staphylococcus aureus subsp. aureus N315
accauugugaauaauuu

SEQ ID NO: 4047539 - RNA, 19 nt, Staphylococcus aureus subsp. aureus N315
accauugugaugauaauua

SEQ ID NO: 4047540 - RNA, 14 nt, Staphylococcus aureus subsp. aureus N315
accauuuaaaaauu

SEQ ID NO: 4047541 - RNA, 13 nt, Staphylococcus aureus subsp. aureus N315
accauuuuuuuau

SEQ ID NO: 4047542 - RNA, 20 nt, Staphylococcus aureus subsp. aureus N315
acccaaguccggcugaaggg

SEQ ID NO: 4047543 - RNA, 13 nt, Staphylococcus aureus subsp. aureus N315
acccaaucuuguu

SEQ ID NO: 4047544 - RNA, 18 nt, Staphylococcus aureus subsp. aureus N315
acccacaucuuuuuaaaa

SEQ ID NO: 4047545 - RNA, 21 nt, Staphylococcus aureus subsp. aureus N315
acccacauuaaauauuauuuu

SEQ ID NO: 4047546 - RNA, 18 nt, Staphylococcus aureus subsp. aureus N315
acccaccguuaaaauaua

SEQ ID NO: 4047547 - RNA, 21 nt, Staphylococcus aureus subsp. aureus N315
acccagaugaauuuuuauuuu

SEQ ID NO: 4047548 - RNA, 13 nt, Staphylococcus aureus subsp. aureus N315
acccauauaauuu

SEQ ID NO: 4047549 - RNA, 20 nt, Staphylococcus aureus subsp. aureus N315
accccaacuugcacauuauc

SEQ ID NO: 4047550 - RNA, 16 nt, Staphylococcus aureus subsp. aureus N315
accccgaaaagaggga

SEQ ID NO: 4047551 - RNA, 21 nt, Staphylococcus aureus subsp. aureus N315
accccuccuggugcugcacca

SEQ ID NO: 4047552 - RNA, 16 nt, Staphylococcus aureus subsp. aureus N315
acccuacuauauauca

SEQ ID NO: 4047553 - RNA, 21 nt, Staphylococcus aureus subsp. aureus N315
acccucauuuuuauaaauuuu

SEQ ID NO: 4047554 - RNA, 20 nt, Staphylococcus aureus subsp. aureus N315
acccuugucaguuuuuuuau

SEQ ID NO: 4047555 - RNA, 16 nt, Staphylococcus aureus subsp. aureus N315
accgaauaauuuugau

SEQ ID NO: 4047556 - RNA, 20 nt, Staphylococcus aureus subsp. aureus N315
accgauuaauauaauaccua

SEQ ID NO: 4047557 - RNA, 19 nt, Staphylococcus aureus subsp. aureus N315
accgcuucucgccuaauua

SEQ ID NO: 4047558 - RNA, 16 nt, Staphylococcus aureus subsp. aureus N315
accguaacauauguac

SEQ ID NO: 4047559 - RNA, 14 nt, Staphylococcus aureus subsp. aureus N315
accguaaucuuuua

SEQ ID NO: 4047560 - RNA, 15 nt, Staphylococcus aureus subsp. aureus N315
accguaaucuuuuaa

SEQ ID NO: 4047561 - RNA, 22 nt, Staphylococcus aureus subsp. aureus N315
accguauuauuggauuugaagu

SEQ ID NO: 4047562 - RNA, 15 nt, Staphylococcus aureus subsp. aureus N315
accgucaaacuuaaa

SEQ ID NO: 4047563 - RNA, 19 nt, Staphylococcus aureus subsp. aureus N315
accgucaaacuuaaaacua

SEQ ID NO: 4047564 - RNA, 16 nt, Staphylococcus aureus subsp. aureus N315
accgucuuaucuaaau

SEQ ID NO: 4047565 - RNA, 18 nt, Staphylococcus aureus subsp. aureus N315
accgucuuaucuaaaucu

SEQ ID NO: 4047566 - RNA, 21 nt, Staphylococcus aureus subsp. aureus N315
accgucuuaucuaaaucuuca

SEQ ID NO: 4047567 - RNA, 20 nt, Staphylococcus aureus subsp. aureus N315
accgucuucucuaucaguau

SEQ ID NO: 4047568 - RNA, 19 nt, Staphylococcus aureus subsp. aureus N315
accguguuguugaauaauu

SEQ ID NO: 4047569 - RNA, 13 nt, Staphylococcus aureus subsp. aureus N315
accuaaaaacaaa

SEQ ID NO: 4047570 - RNA, 18 nt, Staphylococcus aureus subsp. aureus N315
accuaaaauacccauuuu

SEQ ID NO: 4047571 - RNA, 21 nt, Staphylococcus aureus subsp. aureus N315
accuaaaucuuuaaauguauc

SEQ ID NO: 4047572 - RNA, 21 nt, Staphylococcus aureus subsp. aureus N315
accuaaaugauuaauaacaua

SEQ ID NO: 4047573 - RNA, 18 nt, Staphylococcus aureus subsp. aureus N315
accuaagcaagauaauag

SEQ ID NO: 4047574 - RNA, 16 nt, Staphylococcus aureus subsp. aureus N315
accuaaggcuaaugau

SEQ ID NO: 4047575 - RNA, 20 nt, Staphylococcus aureus subsp. aureus N315
accuaaggcuaaugauaauc

SEQ ID NO: 4047576 - RNA, 22 nt, Staphylococcus aureus subsp. aureus N315
accuaaguuaauuuaucguuua

SEQ ID NO: 4047577 - RNA, 18 nt, Staphylococcus aureus subsp. aureus N315
accuaauauuuuaaacgu

SEQ ID NO: 4047578 - RNA, 16 nt, Staphylococcus aureus subsp. aureus N315
accuaauucauauaua

SEQ ID NO: 4047579 - RNA, 18 nt, Staphylococcus aureus subsp. aureus N315
accuaauucauauauacu

SEQ ID NO: 4047580 - RNA, 20 nt, Staphylococcus aureus subsp. aureus N315
accuaauucgccaucuuuuu

SEQ ID NO: 4047581 - RNA, 19 nt, Staphylococcus aureus subsp. aureus N315
accuacaacaccaauugaa

SEQ ID NO: 4047582 - RNA, 21 nt, Staphylococcus aureus subsp. aureus N315
accuacacgaccaagacgaac

SEQ ID NO: 4047583 - RNA, 15 nt, Staphylococcus aureus subsp. aureus N315
accuacagauaaagc

SEQ ID NO: 4047584 - RNA, 16 nt, Staphylococcus aureus subsp. aureus N315
accuauaagucucuuu

SEQ ID NO: 4047585 - RNA, 23 nt, Staphylococcus aureus subsp. aureus N315
accuaugauaugugaaaaagcua

SEQ ID NO: 4047586 - RNA, 16 nt, Staphylococcus aureus subsp. aureus N315
accuauuaauaucaua

SEQ ID NO: 4047587 - RNA, 17 nt, Staphylococcus aureus subsp. aureus N315
accuauuccuaauaaau

SEQ ID NO: 4047588 - RNA, 17 nt, Staphylococcus aureus subsp. aureus N315
accuauuuuuugagcac

SEQ ID NO: 4047589 - RNA, 20 nt, Staphylococcus aureus subsp. aureus N315
accucauccgccaauuaaaa

SEQ ID NO: 4047590 - RNA, 15 nt, Staphylococcus aureus subsp. aureus N315
accucauuugacaua

SEQ ID NO: 4047591 - RNA, 23 nt, Staphylococcus aureus subsp. aureus N315
accucuaaguucaccuaaaugau

SEQ ID NO: 4047592 - RNA, 16 nt, Staphylococcus aureus subsp. aureus N315
accucuacauuauauu

SEQ ID NO: 4047593 - RNA, 19 nt, Staphylococcus aureus subsp. aureus N315
accucuaccaguucaacau

SEQ ID NO: 4047594 - RNA, 21 nt, Staphylococcus aureus subsp. aureus N315
accucugauguguuauguuag

SEQ ID NO: 4047595 - RNA, 21 nt, Staphylococcus aureus subsp. aureus N315
accucuuuauuuuaucucuua

SEQ ID NO: 4047596 - RNA, 19 nt, Staphylococcus aureus subsp. aureus N315
accucuuuuguuuaguaug

SEQ ID NO: 4047597 - RNA, 16 nt, Staphylococcus aureus subsp. aureus N315
accugcauauguguuu

SEQ ID NO: 4047598 - RNA, 15 nt, Staphylococcus aureus subsp. aureus N315
accugggacauuaau

SEQ ID NO: 4047599 - RNA, 19 nt, Staphylococcus aureus subsp. aureus N315
accugggacauuaaucgau

SEQ ID NO: 4047600 - RNA, 14 nt, Staphylococcus aureus subsp. aureus N315
accugugauaaaaa

SEQ ID NO: 4047601 - RNA, 12 nt, Staphylococcus aureus subsp. aureus N315
accugugauaac

SEQ ID NO: 4047602 - RNA, 23 nt, Staphylococcus aureus subsp. aureus N315
accuguuucuuuacuucuuucaa

SEQ ID NO: 4047603 - RNA, 18 nt, Staphylococcus aureus subsp. aureus N315
accuuaauaaugaauucu

SEQ ID NO: 4047604 - RNA, 18 nt, Staphylococcus aureus subsp. aureus N315
accuuacauaggauaucu

SEQ ID NO: 4047605 - RNA, 15 nt, Staphylococcus aureus subsp. aureus N315
accuuacccaaaaaa

SEQ ID NO: 4047606 - RNA, 20 nt, Staphylococcus aureus subsp. aureus N315
accuuacccaaaaaauugua

SEQ ID NO: 4047607 - RNA, 21 nt, Staphylococcus aureus subsp. aureus N315
accuuacuacgcauuauuaag

SEQ ID NO: 4047608 - RNA, 12 nt, Staphylococcus aureus subsp. aureus N315
accuuauauuuu

SEQ ID NO: 4047609 - RNA, 22 nt, Staphylococcus aureus subsp. aureus N315
accuuauauuuuauuuaaaaau

SEQ ID NO: 4047610 - RNA, 23 nt, Staphylococcus aureus subsp. aureus N315
accuuauauuuuauuuaaaaaua

SEQ ID NO: 4047611 - RNA, 19 nt, Staphylococcus aureus subsp. aureus N315
accuuaucaguguaaguuu

SEQ ID NO: 4047612 - RNA, 16 nt, Staphylococcus aureus subsp. aureus N315
accuuaucaugacaca

SEQ ID NO: 4047613 - RNA, 16 nt, Staphylococcus aureus subsp. aureus N315
accuucagaugcuaca

SEQ ID NO: 4047614 - RNA, 15 nt, Staphylococcus aureus subsp. aureus N315
accuucguuuaaauu

SEQ ID NO: 4047615 - RNA, 20 nt, Staphylococcus aureus subsp. aureus N315
accuugauuuaauuuuuaau

SEQ ID NO: 4047616 - RNA, 15 nt, Staphylococcus aureus subsp. aureus N315
accuuguaaauuuaa

SEQ ID NO: 4047617 - RNA, 14 nt, Staphylococcus aureus subsp. aureus N315
accuuguuaaaaua

SEQ ID NO: 4047618 - RNA, 20 nt, Staphylococcus aureus subsp. aureus N315
accuuguucuuuacuccaaa

SEQ ID NO: 4047619 - RNA, 14 nt, Staphylococcus aureus subsp. aureus N315
accuuuaaaacauc

SEQ ID NO: 4047620 - RNA, 15 nt, Staphylococcus aureus subsp. aureus N315
accuuuaaaacauca

SEQ ID NO: 4047621 - RNA, 19 nt, Staphylococcus aureus subsp. aureus N315
accuuuaaaacaucauuca

SEQ ID NO: 4047622 - RNA, 17 nt, Staphylococcus aureus subsp. aureus N315
accuuuaccaguaucau

SEQ ID NO: 4047623 - RNA, 14 nt, Staphylococcus aureus subsp. aureus N315
accuuuacuuucau

SEQ ID NO: 4047624 - RNA, 17 nt, Staphylococcus aureus subsp. aureus N315
accuuuagacaauauuu

SEQ ID NO: 4047625 - RNA, 23 nt, Staphylococcus aureus subsp. aureus N315
accuuuagacaauauuuuuacau

SEQ ID NO: 4047626 - RNA, 20 nt, Staphylococcus aureus subsp. aureus N315
accuuuaugugcaucauuua

SEQ ID NO: 4047627 - RNA, 12 nt, Staphylococcus aureus subsp. aureus N315
accuuucaaaua

SEQ ID NO: 4047628 - RNA, 14 nt, Staphylococcus aureus subsp. aureus N315
accuuucgauaaac

SEQ ID NO: 4047629 - RNA, 22 nt, Staphylococcus aureus subsp. aureus N315
accuuucgcagcuucuuuaaca

SEQ ID NO: 4047630 - RNA, 21 nt, Staphylococcus aureus subsp. aureus N315
accuuuuaaggcagcuaaaaa

SEQ ID NO: 4047631 - RNA, 12 nt, Staphylococcus aureus subsp. aureus N315
accuuuuuuaag

SEQ ID NO: 4047632 - RNA, 20 nt, Staphylococcus aureus subsp. aureus N315
acgaaaaagaugguuuuguu

SEQ ID NO: 4047633 - RNA, 21 nt, Staphylococcus aureus subsp. aureus N315
acgaaaaaugccaacuauacc

SEQ ID NO: 4047634 - RNA, 13 nt, Staphylococcus aureus subsp. aureus N315
acgaaaugcaaug

SEQ ID NO: 4047635 - RNA, 20 nt, Staphylococcus aureus subsp. aureus N315
acgaaauggugaacuaaauu

SEQ ID NO: 4047636 - RNA, 19 nt, Staphylococcus aureus subsp. aureus N315
acgaaauuacuuuaacagu

SEQ ID NO: 4047637 - RNA, 23 nt, Staphylococcus aureus subsp. aureus N315
acgaacaagucuugcaauaccuc

SEQ ID NO: 4047638 - RNA, 23 nt, Staphylococcus aureus subsp. aureus N315
acgaacaucuaauacauuauguu

SEQ ID NO: 4047639 - RNA, 23 nt, Staphylococcus aureus subsp. aureus N315
acgaaucacaguuauauauuccu

SEQ ID NO: 4047640 - RNA, 22 nt, Staphylococcus aureus subsp. aureus N315
acgacaacuugaacuaaaacga

SEQ ID NO: 4047641 - RNA, 14 nt, Staphylococcus aureus subsp. aureus N315
acgacauuguuuag

SEQ ID NO: 4047642 - RNA, 22 nt, Staphylococcus aureus subsp. aureus N315
acgacauuuuuagacauuaaaa

SEQ ID NO: 4047643 - RNA, 22 nt, Staphylococcus aureus subsp. aureus N315
acgaccagucgcauauuuugau

SEQ ID NO: 4047644 - RNA, 16 nt, Staphylococcus aureus subsp. aureus N315
acgacgaaauaaauuu

SEQ ID NO: 4047645 - RNA, 19 nt, Staphylococcus aureus subsp. aureus N315
acgagcaacaucuuuuguu

SEQ ID NO: 4047646 - RNA, 16 nt, Staphylococcus aureus subsp. aureus N315
acgagcaguauauauc

SEQ ID NO: 4047647 - RNA, 16 nt, Staphylococcus aureus subsp. aureus N315
acgagcuggugagaaa

SEQ ID NO: 4047648 - RNA, 14 nt, Staphylococcus aureus subsp. aureus N315
acgaguauuaucac

SEQ ID NO: 4047649 - RNA, 20 nt, Staphylococcus aureus subsp. aureus N315
acgagucauaaauauaaaau

SEQ ID NO: 4047650 - RNA, 20 nt, Staphylococcus aureus subsp. aureus N315
acgauaacagcuacaaauaa

SEQ ID NO: 4047651 - RNA, 21 nt, Staphylococcus aureus subsp. aureus N315
acgauaacagcuacaaauaau

SEQ ID NO: 4047652 - RNA, 23 nt, Staphylococcus aureus subsp. aureus N315
acgauaacagcuacaaauaauga

SEQ ID NO: 4047653 - RNA, 14 nt, Staphylococcus aureus subsp. aureus N315
acgauaagaauuaa

SEQ ID NO: 4047654 - RNA, 18 nt, Staphylococcus aureus subsp. aureus N315
acgauaagaauuaacaac

SEQ ID NO: 4047655 - RNA, 13 nt, Staphylococcus aureus subsp. aureus N315
acgauaauuauac

SEQ ID NO: 4047656 - RNA, 16 nt, Staphylococcus aureus subsp. aureus N315
acgauaauuguuaaag

SEQ ID NO: 4047657 - RNA, 18 nt, Staphylococcus aureus subsp. aureus N315
acgauaccuuuaauaaua

SEQ ID NO: 4047658 - RNA, 14 nt, Staphylococcus aureus subsp. aureus N315
acgauagauuuauc

SEQ ID NO: 4047659 - RNA, 17 nt, Staphylococcus aureus subsp. aureus N315
acgauauaacauuaaaa

SEQ ID NO: 4047660 - RNA, 16 nt, Staphylococcus aureus subsp. aureus N315
acgaucacuuggcuua

SEQ ID NO: 4047661 - RNA, 20 nt, Staphylococcus aureus subsp. aureus N315
acgaucaguugagucaauuu

SEQ ID NO: 4047662 - RNA, 17 nt, Staphylococcus aureus subsp. aureus N315
acgaucauaaauauuuu

SEQ ID NO: 4047663 - RNA, 17 nt, Staphylococcus aureus subsp. aureus N315
acgaugaaacucuguuu

SEQ ID NO: 4047664 - RNA, 22 nt, Staphylococcus aureus subsp. aureus N315
acgauuacgcucauaugucugu

SEQ ID NO: 4047665 - RNA, 15 nt, Staphylococcus aureus subsp. aureus N315
acgauucacagacaa

SEQ ID NO: 4047666 - RNA, 15 nt, Staphylococcus aureus subsp. aureus N315
acgauugaacaucuc

SEQ ID NO: 4047667 - RNA, 16 nt, Staphylococcus aureus subsp. aureus N315
acgauugaacaucucu

SEQ ID NO: 4047668 - RNA, 23 nt, Staphylococcus aureus subsp. aureus N315
acgauugauagacauaaccuugc

SEQ ID NO: 4047669 - RNA, 16 nt, Staphylococcus aureus subsp. aureus N315
acgauugauuaucaua

SEQ ID NO: 4047670 - RNA, 18 nt, Staphylococcus aureus subsp. aureus N315
acgauuuaauuaaaacau

SEQ ID NO: 4047671 - RNA, 15 nt, Staphylococcus aureus subsp. aureus N315
acgauuuugucuuuu

SEQ ID NO: 4047672 - RNA, 17 nt, Staphylococcus aureus subsp. aureus N315
acgcaaaaauacuccuu

SEQ ID NO: 4047673 - RNA, 17 nt, Staphylococcus aureus subsp. aureus N315
acgcaauacgaauaucu

SEQ ID NO: 4047674 - RNA, 17 nt, Staphylococcus aureus subsp. aureus N315
acgcaauuuaauauuau

SEQ ID NO: 4047675 - RNA, 19 nt, Staphylococcus aureus subsp. aureus N315
acgcacguauauacgauug

SEQ ID NO: 4047676 - RNA, 14 nt, Staphylococcus aureus subsp. aureus N315
acgcaguugaaaaa

SEQ ID NO: 4047677 - RNA, 15 nt, Staphylococcus aureus subsp. aureus N315
acgcaguugaaaaag

SEQ ID NO: 4047678 - RNA, 23 nt, Staphylococcus aureus subsp. aureus N315
acgcauacaggaaauugaagcgu

SEQ ID NO: 4047679 - RNA, 23 nt, Staphylococcus aureus subsp. aureus N315
acgcauuacuuuagaaagugauu

SEQ ID NO: 4047680 - RNA, 16 nt, Staphylococcus aureus subsp. aureus N315
acgccauaagaaaaua

SEQ ID NO: 4047681 - RNA, 14 nt, Staphylococcus aureus subsp. aureus N315
acgccauucaucau

SEQ ID NO: 4047682 - RNA, 21 nt, Staphylococcus aureus subsp. aureus N315
acgccucaacacuuucuacuc

SEQ ID NO: 4047683 - RNA, 18 nt, Staphylococcus aureus subsp. aureus N315
acgcgcuucaucaaugga

SEQ ID NO: 4047684 - RNA, 17 nt, Staphylococcus aureus subsp. aureus N315
acgcgugaauuaaaaaa

SEQ ID NO: 4047685 - RNA, 17 nt, Staphylococcus aureus subsp. aureus N315
acgcuaauuuuacucug

SEQ ID NO: 4047686 - RNA, 19 nt, Staphylococcus aureus subsp. aureus N315
acgcuagugcgcgauaaau

SEQ ID NO: 4047687 - RNA, 17 nt, Staphylococcus aureus subsp. aureus N315
acgcucaacuauauaua

SEQ ID NO: 4047688 - RNA, 15 nt, Staphylococcus aureus subsp. aureus N315
acgcugaaauuuuuu

SEQ ID NO: 4047689 - RNA, 15 nt, Staphylococcus aureus subsp. aureus N315
acgcugguaauauuu

SEQ ID NO: 4047690 - RNA, 22 nt, Staphylococcus aureus subsp. aureus N315
acgcugucucauuaauguaagc

SEQ ID NO: 4047691 - RNA, 15 nt, Staphylococcus aureus subsp. aureus N315
acgcuguuuuaaauu

SEQ ID NO: 4047692 - RNA, 17 nt, Staphylococcus aureus subsp. aureus N315
acgcuucaauuauuuca

SEQ ID NO: 4047693 - RNA, 18 nt, Staphylococcus aureus subsp. aureus N315
acgcuuuauucuucccaa

SEQ ID NO: 4047694 - RNA, 17 nt, Staphylococcus aureus subsp. aureus N315
acggcguauucaauugu

SEQ ID NO: 4047695 - RNA, 13 nt, Staphylococcus aureus subsp. aureus N315
acgggaacaucau

SEQ ID NO: 4047696 - RNA, 23 nt, Staphylococcus aureus subsp. aureus N315
acgggugguuuuuaauuugagua

SEQ ID NO: 4047697 - RNA, 12 nt, Staphylococcus aureus subsp. aureus N315
acgguacagaua

SEQ ID NO: 4047698 - RNA, 18 nt, Staphylococcus aureus subsp. aureus N315
acgguaggaccucuuauu

SEQ ID NO: 4047699 - RNA, 13 nt, Staphylococcus aureus subsp. aureus N315
acgguauuuucaa

SEQ ID NO: 4047700 - RNA, 15 nt, Staphylococcus aureus subsp. aureus N315
acgguuauggugugu

SEQ ID NO: 4047701 - RNA, 22 nt, Staphylococcus aureus subsp. aureus N315
acgguucaaaaguaaaagcuuu

SEQ ID NO: 4047702 - RNA, 13 nt, Staphylococcus aureus subsp. aureus N315
acgguuugaaaaa

SEQ ID NO: 4047703 - RNA, 14 nt, Staphylococcus aureus subsp. aureus N315
acguaaaauaugau

SEQ ID NO: 4047704 - RNA, 22 nt, Staphylococcus aureus subsp. aureus N315
acguaacaucacauaaaauaca

SEQ ID NO: 4047705 - RNA, 19 nt, Staphylococcus aureus subsp. aureus N315
acguaaguguaaaugaaag

SEQ ID NO: 4047706 - RNA, 14 nt, Staphylococcus aureus subsp. aureus N315
acguaaguuugcua

SEQ ID NO: 4047707 - RNA, 16 nt, Staphylococcus aureus subsp. aureus N315
acguaaucuaauacau

SEQ ID NO: 4047708 - RNA, 19 nt, Staphylococcus aureus subsp. aureus N315
acguauauaaguuaaaauu

SEQ ID NO: 4047709 - RNA, 15 nt, Staphylococcus aureus subsp. aureus N315
acguaucaaaauuuu

SEQ ID NO: 4047710 - RNA, 14 nt, Staphylococcus aureus subsp. aureus N315
acgucaacagcaua

SEQ ID NO: 4047711 - RNA, 19 nt, Staphylococcus aureus subsp. aureus N315
acgucauauguuuuauaau

SEQ ID NO: 4047712 - RNA, 16 nt, Staphylococcus aureus subsp. aureus N315
acguccaaacacaaau

SEQ ID NO: 4047713 - RNA, 22 nt, Staphylococcus aureus subsp. aureus N315
acgucgcaacaggaccacucaa

SEQ ID NO: 4047714 - RNA, 16 nt, Staphylococcus aureus subsp. aureus N315
acgucuuguaucaaca

SEQ ID NO: 4047715 - RNA, 22 nt, Staphylococcus aureus subsp. aureus N315
acgucuuguaucaacauuaaua

SEQ ID NO: 4047716 - RNA, 13 nt, Staphylococcus aureus subsp. aureus N315
acgugaacaacau

SEQ ID NO: 4047717 - RNA, 22 nt, Staphylococcus aureus subsp. aureus N315
acgugacauuuucaaguuuaaa

SEQ ID NO: 4047718 - RNA, 22 nt, Staphylococcus aureus subsp. aureus N315
acgugaggcccauaaauuacuu

SEQ ID NO: 4047719 - RNA, 18 nt, Staphylococcus aureus subsp. aureus N315
acgugcauuguaauacca

SEQ ID NO: 4047720 - RNA, 19 nt, Staphylococcus aureus subsp. aureus N315
acgugcugccuuuuugcuu

SEQ ID NO: 4047721 - RNA, 13 nt, Staphylococcus aureus subsp. aureus N315
acgugcuuuaaag

SEQ ID NO: 4047722 - RNA, 16 nt, Staphylococcus aureus subsp. aureus N315
acguguaaauguuaaa

SEQ ID NO: 4047723 - RNA, 18 nt, Staphylococcus aureus subsp. aureus N315
acguuauucguuaacaau

SEQ ID NO: 4047724 - RNA, 20 nt, Staphylococcus aureus subsp. aureus N315
acguuauucguuaacaauca

SEQ ID NO: 4047725 - RNA, 13 nt, Staphylococcus aureus subsp. aureus N315
acguuauuuucaa

SEQ ID NO: 4047726 - RNA, 17 nt, Staphylococcus aureus subsp. aureus N315
acguucaaucguuucuu

SEQ ID NO: 4047727 - RNA, 14 nt, Staphylococcus aureus subsp. aureus N315
acguucauggauuc

SEQ ID NO: 4047728 - RNA, 21 nt, Staphylococcus aureus subsp. aureus N315
acguucgauaacguugccaua

SEQ ID NO: 4047729 - RNA, 23 nt, Staphylococcus aureus subsp. aureus N315
acguucuugguauuuuuuaaaug

SEQ ID NO: 4047730 - RNA, 15 nt, Staphylococcus aureus subsp. aureus N315
acguugauguaauuc

SEQ ID NO: 4047731 - RNA, 16 nt, Staphylococcus aureus subsp. aureus N315
acguugauuaacacau

SEQ ID NO: 4047732 - RNA, 20 nt, Staphylococcus aureus subsp. aureus N315
acguugguuuaaaaauugau

SEQ ID NO: 4047733 - RNA, 18 nt, Staphylococcus aureus subsp. aureus N315
acguuuauccuuuaaauc

SEQ ID NO: 4047734 - RNA, 21 nt, Staphylococcus aureus subsp. aureus N315
acguuuauccuuuaaaucauu

SEQ ID NO: 4047735 - RNA, 15 nt, Staphylococcus aureus subsp. aureus N315
acguuucaauguauc

SEQ ID NO: 4047736 - RNA, 21 nt, Staphylococcus aureus subsp. aureus N315
acguuuuaaagguuaaauauu

SEQ ID NO: 4047737 - RNA, 20 nt, Staphylococcus aureus subsp. aureus N315
acguuuuaaauaaaugacuu

SEQ ID NO: 4047738 - RNA, 13 nt, Staphylococcus aureus subsp. aureus N315
acguuuuaagcca

SEQ ID NO: 4047739 - RNA, 17 nt, Staphylococcus aureus subsp. aureus N315
acguuuuagacauaaaa

SEQ ID NO: 4047740 - RNA, 17 nt, Staphylococcus aureus subsp. aureus N315
acguuuucacuucgcca

SEQ ID NO: 4047741 - RNA, 17 nt, Staphylococcus aureus subsp. aureus N315
acguuuuccaugaguuu

SEQ ID NO: 4047742 - RNA, 11 nt, Staphylococcus aureus subsp. aureus N315
acguuuucuag

SEQ ID NO: 4047743 - RNA, 15 nt, Staphylococcus aureus subsp. aureus N315
acguuuuuuuaaaua

SEQ ID NO: 4047744 - RNA, 23 nt, Staphylococcus aureus subsp. aureus N315
acguuuuuuuauaaauuauagua

SEQ ID NO: 4047745 - RNA, 22 nt, Staphylococcus aureus subsp. aureus N315
acuaaaaagaagcucccauuaa

SEQ ID NO: 4047746 - RNA, 19 nt, Staphylococcus aureus subsp. aureus N315
acuaaaacgauaauaauaa

SEQ ID NO: 4047747 - RNA, 13 nt, Staphylococcus aureus subsp. aureus N315
acuaaaaucacuu

SEQ ID NO: 4047748 - RNA, 14 nt, Staphylococcus aureus subsp. aureus N315
acuaaacauugcuu

SEQ ID NO: 4047749 - RNA, 15 nt, Staphylococcus aureus subsp. aureus N315
acuaaaccaaugauu

SEQ ID NO: 4047750 - RNA, 15 nt, Staphylococcus aureus subsp. aureus N315
acuaaaccauugaau

SEQ ID NO: 4047751 - RNA, 17 nt, Staphylococcus aureus subsp. aureus N315
acuaaaguaaauaacac

SEQ ID NO: 4047752 - RNA, 16 nt, Staphylococcus aureus subsp. aureus N315
acuaaaugaauugcuu

SEQ ID NO: 4047753 - RNA, 20 nt, Staphylococcus aureus subsp. aureus N315
acuaacauguuauugcuuau

SEQ ID NO: 4047754 - RNA, 14 nt, Staphylococcus aureus subsp. aureus N315
acuaacguuuuaaa

SEQ ID NO: 4047755 - RNA, 14 nt, Staphylococcus aureus subsp. aureus N315
acuaagauauauug

SEQ ID NO: 4047756 - RNA, 22 nt, Staphylococcus aureus subsp. aureus N315
acuaagugaacuauuaaaacca

SEQ ID NO: 4047757 - RNA, 19 nt, Staphylococcus aureus subsp. aureus N315
acuaaguuauuuaguacau

SEQ ID NO: 4047758 - RNA, 20 nt, Staphylococcus aureus subsp. aureus N315
acuaaguuuucuuucuuuug

SEQ ID NO: 4047759 - RNA, 14 nt, Staphylococcus aureus subsp. aureus N315
acuaauaauugucc

SEQ ID NO: 4047760 - RNA, 16 nt, Staphylococcus aureus subsp. aureus N315
acuaauaauuuguaau

SEQ ID NO: 4047761 - RNA, 17 nt, Staphylococcus aureus subsp. aureus N315
acuaauaugauugguuu

SEQ ID NO: 4047762 - RNA, 21 nt, Staphylococcus aureus subsp. aureus N315
acuaauauuucuuagauacuc

SEQ ID NO: 4047763 - RNA, 23 nt, Staphylococcus aureus subsp. aureus N315
acuaaucaacuuuuuguuaauuu

SEQ ID NO: 4047764 - RNA, 20 nt, Staphylococcus aureus subsp. aureus N315
acuaaucguuccaacaacua

SEQ ID NO: 4047765 - RNA, 18 nt, Staphylococcus aureus subsp. aureus N315
acuaaucguuguggcuuu

SEQ ID NO: 4047766 - RNA, 19 nt, Staphylococcus aureus subsp. aureus N315
acuaaugucgcacuauaaa

SEQ ID NO: 4047767 - RNA, 17 nt, Staphylococcus aureus subsp. aureus N315
acuaauuuaaagcauca

SEQ ID NO: 4047768 - RNA, 22 nt, Staphylococcus aureus subsp. aureus N315
acuacacuccccuuaucaaaac

SEQ ID NO: 4047769 - RNA, 16 nt, Staphylococcus aureus subsp. aureus N315
acuaccuguuggcuuu

SEQ ID NO: 4047770 - RNA, 15 nt, Staphylococcus aureus subsp. aureus N315
acuacgcauuuuaaa

SEQ ID NO: 4047771 - RNA, 17 nt, Staphylococcus aureus subsp. aureus N315
acuacgcauuuuaaaua

SEQ ID NO: 4047772 - RNA, 15 nt, Staphylococcus aureus subsp. aureus N315
acuacuauugauauu

SEQ ID NO: 4047773 - RNA, 14 nt, Staphylococcus aureus subsp. aureus N315
acuacuuuuucaac

SEQ ID NO: 4047774 - RNA, 19 nt, Staphylococcus aureus subsp. aureus N315
acuacuuuuucaacuguac

SEQ ID NO: 4047775 - RNA, 19 nt, Staphylococcus aureus subsp. aureus N315
acuagaaaacauaaauaca

SEQ ID NO: 4047776 - RNA, 13 nt, Staphylococcus aureus subsp. aureus N315
acuagauaguuua

SEQ ID NO: 4047777 - RNA, 21 nt, Staphylococcus aureus subsp. aureus N315
acuagcauuagcaaauauuau

SEQ ID NO: 4047778 - RNA, 19 nt, Staphylococcus aureus subsp. aureus N315
acuagcuaaugcacgugag

SEQ ID NO: 4047779 - RNA, 23 nt, Staphylococcus aureus subsp. aureus N315
acuaggaauauaaaacugugcau

SEQ ID NO: 4047780 - RNA, 14 nt, Staphylococcus aureus subsp. aureus N315
acuagggguuuuua

SEQ ID NO: 4047781 - RNA, 16 nt, Staphylococcus aureus subsp. aureus N315
acuagggguuuuuaau

SEQ ID NO: 4047782 - RNA, 20 nt, Staphylococcus aureus subsp. aureus N315
acuaguaaaucaaagaugac

SEQ ID NO: 4047783 - RNA, 14 nt, Staphylococcus aureus subsp. aureus N315
acuaguaauagaau

SEQ ID NO: 4047784 - RNA, 20 nt, Staphylococcus aureus subsp. aureus N315
acuagucuuuuuauuuuaau

SEQ ID NO: 4047785 - RNA, 18 nt, Staphylococcus aureus subsp. aureus N315
acuaguuuguaauaauua

SEQ ID NO: 4047786 - RNA, 19 nt, Staphylococcus aureus subsp. aureus N315
acuaguuuguaauaauuaa

SEQ ID NO: 4047787 - RNA, 15 nt, Staphylococcus aureus subsp. aureus N315
acuauaaaaaacagc

SEQ ID NO: 4047788 - RNA, 16 nt, Staphylococcus aureus subsp. aureus N315
acuauaaaaaacagca

SEQ ID NO: 4047789 - RNA, 19 nt, Staphylococcus aureus subsp. aureus N315
acuauaaaauucaccaacu

SEQ ID NO: 4047790 - RNA, 17 nt, Staphylococcus aureus subsp. aureus N315
acuauaaauacaaauau

SEQ ID NO: 4047791 - RNA, 18 nt, Staphylococcus aureus subsp. aureus N315
acuauaaauacaaauaua

SEQ ID NO: 4047792 - RNA, 19 nt, Staphylococcus aureus subsp. aureus N315
acuauaacaccaauuaaau

SEQ ID NO: 4047793 - RNA, 19 nt, Staphylococcus aureus subsp. aureus N315
acuauaaccuauuaaaucu

SEQ ID NO: 4047794 - RNA, 14 nt, Staphylococcus aureus subsp. aureus N315
acuauaauaauuaa

SEQ ID NO: 4047795 - RNA, 16 nt, Staphylococcus aureus subsp. aureus N315
acuauaauaauuggaa

SEQ ID NO: 4047796 - RNA, 14 nt, Staphylococcus aureus subsp. aureus N315
acuauaaugaugua

SEQ ID NO: 4047797 - RNA, 20 nt, Staphylococcus aureus subsp. aureus N315
acuauaaugauguauuuuag

SEQ ID NO: 4047798 - RNA, 14 nt, Staphylococcus aureus subsp. aureus N315
acuauacaaucaua

SEQ ID NO: 4047799 - RNA, 21 nt, Staphylococcus aureus subsp. aureus N315
acuauaccuagggaugauaua

SEQ ID NO: 4047800 - RNA, 21 nt, Staphylococcus aureus subsp. aureus N315
acuauacuuuuauagaaaauu

SEQ ID NO: 4047801 - RNA, 15 nt, Staphylococcus aureus subsp. aureus N315
acuauagauaggaua

SEQ ID NO: 4047802 - RNA, 12 nt, Staphylococcus aureus subsp. aureus N315
acuauauauagu

SEQ ID NO: 4047803 - RNA, 16 nt, Staphylococcus aureus subsp. aureus N315
acuauaugaaaagaga

SEQ ID NO: 4047804 - RNA, 22 nt, Staphylococcus aureus subsp. aureus N315
acuauaugaaaagagaaacaaa

SEQ ID NO: 4047805 - RNA, 19 nt, Staphylococcus aureus subsp. aureus N315
acuauauuucacacagcuu

SEQ ID NO: 4047806 - RNA, 13 nt, Staphylococcus aureus subsp. aureus N315
acuaucaauauaa

SEQ ID NO: 4047807 - RNA, 14 nt, Staphylococcus aureus subsp. aureus N315
acuaucguuuuuau

SEQ ID NO: 4047808 - RNA, 14 nt, Staphylococcus aureus subsp. aureus N315
acuaucuauaauac

SEQ ID NO: 4047809 - RNA, 13 nt, Staphylococcus aureus subsp. aureus N315
acuaucuguuguu

SEQ ID NO: 4047810 - RNA, 18 nt, Staphylococcus aureus subsp. aureus N315
acuaucuucaucauauuc

SEQ ID NO: 4047811 - RNA, 14 nt, Staphylococcus aureus subsp. aureus N315
acuaucuuuugcuu

SEQ ID NO: 4047812 - RNA, 13 nt, Staphylococcus aureus subsp. aureus N315
acuauuaaaggaa

SEQ ID NO: 4047813 - RNA, 19 nt, Staphylococcus aureus subsp. aureus N315
acuauuaaaggaaaucaau

SEQ ID NO: 4047814 - RNA, 16 nt, Staphylococcus aureus subsp. aureus N315
acuauuaguaugcaua

SEQ ID NO: 4047815 - RNA, 15 nt, Staphylococcus aureus subsp. aureus N315
acuauuaucgaagaa

SEQ ID NO: 4047816 - RNA, 19 nt, Staphylococcus aureus subsp. aureus N315
acuauugaaaauagaaaga

SEQ ID NO: 4047817 - RNA, 13 nt, Staphylococcus aureus subsp. aureus N315
acuauuuuaaaaa

SEQ ID NO: 4047818 - RNA, 17 nt, Staphylococcus aureus subsp. aureus N315
acuauuuuaaaaaugcu

SEQ ID NO: 4047819 - RNA, 18 nt, Staphylococcus aureus subsp. aureus N315
acuauuuuaaaaaugcug

SEQ ID NO: 4047820 - RNA, 19 nt, Staphylococcus aureus subsp. aureus N315
acuauuuuuaaaugauucu

SEQ ID NO: 4047821 - RNA, 17 nt, Staphylococcus aureus subsp. aureus N315
acucaaaauuaaagcuu

SEQ ID NO: 4047822 - RNA, 21 nt, Staphylococcus aureus subsp. aureus N315
acucaacacgauagucauaac

SEQ ID NO: 4047823 - RNA, 16 nt, Staphylococcus aureus subsp. aureus N315
acucaaggaaaucaua

SEQ ID NO: 4047824 - RNA, 19 nt, Staphylococcus aureus subsp. aureus N315
acucaaggaaaucauauau

SEQ ID NO: 4047825 - RNA, 22 nt, Staphylococcus aureus subsp. aureus N315
acucaaggaaaucauauauuuc

SEQ ID NO: 4047826 - RNA, 13 nt, Staphylococcus aureus subsp. aureus N315
acucaauaaaauu

SEQ ID NO: 4047827 - RNA, 22 nt, Staphylococcus aureus subsp. aureus N315
acucaauaugaaaccuuugguu

SEQ ID NO: 4047828 - RNA, 12 nt, Staphylococcus aureus subsp. aureus N315
acucaauucucu

SEQ ID NO: 4047829 - RNA, 16 nt, Staphylococcus aureus subsp. aureus N315
acucaauucucuaacu

SEQ ID NO: 4047830 - RNA, 18 nt, Staphylococcus aureus subsp. aureus N315
acucaauuucauuugaaa

SEQ ID NO: 4047831 - RNA, 13 nt, Staphylococcus aureus subsp. aureus N315
acucacuucaacg

SEQ ID NO: 4047832 - RNA, 20 nt, Staphylococcus aureus subsp. aureus N315
acucagaaucuuacauugau

SEQ ID NO: 4047833 - RNA, 19 nt, Staphylococcus aureus subsp. aureus N315
acucauaaccgcuucuuuu

SEQ ID NO: 4047834 - RNA, 15 nt, Staphylococcus aureus subsp. aureus N315
acucauaccaaaaac

SEQ ID NO: 4047835 - RNA, 21 nt, Staphylococcus aureus subsp. aureus N315
acucauccauugaucuuuuau

SEQ ID NO: 4047836 - RNA, 13 nt, Staphylococcus aureus subsp. aureus N315
acucauuauaaau

SEQ ID NO: 4047837 - RNA, 14 nt, Staphylococcus aureus subsp. aureus N315
acucauuuuucuug

SEQ ID NO: 4047838 - RNA, 17 nt, Staphylococcus aureus subsp. aureus N315
acuccaguuuauaacug

SEQ ID NO: 4047839 - RNA, 18 nt, Staphylococcus aureus subsp. aureus N315
acucccgcaaauauuaaa

SEQ ID NO: 4047840 - RNA, 15 nt, Staphylococcus aureus subsp. aureus N315
acuccguugaauuca

SEQ ID NO: 4047841 - RNA, 15 nt, Staphylococcus aureus subsp. aureus N315
acuccucuauuuuau

SEQ ID NO: 4047842 - RNA, 15 nt, Staphylococcus aureus subsp. aureus N315
acuccuuaaacaaau

SEQ ID NO: 4047843 - RNA, 15 nt, Staphylococcus aureus subsp. aureus N315
acuccuuacaauaaa

SEQ ID NO: 4047844 - RNA, 13 nt, Staphylococcus aureus subsp. aureus N315
acucgaaaccagc

SEQ ID NO: 4047845 - RNA, 19 nt, Staphylococcus aureus subsp. aureus N315
acucgcuauauguaaagcu

SEQ ID NO: 4047846 - RNA, 16 nt, Staphylococcus aureus subsp. aureus N315
acucggggaauuuuua

SEQ ID NO: 4047847 - RNA, 17 nt, Staphylococcus aureus subsp. aureus N315
acucggggaauuuuuau

SEQ ID NO: 4047848 - RNA, 15 nt, Staphylococcus aureus subsp. aureus N315
acucguaaauuuuau

SEQ ID NO: 4047849 - RNA, 19 nt, Staphylococcus aureus subsp. aureus N315
acucguaaauuuuaucuaa

SEQ ID NO: 4047850 - RNA, 23 nt, Staphylococcus aureus subsp. aureus N315
acucguuauagauaaguagugga

SEQ ID NO: 4047851 - RNA, 16 nt, Staphylococcus aureus subsp. aureus N315
acucguugcacucuuu

SEQ ID NO: 4047852 - RNA, 13 nt, Staphylococcus aureus subsp. aureus N315
acucguuuuucca

SEQ ID NO: 4047853 - RNA, 15 nt, Staphylococcus aureus subsp. aureus N315
acucguuuuuccaug

SEQ ID NO: 4047854 - RNA, 21 nt, Staphylococcus aureus subsp. aureus N315
acucuaaaaguuguaauuuaa

SEQ ID NO: 4047855 - RNA, 17 nt, Staphylococcus aureus subsp. aureus N315
acucuagagguaaaucu

SEQ ID NO: 4047856 - RNA, 19 nt, Staphylococcus aureus subsp. aureus N315
acucugaucuaaaaccaua

SEQ ID NO: 4047857 - RNA, 17 nt, Staphylococcus aureus subsp. aureus N315
acucugauuacauauac

SEQ ID NO: 4047858 - RNA, 22 nt, Staphylococcus aureus subsp. aureus N315
acucuguuugucacuuaacuca

SEQ ID NO: 4047859 - RNA, 18 nt, Staphylococcus aureus subsp. aureus N315
acucuuacucauuuuucu

SEQ ID NO: 4047860 - RNA, 13 nt, Staphylococcus aureus subsp. aureus N315
acucuuuuucuuu

SEQ ID NO: 4047861 - RNA, 16 nt, Staphylococcus aureus subsp. aureus N315
acucuuuuucuuucau

SEQ ID NO: 4047862 - RNA, 21 nt, Staphylococcus aureus subsp. aureus N315
acucuuuuucuuucauaauua

SEQ ID NO: 4047863 - RNA, 16 nt, Staphylococcus aureus subsp. aureus N315
acugaaacuaaauuaa

SEQ ID NO: 4047864 - RNA, 13 nt, Staphylococcus aureus subsp. aureus N315
acugaaauuuuuc

SEQ ID NO: 4047865 - RNA, 18 nt, Staphylococcus aureus subsp. aureus N315
acugaaugcuaauacuaa

SEQ ID NO: 4047866 - RNA, 22 nt, Staphylococcus aureus subsp. aureus N315
acugacacuuuaaccacuccuu

SEQ ID NO: 4047867 - RNA, 17 nt, Staphylococcus aureus subsp. aureus N315
acugacuaauaaaacuu

SEQ ID NO: 4047868 - RNA, 16 nt, Staphylococcus aureus subsp. aureus N315
acugaguuuuaaugaa

SEQ ID NO: 4047869 - RNA, 16 nt, Staphylococcus aureus subsp. aureus N315
acugauaaaaggggaa

SEQ ID NO: 4047870 - RNA, 16 nt, Staphylococcus aureus subsp. aureus N315
acugauauuuagaaua

SEQ ID NO: 4047871 - RNA, 21 nt, Staphylococcus aureus subsp. aureus N315
acugaugaaaacuuaaaaaug

SEQ ID NO: 4047872 - RNA, 13 nt, Staphylococcus aureus subsp. aureus N315
acugauuaaacug

SEQ ID NO: 4047873 - RNA, 23 nt, Staphylococcus aureus subsp. aureus N315
acugauuuauugauaaauauuga

SEQ ID NO: 4047874 - RNA, 16 nt, Staphylococcus aureus subsp. aureus N315
acugauuucgcccacc

SEQ ID NO: 4047875 - RNA, 19 nt, Staphylococcus aureus subsp. aureus N315
acugcaaacacaguacaaa

SEQ ID NO: 4047876 - RNA, 22 nt, Staphylococcus aureus subsp. aureus N315
acugcaaauacgaguguuuuaa

SEQ ID NO: 4047877 - RNA, 20 nt, Staphylococcus aureus subsp. aureus N315
acugcaccgauaucauauaa

SEQ ID NO: 4047878 - RNA, 14 nt, Staphylococcus aureus subsp. aureus N315
acugcaccuccaac

SEQ ID NO: 4047879 - RNA, 21 nt, Staphylococcus aureus subsp. aureus N315
acugcauagguaaccuuaaau

SEQ ID NO: 4047880 - RNA, 16 nt, Staphylococcus aureus subsp. aureus N315
acugccauauguuuua

SEQ ID NO: 4047881 - RNA, 13 nt, Staphylococcus aureus subsp. aureus N315
acugcuaauauua

SEQ ID NO: 4047882 - RNA, 18 nt, Staphylococcus aureus subsp. aureus N315
acugcuaauauuagauau

SEQ ID NO: 4047883 - RNA, 20 nt, Staphylococcus aureus subsp. aureus N315
acugcuaauauuagauaucu

SEQ ID NO: 4047884 - RNA, 16 nt, Staphylococcus aureus subsp. aureus N315
acugcuaauuuuuuca

SEQ ID NO: 4047885 - RNA, 15 nt, Staphylococcus aureus subsp. aureus N315
acugcuguucucuau

SEQ ID NO: 4047886 - RNA, 19 nt, Staphylococcus aureus subsp. aureus N315
acugcuuuuuuaaauuuaa

SEQ ID NO: 4047887 - RNA, 18 nt, Staphylococcus aureus subsp. aureus N315
acugggacauagaucaau

SEQ ID NO: 4047888 - RNA, 18 nt, Staphylococcus aureus subsp. aureus N315
acuggguuguuauuuaua

SEQ ID NO: 4047889 - RNA, 14 nt, Staphylococcus aureus subsp. aureus N315
acugguugauaaau

SEQ ID NO: 4047890 - RNA, 19 nt, Staphylococcus aureus subsp. aureus N315
acugguugauaaauaaacu

SEQ ID NO: 4047891 - RNA, 20 nt, Staphylococcus aureus subsp. aureus N315
acuguaaaauucuauaaaua

SEQ ID NO: 4047892 - RNA, 12 nt, Staphylococcus aureus subsp. aureus N315
acuguaaaucau

SEQ ID NO: 4047893 - RNA, 13 nt, Staphylococcus aureus subsp. aureus N315
acuguaaaucauc

SEQ ID NO: 4047894 - RNA, 22 nt, Staphylococcus aureus subsp. aureus N315
acuguauagcuggcuuuuuaau

SEQ ID NO: 4047895 - RNA, 20 nt, Staphylococcus aureus subsp. aureus N315
acuguaugccgccuaauaau

SEQ ID NO: 4047896 - RNA, 21 nt, Staphylococcus aureus subsp. aureus N315
acuguauggucuggaauaaau

SEQ ID NO: 4047897 - RNA, 22 nt, Staphylococcus aureus subsp. aureus N315
acuguauuuuaacgucauuuuu

SEQ ID NO: 4047898 - RNA, 18 nt, Staphylococcus aureus subsp. aureus N315
acugucaccuucuauauu

SEQ ID NO: 4047899 - RNA, 16 nt, Staphylococcus aureus subsp. aureus N315
acugucgcucauccuc

SEQ ID NO: 4047900 - RNA, 20 nt, Staphylococcus aureus subsp. aureus N315
acugucgguucaucuaaaau

SEQ ID NO: 4047901 - RNA, 19 nt, Staphylococcus aureus subsp. aureus N315
acugugauauuaauugaaa

SEQ ID NO: 4047902 - RNA, 22 nt, Staphylococcus aureus subsp. aureus N315
acugugauauuaauugaaaaac

SEQ ID NO: 4047903 - RNA, 19 nt, Staphylococcus aureus subsp. aureus N315
acuguguuuagguauauaa

SEQ ID NO: 4047904 - RNA, 22 nt, Staphylococcus aureus subsp. aureus N315
acuguuaaagucuguugguuua

SEQ ID NO: 4047905 - RNA, 16 nt, Staphylococcus aureus subsp. aureus N315
acuguuacugcacaca

SEQ ID NO: 4047906 - RNA, 21 nt, Staphylococcus aureus subsp. aureus N315
acuguucuuucgucuuguaaa

SEQ ID NO: 4047907 - RNA, 20 nt, Staphylococcus aureus subsp. aureus N315
acuguugguuugaucauuug

SEQ ID NO: 4047908 - RNA, 21 nt, Staphylococcus aureus subsp. aureus N315
acuguuucacguaaugaauca

SEQ ID NO: 4047909 - RNA, 20 nt, Staphylococcus aureus subsp. aureus N315
acuguuuguuuauugagaau

SEQ ID NO: 4047910 - RNA, 10 nt, Staphylococcus aureus subsp. aureus N315
acuuaaaccu

SEQ ID NO: 4047911 - RNA, 18 nt, Staphylococcus aureus subsp. aureus N315
acuuaaauggaugauagu

SEQ ID NO: 4047912 - RNA, 15 nt, Staphylococcus aureus subsp. aureus N315
acuuaaccauuuaaa

SEQ ID NO: 4047913 - RNA, 16 nt, Staphylococcus aureus subsp. aureus N315
acuuaaccauuuaaaa

SEQ ID NO: 4047914 - RNA, 21 nt, Staphylococcus aureus subsp. aureus N315
acuuaacgagugcuuucaccu

SEQ ID NO: 4047915 - RNA, 16 nt, Staphylococcus aureus subsp. aureus N315
acuuaacuuguguuau

SEQ ID NO: 4047916 - RNA, 16 nt, Staphylococcus aureus subsp. aureus N315
acuuaaucguucccau

SEQ ID NO: 4047917 - RNA, 23 nt, Staphylococcus aureus subsp. aureus N315
acuuaaugacuucuuuauauuua

SEQ ID NO: 4047918 - RNA, 18 nt, Staphylococcus aureus subsp. aureus N315
acuuaauuaauaauuuaa

SEQ ID NO: 4047919 - RNA, 13 nt, Staphylococcus aureus subsp. aureus N315
acuuacaaauaua

SEQ ID NO: 4047920 - RNA, 23 nt, Staphylococcus aureus subsp. aureus N315
acuuaccaugaugagauaaaauc

SEQ ID NO: 4047921 - RNA, 15 nt, Staphylococcus aureus subsp. aureus N315
acuuaccuaauagga

SEQ ID NO: 4047922 - RNA, 15 nt, Staphylococcus aureus subsp. aureus N315
acuuaccuuucaaau

SEQ ID NO: 4047923 - RNA, 18 nt, Staphylococcus aureus subsp. aureus N315
acuuacugugaaaauacc

SEQ ID NO: 4047924 - RNA, 20 nt, Staphylococcus aureus subsp. aureus N315
acuuacugugaaaauaccaa

SEQ ID NO: 4047925 - RNA, 13 nt, Staphylococcus aureus subsp. aureus N315
acuuacuuuucua

SEQ ID NO: 4047926 - RNA, 22 nt, Staphylococcus aureus subsp. aureus N315
acuuacuuuucuaaacaacuuc

SEQ ID NO: 4047927 - RNA, 19 nt, Staphylococcus aureus subsp. aureus N315
acuuagcaaucucuuuaga

SEQ ID NO: 4047928 - RNA, 20 nt, Staphylococcus aureus subsp. aureus N315
acuuagggugacucaaugaa

SEQ ID NO: 4047929 - RNA, 15 nt, Staphylococcus aureus subsp. aureus N315
acuuaguaauaagac

SEQ ID NO: 4047930 - RNA, 22 nt, Staphylococcus aureus subsp. aureus N315
acuuaguagauuuauuaaauau

SEQ ID NO: 4047931 - RNA, 16 nt, Staphylococcus aureus subsp. aureus N315
acuuauaaaaugaaau

SEQ ID NO: 4047932 - RNA, 19 nt, Staphylococcus aureus subsp. aureus N315
acuuauaaaaugaaauauu

SEQ ID NO: 4047933 - RNA, 13 nt, Staphylococcus aureus subsp. aureus N315
acuuauaauauua

SEQ ID NO: 4047934 - RNA, 20 nt, Staphylococcus aureus subsp. aureus N315
acuuauauauucaauaauua

SEQ ID NO: 4047935 - RNA, 13 nt, Staphylococcus aureus subsp. aureus N315
acuuaucaucaca

SEQ ID NO: 4047936 - RNA, 21 nt, Staphylococcus aureus subsp. aureus N315
acuuaucuguagauuagcuua

SEQ ID NO: 4047937 - RNA, 15 nt, Staphylococcus aureus subsp. aureus N315
acuuaugagcaaagc

SEQ ID NO: 4047938 - RNA, 17 nt, Staphylococcus aureus subsp. aureus N315
acuuaugagcaaagcaa

SEQ ID NO: 4047939 - RNA, 13 nt, Staphylococcus aureus subsp. aureus N315
acuuaugauacug

SEQ ID NO: 4047940 - RNA, 20 nt, Staphylococcus aureus subsp. aureus N315
acuuaugauacugauauuua

SEQ ID NO: 4047941 - RNA, 18 nt, Staphylococcus aureus subsp. aureus N315
acuuauuaauuaauagag

SEQ ID NO: 4047942 - RNA, 15 nt, Staphylococcus aureus subsp. aureus N315
acuuauuauuuugua

SEQ ID NO: 4047943 - RNA, 12 nt, Staphylococcus aureus subsp. aureus N315
acuuauucuuca

SEQ ID NO: 4047944 - RNA, 18 nt, Staphylococcus aureus subsp. aureus N315
acuuauucuucacuuuca

SEQ ID NO: 4047945 - RNA, 19 nt, Staphylococcus aureus subsp. aureus N315
acuuauugacgaguagauu

SEQ ID NO: 4047946 - RNA, 15 nt, Staphylococcus aureus subsp. aureus N315
acuuauuugaaugca

SEQ ID NO: 4047947 - RNA, 18 nt, Staphylococcus aureus subsp. aureus N315
acuuauuugaaugcaaau

SEQ ID NO: 4047948 - RNA, 22 nt, Staphylococcus aureus subsp. aureus N315
acuuauuugccauauacacacu

SEQ ID NO: 4047949 - RNA, 23 nt, Staphylococcus aureus subsp. aureus N315
acuuauuuuauacgaaucacagu

SEQ ID NO: 4047950 - RNA, 17 nt, Staphylococcus aureus subsp. aureus N315
acuucaaacguuaugua

SEQ ID NO: 4047951 - RNA, 18 nt, Staphylococcus aureus subsp. aureus N315
acuucaauaacaaugcag

SEQ ID NO: 4047952 - RNA, 21 nt, Staphylococcus aureus subsp. aureus N315
acuucacuaggaucuuuucca

SEQ ID NO: 4047953 - RNA, 17 nt, Staphylococcus aureus subsp. aureus N315
acuucauaagucacagu

SEQ ID NO: 4047954 - RNA, 18 nt, Staphylococcus aureus subsp. aureus N315
acuucauaauauauccug

SEQ ID NO: 4047955 - RNA, 15 nt, Staphylococcus aureus subsp. aureus N315
acuucauauaaugcu

SEQ ID NO: 4047956 - RNA, 15 nt, Staphylococcus aureus subsp. aureus N315
acuucauuaguugcc

SEQ ID NO: 4047957 - RNA, 21 nt, Staphylococcus aureus subsp. aureus N315
acuuccaauacuguugucuug

SEQ ID NO: 4047958 - RNA, 20 nt, Staphylococcus aureus subsp. aureus N315
acuuccaucaauccaacuac

SEQ ID NO: 4047959 - RNA, 17 nt, Staphylococcus aureus subsp. aureus N315
acuuccgacugcaccuc

SEQ ID NO: 4047960 - RNA, 18 nt, Staphylococcus aureus subsp. aureus N315
acuuccugcuuuuuuuau

SEQ ID NO: 4047961 - RNA, 18 nt, Staphylococcus aureus subsp. aureus N315
acuucgauaugauuaaag

SEQ ID NO: 4047962 - RNA, 17 nt, Staphylococcus aureus subsp. aureus N315
acuucgccaagccaucu

SEQ ID NO: 4047963 - RNA, 15 nt, Staphylococcus aureus subsp. aureus N315
acuucuaauaguaau

SEQ ID NO: 4047964 - RNA, 22 nt, Staphylococcus aureus subsp. aureus N315
acuucuaauuugcaaaaucaac

SEQ ID NO: 4047965 - RNA, 22 nt, Staphylococcus aureus subsp. aureus N315
acuucuauauuaauagaaagug

SEQ ID NO: 4047966 - RNA, 15 nt, Staphylococcus aureus subsp. aureus N315
acuucugauucuuca

SEQ ID NO: 4047967 - RNA, 13 nt, Staphylococcus aureus subsp. aureus N315
acuucuuaaaaua

SEQ ID NO: 4047968 - RNA, 19 nt, Staphylococcus aureus subsp. aureus N315
acuucuuaaaauaugauuu

SEQ ID NO: 4047969 - RNA, 22 nt, Staphylococcus aureus subsp. aureus N315
acuucuuaaaauaugauuuaaa

SEQ ID NO: 4047970 - RNA, 17 nt, Staphylococcus aureus subsp. aureus N315
acuucuucuucagacca

SEQ ID NO: 4047971 - RNA, 16 nt, Staphylococcus aureus subsp. aureus N315
acuucuuuauauuuau

SEQ ID NO: 4047972 - RNA, 18 nt, Staphylococcus aureus subsp. aureus N315
acuucuuuauauuuauca

SEQ ID NO: 4047973 - RNA, 16 nt, Staphylococcus aureus subsp. aureus N315
acuucuuucaaaaaca

SEQ ID NO: 4047974 - RNA, 22 nt, Staphylococcus aureus subsp. aureus N315
acuucuuuucuuugauaacaau

SEQ ID NO: 4047975 - RNA, 15 nt, Staphylococcus aureus subsp. aureus N315
acuucuuuugcaaaa

SEQ ID NO: 4047976 - RNA, 14 nt, Staphylococcus aureus subsp. aureus N315
acuucuuuuguuuu

SEQ ID NO: 4047977 - RNA, 17 nt, Staphylococcus aureus subsp. aureus N315
acuucuuuuuuguaucu

SEQ ID NO: 4047978 - RNA, 18 nt, Staphylococcus aureus subsp. aureus N315
acuugaauaccuuuuauu

SEQ ID NO: 4047979 - RNA, 17 nt, Staphylococcus aureus subsp. aureus N315
acuugaccacuuuuguu

SEQ ID NO: 4047980 - RNA, 17 nt, Staphylococcus aureus subsp. aureus N315
acuugauaaaaaaugaa

SEQ ID NO: 4047981 - RNA, 18 nt, Staphylococcus aureus subsp. aureus N315
acuugauaaaaaaugaau

SEQ ID NO: 4047982 - RNA, 16 nt, Staphylococcus aureus subsp. aureus N315
acuugauaaaacuaau

SEQ ID NO: 4047983 - RNA, 13 nt, Staphylococcus aureus subsp. aureus N315
acuugauaucauc

SEQ ID NO: 4047984 - RNA, 18 nt, Staphylococcus aureus subsp. aureus N315
acuugaucauuauaaaau

SEQ ID NO: 4047985 - RNA, 20 nt, Staphylococcus aureus subsp. aureus N315
acuugcuguugcaauaaaau

SEQ ID NO: 4047986 - RNA, 21 nt, Staphylococcus aureus subsp. aureus N315
acuugcuguugcaauaaaauc

SEQ ID NO: 4047987 - RNA, 17 nt, Staphylococcus aureus subsp. aureus N315
acuuggaaauguauaug

SEQ ID NO: 4047988 - RNA, 18 nt, Staphylococcus aureus subsp. aureus N315
acuuggauucaaaugaca

SEQ ID NO: 4047989 - RNA, 21 nt, Staphylococcus aureus subsp. aureus N315
acuugguauugguaaauuuau

SEQ ID NO: 4047990 - RNA, 19 nt, Staphylococcus aureus subsp. aureus N315
acuuguaaauuuauuuuua

SEQ ID NO: 4047991 - RNA, 18 nt, Staphylococcus aureus subsp. aureus N315
acuuguaauauaacaagu

SEQ ID NO: 4047992 - RNA, 18 nt, Staphylococcus aureus subsp. aureus N315
acuuguaucaucgccaug

SEQ ID NO: 4047993 - RNA, 18 nt, Staphylococcus aureus subsp. aureus N315
acuugugauauauaacca

SEQ ID NO: 4047994 - RNA, 20 nt, Staphylococcus aureus subsp. aureus N315
acuugugcgcgacguuuaaa

SEQ ID NO: 4047995 - RNA, 19 nt, Staphylococcus aureus subsp. aureus N315
acuuguucaacaacugcga

SEQ ID NO: 4047996 - RNA, 13 nt, Staphylococcus aureus subsp. aureus N315
acuuguuuccuac

SEQ ID NO: 4047997 - RNA, 16 nt, Staphylococcus aureus subsp. aureus N315
acuuuaaaauuguaua

SEQ ID NO: 4047998 - RNA, 16 nt, Staphylococcus aureus subsp. aureus N315
acuuuaacuucuuuug

SEQ ID NO: 4047999 - RNA, 21 nt, Staphylococcus aureus subsp. aureus N315
acuuuaauacuaccguuuuua

SEQ ID NO: 4048000 - RNA, 22 nt, Staphylococcus aureus subsp. aureus N315
acuuuaauacuaccguuuuuau

SEQ ID NO: 4048001 - RNA, 11 nt, Staphylococcus aureus subsp. aureus N315
acuuuaccauc

SEQ ID NO: 4048002 - RNA, 18 nt, Staphylococcus aureus subsp. aureus N315
acuuuacgauaaauagug

SEQ ID NO: 4048003 - RNA, 15 nt, Staphylococcus aureus subsp. aureus N315
acuuuagaaagugau

SEQ ID NO: 4048004 - RNA, 23 nt, Staphylococcus aureus subsp. aureus N315
acuuuagaaagugauucccaaag

SEQ ID NO: 4048005 - RNA, 13 nt, Staphylococcus aureus subsp. aureus N315
acuuuaguauauu

SEQ ID NO: 4048006 - RNA, 14 nt, Staphylococcus aureus subsp. aureus N315
acuuuaguauuaua

SEQ ID NO: 4048007 - RNA, 15 nt, Staphylococcus aureus subsp. aureus N315
acuuuauaauuuuug

SEQ ID NO: 4048008 - RNA, 20 nt, Staphylococcus aureus subsp. aureus N315
acuuuauauauaaagaaaua

SEQ ID NO: 4048009 - RNA, 14 nt, Staphylococcus aureus subsp. aureus N315
acuuuaugaaauuu

SEQ ID NO: 4048010 - RNA, 23 nt, Staphylococcus aureus subsp. aureus N315
acuuucaaacaaaucuuuuaaau

SEQ ID NO: 4048011 - RNA, 16 nt, Staphylococcus aureus subsp. aureus N315
acuuucacuuuuuaua

SEQ ID NO: 4048012 - RNA, 15 nt, Staphylococcus aureus subsp. aureus N315
acuuucccuacugcu

SEQ ID NO: 4048013 - RNA, 18 nt, Staphylococcus aureus subsp. aureus N315
acuuuccgccuucaaucc

SEQ ID NO: 4048014 - RNA, 15 nt, Staphylococcus aureus subsp. aureus N315
acuuucgcuugcaaa

SEQ ID NO: 4048015 - RNA, 18 nt, Staphylococcus aureus subsp. aureus N315
acuuucguauuuuucuug

SEQ ID NO: 4048016 - RNA, 14 nt, Staphylococcus aureus subsp. aureus N315
acuuucuaauuguu

SEQ ID NO: 4048017 - RNA, 23 nt, Staphylococcus aureus subsp. aureus N315
acuuugaauugguugaucaauua

SEQ ID NO: 4048018 - RNA, 20 nt, Staphylococcus aureus subsp. aureus N315
acuuugauaucuacagagaa

SEQ ID NO: 4048019 - RNA, 14 nt, Staphylococcus aureus subsp. aureus N315
acuuugauauguuu

SEQ ID NO: 4048020 - RNA, 19 nt, Staphylococcus aureus subsp. aureus N315
acuuuggaaauuuauuaua

SEQ ID NO: 4048021 - RNA, 17 nt, Staphylococcus aureus subsp. aureus N315
acuuuggacuuuaaagu

SEQ ID NO: 4048022 - RNA, 21 nt, Staphylococcus aureus subsp. aureus N315
acuuuguggauucucuuuaua

SEQ ID NO: 4048023 - RNA, 15 nt, Staphylococcus aureus subsp. aureus N315
acuuugugugcuuua

SEQ ID NO: 4048024 - RNA, 21 nt, Staphylococcus aureus subsp. aureus N315
acuuuuaccauugugaauaau

SEQ ID NO: 4048025 - RNA, 13 nt, Staphylococcus aureus subsp. aureus N315
acuuuuagauuau

SEQ ID NO: 4048026 - RNA, 17 nt, Staphylococcus aureus subsp. aureus N315
acuuuuauaaucuuuua

SEQ ID NO: 4048027 - RNA, 20 nt, Staphylococcus aureus subsp. aureus N315
acuuuuauuuguauuguaua

SEQ ID NO: 4048028 - RNA, 15 nt, Staphylococcus aureus subsp. aureus N315
acuuuuauuuuuuau

SEQ ID NO: 4048029 - RNA, 17 nt, Staphylococcus aureus subsp. aureus N315
acuuuucaacuuuaguu

SEQ ID NO: 4048030 - RNA, 20 nt, Staphylococcus aureus subsp. aureus N315
acuuuuccuugauucuuaua

SEQ ID NO: 4048031 - RNA, 12 nt, Staphylococcus aureus subsp. aureus N315
acuuuucuuauc

SEQ ID NO: 4048032 - RNA, 16 nt, Staphylococcus aureus subsp. aureus N315
acuuuugauuuugaau

SEQ ID NO: 4048033 - RNA, 24 nt, Staphylococcus aureus subsp. aureus N315
acuuuugcaucacagauaaugcau

SEQ ID NO: 4048034 - RNA, 15 nt, Staphylococcus aureus subsp. aureus N315
acuuuuucaacugua

SEQ ID NO: 4048035 - RNA, 14 nt, Staphylococcus aureus subsp. aureus N315
acuuuuucaucuuu

SEQ ID NO: 4048036 - RNA, 17 nt, Staphylococcus aureus subsp. aureus N315
acuuuuucaucuuucac

SEQ ID NO: 4048037 - RNA, 13 nt, Staphylococcus aureus subsp. aureus N315
acuuuuuguuaau

SEQ ID NO: 4048038 - RNA, 19 nt, Staphylococcus aureus subsp. aureus N315
acuuuuuuguucaaucacu

SEQ ID NO: 4048039 - RNA, 23 nt, Staphylococcus aureus subsp. aureus N315
acuuuuuuuaaaucuucuauuuu

SEQ ID NO: 4048040 - RNA, 12 nt, Staphylococcus aureus subsp. aureus N315
agaaaaaguauu

SEQ ID NO: 4048041 - RNA, 14 nt, Staphylococcus aureus subsp. aureus N315
agaaaaagugauaa

SEQ ID NO: 4048042 - RNA, 13 nt, Staphylococcus aureus subsp. aureus N315
agaaaaauaugau

SEQ ID NO: 4048043 - RNA, 16 nt, Staphylococcus aureus subsp. aureus N315
agaaaacauaaauaca

SEQ ID NO: 4048044 - RNA, 17 nt, Staphylococcus aureus subsp. aureus N315
agaaaacauaaauacaa

SEQ ID NO: 4048045 - RNA, 18 nt, Staphylococcus aureus subsp. aureus N315
agaaaaggauuauaggua

SEQ ID NO: 4048046 - RNA, 20 nt, Staphylococcus aureus subsp. aureus N315
agaaaagggcaaaaaaggau

SEQ ID NO: 4048047 - RNA, 15 nt, Staphylococcus aureus subsp. aureus N315
agaaaaguauaaaua

SEQ ID NO: 4048048 - RNA, 18 nt, Staphylococcus aureus subsp. aureus N315
agaaaaguauaaauauaa

SEQ ID NO: 4048049 - RNA, 22 nt, Staphylococcus aureus subsp. aureus N315
agaaaaguauaaauauaaaaag

SEQ ID NO: 4048050 - RNA, 23 nt, Staphylococcus aureus subsp. aureus N315
agaaaaguauaaauauaaaaagu

SEQ ID NO: 4048051 - RNA, 23 nt, Staphylococcus aureus subsp. aureus N315
agaaaaguuacuuacgccaauca

SEQ ID NO: 4048052 - RNA, 21 nt, Staphylococcus aureus subsp. aureus N315
agaaaauaugacgaucuucau

SEQ ID NO: 4048053 - RNA, 22 nt, Staphylococcus aureus subsp. aureus N315
agaaaaucguuauaaguacaaa

SEQ ID NO: 4048054 - RNA, 18 nt, Staphylococcus aureus subsp. aureus N315
agaaaaugaguacaacau

SEQ ID NO: 4048055 - RNA, 13 nt, Staphylococcus aureus subsp. aureus N315
agaaacacaagga

SEQ ID NO: 4048056 - RNA, 11 nt, Staphylococcus aureus subsp. aureus N315
agaaacacuuu

SEQ ID NO: 4048057 - RNA, 23 nt, Staphylococcus aureus subsp. aureus N315
agaaacuauuaucgaagaaacau

SEQ ID NO: 4048058 - RNA, 13 nt, Staphylococcus aureus subsp. aureus N315
agaaagaauaaau

SEQ ID NO: 4048059 - RNA, 18 nt, Staphylococcus aureus subsp. aureus N315
agaaagaauaaauguuaa

SEQ ID NO: 4048060 - RNA, 18 nt, Staphylococcus aureus subsp. aureus N315
agaaagaccauuguauua

SEQ ID NO: 4048061 - RNA, 15 nt, Staphylococcus aureus subsp. aureus N315
agaaauaaucacauu

SEQ ID NO: 4048062 - RNA, 23 nt, Staphylococcus aureus subsp. aureus N315
agaaauacuaauuucuauagaaa

SEQ ID NO: 4048063 - RNA, 20 nt, Staphylococcus aureus subsp. aureus N315
agaaauacucaguuuauuga

SEQ ID NO: 4048064 - RNA, 12 nt, Staphylococcus aureus subsp. aureus N315
agaaaucaccag

SEQ ID NO: 4048065 - RNA, 14 nt, Staphylococcus aureus subsp. aureus N315
agaaaucaccagau

SEQ ID NO: 4048066 - RNA, 16 nt, Staphylococcus aureus subsp. aureus N315
agaaaucaccagauuu

SEQ ID NO: 4048067 - RNA, 14 nt, Staphylococcus aureus subsp. aureus N315
agaaaucuuaaaga

SEQ ID NO: 4048068 - RNA, 21 nt, Staphylococcus aureus subsp. aureus N315
agaaaugacgauaccuuuaau

SEQ ID NO: 4048069 - RNA, 22 nt, Staphylococcus aureus subsp. aureus N315
agaaauguuaacgauagacauu

SEQ ID NO: 4048070 - RNA, 21 nt, Staphylococcus aureus subsp. aureus N315
agaaauuaccguuuauuucgu

SEQ ID NO: 4048071 - RNA, 16 nt, Staphylococcus aureus subsp. aureus N315
agaaauucgaaaagaa

SEQ ID NO: 4048072 - RNA, 18 nt, Staphylococcus aureus subsp. aureus N315
agaaauucgaaaagaaau

SEQ ID NO: 4048073 - RNA, 17 nt, Staphylococcus aureus subsp. aureus N315
agaaauucuacaaacaa

SEQ ID NO: 4048074 - RNA, 16 nt, Staphylococcus aureus subsp. aureus N315
agaaauugaauucucg

SEQ ID NO: 4048075 - RNA, 20 nt, Staphylococcus aureus subsp. aureus N315
agaaauuguguuucuuuuau

SEQ ID NO: 4048076 - RNA, 15 nt, Staphylococcus aureus subsp. aureus N315
agaaauuuaauacaa

SEQ ID NO: 4048077 - RNA, 14 nt, Staphylococcus aureus subsp. aureus N315
agaaauuuuaaaau

SEQ ID NO: 4048078 - RNA, 12 nt, Staphylococcus aureus subsp. aureus N315
agaacaaaaugu

SEQ ID NO: 4048079 - RNA, 14 nt, Staphylococcus aureus subsp. aureus N315
agaacaagaauuau

SEQ ID NO: 4048080 - RNA, 15 nt, Staphylococcus aureus subsp. aureus N315
agaacaagaauuaug

SEQ ID NO: 4048081 - RNA, 13 nt, Staphylococcus aureus subsp. aureus N315
agaacaaucaaua

SEQ ID NO: 4048082 - RNA, 17 nt, Staphylococcus aureus subsp. aureus N315
agaacaaucaauacaga

SEQ ID NO: 4048083 - RNA, 17 nt, Staphylococcus aureus subsp. aureus N315
agaacagcacauuuuua

SEQ ID NO: 4048084 - RNA, 23 nt, Staphylococcus aureus subsp. aureus N315
agaacaugauacugaaauuucau

SEQ ID NO: 4048085 - RNA, 14 nt, Staphylococcus aureus subsp. aureus N315
agaaccaacaauaa

SEQ ID NO: 4048086 - RNA, 18 nt, Staphylococcus aureus subsp. aureus N315
agaaccacgcaucaugua

SEQ ID NO: 4048087 - RNA, 22 nt, Staphylococcus aureus subsp. aureus N315
agaaccacgcaucauguauaug

SEQ ID NO: 4048088 - RNA, 21 nt, Staphylococcus aureus subsp. aureus N315
agaaccaucauucauauggaa

SEQ ID NO: 4048089 - RNA, 18 nt, Staphylococcus aureus subsp. aureus N315
agaaccuuuaaaaguaac

SEQ ID NO: 4048090 - RNA, 21 nt, Staphylococcus aureus subsp. aureus N315
agaaccuuuaaaaguaacaua

SEQ ID NO: 4048091 - RNA, 13 nt, Staphylococcus aureus subsp. aureus N315
agaaccuuucuug

SEQ ID NO: 4048092 - RNA, 19 nt, Staphylococcus aureus subsp. aureus N315
agaaccuuuuuguuuucaa

SEQ ID NO: 4048093 - RNA, 14 nt, Staphylococcus aureus subsp. aureus N315
agaacgagaauuuc

SEQ ID NO: 4048094 - RNA, 15 nt, Staphylococcus aureus subsp. aureus N315
agaacguucauauau

SEQ ID NO: 4048095 - RNA, 15 nt, Staphylococcus aureus subsp. aureus N315
agaacguucuaaggu

SEQ ID NO: 4048096 - RNA, 19 nt, Staphylococcus aureus subsp. aureus N315
agaacuaacauaauuuuua

SEQ ID NO: 4048097 - RNA, 23 nt, Staphylococcus aureus subsp. aureus N315
agaacuaagaugugcaucccgaa

SEQ ID NO: 4048098 - RNA, 14 nt, Staphylococcus aureus subsp. aureus N315
agaacuaauguaaa

SEQ ID NO: 4048099 - RNA, 22 nt, Staphylococcus aureus subsp. aureus N315
agaacuacgcauuuuaaauaaa

SEQ ID NO: 4048100 - RNA, 23 nt, Staphylococcus aureus subsp. aureus N315
agaacuuuaaaaauugcaaugcu

SEQ ID NO: 4048101 - RNA, 16 nt, Staphylococcus aureus subsp. aureus N315
agaagaaacuuaauca

SEQ ID NO: 4048102 - RNA, 18 nt, Staphylococcus aureus subsp. aureus N315
agaagccucuugccuuga

SEQ ID NO: 4048103 - RNA, 19 nt, Staphylococcus aureus subsp. aureus N315
agaaguuguuuagaaaagu

SEQ ID NO: 4048104 - RNA, 13 nt, Staphylococcus aureus subsp. aureus N315
agaaguuucuaua

SEQ ID NO: 4048105 - RNA, 16 nt, Staphylococcus aureus subsp. aureus N315
agaauacaaauauuaa

SEQ ID NO: 4048106 - RNA, 17 nt, Staphylococcus aureus subsp. aureus N315
agaauacaaauauuaag

SEQ ID NO: 4048107 - RNA, 17 nt, Staphylococcus aureus subsp. aureus N315
agaauacuaaaaguguu

SEQ ID NO: 4048108 - RNA, 16 nt, Staphylococcus aureus subsp. aureus N315
agaauaguuaccaaaa

SEQ ID NO: 4048109 - RNA, 17 nt, Staphylococcus aureus subsp. aureus N315
agaauaguuaccaaaau

SEQ ID NO: 4048110 - RNA, 21 nt, Staphylococcus aureus subsp. aureus N315
agaauauauguauaacauuau

SEQ ID NO: 4048111 - RNA, 11 nt, Staphylococcus aureus subsp. aureus N315
agaauauuaac

SEQ ID NO: 4048112 - RNA, 22 nt, Staphylococcus aureus subsp. aureus N315
agaauauuaagauguauaugaa

SEQ ID NO: 4048113 - RNA, 16 nt, Staphylococcus aureus subsp. aureus N315
agaauauucagauuuu

SEQ ID NO: 4048114 - RNA, 17 nt, Staphylococcus aureus subsp. aureus N315
agaaucaaguaauucau

SEQ ID NO: 4048115 - RNA, 19 nt, Staphylococcus aureus subsp. aureus N315
agaaucaauuauugaaaac

SEQ ID NO: 4048116 - RNA, 13 nt, Staphylococcus aureus subsp. aureus N315
agaaucaucuaaa

SEQ ID NO: 4048117 - RNA, 19 nt, Staphylococcus aureus subsp. aureus N315
agaaucauuuaaaucaaua

SEQ ID NO: 4048118 - RNA, 19 nt, Staphylococcus aureus subsp. aureus N315
agaauccuaugccaaauaa

SEQ ID NO: 4048119 - RNA, 14 nt, Staphylococcus aureus subsp. aureus N315
agaaucuccauuua

SEQ ID NO: 4048120 - RNA, 23 nt, Staphylococcus aureus subsp. aureus N315
agaaucuuggaaguaucugugaa

SEQ ID NO: 4048121 - RNA, 18 nt, Staphylococcus aureus subsp. aureus N315
agaaugaacuucucuuag

SEQ ID NO: 4048122 - RNA, 16 nt, Staphylococcus aureus subsp. aureus N315
agaaugaauaauucca

SEQ ID NO: 4048123 - RNA, 19 nt, Staphylococcus aureus subsp. aureus N315
agaaugacaccuaauacca

SEQ ID NO: 4048124 - RNA, 15 nt, Staphylococcus aureus subsp. aureus N315
agaaugauacuguau

SEQ ID NO: 4048125 - RNA, 17 nt, Staphylococcus aureus subsp. aureus N315
agaauguguuaaucaac

SEQ ID NO: 4048126 - RNA, 13 nt, Staphylococcus aureus subsp. aureus N315
agaauuaaagucu

SEQ ID NO: 4048127 - RNA, 15 nt, Staphylococcus aureus subsp. aureus N315
agaauuaacaacaaa

SEQ ID NO: 4048128 - RNA, 23 nt, Staphylococcus aureus subsp. aureus N315
agaauuaauaauuuuuuuccuuu

SEQ ID NO: 4048129 - RNA, 15 nt, Staphylococcus aureus subsp. aureus N315
agaauuaaugaaaua

SEQ ID NO: 4048130 - RNA, 20 nt, Staphylococcus aureus subsp. aureus N315
agaauuaguacuugaaacau

SEQ ID NO: 4048131 - RNA, 17 nt, Staphylococcus aureus subsp. aureus N315
agaauuauuuuggacug

SEQ ID NO: 4048132 - RNA, 16 nt, Staphylococcus aureus subsp. aureus N315
agaauucaauuucuca

SEQ ID NO: 4048133 - RNA, 19 nt, Staphylococcus aureus subsp. aureus N315
agaauucacgcaauaucau

SEQ ID NO: 4048134 - RNA, 17 nt, Staphylococcus aureus subsp. aureus N315
agaauucagcugaugcu

SEQ ID NO: 4048135 - RNA, 13 nt, Staphylococcus aureus subsp. aureus N315
agaauucauuaau

SEQ ID NO: 4048136 - RNA, 16 nt, Staphylococcus aureus subsp. aureus N315
agaauucuaaaagaau

SEQ ID NO: 4048137 - RNA, 19 nt, Staphylococcus aureus subsp. aureus N315
agaauuucgaaaagaaauu

SEQ ID NO: 4048138 - RNA, 21 nt, Staphylococcus aureus subsp. aureus N315
agaauuucuuuucgaaaaucu

SEQ ID NO: 4048139 - RNA, 23 nt, Staphylococcus aureus subsp. aureus N315
agaauuucuuuucgaaaaucucu

SEQ ID NO: 4048140 - RNA, 20 nt, Staphylococcus aureus subsp. aureus N315
agaauuuuaauuaauuauca

SEQ ID NO: 4048141 - RNA, 20 nt, Staphylococcus aureus subsp. aureus N315
agaauuuuucauauacuuaa

SEQ ID NO: 4048142 - RNA, 16 nt, Staphylococcus aureus subsp. aureus N315
agacaaguauacuuga

SEQ ID NO: 4048143 - RNA, 15 nt, Staphylococcus aureus subsp. aureus N315
agacaauauuuuuac

SEQ ID NO: 4048144 - RNA, 21 nt, Staphylococcus aureus subsp. aureus N315
agacaaugauuugugguaauc

SEQ ID NO: 4048145 - RNA, 13 nt, Staphylococcus aureus subsp. aureus N315
agacaccaaaaaa

SEQ ID NO: 4048146 - RNA, 16 nt, Staphylococcus aureus subsp. aureus N315
agacaccuuaucacuu

SEQ ID NO: 4048147 - RNA, 16 nt, Staphylococcus aureus subsp. aureus N315
agacauaaaaaaagag

SEQ ID NO: 4048148 - RNA, 12 nt, Staphylococcus aureus subsp. aureus N315
agacauaaauau

SEQ ID NO: 4048149 - RNA, 17 nt, Staphylococcus aureus subsp. aureus N315
agacauaaauauggauu

SEQ ID NO: 4048150 - RNA, 17 nt, Staphylococcus aureus subsp. aureus N315
agacauaaccuugcuuu

SEQ ID NO: 4048151 - RNA, 22 nt, Staphylococcus aureus subsp. aureus N315
agacauacagucaauacaaaga

SEQ ID NO: 4048152 - RNA, 22 nt, Staphylococcus aureus subsp. aureus N315
agacauauagcggugucaauau

SEQ ID NO: 4048153 - RNA, 15 nt, Staphylococcus aureus subsp. aureus N315
agacauccacagaau

SEQ ID NO: 4048154 - RNA, 14 nt, Staphylococcus aureus subsp. aureus N315
agacauuacauuua

SEQ ID NO: 4048155 - RNA, 21 nt, Staphylococcus aureus subsp. aureus N315
agacauugaaaggaacauuuc

SEQ ID NO: 4048156 - RNA, 16 nt, Staphylococcus aureus subsp. aureus N315
agaccaugcaaacuca

SEQ ID NO: 4048157 - RNA, 19 nt, Staphylococcus aureus subsp. aureus N315
agaccauuuuauauuuuag

SEQ ID NO: 4048158 - RNA, 14 nt, Staphylococcus aureus subsp. aureus N315
agaccccgaaaaga

SEQ ID NO: 4048159 - RNA, 13 nt, Staphylococcus aureus subsp. aureus N315
agaccuaugaauu

SEQ ID NO: 4048160 - RNA, 19 nt, Staphylococcus aureus subsp. aureus N315
agacguaaguguaaaugaa

SEQ ID NO: 4048161 - RNA, 20 nt, Staphylococcus aureus subsp. aureus N315
agacguacaugcuucaauau

SEQ ID NO: 4048162 - RNA, 14 nt, Staphylococcus aureus subsp. aureus N315
agacguuuuccaug

SEQ ID NO: 4048163 - RNA, 21 nt, Staphylococcus aureus subsp. aureus N315
agacuaaaaaacuaacuuuau

SEQ ID NO: 4048164 - RNA, 17 nt, Staphylococcus aureus subsp. aureus N315
agacuaaaaugaaugaa

SEQ ID NO: 4048165 - RNA, 15 nt, Staphylococcus aureus subsp. aureus N315
agacuauauucaauu

SEQ ID NO: 4048166 - RNA, 13 nt, Staphylococcus aureus subsp. aureus N315
agacucaaggaaa

SEQ ID NO: 4048167 - RNA, 17 nt, Staphylococcus aureus subsp. aureus N315
agacucaaggaaaucau

SEQ ID NO: 4048168 - RNA, 18 nt, Staphylococcus aureus subsp. aureus N315
agacucaaggaaaucaua

SEQ ID NO: 4048169 - RNA, 13 nt, Staphylococcus aureus subsp. aureus N315
agacucaauuuca

SEQ ID NO: 4048170 - RNA, 15 nt, Staphylococcus aureus subsp. aureus N315
agacucaauuucauu

SEQ ID NO: 4048171 - RNA, 13 nt, Staphylococcus aureus subsp. aureus N315
agacucacuucuu

SEQ ID NO: 4048172 - RNA, 13 nt, Staphylococcus aureus subsp. aureus N315
agacuccuaaauu

SEQ ID NO: 4048173 - RNA, 17 nt, Staphylococcus aureus subsp. aureus N315
agacuguuuuuuuguuu

SEQ ID NO: 4048174 - RNA, 19 nt, Staphylococcus aureus subsp. aureus N315
agacuuauuugaaugcaaa

SEQ ID NO: 4048175 - RNA, 20 nt, Staphylococcus aureus subsp. aureus N315
agacuuuccaccauaugugg

SEQ ID NO: 4048176 - RNA, 11 nt, Staphylococcus aureus subsp. aureus N315
agacuuucuug

SEQ ID NO: 4048177 - RNA, 22 nt, Staphylococcus aureus subsp. aureus N315
agacuuucuugaugaauuaaac

SEQ ID NO: 4048178 - RNA, 17 nt, Staphylococcus aureus subsp. aureus N315
agagaaacgugacggua

SEQ ID NO: 4048179 - RNA, 11 nt, Staphylococcus aureus subsp. aureus N315
agagaaauucg

SEQ ID NO: 4048180 - RNA, 19 nt, Staphylococcus aureus subsp. aureus N315
agagaaauucgaaaagaaa

SEQ ID NO: 4048181 - RNA, 16 nt, Staphylococcus aureus subsp. aureus N315
agagaacgcuuuauua

SEQ ID NO: 4048182 - RNA, 20 nt, Staphylococcus aureus subsp. aureus N315
agagaacgcuuuauuacuuu

SEQ ID NO: 4048183 - RNA, 13 nt, Staphylococcus aureus subsp. aureus N315
agagaagggagua

SEQ ID NO: 4048184 - RNA, 13 nt, Staphylococcus aureus subsp. aureus N315
agagaaucaauua

SEQ ID NO: 4048185 - RNA, 17 nt, Staphylococcus aureus subsp. aureus N315
agagaauuucgaaaaga

SEQ ID NO: 4048186 - RNA, 18 nt, Staphylococcus aureus subsp. aureus N315
agagaauuucgaaaagaa

SEQ ID NO: 4048187 - RNA, 19 nt, Staphylococcus aureus subsp. aureus N315
agagaauuucgaaaagaaa

SEQ ID NO: 4048188 - RNA, 21 nt, Staphylococcus aureus subsp. aureus N315
agagaauuucgaaaagaaauu

SEQ ID NO: 4048189 - RNA, 16 nt, Staphylococcus aureus subsp. aureus N315
agagcacgagaaaugu

SEQ ID NO: 4048190 - RNA, 20 nt, Staphylococcus aureus subsp. aureus N315
agagcucaaccucuuaguuc

SEQ ID NO: 4048191 - RNA, 22 nt, Staphylococcus aureus subsp. aureus N315
agaggaacagcggaauacagau

SEQ ID NO: 4048192 - RNA, 19 nt, Staphylococcus aureus subsp. aureus N315
agaggauaggcaacugcaa

SEQ ID NO: 4048193 - RNA, 20 nt, Staphylococcus aureus subsp. aureus N315
agaggcugguggaaagucag

SEQ ID NO: 4048194 - RNA, 17 nt, Staphylococcus aureus subsp. aureus N315
agaguaguucggaugag

SEQ ID NO: 4048195 - RNA, 20 nt, Staphylococcus aureus subsp. aureus N315
agaguuuuuauuauuaggcg

SEQ ID NO: 4048196 - RNA, 15 nt, Staphylococcus aureus subsp. aureus N315
agauaaacaagccaa

SEQ ID NO: 4048197 - RNA, 19 nt, Staphylococcus aureus subsp. aureus N315
agauaaacucuaaauaaac

SEQ ID NO: 4048198 - RNA, 14 nt, Staphylococcus aureus subsp. aureus N315
agauaaaucaucau

SEQ ID NO: 4048199 - RNA, 19 nt, Staphylococcus aureus subsp. aureus N315
agauaaaucgauaaaaugu

SEQ ID NO: 4048200 - RNA, 17 nt, Staphylococcus aureus subsp. aureus N315
agauaaauuaauaugaa

SEQ ID NO: 4048201 - RNA, 15 nt, Staphylococcus aureus subsp. aureus N315
agauaagaauauuua

SEQ ID NO: 4048202 - RNA, 23 nt, Staphylococcus aureus subsp. aureus N315
agauaaguaguggauaaucacaa

SEQ ID NO: 4048203 - RNA, 16 nt, Staphylococcus aureus subsp. aureus N315
agauaaguuacuagca

SEQ ID NO: 4048204 - RNA, 12 nt, Staphylococcus aureus subsp. aureus N315
agauaaugcacc

SEQ ID NO: 4048205 - RNA, 14 nt, Staphylococcus aureus subsp. aureus N315
agauaauuauuucu

SEQ ID NO: 4048206 - RNA, 19 nt, Staphylococcus aureus subsp. aureus N315
agauaauuuucaauuagaa

SEQ ID NO: 4048207 - RNA, 16 nt, Staphylococcus aureus subsp. aureus N315
agauacacguaacgca

SEQ ID NO: 4048208 - RNA, 19 nt, Staphylococcus aureus subsp. aureus N315
agauacauuaucaagaaua

SEQ ID NO: 4048209 - RNA, 18 nt, Staphylococcus aureus subsp. aureus N315
agauacguugauguaauu

SEQ ID NO: 4048210 - RNA, 22 nt, Staphylococcus aureus subsp. aureus N315
agauacugcuucuacccuugca

SEQ ID NO: 4048211 - RNA, 23 nt, Staphylococcus aureus subsp. aureus N315
agauacuucaguacgguuauuua

SEQ ID NO: 4048212 - RNA, 13 nt, Staphylococcus aureus subsp. aureus N315
agauagaaauuac

SEQ ID NO: 4048213 - RNA, 13 nt, Staphylococcus aureus subsp. aureus N315
agauaggauuuac

SEQ ID NO: 4048214 - RNA, 15 nt, Staphylococcus aureus subsp. aureus N315
agauaggauuuacac

SEQ ID NO: 4048215 - RNA, 22 nt, Staphylococcus aureus subsp. aureus N315
agauaggauuugcaccuauacc

SEQ ID NO: 4048216 - RNA, 13 nt, Staphylococcus aureus subsp. aureus N315
agauauagaauuc

SEQ ID NO: 4048217 - RNA, 22 nt, Staphylococcus aureus subsp. aureus N315
agauaucuuaaucuaaaaauag

SEQ ID NO: 4048218 - RNA, 16 nt, Staphylococcus aureus subsp. aureus N315
agauaucuuauaacaa

SEQ ID NO: 4048219 - RNA, 21 nt, Staphylococcus aureus subsp. aureus N315
agauauuauugugaaaucuau

SEQ ID NO: 4048220 - RNA, 14 nt, Staphylococcus aureus subsp. aureus N315
agauauugaaugga

SEQ ID NO: 4048221 - RNA, 12 nt, Staphylococcus aureus subsp. aureus N315
agaucaauauca

SEQ ID NO: 4048222 - RNA, 18 nt, Staphylococcus aureus subsp. aureus N315
agaucauuaaaaacgauu

SEQ ID NO: 4048223 - RNA, 14 nt, Staphylococcus aureus subsp. aureus N315
agaucuaacaauau

SEQ ID NO: 4048224 - RNA, 21 nt, Staphylococcus aureus subsp. aureus N315
agaucucaauccaauuaaaua

SEQ ID NO: 4048225 - RNA, 22 nt, Staphylococcus aureus subsp. aureus N315
agaugacugaaccaauccaaua

SEQ ID NO: 4048226 - RNA, 17 nt, Staphylococcus aureus subsp. aureus N315
agaugagauuucguuag

SEQ ID NO: 4048227 - RNA, 19 nt, Staphylococcus aureus subsp. aureus N315
agaugaggcgauaaaagaa

SEQ ID NO: 4048228 - RNA, 19 nt, Staphylococcus aureus subsp. aureus N315
agaugauauuuaacaaaau

SEQ ID NO: 4048229 - RNA, 21 nt, Staphylococcus aureus subsp. aureus N315
agaugaucagggaaaucaucu

SEQ ID NO: 4048230 - RNA, 15 nt, Staphylococcus aureus subsp. aureus N315
agaugaugcuucgca

SEQ ID NO: 4048231 - RNA, 16 nt, Staphylococcus aureus subsp. aureus N315
agaugauucuuaucau

SEQ ID NO: 4048232 - RNA, 16 nt, Staphylococcus aureus subsp. aureus N315
agaugauugucuagca

SEQ ID NO: 4048233 - RNA, 15 nt, Staphylococcus aureus subsp. aureus N315
agaugcauaaaaaaa

SEQ ID NO: 4048234 - RNA, 17 nt, Staphylococcus aureus subsp. aureus N315
agaugcauaaaaaccua

SEQ ID NO: 4048235 - RNA, 19 nt, Staphylococcus aureus subsp. aureus N315
agaugcuugaccuucaguu

SEQ ID NO: 4048236 - RNA, 17 nt, Staphylococcus aureus subsp. aureus N315
agaugcuuuaauuaaag

SEQ ID NO: 4048237 - RNA, 22 nt, Staphylococcus aureus subsp. aureus N315
agauggacaguuuuuauauuaa

SEQ ID NO: 4048238 - RNA, 17 nt, Staphylococcus aureus subsp. aureus N315
agauggcuuuuuuugcu

SEQ ID NO: 4048239 - RNA, 15 nt, Staphylococcus aureus subsp. aureus N315
agauguauaaaacua

SEQ ID NO: 4048240 - RNA, 17 nt, Staphylococcus aureus subsp. aureus N315
agauguauaaaacuaau

SEQ ID NO: 4048241 - RNA, 18 nt, Staphylococcus aureus subsp. aureus N315
agaugucgaaaaguauau

SEQ ID NO: 4048242 - RNA, 19 nt, Staphylococcus aureus subsp. aureus N315
agaugucgaaaaguauaug

SEQ ID NO: 4048243 - RNA, 21 nt, Staphylococcus aureus subsp. aureus N315
agaugucgaaaaguauaugaa

SEQ ID NO: 4048244 - RNA, 18 nt, Staphylococcus aureus subsp. aureus N315
agaugugaugcuugaaug

SEQ ID NO: 4048245 - RNA, 16 nt, Staphylococcus aureus subsp. aureus N315
agauguucacauucuu

SEQ ID NO: 4048246 - RNA, 16 nt, Staphylococcus aureus subsp. aureus N315
agauuaaaaaaucauu

SEQ ID NO: 4048247 - RNA, 17 nt, Staphylococcus aureus subsp. aureus N315
agauuaaaaaaucauuc

SEQ ID NO: 4048248 - RNA, 19 nt, Staphylococcus aureus subsp. aureus N315
agauuaaaauaugacacau

SEQ ID NO: 4048249 - RNA, 12 nt, Staphylococcus aureus subsp. aureus N315
agauuagagaag

SEQ ID NO: 4048250 - RNA, 13 nt, Staphylococcus aureus subsp. aureus N315
agauuagagaaga

SEQ ID NO: 4048251 - RNA, 13 nt, Staphylococcus aureus subsp. aureus N315
agauuauuaugug

SEQ ID NO: 4048252 - RNA, 22 nt, Staphylococcus aureus subsp. aureus N315
agauuauugguugaaauuaauu

SEQ ID NO: 4048253 - RNA, 17 nt, Staphylococcus aureus subsp. aureus N315
agauuauuuaaaacuug

SEQ ID NO: 4048254 - RNA, 23 nt, Staphylococcus aureus subsp. aureus N315
agauuauuuaaaacuuguaaauu

SEQ ID NO: 4048255 - RNA, 15 nt, Staphylococcus aureus subsp. aureus N315
agauucaaauugguu

SEQ ID NO: 4048256 - RNA, 12 nt, Staphylococcus aureus subsp. aureus N315
agauucaccuaa

SEQ ID NO: 4048257 - RNA, 20 nt, Staphylococcus aureus subsp. aureus N315
agauucggaaaauaugauaa

SEQ ID NO: 4048258 - RNA, 17 nt, Staphylococcus aureus subsp. aureus N315
agauucuguuugguguu

SEQ ID NO: 4048259 - RNA, 16 nt, Staphylococcus aureus subsp. aureus N315
agauugaaaaaauaac

SEQ ID NO: 4048260 - RNA, 16 nt, Staphylococcus aureus subsp. aureus N315
agauugauauaaauua

SEQ ID NO: 4048261 - RNA, 15 nt, Staphylococcus aureus subsp. aureus N315
agauuggaagggcau

SEQ ID NO: 4048262 - RNA, 22 nt, Staphylococcus aureus subsp. aureus N315
agauuuaccucuugauaaaaua

SEQ ID NO: 4048263 - RNA, 19 nt, Staphylococcus aureus subsp. aureus N315
agauuuaguuuuuuuaaag

SEQ ID NO: 4048264 - RNA, 15 nt, Staphylococcus aureus subsp. aureus N315
agauuuauaaauguu

SEQ ID NO: 4048265 - RNA, 19 nt, Staphylococcus aureus subsp. aureus N315
agauuuauuaaauauaugc

SEQ ID NO: 4048266 - RNA, 13 nt, Staphylococcus aureus subsp. aureus N315
agauuugaaauuu

SEQ ID NO: 4048267 - RNA, 15 nt, Staphylococcus aureus subsp. aureus N315
agauuugaaauuuau

SEQ ID NO: 4048268 - RNA, 17 nt, Staphylococcus aureus subsp. aureus N315
agauuuguagcuugaau

SEQ ID NO: 4048269 - RNA, 12 nt, Staphylococcus aureus subsp. aureus N315
agauuuuaaauc

SEQ ID NO: 4048270 - RNA, 14 nt, Staphylococcus aureus subsp. aureus N315
agauuuuaaaucaa

SEQ ID NO: 4048271 - RNA, 22 nt, Staphylococcus aureus subsp. aureus N315
agauuuuaauauugacauuuac

SEQ ID NO: 4048272 - RNA, 14 nt, Staphylococcus aureus subsp. aureus N315
agauuuuauauaaa

SEQ ID NO: 4048273 - RNA, 19 nt, Staphylococcus aureus subsp. aureus N315
agauuuuaugcuuuacuug

SEQ ID NO: 4048274 - RNA, 17 nt, Staphylococcus aureus subsp. aureus N315
agauuuuguauuagcau

SEQ ID NO: 4048275 - RNA, 21 nt, Staphylococcus aureus subsp. aureus N315
agcaaaaaauaaaucuccauu

SEQ ID NO: 4048276 - RNA, 15 nt, Staphylococcus aureus subsp. aureus N315
agcaaaaauauuuaa

SEQ ID NO: 4048277 - RNA, 17 nt, Staphylococcus aureus subsp. aureus N315
agcaaaaauauuuaaac

SEQ ID NO: 4048278 - RNA, 13 nt, Staphylococcus aureus subsp. aureus N315
agcaaaagaugaa

SEQ ID NO: 4048279 - RNA, 18 nt, Staphylococcus aureus subsp. aureus N315
agcaaaagaugaaaaucu

SEQ ID NO: 4048280 - RNA, 16 nt, Staphylococcus aureus subsp. aureus N315
agcaaaauuauguaaa

SEQ ID NO: 4048281 - RNA, 15 nt, Staphylococcus aureus subsp. aureus N315
agcaaacaauuuugu

SEQ ID NO: 4048282 - RNA, 22 nt, Staphylococcus aureus subsp. aureus N315
agcaaagucuccgugauaaauu

SEQ ID NO: 4048283 - RNA, 13 nt, Staphylococcus aureus subsp. aureus N315
agcaaauaaaauc

SEQ ID NO: 4048284 - RNA, 15 nt, Staphylococcus aureus subsp. aureus N315
agcaaauaaaaucau

SEQ ID NO: 4048285 - RNA, 17 nt, Staphylococcus aureus subsp. aureus N315
agcaaauacuucaagag

SEQ ID NO: 4048286 - RNA, 16 nt, Staphylococcus aureus subsp. aureus N315
agcaaauauuauuaaa

SEQ ID NO: 4048287 - RNA, 13 nt, Staphylococcus aureus subsp. aureus N315
agcaaauauuucu

SEQ ID NO: 4048288 - RNA, 18 nt, Staphylococcus aureus subsp. aureus N315
agcaaauuaguaugacuu

SEQ ID NO: 4048289 - RNA, 13 nt, Staphylococcus aureus subsp. aureus N315
agcaacaaaagau

SEQ ID NO: 4048290 - RNA, 14 nt, Staphylococcus aureus subsp. aureus N315
agcaacauuauuuu

SEQ ID NO: 4048291 - RNA, 15 nt, Staphylococcus aureus subsp. aureus N315
agcaacgaugucacu

SEQ ID NO: 4048292 - RNA, 15 nt, Staphylococcus aureus subsp. aureus N315
agcaaucauaauacu

SEQ ID NO: 4048293 - RNA, 20 nt, Staphylococcus aureus subsp. aureus N315
agcaauuaaagucaauuuaa

SEQ ID NO: 4048294 - RNA, 22 nt, Staphylococcus aureus subsp. aureus N315
agcaauuaaagucaauuuaaau

SEQ ID NO: 4048295 - RNA, 19 nt, Staphylococcus aureus subsp. aureus N315
agcaauucuucaauuucau

SEQ ID NO: 4048296 - RNA, 20 nt, Staphylococcus aureus subsp. aureus N315
agcaauucuugaaaaguuug

SEQ ID NO: 4048297 - RNA, 17 nt, Staphylococcus aureus subsp. aureus N315
agcaauugaaucaaaua

SEQ ID NO: 4048298 - RNA, 15 nt, Staphylococcus aureus subsp. aureus N315
agcaauuuucgauau

SEQ ID NO: 4048299 - RNA, 21 nt, Staphylococcus aureus subsp. aureus N315
agcacaauauuuaccacaaau

SEQ ID NO: 4048300 - RNA, 22 nt, Staphylococcus aureus subsp. aureus N315
agcacaauauuuaccacaaaua

SEQ ID NO: 4048301 - RNA, 23 nt, Staphylococcus aureus subsp. aureus N315
agcacaccuaauucauauauacu

SEQ ID NO: 4048302 - RNA, 13 nt, Staphylococcus aureus subsp. aureus N315
agcacauuuuuag

SEQ ID NO: 4048303 - RNA, 20 nt, Staphylococcus aureus subsp. aureus N315
agcacauuuuuaguuagaaa

SEQ ID NO: 4048304 - RNA, 21 nt, Staphylococcus aureus subsp. aureus N315
agcacauuuuuaguuagaaag

SEQ ID NO: 4048305 - RNA, 23 nt, Staphylococcus aureus subsp. aureus N315
agcaccgauuuggucagcgacau

SEQ ID NO: 4048306 - RNA, 14 nt, Staphylococcus aureus subsp. aureus N315
agcacgagaaaugu

SEQ ID NO: 4048307 - RNA, 16 nt, Staphylococcus aureus subsp. aureus N315
agcacgagaaauguca

SEQ ID NO: 4048308 - RNA, 16 nt, Staphylococcus aureus subsp. aureus N315
agcacgagacaauaau

SEQ ID NO: 4048309 - RNA, 18 nt, Staphylococcus aureus subsp. aureus N315
agcacuagccguuauuuu

SEQ ID NO: 4048310 - RNA, 20 nt, Staphylococcus aureus subsp. aureus N315
agcacuauaacaagguguuc

SEQ ID NO: 4048311 - RNA, 17 nt, Staphylococcus aureus subsp. aureus N315
agcacugaaaucuagac

SEQ ID NO: 4048312 - RNA, 19 nt, Staphylococcus aureus subsp. aureus N315
agcagcaguugacuguaaa

SEQ ID NO: 4048313 - RNA, 20 nt, Staphylococcus aureus subsp. aureus N315
agcaguaagacgauuucaau

SEQ ID NO: 4048314 - RNA, 20 nt, Staphylococcus aureus subsp. aureus N315
agcaguaagauaauuuucaa

SEQ ID NO: 4048315 - RNA, 20 nt, Staphylococcus aureus subsp. aureus N315
agcaguaaguugauuucuac

SEQ ID NO: 4048316 - RNA, 18 nt, Staphylococcus aureus subsp. aureus N315
agcaguauauaucaaaua

SEQ ID NO: 4048317 - RNA, 24 nt, Staphylococcus aureus subsp. aureus N315
agcaguauauaucaaauacauuuc

SEQ ID NO: 4048318 - RNA, 17 nt, Staphylococcus aureus subsp. aureus N315
agcauaccuacagaaug

SEQ ID NO: 4048319 - RNA, 19 nt, Staphylococcus aureus subsp. aureus N315
agcauaucuuuaucauuau

SEQ ID NO: 4048320 - RNA, 20 nt, Staphylococcus aureus subsp. aureus N315
agcauaugguaaaucgucau

SEQ ID NO: 4048321 - RNA, 15 nt, Staphylococcus aureus subsp. aureus N315
agcaucaaaaauaaa

SEQ ID NO: 4048322 - RNA, 13 nt, Staphylococcus aureus subsp. aureus N315
agcaucaucaauu

SEQ ID NO: 4048323 - RNA, 14 nt, Staphylococcus aureus subsp. aureus N315
agcaucguaaaaaa

SEQ ID NO: 4048324 - RNA, 21 nt, Staphylococcus aureus subsp. aureus N315
agcaucguaaaaaacaaaaaa

SEQ ID NO: 4048325 - RNA, 21 nt, Staphylococcus aureus subsp. aureus N315
agcaucuugucuaguucgauu

SEQ ID NO: 4048326 - RNA, 17 nt, Staphylococcus aureus subsp. aureus N315
agcaucuuuuacugcuu

SEQ ID NO: 4048327 - RNA, 15 nt, Staphylococcus aureus subsp. aureus N315
agcaugaaucgcauu

SEQ ID NO: 4048328 - RNA, 20 nt, Staphylococcus aureus subsp. aureus N315
agcaugaaucgcauuuaaau

SEQ ID NO: 4048329 - RNA, 16 nt, Staphylococcus aureus subsp. aureus N315
agcaugacuguaagua

SEQ ID NO: 4048330 - RNA, 21 nt, Staphylococcus aureus subsp. aureus N315
agcaugauaaaguauguuguc

SEQ ID NO: 4048331 - RNA, 17 nt, Staphylococcus aureus subsp. aureus N315
agcauuaaauuccaugu

SEQ ID NO: 4048332 - RNA, 20 nt, Staphylococcus aureus subsp. aureus N315
agcauuacgccaccaguuuc

SEQ ID NO: 4048333 - RNA, 14 nt, Staphylococcus aureus subsp. aureus N315
agcauuaucaucac

SEQ ID NO: 4048334 - RNA, 11 nt, Staphylococcus aureus subsp. aureus N315
agcauuauuau

SEQ ID NO: 4048335 - RNA, 14 nt, Staphylococcus aureus subsp. aureus N315
agcauuuucaaugu

SEQ ID NO: 4048336 - RNA, 14 nt, Staphylococcus aureus subsp. aureus N315
agccaauaaaaugu

SEQ ID NO: 4048337 - RNA, 14 nt, Staphylococcus aureus subsp. aureus N315
agccacagcgaccu

SEQ ID NO: 4048338 - RNA, 18 nt, Staphylococcus aureus subsp. aureus N315
agccauaccuuauuucag

SEQ ID NO: 4048339 - RNA, 19 nt, Staphylococcus aureus subsp. aureus N315
agccauaccuuauuucagc

SEQ ID NO: 4048340 - RNA, 13 nt, Staphylococcus aureus subsp. aureus N315
agccauuaaacca

SEQ ID NO: 4048341 - RNA, 21 nt, Staphylococcus aureus subsp. aureus N315
agccuagaacauugauuauug

SEQ ID NO: 4048342 - RNA, 15 nt, Staphylococcus aureus subsp. aureus N315
agccuaggaguaucu

SEQ ID NO: 4048343 - RNA, 13 nt, Staphylococcus aureus subsp. aureus N315
agccuauccauuc

SEQ ID NO: 4048344 - RNA, 15 nt, Staphylococcus aureus subsp. aureus N315
agccuauccauucaa

SEQ ID NO: 4048345 - RNA, 22 nt, Staphylococcus aureus subsp. aureus N315
agccuauuuaaaagacaaucuc

SEQ ID NO: 4048346 - RNA, 17 nt, Staphylococcus aureus subsp. aureus N315
agccucuugccuugaaa

SEQ ID NO: 4048347 - RNA, 19 nt, Staphylococcus aureus subsp. aureus N315
agccucuugccuugaaauc

SEQ ID NO: 4048348 - RNA, 17 nt, Staphylococcus aureus subsp. aureus N315
agccuuaauaucaugca

SEQ ID NO: 4048349 - RNA, 13 nt, Staphylococcus aureus subsp. aureus N315
agccuucaaaaug

SEQ ID NO: 4048350 - RNA, 13 nt, Staphylococcus aureus subsp. aureus N315
agccuucuaucuu

SEQ ID NO: 4048351 - RNA, 22 nt, Staphylococcus aureus subsp. aureus N315
agcgaaaguaucuaugaaauuu

SEQ ID NO: 4048352 - RNA, 18 nt, Staphylococcus aureus subsp. aureus N315
agcgaccgugguucaaaa

SEQ ID NO: 4048353 - RNA, 20 nt, Staphylococcus aureus subsp. aureus N315
agcgaucuuuuuuauuuaau

SEQ ID NO: 4048354 - RNA, 17 nt, Staphylococcus aureus subsp. aureus N315
agcgaugaaaguugcuu

SEQ ID NO: 4048355 - RNA, 22 nt, Staphylococcus aureus subsp. aureus N315
agcgauuuuaaagaaaaguuua

SEQ ID NO: 4048356 - RNA, 17 nt, Staphylococcus aureus subsp. aureus N315
agcgcaccaauuaucaa

SEQ ID NO: 4048357 - RNA, 17 nt, Staphylococcus aureus subsp. aureus N315
agcgcaggcgaaccgaa

SEQ ID NO: 4048358 - RNA, 17 nt, Staphylococcus aureus subsp. aureus N315
agcgcagugaccucagg

SEQ ID NO: 4048359 - RNA, 20 nt, Staphylococcus aureus subsp. aureus N315
agcgcauaaauuuucuguuu

SEQ ID NO: 4048360 - RNA, 21 nt, Staphylococcus aureus subsp. aureus N315
agcgccuaugugaugguaaau

SEQ ID NO: 4048361 - RNA, 22 nt, Staphylococcus aureus subsp. aureus N315
agcgcuguugugaguucauaau

SEQ ID NO: 4048362 - RNA, 20 nt, Staphylococcus aureus subsp. aureus N315
agcggaaauaugauugaaug

SEQ ID NO: 4048363 - RNA, 14 nt, Staphylococcus aureus subsp. aureus N315
agcguaauggauua

SEQ ID NO: 4048364 - RNA, 15 nt, Staphylococcus aureus subsp. aureus N315
agcguacgauauagu

SEQ ID NO: 4048365 - RNA, 22 nt, Staphylococcus aureus subsp. aureus N315
agcguauauugaaauuaaauuu

SEQ ID NO: 4048366 - RNA, 19 nt, Staphylococcus aureus subsp. aureus N315
agcguucucuaauuucaca

SEQ ID NO: 4048367 - RNA, 21 nt, Staphylococcus aureus subsp. aureus N315
agcguuucuugaucuaaugua

SEQ ID NO: 4048368 - RNA, 13 nt, Staphylococcus aureus subsp. aureus N315
agcuaaaaguuuc

SEQ ID NO: 4048369 - RNA, 18 nt, Staphylococcus aureus subsp. aureus N315
agcuaaaugcucaagcca

SEQ ID NO: 4048370 - RNA, 13 nt, Staphylococcus aureus subsp. aureus N315
agcuaaccaaaua

SEQ ID NO: 4048371 - RNA, 18 nt, Staphylococcus aureus subsp. aureus N315
agcuaacucuuuguauaa

SEQ ID NO: 4048372 - RNA, 13 nt, Staphylococcus aureus subsp. aureus N315
agcuaaguuaaau

SEQ ID NO: 4048373 - RNA, 16 nt, Staphylococcus aureus subsp. aureus N315
agcuaauaucaauaau

SEQ ID NO: 4048374 - RNA, 18 nt, Staphylococcus aureus subsp. aureus N315
agcuaaugcaacuaaaac

SEQ ID NO: 4048375 - RNA, 12 nt, Staphylococcus aureus subsp. aureus N315
agcuaaugcauu

SEQ ID NO: 4048376 - RNA, 17 nt, Staphylococcus aureus subsp. aureus N315
agcuaaugucaugaaaa

SEQ ID NO: 4048377 - RNA, 22 nt, Staphylococcus aureus subsp. aureus N315
agcuaauguguacuuaaaaaua

SEQ ID NO: 4048378 - RNA, 19 nt, Staphylococcus aureus subsp. aureus N315
agcuaauucauauucaaau

SEQ ID NO: 4048379 - RNA, 21 nt, Staphylococcus aureus subsp. aureus N315
agcuaauuucuaauacauacu

SEQ ID NO: 4048380 - RNA, 16 nt, Staphylococcus aureus subsp. aureus N315
agcuacaaauaaugag

SEQ ID NO: 4048381 - RNA, 18 nt, Staphylococcus aureus subsp. aureus N315
agcuacccuauuuuacaa

SEQ ID NO: 4048382 - RNA, 15 nt, Staphylococcus aureus subsp. aureus N315
agcuagaaacaaugc

SEQ ID NO: 4048383 - RNA, 14 nt, Staphylococcus aureus subsp. aureus N315
agcuaguugaaccg

SEQ ID NO: 4048384 - RNA, 12 nt, Staphylococcus aureus subsp. aureus N315
agcuauaaaagu

SEQ ID NO: 4048385 - RNA, 18 nt, Staphylococcus aureus subsp. aureus N315
agcuauaaaaguacuuua

SEQ ID NO: 4048386 - RNA, 13 nt, Staphylococcus aureus subsp. aureus N315
agcuauagaaaug

SEQ ID NO: 4048387 - RNA, 15 nt, Staphylococcus aureus subsp. aureus N315
agcuaucguaaacaa

SEQ ID NO: 4048388 - RNA, 22 nt, Staphylococcus aureus subsp. aureus N315
agcuauucauagaccuaugaau

SEQ ID NO: 4048389 - RNA, 16 nt, Staphylococcus aureus subsp. aureus N315
agcucaugaaucagau

SEQ ID NO: 4048390 - RNA, 19 nt, Staphylococcus aureus subsp. aureus N315
agcucaugaaucagaugau

SEQ ID NO: 4048391 - RNA, 22 nt, Staphylococcus aureus subsp. aureus N315
agcucugaaggagacauuuccc

SEQ ID NO: 4048392 - RNA, 19 nt, Staphylococcus aureus subsp. aureus N315
agcucuuaaaucacuagcu

SEQ ID NO: 4048393 - RNA, 15 nt, Staphylococcus aureus subsp. aureus N315
agcucuucaaauuua

SEQ ID NO: 4048394 - RNA, 16 nt, Staphylococcus aureus subsp. aureus N315
agcucuuuuuugauuu

SEQ ID NO: 4048395 - RNA, 15 nt, Staphylococcus aureus subsp. aureus N315
agcugauuaaaaugu

SEQ ID NO: 4048396 - RNA, 19 nt, Staphylococcus aureus subsp. aureus N315
agcugauuucuaucaaaua

SEQ ID NO: 4048397 - RNA, 13 nt, Staphylococcus aureus subsp. aureus N315
agcugauuuuuca

SEQ ID NO: 4048398 - RNA, 14 nt, Staphylococcus aureus subsp. aureus N315
agcugcgauauaac

SEQ ID NO: 4048399 - RNA, 22 nt, Staphylococcus aureus subsp. aureus N315
agcugugcugucauuuucugcu

SEQ ID NO: 4048400 - RNA, 21 nt, Staphylococcus aureus subsp. aureus N315
agcuguuggugaguguuucau

SEQ ID NO: 4048401 - RNA, 21 nt, Staphylococcus aureus subsp. aureus N315
agcuuaaauagugcuuuuuca

SEQ ID NO: 4048402 - RNA, 18 nt, Staphylococcus aureus subsp. aureus N315
agcuuacaauagugugca

SEQ ID NO: 4048403 - RNA, 21 nt, Staphylococcus aureus subsp. aureus N315
agcuuagucaauguauauuua

SEQ ID NO: 4048404 - RNA, 20 nt, Staphylococcus aureus subsp. aureus N315
agcuuaucaacgauuuuguc

SEQ ID NO: 4048405 - RNA, 14 nt, Staphylococcus aureus subsp. aureus N315
agcuucaguuaaau

SEQ ID NO: 4048406 - RNA, 13 nt, Staphylococcus aureus subsp. aureus N315
agcuucauauuua

SEQ ID NO: 4048407 - RNA, 22 nt, Staphylococcus aureus subsp. aureus N315
agcuucugcaugggcuucugcu

SEQ ID NO: 4048408 - RNA, 20 nt, Staphylococcus aureus subsp. aureus N315
agcuucuguguuggggccca

SEQ ID NO: 4048409 - RNA, 16 nt, Staphylococcus aureus subsp. aureus N315
agcuucuuuaacaauu

SEQ ID NO: 4048410 - RNA, 16 nt, Staphylococcus aureus subsp. aureus N315
agcuugaauaauauau

SEQ ID NO: 4048411 - RNA, 19 nt, Staphylococcus aureus subsp. aureus N315
agcuugaauaauauauuua

SEQ ID NO: 4048412 - RNA, 19 nt, Staphylococcus aureus subsp. aureus N315
agcuugaucuaaaugaucu

SEQ ID NO: 4048413 - RNA, 15 nt, Staphylococcus aureus subsp. aureus N315
agcuugauuuaacaa

SEQ ID NO: 4048414 - RNA, 16 nt, Staphylococcus aureus subsp. aureus N315
agcuugcuuacaauaa

SEQ ID NO: 4048415 - RNA, 18 nt, Staphylococcus aureus subsp. aureus N315
agcuugcuuacaauaauc

SEQ ID NO: 4048416 - RNA, 20 nt, Staphylococcus aureus subsp. aureus N315
agcuugggacagaaaacaaa

SEQ ID NO: 4048417 - RNA, 17 nt, Staphylococcus aureus subsp. aureus N315
agcuuguaaaucacgau

SEQ ID NO: 4048418 - RNA, 15 nt, Staphylococcus aureus subsp. aureus N315
agcuuguuucagguu

SEQ ID NO: 4048419 - RNA, 22 nt, Staphylococcus aureus subsp. aureus N315
agcuuguuuguuacauauugca

SEQ ID NO: 4048420 - RNA, 14 nt, Staphylococcus aureus subsp. aureus N315
agcuuuaguuacua

SEQ ID NO: 4048421 - RNA, 20 nt, Staphylococcus aureus subsp. aureus N315
agcuuucuuuuucaucuuuc

SEQ ID NO: 4048422 - RNA, 17 nt, Staphylococcus aureus subsp. aureus N315
agcuuuuacgccuucuu

SEQ ID NO: 4048423 - RNA, 15 nt, Staphylococcus aureus subsp. aureus N315
agcuuuucauuuuua

SEQ ID NO: 4048424 - RNA, 14 nt, Staphylococcus aureus subsp. aureus N315
agcuuuucuaaugc

SEQ ID NO: 4048425 - RNA, 11 nt, Staphylococcus aureus subsp. aureus N315
agcuuuuucuu

SEQ ID NO: 4048426 - RNA, 17 nt, Staphylococcus aureus subsp. aureus N315
agcuuuuucuuucucua

SEQ ID NO: 4048427 - RNA, 22 nt, Staphylococcus aureus subsp. aureus N315
agcuuuuucuuucucuaacauu

SEQ ID NO: 4048428 - RNA, 16 nt, Staphylococcus aureus subsp. aureus N315
aggaaaucauauauuu

SEQ ID NO: 4048429 - RNA, 18 nt, Staphylococcus aureus subsp. aureus N315
aggaaaucauauauuucu

SEQ ID NO: 4048430 - RNA, 23 nt, Staphylococcus aureus subsp. aureus N315
aggaacagcggaauacagaugau

SEQ ID NO: 4048431 - RNA, 21 nt, Staphylococcus aureus subsp. aureus N315
aggaacguguucuaaaaguug

SEQ ID NO: 4048432 - RNA, 18 nt, Staphylococcus aureus subsp. aureus N315
aggaauaauuuuaaaaau

SEQ ID NO: 4048433 - RNA, 21 nt, Staphylococcus aureus subsp. aureus N315
aggaauaauuuuaaaaauaaa

SEQ ID NO: 4048434 - RNA, 19 nt, Staphylococcus aureus subsp. aureus N315
aggaauacaugaguaaaac

SEQ ID NO: 4048435 - RNA, 17 nt, Staphylococcus aureus subsp. aureus N315
aggaauaccacuuaauc

SEQ ID NO: 4048436 - RNA, 22 nt, Staphylococcus aureus subsp. aureus N315
aggaaugauauaccuugauuca

SEQ ID NO: 4048437 - RNA, 13 nt, Staphylococcus aureus subsp. aureus N315
aggaccaaauaga

SEQ ID NO: 4048438 - RNA, 19 nt, Staphylococcus aureus subsp. aureus N315
aggaccacucaauucucua

SEQ ID NO: 4048439 - RNA, 21 nt, Staphylococcus aureus subsp. aureus N315
aggagacauuucccauuuauc

SEQ ID NO: 4048440 - RNA, 12 nt, Staphylococcus aureus subsp. aureus N315
aggauaagaacg

SEQ ID NO: 4048441 - RNA, 18 nt, Staphylococcus aureus subsp. aureus N315
aggauacauaaaucuaau

SEQ ID NO: 4048442 - RNA, 15 nt, Staphylococcus aureus subsp. aureus N315
aggauaucuacgccu

SEQ ID NO: 4048443 - RNA, 21 nt, Staphylococcus aureus subsp. aureus N315
aggauaugcuguguaucauca

SEQ ID NO: 4048444 - RNA, 22 nt, Staphylococcus aureus subsp. aureus N315
aggauaugcuguguaucaucau

SEQ ID NO: 4048445 - RNA, 15 nt, Staphylococcus aureus subsp. aureus N315
aggaucaacugaaau

SEQ ID NO: 4048446 - RNA, 18 nt, Staphylococcus aureus subsp. aureus N315
aggaucaacugaaauuuu

SEQ ID NO: 4048447 - RNA, 22 nt, Staphylococcus aureus subsp. aureus N315
aggaucacguuuuucuuuaaac

SEQ ID NO: 4048448 - RNA, 19 nt, Staphylococcus aureus subsp. aureus N315
aggaucuucuuguuuuaaa

SEQ ID NO: 4048449 - RNA, 17 nt, Staphylococcus aureus subsp. aureus N315
aggaugaguuuaaaaau

SEQ ID NO: 4048450 - RNA, 18 nt, Staphylococcus aureus subsp. aureus N315
aggaugaguuuaaaaaua

SEQ ID NO: 4048451 - RNA, 16 nt, Staphylococcus aureus subsp. aureus N315
aggaugauuuauuaac

SEQ ID NO: 4048452 - RNA, 19 nt, Staphylococcus aureus subsp. aureus N315
aggauggaaugauacgccu

SEQ ID NO: 4048453 - RNA, 18 nt, Staphylococcus aureus subsp. aureus N315
aggauguuauaaaaugaa

SEQ ID NO: 4048454 - RNA, 20 nt, Staphylococcus aureus subsp. aureus N315
aggauguucaucaacaugau

SEQ ID NO: 4048455 - RNA, 20 nt, Staphylococcus aureus subsp. aureus N315
aggauuauagguauaagaau

SEQ ID NO: 4048456 - RNA, 14 nt, Staphylococcus aureus subsp. aureus N315
aggauuauuaucaa

SEQ ID NO: 4048457 - RNA, 19 nt, Staphylococcus aureus subsp. aureus N315
aggauuuacaccuauaccu

SEQ ID NO: 4048458 - RNA, 19 nt, Staphylococcus aureus subsp. aureus N315
aggauuugcaccuauaccu

SEQ ID NO: 4048459 - RNA, 12 nt, Staphylococcus aureus subsp. aureus N315
aggauuuuagau

SEQ ID NO: 4048460 - RNA, 17 nt, Staphylococcus aureus subsp. aureus N315
aggauuuuagauuuagu

SEQ ID NO: 4048461 - RNA, 23 nt, Staphylococcus aureus subsp. aureus N315
aggcaaauaggcacgugcuuugg

SEQ ID NO: 4048462 - RNA, 13 nt, Staphylococcus aureus subsp. aureus N315
aggcaacaaauau

SEQ ID NO: 4048463 - RNA, 12 nt, Staphylococcus aureus subsp. aureus N315
aggcaacaacuu

SEQ ID NO: 4048464 - RNA, 22 nt, Staphylococcus aureus subsp. aureus N315
aggcaacaacuuuucauauaaa

SEQ ID NO: 4048465 - RNA, 19 nt, Staphylococcus aureus subsp. aureus N315
aggcaacuuuuauuacuua

SEQ ID NO: 4048466 - RNA, 14 nt, Staphylococcus aureus subsp. aureus N315
aggcaauauuaaaa

SEQ ID NO: 4048467 - RNA, 12 nt, Staphylococcus aureus subsp. aureus N315
aggcaaugcaag

SEQ ID NO: 4048468 - RNA, 17 nt, Staphylococcus aureus subsp. aureus N315
aggcaaugcaaguuggc

SEQ ID NO: 4048469 - RNA, 23 nt, Staphylococcus aureus subsp. aureus N315
aggcacagcggaauacagaugau

SEQ ID NO: 4048470 - RNA, 21 nt, Staphylococcus aureus subsp. aureus N315
aggcacaguggauuacagaug

SEQ ID NO: 4048471 - RNA, 16 nt, Staphylococcus aureus subsp. aureus N315
aggcccauaaauuacu

SEQ ID NO: 4048472 - RNA, 18 nt, Staphylococcus aureus subsp. aureus N315
aggcccauaaauuacuug

SEQ ID NO: 4048473 - RNA, 23 nt, Staphylococcus aureus subsp. aureus N315
aggcccgaccaacuugcacauua

SEQ ID NO: 4048474 - RNA, 13 nt, Staphylococcus aureus subsp. aureus N315
aggcgccauaauc

SEQ ID NO: 4048475 - RNA, 22 nt, Staphylococcus aureus subsp. aureus N315
aggcgcuacaauguuauauugg

SEQ ID NO: 4048476 - RNA, 23 nt, Staphylococcus aureus subsp. aureus N315
aggcgcuccuacuuuucaacuuu

SEQ ID NO: 4048477 - RNA, 14 nt, Staphylococcus aureus subsp. aureus N315
aggcgucuuaaauu

SEQ ID NO: 4048478 - RNA, 23 nt, Staphylococcus aureus subsp. aureus N315
aggcugaguauaccaauugcuga

SEQ ID NO: 4048479 - RNA, 14 nt, Staphylococcus aureus subsp. aureus N315
aggcugggacauaa

SEQ ID NO: 4048480 - RNA, 22 nt, Staphylococcus aureus subsp. aureus N315
aggcuguucuggaauugggaaa

SEQ ID NO: 4048481 - RNA, 13 nt, Staphylococcus aureus subsp. aureus N315
aggcuuuaaaauu

SEQ ID NO: 4048482 - RNA, 17 nt, Staphylococcus aureus subsp. aureus N315
agggaguaccaagaaau

SEQ ID NO: 4048483 - RNA, 16 nt, Staphylococcus aureus subsp. aureus N315
agggagugaggugaga

SEQ ID NO: 4048484 - RNA, 14 nt, Staphylococcus aureus subsp. aureus N315
agggcaaaaaagga

SEQ ID NO: 4048485 - RNA, 15 nt, Staphylococcus aureus subsp. aureus N315
agggcaaaaaaggau

SEQ ID NO: 4048486 - RNA, 14 nt, Staphylococcus aureus subsp. aureus N315
agggcauugauuca

SEQ ID NO: 4048487 - RNA, 18 nt, Staphylococcus aureus subsp. aureus N315
agggccccaacacagaag

SEQ ID NO: 4048488 - RNA, 23 nt, Staphylococcus aureus subsp. aureus N315
aggggacuuaaccauuuaaaaau

SEQ ID NO: 4048489 - RNA, 12 nt, Staphylococcus aureus subsp. aureus N315
aggggccccaac

SEQ ID NO: 4048490 - RNA, 17 nt, Staphylococcus aureus subsp. aureus N315
aggggccccaacacaga

SEQ ID NO: 4048491 - RNA, 20 nt, Staphylococcus aureus subsp. aureus N315
aggggcuucuuucuaaaaua

SEQ ID NO: 4048492 - RNA, 14 nt, Staphylococcus aureus subsp. aureus N315
aggggcuuuuaugc

SEQ ID NO: 4048493 - RNA, 13 nt, Staphylococcus aureus subsp. aureus N315
agggguaaaacuu

SEQ ID NO: 4048494 - RNA, 15 nt, Staphylococcus aureus subsp. aureus N315
agggugaauuaguaa

SEQ ID NO: 4048495 - RNA, 13 nt, Staphylococcus aureus subsp. aureus N315
agguaaaucuguu

SEQ ID NO: 4048496 - RNA, 13 nt, Staphylococcus aureus subsp. aureus N315
agguaaauuuaaa

SEQ ID NO: 4048497 - RNA, 18 nt, Staphylococcus aureus subsp. aureus N315
agguaaauuuaaaauaau

SEQ ID NO: 4048498 - RNA, 19 nt, Staphylococcus aureus subsp. aureus N315
agguaaauuuaaaauaaua

SEQ ID NO: 4048499 - RNA, 13 nt, Staphylococcus aureus subsp. aureus N315
agguaacugcuuu

SEQ ID NO: 4048500 - RNA, 23 nt, Staphylococcus aureus subsp. aureus N315
agguaacugcuuuggaguuucuu

SEQ ID NO: 4048501 - RNA, 17 nt, Staphylococcus aureus subsp. aureus N315
agguaaugcaaguuggc

SEQ ID NO: 4048502 - RNA, 11 nt, Staphylococcus aureus subsp. aureus N315
agguauucaaa

SEQ ID NO: 4048503 - RNA, 19 nt, Staphylococcus aureus subsp. aureus N315
agguauuucauugauaagu

SEQ ID NO: 4048504 - RNA, 14 nt, Staphylococcus aureus subsp. aureus N315
aggugacuuuccua

SEQ ID NO: 4048505 - RNA, 19 nt, Staphylococcus aureus subsp. aureus N315
agguguggaguaaagauca

SEQ ID NO: 4048506 - RNA, 14 nt, Staphylococcus aureus subsp. aureus N315
agguuauauuuaaa

SEQ ID NO: 4048507 - RNA, 19 nt, Staphylococcus aureus subsp. aureus N315
agguuauuauaaaauaaau

SEQ ID NO: 4048508 - RNA, 16 nt, Staphylococcus aureus subsp. aureus N315
agguucaguagaauug

SEQ ID NO: 4048509 - RNA, 16 nt, Staphylococcus aureus subsp. aureus N315
agguucaucuuuaugc

SEQ ID NO: 4048510 - RNA, 18 nt, Staphylococcus aureus subsp. aureus N315
agguucaucuuuaugcaa

SEQ ID NO: 4048511 - RNA, 15 nt, Staphylococcus aureus subsp. aureus N315
agguucuucaucuuu

SEQ ID NO: 4048512 - RNA, 19 nt, Staphylococcus aureus subsp. aureus N315
agguuguucuauacauucc

SEQ ID NO: 4048513 - RNA, 21 nt, Staphylococcus aureus subsp. aureus N315
agguuuaaacaucuauaacaa

SEQ ID NO: 4048514 - RNA, 14 nt, Staphylococcus aureus subsp. aureus N315
agguuuauaaaaaa

SEQ ID NO: 4048515 - RNA, 15 nt, Staphylococcus aureus subsp. aureus N315
agguuuauaaaaaau

SEQ ID NO: 4048516 - RNA, 20 nt, Staphylococcus aureus subsp. aureus N315
agguuuauaaaaaaucaguu

SEQ ID NO: 4048517 - RNA, 13 nt, Staphylococcus aureus subsp. aureus N315
agguuuauauauc

SEQ ID NO: 4048518 - RNA, 16 nt, Staphylococcus aureus subsp. aureus N315
agguuucacaaauucu

SEQ ID NO: 4048519 - RNA, 18 nt, Staphylococcus aureus subsp. aureus N315
agguuuguaagacaacaa

SEQ ID NO: 4048520 - RNA, 16 nt, Staphylococcus aureus subsp. aureus N315
agguuuucgccaauaa

SEQ ID NO: 4048521 - RNA, 14 nt, Staphylococcus aureus subsp. aureus N315
aguaaaaacgaaau

SEQ ID NO: 4048522 - RNA, 14 nt, Staphylococcus aureus subsp. aureus N315
aguaaaaauacauu

SEQ ID NO: 4048523 - RNA, 20 nt, Staphylococcus aureus subsp. aureus N315
aguaaaaccuguaucuuaaa

SEQ ID NO: 4048524 - RNA, 14 nt, Staphylococcus aureus subsp. aureus N315
aguaaaacugcaau

SEQ ID NO: 4048525 - RNA, 16 nt, Staphylococcus aureus subsp. aureus N315
aguaaacuaauccuca

SEQ ID NO: 4048526 - RNA, 14 nt, Staphylococcus aureus subsp. aureus N315
aguaaauguuuuau

SEQ ID NO: 4048527 - RNA, 22 nt, Staphylococcus aureus subsp. aureus N315
aguaaauguuuuauguauuuau

SEQ ID NO: 4048528 - RNA, 22 nt, Staphylococcus aureus subsp. aureus N315
aguaaauuaauagagaaagaau

SEQ ID NO: 4048529 - RNA, 15 nt, Staphylococcus aureus subsp. aureus N315
aguaacauacuauaa

SEQ ID NO: 4048530 - RNA, 19 nt, Staphylococcus aureus subsp. aureus N315
aguaacauacuauaaaaau

SEQ ID NO: 4048531 - RNA, 20 nt, Staphylococcus aureus subsp. aureus N315
aguaagacgauuucaaugag

SEQ ID NO: 4048532 - RNA, 17 nt, Staphylococcus aureus subsp. aureus N315
aguaagauauuuccaaa

SEQ ID NO: 4048533 - RNA, 18 nt, Staphylococcus aureus subsp. aureus N315
aguaagauauuuccaaau

SEQ ID NO: 4048534 - RNA, 17 nt, Staphylococcus aureus subsp. aureus N315
aguaagauuauuuucaa

SEQ ID NO: 4048535 - RNA, 19 nt, Staphylococcus aureus subsp. aureus N315
aguaagauuauuuucaauu

SEQ ID NO: 4048536 - RNA, 15 nt, Staphylococcus aureus subsp. aureus N315
aguaaguaaaauaaa

SEQ ID NO: 4048537 - RNA, 14 nt, Staphylococcus aureus subsp. aureus N315
aguaaguaauaaaa

SEQ ID NO: 4048538 - RNA, 17 nt, Staphylococcus aureus subsp. aureus N315
aguaaguaauaaaauaa

SEQ ID NO: 4048539 - RNA, 21 nt, Staphylococcus aureus subsp. aureus N315
aguaauaaaagucgauaaaua

SEQ ID NO: 4048540 - RNA, 15 nt, Staphylococcus aureus subsp. aureus N315
aguaauaacaucuaa

SEQ ID NO: 4048541 - RNA, 22 nt, Staphylococcus aureus subsp. aureus N315
aguaauauguugcuuaucaaca

SEQ ID NO: 4048542 - RNA, 16 nt, Staphylococcus aureus subsp. aureus N315
aguaaucaagcaaugc

SEQ ID NO: 4048543 - RNA, 19 nt, Staphylococcus aureus subsp. aureus N315
aguaaucagcuuuuucaca

SEQ ID NO: 4048544 - RNA, 17 nt, Staphylococcus aureus subsp. aureus N315
aguaaucaguuacucua

SEQ ID NO: 4048545 - RNA, 19 nt, Staphylococcus aureus subsp. aureus N315
aguaauccccgaagcacag

SEQ ID NO: 4048546 - RNA, 20 nt, Staphylococcus aureus subsp. aureus N315
aguaaucuuguuuucauuua

SEQ ID NO: 4048547 - RNA, 18 nt, Staphylococcus aureus subsp. aureus N315
aguaaugaccaauagcaa

SEQ ID NO: 4048548 - RNA, 21 nt, Staphylococcus aureus subsp. aureus N315
aguaaugcuguacuauauuca

SEQ ID NO: 4048549 - RNA, 15 nt, Staphylococcus aureus subsp. aureus N315
aguaauucuuaaaaa

SEQ ID NO: 4048550 - RNA, 12 nt, Staphylococcus aureus subsp. aureus N315
aguacaaauaau

SEQ ID NO: 4048551 - RNA, 22 nt, Staphylococcus aureus subsp. aureus N315
aguacaacaguugcaccuaaac

SEQ ID NO: 4048552 - RNA, 21 nt, Staphylococcus aureus subsp. aureus N315
aguacaauaauaccuucaauu

SEQ ID NO: 4048553 - RNA, 17 nt, Staphylococcus aureus subsp. aureus N315
aguacaguuaguggcau

SEQ ID NO: 4048554 - RNA, 16 nt, Staphylococcus aureus subsp. aureus N315
aguaccaagaaauacu

SEQ ID NO: 4048555 - RNA, 19 nt, Staphylococcus aureus subsp. aureus N315
aguaccauguuuuuuaagu

SEQ ID NO: 4048556 - RNA, 13 nt, Staphylococcus aureus subsp. aureus N315
aguaccuaaaaua

SEQ ID NO: 4048557 - RNA, 15 nt, Staphylococcus aureus subsp. aureus N315
aguacgaacaacuaa

SEQ ID NO: 4048558 - RNA, 23 nt, Staphylococcus aureus subsp. aureus N315
aguacgcaauuuaauauuauaag

SEQ ID NO: 4048559 - RNA, 18 nt, Staphylococcus aureus subsp. aureus N315
aguacggcugcuuuaacu

SEQ ID NO: 4048560 - RNA, 16 nt, Staphylococcus aureus subsp. aureus N315
aguacuaaaaguauga

SEQ ID NO: 4048561 - RNA, 22 nt, Staphylococcus aureus subsp. aureus N315
aguacucaauguuaggugcuug

SEQ ID NO: 4048562 - RNA, 23 nt, Staphylococcus aureus subsp. aureus N315
aguacuuuaaaauuguauagaau

SEQ ID NO: 4048563 - RNA, 17 nt, Staphylococcus aureus subsp. aureus N315
aguagaaccuauauuaa

SEQ ID NO: 4048564 - RNA, 18 nt, Staphylococcus aureus subsp. aureus N315
aguagaauuauuuagaaa

SEQ ID NO: 4048565 - RNA, 16 nt, Staphylococcus aureus subsp. aureus N315
aguagacauugaaagg

SEQ ID NO: 4048566 - RNA, 21 nt, Staphylococcus aureus subsp. aureus N315
aguagacgguaucaucugcau

SEQ ID NO: 4048567 - RNA, 19 nt, Staphylococcus aureus subsp. aureus N315
aguagauugauauccuuaa

SEQ ID NO: 4048568 - RNA, 17 nt, Staphylococcus aureus subsp. aureus N315
aguagcucaaaacaauu

SEQ ID NO: 4048569 - RNA, 22 nt, Staphylococcus aureus subsp. aureus N315
aguagcucaaaacaauuuaaaa

SEQ ID NO: 4048570 - RNA, 24 nt, Staphylococcus aureus subsp. aureus N315
aguagcuuguuuagaagcuucugc

SEQ ID NO: 4048571 - RNA, 18 nt, Staphylococcus aureus subsp. aureus N315
aguaggauaauuucaauu

SEQ ID NO: 4048572 - RNA, 20 nt, Staphylococcus aureus subsp. aureus N315
aguaggguauugaaauaaua

SEQ ID NO: 4048573 - RNA, 14 nt, Staphylococcus aureus subsp. aureus N315
aguagucacuguuu

SEQ ID NO: 4048574 - RNA, 18 nt, Staphylococcus aureus subsp. aureus N315
aguaguuaucuaaugauc

SEQ ID NO: 4048575 - RNA, 20 nt, Staphylococcus aureus subsp. aureus N315
aguaguugacugaacgaaaa

SEQ ID NO: 4048576 - RNA, 20 nt, Staphylococcus aureus subsp. aureus N315
aguaguuucucuacuaauau

SEQ ID NO: 4048577 - RNA, 23 nt, Staphylococcus aureus subsp. aureus N315
aguauaaaccgccaacuaauguu

SEQ ID NO: 4048578 - RNA, 14 nt, Staphylococcus aureus subsp. aureus N315
aguauaaauaaaaa

SEQ ID NO: 4048579 - RNA, 16 nt, Staphylococcus aureus subsp. aureus N315
aguauaaauauaaaaa

SEQ ID NO: 4048580 - RNA, 17 nt, Staphylococcus aureus subsp. aureus N315
aguauaaauauaaaaag

SEQ ID NO: 4048581 - RNA, 16 nt, Staphylococcus aureus subsp. aureus N315
aguauaaucagcaaug

SEQ ID NO: 4048582 - RNA, 16 nt, Staphylococcus aureus subsp. aureus N315
aguauaauuuucuguc

SEQ ID NO: 4048583 - RNA, 15 nt, Staphylococcus aureus subsp. aureus N315
aguauauaucaaaua

SEQ ID NO: 4048584 - RNA, 22 nt, Staphylococcus aureus subsp. aureus N315
aguaucauuguguccauaaaua

SEQ ID NO: 4048585 - RNA, 18 nt, Staphylococcus aureus subsp. aureus N315
aguaucugugaauaugcu

SEQ ID NO: 4048586 - RNA, 14 nt, Staphylococcus aureus subsp. aureus N315
aguaugcauauuca

SEQ ID NO: 4048587 - RNA, 14 nt, Staphylococcus aureus subsp. aureus N315
aguauguugucaua

SEQ ID NO: 4048588 - RNA, 18 nt, Staphylococcus aureus subsp. aureus N315
aguauguuuuauacauuu

SEQ ID NO: 4048589 - RNA, 14 nt, Staphylococcus aureus subsp. aureus N315
aguauuaaauuuga

SEQ ID NO: 4048590 - RNA, 14 nt, Staphylococcus aureus subsp. aureus N315
aguauuaucacaua

SEQ ID NO: 4048591 - RNA, 21 nt, Staphylococcus aureus subsp. aureus N315
aguauugccguuauuuucaau

SEQ ID NO: 4048592 - RNA, 15 nt, Staphylococcus aureus subsp. aureus N315
aguauuguuuuauau

SEQ ID NO: 4048593 - RNA, 21 nt, Staphylococcus aureus subsp. aureus N315
aguauuguuuuauauuuaaac

SEQ ID NO: 4048594 - RNA, 22 nt, Staphylococcus aureus subsp. aureus N315
aguauuguuuuauauuuaaacu

SEQ ID NO: 4048595 - RNA, 13 nt, Staphylococcus aureus subsp. aureus N315
aguauuuucucua

SEQ ID NO: 4048596 - RNA, 22 nt, Staphylococcus aureus subsp. aureus N315
aguauuuuugcguuaauaauuu

SEQ ID NO: 4048597 - RNA, 21 nt, Staphylococcus aureus subsp. aureus N315
aguauuuuuugugccuuucuc

SEQ ID NO: 4048598 - RNA, 23 nt, Staphylococcus aureus subsp. aureus N315
aguauuuuuugugccuuucucua

SEQ ID NO: 4048599 - RNA, 23 nt, Staphylococcus aureus subsp. aureus N315
agucaaaaaaucgaacaaaugaa

SEQ ID NO: 4048600 - RNA, 19 nt, Staphylococcus aureus subsp. aureus N315
agucaacaucguauucuuu

SEQ ID NO: 4048601 - RNA, 14 nt, Staphylococcus aureus subsp. aureus N315
agucaacugcugcu

SEQ ID NO: 4048602 - RNA, 17 nt, Staphylococcus aureus subsp. aureus N315
agucaacugcugcuaaa

SEQ ID NO: 4048603 - RNA, 22 nt, Staphylococcus aureus subsp. aureus N315
agucaacugcugcuaaaauaaa

SEQ ID NO: 4048604 - RNA, 19 nt, Staphylococcus aureus subsp. aureus N315
agucaauaauuuuaucuaa

SEQ ID NO: 4048605 - RNA, 19 nt, Staphylococcus aureus subsp. aureus N315
agucaauguauauuuaaca

SEQ ID NO: 4048606 - RNA, 23 nt, Staphylococcus aureus subsp. aureus N315
agucaauguauauuuaacaucaa

SEQ ID NO: 4048607 - RNA, 18 nt, Staphylococcus aureus subsp. aureus N315
agucaauuucuuuaaagu

SEQ ID NO: 4048608 - RNA, 15 nt, Staphylococcus aureus subsp. aureus N315
agucaauuuuuucau

SEQ ID NO: 4048609 - RNA, 17 nt, Staphylococcus aureus subsp. aureus N315
agucaccauauuuaaca

SEQ ID NO: 4048610 - RNA, 21 nt, Staphylococcus aureus subsp. aureus N315
agucaccugcuuuuuauuauu

SEQ ID NO: 4048611 - RNA, 13 nt, Staphylococcus aureus subsp. aureus N315
agucagaaagaau

SEQ ID NO: 4048612 - RNA, 14 nt, Staphylococcus aureus subsp. aureus N315
agucaggggcccca

SEQ ID NO: 4048613 - RNA, 20 nt, Staphylococcus aureus subsp. aureus N315
agucaggggccccaacacag

SEQ ID NO: 4048614 - RNA, 22 nt, Staphylococcus aureus subsp. aureus N315
agucaggggccccaacacagag

SEQ ID NO: 4048615 - RNA, 13 nt, Staphylococcus aureus subsp. aureus N315
agucauaaauaua

SEQ ID NO: 4048616 - RNA, 16 nt, Staphylococcus aureus subsp. aureus N315
agucauaaauauaaaa

SEQ ID NO: 4048617 - RNA, 15 nt, Staphylococcus aureus subsp. aureus N315
agucauaauuuaaaa

SEQ ID NO: 4048618 - RNA, 16 nt, Staphylococcus aureus subsp. aureus N315
agucauaugugccaua

SEQ ID NO: 4048619 - RNA, 19 nt, Staphylococcus aureus subsp. aureus N315
agucaucaaccucauuuga

SEQ ID NO: 4048620 - RNA, 22 nt, Staphylococcus aureus subsp. aureus N315
agucaucuugagauuuucaaca

SEQ ID NO: 4048621 - RNA, 15 nt, Staphylococcus aureus subsp. aureus N315
agucaugucccauaa

SEQ ID NO: 4048622 - RNA, 13 nt, Staphylococcus aureus subsp. aureus N315
agucauuacaaau

SEQ ID NO: 4048623 - RNA, 23 nt, Staphylococcus aureus subsp. aureus N315
agucauugcaaaugcaauaggau

SEQ ID NO: 4048624 - RNA, 17 nt, Staphylococcus aureus subsp. aureus N315
agucauuguauaaaaag

SEQ ID NO: 4048625 - RNA, 13 nt, Staphylococcus aureus subsp. aureus N315
agucauuuucauu

SEQ ID NO: 4048626 - RNA, 16 nt, Staphylococcus aureus subsp. aureus N315
aguccaaauaauaucu

SEQ ID NO: 4048627 - RNA, 19 nt, Staphylococcus aureus subsp. aureus N315
aguccaauuccaauaaaca

SEQ ID NO: 4048628 - RNA, 12 nt, Staphylococcus aureus subsp. aureus N315
aguccauuuucu

SEQ ID NO: 4048629 - RNA, 14 nt, Staphylococcus aureus subsp. aureus N315
aguccauuuucuuu

SEQ ID NO: 4048630 - RNA, 16 nt, Staphylococcus aureus subsp. aureus N315
aguccauuuucuuuuu

SEQ ID NO: 4048631 - RNA, 22 nt, Staphylococcus aureus subsp. aureus N315
aguccgcguguacuuuaccauc

SEQ ID NO: 4048632 - RNA, 14 nt, Staphylococcus aureus subsp. aureus N315
aguccggggcccca

SEQ ID NO: 4048633 - RNA, 18 nt, Staphylococcus aureus subsp. aureus N315
aguccuucuuugaaauca

SEQ ID NO: 4048634 - RNA, 21 nt, Staphylococcus aureus subsp. aureus N315
aguccuucuuugaaaucaaug

SEQ ID NO: 4048635 - RNA, 14 nt, Staphylococcus aureus subsp. aureus N315
agucgaacaaugau

SEQ ID NO: 4048636 - RNA, 18 nt, Staphylococcus aureus subsp. aureus N315
agucggggccccaacaca

SEQ ID NO: 4048637 - RNA, 18 nt, Staphylococcus aureus subsp. aureus N315
agucguucucuuaaauau

SEQ ID NO: 4048638 - RNA, 19 nt, Staphylococcus aureus subsp. aureus N315
agucguucucuuaaauaug

SEQ ID NO: 4048639 - RNA, 20 nt, Staphylococcus aureus subsp. aureus N315
agucuaggacauugauuucu

SEQ ID NO: 4048640 - RNA, 12 nt, Staphylococcus aureus subsp. aureus N315
agucuaugaaua

SEQ ID NO: 4048641 - RNA, 13 nt, Staphylococcus aureus subsp. aureus N315
agucuaugaauaa

SEQ ID NO: 4048642 - RNA, 15 nt, Staphylococcus aureus subsp. aureus N315
agucucguaauaaug

SEQ ID NO: 4048643 - RNA, 16 nt, Staphylococcus aureus subsp. aureus N315
agucucuuuugauaaa

SEQ ID NO: 4048644 - RNA, 21 nt, Staphylococcus aureus subsp. aureus N315
agucuguauauggcgauaaca

SEQ ID NO: 4048645 - RNA, 13 nt, Staphylococcus aureus subsp. aureus N315
agucuguugguuu

SEQ ID NO: 4048646 - RNA, 14 nt, Staphylococcus aureus subsp. aureus N315
agucuuauuuuuau

SEQ ID NO: 4048647 - RNA, 16 nt, Staphylococcus aureus subsp. aureus N315
agucuucuuacugcaa

SEQ ID NO: 4048648 - RNA, 23 nt, Staphylococcus aureus subsp. aureus N315
agucuucuuacugcaauuauuuu

SEQ ID NO: 4048649 - RNA, 17 nt, Staphylococcus aureus subsp. aureus N315
agucuucuuuuuuuaac

SEQ ID NO: 4048650 - RNA, 13 nt, Staphylococcus aureus subsp. aureus N315
agucuuuaacuuu

SEQ ID NO: 4048651 - RNA, 18 nt, Staphylococcus aureus subsp. aureus N315
agucuuuacucuacacuc

SEQ ID NO: 4048652 - RNA, 22 nt, Staphylococcus aureus subsp. aureus N315
agucuuuuuauuuuaauauuuu

SEQ ID NO: 4048653 - RNA, 22 nt, Staphylococcus aureus subsp. aureus N315
agucuuuuuuaagcuuaucaac

SEQ ID NO: 4048654 - RNA, 18 nt, Staphylococcus aureus subsp. aureus N315
agugaaaacuucucuauc

SEQ ID NO: 4048655 - RNA, 13 nt, Staphylococcus aureus subsp. aureus N315
agugaaaagaaca

SEQ ID NO: 4048656 - RNA, 22 nt, Staphylococcus aureus subsp. aureus N315
agugaaagucguuguugaaauu

SEQ ID NO: 4048657 - RNA, 17 nt, Staphylococcus aureus subsp. aureus N315
agugaaaucauuuaaau

SEQ ID NO: 4048658 - RNA, 16 nt, Staphylococcus aureus subsp. aureus N315
agugaaguacgacggu

SEQ ID NO: 4048659 - RNA, 21 nt, Staphylococcus aureus subsp. aureus N315
agugaaucuucuaauuaagaa

SEQ ID NO: 4048660 - RNA, 20 nt, Staphylococcus aureus subsp. aureus N315
agugaauuaucuauauauga

SEQ ID NO: 4048661 - RNA, 15 nt, Staphylococcus aureus subsp. aureus N315
agugacacuguaacg

SEQ ID NO: 4048662 - RNA, 16 nt, Staphylococcus aureus subsp. aureus N315
agugauaaauaaugca

SEQ ID NO: 4048663 - RNA, 13 nt, Staphylococcus aureus subsp. aureus N315
agugauaauuaaa

SEQ ID NO: 4048664 - RNA, 15 nt, Staphylococcus aureus subsp. aureus N315
agugauaauuaaaau

SEQ ID NO: 4048665 - RNA, 21 nt, Staphylococcus aureus subsp. aureus N315
agugauaauuaaaauaagaua

SEQ ID NO: 4048666 - RNA, 15 nt, Staphylococcus aureus subsp. aureus N315
agugauucaggauug

SEQ ID NO: 4048667 - RNA, 12 nt, Staphylococcus aureus subsp. aureus N315
agugauucccaa

SEQ ID NO: 4048668 - RNA, 12 nt, Staphylococcus aureus subsp. aureus N315
agugauuuaaaa

SEQ ID NO: 4048669 - RNA, 15 nt, Staphylococcus aureus subsp. aureus N315
agugauuuuaaucua

SEQ ID NO: 4048670 - RNA, 22 nt, Staphylococcus aureus subsp. aureus N315
agugcaauaacaccaauugaau

SEQ ID NO: 4048671 - RNA, 13 nt, Staphylococcus aureus subsp. aureus N315
agugcaauuauuu

SEQ ID NO: 4048672 - RNA, 14 nt, Staphylococcus aureus subsp. aureus N315
agugcaauuauuuc

SEQ ID NO: 4048673 - RNA, 21 nt, Staphylococcus aureus subsp. aureus N315
agugcauuuuuuauuuuacuu

SEQ ID NO: 4048674 - RNA, 23 nt, Staphylococcus aureus subsp. aureus N315
agugcgaauucaacgaaagugau

SEQ ID NO: 4048675 - RNA, 16 nt, Staphylococcus aureus subsp. aureus N315
agugcucuugcaauag

SEQ ID NO: 4048676 - RNA, 16 nt, Staphylococcus aureus subsp. aureus N315
uagguacaacuaaaua

SEQ ID NO: 4048677 - RNA, 19 nt, Staphylococcus aureus subsp. aureus N315
uagguauaguguuugacaa

SEQ ID NO: 4048678 - RNA, 21 nt, Staphylococcus aureus subsp. aureus N315
uagguaugcguggucuauuuu

SEQ ID NO: 4048679 - RNA, 21 nt, Staphylococcus aureus subsp. aureus N315
uaggucaacuguaguggaaga

SEQ ID NO: 4048680 - RNA, 18 nt, Staphylococcus aureus subsp. aureus N315
uaggucuacgaucaaaau

SEQ ID NO: 4048681 - RNA, 16 nt, Staphylococcus aureus subsp. aureus N315
uagguucaucuuuaug

SEQ ID NO: 4048682 - RNA, 16 nt, Staphylococcus aureus subsp. aureus N315
uagguugauuucugcu

SEQ ID NO: 4048683 - RNA, 16 nt, Staphylococcus aureus subsp. aureus N315
uagguuuaauuuuaaa

SEQ ID NO: 4048684 - RNA, 17 nt, Staphylococcus aureus subsp. aureus N315
uagguuuaauuuuaaau

SEQ ID NO: 4048685 - RNA, 15 nt, Staphylococcus aureus subsp. aureus N315
uaguaaaaccuguau

SEQ ID NO: 4048686 - RNA, 23 nt, Staphylococcus aureus subsp. aureus N315
uaguaaaauaaauacaauagaaa

SEQ ID NO: 4048687 - RNA, 19 nt, Staphylococcus aureus subsp. aureus N315
uaguaaauauaguuaaagu

SEQ ID NO: 4048688 - RNA, 14 nt, Staphylococcus aureus subsp. aureus N315
uaguaacucaacau

SEQ ID NO: 4048689 - RNA, 17 nt, Staphylococcus aureus subsp. aureus N315
uaguaagguuugaacuc

SEQ ID NO: 4048690 - RNA, 19 nt, Staphylococcus aureus subsp. aureus N315
uaguaauaacaucuaaauu

SEQ ID NO: 4048691 - RNA, 16 nt, Staphylococcus aureus subsp. aureus N315
uaguaauaagacaaua

SEQ ID NO: 4048692 - RNA, 18 nt, Staphylococcus aureus subsp. aureus N315
uaguaauagcuauauuuu

SEQ ID NO: 4048693 - RNA, 22 nt, Staphylococcus aureus subsp. aureus N315
uaguaaugaugugaauuggauu

SEQ ID NO: 4048694 - RNA, 23 nt, Staphylococcus aureus subsp. aureus N315
uaguaauucuucaucuucuucaa

SEQ ID NO: 4048695 - RNA, 19 nt, Staphylococcus aureus subsp. aureus N315
uaguacaccucuaaguuca

SEQ ID NO: 4048696 - RNA, 19 nt, Staphylococcus aureus subsp. aureus N315
uaguacacgaauucauuaa

SEQ ID NO: 4048697 - RNA, 14 nt, Staphylococcus aureus subsp. aureus N315
uaguacacguguau

SEQ ID NO: 4048698 - RNA, 18 nt, Staphylococcus aureus subsp. aureus N315
uaguaccaagcuucauua

SEQ ID NO: 4048699 - RNA, 20 nt, Staphylococcus aureus subsp. aureus N315
uaguacggcugcuuuaacug

SEQ ID NO: 4048700 - RNA, 22 nt, Staphylococcus aureus subsp. aureus N315
uaguagacgguaucaucugcau

SEQ ID NO: 4048701 - RNA, 16 nt, Staphylococcus aureus subsp. aureus N315
uaguagauuuauuaaa

SEQ ID NO: 4048702 - RNA, 20 nt, Staphylococcus aureus subsp. aureus N315
uaguagauuuauuaaauaua

SEQ ID NO: 4048703 - RNA, 22 nt, Staphylococcus aureus subsp. aureus N315
uaguauagcgcagcaaaugcuu

SEQ ID NO: 4048704 - RNA, 13 nt, Staphylococcus aureus subsp. aureus N315
uaguauauucaac

SEQ ID NO: 4048705 - RNA, 15 nt, Staphylococcus aureus subsp. aureus N315
uaguauuauagccua

SEQ ID NO: 4048706 - RNA, 18 nt, Staphylococcus aureus subsp. aureus N315
uaguauucaaaaaauauu

SEQ ID NO: 4048707 - RNA, 15 nt, Staphylococcus aureus subsp. aureus N315
uaguauuucaucauu

SEQ ID NO: 4048708 - RNA, 22 nt, Staphylococcus aureus subsp. aureus N315
uaguauuucaucauuaguuuuu

SEQ ID NO: 4048709 - RNA, 17 nt, Staphylococcus aureus subsp. aureus N315
uagucaauuaaugauaa

SEQ ID NO: 4048710 - RNA, 16 nt, Staphylococcus aureus subsp. aureus N315
uagucauaauuuaaaa

SEQ ID NO: 4048711 - RNA, 20 nt, Staphylococcus aureus subsp. aureus N315
uagucauguuuggcauaaua

SEQ ID NO: 4048712 - RNA, 16 nt, Staphylococcus aureus subsp. aureus N315
uagucauuacaaauca

SEQ ID NO: 4048713 - RNA, 23 nt, Staphylococcus aureus subsp. aureus N315
uagucauuacaaaucaugacaua

SEQ ID NO: 4048714 - RNA, 15 nt, Staphylococcus aureus subsp. aureus N315
uagucauuacauuuu

SEQ ID NO: 4048715 - RNA, 22 nt, Staphylococcus aureus subsp. aureus N315
uaguccuucccacuuaucauca

SEQ ID NO: 4048716 - RNA, 23 nt, Staphylococcus aureus subsp. aureus N315
uaguccuucuuuacuaaaccuca

SEQ ID NO: 4048717 - RNA, 23 nt, Staphylococcus aureus subsp. aureus N315
uagucuaugaauaauguuuucau

SEQ ID NO: 4048718 - RNA, 20 nt, Staphylococcus aureus subsp. aureus N315
uagucuucggcuuuguaaaa

SEQ ID NO: 4048719 - RNA, 13 nt, Staphylococcus aureus subsp. aureus N315
uagucuuuuuaag

SEQ ID NO: 4048720 - RNA, 15 nt, Staphylococcus aureus subsp. aureus N315
uagucuuuuuaagua

SEQ ID NO: 4048721 - RNA, 23 nt, Staphylococcus aureus subsp. aureus N315
uagucuuuuuauuuuaauauuuu

SEQ ID NO: 4048722 - RNA, 21 nt, Staphylococcus aureus subsp. aureus N315
uagucuuuuuuaagcuuauca

SEQ ID NO: 4048723 - RNA, 12 nt, Staphylococcus aureus subsp. aureus N315
uagugaaaagaa

SEQ ID NO: 4048724 - RNA, 13 nt, Staphylococcus aureus subsp. aureus N315
uagugagcguauu

SEQ ID NO: 4048725 - RNA, 16 nt, Staphylococcus aureus subsp. aureus N315
uagugauuuuuuacau

SEQ ID NO: 4048726 - RNA, 17 nt, Staphylococcus aureus subsp. aureus N315
uagugcaaguaauuuaa

SEQ ID NO: 4048727 - RNA, 21 nt, Staphylococcus aureus subsp. aureus N315
uagugcucgaaucucauugau

SEQ ID NO: 4048728 - RNA, 13 nt, Staphylococcus aureus subsp. aureus N315
uagugcucuugca

SEQ ID NO: 4048729 - RNA, 22 nt, Staphylococcus aureus subsp. aureus N315
uagugcucuugcaauagcaaca

SEQ ID NO: 4048730 - RNA, 23 nt, Staphylococcus aureus subsp. aureus N315
uaguggaagacaaugauuugugg

SEQ ID NO: 4048731 - RNA, 18 nt, Staphylococcus aureus subsp. aureus N315
uaguggugguacuuuuuu

SEQ ID NO: 4048732 - RNA, 17 nt, Staphylococcus aureus subsp. aureus N315
uaguguuauauuguauu

SEQ ID NO: 4048733 - RNA, 12 nt, Staphylococcus aureus subsp. aureus N315
uaguuaaauaca

SEQ ID NO: 4048734 - RNA, 21 nt, Staphylococcus aureus subsp. aureus N315
uaguuaagauaccuuuuucua

SEQ ID NO: 4048735 - RNA, 17 nt, Staphylococcus aureus subsp. aureus N315
uaguuagcccuauucaa

SEQ ID NO: 4048736 - RNA, 17 nt, Staphylococcus aureus subsp. aureus N315
uaguuagggaaauguag

SEQ ID NO: 4048737 - RNA, 22 nt, Staphylococcus aureus subsp. aureus N315
uaguuagggaaauguagauuac

SEQ ID NO: 4048738 - RNA, 17 nt, Staphylococcus aureus subsp. aureus N315
uaguuaugugcuaaucu

SEQ ID NO: 4048739 - RNA, 21 nt, Staphylococcus aureus subsp. aureus N315
uaguucaaauugaacuucuuu

SEQ ID NO: 4048740 - RNA, 20 nt, Staphylococcus aureus subsp. aureus N315
uaguucacaugaauuuuaau

SEQ ID NO: 4048741 - RNA, 21 nt, Staphylococcus aureus subsp. aureus N315
uaguucacaugaauuuuaaua

SEQ ID NO: 4048742 - RNA, 22 nt, Staphylococcus aureus subsp. aureus N315
uaguucuauugcagaagaaaac

SEQ ID NO: 4048743 - RNA, 19 nt, Staphylococcus aureus subsp. aureus N315
uaguucuggcaaagaaucc

SEQ ID NO: 4048744 - RNA, 15 nt, Staphylococcus aureus subsp. aureus N315
uaguucuuuaaauua

SEQ ID NO: 4048745 - RNA, 21 nt, Staphylococcus aureus subsp. aureus N315
uaguugagcguuuaauuagaa

SEQ ID NO: 4048746 - RNA, 16 nt, Staphylococcus aureus subsp. aureus N315
uaguugaucaaaaaga

SEQ ID NO: 4048747 - RNA, 20 nt, Staphylococcus aureus subsp. aureus N315
uaguuuaagucuaacuuuag

SEQ ID NO: 4048748 - RNA, 14 nt, Staphylococcus aureus subsp. aureus N315
uaguuuagguugau

SEQ ID NO: 4048749 - RNA, 14 nt, Staphylococcus aureus subsp. aureus N315
uaguuucucuacua

SEQ ID NO: 4048750 - RNA, 15 nt, Staphylococcus aureus subsp. aureus N315
uaguuucucuacuaa

SEQ ID NO: 4048751 - RNA, 17 nt, Staphylococcus aureus subsp. aureus N315
uaguuucucuacuaaua

SEQ ID NO: 4048752 - RNA, 15 nt, Staphylococcus aureus subsp. aureus N315
uaguuugaauuggga

SEQ ID NO: 4048753 - RNA, 20 nt, Staphylococcus aureus subsp. aureus N315
uaguuugacaucuauuucuu

SEQ ID NO: 4048754 - RNA, 21 nt, Staphylococcus aureus subsp. aureus N315
uaguuugauaugcucucuuca

SEQ ID NO: 4048755 - RNA, 23 nt, Staphylococcus aureus subsp. aureus N315
uaguuugauaugcucucuucaaa

SEQ ID NO: 4048756 - RNA, 14 nt, Staphylococcus aureus subsp. aureus N315
uaguuuuuaaaauu

SEQ ID NO: 4048757 - RNA, 18 nt, Staphylococcus aureus subsp. aureus N315
uaguuuuuacguuuucua

SEQ ID NO: 4048758 - RNA, 14 nt, Staphylococcus aureus subsp. aureus N315
uaguuuuuuuuaua

SEQ ID NO: 4048759 - RNA, 23 nt, Staphylococcus aureus subsp. aureus N315
uauaaaaaaauuaacuauacuuu

SEQ ID NO: 4048760 - RNA, 21 nt, Staphylococcus aureus subsp. aureus N315
uauaaaaaagaucacugccaa

SEQ ID NO: 4048761 - RNA, 16 nt, Staphylococcus aureus subsp. aureus N315
uauaaaaacagcagug

SEQ ID NO: 4048762 - RNA, 23 nt, Staphylococcus aureus subsp. aureus N315
uauaaaaagucccgcuuaaaaug

SEQ ID NO: 4048763 - RNA, 20 nt, Staphylococcus aureus subsp. aureus N315
uauaaaacgauaagaauuaa

SEQ ID NO: 4048764 - RNA, 20 nt, Staphylococcus aureus subsp. aureus N315
uauaaaaggaagcaucucca

SEQ ID NO: 4048765 - RNA, 13 nt, Staphylococcus aureus subsp. aureus N315
uauaaaaguacuu

SEQ ID NO: 4048766 - RNA, 14 nt, Staphylococcus aureus subsp. aureus N315
uauaaaauaaaaug

SEQ ID NO: 4048767 - RNA, 17 nt, Staphylococcus aureus subsp. aureus N315
uauaaaauauauuuaau

SEQ ID NO: 4048768 - RNA, 23 nt, Staphylococcus aureus subsp. aureus N315
uauaaaauggugcgaauaauaau

SEQ ID NO: 4048769 - RNA, 16 nt, Staphylococcus aureus subsp. aureus N315
uauaaacauaucuucu

SEQ ID NO: 4048770 - RNA, 13 nt, Staphylococcus aureus subsp. aureus N315
uauaaacauuuau

SEQ ID NO: 4048771 - RNA, 17 nt, Staphylococcus aureus subsp. aureus N315
uauaaaccgccaacuaa

SEQ ID NO: 4048772 - RNA, 21 nt, Staphylococcus aureus subsp. aureus N315
uauaaacgucacuuuauuaaa

SEQ ID NO: 4048773 - RNA, 22 nt, Staphylococcus aureus subsp. aureus N315
uauaaacgucacuuuauuaaau

SEQ ID NO: 4048774 - RNA, 20 nt, Staphylococcus aureus subsp. aureus N315
uauaaagaaauaauuuaaag

SEQ ID NO: 4048775 - RNA, 21 nt, Staphylococcus aureus subsp. aureus N315
uauaaagaaauaauuuaaagg

SEQ ID NO: 4048776 - RNA, 10 nt, Staphylococcus aureus subsp. aureus N315
uauaaagaau

SEQ ID NO: 4048777 - RNA, 20 nt, Staphylococcus aureus subsp. aureus N315
uauaaagaaugauuuauaaa

SEQ ID NO: 4048778 - RNA, 23 nt, Staphylococcus aureus subsp. aureus N315
uauaaagaaugauuuauaaaaaa

SEQ ID NO: 4048779 - RNA, 16 nt, Staphylococcus aureus subsp. aureus N315
uauaaagacaccuuca

SEQ ID NO: 4048780 - RNA, 16 nt, Staphylococcus aureus subsp. aureus N315
uauaaagauuuaaguc

SEQ ID NO: 4048781 - RNA, 14 nt, Staphylococcus aureus subsp. aureus N315
uauaaauaaaaaua

SEQ ID NO: 4048782 - RNA, 18 nt, Staphylococcus aureus subsp. aureus N315
uauaaauaaaaauacaua

SEQ ID NO: 4048783 - RNA, 20 nt, Staphylococcus aureus subsp. aureus N315
uauaaauaaaaauacauaau

SEQ ID NO: 4048784 - RNA, 20 nt, Staphylococcus aureus subsp. aureus N315
uauaaauaaccgcacuuucu

SEQ ID NO: 4048785 - RNA, 21 nt, Staphylococcus aureus subsp. aureus N315
uauaaauaauaaaugcuauau

SEQ ID NO: 4048786 - RNA, 13 nt, Staphylococcus aureus subsp. aureus N315
uauaaauacaaau

SEQ ID NO: 4048787 - RNA, 14 nt, Staphylococcus aureus subsp. aureus N315
uauaaauacaaaua

SEQ ID NO: 4048788 - RNA, 14 nt, Staphylococcus aureus subsp. aureus N315
uauaaauauaaaaa

SEQ ID NO: 4048789 - RNA, 15 nt, Staphylococcus aureus subsp. aureus N315
uauaaauauaaaaag

SEQ ID NO: 4048790 - RNA, 13 nt, Staphylococcus aureus subsp. aureus N315
uauaaauaucaau

SEQ ID NO: 4048791 - RNA, 13 nt, Staphylococcus aureus subsp. aureus N315
uauaaauaucuuu

SEQ ID NO: 4048792 - RNA, 18 nt, Staphylococcus aureus subsp. aureus N315
uauaaaucaaauauacuu

SEQ ID NO: 4048793 - RNA, 19 nt, Staphylococcus aureus subsp. aureus N315
uauaaaucaaauauacuuu

SEQ ID NO: 4048794 - RNA, 22 nt, Staphylococcus aureus subsp. aureus N315
uauaaaucauucuuuauagaaa

SEQ ID NO: 4048795 - RNA, 22 nt, Staphylococcus aureus subsp. aureus N315
uauaaauccuaagucuuuuaaa

SEQ ID NO: 4048796 - RNA, 21 nt, Staphylococcus aureus subsp. aureus N315
uauaaaugaaucgcuuugauu

SEQ ID NO: 4048797 - RNA, 19 nt, Staphylococcus aureus subsp. aureus N315
uauaaauguuuauaucuuu

SEQ ID NO: 4048798 - RNA, 22 nt, Staphylococcus aureus subsp. aureus N315
uauaaauguuuauaucuuuuau

SEQ ID NO: 4048799 - RNA, 15 nt, Staphylococcus aureus subsp. aureus N315
uauaaauuaucagaa

SEQ ID NO: 4048800 - RNA, 22 nt, Staphylococcus aureus subsp. aureus N315
uauaaauuucuucauaguucaa

SEQ ID NO: 4048801 - RNA, 20 nt, Staphylococcus aureus subsp. aureus N315
uauaacaacuacuuaaauua

SEQ ID NO: 4048802 - RNA, 20 nt, Staphylococcus aureus subsp. aureus N315
uauaacacuucguauugaau

SEQ ID NO: 4048803 - RNA, 12 nt, Staphylococcus aureus subsp. aureus N315
uauaacauuaaa

SEQ ID NO: 4048804 - RNA, 14 nt, Staphylococcus aureus subsp. aureus N315
uauaacauuaaaau

SEQ ID NO: 4048805 - RNA, 16 nt, Staphylococcus aureus subsp. aureus N315
uauaacauucuucaaa

SEQ ID NO: 4048806 - RNA, 20 nt, Staphylococcus aureus subsp. aureus N315
uauaacauucuucaaaaaau

SEQ ID NO: 4048807 - RNA, 21 nt, Staphylococcus aureus subsp. aureus N315
uauaacccuaauguguggauu

SEQ ID NO: 4048808 - RNA, 19 nt, Staphylococcus aureus subsp. aureus N315
uauaacccucguaggcaua

SEQ ID NO: 4048809 - RNA, 23 nt, Staphylococcus aureus subsp. aureus N315
uauaacccucguaggcauaggcu

SEQ ID NO: 4048810 - RNA, 17 nt, Staphylococcus aureus subsp. aureus N315
uauaaccgcuacaauua

SEQ ID NO: 4048811 - RNA, 21 nt, Staphylococcus aureus subsp. aureus N315
uauaaccgugaugaugugcaa

SEQ ID NO: 4048812 - RNA, 17 nt, Staphylococcus aureus subsp. aureus N315
uauaaccuauuaaaucu

SEQ ID NO: 4048813 - RNA, 17 nt, Staphylococcus aureus subsp. aureus N315
uauaaccuuguucuuua

SEQ ID NO: 4048814 - RNA, 15 nt, Staphylococcus aureus subsp. aureus N315
uauaacgcuuuaaua

SEQ ID NO: 4048815 - RNA, 16 nt, Staphylococcus aureus subsp. aureus N315
uauaacgcuuuaauau

SEQ ID NO: 4048816 - RNA, 18 nt, Staphylococcus aureus subsp. aureus N315
uauaacugauaauacugu

SEQ ID NO: 4048817 - RNA, 20 nt, Staphylococcus aureus subsp. aureus N315
uauaacugcauguacaucuu

SEQ ID NO: 4048818 - RNA, 13 nt, Staphylococcus aureus subsp. aureus N315
uauaacuuuaaaa

SEQ ID NO: 4048819 - RNA, 15 nt, Staphylococcus aureus subsp. aureus N315
uauaagccuuuucaa

SEQ ID NO: 4048820 - RNA, 20 nt, Staphylococcus aureus subsp. aureus N315
uauaagccuuuucaaacaua

SEQ ID NO: 4048821 - RNA, 15 nt, Staphylococcus aureus subsp. aureus N315
uauaagcuuuuucuu

SEQ ID NO: 4048822 - RNA, 22 nt, Staphylococcus aureus subsp. aureus N315
uauaagcuuuuucuuucucuaa

SEQ ID NO: 4048823 - RNA, 20 nt, Staphylococcus aureus subsp. aureus N315
uauaagggguauauuaaaaa

SEQ ID NO: 4048824 - RNA, 22 nt, Staphylococcus aureus subsp. aureus N315
uauaagggguauauuaaaaauu

SEQ ID NO: 4048825 - RNA, 13 nt, Staphylococcus aureus subsp. aureus N315
uauaaguaaauaa

SEQ ID NO: 4048826 - RNA, 19 nt, Staphylococcus aureus subsp. aureus N315
uauaaguaaucauaauaau

SEQ ID NO: 4048827 - RNA, 12 nt, Staphylococcus aureus subsp. aureus N315
uauaaguacaaa

SEQ ID NO: 4048828 - RNA, 15 nt, Staphylococcus aureus subsp. aureus N315
uauaaguacaaauaa

SEQ ID NO: 4048829 - RNA, 18 nt, Staphylococcus aureus subsp. aureus N315
uauaaguagcucaaaaca

SEQ ID NO: 4048830 - RNA, 23 nt, Staphylococcus aureus subsp. aureus N315
uauaaguagugauuuuuuacauu

SEQ ID NO: 4048831 - RNA, 23 nt, Staphylococcus aureus subsp. aureus N315
uauaaguaucgccaucauucacc

SEQ ID NO: 4048832 - RNA, 18 nt, Staphylococcus aureus subsp. aureus N315
uauaaguauuuuaggguu

SEQ ID NO: 4048833 - RNA, 20 nt, Staphylococcus aureus subsp. aureus N315
uauaagugauuucuucauua

SEQ ID NO: 4048834 - RNA, 13 nt, Staphylococcus aureus subsp. aureus N315
uauaaguuaaaaa

SEQ ID NO: 4048835 - RNA, 18 nt, Staphylococcus aureus subsp. aureus N315
uauaaguuaaaaauguaa

SEQ ID NO: 4048836 - RNA, 14 nt, Staphylococcus aureus subsp. aureus N315
uauaaguuaaaauu

SEQ ID NO: 4048837 - RNA, 19 nt, Staphylococcus aureus subsp. aureus N315
uauaaguugcauauaaaaa

SEQ ID NO: 4048838 - RNA, 19 nt, Staphylococcus aureus subsp. aureus N315
uauaaguuugguucaguag

SEQ ID NO: 4048839 - RNA, 13 nt, Staphylococcus aureus subsp. aureus N315
uauaauaccccaa

SEQ ID NO: 4048840 - RNA, 13 nt, Staphylococcus aureus subsp. aureus N315
uauaauagaaaua

SEQ ID NO: 4048841 - RNA, 14 nt, Staphylococcus aureus subsp. aureus N315
uauaauagaaauaa

SEQ ID NO: 4048842 - RNA, 15 nt, Staphylococcus aureus subsp. aureus N315
uauaauauacacaaa

SEQ ID NO: 4048843 - RNA, 16 nt, Staphylococcus aureus subsp. aureus N315
uauaauauacacaaaa

SEQ ID NO: 4048844 - RNA, 16 nt, Staphylococcus aureus subsp. aureus N315
uauaaucuauaaaugg

SEQ ID NO: 4048845 - RNA, 15 nt, Staphylococcus aureus subsp. aureus N315
uauaaugauguauuu

SEQ ID NO: 4048846 - RNA, 21 nt, Staphylococcus aureus subsp. aureus N315
uauaaugauugucuuauaaga

SEQ ID NO: 4048847 - RNA, 17 nt, Staphylococcus aureus subsp. aureus N315
uauaaugccaaauauag

SEQ ID NO: 4048848 - RNA, 16 nt, Staphylococcus aureus subsp. aureus N315
uauaaugguugaauaa

SEQ ID NO: 4048849 - RNA, 15 nt, Staphylococcus aureus subsp. aureus N315
uauaauuaaacauuu

SEQ ID NO: 4048850 - RNA, 21 nt, Staphylococcus aureus subsp. aureus N315
uauaauuaaacauuuagauuu

SEQ ID NO: 4048851 - RNA, 12 nt, Staphylococcus aureus subsp. aureus N315
uauaauuaauuu

SEQ ID NO: 4048852 - RNA, 11 nt, Staphylococcus aureus subsp. aureus N315
uauaauucuuc

SEQ ID NO: 4048853 - RNA, 12 nt, Staphylococcus aureus subsp. aureus N315
uauaauugauug

SEQ ID NO: 4048854 - RNA, 16 nt, Staphylococcus aureus subsp. aureus N315
uauaauugauugucau

SEQ ID NO: 4048855 - RNA, 23 nt, Staphylococcus aureus subsp. aureus N315
uauaauugauugucauauaaaac

SEQ ID NO: 4048856 - RNA, 15 nt, Staphylococcus aureus subsp. aureus N315
uauaauuuauaaaaa

SEQ ID NO: 4048857 - RNA, 16 nt, Staphylococcus aureus subsp. aureus N315
uauaauuuaucuuaau

SEQ ID NO: 4048858 - RNA, 12 nt, Staphylococcus aureus subsp. aureus N315
uauaauuuauuu

SEQ ID NO: 4048859 - RNA, 23 nt, Staphylococcus aureus subsp. aureus N315
uauaauuucaguaggacauauaa

SEQ ID NO: 4048860 - RNA, 13 nt, Staphylococcus aureus subsp. aureus N315
uauaauuuccuaa

SEQ ID NO: 4048861 - RNA, 20 nt, Staphylococcus aureus subsp. aureus N315
uauaauuucuguuuacgcca

SEQ ID NO: 4048862 - RNA, 20 nt, Staphylococcus aureus subsp. aureus N315
uauaauuuucuguccaaaaa

SEQ ID NO: 4048863 - RNA, 15 nt, Staphylococcus aureus subsp. aureus N315
uauaauuuuguuuca

SEQ ID NO: 4048864 - RNA, 17 nt, Staphylococcus aureus subsp. aureus N315
uauacaacauguguaug

SEQ ID NO: 4048865 - RNA, 22 nt, Staphylococcus aureus subsp. aureus N315
uauacaauacuucguauugaau

SEQ ID NO: 4048866 - RNA, 21 nt, Staphylococcus aureus subsp. aureus N315
uauacacacuaaggaaaauua

SEQ ID NO: 4048867 - RNA, 20 nt, Staphylococcus aureus subsp. aureus N315
uauacagguuuaauaaauuu

SEQ ID NO: 4048868 - RNA, 21 nt, Staphylococcus aureus subsp. aureus N315
uauacauaccacacuuuaaac

SEQ ID NO: 4048869 - RNA, 17 nt, Staphylococcus aureus subsp. aureus N315
uauacauugauaaauuu

SEQ ID NO: 4048870 - RNA, 13 nt, Staphylococcus aureus subsp. aureus N315
uauacauuuuacc

SEQ ID NO: 4048871 - RNA, 14 nt, Staphylococcus aureus subsp. aureus N315
uauaccaaccaaaa

SEQ ID NO: 4048872 - RNA, 22 nt, Staphylococcus aureus subsp. aureus N315
uauaccuagggaugauauaguu

SEQ ID NO: 4048873 - RNA, 15 nt, Staphylococcus aureus subsp. aureus N315
uauacuaaacuuuuu

SEQ ID NO: 4048874 - RNA, 19 nt, Staphylococcus aureus subsp. aureus N315
uauacuaaacuuuuuucaa

SEQ ID NO: 4048875 - RNA, 12 nt, Staphylococcus aureus subsp. aureus N315
uauacuaaauug

SEQ ID NO: 4048876 - RNA, 17 nt, Staphylococcus aureus subsp. aureus N315
uauacuacuauugauau

SEQ ID NO: 4048877 - RNA, 14 nt, Staphylococcus aureus subsp. aureus N315
uauacucauuuucu

SEQ ID NO: 4048878 - RNA, 15 nt, Staphylococcus aureus subsp. aureus N315
uauacugaugaaaac

SEQ ID NO: 4048879 - RNA, 16 nt, Staphylococcus aureus subsp. aureus N315
uauacuugaagaaaag

SEQ ID NO: 4048880 - RNA, 19 nt, Staphylococcus aureus subsp. aureus N315
uauacuugaugaaacugau

SEQ ID NO: 4048881 - RNA, 15 nt, Staphylococcus aureus subsp. aureus N315
uauacuuuuauagaa

SEQ ID NO: 4048882 - RNA, 14 nt, Staphylococcus aureus subsp. aureus N315
uauacuuuuuaaau

SEQ ID NO: 4048883 - RNA, 18 nt, Staphylococcus aureus subsp. aureus N315
uauacuuuuuaaaugauu

SEQ ID NO: 4048884 - RNA, 23 nt, Staphylococcus aureus subsp. aureus N315
uauagaaaaugaguacaacauag

SEQ ID NO: 4048885 - RNA, 22 nt, Staphylococcus aureus subsp. aureus N315
uauagaauucacgcaauaucau

SEQ ID NO: 4048886 - RNA, 22 nt, Staphylococcus aureus subsp. aureus N315
uauagaccguugaaauguucaa

SEQ ID NO: 4048887 - RNA, 22 nt, Staphylococcus aureus subsp. aureus N315
uauagaggauauuuauucuaag

SEQ ID NO: 4048888 - RNA, 19 nt, Staphylococcus aureus subsp. aureus N315
uauagauagguaugcgugg

SEQ ID NO: 4048889 - RNA, 18 nt, Staphylococcus aureus subsp. aureus N315
uauagaugacuguagaaa

SEQ ID NO: 4048890 - RNA, 21 nt, Staphylococcus aureus subsp. aureus N315
uauagaugacuguagaaaaca

SEQ ID NO: 4048891 - RNA, 23 nt, Staphylococcus aureus subsp. aureus N315
uauagaugacuguagaaaacaug

SEQ ID NO: 4048892 - RNA, 15 nt, Staphylococcus aureus subsp. aureus N315
uauagaugugucuuu

SEQ ID NO: 4048893 - RNA, 14 nt, Staphylococcus aureus subsp. aureus N315
uauagauuaaaaaa

SEQ ID NO: 4048894 - RNA, 20 nt, Staphylococcus aureus subsp. aureus N315
uauagauucauguaaauagu

SEQ ID NO: 4048895 - RNA, 14 nt, Staphylococcus aureus subsp. aureus N315
uauagauugccauu

SEQ ID NO: 4048896 - RNA, 22 nt, Staphylococcus aureus subsp. aureus N315
uauagauuuuguauuagcaucu

SEQ ID NO: 4048897 - RNA, 13 nt, Staphylococcus aureus subsp. aureus N315
uauagccuucauu

SEQ ID NO: 4048898 - RNA, 21 nt, Staphylococcus aureus subsp. aureus N315
uauaggcccuaacgguagaau

SEQ ID NO: 4048899 - RNA, 19 nt, Staphylococcus aureus subsp. aureus N315
uauaggugcaguuaaauua

SEQ ID NO: 4048900 - RNA, 15 nt, Staphylococcus aureus subsp. aureus N315
uauagguuuauaaaa

SEQ ID NO: 4048901 - RNA, 14 nt, Staphylococcus aureus subsp. aureus N315
uauaguaagaaaag

SEQ ID NO: 4048902 - RNA, 15 nt, Staphylococcus aureus subsp. aureus N315
uauaguaauaaaagu

SEQ ID NO: 4048903 - RNA, 18 nt, Staphylococcus aureus subsp. aureus N315
uauaguaauagcuauauu

SEQ ID NO: 4048904 - RNA, 13 nt, Staphylococcus aureus subsp. aureus N315
uauagucauucau

SEQ ID NO: 4048905 - RNA, 16 nt, Staphylococcus aureus subsp. aureus N315
uauagucuuaaacaua

SEQ ID NO: 4048906 - RNA, 20 nt, Staphylococcus aureus subsp. aureus N315
uauagugucgagauuuuaua

SEQ ID NO: 4048907 - RNA, 18 nt, Staphylococcus aureus subsp. aureus N315
uauaguguuugacaaguu

SEQ ID NO: 4048908 - RNA, 19 nt, Staphylococcus aureus subsp. aureus N315
uauaguguuuuauucgaua

SEQ ID NO: 4048909 - RNA, 14 nt, Staphylococcus aureus subsp. aureus N315
uauaguucuauugc

SEQ ID NO: 4048910 - RNA, 16 nt, Staphylococcus aureus subsp. aureus N315
uauaguuggcaauccu

SEQ ID NO: 4048911 - RNA, 13 nt, Staphylococcus aureus subsp. aureus N315
uauaguuuagauu

SEQ ID NO: 4048912 - RNA, 20 nt, Staphylococcus aureus subsp. aureus N315
uauauaaagcuuugacauau

SEQ ID NO: 4048913 - RNA, 20 nt, Staphylococcus aureus subsp. aureus N315
uauauaaaguugacaauaca

SEQ ID NO: 4048914 - RNA, 21 nt, Staphylococcus aureus subsp. aureus N315
uauauaaaguugacaauacaa

SEQ ID NO: 4048915 - RNA, 23 nt, Staphylococcus aureus subsp. aureus N315
uauauaaaguugacaauacaaau

SEQ ID NO: 4048916 - RNA, 11 nt, Staphylococcus aureus subsp. aureus N315
uauauaaauua

SEQ ID NO: 4048917 - RNA, 20 nt, Staphylococcus aureus subsp. aureus N315
uauauaacaaguacaauaau

SEQ ID NO: 4048918 - RNA, 14 nt, Staphylococcus aureus subsp. aureus N315
uauauaacacaaua

SEQ ID NO: 4048919 - RNA, 13 nt, Staphylococcus aureus subsp. aureus N315
uauauaauugauu

SEQ ID NO: 4048920 - RNA, 14 nt, Staphylococcus aureus subsp. aureus N315
uauauaauuuaaag

SEQ ID NO: 4048921 - RNA, 16 nt, Staphylococcus aureus subsp. aureus N315
uauauaauuuauaaaa

SEQ ID NO: 4048922 - RNA, 18 nt, Staphylococcus aureus subsp. aureus N315
uauauaauuuauaaaaag

SEQ ID NO: 4048923 - RNA, 18 nt, Staphylococcus aureus subsp. aureus N315
uauauaauuuauuuagca

SEQ ID NO: 4048924 - RNA, 20 nt, Staphylococcus aureus subsp. aureus N315
uauauacaaugacagcagac

SEQ ID NO: 4048925 - RNA, 23 nt, Staphylococcus aureus subsp. aureus N315
uauauacgauugaguugaaaaua

SEQ ID NO: 4048926 - RNA, 13 nt, Staphylococcus aureus subsp. aureus N315
uauauacuaaucu

SEQ ID NO: 4048927 - RNA, 21 nt, Staphylococcus aureus subsp. aureus N315
uauauagcgcgcuuauugaaa

SEQ ID NO: 4048928 - RNA, 23 nt, Staphylococcus aureus subsp. aureus N315
uauauagcgcgcuuauugaaaag

SEQ ID NO: 4048929 - RNA, 20 nt, Staphylococcus aureus subsp. aureus N315
uauauaguaggguauugaaa

SEQ ID NO: 4048930 - RNA, 20 nt, Staphylococcus aureus subsp. aureus N315
uauauauaaagaaauaauuu

SEQ ID NO: 4048931 - RNA, 13 nt, Staphylococcus aureus subsp. aureus N315
uauauauauuaaa

SEQ ID NO: 4048932 - RNA, 16 nt, Staphylococcus aureus subsp. aureus N315
uauauaucaaauacau

SEQ ID NO: 4048933 - RNA, 18 nt, Staphylococcus aureus subsp. aureus N315
uauauaucacaacacaua

SEQ ID NO: 4048934 - RNA, 17 nt, Staphylococcus aureus subsp. aureus N315
uauauaucacauauuau

SEQ ID NO: 4048935 - RNA, 15 nt, Staphylococcus aureus subsp. aureus N315
uauauauccauucaa

SEQ ID NO: 4048936 - RNA, 15 nt, Staphylococcus aureus subsp. aureus N315
uauauauuaaaguaa

SEQ ID NO: 4048937 - RNA, 16 nt, Staphylococcus aureus subsp. aureus N315
uauauauuaaaguaaa

SEQ ID NO: 4048938 - RNA, 12 nt, Staphylococcus aureus subsp. aureus N315
uauauauucaau

SEQ ID NO: 4048939 - RNA, 18 nt, Staphylococcus aureus subsp. aureus N315
uauauauuccuuaaaccg

SEQ ID NO: 4048940 - RNA, 14 nt, Staphylococcus aureus subsp. aureus N315
uauauauuuugcaa

SEQ ID NO: 4048941 - RNA, 15 nt, Staphylococcus aureus subsp. aureus N315
uauaucaacguuaau

SEQ ID NO: 4048942 - RNA, 19 nt, Staphylococcus aureus subsp. aureus N315
uauaucaacguuaauauaa

SEQ ID NO: 4048943 - RNA, 16 nt, Staphylococcus aureus subsp. aureus N315
uauauccaguaaaguu

SEQ ID NO: 4048944 - RNA, 17 nt, Staphylococcus aureus subsp. aureus N315
uauauccgcaucuuuug

SEQ ID NO: 4048945 - RNA, 24 nt, Staphylococcus aureus subsp. aureus N315
uauaucuaauucguaauuuaugau

SEQ ID NO: 4048946 - RNA, 21 nt, Staphylococcus aureus subsp. aureus N315
uauaucuauuuaucauacuuc

SEQ ID NO: 4048947 - RNA, 19 nt, Staphylococcus aureus subsp. aureus N315
uauaucuuaaguacauaaa

SEQ ID NO: 4048948 - RNA, 13 nt, Staphylococcus aureus subsp. aureus N315
uauaucuuuuaua

SEQ ID NO: 4048949 - RNA, 14 nt, Staphylococcus aureus subsp. aureus N315
uauaugaauuuuau

SEQ ID NO: 4048950 - RNA, 15 nt, Staphylococcus aureus subsp. aureus N315
uauaugaauuuuaua

SEQ ID NO: 4048951 - RNA, 17 nt, Staphylococcus aureus subsp. aureus N315
uauaugauaaauauugu

SEQ ID NO: 4048952 - RNA, 23 nt, Staphylococcus aureus subsp. aureus N315
uauaugccgauugcucuaaucca

SEQ ID NO: 4048953 - RNA, 15 nt, Staphylococcus aureus subsp. aureus N315
uauauggcaucauca

SEQ ID NO: 4048954 - RNA, 16 nt, Staphylococcus aureus subsp. aureus N315
uauauguaaucagagu

SEQ ID NO: 4048955 - RNA, 23 nt, Staphylococcus aureus subsp. aureus N315
uauauguaggggagucuuauuuu

SEQ ID NO: 4048956 - RNA, 16 nt, Staphylococcus aureus subsp. aureus N315
uauauuaaaaauuuca

SEQ ID NO: 4048957 - RNA, 19 nt, Staphylococcus aureus subsp. aureus N315
uauauuaaaaauuucaaua

SEQ ID NO: 4048958 - RNA, 23 nt, Staphylococcus aureus subsp. aureus N315
uauauuaaaaauuucaauaaugu

SEQ ID NO: 4048959 - RNA, 17 nt, Staphylococcus aureus subsp. aureus N315
uauauuaaauacuauau

SEQ ID NO: 4048960 - RNA, 15 nt, Staphylococcus aureus subsp. aureus N315
uauauuaauaaucuu

SEQ ID NO: 4048961 - RNA, 15 nt, Staphylococcus aureus subsp. aureus N315
uauauuaauguuuga

SEQ ID NO: 4048962 - RNA, 22 nt, Staphylococcus aureus subsp. aureus N315
uauauuacuaaccuauuaaaau

SEQ ID NO: 4048963 - RNA, 14 nt, Staphylococcus aureus subsp. aureus N315
uauauuaguauaau

SEQ ID NO: 4048964 - RNA, 13 nt, Staphylococcus aureus subsp. aureus N315
uauauucaacuua

SEQ ID NO: 4048965 - RNA, 16 nt, Staphylococcus aureus subsp. aureus N315
uauauucaacuuauua

SEQ ID NO: 4048966 - RNA, 12 nt, Staphylococcus aureus subsp. aureus N315
uauauucaauuu

SEQ ID NO: 4048967 - RNA, 19 nt, Staphylococcus aureus subsp. aureus N315
uauauugagacaacauugu

SEQ ID NO: 4048968 - RNA, 16 nt, Staphylococcus aureus subsp. aureus N315
uauauugauagcaccg

SEQ ID NO: 4048969 - RNA, 23 nt, Staphylococcus aureus subsp. aureus N315
uauauugcacauaaaaaauguga

SEQ ID NO: 4048970 - RNA, 21 nt, Staphylococcus aureus subsp. aureus N315
uauauuguauuuuauuuauuu

SEQ ID NO: 4048971 - RNA, 20 nt, Staphylococcus aureus subsp. aureus N315
uauauugucgacuuuuagau

SEQ ID NO: 4048972 - RNA, 12 nt, Staphylococcus aureus subsp. aureus N315
uauauuuaaacu

SEQ ID NO: 4048973 - RNA, 15 nt, Staphylococcus aureus subsp. aureus N315
uauauuuaaaugucu

SEQ ID NO: 4048974 - RNA, 14 nt, Staphylococcus aureus subsp. aureus N315
uauauuuaaauugg

SEQ ID NO: 4048975 - RNA, 12 nt, Staphylococcus aureus subsp. aureus N315
uauauuuaauuu

SEQ ID NO: 4048976 - RNA, 14 nt, Staphylococcus aureus subsp. aureus N315
uauauuuacacaga

SEQ ID NO: 4048977 - RNA, 22 nt, Staphylococcus aureus subsp. aureus N315
uauauuuacacagaaugauaua

SEQ ID NO: 4048978 - RNA, 23 nt, Staphylococcus aureus subsp. aureus N315
uauauuuaguuaauuauuuagau

SEQ ID NO: 4048979 - RNA, 16 nt, Staphylococcus aureus subsp. aureus N315
uauauuuauuuuugau

SEQ ID NO: 4048980 - RNA, 17 nt, Staphylococcus aureus subsp. aureus N315
uauauuuauuuuugaua

SEQ ID NO: 4048981 - RNA, 20 nt, Staphylococcus aureus subsp. aureus N315
uauauuucgguauuuuaaau

SEQ ID NO: 4048982 - RNA, 22 nt, Staphylococcus aureus subsp. aureus N315
uauauuucgguauuuuaaauuu

SEQ ID NO: 4048983 - RNA, 15 nt, Staphylococcus aureus subsp. aureus N315
uauauuuuaugucaa

SEQ ID NO: 4048984 - RNA, 13 nt, Staphylococcus aureus subsp. aureus N315
uauauuuuauuag

SEQ ID NO: 4048985 - RNA, 19 nt, Staphylococcus aureus subsp. aureus N315
uauauuuuauuuaaaaaua

SEQ ID NO: 4048986 - RNA, 15 nt, Staphylococcus aureus subsp. aureus N315
uauauuuuuaucauc

SEQ ID NO: 4048987 - RNA, 20 nt, Staphylococcus aureus subsp. aureus N315
uaucaaaaccgcuauaaaau

SEQ ID NO: 4048988 - RNA, 15 nt, Staphylococcus aureus subsp. aureus N315
uaucaaaauauaaaa

SEQ ID NO: 4048989 - RNA, 17 nt, Staphylococcus aureus subsp. aureus N315
uaucaaaauauaaaauc

SEQ ID NO: 4048990 - RNA, 18 nt, Staphylococcus aureus subsp. aureus N315
uaucaaacggaauuaaag

SEQ ID NO: 4048991 - RNA, 21 nt, Staphylococcus aureus subsp. aureus N315
uaucaaacuuggcaaugaaau

SEQ ID NO: 4048992 - RNA, 14 nt, Staphylococcus aureus subsp. aureus N315
uaucaacaauggaa

SEQ ID NO: 4048993 - RNA, 17 nt, Staphylococcus aureus subsp. aureus N315
uaucaacagcuucaaaa

SEQ ID NO: 4048994 - RNA, 18 nt, Staphylococcus aureus subsp. aureus N315
uaucaacauaaaauuuaa

SEQ ID NO: 4048995 - RNA, 16 nt, Staphylococcus aureus subsp. aureus N315
uaucaacauaauauuu

SEQ ID NO: 4048996 - RNA, 15 nt, Staphylococcus aureus subsp. aureus N315
uaucaacauauuuau

SEQ ID NO: 4048997 - RNA, 20 nt, Staphylococcus aureus subsp. aureus N315
uaucaacauuaauaaauaau

SEQ ID NO: 4048998 - RNA, 15 nt, Staphylococcus aureus subsp. aureus N315
uaucaagaaaaaguu

SEQ ID NO: 4048999 - RNA, 20 nt, Staphylococcus aureus subsp. aureus N315
uaucaagaaaaaguuuuucu

SEQ ID NO: 4049000 - RNA, 19 nt, Staphylococcus aureus subsp. aureus N315
uaucaagaauauaacgaau

SEQ ID NO: 4049001 - RNA, 16 nt, Staphylococcus aureus subsp. aureus N315
uaucaagauguuugca

SEQ ID NO: 4049002 - RNA, 22 nt, Staphylococcus aureus subsp. aureus N315
uaucaagauguuugcaacauau

SEQ ID NO: 4049003 - RNA, 23 nt, Staphylococcus aureus subsp. aureus N315
uaucaagauguuugcaacauauu

SEQ ID NO: 4049004 - RNA, 15 nt, Staphylococcus aureus subsp. aureus N315
uaucaauagaugaaa

SEQ ID NO: 4049005 - RNA, 14 nt, Staphylococcus aureus subsp. aureus N315
uaucaaugacaucc

SEQ ID NO: 4049006 - RNA, 15 nt, Staphylococcus aureus subsp. aureus N315
uaucaauugaaugaa

SEQ ID NO: 4049007 - RNA, 18 nt, Staphylococcus aureus subsp. aureus N315
uaucaauugaaugaagua

SEQ ID NO: 4049008 - RNA, 22 nt, Staphylococcus aureus subsp. aureus N315
uaucaauuucaacuuauaaaau

SEQ ID NO: 4049009 - RNA, 20 nt, Staphylococcus aureus subsp. aureus N315
uaucacauauuaugauacgc

SEQ ID NO: 4049010 - RNA, 17 nt, Staphylococcus aureus subsp. aureus N315
uaucacgagcuuuuaaa

SEQ ID NO: 4049011 - RNA, 15 nt, Staphylococcus aureus subsp. aureus N315
uaucacuaucagcuu

SEQ ID NO: 4049012 - RNA, 13 nt, Staphylococcus aureus subsp. aureus N315
uaucacuuauuau

SEQ ID NO: 4049013 - RNA, 16 nt, Staphylococcus aureus subsp. aureus N315
uaucagcuuuuucauu

SEQ ID NO: 4049014 - RNA, 15 nt, Staphylococcus aureus subsp. aureus N315
uaucaguaauaauac

SEQ ID NO: 4049015 - RNA, 18 nt, Staphylococcus aureus subsp. aureus N315
uaucagugugauuuugga

SEQ ID NO: 4049016 - RNA, 18 nt, Staphylococcus aureus subsp. aureus N315
uaucaguuauuuuaauaa

SEQ ID NO: 4049017 - RNA, 13 nt, Staphylococcus aureus subsp. aureus N315
uaucauaauauug

SEQ ID NO: 4049018 - RNA, 15 nt, Staphylococcus aureus subsp. aureus N315
uaucauaauauugau

SEQ ID NO: 4049019 - RNA, 22 nt, Staphylococcus aureus subsp. aureus N315
uaucauaauauugaugaauaaa

SEQ ID NO: 4049020 - RNA, 12 nt, Staphylococcus aureus subsp. aureus N315
uaucauaaucuu

SEQ ID NO: 4049021 - RNA, 23 nt, Staphylococcus aureus subsp. aureus N315
uaucauaccgacaccuauacaua

SEQ ID NO: 4049022 - RNA, 13 nt, Staphylococcus aureus subsp. aureus N315
uaucauacuucaa

SEQ ID NO: 4049023 - RNA, 14 nt, Staphylococcus aureus subsp. aureus N315
uaucauauucaaaa

SEQ ID NO: 4049024 - RNA, 12 nt, Staphylococcus aureus subsp. aureus N315
uaucauauuuga

SEQ ID NO: 4049025 - RNA, 19 nt, Staphylococcus aureus subsp. aureus N315
uaucaucauacuucaauaa

SEQ ID NO: 4049026 - RNA, 21 nt, Staphylococcus aureus subsp. aureus N315
uaucaucaugacuauuucgcu

SEQ ID NO: 4049027 - RNA, 16 nt, Staphylococcus aureus subsp. aureus N315
uaucaucauuuaaaua

SEQ ID NO: 4049028 - RNA, 22 nt, Staphylococcus aureus subsp. aureus N315
uaucauccacaaucacaguaug

SEQ ID NO: 4049029 - RNA, 17 nt, Staphylococcus aureus subsp. aureus N315
uaucaugaugauaaauu

SEQ ID NO: 4049030 - RNA, 14 nt, Staphylococcus aureus subsp. aureus N315
uaucaugauuaauu

SEQ ID NO: 4049031 - RNA, 15 nt, Staphylococcus aureus subsp. aureus N315
uaucaugcaaaauaa

SEQ ID NO: 4049032 - RNA, 16 nt, Staphylococcus aureus subsp. aureus N315
uaucaugcuuaucugu

SEQ ID NO: 4049033 - RNA, 21 nt, Staphylococcus aureus subsp. aureus N315
uaucaugcuuaucuguaaaua

SEQ ID NO: 4049034 - RNA, 17 nt, Staphylococcus aureus subsp. aureus N315
uaucauguucuuauaaa

SEQ ID NO: 4049035 - RNA, 13 nt, Staphylococcus aureus subsp. aureus N315
uaucauuaucaaa

SEQ ID NO: 4049036 - RNA, 22 nt, Staphylococcus aureus subsp. aureus N315
uaucauuaugcccgauaauucu

SEQ ID NO: 4049037 - RNA, 22 nt, Staphylococcus aureus subsp. aureus N315
uaucauuguguccauaaauauu

SEQ ID NO: 4049038 - RNA, 18 nt, Staphylococcus aureus subsp. aureus N315
uaucauuguucauacgcu

SEQ ID NO: 4049039 - RNA, 17 nt, Staphylococcus aureus subsp. aureus N315
uaucauuuaaaauauuu

SEQ ID NO: 4049040 - RNA, 23 nt, Staphylococcus aureus subsp. aureus N315
uaucauuuaaaauauuuuuucug

SEQ ID NO: 4049041 - RNA, 13 nt, Staphylococcus aureus subsp. aureus N315
uauccaaagacau

SEQ ID NO: 4049042 - RNA, 19 nt, Staphylococcus aureus subsp. aureus N315
uauccaaggauguuauaaa

SEQ ID NO: 4049043 - RNA, 20 nt, Staphylococcus aureus subsp. aureus N315
uauccaaggauguuauaaaa

SEQ ID NO: 4049044 - RNA, 21 nt, Staphylococcus aureus subsp. aureus N315
uauccaaggauguuauaaaau

SEQ ID NO: 4049045 - RNA, 20 nt, Staphylococcus aureus subsp. aureus N315
uauccauuaugauguagaug

SEQ ID NO: 4049046 - RNA, 20 nt, Staphylococcus aureus subsp. aureus N315
uauccauucaauguuuaauu

SEQ ID NO: 4049047 - RNA, 19 nt, Staphylococcus aureus subsp. aureus N315
uauccuaagcauaauucaa

SEQ ID NO: 4049048 - RNA, 17 nt, Staphylococcus aureus subsp. aureus N315
uauccucgguauuuaau

SEQ ID NO: 4049049 - RNA, 18 nt, Staphylococcus aureus subsp. aureus N315
uauccucgguauuuaaug

SEQ ID NO: 4049050 - RNA, 13 nt, Staphylococcus aureus subsp. aureus N315
uauccugauuuaa

SEQ ID NO: 4049051 - RNA, 14 nt, Staphylococcus aureus subsp. aureus N315
uauccugauuuaau

SEQ ID NO: 4049052 - RNA, 17 nt, Staphylococcus aureus subsp. aureus N315
uauccugauuuaauguu

SEQ ID NO: 4049053 - RNA, 16 nt, Staphylococcus aureus subsp. aureus N315
uauccuguguaaaaua

SEQ ID NO: 4049054 - RNA, 15 nt, Staphylococcus aureus subsp. aureus N315
uauccuucaaaaguu

SEQ ID NO: 4049055 - RNA, 14 nt, Staphylococcus aureus subsp. aureus N315
uauccuuuuugacu

SEQ ID NO: 4049056 - RNA, 15 nt, Staphylococcus aureus subsp. aureus N315
uauccuuuuugacuc

SEQ ID NO: 4049057 - RNA, 22 nt, Staphylococcus aureus subsp. aureus N315
uaucgaaagguauaucuucauu

SEQ ID NO: 4049058 - RNA, 21 nt, Staphylococcus aureus subsp. aureus N315
uaucgaagaaacauuauauaa

SEQ ID NO: 4049059 - RNA, 14 nt, Staphylococcus aureus subsp. aureus N315
uaucgauaguucua

SEQ ID NO: 4049060 - RNA, 21 nt, Staphylococcus aureus subsp. aureus N315
uaucgauaguucuauauaauu

SEQ ID NO: 4049061 - RNA, 14 nt, Staphylococcus aureus subsp. aureus N315
uaucgauuaucuga

SEQ ID NO: 4049062 - RNA, 17 nt, Staphylococcus aureus subsp. aureus N315
uaucgauucgauuauuu

SEQ ID NO: 4049063 - RNA, 19 nt, Staphylococcus aureus subsp. aureus N315
uaucgccuaaaaauaaaau

SEQ ID NO: 4049064 - RNA, 18 nt, Staphylococcus aureus subsp. aureus N315
uaucgccuggugcaggca

SEQ ID NO: 4049065 - RNA, 16 nt, Staphylococcus aureus subsp. aureus N315
uaucguaaacaacauc

SEQ ID NO: 4049066 - RNA, 13 nt, Staphylococcus aureus subsp. aureus N315
uaucgugaagaaa

SEQ ID NO: 4049067 - RNA, 17 nt, Staphylococcus aureus subsp. aureus N315
uaucuaaagcuauaaaa

SEQ ID NO: 4049068 - RNA, 22 nt, Staphylococcus aureus subsp. aureus N315
uaucuaaagcuauaaaaaaucu

SEQ ID NO: 4049069 - RNA, 15 nt, Staphylococcus aureus subsp. aureus N315
uaucuaaaucuucau

SEQ ID NO: 4049070 - RNA, 18 nt, Staphylococcus aureus subsp. aureus N315
uaucuaaaucuucaucau

SEQ ID NO: 4049071 - RNA, 20 nt, Staphylococcus aureus subsp. aureus N315
uaucuaacaaucguuuuaau

SEQ ID NO: 4049072 - RNA, 23 nt, Staphylococcus aureus subsp. aureus N315
uaucuaacaaucguuuuaaugcc

SEQ ID NO: 4049073 - RNA, 12 nt, Staphylococcus aureus subsp. aureus N315
uaucuacagaga

SEQ ID NO: 4049074 - RNA, 23 nt, Staphylococcus aureus subsp. aureus N315
uaucuacaugguuuucaccagac

SEQ ID NO: 4049075 - RNA, 16 nt, Staphylococcus aureus subsp. aureus N315
uaucuacauuaaagaa

SEQ ID NO: 4049076 - RNA, 22 nt, Staphylococcus aureus subsp. aureus N315
uaucuacauuaaagaaaauauc

SEQ ID NO: 4049077 - RNA, 16 nt, Staphylococcus aureus subsp. aureus N315
uaucuaccuuuuaauu

SEQ ID NO: 4049078 - RNA, 18 nt, Staphylococcus aureus subsp. aureus N315
uaucuacuauuuguuuua

SEQ ID NO: 4049079 - RNA, 16 nt, Staphylococcus aureus subsp. aureus N315
uaucuagccugaaaua

SEQ ID NO: 4049080 - RNA, 14 nt, Staphylococcus aureus subsp. aureus N315
uaucuagcugcuuc

SEQ ID NO: 4049081 - RNA, 16 nt, Staphylococcus aureus subsp. aureus N315
uaucuaguguucucau

SEQ ID NO: 4049082 - RNA, 23 nt, Staphylococcus aureus subsp. aureus N315
uaucuaguguucucauuauaaug

SEQ ID NO: 4049083 - RNA, 13 nt, Staphylococcus aureus subsp. aureus N315
uaucuauaaaaag

SEQ ID NO: 4049084 - RNA, 13 nt, Staphylococcus aureus subsp. aureus N315
uaucuaugaaauu

SEQ ID NO: 4049085 - RNA, 18 nt, Staphylococcus aureus subsp. aureus N315
uaucucaaagauuccugu

SEQ ID NO: 4049086 - RNA, 18 nt, Staphylococcus aureus subsp. aureus N315
uaucuccgcuacaauuau

SEQ ID NO: 4049087 - RNA, 23 nt, Staphylococcus aureus subsp. aureus N315
uaucuccgcuacaauuauaugua

SEQ ID NO: 4049088 - RNA, 19 nt, Staphylococcus aureus subsp. aureus N315
uaucucugaaaaacuucuu

SEQ ID NO: 4049089 - RNA, 19 nt, Staphylococcus aureus subsp. aureus N315
uaucucuuuucuauucaaa

SEQ ID NO: 4049090 - RNA, 18 nt, Staphylococcus aureus subsp. aureus N315
uaucugacauuguugcua

SEQ ID NO: 4049091 - RNA, 14 nt, Staphylococcus aureus subsp. aureus N315
uaucugacauuuaa

SEQ ID NO: 4049092 - RNA, 14 nt, Staphylococcus aureus subsp. aureus N315
uaucugcuuuucua

SEQ ID NO: 4049093 - RNA, 19 nt, Staphylococcus aureus subsp. aureus N315
uaucuguaccguauuuuaa

SEQ ID NO: 4049094 - RNA, 15 nt, Staphylococcus aureus subsp. aureus N315
uaucuguaucaaaau

SEQ ID NO: 4049095 - RNA, 12 nt, Staphylococcus aureus subsp. aureus N315
uaucuguuguua

SEQ ID NO: 4049096 - RNA, 16 nt, Staphylococcus aureus subsp. aureus N315
uaucuguuguuauaua

SEQ ID NO: 4049097 - RNA, 19 nt, Staphylococcus aureus subsp. aureus N315
uaucuguuguuauauaaau

SEQ ID NO: 4049098 - RNA, 12 nt, Staphylococcus aureus subsp. aureus N315
uaucuguuucua

SEQ ID NO: 4049099 - RNA, 14 nt, Staphylococcus aureus subsp. aureus N315
uaucuuacugcugu

SEQ ID NO: 4049100 - RNA, 17 nt, Staphylococcus aureus subsp. aureus N315
uaucuuauaacaaaaau

SEQ ID NO: 4049101 - RNA, 18 nt, Staphylococcus aureus subsp. aureus N315
uaucuuauaacaaaaauu

SEQ ID NO: 4049102 - RNA, 14 nt, Staphylococcus aureus subsp. aureus N315
uaucuuauauucuu

SEQ ID NO: 4049103 - RNA, 15 nt, Staphylococcus aureus subsp. aureus N315
uaucuucuaauucca

SEQ ID NO: 4049104 - RNA, 12 nt, Staphylococcus aureus subsp. aureus N315
uaucuucuucua

SEQ ID NO: 4049105 - RNA, 18 nt, Staphylococcus aureus subsp. aureus N315
uaucuucuuuuaauauuu

SEQ ID NO: 4049106 - RNA, 14 nt, Staphylococcus aureus subsp. aureus N315
uaucuugauuuaaa

SEQ ID NO: 4049107 - RNA, 18 nt, Staphylococcus aureus subsp. aureus N315
uaucuugauuuaaaccau

SEQ ID NO: 4049108 - RNA, 19 nt, Staphylococcus aureus subsp. aureus N315
uaucuugauuuaaaccauc

SEQ ID NO: 4049109 - RNA, 22 nt, Staphylococcus aureus subsp. aureus N315
uaucuuuacgauaaacuaaaaa

SEQ ID NO: 4049110 - RNA, 16 nt, Staphylococcus aureus subsp. aureus N315
uaucuuuaucauuauu

SEQ ID NO: 4049111 - RNA, 17 nt, Staphylococcus aureus subsp. aureus N315
uaucuuuauuugauucu

SEQ ID NO: 4049112 - RNA, 14 nt, Staphylococcus aureus subsp. aureus N315
uaucuuucaauuaa

SEQ ID NO: 4049113 - RNA, 14 nt, Staphylococcus aureus subsp. aureus N315
uaucuuuugcuucg

SEQ ID NO: 4049114 - RNA, 23 nt, Staphylococcus aureus subsp. aureus N315
uaugaaaagagaaacaaaacaaa

SEQ ID NO: 4049115 - RNA, 13 nt, Staphylococcus aureus subsp. aureus N315
uaugaaaaguaaa

SEQ ID NO: 4049116 - RNA, 15 nt, Staphylococcus aureus subsp. aureus N315
uaugaauaaccaucu

SEQ ID NO: 4049117 - RNA, 14 nt, Staphylococcus aureus subsp. aureus N315
uaugaauagaugau

SEQ ID NO: 4049118 - RNA, 16 nt, Staphylococcus aureus subsp. aureus N315
uaugaaucgauauaau

SEQ ID NO: 4049119 - RNA, 22 nt, Staphylococcus aureus subsp. aureus N315
uaugaauggcaaucuauauaaa

SEQ ID NO: 4049120 - RNA, 17 nt, Staphylococcus aureus subsp. aureus N315
uaugaauuauuaauaag

SEQ ID NO: 4049121 - RNA, 17 nt, Staphylococcus aureus subsp. aureus N315
uaugaauugaguauuaa

SEQ ID NO: 4049122 - RNA, 21 nt, Staphylococcus aureus subsp. aureus N315
uaugaauugaguauuaaauuu

SEQ ID NO: 4049123 - RNA, 23 nt, Staphylococcus aureus subsp. aureus N315
uaugaauuuagaugcauaaaaaa

SEQ ID NO: 4049124 - RNA, 12 nt, Staphylococcus aureus subsp. aureus N315
uaugacaacaua

SEQ ID NO: 4049125 - RNA, 21 nt, Staphylococcus aureus subsp. aureus N315
uaugacgcgugaauuaaaaaa

SEQ ID NO: 4049126 - RNA, 22 nt, Staphylococcus aureus subsp. aureus N315
uaugacuaacgaaaaagauggu

SEQ ID NO: 4049127 - RNA, 19 nt, Staphylococcus aureus subsp. aureus N315
uaugacugcaaauacgagu

SEQ ID NO: 4049128 - RNA, 18 nt, Staphylococcus aureus subsp. aureus N315
uaugacugcuuuuuauua

SEQ ID NO: 4049129 - RNA, 18 nt, Staphylococcus aureus subsp. aureus N315
uaugacuuauuuuucauc

SEQ ID NO: 4049130 - RNA, 17 nt, Staphylococcus aureus subsp. aureus N315
uaugagcuuaauaaauu

SEQ ID NO: 4049131 - RNA, 15 nt, Staphylococcus aureus subsp. aureus N315
uaugagugauagaaa

SEQ ID NO: 4049132 - RNA, 15 nt, Staphylococcus aureus subsp. aureus N315
uaugauaauaagaau

SEQ ID NO: 4049133 - RNA, 21 nt, Staphylococcus aureus subsp. aureus N315
uaugauaaucguuuuuacugu

SEQ ID NO: 4049134 - RNA, 16 nt, Staphylococcus aureus subsp. aureus N315
uaugauaauuaauuaa

SEQ ID NO: 4049135 - RNA, 19 nt, Staphylococcus aureus subsp. aureus N315
uaugauaauuaauuaaaau

SEQ ID NO: 4049136 - RNA, 20 nt, Staphylococcus aureus subsp. aureus N315
uaugauaauuaauuaaaauu

SEQ ID NO: 4049137 - RNA, 22 nt, Staphylococcus aureus subsp. aureus N315
uaugauagaauacuaaaagugu

SEQ ID NO: 4049138 - RNA, 19 nt, Staphylococcus aureus subsp. aureus N315
uaugauauauguaacauaa

SEQ ID NO: 4049139 - RNA, 14 nt, Staphylococcus aureus subsp. aureus N315
uaugauauugauug

SEQ ID NO: 4049140 - RNA, 14 nt, Staphylococcus aureus subsp. aureus N315
uaugaugcuucuaa

SEQ ID NO: 4049141 - RNA, 16 nt, Staphylococcus aureus subsp. aureus N315
uaugaugggaaaaaau

SEQ ID NO: 4049142 - RNA, 15 nt, Staphylococcus aureus subsp. aureus N315
uaugauguuaaaaaa

SEQ ID NO: 4049143 - RNA, 16 nt, Staphylococcus aureus subsp. aureus N315
uaugauguuaaaaaau

SEQ ID NO: 4049144 - RNA, 12 nt, Staphylococcus aureus subsp. aureus N315
uaugauguucaa

SEQ ID NO: 4049145 - RNA, 19 nt, Staphylococcus aureus subsp. aureus N315
uaugauuaauaaaguaauc

SEQ ID NO: 4049146 - RNA, 20 nt, Staphylococcus aureus subsp. aureus N315
uaugauuaggauuagcguua

SEQ ID NO: 4049147 - RNA, 23 nt, Staphylococcus aureus subsp. aureus N315
uaugauucuaacggcguuuguuu

SEQ ID NO: 4049148 - RNA, 17 nt, Staphylococcus aureus subsp. aureus N315
uaugauuuaaaauauaa

SEQ ID NO: 4049149 - RNA, 23 nt, Staphylococcus aureus subsp. aureus N315
uaugauuugccccgccauucaua

SEQ ID NO: 4049150 - RNA, 12 nt, Staphylococcus aureus subsp. aureus N315
uaugauuuguuu

SEQ ID NO: 4049151 - RNA, 22 nt, Staphylococcus aureus subsp. aureus N315
uaugauuuucuuuaauaacuaa

SEQ ID NO: 4049152 - RNA, 16 nt, Staphylococcus aureus subsp. aureus N315
uaugcaaaugaaauuc

SEQ ID NO: 4049153 - RNA, 20 nt, Staphylococcus aureus subsp. aureus N315
uaugcaaugcaccuauaaua

SEQ ID NO: 4049154 - RNA, 16 nt, Staphylococcus aureus subsp. aureus N315
uaugcacaucauugau

SEQ ID NO: 4049155 - RNA, 20 nt, Staphylococcus aureus subsp. aureus N315
uaugcauaauaccaauugcu

SEQ ID NO: 4049156 - RNA, 19 nt, Staphylococcus aureus subsp. aureus N315
uaugcaugccagaugcaau

SEQ ID NO: 4049157 - RNA, 18 nt, Staphylococcus aureus subsp. aureus N315
uaugccaaauaacguuaa

SEQ ID NO: 4049158 - RNA, 15 nt, Staphylococcus aureus subsp. aureus N315
uaugccauucauuaa

SEQ ID NO: 4049159 - RNA, 18 nt, Staphylococcus aureus subsp. aureus N315
uaugccgccuaauaauaa

SEQ ID NO: 4049160 - RNA, 22 nt, Staphylococcus aureus subsp. aureus N315
uaugcguagcaacauuauuuuu

SEQ ID NO: 4049161 - RNA, 17 nt, Staphylococcus aureus subsp. aureus N315
uaugcuaaacuugcauc

SEQ ID NO: 4049162 - RNA, 21 nt, Staphylococcus aureus subsp. aureus N315
uaugcucuacaaaguuauaau

SEQ ID NO: 4049163 - RNA, 19 nt, Staphylococcus aureus subsp. aureus N315
uaugcugcaagucucauau

SEQ ID NO: 4049164 - RNA, 15 nt, Staphylococcus aureus subsp. aureus N315
uaugcuguguaucau

SEQ ID NO: 4049165 - RNA, 21 nt, Staphylococcus aureus subsp. aureus N315
uaugcuguuggcaaaacaaua

SEQ ID NO: 4049166 - RNA, 22 nt, Staphylococcus aureus subsp. aureus N315
uaugcuguuggcaaaacaauau

SEQ ID NO: 4049167 - RNA, 22 nt, Staphylococcus aureus subsp. aureus N315
uaugcuuuacuugcuuuuucaa

SEQ ID NO: 4049168 - RNA, 16 nt, Staphylococcus aureus subsp. aureus N315
uaugcuuuuaauagug

SEQ ID NO: 4049169 - RNA, 19 nt, Staphylococcus aureus subsp. aureus N315
uauggaaaauguuaucaau

SEQ ID NO: 4049170 - RNA, 16 nt, Staphylococcus aureus subsp. aureus N315
uauggauaaaauuuaa

SEQ ID NO: 4049171 - RNA, 22 nt, Staphylococcus aureus subsp. aureus N315
uaugguauuuacccaacauauc

SEQ ID NO: 4049172 - RNA, 13 nt, Staphylococcus aureus subsp. aureus N315
uaugguuagagaa

SEQ ID NO: 4049173 - RNA, 15 nt, Staphylococcus aureus subsp. aureus N315
uaugguuagagaaaa

SEQ ID NO: 4049174 - RNA, 15 nt, Staphylococcus aureus subsp. aureus N315
uaugguucguccauu

SEQ ID NO: 4049175 - RNA, 12 nt, Staphylococcus aureus subsp. aureus N315
uauguaaaaaau

SEQ ID NO: 4049176 - RNA, 23 nt, Staphylococcus aureus subsp. aureus N315
uauguaacaauuuagcaaauauu

SEQ ID NO: 4049177 - RNA, 14 nt, Staphylococcus aureus subsp. aureus N315
uauguaaucagagu

SEQ ID NO: 4049178 - RNA, 15 nt, Staphylococcus aureus subsp. aureus N315
uauguagaauuucuu

SEQ ID NO: 4049179 - RNA, 20 nt, Staphylococcus aureus subsp. aureus N315
uauguagcaggcaacuuuua

SEQ ID NO: 4049180 - RNA, 22 nt, Staphylococcus aureus subsp. aureus N315
uaugucaauagcgguuuaaaaa

SEQ ID NO: 4049181 - RNA, 17 nt, Staphylococcus aureus subsp. aureus N315
uaugucauauacuauau

SEQ ID NO: 4049182 - RNA, 18 nt, Staphylococcus aureus subsp. aureus N315
uaugucaucuucaauucu

SEQ ID NO: 4049183 - RNA, 22 nt, Staphylococcus aureus subsp. aureus N315
uaugucauucuaguagcuagaa

SEQ ID NO: 4049184 - RNA, 21 nt, Staphylococcus aureus subsp. aureus N315
uaugucccaaugcugaauaaa

SEQ ID NO: 4049185 - RNA, 20 nt, Staphylococcus aureus subsp. aureus N315
uaugucuagacuuauuugaa

SEQ ID NO: 4049186 - RNA, 21 nt, Staphylococcus aureus subsp. aureus N315
uaugucuagacuuauuugaau

SEQ ID NO: 4049187 - RNA, 16 nt, Staphylococcus aureus subsp. aureus N315
uaugucucucuuucuu

SEQ ID NO: 4049188 - RNA, 21 nt, Staphylococcus aureus subsp. aureus N315
uaugucucucuuucuuauuca

SEQ ID NO: 4049189 - RNA, 21 nt, Staphylococcus aureus subsp. aureus N315
uaugugcaugagacuuauuca

SEQ ID NO: 4049190 - RNA, 15 nt, Staphylococcus aureus subsp. aureus N315
uauguguuucuagcu

SEQ ID NO: 4049191 - RNA, 19 nt, Staphylococcus aureus subsp. aureus N315
uauguuaaugucuuaaaau

SEQ ID NO: 4049192 - RNA, 18 nt, Staphylococcus aureus subsp. aureus N315
uauguuacuuauauauuc

SEQ ID NO: 4049193 - RNA, 21 nt, Staphylococcus aureus subsp. aureus N315
uauguuacuuauauauucaau

SEQ ID NO: 4049194 - RNA, 15 nt, Staphylococcus aureus subsp. aureus N315
uauguuauauuaaac

SEQ ID NO: 4049195 - RNA, 17 nt, Staphylococcus aureus subsp. aureus N315
uauguucagaaauuuaa

SEQ ID NO: 4049196 - RNA, 21 nt, Staphylococcus aureus subsp. aureus N315
uauguugaaagugacacugua

SEQ ID NO: 4049197 - RNA, 20 nt, Staphylococcus aureus subsp. aureus N315
uauguugugcugccaaauau

SEQ ID NO: 4049198 - RNA, 13 nt, Staphylococcus aureus subsp. aureus N315
uauguuguuucua

SEQ ID NO: 4049199 - RNA, 16 nt, Staphylococcus aureus subsp. aureus N315
uauguuguuucuaaug

SEQ ID NO: 4049200 - RNA, 13 nt, Staphylococcus aureus subsp. aureus N315
uauguuuuaucaa

SEQ ID NO: 4049201 - RNA, 15 nt, Staphylococcus aureus subsp. aureus N315
uauguuuuauuuucu

SEQ ID NO: 4049202 - RNA, 22 nt, Staphylococcus aureus subsp. aureus N315
uauuaaaagcaugauacucaau

SEQ ID NO: 4049203 - RNA, 17 nt, Staphylococcus aureus subsp. aureus N315
uauuaaaauaaaccacg

SEQ ID NO: 4049204 - RNA, 16 nt, Staphylococcus aureus subsp. aureus N315
uauuaaaauuaaaacu

SEQ ID NO: 4049205 - RNA, 22 nt, Staphylococcus aureus subsp. aureus N315
uauuaaacauuuuugaauuuaa

SEQ ID NO: 4049206 - RNA, 23 nt, Staphylococcus aureus subsp. aureus N315
uauuaaaguaaaauauacuugaa

SEQ ID NO: 4049207 - RNA, 17 nt, Staphylococcus aureus subsp. aureus N315
uauuaaauauaugcgua

SEQ ID NO: 4049208 - RNA, 20 nt, Staphylococcus aureus subsp. aureus N315
uauuaaauuuguguucaaau

SEQ ID NO: 4049209 - RNA, 13 nt, Staphylococcus aureus subsp. aureus N315
uauuaacuuuaau

SEQ ID NO: 4049210 - RNA, 18 nt, Staphylococcus aureus subsp. aureus N315
uauuaagcuauacucauu

SEQ ID NO: 4049211 - RNA, 22 nt, Staphylococcus aureus subsp. aureus N315
uauuaagcuauacucauuuucu

SEQ ID NO: 4049212 - RNA, 24 nt, Staphylococcus aureus subsp. aureus N315
uauuaaggggguaauacuauauga

SEQ ID NO: 4049213 - RNA, 16 nt, Staphylococcus aureus subsp. aureus N315
uauuaaguauaucuuu

SEQ ID NO: 4049214 - RNA, 21 nt, Staphylococcus aureus subsp. aureus N315
uauuaaucauaaugaauaauu

SEQ ID NO: 4049215 - RNA, 13 nt, Staphylococcus aureus subsp. aureus N315
uauuaaugaauau

SEQ ID NO: 4049216 - RNA, 17 nt, Staphylococcus aureus subsp. aureus N315
uauuaaugauugacgau

SEQ ID NO: 4049217 - RNA, 14 nt, Staphylococcus aureus subsp. aureus N315
uauuaauuuacuca

SEQ ID NO: 4049218 - RNA, 12 nt, Staphylococcus aureus subsp. aureus N315
uauuaauuucau

SEQ ID NO: 4049219 - RNA, 16 nt, Staphylococcus aureus subsp. aureus N315
uauuaauuucauugua

SEQ ID NO: 4049220 - RNA, 17 nt, Staphylococcus aureus subsp. aureus N315
uauuaauuugauaaaug

SEQ ID NO: 4049221 - RNA, 13 nt, Staphylococcus aureus subsp. aureus N315
uauuacauaauuu

SEQ ID NO: 4049222 - RNA, 17 nt, Staphylococcus aureus subsp. aureus N315
uauuacuaaccuauuaa

SEQ ID NO: 4049223 - RNA, 21 nt, Staphylococcus aureus subsp. aureus N315
uauuacuaaccuauuaaaaua

SEQ ID NO: 4049224 - RNA, 21 nt, Staphylococcus aureus subsp. aureus N315
uauuacuacauaauuuaucaa

SEQ ID NO: 4049225 - RNA, 22 nt, Staphylococcus aureus subsp. aureus N315
uauuacuacauaauuuaucaau

SEQ ID NO: 4049226 - RNA, 12 nt, Staphylococcus aureus subsp. aureus N315
uauuacuauaaa

SEQ ID NO: 4049227 - RNA, 19 nt, Staphylococcus aureus subsp. aureus N315
uauuacuauaaaaaacagc

SEQ ID NO: 4049228 - RNA, 15 nt, Staphylococcus aureus subsp. aureus N315
uauuacuuauuucuu

SEQ ID NO: 4049229 - RNA, 16 nt, Staphylococcus aureus subsp. aureus N315
uauuacuuauuucuuu

SEQ ID NO: 4049230 - RNA, 20 nt, Staphylococcus aureus subsp. aureus N315
uauuacuuauuucuuuucau

SEQ ID NO: 4049231 - RNA, 14 nt, Staphylococcus aureus subsp. aureus N315
uauuacuugaaaau

SEQ ID NO: 4049232 - RNA, 16 nt, Staphylococcus aureus subsp. aureus N315
uauuagagcagauucu

SEQ ID NO: 4049233 - RNA, 14 nt, Staphylococcus aureus subsp. aureus N315
uauuagauauauuu

SEQ ID NO: 4049234 - RNA, 16 nt, Staphylococcus aureus subsp. aureus N315
uauuaggcuuaaauau

SEQ ID NO: 4049235 - RNA, 14 nt, Staphylococcus aureus subsp. aureus N315
uauuaguauucaaa

SEQ ID NO: 4049236 - RNA, 21 nt, Staphylococcus aureus subsp. aureus N315
uauuauaaaaacagcagugaa

SEQ ID NO: 4049237 - RNA, 19 nt, Staphylococcus aureus subsp. aureus N315
uauuauaaaauaaauauaa

SEQ ID NO: 4049238 - RNA, 16 nt, Staphylococcus aureus subsp. aureus N315
uauuauaaauauuuuu

SEQ ID NO: 4049239 - RNA, 15 nt, Staphylococcus aureus subsp. aureus N315
uauuauaauuguuca

SEQ ID NO: 4049240 - RNA, 14 nt, Staphylococcus aureus subsp. aureus N315
uauuauaauuuugu

SEQ ID NO: 4049241 - RNA, 15 nt, Staphylococcus aureus subsp. aureus N315
uauuauaguuuagau

SEQ ID NO: 4049242 - RNA, 17 nt, Staphylococcus aureus subsp. aureus N315
uauuauauaauaagaga

SEQ ID NO: 4049243 - RNA, 19 nt, Staphylococcus aureus subsp. aureus N315
uauuaucaaagaaauguau

SEQ ID NO: 4049244 - RNA, 20 nt, Staphylococcus aureus subsp. aureus N315
uauuaucuauccauuugguu

SEQ ID NO: 4049245 - RNA, 21 nt, Staphylococcus aureus subsp. aureus N315
uauuaucuuuaauuuacaauu

SEQ ID NO: 4049246 - RNA, 17 nt, Staphylococcus aureus subsp. aureus N315
uauuaugaauuauuaau

SEQ ID NO: 4049247 - RNA, 22 nt, Staphylococcus aureus subsp. aureus N315
uauuaugauugcuuauuuauuu

SEQ ID NO: 4049248 - RNA, 16 nt, Staphylococcus aureus subsp. aureus N315
uauuaugccuuugauu

SEQ ID NO: 4049249 - RNA, 23 nt, Staphylococcus aureus subsp. aureus N315
uauuauguuauaaauucuaucua

SEQ ID NO: 4049250 - RNA, 14 nt, Staphylococcus aureus subsp. aureus N315
uauuauuauaauuu

SEQ ID NO: 4049251 - RNA, 14 nt, Staphylococcus aureus subsp. aureus N315
uauuauuaugugua

SEQ ID NO: 4049252 - RNA, 15 nt, Staphylococcus aureus subsp. aureus N315
uauuauuauguuaua

SEQ ID NO: 4049253 - RNA, 15 nt, Staphylococcus aureus subsp. aureus N315
uauuauuauugaaau

SEQ ID NO: 4049254 - RNA, 17 nt, Staphylococcus aureus subsp. aureus N315
uauuauuggauuugaag

SEQ ID NO: 4049255 - RNA, 13 nt, Staphylococcus aureus subsp. aureus N315
uauuauugucauc

SEQ ID NO: 4049256 - RNA, 16 nt, Staphylococcus aureus subsp. aureus N315
uauuauugucaucaug

SEQ ID NO: 4049257 - RNA, 16 nt, Staphylococcus aureus subsp. aureus N315
uauuauugugaaaucu

SEQ ID NO: 4049258 - RNA, 19 nt, Staphylococcus aureus subsp. aureus N315
uauuauuuaaauuuucauc

SEQ ID NO: 4049259 - RNA, 18 nt, Staphylococcus aureus subsp. aureus N315
uauuauuuuaauagcauu

SEQ ID NO: 4049260 - RNA, 17 nt, Staphylococcus aureus subsp. aureus N315
uauucaaaaaauauuua

SEQ ID NO: 4049261 - RNA, 17 nt, Staphylococcus aureus subsp. aureus N315
uauucaaaguuuucauu

SEQ ID NO: 4049262 - RNA, 21 nt, Staphylococcus aureus subsp. aureus N315
uauucaacagggguaaaacuu

SEQ ID NO: 4049263 - RNA, 14 nt, Staphylococcus aureus subsp. aureus N315
uauucaauaauuau

SEQ ID NO: 4049264 - RNA, 19 nt, Staphylococcus aureus subsp. aureus N315
uauucaaugauuaguaaug

SEQ ID NO: 4049265 - RNA, 21 nt, Staphylococcus aureus subsp. aureus N315
uauuccaaauuugaaacaaug

SEQ ID NO: 4049266 - RNA, 21 nt, Staphylococcus aureus subsp. aureus N315
uauuccgaacauguuucuaga

SEQ ID NO: 4049267 - RNA, 17 nt, Staphylococcus aureus subsp. aureus N315
uauuccuaauaaauauc

SEQ ID NO: 4049268 - RNA, 16 nt, Staphylococcus aureus subsp. aureus N315
uauuccuucuaacaua

SEQ ID NO: 4049269 - RNA, 17 nt, Staphylococcus aureus subsp. aureus N315
uauucgauaauauaacu

SEQ ID NO: 4049270 - RNA, 20 nt, Staphylococcus aureus subsp. aureus N315
uauucgauacauaaaacauc

SEQ ID NO: 4049271 - RNA, 14 nt, Staphylococcus aureus subsp. aureus N315
uauucgcaccacug

SEQ ID NO: 4049272 - RNA, 21 nt, Staphylococcus aureus subsp. aureus N315
uauucguaucuaguguucuca

SEQ ID NO: 4049273 - RNA, 16 nt, Staphylococcus aureus subsp. aureus N315
uauucuaaaaaauuaa

SEQ ID NO: 4049274 - RNA, 20 nt, Staphylococcus aureus subsp. aureus N315
uauucuaaaaaauuaaaaau

SEQ ID NO: 4049275 - RNA, 16 nt, Staphylococcus aureus subsp. aureus N315
uauucuaaauauauuu

SEQ ID NO: 4049276 - RNA, 14 nt, Staphylococcus aureus subsp. aureus N315
uauucuaaguuaaa

SEQ ID NO: 4049277 - RNA, 22 nt, Staphylococcus aureus subsp. aureus N315
uauucucugcuucuaaaacauc

SEQ ID NO: 4049278 - RNA, 18 nt, Staphylococcus aureus subsp. aureus N315
uauucugagauugagaau

SEQ ID NO: 4049279 - RNA, 20 nt, Staphylococcus aureus subsp. aureus N315
uauucuggaugguuaucacu

SEQ ID NO: 4049280 - RNA, 10 nt, Staphylococcus aureus subsp. aureus N315
uauucuguaa

SEQ ID NO: 4049281 - RNA, 17 nt, Staphylococcus aureus subsp. aureus N315
uauucuguaacguuacu

SEQ ID NO: 4049282 - RNA, 14 nt, Staphylococcus aureus subsp. aureus N315
uauucuuaauuuaa

SEQ ID NO: 4049283 - RNA, 16 nt, Staphylococcus aureus subsp. aureus N315
uauucuuggcguauuu

SEQ ID NO: 4049284 - RNA, 15 nt, Staphylococcus aureus subsp. aureus N315
uauucuuucucuauu

SEQ ID NO: 4049285 - RNA, 12 nt, Staphylococcus aureus subsp. aureus N315
uauucuuugauu

SEQ ID NO: 4049286 - RNA, 12 nt, Staphylococcus aureus subsp. aureus N315
uauugaaacuaa

SEQ ID NO: 4049287 - RNA, 18 nt, Staphylococcus aureus subsp. aureus N315
uauugaaacuaauaauuu

SEQ ID NO: 4049288 - RNA, 19 nt, Staphylococcus aureus subsp. aureus N315
uauugaaaguguaugcaug

SEQ ID NO: 4049289 - RNA, 18 nt, Staphylococcus aureus subsp. aureus N315
uauugaaaucgauacuaa

SEQ ID NO: 4049290 - RNA, 16 nt, Staphylococcus aureus subsp. aureus N315
uauugaaaugagcuua

SEQ ID NO: 4049291 - RNA, 18 nt, Staphylococcus aureus subsp. aureus N315
uauugaauauaaaaaaca

SEQ ID NO: 4049292 - RNA, 22 nt, Staphylococcus aureus subsp. aureus N315
uauugaauggaguauaucagcu

SEQ ID NO: 4049293 - RNA, 12 nt, Staphylococcus aureus subsp. aureus N315
uauugaauggcu

SEQ ID NO: 4049294 - RNA, 21 nt, Staphylococcus aureus subsp. aureus N315
uauugaauuugaauaaguggu

SEQ ID NO: 4049295 - RNA, 15 nt, Staphylococcus aureus subsp. aureus N315
uauugagaauauuaa

SEQ ID NO: 4049296 - RNA, 13 nt, Staphylococcus aureus subsp. aureus N315
uauugauauucua

SEQ ID NO: 4049297 - RNA, 19 nt, Staphylococcus aureus subsp. aureus N315
uauugauauucuaaaaaau

SEQ ID NO: 4049298 - RNA, 23 nt, Staphylococcus aureus subsp. aureus N315
uauugaucugauuucacuucuaa

SEQ ID NO: 4049299 - RNA, 22 nt, Staphylococcus aureus subsp. aureus N315
uauugaugaaaacaaacaagca

SEQ ID NO: 4049300 - RNA, 21 nt, Staphylococcus aureus subsp. aureus N315
uauugauuugauucauuacau

SEQ ID NO: 4049301 - RNA, 23 nt, Staphylococcus aureus subsp. aureus N315
uauugauuugauucauuacaugu

SEQ ID NO: 4049302 - RNA, 15 nt, Staphylococcus aureus subsp. aureus N315
uauugcaaaaauaau

SEQ ID NO: 4049303 - RNA, 23 nt, Staphylococcus aureus subsp. aureus N315
uauugccgguuaaauuauuuaau

SEQ ID NO: 4049304 - RNA, 23 nt, Staphylococcus aureus subsp. aureus N315
uauugccguuauuuucaauaaau

SEQ ID NO: 4049305 - RNA, 20 nt, Staphylococcus aureus subsp. aureus N315
uauugccuaaccuguuugag

SEQ ID NO: 4049306 - RNA, 22 nt, Staphylococcus aureus subsp. aureus N315
uauuggguggucguaauuuggu

SEQ ID NO: 4049307 - RNA, 16 nt, Staphylococcus aureus subsp. aureus N315
uauuggucauuacuaa

SEQ ID NO: 4049308 - RNA, 18 nt, Staphylococcus aureus subsp. aureus N315
uauuggucauuacuaaaa

SEQ ID NO: 4049309 - RNA, 13 nt, Staphylococcus aureus subsp. aureus N315
uauugguugaaau

SEQ ID NO: 4049310 - RNA, 17 nt, Staphylococcus aureus subsp. aureus N315
uauugguugaaauuaau

SEQ ID NO: 4049311 - RNA, 13 nt, Staphylococcus aureus subsp. aureus N315
uauuguaaucacu

SEQ ID NO: 4049312 - RNA, 13 nt, Staphylococcus aureus subsp. aureus N315
uauugucaucaug

SEQ ID NO: 4049313 - RNA, 16 nt, Staphylococcus aureus subsp. aureus N315
uauugugccgcuucua

SEQ ID NO: 4049314 - RNA, 22 nt, Staphylococcus aureus subsp. aureus N315
uauuguuaaacuagaaaacaua

SEQ ID NO: 4049315 - RNA, 23 nt, Staphylococcus aureus subsp. aureus N315
uauuguuaaacuagaaaacauaa

SEQ ID NO: 4049316 - RNA, 14 nt, Staphylococcus aureus subsp. aureus N315
uauuguuugaaaau

SEQ ID NO: 4049317 - RNA, 20 nt, Staphylococcus aureus subsp. aureus N315
uauuguuugaaaauuaacua

SEQ ID NO: 4049318 - RNA, 19 nt, Staphylococcus aureus subsp. aureus N315
uauuguuuguuuuuauagu

SEQ ID NO: 4049319 - RNA, 15 nt, Staphylococcus aureus subsp. aureus N315
uauuguuuucaucau

SEQ ID NO: 4049320 - RNA, 14 nt, Staphylococcus aureus subsp. aureus N315
uauuguuuuuaaaa

SEQ ID NO: 4049321 - RNA, 18 nt, Staphylococcus aureus subsp. aureus N315
uauuuaaaacuuguaaau

SEQ ID NO: 4049322 - RNA, 19 nt, Staphylococcus aureus subsp. aureus N315
uauuuaaaauauuauuuuu

SEQ ID NO: 4049323 - RNA, 19 nt, Staphylococcus aureus subsp. aureus N315
uauuuaaaaugcuuguuca

SEQ ID NO: 4049324 - RNA, 20 nt, Staphylococcus aureus subsp. aureus N315
uauuuaaaaugcuuguucaa

SEQ ID NO: 4049325 - RNA, 16 nt, Staphylococcus aureus subsp. aureus N315
uauuuaaacuaguaau

SEQ ID NO: 4049326 - RNA, 21 nt, Staphylococcus aureus subsp. aureus N315
uauuuaaacuaguaauagaau

SEQ ID NO: 4049327 - RNA, 21 nt, Staphylococcus aureus subsp. aureus N315
uauuuaaacucucuaaaaagc

SEQ ID NO: 4049328 - RNA, 20 nt, Staphylococcus aureus subsp. aureus N315
uauuuaacacuucaguuaaa

SEQ ID NO: 4049329 - RNA, 17 nt, Staphylococcus aureus subsp. aureus N315
uauuuaacaucaauuac

SEQ ID NO: 4049330 - RNA, 21 nt, Staphylococcus aureus subsp. aureus N315
uauuuaacaucaauuacucuu

SEQ ID NO: 4049331 - RNA, 16 nt, Staphylococcus aureus subsp. aureus N315
uauuuaauuuugauau

SEQ ID NO: 4049332 - RNA, 19 nt, Staphylococcus aureus subsp. aureus N315
uauuuaauuuugauauuuu

SEQ ID NO: 4049333 - RNA, 15 nt, Staphylococcus aureus subsp. aureus N315
uauuuaauuuuucua

SEQ ID NO: 4049334 - RNA, 18 nt, Staphylococcus aureus subsp. aureus N315
uauuuaauuuuuuacuuu

SEQ ID NO: 4049335 - RNA, 22 nt, Staphylococcus aureus subsp. aureus N315
uauuuacaauguuaucuugcuu

SEQ ID NO: 4049336 - RNA, 19 nt, Staphylococcus aureus subsp. aureus N315
uauuuaccacaaauaucaa

SEQ ID NO: 4049337 - RNA, 20 nt, Staphylococcus aureus subsp. aureus N315
uauuuaccacaaauaucaau

SEQ ID NO: 4049338 - RNA, 13 nt, Staphylococcus aureus subsp. aureus N315
uauuuacccaaca

SEQ ID NO: 4049339 - RNA, 19 nt, Staphylococcus aureus subsp. aureus N315
uauuuacccaacauaucac

SEQ ID NO: 4049340 - RNA, 16 nt, Staphylococcus aureus subsp. aureus N315
uauuuagaauaaacuu

SEQ ID NO: 4049341 - RNA, 16 nt, Staphylococcus aureus subsp. aureus N315
uauuuagaauucuaaa

SEQ ID NO: 4049342 - RNA, 15 nt, Staphylococcus aureus subsp. aureus N315
uauuuagauaaaaau

SEQ ID NO: 4049343 - RNA, 16 nt, Staphylococcus aureus subsp. aureus N315
uauuuagauuuauaac

SEQ ID NO: 4049344 - RNA, 21 nt, Staphylococcus aureus subsp. aureus N315
uauuuagcaucuuuaccauau

SEQ ID NO: 4049345 - RNA, 22 nt, Staphylococcus aureus subsp. aureus N315
uauuuaggacgugccuuaacuu

SEQ ID NO: 4049346 - RNA, 17 nt, Staphylococcus aureus subsp. aureus N315
uauuuaggaguauccug

SEQ ID NO: 4049347 - RNA, 14 nt, Staphylococcus aureus subsp. aureus N315
uauuuauaaaauaa

SEQ ID NO: 4049348 - RNA, 18 nt, Staphylococcus aureus subsp. aureus N315
uauuuauaaaauaaaaug

SEQ ID NO: 4049349 - RNA, 15 nt, Staphylococcus aureus subsp. aureus N315
uauuuauaaacaaua

SEQ ID NO: 4049350 - RNA, 18 nt, Staphylococcus aureus subsp. aureus N315
uauuuauaagaggagaaa

SEQ ID NO: 4049351 - RNA, 12 nt, Staphylococcus aureus subsp. aureus N315
uauuuauaauuu

SEQ ID NO: 4049352 - RNA, 17 nt, Staphylococcus aureus subsp. aureus N315
uauuuauacuaaagcac

SEQ ID NO: 4049353 - RNA, 18 nt, Staphylococcus aureus subsp. aureus N315
uauuuauacuaaauugag

SEQ ID NO: 4049354 - RNA, 15 nt, Staphylococcus aureus subsp. aureus N315
uauuuauauuaaaua

SEQ ID NO: 4049355 - RNA, 16 nt, Staphylococcus aureus subsp. aureus N315
uauuuaucaauaaauc

SEQ ID NO: 4049356 - RNA, 15 nt, Staphylococcus aureus subsp. aureus N315
uauuuaucauacuuc

SEQ ID NO: 4049357 - RNA, 18 nt, Staphylococcus aureus subsp. aureus N315
uauuuaucucuuucuuca

SEQ ID NO: 4049358 - RNA, 14 nt, Staphylococcus aureus subsp. aureus N315
uauuuaucuuuaga

SEQ ID NO: 4049359 - RNA, 21 nt, Staphylococcus aureus subsp. aureus N315
uauuuaucuuuuaaaaucguu

SEQ ID NO: 4049360 - RNA, 21 nt, Staphylococcus aureus subsp. aureus N315
uauuuauguucgauuauucuu

SEQ ID NO: 4049361 - RNA, 11 nt, Staphylococcus aureus subsp. aureus N315
uauuuauucag

SEQ ID NO: 4049362 - RNA, 19 nt, Staphylococcus aureus subsp. aureus N315
uauuuauucuaaucuaaau

SEQ ID NO: 4049363 - RNA, 23 nt, Staphylococcus aureus subsp. aureus N315
uauuuauucuaaucuaaauucag

SEQ ID NO: 4049364 - RNA, 19 nt, Staphylococcus aureus subsp. aureus N315
uauuuauugagauagaaau

SEQ ID NO: 4049365 - RNA, 12 nt, Staphylococcus aureus subsp. aureus N315
uauuuauuuaau

SEQ ID NO: 4049366 - RNA, 18 nt, Staphylococcus aureus subsp. aureus N315
uauuuauuuuaauagugu

SEQ ID NO: 4049367 - RNA, 15 nt, Staphylococcus aureus subsp. aureus N315
uauuuauuuuauaau

SEQ ID NO: 4049368 - RNA, 13 nt, Staphylococcus aureus subsp. aureus N315
uauuucaaaugua

SEQ ID NO: 4049369 - RNA, 19 nt, Staphylococcus aureus subsp. aureus N315
uauuucaacuuuuuaauaa

SEQ ID NO: 4049370 - RNA, 14 nt, Staphylococcus aureus subsp. aureus N315
uauuucaauaauaa

SEQ ID NO: 4049371 - RNA, 15 nt, Staphylococcus aureus subsp. aureus N315
uauuucaauuaucaa

SEQ ID NO: 4049372 - RNA, 17 nt, Staphylococcus aureus subsp. aureus N315
uauuucacucuacaauc

SEQ ID NO: 4049373 - RNA, 21 nt, Staphylococcus aureus subsp. aureus N315
uauuucacucuacaauccuau

SEQ ID NO: 4049374 - RNA, 16 nt, Staphylococcus aureus subsp. aureus N315
uauuucagcuuauuaa

SEQ ID NO: 4049375 - RNA, 15 nt, Staphylococcus aureus subsp. aureus N315
uauuucauuagaaaa

SEQ ID NO: 4049376 - RNA, 15 nt, Staphylococcus aureus subsp. aureus N315
uauuuccaaauugaa

SEQ ID NO: 4049377 - RNA, 16 nt, Staphylococcus aureus subsp. aureus N315
uauuucccuaugaaau

SEQ ID NO: 4049378 - RNA, 20 nt, Staphylococcus aureus subsp. aureus N315
uauuucgguauuuuaaauuu

SEQ ID NO: 4049379 - RNA, 13 nt, Staphylococcus aureus subsp. aureus N315
uauuucuaaauua

SEQ ID NO: 4049380 - RNA, 16 nt, Staphylococcus aureus subsp. aureus N315
uauuucuaaauuauuu

SEQ ID NO: 4049381 - RNA, 21 nt, Staphylococcus aureus subsp. aureus N315
uauuucuaaauuauuuauuca

SEQ ID NO: 4049382 - RNA, 18 nt, Staphylococcus aureus subsp. aureus N315
uauuucuauuccuucuaa

SEQ ID NO: 4049383 - RNA, 21 nt, Staphylococcus aureus subsp. aureus N315
uauuucuauuccuucuaacau

SEQ ID NO: 4049384 - RNA, 22 nt, Staphylococcus aureus subsp. aureus N315
uauuucugaaaugauacauuau

SEQ ID NO: 4049385 - RNA, 16 nt, Staphylococcus aureus subsp. aureus N315
uauuucuucauuugua

SEQ ID NO: 4049386 - RNA, 19 nt, Staphylococcus aureus subsp. aureus N315
uauuucuuuucauuaucau

SEQ ID NO: 4049387 - RNA, 16 nt, Staphylococcus aureus subsp. aureus N315
uauuugaaaaaguguu

SEQ ID NO: 4049388 - RNA, 22 nt, Staphylococcus aureus subsp. aureus N315
uauuugaaagacauuuaaauau

SEQ ID NO: 4049389 - RNA, 23 nt, Staphylococcus aureus subsp. aureus N315
uauuugaaagacauuuaaauaua

SEQ ID NO: 4049390 - RNA, 14 nt, Staphylococcus aureus subsp. aureus N315
uauuugaauacuuu

SEQ ID NO: 4049391 - RNA, 19 nt, Staphylococcus aureus subsp. aureus N315
uauuugacacauuauugaa

SEQ ID NO: 4049392 - RNA, 21 nt, Staphylococcus aureus subsp. aureus N315
uauuugacacauuauugaaau

SEQ ID NO: 4049393 - RNA, 16 nt, Staphylococcus aureus subsp. aureus N315
uauuugauaaauaaaa

SEQ ID NO: 4049394 - RNA, 13 nt, Staphylococcus aureus subsp. aureus N315
uauuugauacaac

SEQ ID NO: 4049395 - RNA, 15 nt, Staphylococcus aureus subsp. aureus N315
uauuugauauuucau

SEQ ID NO: 4049396 - RNA, 18 nt, Staphylococcus aureus subsp. aureus N315
uauuugauuauucuucau

SEQ ID NO: 4049397 - RNA, 20 nt, Staphylococcus aureus subsp. aureus N315
uauuugauucuauuucuuca

SEQ ID NO: 4049398 - RNA, 14 nt, Staphylococcus aureus subsp. aureus N315
uauuugauucuuca

SEQ ID NO: 4049399 - RNA, 14 nt, Staphylococcus aureus subsp. aureus N315
uauuugcccgacuu

SEQ ID NO: 4049400 - RNA, 18 nt, Staphylococcus aureus subsp. aureus N315
uauuugccuuuugaauaa

SEQ ID NO: 4049401 - RNA, 19 nt, Staphylococcus aureus subsp. aureus N315
uauuugcuagucauaauuu

SEQ ID NO: 4049402 - RNA, 22 nt, Staphylococcus aureus subsp. aureus N315
uauuugcuagucauaauuuaaa

SEQ ID NO: 4049403 - RNA, 16 nt, Staphylococcus aureus subsp. aureus N315
uauuuggauauuuauu

SEQ ID NO: 4049404 - RNA, 15 nt, Staphylococcus aureus subsp. aureus N315
uauuuguaauuucag

SEQ ID NO: 4049405 - RNA, 13 nt, Staphylococcus aureus subsp. aureus N315
uauuugucuuuga

SEQ ID NO: 4049406 - RNA, 10 nt, Staphylococcus aureus subsp. aureus N315
uauuuuaaac

SEQ ID NO: 4049407 - RNA, 13 nt, Staphylococcus aureus subsp. aureus N315
uauuuuaaacaug

SEQ ID NO: 4049408 - RNA, 22 nt, Staphylococcus aureus subsp. aureus N315
uauuuuaaacguaucauuuaaa

SEQ ID NO: 4049409 - RNA, 23 nt, Staphylococcus aureus subsp. aureus N315
uauuuuaaacguaucauuuaaaa

SEQ ID NO: 4049410 - RNA, 21 nt, Staphylococcus aureus subsp. aureus N315
uauuuuaaauuacaacuuuua

SEQ ID NO: 4049411 - RNA, 19 nt, Staphylococcus aureus subsp. aureus N315
uauuuuaaauuuauaauac

SEQ ID NO: 4049412 - RNA, 15 nt, Staphylococcus aureus subsp. aureus N315
uauuuuaauagcauu

SEQ ID NO: 4049413 - RNA, 18 nt, Staphylococcus aureus subsp. aureus N315
uauuuuaauauugaaaug

SEQ ID NO: 4049414 - RNA, 13 nt, Staphylococcus aureus subsp. aureus N315
uauuuuaauauuu

SEQ ID NO: 4049415 - RNA, 13 nt, Staphylococcus aureus subsp. aureus N315
uauuuuauaaaau

SEQ ID NO: 4049416 - RNA, 16 nt, Staphylococcus aureus subsp. aureus N315
uauuuuauaaaauaua

SEQ ID NO: 4049417 - RNA, 14 nt, Staphylococcus aureus subsp. aureus N315
uauuuuauaagaau

SEQ ID NO: 4049418 - RNA, 19 nt, Staphylococcus aureus subsp. aureus N315
uauuuuauaagaauuuaaa

SEQ ID NO: 4049419 - RNA, 14 nt, Staphylococcus aureus subsp. aureus N315
uauuuuauaauaaa

SEQ ID NO: 4049420 - RNA, 19 nt, Staphylococcus aureus subsp. aureus N315
uauuuuaucaucuauucaa

SEQ ID NO: 4049421 - RNA, 15 nt, Staphylococcus aureus subsp. aureus N315
uauuuuauuuaaaaa

SEQ ID NO: 4049422 - RNA, 16 nt, Staphylococcus aureus subsp. aureus N315
uauuuuauuuaaaaau

SEQ ID NO: 4049423 - RNA, 17 nt, Staphylococcus aureus subsp. aureus N315
uauuuuauuuaaaaaua

SEQ ID NO: 4049424 - RNA, 22 nt, Staphylococcus aureus subsp. aureus N315
uauuuuauuuaaaaauagccuu

SEQ ID NO: 4049425 - RNA, 18 nt, Staphylococcus aureus subsp. aureus N315
uauuuucaauauuugaua

SEQ ID NO: 4049426 - RNA, 16 nt, Staphylococcus aureus subsp. aureus N315
uauuuucaauuagaaa

SEQ ID NO: 4049427 - RNA, 17 nt, Staphylococcus aureus subsp. aureus N315
uauuuucaguuaaaaua

SEQ ID NO: 4049428 - RNA, 21 nt, Staphylococcus aureus subsp. aureus N315
uauuuucauuuuaguuauacu

SEQ ID NO: 4049429 - RNA, 12 nt, Staphylococcus aureus subsp. aureus N315
uauuuucuuaga

SEQ ID NO: 4049430 - RNA, 13 nt, Staphylococcus aureus subsp. aureus N315
uauuuucuuuuuc

SEQ ID NO: 4049431 - RNA, 21 nt, Staphylococcus aureus subsp. aureus N315
uauuuucuuuuucuaaauaaa

SEQ ID NO: 4049432 - RNA, 13 nt, Staphylococcus aureus subsp. aureus N315
uauuuugcaauaa

SEQ ID NO: 4049433 - RNA, 15 nt, Staphylococcus aureus subsp. aureus N315
uauuuugcaauugca

SEQ ID NO: 4049434 - RNA, 20 nt, Staphylococcus aureus subsp. aureus N315
uauuuugcaauugcaaugaa

SEQ ID NO: 4049435 - RNA, 17 nt, Staphylococcus aureus subsp. aureus N315
uauuuugcgcuucuagu

SEQ ID NO: 4049436 - RNA, 22 nt, Staphylococcus aureus subsp. aureus N315
uauuuuggacugguacuacuau

SEQ ID NO: 4049437 - RNA, 12 nt, Staphylococcus aureus subsp. aureus N315
uauuuuguaguu

SEQ ID NO: 4049438 - RNA, 14 nt, Staphylococcus aureus subsp. aureus N315
uauuuuguauuuuu

SEQ ID NO: 4049439 - RNA, 12 nt, Staphylococcus aureus subsp. aureus N315
uauuuuguuuua

SEQ ID NO: 4049440 - RNA, 16 nt, Staphylococcus aureus subsp. aureus N315
uauuuuguuuuaaaaa

SEQ ID NO: 4049441 - RNA, 19 nt, Staphylococcus aureus subsp. aureus N315
uauuuuuaaaugauucuuu

SEQ ID NO: 4049442 - RNA, 22 nt, Staphylococcus aureus subsp. aureus N315
uauuuuuaaaugauucuuuaua

SEQ ID NO: 4049443 - RNA, 17 nt, Staphylococcus aureus subsp. aureus N315
uauuuuuauauaaaauu

SEQ ID NO: 4049444 - RNA, 13 nt, Staphylococcus aureus subsp. aureus N315
uauuuuuaucauc

SEQ ID NO: 4049445 - RNA, 13 nt, Staphylococcus aureus subsp. aureus N315
uauuuuucaucau

SEQ ID NO: 4049446 - RNA, 11 nt, Staphylococcus aureus subsp. aureus N315
uauuuuucuuu

SEQ ID NO: 4049447 - RNA, 17 nt, Staphylococcus aureus subsp. aureus N315
uauuuuugauuuaauaa

SEQ ID NO: 4049448 - RNA, 21 nt, Staphylococcus aureus subsp. aureus N315
uauuuuuuaaaaugauagcua

SEQ ID NO: 4049449 - RNA, 13 nt, Staphylococcus aureus subsp. aureus N315
uauuuuuuaauaa

SEQ ID NO: 4049450 - RNA, 15 nt, Staphylococcus aureus subsp. aureus N315
uauuuuuuauggucu

SEQ ID NO: 4049451 - RNA, 17 nt, Staphylococcus aureus subsp. aureus N315
uauuuuuuauguuuuaa

SEQ ID NO: 4049452 - RNA, 23 nt, Staphylococcus aureus subsp. aureus N315
uauuuuuuauguuuuaauuucuu

SEQ ID NO: 4049453 - RNA, 21 nt, Staphylococcus aureus subsp. aureus N315
uauuuuuugagcacuuaauaa

SEQ ID NO: 4049454 - RNA, 22 nt, Staphylococcus aureus subsp. aureus N315
uauuuuuuggacuggguuguua

SEQ ID NO: 4049455 - RNA, 13 nt, Staphylococcus aureus subsp. aureus N315
uauuuuuuuaaau

SEQ ID NO: 4049456 - RNA, 13 nt, Staphylococcus aureus subsp. aureus N315
uauuuuuuuaugc

SEQ ID NO: 4049457 - RNA, 12 nt, Staphylococcus aureus subsp. aureus N315
uauuuuuuucuu

SEQ ID NO: 4049458 - RNA, 23 nt, Staphylococcus aureus subsp. aureus N315
ucaaaaauagcguaauuauuaua

SEQ ID NO: 4049459 - RNA, 12 nt, Staphylococcus aureus subsp. aureus N315
ucaaaaaucaua

SEQ ID NO: 4049460 - RNA, 19 nt, Staphylococcus aureus subsp. aureus N315
ucaaaaauguuaucuagua

SEQ ID NO: 4049461 - RNA, 15 nt, Staphylococcus aureus subsp. aureus N315
ucaaaacaauuuaaa

SEQ ID NO: 4049462 - RNA, 21 nt, Staphylococcus aureus subsp. aureus N315
ucaaaacaauuuaaaaagcag

SEQ ID NO: 4049463 - RNA, 13 nt, Staphylococcus aureus subsp. aureus N315
ucaaaauaguaaa

SEQ ID NO: 4049464 - RNA, 13 nt, Staphylococcus aureus subsp. aureus N315
ucaaaauauaaaa

SEQ ID NO: 4049465 - RNA, 19 nt, Staphylococcus aureus subsp. aureus N315
ucaaaaucggauuaacauu

SEQ ID NO: 4049466 - RNA, 18 nt, Staphylococcus aureus subsp. aureus N315
ucaaaauguuuaacaaua

SEQ ID NO: 4049467 - RNA, 21 nt, Staphylococcus aureus subsp. aureus N315
ucaaaauguuuaacaauaaua

SEQ ID NO: 4049468 - RNA, 20 nt, Staphylococcus aureus subsp. aureus N315
ucaaaauuaaagcuuaauua

SEQ ID NO: 4049469 - RNA, 23 nt, Staphylococcus aureus subsp. aureus N315
ucaaaauuaugacuaacauuggu

SEQ ID NO: 4049470 - RNA, 22 nt, Staphylococcus aureus subsp. aureus N315
ucaaaauucaauauuaaucaua

SEQ ID NO: 4049471 - RNA, 21 nt, Staphylococcus aureus subsp. aureus N315
ucaaaauuucgauuuucacca

SEQ ID NO: 4049472 - RNA, 23 nt, Staphylococcus aureus subsp. aureus N315
ucaaacaaaucuuuuaaauuuag

SEQ ID NO: 4049473 - RNA, 14 nt, Staphylococcus aureus subsp. aureus N315
ucaaacagacuuaa

SEQ ID NO: 4049474 - RNA, 14 nt, Staphylococcus aureus subsp. aureus N315
ucaaacauauucau

SEQ ID NO: 4049475 - RNA, 19 nt, Staphylococcus aureus subsp. aureus N315
ucaaaccaccaaaaaucau

SEQ ID NO: 4049476 - RNA, 21 nt, Staphylococcus aureus subsp. aureus N315
ucaaaccaucuuaucuuuaug

SEQ ID NO: 4049477 - RNA, 15 nt, Staphylococcus aureus subsp. aureus N315
ucaaacggaauuaaa

SEQ ID NO: 4049478 - RNA, 16 nt, Staphylococcus aureus subsp. aureus N315
ucaaacuuaaaacuau

SEQ ID NO: 4049479 - RNA, 14 nt, Staphylococcus aureus subsp. aureus N315
ucaaacuuaucgcc

SEQ ID NO: 4049480 - RNA, 12 nt, Staphylococcus aureus subsp. aureus N315
ucaaagaaaaag

SEQ ID NO: 4049481 - RNA, 17 nt, Staphylococcus aureus subsp. aureus N315
ucaaagaggcuuuaaaa

SEQ ID NO: 4049482 - RNA, 22 nt, Staphylococcus aureus subsp. aureus N315
ucaaagccugucggaauugguu

SEQ ID NO: 4049483 - RNA, 21 nt, Staphylococcus aureus subsp. aureus N315
ucaaagcgauaaaguaugagu

SEQ ID NO: 4049484 - RNA, 21 nt, Staphylococcus aureus subsp. aureus N315
ucaaagcuauauaugaauuga

SEQ ID NO: 4049485 - RNA, 14 nt, Staphylococcus aureus subsp. aureus N315
ucaaaguagacauu

SEQ ID NO: 4049486 - RNA, 19 nt, Staphylococcus aureus subsp. aureus N315
ucaaaguagacauugaaua

SEQ ID NO: 4049487 - RNA, 23 nt, Staphylococcus aureus subsp. aureus N315
ucaaaguagauauugaauggagu

SEQ ID NO: 4049488 - RNA, 16 nt, Staphylococcus aureus subsp. aureus N315
ucaaagucuucuucaa

SEQ ID NO: 4049489 - RNA, 16 nt, Staphylococcus aureus subsp. aureus N315
ucaaaguuuaauugcu

SEQ ID NO: 4049490 - RNA, 15 nt, Staphylococcus aureus subsp. aureus N315
ucaaaguuuucauuu

SEQ ID NO: 4049491 - RNA, 21 nt, Staphylococcus aureus subsp. aureus N315
ucaaaguuuucauuuaacaug

SEQ ID NO: 4049492 - RNA, 17 nt, Staphylococcus aureus subsp. aureus N315
ucaaauaaccuauuaau

SEQ ID NO: 4049493 - RNA, 14 nt, Staphylococcus aureus subsp. aureus N315
ucaaauaauauaaa

SEQ ID NO: 4049494 - RNA, 16 nt, Staphylococcus aureus subsp. aureus N315
ucaaauaauauaaaac

SEQ ID NO: 4049495 - RNA, 14 nt, Staphylococcus aureus subsp. aureus N315
ucaaauaaugaaua

SEQ ID NO: 4049496 - RNA, 13 nt, Staphylococcus aureus subsp. aureus N315
ucaaauaauguga

SEQ ID NO: 4049497 - RNA, 18 nt, Staphylococcus aureus subsp. aureus N315
ucaaauaaugugaaaaau

SEQ ID NO: 4049498 - RNA, 21 nt, Staphylococcus aureus subsp. aureus N315
ucaaauaaugugaaaaaucuu

SEQ ID NO: 4049499 - RNA, 22 nt, Staphylococcus aureus subsp. aureus N315
ucaaauaaugugaaaaaucuuc

SEQ ID NO: 4049500 - RNA, 17 nt, Staphylococcus aureus subsp. aureus N315
ucaaauacauuucaaaa

SEQ ID NO: 4049501 - RNA, 24 nt, Staphylococcus aureus subsp. aureus N315
ucaaauauaucaacguuaauauaa

SEQ ID NO: 4049502 - RNA, 13 nt, Staphylococcus aureus subsp. aureus N315
ucaaauauaucua

SEQ ID NO: 4049503 - RNA, 22 nt, Staphylococcus aureus subsp. aureus N315
ucaaaucacaaguuuacagguu

SEQ ID NO: 4049504 - RNA, 17 nt, Staphylococcus aureus subsp. aureus N315
ucaaaucauaaguuaaa

SEQ ID NO: 4049505 - RNA, 16 nt, Staphylococcus aureus subsp. aureus N315
ucaaauccaaaaucuu

SEQ ID NO: 4049506 - RNA, 17 nt, Staphylococcus aureus subsp. aureus N315
ucaaaucggcuauacau

SEQ ID NO: 4049507 - RNA, 21 nt, Staphylococcus aureus subsp. aureus N315
ucaaaugacauuuuaaaucua

SEQ ID NO: 4049508 - RNA, 20 nt, Staphylococcus aureus subsp. aureus N315
ucaaaugccgcuucuaauuu

SEQ ID NO: 4049509 - RNA, 21 nt, Staphylococcus aureus subsp. aureus N315
ucaaaugcuuaauaaaaucaa

SEQ ID NO: 4049510 - RNA, 22 nt, Staphylococcus aureus subsp. aureus N315
ucaaauucaucaguaccaaaga

SEQ ID NO: 4049511 - RNA, 19 nt, Staphylococcus aureus subsp. aureus N315
ucaaauucucaauuaauuu

SEQ ID NO: 4049512 - RNA, 16 nt, Staphylococcus aureus subsp. aureus N315
ucaaauugaacuucuu

SEQ ID NO: 4049513 - RNA, 19 nt, Staphylococcus aureus subsp. aureus N315
ucaaauugagcaguauuuu

SEQ ID NO: 4049514 - RNA, 19 nt, Staphylococcus aureus subsp. aureus N315
ucaaauuggacuuaugggu

SEQ ID NO: 4049515 - RNA, 14 nt, Staphylococcus aureus subsp. aureus N315
ucaaauugguuuuc

SEQ ID NO: 4049516 - RNA, 23 nt, Staphylococcus aureus subsp. aureus N315
ucaaauugguuuucaugugucau

SEQ ID NO: 4049517 - RNA, 19 nt, Staphylococcus aureus subsp. aureus N315
ucaaauuuaccaguuugau

SEQ ID NO: 4049518 - RNA, 21 nt, Staphylococcus aureus subsp. aureus N315
ucaaauuuaccgucauuauau

SEQ ID NO: 4049519 - RNA, 13 nt, Staphylococcus aureus subsp. aureus N315
ucaaauuuuucga

SEQ ID NO: 4049520 - RNA, 18 nt, Staphylococcus aureus subsp. aureus N315
ucaacaaagugcaauuau

SEQ ID NO: 4049521 - RNA, 13 nt, Staphylococcus aureus subsp. aureus N315
ucaacaaauuuaa

SEQ ID NO: 4049522 - RNA, 15 nt, Staphylococcus aureus subsp. aureus N315
ucaacaauuucaaug

SEQ ID NO: 4049523 - RNA, 15 nt, Staphylococcus aureus subsp. aureus N315
ucaacacacuauuau

SEQ ID NO: 4049524 - RNA, 16 nt, Staphylococcus aureus subsp. aureus N315
ucaacacgauagucau

SEQ ID NO: 4049525 - RNA, 15 nt, Staphylococcus aureus subsp. aureus N315
ucaacacuuucuacu

SEQ ID NO: 4049526 - RNA, 17 nt, Staphylococcus aureus subsp. aureus N315
ucaacagcaaaaaauaa

SEQ ID NO: 4049527 - RNA, 14 nt, Staphylococcus aureus subsp. aureus N315
ucaacaguuucuug

SEQ ID NO: 4049528 - RNA, 17 nt, Staphylococcus aureus subsp. aureus N315
ucaacauaaaauuuaaa

SEQ ID NO: 4049529 - RNA, 20 nt, Staphylococcus aureus subsp. aureus N315
ucaacauaacucaaauaucu

SEQ ID NO: 4049530 - RNA, 21 nt, Staphylococcus aureus subsp. aureus N315
ucaacaucaucuuuaauuuuc

SEQ ID NO: 4049531 - RNA, 11 nt, Staphylococcus aureus subsp. aureus N315
ucaacaucaug

SEQ ID NO: 4049532 - RNA, 20 nt, Staphylococcus aureus subsp. aureus N315
ucaacauguuccgcuacaaa

SEQ ID NO: 4049533 - RNA, 21 nt, Staphylococcus aureus subsp. aureus N315
ucaacauguucguuauagacu

SEQ ID NO: 4049534 - RNA, 16 nt, Staphylococcus aureus subsp. aureus N315
ucaacauuaauaaaua

SEQ ID NO: 4049535 - RNA, 18 nt, Staphylococcus aureus subsp. aureus N315
ucaacauuaauaaauaau

SEQ ID NO: 4049536 - RNA, 19 nt, Staphylococcus aureus subsp. aureus N315
ucaacauuacaugcaccuu

SEQ ID NO: 4049537 - RNA, 18 nt, Staphylococcus aureus subsp. aureus N315
ucaacauuacuaauugau

SEQ ID NO: 4049538 - RNA, 15 nt, Staphylococcus aureus subsp. aureus N315
ucaacauuuuuucua

SEQ ID NO: 4049539 - RNA, 20 nt, Staphylococcus aureus subsp. aureus N315
ucaaccauuuguucugcaga

SEQ ID NO: 4049540 - RNA, 17 nt, Staphylococcus aureus subsp. aureus N315
ucaacccaucauguaca

SEQ ID NO: 4049541 - RNA, 17 nt, Staphylococcus aureus subsp. aureus N315
ucaaccuguucuuuauu

SEQ ID NO: 4049542 - RNA, 23 nt, Staphylococcus aureus subsp. aureus N315
ucaaccuguucuuuauuuaaagg

SEQ ID NO: 4049543 - RNA, 22 nt, Staphylococcus aureus subsp. aureus N315
ucaaccuuugcuaaaucaagac

SEQ ID NO: 4049544 - RNA, 14 nt, Staphylococcus aureus subsp. aureus N315
ucaacgauugaauu

SEQ ID NO: 4049545 - RNA, 16 nt, Staphylococcus aureus subsp. aureus N315
ucaacgggaacaucau

SEQ ID NO: 4049546 - RNA, 21 nt, Staphylococcus aureus subsp. aureus N315
ucaacguauauaaguuaaaau

SEQ ID NO: 4049547 - RNA, 16 nt, Staphylococcus aureus subsp. aureus N315
ucaacgucaucugcuu

SEQ ID NO: 4049548 - RNA, 21 nt, Staphylococcus aureus subsp. aureus N315
ucaacgucaucugcuuguaau

SEQ ID NO: 4049549 - RNA, 19 nt, Staphylococcus aureus subsp. aureus N315
ucaacgucgaauguuucuu

SEQ ID NO: 4049550 - RNA, 19 nt, Staphylococcus aureus subsp. aureus N315
ucaacuaaucguguauuau

SEQ ID NO: 4049551 - RNA, 14 nt, Staphylococcus aureus subsp. aureus N315
ucaacuaauuuaaa

SEQ ID NO: 4049552 - RNA, 15 nt, Staphylococcus aureus subsp. aureus N315
ucaacuacugucaau

SEQ ID NO: 4049553 - RNA, 21 nt, Staphylococcus aureus subsp. aureus N315
ucaacugaaauuuuuccgauu

SEQ ID NO: 4049554 - RNA, 18 nt, Staphylococcus aureus subsp. aureus N315
ucaacugcugcuaaaaua

SEQ ID NO: 4049555 - RNA, 21 nt, Staphylococcus aureus subsp. aureus N315
ucaacuuauaaaaugaaauau

SEQ ID NO: 4049556 - RNA, 23 nt, Staphylococcus aureus subsp. aureus N315
ucaacuuauaaaaugaaauauuu

SEQ ID NO: 4049557 - RNA, 15 nt, Staphylococcus aureus subsp. aureus N315
ucaacuugauuaauu

SEQ ID NO: 4049558 - RNA, 15 nt, Staphylococcus aureus subsp. aureus N315
ucaacuuguuuccua

SEQ ID NO: 4049559 - RNA, 15 nt, Staphylococcus aureus subsp. aureus N315
ucaacuuuaguuguu

SEQ ID NO: 4049560 - RNA, 16 nt, Staphylococcus aureus subsp. aureus N315
ucaacuuuaguuguua

SEQ ID NO: 4049561 - RNA, 10 nt, Staphylococcus aureus subsp. aureus N315
ucaacuuuuc

SEQ ID NO: 4049562 - RNA, 12 nt, Staphylococcus aureus subsp. aureus N315
ucaacuuuucaa

SEQ ID NO: 4049563 - RNA, 14 nt, Staphylococcus aureus subsp. aureus N315
ucaacuuuuuuaac

SEQ ID NO: 4049564 - RNA, 15 nt, Staphylococcus aureus subsp. aureus N315
ucaagaaaaaguuuu

SEQ ID NO: 4049565 - RNA, 19 nt, Staphylococcus aureus subsp. aureus N315
ucaagaaaaaguuuuucug

SEQ ID NO: 4049566 - RNA, 15 nt, Staphylococcus aureus subsp. aureus N315
ucaagaaauguuaaa

SEQ ID NO: 4049567 - RNA, 20 nt, Staphylococcus aureus subsp. aureus N315
ucaagaaauguuaaauuaaa

SEQ ID NO: 4049568 - RNA, 12 nt, Staphylococcus aureus subsp. aureus N315
ucaagaacaauc

SEQ ID NO: 4049569 - RNA, 18 nt, Staphylococcus aureus subsp. aureus N315
ucaagaacuuuaaaaauu

SEQ ID NO: 4049570 - RNA, 12 nt, Staphylococcus aureus subsp. aureus N315
ucaagaauauaa

SEQ ID NO: 4049571 - RNA, 19 nt, Staphylococcus aureus subsp. aureus N315
ucaagaaugugaacaucua

SEQ ID NO: 4049572 - RNA, 19 nt, Staphylococcus aureus subsp. aureus N315
ucaagaccaaauauuuuau

SEQ ID NO: 4049573 - RNA, 18 nt, Staphylococcus aureus subsp. aureus N315
ucaagaccaugcaaacuc

SEQ ID NO: 4049574 - RNA, 19 nt, Staphylococcus aureus subsp. aureus N315
ucaagauauccauuaugau

SEQ ID NO: 4049575 - RNA, 18 nt, Staphylococcus aureus subsp. aureus N315
ucaagcaucauuuuucgu

SEQ ID NO: 4049576 - RNA, 16 nt, Staphylococcus aureus subsp. aureus N315
ucaagcuagcaucaug

SEQ ID NO: 4049577 - RNA, 20 nt, Staphylococcus aureus subsp. aureus N315
ucaagcugagcuuuaauuuu

SEQ ID NO: 4049578 - RNA, 19 nt, Staphylococcus aureus subsp. aureus N315
ucaaggaaaucauauauuu

SEQ ID NO: 4049579 - RNA, 12 nt, Staphylococcus aureus subsp. aureus N315
ucaaguaacuca

SEQ ID NO: 4049580 - RNA, 15 nt, Staphylococcus aureus subsp. aureus N315
ucaaguaaugauauu

SEQ ID NO: 4049581 - RNA, 20 nt, Staphylococcus aureus subsp. aureus N315
ucaaguaauggauugauaau

SEQ ID NO: 4049582 - RNA, 20 nt, Staphylococcus aureus subsp. aureus N315
ucaaguauauccgcaucuuu

SEQ ID NO: 4049583 - RNA, 18 nt, Staphylococcus aureus subsp. aureus N315
ucaagucugcauuaauuu

SEQ ID NO: 4049584 - RNA, 20 nt, Staphylococcus aureus subsp. aureus N315
ucaagugccauuuuuaaauu

SEQ ID NO: 4049585 - RNA, 11 nt, Staphylococcus aureus subsp. aureus N315
ucaagugcuug

SEQ ID NO: 4049586 - RNA, 15 nt, Staphylococcus aureus subsp. aureus N315
ucaaguguauuaaag

SEQ ID NO: 4049587 - RNA, 19 nt, Staphylococcus aureus subsp. aureus N315
ucaaguucaccguaaucuu

SEQ ID NO: 4049588 - RNA, 13 nt, Staphylococcus aureus subsp. aureus N315
ucaaguuuaaaau

SEQ ID NO: 4049589 - RNA, 22 nt, Staphylococcus aureus subsp. aureus N315
ucaaguuuacgaucauaaauau

SEQ ID NO: 4049590 - RNA, 14 nt, Staphylococcus aureus subsp. aureus N315
ucaaguuuuaagug

SEQ ID NO: 4049591 - RNA, 12 nt, Staphylococcus aureus subsp. aureus N315
ucaauaaaaaug

SEQ ID NO: 4049592 - RNA, 17 nt, Staphylococcus aureus subsp. aureus N315
ucaauaaaaaugguauu

SEQ ID NO: 4049593 - RNA, 12 nt, Staphylococcus aureus subsp. aureus N315
ucaauaaauugu

SEQ ID NO: 4049594 - RNA, 19 nt, Staphylococcus aureus subsp. aureus N315
ucaauaacaccuuucauuu

SEQ ID NO: 4049595 - RNA, 18 nt, Staphylococcus aureus subsp. aureus N315
ucaauaaugugucaaaua

SEQ ID NO: 4049596 - RNA, 22 nt, Staphylococcus aureus subsp. aureus N315
ucaauacgaaguguuauaaaua

SEQ ID NO: 4049597 - RNA, 15 nt, Staphylococcus aureus subsp. aureus N315
ucaauacuugaaaga

SEQ ID NO: 4049598 - RNA, 17 nt, Staphylococcus aureus subsp. aureus N315
ucaauacuuucacuuug

SEQ ID NO: 4049599 - RNA, 23 nt, Staphylococcus aureus subsp. aureus N315
ucaauagcgguuuaaaaaugcug

SEQ ID NO: 4049600 - RNA, 14 nt, Staphylococcus aureus subsp. aureus N315
ucaauaguuuauaa

SEQ ID NO: 4049601 - RNA, 19 nt, Staphylococcus aureus subsp. aureus N315
ucaauaguuucaaugccuu

SEQ ID NO: 4049602 - RNA, 15 nt, Staphylococcus aureus subsp. aureus N315
ucaauaucaaauuug

SEQ ID NO: 4049603 - RNA, 23 nt, Staphylococcus aureus subsp. aureus N315
ucaauaucuguagcgauaccuuu

SEQ ID NO: 4049604 - RNA, 24 nt, Staphylococcus aureus subsp. aureus N315
ucaauaucuucuucuaaccacuuc

SEQ ID NO: 4049605 - RNA, 15 nt, Staphylococcus aureus subsp. aureus N315
ucaauaucuuuaauu

SEQ ID NO: 4049606 - RNA, 16 nt, Staphylococcus aureus subsp. aureus N315
ucaauaucuuuaauug

SEQ ID NO: 4049607 - RNA, 12 nt, Staphylococcus aureus subsp. aureus N315
ucaauauuaaaa

SEQ ID NO: 4049608 - RNA, 13 nt, Staphylococcus aureus subsp. aureus N315
ucaauauuaaaau

SEQ ID NO: 4049609 - RNA, 21 nt, Staphylococcus aureus subsp. aureus N315
ucaauauuaaucauaaugaau

SEQ ID NO: 4049610 - RNA, 22 nt, Staphylococcus aureus subsp. aureus N315
ucaauauuacuuuaucucauug

SEQ ID NO: 4049611 - RNA, 14 nt, Staphylococcus aureus subsp. aureus N315
ucaauauucuuauc

SEQ ID NO: 4049612 - RNA, 19 nt, Staphylococcus aureus subsp. aureus N315
ucaauauucuuaucauuca

SEQ ID NO: 4049613 - RNA, 21 nt, Staphylococcus aureus subsp. aureus N315
ucaauccaauuaaauauuuaa

SEQ ID NO: 4049614 - RNA, 22 nt, Staphylococcus aureus subsp. aureus N315
ucaauccaauuaaauauuuaac

SEQ ID NO: 4049615 - RNA, 22 nt, Staphylococcus aureus subsp. aureus N315
ucaauccaucaauaccauaauu

SEQ ID NO: 4049616 - RNA, 15 nt, Staphylococcus aureus subsp. aureus N315
ucaaucguuaauuuc

SEQ ID NO: 4049617 - RNA, 14 nt, Staphylococcus aureus subsp. aureus N315
ucaaugaauuuacu

SEQ ID NO: 4049618 - RNA, 12 nt, Staphylococcus aureus subsp. aureus N315
ucaaugacuaag

SEQ ID NO: 4049619 - RNA, 18 nt, Staphylococcus aureus subsp. aureus N315
ucaaugacugagaaaaau

SEQ ID NO: 4049620 - RNA, 14 nt, Staphylococcus aureus subsp. aureus N315
ucaaugauuuuaua

SEQ ID NO: 4049621 - RNA, 19 nt, Staphylococcus aureus subsp. aureus N315
ucaaugauuuuauaauauu

SEQ ID NO: 4049622 - RNA, 20 nt, Staphylococcus aureus subsp. aureus N315
ucaaugauuuuauaauauua

SEQ ID NO: 4049623 - RNA, 21 nt, Staphylococcus aureus subsp. aureus N315
ucaaugauuuuauaauauuau

SEQ ID NO: 4049624 - RNA, 21 nt, Staphylococcus aureus subsp. aureus N315
ucaauggugaccaagauucca

SEQ ID NO: 4049625 - RNA, 16 nt, Staphylococcus aureus subsp. aureus N315
ucaauguaagcaacau

SEQ ID NO: 4049626 - RNA, 17 nt, Staphylococcus aureus subsp. aureus N315
ucaauguaagcaacaua

SEQ ID NO: 4049627 - RNA, 15 nt, Staphylococcus aureus subsp. aureus N315
ucaauguauauuuaa

SEQ ID NO: 4049628 - RNA, 16 nt, Staphylococcus aureus subsp. aureus N315
ucaauguauauuuaac

SEQ ID NO: 4049629 - RNA, 17 nt, Staphylococcus aureus subsp. aureus N315
ucaauguauauuuaaca

SEQ ID NO: 4049630 - RNA, 14 nt, Staphylococcus aureus subsp. aureus N315
ucaauguuuaauuu

SEQ ID NO: 4049631 - RNA, 20 nt, Staphylococcus aureus subsp. aureus N315
ucaauguuuaauuuucuaaa

SEQ ID NO: 4049632 - RNA, 16 nt, Staphylococcus aureus subsp. aureus N315
ucaauguuuuaaauuu

SEQ ID NO: 4049633 - RNA, 19 nt, Staphylococcus aureus subsp. aureus N315
ucaauguuuuaaauuuaua

SEQ ID NO: 4049634 - RNA, 20 nt, Staphylococcus aureus subsp. aureus N315
ucaauuaaucggaucauuau

SEQ ID NO: 4049635 - RNA, 19 nt, Staphylococcus aureus subsp. aureus N315
ucaauuaauuuaaaugcuu

SEQ ID NO: 4049636 - RNA, 20 nt, Staphylococcus aureus subsp. aureus N315
ucaauuaauuuaaaugcuua

SEQ ID NO: 4049637 - RNA, 22 nt, Staphylococcus aureus subsp. aureus N315
ucaauuacucuuuuucuuucau

SEQ ID NO: 4049638 - RNA, 14 nt, Staphylococcus aureus subsp. aureus N315
ucaauuauugaaaa

SEQ ID NO: 4049639 - RNA, 15 nt, Staphylococcus aureus subsp. aureus N315
ucaauuauuucaucg

SEQ ID NO: 4049640 - RNA, 21 nt, Staphylococcus aureus subsp. aureus N315
ucaauucgcgucauuuguuca

SEQ ID NO: 4049641 - RNA, 15 nt, Staphylococcus aureus subsp. aureus N315
ucaauucgcucacau

SEQ ID NO: 4049642 - RNA, 12 nt, Staphylococcus aureus subsp. aureus N315
ucaauucucuaa

SEQ ID NO: 4049643 - RNA, 15 nt, Staphylococcus aureus subsp. aureus N315
ucaauuguaaaucuu

SEQ ID NO: 4049644 - RNA, 18 nt, Staphylococcus aureus subsp. aureus N315
ucaauuguuacuuuaacu

SEQ ID NO: 4049645 - RNA, 23 nt, Staphylococcus aureus subsp. aureus N315
ucaauuguugcaaaauacgauuu

SEQ ID NO: 4049646 - RNA, 12 nt, Staphylococcus aureus subsp. aureus N315
ucaauuuaaaua

SEQ ID NO: 4049647 - RNA, 20 nt, Staphylococcus aureus subsp. aureus N315
ucaauuuaaauaaguuacuc

SEQ ID NO: 4049648 - RNA, 18 nt, Staphylococcus aureus subsp. aureus N315
ucaauuuaguauaaauaa

SEQ ID NO: 4049649 - RNA, 23 nt, Staphylococcus aureus subsp. aureus N315
ucaauuuaguccuucuuuacuaa

SEQ ID NO: 4049650 - RNA, 22 nt, Staphylococcus aureus subsp. aureus N315
ucaauuucaacuuauaaaauga

SEQ ID NO: 4049651 - RNA, 14 nt, Staphylococcus aureus subsp. aureus N315
ucaauuucaccuug

SEQ ID NO: 4049652 - RNA, 22 nt, Staphylococcus aureus subsp. aureus N315
ucaauuucaccuuguaaauuga

SEQ ID NO: 4049653 - RNA, 16 nt, Staphylococcus aureus subsp. aureus N315
ucaauuucauuugaaa

SEQ ID NO: 4049654 - RNA, 14 nt, Staphylococcus aureus subsp. aureus N315
ucaauuucauuuuu

SEQ ID NO: 4049655 - RNA, 14 nt, Staphylococcus aureus subsp. aureus N315
ucaauuucuguaau

SEQ ID NO: 4049656 - RNA, 18 nt, Staphylococcus aureus subsp. aureus N315
ucaauuuggaaauaucuu

SEQ ID NO: 4049657 - RNA, 19 nt, Staphylococcus aureus subsp. aureus N315
ucaauuuggaaauaucuua

SEQ ID NO: 4049658 - RNA, 19 nt, Staphylococcus aureus subsp. aureus N315
ucaauuuuaccauguuuua

SEQ ID NO: 4049659 - RNA, 21 nt, Staphylococcus aureus subsp. aureus N315
ucaauuuuuucaugauuuacu

SEQ ID NO: 4049660 - RNA, 13 nt, Staphylococcus aureus subsp. aureus N315
ucacaaagaaauu

SEQ ID NO: 4049661 - RNA, 18 nt, Staphylococcus aureus subsp. aureus N315
ucacaaauuugaauauac

SEQ ID NO: 4049662 - RNA, 15 nt, Staphylococcus aureus subsp. aureus N315
ucacaaguucaggau

SEQ ID NO: 4049663 - RNA, 16 nt, Staphylococcus aureus subsp. aureus N315
ucacaaguuuacaggu

SEQ ID NO: 4049664 - RNA, 21 nt, Staphylococcus aureus subsp. aureus N315
ucacaauacgaaaucaaaaau

SEQ ID NO: 4049665 - RNA, 14 nt, Staphylococcus aureus subsp. aureus N315
ucacaauauaacau

SEQ ID NO: 4049666 - RNA, 14 nt, Staphylococcus aureus subsp. aureus N315
ucacagcaauaaua

SEQ ID NO: 4049667 - RNA, 13 nt, Staphylococcus aureus subsp. aureus N315
ucacauaaaauac

SEQ ID NO: 4049668 - RNA, 16 nt, Staphylococcus aureus subsp. aureus N315
ucacauaaaauacauu

SEQ ID NO: 4049669 - RNA, 20 nt, Staphylococcus aureus subsp. aureus N315
ucacauacauuuugaaacau

SEQ ID NO: 4049670 - RNA, 15 nt, Staphylococcus aureus subsp. aureus N315
ucacauagaguaauu

SEQ ID NO: 4049671 - RNA, 13 nt, Staphylococcus aureus subsp. aureus N315
ucacauauaaaua

SEQ ID NO: 4049672 - RNA, 14 nt, Staphylococcus aureus subsp. aureus N315
ucacauauaaauau

SEQ ID NO: 4049673 - RNA, 18 nt, Staphylococcus aureus subsp. aureus N315
ucacauaugacuuuauuu

SEQ ID NO: 4049674 - RNA, 22 nt, Staphylococcus aureus subsp. aureus N315
ucacaucacguugugcaauacc

SEQ ID NO: 4049675 - RNA, 21 nt, Staphylococcus aureus subsp. aureus N315
ucacaugaggaucaacugaaa

SEQ ID NO: 4049676 - RNA, 23 nt, Staphylococcus aureus subsp. aureus N315
ucacaugaggaucaacugaaauu

SEQ ID NO: 4049677 - RNA, 18 nt, Staphylococcus aureus subsp. aureus N315
ucacauguaccacauuuu

SEQ ID NO: 4049678 - RNA, 15 nt, Staphylococcus aureus subsp. aureus N315
ucacaugugaaauaa

SEQ ID NO: 4049679 - RNA, 15 nt, Staphylococcus aureus subsp. aureus N315
ucacauuaaguuaaa

SEQ ID NO: 4049680 - RNA, 16 nt, Staphylococcus aureus subsp. aureus N315
ucacauuuucaaauuu

SEQ ID NO: 4049681 - RNA, 14 nt, Staphylococcus aureus subsp. aureus N315
ucaccaauauuaau

SEQ ID NO: 4049682 - RNA, 18 nt, Staphylococcus aureus subsp. aureus N315
ucaccaauccgauucacu

SEQ ID NO: 4049683 - RNA, 14 nt, Staphylococcus aureus subsp. aureus N315
ucaccagauuuuaa

SEQ ID NO: 4049684 - RNA, 14 nt, Staphylococcus aureus subsp. aureus N315
ucaccauauuuaac

SEQ ID NO: 4049685 - RNA, 17 nt, Staphylococcus aureus subsp. aureus N315
ucaccaucauauucaac

SEQ ID NO: 4049686 - RNA, 14 nt, Staphylococcus aureus subsp. aureus N315
ucaccguaaucuuu

SEQ ID NO: 4049687 - RNA, 20 nt, Staphylococcus aureus subsp. aureus N315
ucaccguaaucuuuuaacuu

SEQ ID NO: 4049688 - RNA, 17 nt, Staphylococcus aureus subsp. aureus N315
ucaccuaaaaagaaaau

SEQ ID NO: 4049689 - RNA, 20 nt, Staphylococcus aureus subsp. aureus N315
ucaccuaaaugauuaauaac

SEQ ID NO: 4049690 - RNA, 22 nt, Staphylococcus aureus subsp. aureus N315
ucaccugcagcauccuuaccuu

SEQ ID NO: 4049691 - RNA, 21 nt, Staphylococcus aureus subsp. aureus N315
ucaccuuuaggcaaauaaccu

SEQ ID NO: 4049692 - RNA, 14 nt, Staphylococcus aureus subsp. aureus N315
ucacgaauaucuua

SEQ ID NO: 4049693 - RNA, 19 nt, Staphylococcus aureus subsp. aureus N315
ucacgacuugauagcauuu

SEQ ID NO: 4049694 - RNA, 15 nt, Staphylococcus aureus subsp. aureus N315
ucacgauaauguaua

SEQ ID NO: 4049695 - RNA, 14 nt, Staphylococcus aureus subsp. aureus N315
ucacgauauaacau

SEQ ID NO: 4049696 - RNA, 19 nt, Staphylococcus aureus subsp. aureus N315
ucacgauauaacauuaaaa

SEQ ID NO: 4049697 - RNA, 21 nt, Staphylococcus aureus subsp. aureus N315
ucacgauauguugugcugcca

SEQ ID NO: 4049698 - RNA, 14 nt, Staphylococcus aureus subsp. aureus N315
ucacgaucaaauuu

SEQ ID NO: 4049699 - RNA, 13 nt, Staphylococcus aureus subsp. aureus N315
ucacgaucuuuaa

SEQ ID NO: 4049700 - RNA, 18 nt, Staphylococcus aureus subsp. aureus N315
ucacgauuaauaaaauuc

SEQ ID NO: 4049701 - RNA, 19 nt, Staphylococcus aureus subsp. aureus N315
ucacgauuuuuaaaaugcu

SEQ ID NO: 4049702 - RNA, 14 nt, Staphylococcus aureus subsp. aureus N315
ucacgcugaaauuu

SEQ ID NO: 4049703 - RNA, 17 nt, Staphylococcus aureus subsp. aureus N315
ucacguaaugaaucaau

SEQ ID NO: 4049704 - RNA, 16 nt, Staphylococcus aureus subsp. aureus N315
ucacuaaaguaaauaa

SEQ ID NO: 4049705 - RNA, 17 nt, Staphylococcus aureus subsp. aureus N315
ucacuaaaguaaauaac

SEQ ID NO: 4049706 - RNA, 13 nt, Staphylococcus aureus subsp. aureus N315
ucacuaacucaau

SEQ ID NO: 4049707 - RNA, 20 nt, Staphylococcus aureus subsp. aureus N315
ucacuaaucucgguacauuu

SEQ ID NO: 4049708 - RNA, 18 nt, Staphylococcus aureus subsp. aureus N315
ucacuagauaguuuauac

SEQ ID NO: 4049709 - RNA, 16 nt, Staphylococcus aureus subsp. aureus N315
ucacuaggauguucau

SEQ ID NO: 4049710 - RNA, 13 nt, Staphylococcus aureus subsp. aureus N315
ucacuauacaauc

SEQ ID NO: 4049711 - RNA, 18 nt, Staphylococcus aureus subsp. aureus N315
ucacucggcagauguuca

SEQ ID NO: 4049712 - RNA, 15 nt, Staphylococcus aureus subsp. aureus N315
ucacucuuacucauu

SEQ ID NO: 4049713 - RNA, 13 nt, Staphylococcus aureus subsp. aureus N315
ucacugaaaauuu

SEQ ID NO: 4049714 - RNA, 20 nt, Staphylococcus aureus subsp. aureus N315
ucacugcaaacacaguacaa

SEQ ID NO: 4049715 - RNA, 22 nt, Staphylococcus aureus subsp. aureus N315
ucacugcuguuuuuauuauaau

SEQ ID NO: 4049716 - RNA, 21 nt, Staphylococcus aureus subsp. aureus N315
ucacuguauggucuggaauaa

SEQ ID NO: 4049717 - RNA, 23 nt, Staphylococcus aureus subsp. aureus N315
ucacuguauggucuggaauaaau

SEQ ID NO: 4049718 - RNA, 13 nt, Staphylococcus aureus subsp. aureus N315
ucacuguuuuauu

SEQ ID NO: 4049719 - RNA, 16 nt, Staphylococcus aureus subsp. aureus N315
ucacuguuuuauuaug

SEQ ID NO: 4049720 - RNA, 12 nt, Staphylococcus aureus subsp. aureus N315
ucacuuaauaaa

SEQ ID NO: 4049721 - RNA, 20 nt, Staphylococcus aureus subsp. aureus N315
ucacuuacugugaaaauacc

SEQ ID NO: 4049722 - RNA, 11 nt, Staphylococcus aureus subsp. aureus N315
ucacuucaacg

SEQ ID NO: 4049723 - RNA, 20 nt, Staphylococcus aureus subsp. aureus N315
ucacuuggauucaaaugaca

SEQ ID NO: 4049724 - RNA, 15 nt, Staphylococcus aureus subsp. aureus N315
ucacuuuaacuucuu

SEQ ID NO: 4049725 - RNA, 18 nt, Staphylococcus aureus subsp. aureus N315
ucacuuuaacuucuuuug

SEQ ID NO: 4049726 - RNA, 23 nt, Staphylococcus aureus subsp. aureus N315
ucacuuuagauaaacucuaaaua

SEQ ID NO: 4049727 - RNA, 21 nt, Staphylococcus aureus subsp. aureus N315
ucacuuuuuaaacguacauuu

SEQ ID NO: 4049728 - RNA, 19 nt, Staphylococcus aureus subsp. aureus N315
ucagaaguuguuuagaaaa

SEQ ID NO: 4049729 - RNA, 12 nt, Staphylococcus aureus subsp. aureus N315
ucagaguagaaa

SEQ ID NO: 4049730 - RNA, 15 nt, Staphylococcus aureus subsp. aureus N315
ucagaugauuuaauu

SEQ ID NO: 4049731 - RNA, 18 nt, Staphylococcus aureus subsp. aureus N315
ucagaugauuuaauucug

SEQ ID NO: 4049732 - RNA, 20 nt, Staphylococcus aureus subsp. aureus N315
ucagcaccgacaauuauaau

SEQ ID NO: 4049733 - RNA, 19 nt, Staphylococcus aureus subsp. aureus N315
ucagcauuaaucguauuuu

SEQ ID NO: 4049734 - RNA, 20 nt, Staphylococcus aureus subsp. aureus N315
ucagcauugggacauaaaau

SEQ ID NO: 4049735 - RNA, 14 nt, Staphylococcus aureus subsp. aureus N315
ucagccacugucau

SEQ ID NO: 4049736 - RNA, 17 nt, Staphylococcus aureus subsp. aureus N315
ucagccacugucaugug

SEQ ID NO: 4049737 - RNA, 15 nt, Staphylococcus aureus subsp. aureus N315
ucagcgucauauguu

SEQ ID NO: 4049738 - RNA, 13 nt, Staphylococcus aureus subsp. aureus N315
ucagcuuauuaag

SEQ ID NO: 4049739 - RNA, 10 nt, Staphylococcus aureus subsp. aureus N315
ucagcuuguu

SEQ ID NO: 4049740 - RNA, 16 nt, Staphylococcus aureus subsp. aureus N315
ucagcuuuaauaauau

SEQ ID NO: 4049741 - RNA, 18 nt, Staphylococcus aureus subsp. aureus N315
ucagcuuuggcgacauaa

SEQ ID NO: 4049742 - RNA, 22 nt, Staphylococcus aureus subsp. aureus N315
ucagcuuuggcgacauaaauac

SEQ ID NO: 4049743 - RNA, 13 nt, Staphylococcus aureus subsp. aureus N315
ucagcuuuuucac

SEQ ID NO: 4049744 - RNA, 23 nt, Staphylococcus aureus subsp. aureus N315
ucagcuuuuucacauugccuaag

SEQ ID NO: 4049745 - RNA, 16 nt, Staphylococcus aureus subsp. aureus N315
ucaggaauagauguca

SEQ ID NO: 4049746 - RNA, 18 nt, Staphylococcus aureus subsp. aureus N315
ucaggaccaaauagagaa

SEQ ID NO: 4049747 - RNA, 22 nt, Staphylococcus aureus subsp. aureus N315
ucaggaccaaauagagaaauac

SEQ ID NO: 4049748 - RNA, 18 nt, Staphylococcus aureus subsp. aureus N315
ucaggcuuaauuaauaaa

SEQ ID NO: 4049749 - RNA, 18 nt, Staphylococcus aureus subsp. aureus N315
ucaggcuuuguuuuucac

SEQ ID NO: 4049750 - RNA, 14 nt, Staphylococcus aureus subsp. aureus N315
ucagggaaaucauc

SEQ ID NO: 4049751 - RNA, 16 nt, Staphylococcus aureus subsp. aureus N315
ucagggaaaucaucug

SEQ ID NO: 4049752 - RNA, 16 nt, Staphylococcus aureus subsp. aureus N315
ucaguaaaaacgaaau

SEQ ID NO: 4049753 - RNA, 17 nt, Staphylococcus aureus subsp. aureus N315
ucaguaaaaacgaaauu

SEQ ID NO: 4049754 - RNA, 16 nt, Staphylococcus aureus subsp. aureus N315
ucaguaaucuuguuuu

SEQ ID NO: 4049755 - RNA, 16 nt, Staphylococcus aureus subsp. aureus N315
ucaguaccaaagaaau

SEQ ID NO: 4049756 - RNA, 17 nt, Staphylococcus aureus subsp. aureus N315
ucaguacgaacaacuaa

SEQ ID NO: 4049757 - RNA, 23 nt, Staphylococcus aureus subsp. aureus N315
ucaguacgguuauuuaauaaugc

SEQ ID NO: 4049758 - RNA, 15 nt, Staphylococcus aureus subsp. aureus N315
ucagucauucacaua

SEQ ID NO: 4049759 - RNA, 20 nt, Staphylococcus aureus subsp. aureus N315
ucaguccgcuuuuucauaga

SEQ ID NO: 4049760 - RNA, 23 nt, Staphylococcus aureus subsp. aureus N315
ucagucucuaaaacuuuuucaau

SEQ ID NO: 4049761 - RNA, 13 nt, Staphylococcus aureus subsp. aureus N315
ucagugcauuuuu

SEQ ID NO: 4049762 - RNA, 23 nt, Staphylococcus aureus subsp. aureus N315
ucagugcauuuuuuauuuuacuu

SEQ ID NO: 4049763 - RNA, 19 nt, Staphylococcus aureus subsp. aureus N315
ucaguuaaaauaaccauuu

SEQ ID NO: 4049764 - RNA, 13 nt, Staphylococcus aureus subsp. aureus N315
ucaguuaaaucuu

SEQ ID NO: 4049765 - RNA, 14 nt, Staphylococcus aureus subsp. aureus N315
ucaguuaaaucuuu

SEQ ID NO: 4049766 - RNA, 13 nt, Staphylococcus aureus subsp. aureus N315
ucaguuaauaauu

SEQ ID NO: 4049767 - RNA, 18 nt, Staphylococcus aureus subsp. aureus N315
ucaguuauaccauauuua

SEQ ID NO: 4049768 - RNA, 16 nt, Staphylococcus aureus subsp. aureus N315
ucaguugagucaauuu

SEQ ID NO: 4049769 - RNA, 19 nt, Staphylococcus aureus subsp. aureus N315
ucauaaaaaucauaaauaa

SEQ ID NO: 4049770 - RNA, 13 nt, Staphylococcus aureus subsp. aureus N315
ucauaaaauacca

SEQ ID NO: 4049771 - RNA, 13 nt, Staphylococcus aureus subsp. aureus N315
ucauaaaauuuaa

SEQ ID NO: 4049772 - RNA, 15 nt, Staphylococcus aureus subsp. aureus N315
ucauaaaauuuaaaa

SEQ ID NO: 4049773 - RNA, 18 nt, Staphylococcus aureus subsp. aureus N315
ucauaaaauuuaaaacaa

SEQ ID NO: 4049774 - RNA, 15 nt, Staphylococcus aureus subsp. aureus N315
ucauaaaguuuauuu

SEQ ID NO: 4049775 - RNA, 12 nt, Staphylococcus aureus subsp. aureus N315
ucauaaauauuu

SEQ ID NO: 4049776 - RNA, 15 nt, Staphylococcus aureus subsp. aureus N315
ucauaaaucaugaaa

SEQ ID NO: 4049777 - RNA, 22 nt, Staphylococcus aureus subsp. aureus N315
ucauaaaucaugaaauaaaaaa

SEQ ID NO: 4049778 - RNA, 21 nt, Staphylococcus aureus subsp. aureus N315
ucauaaccgcuucuuuuaagu

SEQ ID NO: 4049779 - RNA, 15 nt, Staphylococcus aureus subsp. aureus N315
ucauaaguuaaaguu

SEQ ID NO: 4049780 - RNA, 13 nt, Staphylococcus aureus subsp. aureus N315
ucauaauaauuca

SEQ ID NO: 4049781 - RNA, 21 nt, Staphylococcus aureus subsp. aureus N315
ucauaauauugaugaauaaau

SEQ ID NO: 4049782 - RNA, 18 nt, Staphylococcus aureus subsp. aureus N315
ucauaaucaagucugcau

SEQ ID NO: 4049783 - RNA, 14 nt, Staphylococcus aureus subsp. aureus N315
ucauaaugaauaau

SEQ ID NO: 4049784 - RNA, 18 nt, Staphylococcus aureus subsp. aureus N315
ucauaaugaauaauuaaa

SEQ ID NO: 4049785 - RNA, 21 nt, Staphylococcus aureus subsp. aureus N315
ucauaaugaauaauuaaaaaa

SEQ ID NO: 4049786 - RNA, 11 nt, Staphylococcus aureus subsp. aureus N315
ucauaauuaau

SEQ ID NO: 4049787 - RNA, 16 nt, Staphylococcus aureus subsp. aureus N315
ucauaauuaauaacau

SEQ ID NO: 4049788 - RNA, 12 nt, Staphylococcus aureus subsp. aureus N315
ucauaauuuaaa

SEQ ID NO: 4049789 - RNA, 18 nt, Staphylococcus aureus subsp. aureus N315
ucauacacugcacaucau

SEQ ID NO: 4049790 - RNA, 18 nt, Staphylococcus aureus subsp. aureus N315
ucauaccaaaaacauuaa

SEQ ID NO: 4049791 - RNA, 18 nt, Staphylococcus aureus subsp. aureus N315
ucauaccgaagaaacuaa

SEQ ID NO: 4049792 - RNA, 17 nt, Staphylococcus aureus subsp. aureus N315
ucauaccgacaccuaua

SEQ ID NO: 4049793 - RNA, 16 nt, Staphylococcus aureus subsp. aureus N315
ucauaccuuuuaauuu

SEQ ID NO: 4049794 - RNA, 14 nt, Staphylococcus aureus subsp. aureus N315
ucauacgagaaauu

SEQ ID NO: 4049795 - RNA, 22 nt, Staphylococcus aureus subsp. aureus N315
ucauacgcaaugauuauaaaua

SEQ ID NO: 4049796 - RNA, 16 nt, Staphylococcus aureus subsp. aureus N315
ucauagagguuaaccu

SEQ ID NO: 4049797 - RNA, 15 nt, Staphylococcus aureus subsp. aureus N315
ucauaguuaucgauu

SEQ ID NO: 4049798 - RNA, 14 nt, Staphylococcus aureus subsp. aureus N315
ucauaguuauuaaa

SEQ ID NO: 4049799 - RNA, 15 nt, Staphylococcus aureus subsp. aureus N315
ucauaguuauuaaau

SEQ ID NO: 4049800 - RNA, 18 nt, Staphylococcus aureus subsp. aureus N315
ucauaguuauuaaaucuu

SEQ ID NO: 4049801 - RNA, 16 nt, Staphylococcus aureus subsp. aureus N315
ucauaguucaaauuga

SEQ ID NO: 4049802 - RNA, 20 nt, Staphylococcus aureus subsp. aureus N315
ucauaguucaaauugaacuu

SEQ ID NO: 4049803 - RNA, 20 nt, Staphylococcus aureus subsp. aureus N315
ucauauaaaacaaaaacggu

SEQ ID NO: 4049804 - RNA, 13 nt, Staphylococcus aureus subsp. aureus N315
ucauauaaauagc

SEQ ID NO: 4049805 - RNA, 21 nt, Staphylococcus aureus subsp. aureus N315
ucauauaaaucguaauaauuu

SEQ ID NO: 4049806 - RNA, 14 nt, Staphylococcus aureus subsp. aureus N315
ucauauaaugaaug

SEQ ID NO: 4049807 - RNA, 15 nt, Staphylococcus aureus subsp. aureus N315
ucauauaugauaaau

SEQ ID NO: 4049808 - RNA, 17 nt, Staphylococcus aureus subsp. aureus N315
ucauaucuuuauuugau

SEQ ID NO: 4049809 - RNA, 20 nt, Staphylococcus aureus subsp. aureus N315
ucauaucuuucaauuaauuu

SEQ ID NO: 4049810 - RNA, 15 nt, Staphylococcus aureus subsp. aureus N315
ucauaugcaucaaca

SEQ ID NO: 4049811 - RNA, 15 nt, Staphylococcus aureus subsp. aureus N315
ucauauggaauacua

SEQ ID NO: 4049812 - RNA, 18 nt, Staphylococcus aureus subsp. aureus N315
ucauauguuuuauaauaa

SEQ ID NO: 4049813 - RNA, 14 nt, Staphylococcus aureus subsp. aureus N315
ucauauucaaaaua

SEQ ID NO: 4049814 - RNA, 17 nt, Staphylococcus aureus subsp. aureus N315
ucauauucaauguuuua

SEQ ID NO: 4049815 - RNA, 13 nt, Staphylococcus aureus subsp. aureus N315
ucauauucacauc

SEQ ID NO: 4049816 - RNA, 16 nt, Staphylococcus aureus subsp. aureus N315
ucauauucacaucuuu

SEQ ID NO: 4049817 - RNA, 20 nt, Staphylococcus aureus subsp. aureus N315
ucauauucacaucuuuagcu

SEQ ID NO: 4049818 - RNA, 18 nt, Staphylococcus aureus subsp. aureus N315
ucauauuuagguaauaca

SEQ ID NO: 4049819 - RNA, 11 nt, Staphylococcus aureus subsp. aureus N315
ucauauuuaua

SEQ ID NO: 4049820 - RNA, 21 nt, Staphylococcus aureus subsp. aureus N315
ucauauuuauauuuacacaga

SEQ ID NO: 4049821 - RNA, 17 nt, Staphylococcus aureus subsp. aureus N315
ucauauuugaauacuuu

SEQ ID NO: 4049822 - RNA, 14 nt, Staphylococcus aureus subsp. aureus N315
ucaucaaaaguuug

SEQ ID NO: 4049823 - RNA, 14 nt, Staphylococcus aureus subsp. aureus N315
ucaucaaacaacau

SEQ ID NO: 4049824 - RNA, 18 nt, Staphylococcus aureus subsp. aureus N315
ucaucaaacaacaucacu

SEQ ID NO: 4049825 - RNA, 15 nt, Staphylococcus aureus subsp. aureus N315
ucaucaaguuuaucu

SEQ ID NO: 4049826 - RNA, 22 nt, Staphylococcus aureus subsp. aureus N315
ucaucaauaaauauugauucua

SEQ ID NO: 4049827 - RNA, 12 nt, Staphylococcus aureus subsp. aureus N315
ucaucaauaagg

SEQ ID NO: 4049828 - RNA, 12 nt, Staphylococcus aureus subsp. aureus N315
ucaucaauaauu

SEQ ID NO: 4049829 - RNA, 13 nt, Staphylococcus aureus subsp. aureus N315
ucaucaauuggca

SEQ ID NO: 4049830 - RNA, 19 nt, Staphylococcus aureus subsp. aureus N315
ucaucaguaccaaagaaau

SEQ ID NO: 4049831 - RNA, 13 nt, Staphylococcus aureus subsp. aureus N315
ucaucauaaucug

SEQ ID NO: 4049832 - RNA, 19 nt, Staphylococcus aureus subsp. aureus N315
ucaucauaaucugcugcug

SEQ ID NO: 4049833 - RNA, 20 nt, Staphylococcus aureus subsp. aureus N315
ucaucaugacuauuuuccau

SEQ ID NO: 4049834 - RNA, 22 nt, Staphylococcus aureus subsp. aureus N315
ucaucaugcauaaucaucauug

SEQ ID NO: 4049835 - RNA, 13 nt, Staphylococcus aureus subsp. aureus N315
ucaucauguucua

SEQ ID NO: 4049836 - RNA, 12 nt, Staphylococcus aureus subsp. aureus N315
ucaucguauuuc

SEQ ID NO: 4049837 - RNA, 14 nt, Staphylococcus aureus subsp. aureus N315
ucaucuaaaaugag

SEQ ID NO: 4049838 - RNA, 21 nt, Staphylococcus aureus subsp. aureus N315
ucaucuaaaaugaguuguuca

SEQ ID NO: 4049839 - RNA, 20 nt, Staphylococcus aureus subsp. aureus N315
ucaucuaaccuuuucaucag

SEQ ID NO: 4049840 - RNA, 21 nt, Staphylococcus aureus subsp. aureus N315
ucaucuacuauuuaaucuuaa

SEQ ID NO: 4049841 - RNA, 19 nt, Staphylococcus aureus subsp. aureus N315
ucaucuauauuuaauuuug

SEQ ID NO: 4049842 - RNA, 12 nt, Staphylococcus aureus subsp. aureus N315
ucaucuauuuaa

SEQ ID NO: 4049843 - RNA, 22 nt, Staphylococcus aureus subsp. aureus N315
ucaucuauuuuuaacuaauaga

SEQ ID NO: 4049844 - RNA, 22 nt, Staphylococcus aureus subsp. aureus N315
ucaucugaugaggcaauauuaa

SEQ ID NO: 4049845 - RNA, 20 nt, Staphylococcus aureus subsp. aureus N315
ucaucuuagacgcuguuuua

SEQ ID NO: 4049846 - RNA, 19 nt, Staphylococcus aureus subsp. aureus N315
ucaucuucugaauuuaaua

SEQ ID NO: 4049847 - RNA, 13 nt, Staphylococcus aureus subsp. aureus N315
ucaucuuuaugca

SEQ ID NO: 4049848 - RNA, 22 nt, Staphylococcus aureus subsp. aureus N315
ucaucuuucacaauuguauaau

SEQ ID NO: 4049849 - RNA, 18 nt, Staphylococcus aureus subsp. aureus N315
ucaucuuuuugaaauuuc

SEQ ID NO: 4049850 - RNA, 18 nt, Staphylococcus aureus subsp. aureus N315
ucaugaaaauaagcauca

SEQ ID NO: 4049851 - RNA, 23 nt, Staphylococcus aureus subsp. aureus N315
ucaugacacguccaccaacuuua

SEQ ID NO: 4049852 - RNA, 18 nt, Staphylococcus aureus subsp. aureus N315
ucaugacauaaaacuuac

SEQ ID NO: 4049853 - RNA, 16 nt, Staphylococcus aureus subsp. aureus N315
ucaugaugauaaauug

SEQ ID NO: 4049854 - RNA, 15 nt, Staphylococcus aureus subsp. aureus N315
ucaugcaaaauaaua

SEQ ID NO: 4049855 - RNA, 16 nt, Staphylococcus aureus subsp. aureus N315
ucaugcauaaucauca

SEQ ID NO: 4049856 - RNA, 19 nt, Staphylococcus aureus subsp. aureus N315
ucaugcauaaucaucauug

SEQ ID NO: 4049857 - RNA, 13 nt, Staphylococcus aureus subsp. aureus N315
ucaugccuucauu

SEQ ID NO: 4049858 - RNA, 19 nt, Staphylococcus aureus subsp. aureus N315
ucaugcuuaucuguaaaua

SEQ ID NO: 4049859 - RNA, 20 nt, Staphylococcus aureus subsp. aureus N315
ucauguaaugcuuaaaaaca

SEQ ID NO: 4049860 - RNA, 18 nt, Staphylococcus aureus subsp. aureus N315
ucauguacaguuacuuuc

SEQ ID NO: 4049861 - RNA, 17 nt, Staphylococcus aureus subsp. aureus N315
ucauguauauggcauca

SEQ ID NO: 4049862 - RNA, 22 nt, Staphylococcus aureus subsp. aureus N315
ucaugugcaagcuuuuuaggaa

SEQ ID NO: 4049863 - RNA, 22 nt, Staphylococcus aureus subsp. aureus N315
ucaugugcaagugguaaaaaug

SEQ ID NO: 4049864 - RNA, 21 nt, Staphylococcus aureus subsp. aureus N315
ucaugugucacaaugaccauu

SEQ ID NO: 4049865 - RNA, 17 nt, Staphylococcus aureus subsp. aureus N315
ucaugugucauaaucca

SEQ ID NO: 4049866 - RNA, 20 nt, Staphylococcus aureus subsp. aureus N315
ucaugugucuuccaaucaac

SEQ ID NO: 4049867 - RNA, 18 nt, Staphylococcus aureus subsp. aureus N315
ucauguucuuauaaaaaa

SEQ ID NO: 4049868 - RNA, 12 nt, Staphylococcus aureus subsp. aureus N315
ucauguuugauu

SEQ ID NO: 4049869 - RNA, 14 nt, Staphylococcus aureus subsp. aureus N315
ucauuaauaaauug

SEQ ID NO: 4049870 - RNA, 12 nt, Staphylococcus aureus subsp. aureus N315
ucauuaauacaa

SEQ ID NO: 4049871 - RNA, 21 nt, Staphylococcus aureus subsp. aureus N315
ucauuacguaacaucacauaa

SEQ ID NO: 4049872 - RNA, 17 nt, Staphylococcus aureus subsp. aureus N315
ucauuagcauuauuauu

SEQ ID NO: 4049873 - RNA, 18 nt, Staphylococcus aureus subsp. aureus N315
ucauuagcgcaagagaua

SEQ ID NO: 4049874 - RNA, 20 nt, Staphylococcus aureus subsp. aureus N315
ucauuagcgcaagagauaag

SEQ ID NO: 4049875 - RNA, 23 nt, Staphylococcus aureus subsp. aureus N315
ucauuaggucuacgaucaaaauc

SEQ ID NO: 4049876 - RNA, 15 nt, Staphylococcus aureus subsp. aureus N315
ucauuaguguagaaa

SEQ ID NO: 4049877 - RNA, 22 nt, Staphylococcus aureus subsp. aureus N315
ucauuaguugccccuagcaaaa

SEQ ID NO: 4049878 - RNA, 15 nt, Staphylococcus aureus subsp. aureus N315
ucauuaguuguauca

SEQ ID NO: 4049879 - RNA, 16 nt, Staphylococcus aureus subsp. aureus N315
ucauuauaaugauuuu

SEQ ID NO: 4049880 - RNA, 19 nt, Staphylococcus aureus subsp. aureus N315
ucauuauauaauucuucaa

SEQ ID NO: 4049881 - RNA, 13 nt, Staphylococcus aureus subsp. aureus N315
ucauuauuuaaau

SEQ ID NO: 4049882 - RNA, 20 nt, Staphylococcus aureus subsp. aureus N315
ucauuauuuagaauucuaaa

SEQ ID NO: 4049883 - RNA, 21 nt, Staphylococcus aureus subsp. aureus N315
ucauuauuugauaaauaaaau

SEQ ID NO: 4049884 - RNA, 21 nt, Staphylococcus aureus subsp. aureus N315
ucauucaaguguaguaaaaau

SEQ ID NO: 4049885 - RNA, 19 nt, Staphylococcus aureus subsp. aureus N315
ucauucaccuaaaaagaaa

SEQ ID NO: 4049886 - RNA, 21 nt, Staphylococcus aureus subsp. aureus N315
ucauucagucaacuacuguca

SEQ ID NO: 4049887 - RNA, 19 nt, Staphylococcus aureus subsp. aureus N315
ucauucuguguaaauauaa

SEQ ID NO: 4049888 - RNA, 16 nt, Staphylococcus aureus subsp. aureus N315
ucauucuuuaauauaa

SEQ ID NO: 4049889 - RNA, 20 nt, Staphylococcus aureus subsp. aureus N315
ucauucuuuaauauaaauuu

SEQ ID NO: 4049890 - RNA, 20 nt, Staphylococcus aureus subsp. aureus N315
ucauuggauagguaacuaaa

SEQ ID NO: 4049891 - RNA, 19 nt, Staphylococcus aureus subsp. aureus N315
ucauugguuucaucauauc

SEQ ID NO: 4049892 - RNA, 14 nt, Staphylococcus aureus subsp. aureus N315
ucauuguaacucaa

SEQ ID NO: 4049893 - RNA, 15 nt, Staphylococcus aureus subsp. aureus N315
ucauuguaauaauaa

SEQ ID NO: 4049894 - RNA, 12 nt, Staphylococcus aureus subsp. aureus N315
ucauuguauaaa

SEQ ID NO: 4049895 - RNA, 14 nt, Staphylococcus aureus subsp. aureus N315
ucauuguauaaaaa

SEQ ID NO: 4049896 - RNA, 15 nt, Staphylococcus aureus subsp. aureus N315
ucauuguauaaaaag

SEQ ID NO: 4049897 - RNA, 16 nt, Staphylococcus aureus subsp. aureus N315
ucauuguauaaaaagu

SEQ ID NO: 4049898 - RNA, 16 nt, Staphylococcus aureus subsp. aureus N315
ucauugugguauuaau

SEQ ID NO: 4049899 - RNA, 18 nt, Staphylococcus aureus subsp. aureus N315
ucauuguguauuguuuua

SEQ ID NO: 4049900 - RNA, 19 nt, Staphylococcus aureus subsp. aureus N315
ucauuguguccauaaauau

SEQ ID NO: 4049901 - RNA, 22 nt, Staphylococcus aureus subsp. aureus N315
ucauuguguccauaaauauuaa

SEQ ID NO: 4049902 - RNA, 14 nt, Staphylococcus aureus subsp. aureus N315
ucauuguuauuuau

SEQ ID NO: 4049903 - RNA, 14 nt, Staphylococcus aureus subsp. aureus N315
ucauuuaaaauuug

SEQ ID NO: 4049904 - RNA, 13 nt, Staphylococcus aureus subsp. aureus N315
ucauuuaaauauu

SEQ ID NO: 4049905 - RNA, 20 nt, Staphylococcus aureus subsp. aureus N315
ucauuuaacauguauuuagu

SEQ ID NO: 4049906 - RNA, 18 nt, Staphylococcus aureus subsp. aureus N315
ucauuuaguuaaauacaa

SEQ ID NO: 4049907 - RNA, 15 nt, Staphylococcus aureus subsp. aureus N315
ucauuuauaaacauu

SEQ ID NO: 4049908 - RNA, 15 nt, Staphylococcus aureus subsp. aureus N315
ucauuuauaacauuu

SEQ ID NO: 4049909 - RNA, 15 nt, Staphylococcus aureus subsp. aureus N315
ucauuuaucuagacu

SEQ ID NO: 4049910 - RNA, 18 nt, Staphylococcus aureus subsp. aureus N315
ucauuucaauauuaaaau

SEQ ID NO: 4049911 - RNA, 19 nt, Staphylococcus aureus subsp. aureus N315
ucauuucaauauuaaaaua

SEQ ID NO: 4049912 - RNA, 22 nt, Staphylococcus aureus subsp. aureus N315
ucauuucaauauuaaaauacgg

SEQ ID NO: 4049913 - RNA, 16 nt, Staphylococcus aureus subsp. aureus N315
ucauuucgauuaauuu

SEQ ID NO: 4049914 - RNA, 22 nt, Staphylococcus aureus subsp. aureus N315
ucauuugaacaucauuuaauug

SEQ ID NO: 4049915 - RNA, 18 nt, Staphylococcus aureus subsp. aureus N315
ucauuugauuuaaaaagu

SEQ ID NO: 4049916 - RNA, 16 nt, Staphylococcus aureus subsp. aureus N315
ucauuuggcguucaac

SEQ ID NO: 4049917 - RNA, 20 nt, Staphylococcus aureus subsp. aureus N315
ucauuuggcguucaacauua

SEQ ID NO: 4049918 - RNA, 12 nt, Staphylococcus aureus subsp. aureus N315
ucauuuguagga

SEQ ID NO: 4049919 - RNA, 17 nt, Staphylococcus aureus subsp. aureus N315
ucauuuguguaaaugaa

SEQ ID NO: 4049920 - RNA, 13 nt, Staphylococcus aureus subsp. aureus N315
ucauuuguuguua

SEQ ID NO: 4049921 - RNA, 18 nt, Staphylococcus aureus subsp. aureus N315
ucauuuucaaauaacuga

SEQ ID NO: 4049922 - RNA, 14 nt, Staphylococcus aureus subsp. aureus N315
ucauuuucaacaua

SEQ ID NO: 4049923 - RNA, 16 nt, Staphylococcus aureus subsp. aureus N315
ucauuuucaacauaau

SEQ ID NO: 4049924 - RNA, 19 nt, Staphylococcus aureus subsp. aureus N315
ucauuuucaacauaauauu

SEQ ID NO: 4049925 - RNA, 19 nt, Staphylococcus aureus subsp. aureus N315
ucauuuucauucagucaac

SEQ ID NO: 4049926 - RNA, 11 nt, Staphylococcus aureus subsp. aureus N315
ucauuuuuaau

SEQ ID NO: 4049927 - RNA, 16 nt, Staphylococcus aureus subsp. aureus N315
ucauuuuuauaaauuu

SEQ ID NO: 4049928 - RNA, 17 nt, Staphylococcus aureus subsp. aureus N315
ucauuuuucguuguuca

SEQ ID NO: 4049929 - RNA, 12 nt, Staphylococcus aureus subsp. aureus N315
ucauuuuuucaa

SEQ ID NO: 4049930 - RNA, 13 nt, Staphylococcus aureus subsp. aureus N315
uccaaaaauugua

SEQ ID NO: 4049931 - RNA, 19 nt, Staphylococcus aureus subsp. aureus N315
uccaaaaauuguaaaaccu

SEQ ID NO: 4049932 - RNA, 14 nt, Staphylococcus aureus subsp. aureus N315
uccaaaacauuuug

SEQ ID NO: 4049933 - RNA, 16 nt, Staphylococcus aureus subsp. aureus N315
uccaaaauccugaaau

SEQ ID NO: 4049934 - RNA, 21 nt, Staphylococcus aureus subsp. aureus N315
uccaaagcuugauuuaacaac

SEQ ID NO: 4049935 - RNA, 17 nt, Staphylococcus aureus subsp. aureus N315
uccaaaggccaugagcu

SEQ ID NO: 4049936 - RNA, 15 nt, Staphylococcus aureus subsp. aureus N315
uccaaaguaauauga

SEQ ID NO: 4049937 - RNA, 18 nt, Staphylococcus aureus subsp. aureus N315
uccaaaguacucaaguaa

SEQ ID NO: 4049938 - RNA, 14 nt, Staphylococcus aureus subsp. aureus N315
uccaaauaaauaua

SEQ ID NO: 4049939 - RNA, 18 nt, Staphylococcus aureus subsp. aureus N315
uccaaaucgugauaucuu

SEQ ID NO: 4049940 - RNA, 21 nt, Staphylococcus aureus subsp. aureus N315
uccaaauguucagguucaaaa

SEQ ID NO: 4049941 - RNA, 18 nt, Staphylococcus aureus subsp. aureus N315
uccaaauucauuuguauu

SEQ ID NO: 4049942 - RNA, 19 nt, Staphylococcus aureus subsp. aureus N315
uccaaauucauuuguauua

SEQ ID NO: 4049943 - RNA, 22 nt, Staphylococcus aureus subsp. aureus N315
uccaaauugcaaaguaacaaua

SEQ ID NO: 4049944 - RNA, 18 nt, Staphylococcus aureus subsp. aureus N315
uccaacacccauauaauu

SEQ ID NO: 4049945 - RNA, 16 nt, Staphylococcus aureus subsp. aureus N315
uccaagagaauuaaua

SEQ ID NO: 4049946 - RNA, 17 nt, Staphylococcus aureus subsp. aureus N315
uccaagagaauuaauaa

SEQ ID NO: 4049947 - RNA, 20 nt, Staphylococcus aureus subsp. aureus N315
uccaagagaauuaauaauuu

SEQ ID NO: 4049948 - RNA, 19 nt, Staphylococcus aureus subsp. aureus N315
uccaagauuaugacaacau

SEQ ID NO: 4049949 - RNA, 18 nt, Staphylococcus aureus subsp. aureus N315
uccaaggauguuauaaaa

SEQ ID NO: 4049950 - RNA, 19 nt, Staphylococcus aureus subsp. aureus N315
uccaagugacaacauuauu

SEQ ID NO: 4049951 - RNA, 15 nt, Staphylococcus aureus subsp. aureus N315
uccaaguuaaugcac

SEQ ID NO: 4049952 - RNA, 17 nt, Staphylococcus aureus subsp. aureus N315
uccaauaauaaaccuaa

SEQ ID NO: 4049953 - RNA, 14 nt, Staphylococcus aureus subsp. aureus N315
uccaauaaugaaau

SEQ ID NO: 4049954 - RNA, 18 nt, Staphylococcus aureus subsp. aureus N315
uccaauaaugaaaugaag

SEQ ID NO: 4049955 - RNA, 19 nt, Staphylococcus aureus subsp. aureus N315
uccaauacuuuuuauauaa

SEQ ID NO: 4049956 - RNA, 15 nt, Staphylococcus aureus subsp. aureus N315
uccaaucuauuaaug

SEQ ID NO: 4049957 - RNA, 22 nt, Staphylococcus aureus subsp. aureus N315
uccaaucuauuuuaaacucauc

SEQ ID NO: 4049958 - RNA, 11 nt, Staphylococcus aureus subsp. aureus N315
uccaaugaauc

SEQ ID NO: 4049959 - RNA, 15 nt, Staphylococcus aureus subsp. aureus N315
uccaauuaaauauuu

SEQ ID NO: 4049960 - RNA, 15 nt, Staphylococcus aureus subsp. aureus N315
uccaauuaccaauga

SEQ ID NO: 4049961 - RNA, 21 nt, Staphylococcus aureus subsp. aureus N315
uccaauuaccaaugaauaaau

SEQ ID NO: 4049962 - RNA, 15 nt, Staphylococcus aureus subsp. aureus N315
uccaauuauguuuau

SEQ ID NO: 4049963 - RNA, 19 nt, Staphylococcus aureus subsp. aureus N315
uccaauucauuuuauaaau

SEQ ID NO: 4049964 - RNA, 13 nt, Staphylococcus aureus subsp. aureus N315
uccaauucucuua

SEQ ID NO: 4049965 - RNA, 17 nt, Staphylococcus aureus subsp. aureus N315
uccaauuuaaaaugauu

SEQ ID NO: 4049966 - RNA, 14 nt, Staphylococcus aureus subsp. aureus N315
uccaauuucucuau

SEQ ID NO: 4049967 - RNA, 15 nt, Staphylococcus aureus subsp. aureus N315
uccacgcucacauua

SEQ ID NO: 4049968 - RNA, 16 nt, Staphylococcus aureus subsp. aureus N315
uccacgcucacauuaa

SEQ ID NO: 4049969 - RNA, 23 nt, Staphylococcus aureus subsp. aureus N315
uccacguuugaccacaacuucuu

SEQ ID NO: 4049970 - RNA, 17 nt, Staphylococcus aureus subsp. aureus N315
uccacuucaucuaaaug

SEQ ID NO: 4049971 - RNA, 13 nt, Staphylococcus aureus subsp. aureus N315
uccacuuuauaau

SEQ ID NO: 4049972 - RNA, 17 nt, Staphylococcus aureus subsp. aureus N315
uccagcagucauuugau

SEQ ID NO: 4049973 - RNA, 19 nt, Staphylococcus aureus subsp. aureus N315
uccagcguauauugaaauu

SEQ ID NO: 4049974 - RNA, 20 nt, Staphylococcus aureus subsp. aureus N315
uccagcguauauugaaauua

SEQ ID NO: 4049975 - RNA, 14 nt, Staphylococcus aureus subsp. aureus N315
uccaguauuaacug

SEQ ID NO: 4049976 - RNA, 23 nt, Staphylococcus aureus subsp. aureus N315
uccaguccuuuuuuuauguuuaa

SEQ ID NO: 4049977 - RNA, 16 nt, Staphylococcus aureus subsp. aureus N315
uccaguggaaaugaua

SEQ ID NO: 4049978 - RNA, 23 nt, Staphylococcus aureus subsp. aureus N315
uccaguggaaaugauaauuuaau

SEQ ID NO: 4049979 - RNA, 19 nt, Staphylococcus aureus subsp. aureus N315
uccaguuuauaacugggau

SEQ ID NO: 4049980 - RNA, 14 nt, Staphylococcus aureus subsp. aureus N315
uccaguuuucaauu

SEQ ID NO: 4049981 - RNA, 15 nt, Staphylococcus aureus subsp. aureus N315
uccaguuuucaauuu

SEQ ID NO: 4049982 - RNA, 16 nt, Staphylococcus aureus subsp. aureus N315
uccaguuuucaauuua

SEQ ID NO: 4049983 - RNA, 23 nt, Staphylococcus aureus subsp. aureus N315
uccaguuuucaauuuauuaacug

SEQ ID NO: 4049984 - RNA, 13 nt, Staphylococcus aureus subsp. aureus N315
uccauaaauauua

SEQ ID NO: 4049985 - RNA, 14 nt, Staphylococcus aureus subsp. aureus N315
uccauaaauauuua

SEQ ID NO: 4049986 - RNA, 18 nt, Staphylococcus aureus subsp. aureus N315
uccauaaucuuuauuaau

SEQ ID NO: 4049987 - RNA, 21 nt, Staphylococcus aureus subsp. aureus N315
uccauacuucuauuuuauaau

SEQ ID NO: 4049988 - RNA, 21 nt, Staphylococcus aureus subsp. aureus N315
uccauaguaaucgauugguaa

SEQ ID NO: 4049989 - RNA, 23 nt, Staphylococcus aureus subsp. aureus N315
uccauauuuuuuaguaauaacau

SEQ ID NO: 4049990 - RNA, 16 nt, Staphylococcus aureus subsp. aureus N315
uccaucaucucugcuu

SEQ ID NO: 4049991 - RNA, 21 nt, Staphylococcus aureus subsp. aureus N315
uccaucauuuguguaaaugaa

SEQ ID NO: 4049992 - RNA, 19 nt, Staphylococcus aureus subsp. aureus N315
uccaucgucaucacuuuuu

SEQ ID NO: 4049993 - RNA, 22 nt, Staphylococcus aureus subsp. aureus N315
uccauuagaacuaagaugugca

SEQ ID NO: 4049994 - RNA, 17 nt, Staphylococcus aureus subsp. aureus N315
uccauucaauguuuaau

SEQ ID NO: 4049995 - RNA, 22 nt, Staphylococcus aureus subsp. aureus N315
uccauucaauguuuaauuuucu

SEQ ID NO: 4049996 - RNA, 17 nt, Staphylococcus aureus subsp. aureus N315
uccauucguauaagaau

SEQ ID NO: 4049997 - RNA, 21 nt, Staphylococcus aureus subsp. aureus N315
uccauugaucuuuuauaauga

SEQ ID NO: 4049998 - RNA, 13 nt, Staphylococcus aureus subsp. aureus N315
uccauugcacuau

SEQ ID NO: 4049999 - RNA, 20 nt, Staphylococcus aureus subsp. aureus N315
uccauugcacuaugcauaau

SEQ ID NO: 4050000 - RNA, 21 nt, Staphylococcus aureus subsp. aureus N315
ucccaaagcgaauuaucuuua

SEQ ID NO: 4050001 - RNA, 15 nt, Staphylococcus aureus subsp. aureus N315
ucccaacuuaauaac

SEQ ID NO: 4050002 - RNA, 17 nt, Staphylococcus aureus subsp. aureus N315
ucccaaugcuugaauuu

SEQ ID NO: 4050003 - RNA, 19 nt, Staphylococcus aureus subsp. aureus N315
ucccacgugccucauccuu

SEQ ID NO: 4050004 - RNA, 20 nt, Staphylococcus aureus subsp. aureus N315
ucccagauucauaucuuuca

SEQ ID NO: 4050005 - RNA, 23 nt, Staphylococcus aureus subsp. aureus N315
ucccagauucauaucuuucaauu

SEQ ID NO: 4050006 - RNA, 19 nt, Staphylococcus aureus subsp. aureus N315
ucccauaaaagacagaaau

SEQ ID NO: 4050007 - RNA, 13 nt, Staphylococcus aureus subsp. aureus N315
ucccauaaugacu

SEQ ID NO: 4050008 - RNA, 22 nt, Staphylococcus aureus subsp. aureus N315
ucccaucuuuuagguaauaauu

SEQ ID NO: 4050009 - RNA, 22 nt, Staphylococcus aureus subsp. aureus N315
ucccauguauucuuagauauua

SEQ ID NO: 4050010 - RNA, 18 nt, Staphylococcus aureus subsp. aureus N315
ucccauuaaaauugcagc

SEQ ID NO: 4050011 - RNA, 22 nt, Staphylococcus aureus subsp. aureus N315
ucccauucaccaauauuaauga

SEQ ID NO: 4050012 - RNA, 14 nt, Staphylococcus aureus subsp. aureus N315
ucccauuuuaaagu

SEQ ID NO: 4050013 - RNA, 13 nt, Staphylococcus aureus subsp. aureus N315
ucccuacugcuug

SEQ ID NO: 4050014 - RNA, 19 nt, Staphylococcus aureus subsp. aureus N315
ucccuaggaaauaaaaaau

SEQ ID NO: 4050015 - RNA, 12 nt, Staphylococcus aureus subsp. aureus N315
ucccuaugaaau

SEQ ID NO: 4050016 - RNA, 21 nt, Staphylococcus aureus subsp. aureus N315
ucccucuaucaaauuaccauu

SEQ ID NO: 4050017 - RNA, 23 nt, Staphylococcus aureus subsp. aureus N315
ucccucuaucaaauuaccauuca

SEQ ID NO: 4050018 - RNA, 17 nt, Staphylococcus aureus subsp. aureus N315
ucccuuaaauacaauuu

SEQ ID NO: 4050019 - RNA, 11 nt, Staphylococcus aureus subsp. aureus N315
ucccuuaauaa

SEQ ID NO: 4050020 - RNA, 12 nt, Staphylococcus aureus subsp. aureus N315
ucccuuaauaau

SEQ ID NO: 4050021 - RNA, 17 nt, Staphylococcus aureus subsp. aureus N315
ucccuuaauaauaagua

SEQ ID NO: 4050022 - RNA, 19 nt, Staphylococcus aureus subsp. aureus N315
ucccuucaaaguagacauu

SEQ ID NO: 4050023 - RNA, 19 nt, Staphylococcus aureus subsp. aureus N315
ucccuucaaaguuuucauu

SEQ ID NO: 4050024 - RNA, 20 nt, Staphylococcus aureus subsp. aureus N315
ucccuuccuagggugccguc

SEQ ID NO: 4050025 - RNA, 17 nt, Staphylococcus aureus subsp. aureus N315
ucccuuuuaucuuuaua

SEQ ID NO: 4050026 - RNA, 12 nt, Staphylococcus aureus subsp. aureus N315
ucccuuuuuaaa

SEQ ID NO: 4050027 - RNA, 15 nt, Staphylococcus aureus subsp. aureus N315
ucccuuuuuaaaaua

SEQ ID NO: 4050028 - RNA, 21 nt, Staphylococcus aureus subsp. aureus N315
uccgaaaauugcuaaaaaaau

SEQ ID NO: 4050029 - RNA, 15 nt, Staphylococcus aureus subsp. aureus N315
uccgauaucuuuuaa

SEQ ID NO: 4050030 - RNA, 19 nt, Staphylococcus aureus subsp. aureus N315
uccgauaucuuuuaauucu

SEQ ID NO: 4050031 - RNA, 13 nt, Staphylococcus aureus subsp. aureus N315
uccgaucaugccu

SEQ ID NO: 4050032 - RNA, 19 nt, Staphylococcus aureus subsp. aureus N315
uccgauuuugauauaaaaa

SEQ ID NO: 4050033 - RNA, 21 nt, Staphylococcus aureus subsp. aureus N315
uccgcacugccuuuuuguaau

SEQ ID NO: 4050034 - RNA, 17 nt, Staphylococcus aureus subsp. aureus N315
uccgcuuguucaacuaa

SEQ ID NO: 4050035 - RNA, 14 nt, Staphylococcus aureus subsp. aureus N315
uccggggccccaac

SEQ ID NO: 4050036 - RNA, 14 nt, Staphylococcus aureus subsp. aureus N315
uccgugauaaauug

SEQ ID NO: 4050037 - RNA, 15 nt, Staphylococcus aureus subsp. aureus N315
uccguuaauuauaau

SEQ ID NO: 4050038 - RNA, 14 nt, Staphylococcus aureus subsp. aureus N315
uccguuaauuuaac

SEQ ID NO: 4050039 - RNA, 15 nt, Staphylococcus aureus subsp. aureus N315
uccguugaauucaac

SEQ ID NO: 4050040 - RNA, 13 nt, Staphylococcus aureus subsp. aureus N315
uccuaaaaacugu

SEQ ID NO: 4050041 - RNA, 21 nt, Staphylococcus aureus subsp. aureus N315
uccuaaagguaacuuuuuaac

SEQ ID NO: 4050042 - RNA, 22 nt, Staphylococcus aureus subsp. aureus N315
uccuacgacacguguaaaaaug

SEQ ID NO: 4050043 - RNA, 21 nt, Staphylococcus aureus subsp. aureus N315
uccuacuuuucaacuuuaguu

SEQ ID NO: 4050044 - RNA, 21 nt, Staphylococcus aureus subsp. aureus N315
uccuauggcgcaauuuuuaac

SEQ ID NO: 4050045 - RNA, 16 nt, Staphylococcus aureus subsp. aureus N315
uccuauuacuacauaa

SEQ ID NO: 4050046 - RNA, 16 nt, Staphylococcus aureus subsp. aureus N315
uccucaacgggaacau

SEQ ID NO: 4050047 - RNA, 17 nt, Staphylococcus aureus subsp. aureus N315
uccucauaauuaucaua

SEQ ID NO: 4050048 - RNA, 15 nt, Staphylococcus aureus subsp. aureus N315
uccucauuaauaaau

SEQ ID NO: 4050049 - RNA, 18 nt, Staphylococcus aureus subsp. aureus N315
uccucauuaugagaccca

SEQ ID NO: 4050050 - RNA, 13 nt, Staphylococcus aureus subsp. aureus N315
uccuccaaagcua

SEQ ID NO: 4050051 - RNA, 22 nt, Staphylococcus aureus subsp. aureus N315
uccuccgccaucaauauuuaua

SEQ ID NO: 4050052 - RNA, 21 nt, Staphylococcus aureus subsp. aureus N315
uccucgguauuuaauguuuua

SEQ ID NO: 4050053 - RNA, 19 nt, Staphylococcus aureus subsp. aureus N315
uccucgguuuuauuuuuau

SEQ ID NO: 4050054 - RNA, 20 nt, Staphylococcus aureus subsp. aureus N315
uccucgguuuuauuuuuauc

SEQ ID NO: 4050055 - RNA, 20 nt, Staphylococcus aureus subsp. aureus N315
uccucuauuuuaugauuuga

SEQ ID NO: 4050056 - RNA, 19 nt, Staphylococcus aureus subsp. aureus N315
uccucuguccgauuuuuaa

SEQ ID NO: 4050057 - RNA, 16 nt, Staphylococcus aureus subsp. aureus N315
uccugaaauuaacguc

SEQ ID NO: 4050058 - RNA, 13 nt, Staphylococcus aureus subsp. aureus N315
uccugauacaaug

SEQ ID NO: 4050059 - RNA, 17 nt, Staphylococcus aureus subsp. aureus N315
uccugauacaaugauua

SEQ ID NO: 4050060 - RNA, 14 nt, Staphylococcus aureus subsp. aureus N315
uccugauuccacua

SEQ ID NO: 4050061 - RNA, 18 nt, Staphylococcus aureus subsp. aureus N315
uccugauuuaauguuaaa

SEQ ID NO: 4050062 - RNA, 14 nt, Staphylococcus aureus subsp. aureus N315
uccugcuuauuaau

SEQ ID NO: 4050063 - RNA, 16 nt, Staphylococcus aureus subsp. aureus N315
uccugguauaauggac

SEQ ID NO: 4050064 - RNA, 17 nt, Staphylococcus aureus subsp. aureus N315
uccuguguaaaauaaau

SEQ ID NO: 4050065 - RNA, 22 nt, Staphylococcus aureus subsp. aureus N315
uccuuaaaccguauagucauua

SEQ ID NO: 4050066 - RNA, 16 nt, Staphylococcus aureus subsp. aureus N315
uccuucaaaaguuuuu

SEQ ID NO: 4050067 - RNA, 21 nt, Staphylococcus aureus subsp. aureus N315
uccuucaaagauuuuaccuug

SEQ ID NO: 4050068 - RNA, 17 nt, Staphylococcus aureus subsp. aureus N315
uccuuccaauaauaaau

SEQ ID NO: 4050069 - RNA, 20 nt, Staphylococcus aureus subsp. aureus N315
uccuucgauaguuuauuaau

SEQ ID NO: 4050070 - RNA, 22 nt, Staphylococcus aureus subsp. aureus N315
uccuucgauaguuuauuaauau

SEQ ID NO: 4050071 - RNA, 22 nt, Staphylococcus aureus subsp. aureus N315
uccuugcucaugagcacaaacu

SEQ ID NO: 4050072 - RNA, 20 nt, Staphylococcus aureus subsp. aureus N315
uccuuggaaacgauauagac

SEQ ID NO: 4050073 - RNA, 21 nt, Staphylococcus aureus subsp. aureus N315
uccuuggaaacgauauagacc

SEQ ID NO: 4050074 - RNA, 18 nt, Staphylococcus aureus subsp. aureus N315
uccuuggugucgaaauug

SEQ ID NO: 4050075 - RNA, 14 nt, Staphylococcus aureus subsp. aureus N315
uccuuuaaaucauu

SEQ ID NO: 4050076 - RNA, 17 nt, Staphylococcus aureus subsp. aureus N315
uccuuuagcaaaaauau

SEQ ID NO: 4050077 - RNA, 21 nt, Staphylococcus aureus subsp. aureus N315
uccuuuauauucuaauauucc

SEQ ID NO: 4050078 - RNA, 14 nt, Staphylococcus aureus subsp. aureus N315
uccuuuuacuuaau

SEQ ID NO: 4050079 - RNA, 13 nt, Staphylococcus aureus subsp. aureus N315
uccuuuuugacuc

SEQ ID NO: 4050080 - RNA, 12 nt, Staphylococcus aureus subsp. aureus N315
uccuuuuuuaaa

SEQ ID NO: 4050081 - RNA, 13 nt, Staphylococcus aureus subsp. aureus N315
ucgaaaagaaauu

SEQ ID NO: 4050082 - RNA, 19 nt, Staphylococcus aureus subsp. aureus N315
ucgaaaagaaauucuacag

SEQ ID NO: 4050083 - RNA, 17 nt, Staphylococcus aureus subsp. aureus N315
ucgaaaauaaaacaaau

SEQ ID NO: 4050084 - RNA, 20 nt, Staphylococcus aureus subsp. aureus N315
ucgaaaauagcuauuaaaau

SEQ ID NO: 4050085 - RNA, 23 nt, Staphylococcus aureus subsp. aureus N315
ucgaaaauagcuauuaaaauaga

SEQ ID NO: 4050086 - RNA, 17 nt, Staphylococcus aureus subsp. aureus N315
ucgaaagguauaucuuc

SEQ ID NO: 4050087 - RNA, 15 nt, Staphylococcus aureus subsp. aureus N315
ucgaaaucaaauauu

SEQ ID NO: 4050088 - RNA, 17 nt, Staphylococcus aureus subsp. aureus N315
ucgaaaugccuucugua

SEQ ID NO: 4050089 - RNA, 16 nt, Staphylococcus aureus subsp. aureus N315
ucgaaauucucuuugu

SEQ ID NO: 4050090 - RNA, 16 nt, Staphylococcus aureus subsp. aureus N315
ucgaaauuguucuaau

SEQ ID NO: 4050091 - RNA, 12 nt, Staphylococcus aureus subsp. aureus N315
ucgaacagaaaa

SEQ ID NO: 4050092 - RNA, 15 nt, Staphylococcus aureus subsp. aureus N315
ucgaacagaaaaucg

SEQ ID NO: 4050093 - RNA, 21 nt, Staphylococcus aureus subsp. aureus N315
ucgaacaugaaugauauugau

SEQ ID NO: 4050094 - RNA, 17 nt, Staphylococcus aureus subsp. aureus N315
ucgaacgauauuuuaaa

SEQ ID NO: 4050095 - RNA, 22 nt, Staphylococcus aureus subsp. aureus N315
ucgaacuuuuguucuaaguguu

SEQ ID NO: 4050096 - RNA, 20 nt, Staphylococcus aureus subsp. aureus N315
ucgaaguagcuuguuuagaa

SEQ ID NO: 4050097 - RNA, 20 nt, Staphylococcus aureus subsp. aureus N315
ucgaauaacuguuuaucaug

SEQ ID NO: 4050098 - RNA, 21 nt, Staphylococcus aureus subsp. aureus N315
ucgaauguauugcuauaagaa

SEQ ID NO: 4050099 - RNA, 22 nt, Staphylococcus aureus subsp. aureus N315
ucgaauguauugcuauaagaac

SEQ ID NO: 4050100 - RNA, 23 nt, Staphylococcus aureus subsp. aureus N315
ucgaauguuucuucguuagugau

SEQ ID NO: 4050101 - RNA, 15 nt, Staphylococcus aureus subsp. aureus N315
ucgaauuaagaaaag

SEQ ID NO: 4050102 - RNA, 15 nt, Staphylococcus aureus subsp. aureus N315
ucgaauucauuugca

SEQ ID NO: 4050103 - RNA, 17 nt, Staphylococcus aureus subsp. aureus N315
ucgaauugauggaaaag

SEQ ID NO: 4050104 - RNA, 20 nt, Staphylococcus aureus subsp. aureus N315
ucgacaacugauuuaauauc

SEQ ID NO: 4050105 - RNA, 15 nt, Staphylococcus aureus subsp. aureus N315
ucgacaauugcgacc

SEQ ID NO: 4050106 - RNA, 13 nt, Staphylococcus aureus subsp. aureus N315
ucgacaucuagau

SEQ ID NO: 4050107 - RNA, 19 nt, Staphylococcus aureus subsp. aureus N315
ucgacaucuagaugaaauu

SEQ ID NO: 4050108 - RNA, 20 nt, Staphylococcus aureus subsp. aureus N315
ucgacaucuagaugaaauug

SEQ ID NO: 4050109 - RNA, 14 nt, Staphylococcus aureus subsp. aureus N315
ucgacauugauguc

SEQ ID NO: 4050110 - RNA, 19 nt, Staphylococcus aureus subsp. aureus N315
ucgagcucuucaaauuuac

SEQ ID NO: 4050111 - RNA, 15 nt, Staphylococcus aureus subsp. aureus N315
ucgagguaauuucac

SEQ ID NO: 4050112 - RNA, 14 nt, Staphylococcus aureus subsp. aureus N315
ucgaguaauacuuu

SEQ ID NO: 4050113 - RNA, 23 nt, Staphylococcus aureus subsp. aureus N315
ucgaguuuguuucuaaauucuuu

SEQ ID NO: 4050114 - RNA, 12 nt, Staphylococcus aureus subsp. aureus N315
ucgauaaaaugu

SEQ ID NO: 4050115 - RNA, 17 nt, Staphylococcus aureus subsp. aureus N315
ucgauaccuaaaauacc

SEQ ID NO: 4050116 - RNA, 19 nt, Staphylococcus aureus subsp. aureus N315
ucgauaguucuauauaauu

SEQ ID NO: 4050117 - RNA, 13 nt, Staphylococcus aureus subsp. aureus N315
ucgauauuucuag

SEQ ID NO: 4050118 - RNA, 16 nt, Staphylococcus aureus subsp. aureus N315
ucgaucgguauuuuca

SEQ ID NO: 4050119 - RNA, 17 nt, Staphylococcus aureus subsp. aureus N315
ucgaucgguauuuucau

SEQ ID NO: 4050120 - RNA, 21 nt, Staphylococcus aureus subsp. aureus N315
ucgauuaucugacauuguugc

SEQ ID NO: 4050121 - RNA, 20 nt, Staphylococcus aureus subsp. aureus N315
ucgauuauucuuaauuuaag

SEQ ID NO: 4050122 - RNA, 16 nt, Staphylococcus aureus subsp. aureus N315
ucgauugguaaaucua

SEQ ID NO: 4050123 - RNA, 17 nt, Staphylococcus aureus subsp. aureus N315
ucgauuuuggcacauaa

SEQ ID NO: 4050124 - RNA, 13 nt, Staphylococcus aureus subsp. aureus N315
ucgauuuuuuaau

SEQ ID NO: 4050125 - RNA, 14 nt, Staphylococcus aureus subsp. aureus N315
ucgauuuuuuaaug

SEQ ID NO: 4050126 - RNA, 22 nt, Staphylococcus aureus subsp. aureus N315
ucgauuuuuuaaugucuaaaaa

SEQ ID NO: 4050127 - RNA, 15 nt, Staphylococcus aureus subsp. aureus N315
ucgcaaauacauaau

SEQ ID NO: 4050128 - RNA, 23 nt, Staphylococcus aureus subsp. aureus N315
ucgcaccgucaaacuuaaaacua

SEQ ID NO: 4050129 - RNA, 15 nt, Staphylococcus aureus subsp. aureus N315
ucgcacuauaaaauu

SEQ ID NO: 4050130 - RNA, 15 nt, Staphylococcus aureus subsp. aureus N315
ucgcagcuucuuuaa

SEQ ID NO: 4050131 - RNA, 18 nt, Staphylococcus aureus subsp. aureus N315
ucgcaucacugcauauaa

SEQ ID NO: 4050132 - RNA, 22 nt, Staphylococcus aureus subsp. aureus N315
ucgcauucuugguuuuuuagau

SEQ ID NO: 4050133 - RNA, 16 nt, Staphylococcus aureus subsp. aureus N315
ucgcauuuuuuauucc

SEQ ID NO: 4050134 - RNA, 14 nt, Staphylococcus aureus subsp. aureus N315
ucgccaagccaucu

SEQ ID NO: 4050135 - RNA, 17 nt, Staphylococcus aureus subsp. aureus N315
ucgccaagccaucuuuc

SEQ ID NO: 4050136 - RNA, 19 nt, Staphylococcus aureus subsp. aureus N315
ucgccaucccauucaccaa

SEQ ID NO: 4050137 - RNA, 21 nt, Staphylococcus aureus subsp. aureus N315
ucgcccuuuagccaaugcuuc

SEQ ID NO: 4050138 - RNA, 20 nt, Staphylococcus aureus subsp. aureus N315
ucgccuaaaaauaaaaucaa

SEQ ID NO: 4050139 - RNA, 17 nt, Staphylococcus aureus subsp. aureus N315
ucgccuacuauaaauac

SEQ ID NO: 4050140 - RNA, 19 nt, Staphylococcus aureus subsp. aureus N315
ucgcgaacguuauuuucaa

SEQ ID NO: 4050141 - RNA, 16 nt, Staphylococcus aureus subsp. aureus N315
ucgcgcucuucuucag

SEQ ID NO: 4050142 - RNA, 15 nt, Staphylococcus aureus subsp. aureus N315
ucgcugcuacaccac

SEQ ID NO: 4050143 - RNA, 17 nt, Staphylococcus aureus subsp. aureus N315
ucgcugcuacaccaccu

SEQ ID NO: 4050144 - RNA, 21 nt, Staphylococcus aureus subsp. aureus N315
ucgcuucgguuaacuguucua

SEQ ID NO: 4050145 - RNA, 17 nt, Staphylococcus aureus subsp. aureus N315
ucgcuuguaacaagcuu

SEQ ID NO: 4050146 - RNA, 19 nt, Staphylococcus aureus subsp. aureus N315
ucgcuuucauaccuugauu

SEQ ID NO: 4050147 - RNA, 14 nt, Staphylococcus aureus subsp. aureus N315
ucgcuuugcccguc

SEQ ID NO: 4050148 - RNA, 23 nt, Staphylococcus aureus subsp. aureus N315
ucgcuuuuuuuauuuuucuuuuu

SEQ ID NO: 4050149 - RNA, 13 nt, Staphylococcus aureus subsp. aureus N315
ucggaauaaaaua

SEQ ID NO: 4050150 - RNA, 12 nt, Staphylococcus aureus subsp. aureus N315
ucggacagagga

SEQ ID NO: 4050151 - RNA, 18 nt, Staphylococcus aureus subsp. aureus N315
ucggaugagaaauguuaa

SEQ ID NO: 4050152 - RNA, 22 nt, Staphylococcus aureus subsp. aureus N315
ucggauugaaccggaaauuaaa

SEQ ID NO: 4050153 - RNA, 21 nt, Staphylococcus aureus subsp. aureus N315
ucggcaugaugcgcuucuaac

SEQ ID NO: 4050154 - RNA, 13 nt, Staphylococcus aureus subsp. aureus N315
ucggcucucgcuu

SEQ ID NO: 4050155 - RNA, 20 nt, Staphylococcus aureus subsp. aureus N315
ucggcuuuggauuucuuuuu

SEQ ID NO: 4050156 - RNA, 14 nt, Staphylococcus aureus subsp. aureus N315
ucggcuuuguaaaa

SEQ ID NO: 4050157 - RNA, 16 nt, Staphylococcus aureus subsp. aureus N315
ucggcuuuguaaaauu

SEQ ID NO: 4050158 - RNA, 18 nt, Staphylococcus aureus subsp. aureus N315
ucggggccccaacacaga

SEQ ID NO: 4050159 - RNA, 22 nt, Staphylococcus aureus subsp. aureus N315
ucgguacauuuaauggucuaau

SEQ ID NO: 4050160 - RNA, 18 nt, Staphylococcus aureus subsp. aureus N315
ucgguauaucuaaaugau

SEQ ID NO: 4050161 - RNA, 14 nt, Staphylococcus aureus subsp. aureus N315
ucgguaugauauuu

SEQ ID NO: 4050162 - RNA, 14 nt, Staphylococcus aureus subsp. aureus N315
ucgguauucaauuc

SEQ ID NO: 4050163 - RNA, 19 nt, Staphylococcus aureus subsp. aureus N315
ucgguauucaauucuguga

SEQ ID NO: 4050164 - RNA, 16 nt, Staphylococcus aureus subsp. aureus N315
ucgguauuuaauguuu

SEQ ID NO: 4050165 - RNA, 18 nt, Staphylococcus aureus subsp. aureus N315
ucgguauuuaauguuuua

SEQ ID NO: 4050166 - RNA, 18 nt, Staphylococcus aureus subsp. aureus N315
ucgguauuuuaaauuuau

SEQ ID NO: 4050167 - RNA, 16 nt, Staphylococcus aureus subsp. aureus N315
ucgguucaucuaaaau

SEQ ID NO: 4050168 - RNA, 15 nt, Staphylococcus aureus subsp. aureus N315
ucgguuuauuuaaua

SEQ ID NO: 4050169 - RNA, 15 nt, Staphylococcus aureus subsp. aureus N315
ucgguuugauuaaaa

SEQ ID NO: 4050170 - RNA, 21 nt, Staphylococcus aureus subsp. aureus N315
ucgguuugauuaaaaucugcu

SEQ ID NO: 4050171 - RNA, 15 nt, Staphylococcus aureus subsp. aureus N315
ucgguuuuauuuuua

SEQ ID NO: 4050172 - RNA, 18 nt, Staphylococcus aureus subsp. aureus N315
ucguaaacacuauaaaag

SEQ ID NO: 4050173 - RNA, 17 nt, Staphylococcus aureus subsp. aureus N315
ucguaacucuuuaauuu

SEQ ID NO: 4050174 - RNA, 19 nt, Staphylococcus aureus subsp. aureus N315
ucguaauguguuaauacuu

SEQ ID NO: 4050175 - RNA, 22 nt, Staphylococcus aureus subsp. aureus N315
ucguaauugucuuuauaaaaaa

SEQ ID NO: 4050176 - RNA, 16 nt, Staphylococcus aureus subsp. aureus N315
ucguacuuccaauacu

SEQ ID NO: 4050177 - RNA, 18 nt, Staphylococcus aureus subsp. aureus N315
ucguacuuccaauacugu

SEQ ID NO: 4050178 - RNA, 14 nt, Staphylococcus aureus subsp. aureus N315
ucguacuuucaaau

SEQ ID NO: 4050179 - RNA, 21 nt, Staphylococcus aureus subsp. aureus N315
ucguauauguaaucagaguag

SEQ ID NO: 4050180 - RNA, 15 nt, Staphylococcus aureus subsp. aureus N315
ucguauucuucaaua

SEQ ID NO: 4050181 - RNA, 16 nt, Staphylococcus aureus subsp. aureus N315
ucguauucuuuuaaua

SEQ ID NO: 4050182 - RNA, 13 nt, Staphylococcus aureus subsp. aureus N315
ucguauuuuuaag

SEQ ID NO: 4050183 - RNA, 19 nt, Staphylococcus aureus subsp. aureus N315
ucguauuuuucuuggaauu

SEQ ID NO: 4050184 - RNA, 15 nt, Staphylococcus aureus subsp. aureus N315
ucgucaauuuuaaug

SEQ ID NO: 4050185 - RNA, 20 nt, Staphylococcus aureus subsp. aureus N315
ucgucacauauaaauauuuu

SEQ ID NO: 4050186 - RNA, 13 nt, Staphylococcus aureus subsp. aureus N315
ucgucauuaugug

SEQ ID NO: 4050187 - RNA, 14 nt, Staphylococcus aureus subsp. aureus N315
ucgucgaaaugccu

SEQ ID NO: 4050188 - RNA, 15 nt, Staphylococcus aureus subsp. aureus N315
ucgucgcugauacau

SEQ ID NO: 4050189 - RNA, 19 nt, Staphylococcus aureus subsp. aureus N315
ucgucuacuauuuuuucua

SEQ ID NO: 4050190 - RNA, 18 nt, Staphylococcus aureus subsp. aureus N315
ucgucucacuuaauaaau

SEQ ID NO: 4050191 - RNA, 21 nt, Staphylococcus aureus subsp. aureus N315
ucgucuuguaaacuucuuuuc

SEQ ID NO: 4050192 - RNA, 13 nt, Staphylococcus aureus subsp. aureus N315
ucgugaaaauaau

SEQ ID NO: 4050193 - RNA, 16 nt, Staphylococcus aureus subsp. aureus N315
ucgugauagaaguuuu

SEQ ID NO: 4050194 - RNA, 23 nt, Staphylococcus aureus subsp. aureus N315
ucguguuaauaaccgaaauauug

SEQ ID NO: 4050195 - RNA, 15 nt, Staphylococcus aureus subsp. aureus N315
ucguguuccaauuuu

SEQ ID NO: 4050196 - RNA, 22 nt, Staphylococcus aureus subsp. aureus N315
ucguuaacaaucaguaauaaug

SEQ ID NO: 4050197 - RNA, 21 nt, Staphylococcus aureus subsp. aureus N315
ucguuaaggaaagcuucauau

SEQ ID NO: 4050198 - RNA, 23 nt, Staphylococcus aureus subsp. aureus N315
ucguuaccuuuuaaggcagcuaa

SEQ ID NO: 4050199 - RNA, 18 nt, Staphylococcus aureus subsp. aureus N315
ucguuacuaccuauuaau

SEQ ID NO: 4050200 - RNA, 17 nt, Staphylococcus aureus subsp. aureus N315
ucguuagaugaaugccu

SEQ ID NO: 4050201 - RNA, 22 nt, Staphylococcus aureus subsp. aureus N315
ucguuauagacuaacuguacuu

SEQ ID NO: 4050202 - RNA, 21 nt, Staphylococcus aureus subsp. aureus N315
ucguucaagaacaaucaauac

SEQ ID NO: 4050203 - RNA, 24 nt, Staphylococcus aureus subsp. aureus N315
ucguucaagaacaaucaauacaga

SEQ ID NO: 4050204 - RNA, 15 nt, Staphylococcus aureus subsp. aureus N315
ucguucauauauuuu

SEQ ID NO: 4050205 - RNA, 17 nt, Staphylococcus aureus subsp. aureus N315
ucguucauauauuuugu

SEQ ID NO: 4050206 - RNA, 16 nt, Staphylococcus aureus subsp. aureus N315
ucguucccauucuuug

SEQ ID NO: 4050207 - RNA, 20 nt, Staphylococcus aureus subsp. aureus N315
ucguucgaaguagcuuguuu

SEQ ID NO: 4050208 - RNA, 14 nt, Staphylococcus aureus subsp. aureus N315
ucguucucuuaaau

SEQ ID NO: 4050209 - RNA, 21 nt, Staphylococcus aureus subsp. aureus N315
ucguucucuuaaauaugaaua

SEQ ID NO: 4050210 - RNA, 18 nt, Staphylococcus aureus subsp. aureus N315
ucguugaaaaauauccug

SEQ ID NO: 4050211 - RNA, 22 nt, Staphylococcus aureus subsp. aureus N315
ucguuguaaaacuaaguuauuu

SEQ ID NO: 4050212 - RNA, 19 nt, Staphylococcus aureus subsp. aureus N315
ucguuguacaguaauauuc

SEQ ID NO: 4050213 - RNA, 17 nt, Staphylococcus aureus subsp. aureus N315
ucguugucacuauugca

SEQ ID NO: 4050214 - RNA, 15 nt, Staphylococcus aureus subsp. aureus N315
ucguuguugaaauua

SEQ ID NO: 4050215 - RNA, 17 nt, Staphylococcus aureus subsp. aureus N315
ucguuguugaaauuaaa

SEQ ID NO: 4050216 - RNA, 15 nt, Staphylococcus aureus subsp. aureus N315
ucguuucuuuuauau

SEQ ID NO: 4050217 - RNA, 18 nt, Staphylococcus aureus subsp. aureus N315
ucguuugaauuauuuaau

SEQ ID NO: 4050218 - RNA, 16 nt, Staphylococcus aureus subsp. aureus N315
ucguuuuaauaaauug

SEQ ID NO: 4050219 - RNA, 18 nt, Staphylococcus aureus subsp. aureus N315
ucguuuugcuaaccauca

SEQ ID NO: 4050220 - RNA, 21 nt, Staphylococcus aureus subsp. aureus N315
ucguuuugcuaaccaucauaa

SEQ ID NO: 4050221 - RNA, 12 nt, Staphylococcus aureus subsp. aureus N315
ucguuuuuacug

SEQ ID NO: 4050222 - RNA, 21 nt, Staphylococcus aureus subsp. aureus N315
ucguuuuuucauuguaauaau

SEQ ID NO: 4050223 - RNA, 14 nt, Staphylococcus aureus subsp. aureus N315
ucguuuuuuuagcu

SEQ ID NO: 4050224 - RNA, 13 nt, Staphylococcus aureus subsp. aureus N315
ucuaaaaaauuaa

SEQ ID NO: 4050225 - RNA, 13 nt, Staphylococcus aureus subsp. aureus N315
ucuaaaaacauaa

SEQ ID NO: 4050226 - RNA, 14 nt, Staphylococcus aureus subsp. aureus N315
ucuaaaaacauaaa

SEQ ID NO: 4050227 - RNA, 16 nt, Staphylococcus aureus subsp. aureus N315
ucuaaaaacauaaaaa

SEQ ID NO: 4050228 - RNA, 18 nt, Staphylococcus aureus subsp. aureus N315
ucuaaaaacauaaaaauc

SEQ ID NO: 4050229 - RNA, 16 nt, Staphylococcus aureus subsp. aureus N315
ucuaaaacuuuuucaa

SEQ ID NO: 4050230 - RNA, 23 nt, Staphylococcus aureus subsp. aureus N315
ucuaaaaguuguaauuuaaaaua

SEQ ID NO: 4050231 - RNA, 19 nt, Staphylococcus aureus subsp. aureus N315
ucuaaaccuuuuuuaaguu

SEQ ID NO: 4050232 - RNA, 18 nt, Staphylococcus aureus subsp. aureus N315
ucuaaacuauaauaauug

SEQ ID NO: 4050233 - RNA, 17 nt, Staphylococcus aureus subsp. aureus N315
ucuaaacuucuauuaau

SEQ ID NO: 4050234 - RNA, 15 nt, Staphylococcus aureus subsp. aureus N315
ucuaaagcuauaaaa

SEQ ID NO: 4050235 - RNA, 17 nt, Staphylococcus aureus subsp. aureus N315
ucuaaagcuauaaaaaa

SEQ ID NO: 4050236 - RNA, 18 nt, Staphylococcus aureus subsp. aureus N315
ucuaaagcuauaaaaaau

SEQ ID NO: 4050237 - RNA, 16 nt, Staphylococcus aureus subsp. aureus N315
ucuaaagcuuauuaaa

SEQ ID NO: 4050238 - RNA, 19 nt, Staphylococcus aureus subsp. aureus N315
ucuaaagguaccacuguau

SEQ ID NO: 4050239 - RNA, 14 nt, Staphylococcus aureus subsp. aureus N315
ucuaaauaaaauua

SEQ ID NO: 4050240 - RNA, 17 nt, Staphylococcus aureus subsp. aureus N315
ucuaaauaguuuuucau

SEQ ID NO: 4050241 - RNA, 20 nt, Staphylococcus aureus subsp. aureus N315
ucuaaauauaauagaaauaa

SEQ ID NO: 4050242 - RNA, 16 nt, Staphylococcus aureus subsp. aureus N315
ucuaaaucuucaucau

SEQ ID NO: 4050243 - RNA, 18 nt, Staphylococcus aureus subsp. aureus N315
ucuaaauuauuuauucau

SEQ ID NO: 4050244 - RNA, 13 nt, Staphylococcus aureus subsp. aureus N315
ucuaaauucuuuu

SEQ ID NO: 4050245 - RNA, 20 nt, Staphylococcus aureus subsp. aureus N315
ucuaaauucuuuuuguucgg

SEQ ID NO: 4050246 - RNA, 23 nt, Staphylococcus aureus subsp. aureus N315
ucuaacaccugauugacaaugua

SEQ ID NO: 4050247 - RNA, 16 nt, Staphylococcus aureus subsp. aureus N315
ucuaacagcuuaauuu

SEQ ID NO: 4050248 - RNA, 14 nt, Staphylococcus aureus subsp. aureus N315
ucuaacaguuaaua

SEQ ID NO: 4050249 - RNA, 11 nt, Staphylococcus aureus subsp. aureus N315
ucuaacauuuu

SEQ ID NO: 4050250 - RNA, 12 nt, Staphylococcus aureus subsp. aureus N315
ucuaaccaucuc

SEQ ID NO: 4050251 - RNA, 19 nt, Staphylococcus aureus subsp. aureus N315
ucuaacggcguuuguuucu

SEQ ID NO: 4050252 - RNA, 15 nt, Staphylococcus aureus subsp. aureus N315
ucuaacgguaaauaa

SEQ ID NO: 4050253 - RNA, 16 nt, Staphylococcus aureus subsp. aureus N315
ucuaacucauaaucaa

SEQ ID NO: 4050254 - RNA, 14 nt, Staphylococcus aureus subsp. aureus N315
ucuaacugaauuaa

SEQ ID NO: 4050255 - RNA, 17 nt, Staphylococcus aureus subsp. aureus N315
ucuaacuuuaccaauau

SEQ ID NO: 4050256 - RNA, 21 nt, Staphylococcus aureus subsp. aureus N315
ucuaacuuuaccaauaucaug

SEQ ID NO: 4050257 - RNA, 14 nt, Staphylococcus aureus subsp. aureus N315
ucuaagauacguug

SEQ ID NO: 4050258 - RNA, 21 nt, Staphylococcus aureus subsp. aureus N315
ucuaaguuugcguuuuaauuc

SEQ ID NO: 4050259 - RNA, 23 nt, Staphylococcus aureus subsp. aureus N315
ucuaaguuugcguuuuaauucau

SEQ ID NO: 4050260 - RNA, 15 nt, Staphylococcus aureus subsp. aureus N315
ucuaauacauacuga

SEQ ID NO: 4050261 - RNA, 17 nt, Staphylococcus aureus subsp. aureus N315
ucuaauacauacugauu

SEQ ID NO: 4050262 - RNA, 14 nt, Staphylococcus aureus subsp. aureus N315
ucuaauccaaaaua

SEQ ID NO: 4050263 - RNA, 18 nt, Staphylococcus aureus subsp. aureus N315
ucuaauccaaaauaaucg

SEQ ID NO: 4050264 - RNA, 21 nt, Staphylococcus aureus subsp. aureus N315
ucuaaucgacuuuuacaauca

SEQ ID NO: 4050265 - RNA, 20 nt, Staphylococcus aureus subsp. aureus N315
ucuaaucgcauuuuuuauuc

SEQ ID NO: 4050266 - RNA, 19 nt, Staphylococcus aureus subsp. aureus N315
ucuaaugcucauuaauggu

SEQ ID NO: 4050267 - RNA, 17 nt, Staphylococcus aureus subsp. aureus N315
ucuaauuauucaugaau

SEQ ID NO: 4050268 - RNA, 21 nt, Staphylococcus aureus subsp. aureus N315
ucuaauucaaugauuuuuaaa

SEQ ID NO: 4050269 - RNA, 19 nt, Staphylococcus aureus subsp. aureus N315
ucuaauuguuguaauucuu

SEQ ID NO: 4050270 - RNA, 21 nt, Staphylococcus aureus subsp. aureus N315
ucuaauuucuuagauuuuaua

SEQ ID NO: 4050271 - RNA, 13 nt, Staphylococcus aureus subsp. aureus N315
ucuaauuuuccua

SEQ ID NO: 4050272 - RNA, 18 nt, Staphylococcus aureus subsp. aureus N315
ucuacaaacaaugcaagu

SEQ ID NO: 4050273 - RNA, 20 nt, Staphylococcus aureus subsp. aureus N315
ucuacaacuucauuaguugc

SEQ ID NO: 4050274 - RNA, 16 nt, Staphylococcus aureus subsp. aureus N315
ucuacaauauuaaaau

SEQ ID NO: 4050275 - RNA, 18 nt, Staphylococcus aureus subsp. aureus N315
ucuacaauauuaaaauua

SEQ ID NO: 4050276 - RNA, 22 nt, Staphylococcus aureus subsp. aureus N315
ucuacaauauuaaaauuaaaac

SEQ ID NO: 4050277 - RNA, 23 nt, Staphylococcus aureus subsp. aureus N315
ucuacacccauuugucuuaauuu

SEQ ID NO: 4050278 - RNA, 14 nt, Staphylococcus aureus subsp. aureus N315
ucuacagguaaugc

SEQ ID NO: 4050279 - RNA, 22 nt, Staphylococcus aureus subsp. aureus N315
ucuacagguaaugcaaguuggg

SEQ ID NO: 4050280 - RNA, 14 nt, Staphylococcus aureus subsp. aureus N315
ucuacaguuuuaug

SEQ ID NO: 4050281 - RNA, 23 nt, Staphylococcus aureus subsp. aureus N315
ucuacauacaacucguuuuucca

SEQ ID NO: 4050282 - RNA, 21 nt, Staphylococcus aureus subsp. aureus N315
ucuacauauuggcuugcuuca

SEQ ID NO: 4050283 - RNA, 17 nt, Staphylococcus aureus subsp. aureus N315
ucuaccaauaauucccu

SEQ ID NO: 4050284 - RNA, 22 nt, Staphylococcus aureus subsp. aureus N315
ucuaccaauaauucccuaggaa

SEQ ID NO: 4050285 - RNA, 16 nt, Staphylococcus aureus subsp. aureus N315
ucuaccaauacguuuc

SEQ ID NO: 4050286 - RNA, 22 nt, Staphylococcus aureus subsp. aureus N315
ucuacccauaauuuaaaugaua

SEQ ID NO: 4050287 - RNA, 13 nt, Staphylococcus aureus subsp. aureus N315
ucuacuaaaaaug

SEQ ID NO: 4050288 - RNA, 14 nt, Staphylococcus aureus subsp. aureus N315
ucuacuauuuuuuc

SEQ ID NO: 4050289 - RNA, 18 nt, Staphylococcus aureus subsp. aureus N315
ucuacuauuuuuucuaau

SEQ ID NO: 4050290 - RNA, 16 nt, Staphylococcus aureus subsp. aureus N315
ucuacucaaauauaaa

SEQ ID NO: 4050291 - RNA, 17 nt, Staphylococcus aureus subsp. aureus N315
ucuagagauaacuagaa

SEQ ID NO: 4050292 - RNA, 13 nt, Staphylococcus aureus subsp. aureus N315
ucuagaugaaauu

SEQ ID NO: 4050293 - RNA, 21 nt, Staphylococcus aureus subsp. aureus N315
ucuagauucauauuuauauuu

SEQ ID NO: 4050294 - RNA, 21 nt, Staphylococcus aureus subsp. aureus N315
ucuagcguagcgaaaguaucu

SEQ ID NO: 4050295 - RNA, 19 nt, Staphylococcus aureus subsp. aureus N315
ucuagcuuuagucguuugu

SEQ ID NO: 4050296 - RNA, 14 nt, Staphylococcus aureus subsp. aureus N315
ucuagguuagaauu

SEQ ID NO: 4050297 - RNA, 17 nt, Staphylococcus aureus subsp. aureus N315
ucuaguguucucauuau

SEQ ID NO: 4050298 - RNA, 20 nt, Staphylococcus aureus subsp. aureus N315
ucuauaaauaucaauaauuc

SEQ ID NO: 4050299 - RNA, 15 nt, Staphylococcus aureus subsp. aureus N315
ucuauaauuugugug

SEQ ID NO: 4050300 - RNA, 15 nt, Staphylococcus aureus subsp. aureus N315
ucuauaauuuuaauu

SEQ ID NO: 4050301 - RNA, 16 nt, Staphylococcus aureus subsp. aureus N315
ucuauaauuuuaauua

SEQ ID NO: 4050302 - RNA, 22 nt, Staphylococcus aureus subsp. aureus N315
ucuauaccauuccaaaaauugu

SEQ ID NO: 4050303 - RNA, 23 nt, Staphylococcus aureus subsp. aureus N315
ucuauaccauuccaaaaauugua

SEQ ID NO: 4050304 - RNA, 21 nt, Staphylococcus aureus subsp. aureus N315
ucuauacuauuccguuucauu

SEQ ID NO: 4050305 - RNA, 14 nt, Staphylococcus aureus subsp. aureus N315
ucuauagaauuuuu

SEQ ID NO: 4050306 - RNA, 21 nt, Staphylococcus aureus subsp. aureus N315
ucuauauaaaguugacaauac

SEQ ID NO: 4050307 - RNA, 16 nt, Staphylococcus aureus subsp. aureus N315
ucuauauaauuuauuu

SEQ ID NO: 4050308 - RNA, 12 nt, Staphylococcus aureus subsp. aureus N315
ucuauaugcaua

SEQ ID NO: 4050309 - RNA, 16 nt, Staphylococcus aureus subsp. aureus N315
ucuauaugcauauauu

SEQ ID NO: 4050310 - RNA, 18 nt, Staphylococcus aureus subsp. aureus N315
ucuauauuaauaaucuuc

SEQ ID NO: 4050311 - RNA, 13 nt, Staphylococcus aureus subsp. aureus N315
ucuauauuuaauu

SEQ ID NO: 4050312 - RNA, 12 nt, Staphylococcus aureus subsp. aureus N315
ucuaucaaauua

SEQ ID NO: 4050313 - RNA, 17 nt, Staphylococcus aureus subsp. aureus N315
ucuaucgccuaaaaaua

SEQ ID NO: 4050314 - RNA, 21 nt, Staphylococcus aureus subsp. aureus N315
ucuaucgccuaaaaauaaaau

SEQ ID NO: 4050315 - RNA, 18 nt, Staphylococcus aureus subsp. aureus N315
ucuaucgguauaucuaaa

SEQ ID NO: 4050316 - RNA, 19 nt, Staphylococcus aureus subsp. aureus N315
ucuaucuacucaaauauaa

SEQ ID NO: 4050317 - RNA, 17 nt, Staphylococcus aureus subsp. aureus N315
ucuaucuauaaacguca

SEQ ID NO: 4050318 - RNA, 16 nt, Staphylococcus aureus subsp. aureus N315
ucuaugaaauuuuuua

SEQ ID NO: 4050319 - RNA, 16 nt, Staphylococcus aureus subsp. aureus N315
ucuaugaauaauguuu

SEQ ID NO: 4050320 - RNA, 14 nt, Staphylococcus aureus subsp. aureus N315
ucuaugucaaauug

SEQ ID NO: 4050321 - RNA, 14 nt, Staphylococcus aureus subsp. aureus N315
ucuauuaaugcucu

SEQ ID NO: 4050322 - RNA, 23 nt, Staphylococcus aureus subsp. aureus N315
ucuauuauauugaauugaaaaau

SEQ ID NO: 4050323 - RNA, 15 nt, Staphylococcus aureus subsp. aureus N315
ucuauucaaaaaggu

SEQ ID NO: 4050324 - RNA, 17 nt, Staphylococcus aureus subsp. aureus N315
ucuauugcaauauaguu

SEQ ID NO: 4050325 - RNA, 21 nt, Staphylococcus aureus subsp. aureus N315
ucuauugugauauaugaaaua

SEQ ID NO: 4050326 - RNA, 16 nt, Staphylococcus aureus subsp. aureus N315
ucuauuuaauaaugua

SEQ ID NO: 4050327 - RNA, 18 nt, Staphylococcus aureus subsp. aureus N315
ucuauuuacggcauaauu

SEQ ID NO: 4050328 - RNA, 22 nt, Staphylococcus aureus subsp. aureus N315
ucuauuuagcuugcuuacaaua

SEQ ID NO: 4050329 - RNA, 22 nt, Staphylococcus aureus subsp. aureus N315
ucuauuucacucuacaauccua

SEQ ID NO: 4050330 - RNA, 14 nt, Staphylococcus aureus subsp. aureus N315
ucuauuuuauaaaa

SEQ ID NO: 4050331 - RNA, 15 nt, Staphylococcus aureus subsp. aureus N315
ucuauuuuauaaaau

SEQ ID NO: 4050332 - RNA, 12 nt, Staphylococcus aureus subsp. aureus N315
ucuauuuuauga

SEQ ID NO: 4050333 - RNA, 19 nt, Staphylococcus aureus subsp. aureus N315
ucuauuuuaugauuugauu

SEQ ID NO: 4050334 - RNA, 14 nt, Staphylococcus aureus subsp. aureus N315
ucuauuuuugauuu

SEQ ID NO: 4050335 - RNA, 22 nt, Staphylococcus aureus subsp. aureus N315
ucucaaagguuuacuauuaaag

SEQ ID NO: 4050336 - RNA, 21 nt, Staphylococcus aureus subsp. aureus N315
ucucaacaaaucuauaaauau

SEQ ID NO: 4050337 - RNA, 13 nt, Staphylococcus aureus subsp. aureus N315
ucucaacagcaaa

SEQ ID NO: 4050338 - RNA, 15 nt, Staphylococcus aureus subsp. aureus N315
ucucaacagcaaaaa

SEQ ID NO: 4050339 - RNA, 22 nt, Staphylococcus aureus subsp. aureus N315
ucucaacagcaaaaaauaaauc

SEQ ID NO: 4050340 - RNA, 18 nt, Staphylococcus aureus subsp. aureus N315
ucucaaugugagauauaa

SEQ ID NO: 4050341 - RNA, 14 nt, Staphylococcus aureus subsp. aureus N315
ucucagcaauacua

SEQ ID NO: 4050342 - RNA, 21 nt, Staphylococcus aureus subsp. aureus N315
ucucagcaauacuaacugaag

SEQ ID NO: 4050343 - RNA, 20 nt, Staphylococcus aureus subsp. aureus N315
ucucagccucuuuuuacauu

SEQ ID NO: 4050344 - RNA, 13 nt, Staphylococcus aureus subsp. aureus N315
ucucauaauaauu

SEQ ID NO: 4050345 - RNA, 14 nt, Staphylococcus aureus subsp. aureus N315
ucucaucauuuaaa

SEQ ID NO: 4050346 - RNA, 15 nt, Staphylococcus aureus subsp. aureus N315
ucucaucauuuaaaa

SEQ ID NO: 4050347 - RNA, 19 nt, Staphylococcus aureus subsp. aureus N315
ucucaucauuuucaauacu

SEQ ID NO: 4050348 - RNA, 17 nt, Staphylococcus aureus subsp. aureus N315
ucucaucgaauucauuu

SEQ ID NO: 4050349 - RNA, 13 nt, Staphylococcus aureus subsp. aureus N315
ucucaucuucuaa

SEQ ID NO: 4050350 - RNA, 14 nt, Staphylococcus aureus subsp. aureus N315
ucucaucuucuaaa

SEQ ID NO: 4050351 - RNA, 16 nt, Staphylococcus aureus subsp. aureus N315
ucucaucuucuaaauc

SEQ ID NO: 4050352 - RNA, 18 nt, Staphylococcus aureus subsp. aureus N315
ucucaucuucuaaaucaa

SEQ ID NO: 4050353 - RNA, 22 nt, Staphylococcus aureus subsp. aureus N315
ucucauuaaccuuacauaggau

SEQ ID NO: 4050354 - RNA, 14 nt, Staphylococcus aureus subsp. aureus N315
ucucauuauaauga

SEQ ID NO: 4050355 - RNA, 21 nt, Staphylococcus aureus subsp. aureus N315
ucucauucuuuaauauaaauu

SEQ ID NO: 4050356 - RNA, 19 nt, Staphylococcus aureus subsp. aureus N315
ucuccaacucuaacagcuu

SEQ ID NO: 4050357 - RNA, 11 nt, Staphylococcus aureus subsp. aureus N315
ucuccaauacu

SEQ ID NO: 4050358 - RNA, 21 nt, Staphylococcus aureus subsp. aureus N315
ucuccaauacuuuuuauauaa

SEQ ID NO: 4050359 - RNA, 23 nt, Staphylococcus aureus subsp. aureus N315
ucuccaguuuucaauuuauuaac

SEQ ID NO: 4050360 - RNA, 16 nt, Staphylococcus aureus subsp. aureus N315
ucuccguauuuaccuu

SEQ ID NO: 4050361 - RNA, 22 nt, Staphylococcus aureus subsp. aureus N315
ucuccuaaagguaacuuuuuaa

SEQ ID NO: 4050362 - RNA, 20 nt, Staphylococcus aureus subsp. aureus N315
ucucgauuaauuuucuuuuu

SEQ ID NO: 4050363 - RNA, 20 nt, Staphylococcus aureus subsp. aureus N315
ucucgcuaaauuuauauagu

SEQ ID NO: 4050364 - RNA, 13 nt, Staphylococcus aureus subsp. aureus N315
ucucguaaauugu

SEQ ID NO: 4050365 - RNA, 15 nt, Staphylococcus aureus subsp. aureus N315
ucucgugaaaauaau

SEQ ID NO: 4050366 - RNA, 20 nt, Staphylococcus aureus subsp. aureus N315
ucucgugaaaauaauacuac

SEQ ID NO: 4050367 - RNA, 18 nt, Staphylococcus aureus subsp. aureus N315
ucucguguaaaaugcaau

SEQ ID NO: 4050368 - RNA, 23 nt, Staphylococcus aureus subsp. aureus N315
ucucuaaaaagcggacugaaaga

SEQ ID NO: 4050369 - RNA, 17 nt, Staphylococcus aureus subsp. aureus N315
ucucuaaaacuuuuuca

SEQ ID NO: 4050370 - RNA, 19 nt, Staphylococcus aureus subsp. aureus N315
ucucuaaaacuuuuucaau

SEQ ID NO: 4050371 - RNA, 18 nt, Staphylococcus aureus subsp. aureus N315
ucucuaaauaauuucuca

SEQ ID NO: 4050372 - RNA, 19 nt, Staphylococcus aureus subsp. aureus N315
ucucuaaauaauuucucaa

SEQ ID NO: 4050373 - RNA, 19 nt, Staphylococcus aureus subsp. aureus N315
ucucuaacauuuucuuauu

SEQ ID NO: 4050374 - RNA, 21 nt, Staphylococcus aureus subsp. aureus N315
ucucuaccuugaucuaaaaua

SEQ ID NO: 4050375 - RNA, 14 nt, Staphylococcus aureus subsp. aureus N315
ucucuaguaucuga

SEQ ID NO: 4050376 - RNA, 18 nt, Staphylococcus aureus subsp. aureus N315
ucucuaguaucugauacc

SEQ ID NO: 4050377 - RNA, 18 nt, Staphylococcus aureus subsp. aureus N315
ucucuagugcuuugucuu

SEQ ID NO: 4050378 - RNA, 23 nt, Staphylococcus aureus subsp. aureus N315
ucucuaucaguccgcuuuuucau

SEQ ID NO: 4050379 - RNA, 17 nt, Staphylococcus aureus subsp. aureus N315
ucucucgcuaaauuuau

SEQ ID NO: 4050380 - RNA, 19 nt, Staphylococcus aureus subsp. aureus N315
ucucugcuuuaauauaauu

SEQ ID NO: 4050381 - RNA, 16 nt, Staphylococcus aureus subsp. aureus N315
ucucuucaaaguagau

SEQ ID NO: 4050382 - RNA, 18 nt, Staphylococcus aureus subsp. aureus N315
ucucuuuacaccauugca

SEQ ID NO: 4050383 - RNA, 21 nt, Staphylococcus aureus subsp. aureus N315
ucucuuuguuggggcccacac

SEQ ID NO: 4050384 - RNA, 16 nt, Staphylococcus aureus subsp. aureus N315
ucucuuuugauaaauu

SEQ ID NO: 4050385 - RNA, 17 nt, Staphylococcus aureus subsp. aureus N315
ucugaaaaacuucuuaa

SEQ ID NO: 4050386 - RNA, 13 nt, Staphylococcus aureus subsp. aureus N315
ucugaaaacaauc

SEQ ID NO: 4050387 - RNA, 22 nt, Staphylococcus aureus subsp. aureus N315
ucugaaaauaucacugaaugcu

SEQ ID NO: 4050388 - RNA, 18 nt, Staphylococcus aureus subsp. aureus N315
ucugaaacuuuaauacua

SEQ ID NO: 4050389 - RNA, 19 nt, Staphylococcus aureus subsp. aureus N315
ucugaaacuuuaauacuac

SEQ ID NO: 4050390 - RNA, 19 nt, Staphylococcus aureus subsp. aureus N315
ucugaacauaaaaaauacu

SEQ ID NO: 4050391 - RNA, 13 nt, Staphylococcus aureus subsp. aureus N315
ucugaauuuaaua

SEQ ID NO: 4050392 - RNA, 13 nt, Staphylococcus aureus subsp. aureus N315
ucugaauuuagga

SEQ ID NO: 4050393 - RNA, 19 nt, Staphylococcus aureus subsp. aureus N315
ucugacaacuuaauagaaa

SEQ ID NO: 4050394 - RNA, 17 nt, Staphylococcus aureus subsp. aureus N315
ucugacuuuuaaaaaac

SEQ ID NO: 4050395 - RNA, 22 nt, Staphylococcus aureus subsp. aureus N315
ucugauacagaaccaacaauaa

SEQ ID NO: 4050396 - RNA, 21 nt, Staphylococcus aureus subsp. aureus N315
ucugauacaucaucgccagca

SEQ ID NO: 4050397 - RNA, 20 nt, Staphylococcus aureus subsp. aureus N315
ucugaugucgaaaauagcua

SEQ ID NO: 4050398 - RNA, 14 nt, Staphylococcus aureus subsp. aureus N315
ucugauguguuaug

SEQ ID NO: 4050399 - RNA, 22 nt, Staphylococcus aureus subsp. aureus N315
ucugauucuucacuaaaaauau

SEQ ID NO: 4050400 - RNA, 22 nt, Staphylococcus aureus subsp. aureus N315
ucugauuucacuucuaaaacua

SEQ ID NO: 4050401 - RNA, 13 nt, Staphylococcus aureus subsp. aureus N315
ucugcaaaaugca

SEQ ID NO: 4050402 - RNA, 23 nt, Staphylococcus aureus subsp. aureus N315
ucugcaugguuugcugguugcuu

SEQ ID NO: 4050403 - RNA, 18 nt, Staphylococcus aureus subsp. aureus N315
ucugcggauuaucuaacu

SEQ ID NO: 4050404 - RNA, 16 nt, Staphylococcus aureus subsp. aureus N315
ucugcuaaucuucuca

SEQ ID NO: 4050405 - RNA, 21 nt, Staphylococcus aureus subsp. aureus N315
ucugcuaaucuucucauaaaa

SEQ ID NO: 4050406 - RNA, 13 nt, Staphylococcus aureus subsp. aureus N315
ucugcugcuguug

SEQ ID NO: 4050407 - RNA, 14 nt, Staphylococcus aureus subsp. aureus N315
ucugcuucuaaaac

SEQ ID NO: 4050408 - RNA, 16 nt, Staphylococcus aureus subsp. aureus N315
ucugcuuuauuuuauc

SEQ ID NO: 4050409 - RNA, 14 nt, Staphylococcus aureus subsp. aureus N315
ucugcuuuucuauu

SEQ ID NO: 4050410 - RNA, 20 nt, Staphylococcus aureus subsp. aureus N315
ucuggaauaccuaaccauaa

SEQ ID NO: 4050411 - RNA, 15 nt, Staphylococcus aureus subsp. aureus N315
ucuggcaaauugccu

SEQ ID NO: 4050412 - RNA, 14 nt, Staphylococcus aureus subsp. aureus N315
ucugguaaaaaaau

SEQ ID NO: 4050413 - RNA, 17 nt, Staphylococcus aureus subsp. aureus N315
ucugguucuuuacuaaa

SEQ ID NO: 4050414 - RNA, 21 nt, Staphylococcus aureus subsp. aureus N315
ucuguaaauuaucuaaagaaa

SEQ ID NO: 4050415 - RNA, 21 nt, Staphylococcus aureus subsp. aureus N315
ucuguaauaauuauuaauaaa

SEQ ID NO: 4050416 - RNA, 15 nt, Staphylococcus aureus subsp. aureus N315
ucuguaauuaaucca

SEQ ID NO: 4050417 - RNA, 18 nt, Staphylococcus aureus subsp. aureus N315
ucuguaccguauuuuaau

SEQ ID NO: 4050418 - RNA, 16 nt, Staphylococcus aureus subsp. aureus N315
ucuguacguuuuaaau

SEQ ID NO: 4050419 - RNA, 19 nt, Staphylococcus aureus subsp. aureus N315
ucuguacguuuuaaauaaa

SEQ ID NO: 4050420 - RNA, 20 nt, Staphylococcus aureus subsp. aureus N315
ucuguauauggcgauaacaa

SEQ ID NO: 4050421 - RNA, 23 nt, Staphylococcus aureus subsp. aureus N315
ucuguaucgauucgauuauuuag

SEQ ID NO: 4050422 - RNA, 13 nt, Staphylococcus aureus subsp. aureus N315
ucuguccaaaaag

SEQ ID NO: 4050423 - RNA, 22 nt, Staphylococcus aureus subsp. aureus N315
ucuguccgacuuaauauugaau

SEQ ID NO: 4050424 - RNA, 20 nt, Staphylococcus aureus subsp. aureus N315
ucuguccgauaucuuuuaau

SEQ ID NO: 4050425 - RNA, 16 nt, Staphylococcus aureus subsp. aureus N315
ucuguccgauuuuuaa

SEQ ID NO: 4050426 - RNA, 18 nt, Staphylococcus aureus subsp. aureus N315
ucuguccgauuuuuaaug

SEQ ID NO: 4050427 - RNA, 21 nt, Staphylococcus aureus subsp. aureus N315
ucugucggacuccuuuuacuu

SEQ ID NO: 4050428 - RNA, 18 nt, Staphylococcus aureus subsp. aureus N315
ucugucuaaaaacauaaa

SEQ ID NO: 4050429 - RNA, 20 nt, Staphylococcus aureus subsp. aureus N315
ucugucuaaaaacauaaaaa

SEQ ID NO: 4050430 - RNA, 11 nt, Staphylococcus aureus subsp. aureus N315
ucuguguuggg

SEQ ID NO: 4050431 - RNA, 15 nt, Staphylococcus aureus subsp. aureus N315
ucuguuucaaagcug

SEQ ID NO: 4050432 - RNA, 16 nt, Staphylococcus aureus subsp. aureus N315
ucuguuugucacuuaa

SEQ ID NO: 4050433 - RNA, 18 nt, Staphylococcus aureus subsp. aureus N315
ucuuaaaauugaauauca

SEQ ID NO: 4050434 - RNA, 17 nt, Staphylococcus aureus subsp. aureus N315
ucuuaaagauuuuucag

SEQ ID NO: 4050435 - RNA, 19 nt, Staphylococcus aureus subsp. aureus N315
ucuuaaagauuuuucagcu

SEQ ID NO: 4050436 - RNA, 17 nt, Staphylococcus aureus subsp. aureus N315
ucuuaaaucaacaucau

SEQ ID NO: 4050437 - RNA, 14 nt, Staphylococcus aureus subsp. aureus N315
ucuuaacaacauga

SEQ ID NO: 4050438 - RNA, 16 nt, Staphylococcus aureus subsp. aureus N315
ucuuaacaacuuuaau

SEQ ID NO: 4050439 - RNA, 16 nt, Staphylococcus aureus subsp. aureus N315
ucuuaaguacauaaau

SEQ ID NO: 4050440 - RNA, 19 nt, Staphylococcus aureus subsp. aureus N315
ucuuaaucagcuauaaaag

SEQ ID NO: 4050441 - RNA, 21 nt, Staphylococcus aureus subsp. aureus N315
ucuuaaucgagugauucagga

SEQ ID NO: 4050442 - RNA, 13 nt, Staphylococcus aureus subsp. aureus N315
ucuuaauucuucu

SEQ ID NO: 4050443 - RNA, 15 nt, Staphylococcus aureus subsp. aureus N315
ucuuacuacuuaauu

SEQ ID NO: 4050444 - RNA, 22 nt, Staphylococcus aureus subsp. aureus N315
ucuuacuacuuaauuaauaauu

SEQ ID NO: 4050445 - RNA, 19 nt, Staphylococcus aureus subsp. aureus N315
ucuuacugcugcuuuuaau

SEQ ID NO: 4050446 - RNA, 20 nt, Staphylococcus aureus subsp. aureus N315
ucuuacuucguacaucguug

SEQ ID NO: 4050447 - RNA, 20 nt, Staphylococcus aureus subsp. aureus N315
ucuuagcacuuggauuuuaa

SEQ ID NO: 4050448 - RNA, 18 nt, Staphylococcus aureus subsp. aureus N315
ucuuaguaagacugccau

SEQ ID NO: 4050449 - RNA, 18 nt, Staphylococcus aureus subsp. aureus N315
ucuuagugaaucuucuaa

SEQ ID NO: 4050450 - RNA, 13 nt, Staphylococcus aureus subsp. aureus N315
ucuuauaaaaauc

SEQ ID NO: 4050451 - RNA, 14 nt, Staphylococcus aureus subsp. aureus N315
ucuuauaaguucaa

SEQ ID NO: 4050452 - RNA, 13 nt, Staphylococcus aureus subsp. aureus N315
ucuuaucaacaac

SEQ ID NO: 4050453 - RNA, 21 nt, Staphylococcus aureus subsp. aureus N315
ucuuaucaagaauauaacgaa

SEQ ID NO: 4050454 - RNA, 15 nt, Staphylococcus aureus subsp. aureus N315
ucuuaucauaaucuu

SEQ ID NO: 4050455 - RNA, 18 nt, Staphylococcus aureus subsp. aureus N315
ucuuaucauuucaaauaa

SEQ ID NO: 4050456 - RNA, 22 nt, Staphylococcus aureus subsp. aureus N315
ucuuaucgaaagaugauauauu

SEQ ID NO: 4050457 - RNA, 16 nt, Staphylococcus aureus subsp. aureus N315
ucuuaucuuuaugaua

SEQ ID NO: 4050458 - RNA, 15 nt, Staphylococcus aureus subsp. aureus N315
ucuuauuuauucaua

SEQ ID NO: 4050459 - RNA, 15 nt, Staphylococcus aureus subsp. aureus N315
ucuuauuugauucua

SEQ ID NO: 4050460 - RNA, 18 nt, Staphylococcus aureus subsp. aureus N315
ucuuauuuguaauuucag

SEQ ID NO: 4050461 - RNA, 19 nt, Staphylococcus aureus subsp. aureus N315
ucuuauuuguaauuucagc

SEQ ID NO: 4050462 - RNA, 14 nt, Staphylococcus aureus subsp. aureus N315
ucuuauuuuuaugc

SEQ ID NO: 4050463 - RNA, 22 nt, Staphylococcus aureus subsp. aureus N315
ucuucaacaauuucaaugucug

SEQ ID NO: 4050464 - RNA, 21 nt, Staphylococcus aureus subsp. aureus N315
ucuucaauauuuaaauuuuaa

SEQ ID NO: 4050465 - RNA, 17 nt, Staphylococcus aureus subsp. aureus N315
ucuucaaucuaccaaua

SEQ ID NO: 4050466 - RNA, 17 nt, Staphylococcus aureus subsp. aureus N315
ucuucaauucuuacacc

SEQ ID NO: 4050467 - RNA, 13 nt, Staphylococcus aureus subsp. aureus N315
ucuucaauugucu

SEQ ID NO: 4050468 - RNA, 13 nt, Staphylococcus aureus subsp. aureus N315
ucuucaccaucug

SEQ ID NO: 4050469 - RNA, 19 nt, Staphylococcus aureus subsp. aureus N315
ucuucacuaaaaauauauu

SEQ ID NO: 4050470 - RNA, 17 nt, Staphylococcus aureus subsp. aureus N315
ucuucagaaccuugaau

SEQ ID NO: 4050471 - RNA, 17 nt, Staphylococcus aureus subsp. aureus N315
ucuucaggugauucauu

SEQ ID NO: 4050472 - RNA, 16 nt, Staphylococcus aureus subsp. aureus N315
ucuucagguguaguag

SEQ ID NO: 4050473 - RNA, 19 nt, Staphylococcus aureus subsp. aureus N315
ucuucagguguuuuaccuu

SEQ ID NO: 4050474 - RNA, 19 nt, Staphylococcus aureus subsp. aureus N315
ucuucaguuaaaucuuuaa

SEQ ID NO: 4050475 - RNA, 23 nt, Staphylococcus aureus subsp. aureus N315
ucuucaucaauaacuauaaucau

SEQ ID NO: 4050476 - RNA, 13 nt, Staphylococcus aureus subsp. aureus N315
ucuucaucauauu

SEQ ID NO: 4050477 - RNA, 23 nt, Staphylococcus aureus subsp. aureus N315
ucuucaucaugacuauuuuccau

SEQ ID NO: 4050478 - RNA, 17 nt, Staphylococcus aureus subsp. aureus N315
ucuucaucuucuucaaa

SEQ ID NO: 4050479 - RNA, 12 nt, Staphylococcus aureus subsp. aureus N315
ucuucaucuuua

SEQ ID NO: 4050480 - RNA, 12 nt, Staphylococcus aureus subsp. aureus N315
ucuucaucuuuu

SEQ ID NO: 4050481 - RNA, 14 nt, Staphylococcus aureus subsp. aureus N315
ucuucaugaacagc

SEQ ID NO: 4050482 - RNA, 17 nt, Staphylococcus aureus subsp. aureus N315
ucuucauuaucaauaga

SEQ ID NO: 4050483 - RNA, 19 nt, Staphylococcus aureus subsp. aureus N315
ucuucauugaaaauaaucu

SEQ ID NO: 4050484 - RNA, 13 nt, Staphylococcus aureus subsp. aureus N315
ucuuccaaucaac

SEQ ID NO: 4050485 - RNA, 15 nt, Staphylococcus aureus subsp. aureus N315
ucuuccaaucaacuu

SEQ ID NO: 4050486 - RNA, 22 nt, Staphylococcus aureus subsp. aureus N315
ucuuccaaucaacuucauauaa

SEQ ID NO: 4050487 - RNA, 20 nt, Staphylococcus aureus subsp. aureus N315
ucuucccaaaaauuguucaa

SEQ ID NO: 4050488 - RNA, 23 nt, Staphylococcus aureus subsp. aureus N315
ucuuccuccgccaucaauauuua

SEQ ID NO: 4050489 - RNA, 21 nt, Staphylococcus aureus subsp. aureus N315
ucuucgcgaccguguuguuga

SEQ ID NO: 4050490 - RNA, 16 nt, Staphylococcus aureus subsp. aureus N315
ucuucuaaaucaauau

SEQ ID NO: 4050491 - RNA, 20 nt, Staphylococcus aureus subsp. aureus N315
ucuucuaguaauucuucauc

SEQ ID NO: 4050492 - RNA, 23 nt, Staphylococcus aureus subsp. aureus N315
ucuucuauuaaacauuuuugaau

SEQ ID NO: 4050493 - RNA, 17 nt, Staphylococcus aureus subsp. aureus N315
ucuucugcauagcgcuc

SEQ ID NO: 4050494 - RNA, 12 nt, Staphylococcus aureus subsp. aureus N315
ucuucuuuuaau

SEQ ID NO: 4050495 - RNA, 13 nt, Staphylococcus aureus subsp. aureus N315
ucuucuuuuaaua

SEQ ID NO: 4050496 - RNA, 19 nt, Staphylococcus aureus subsp. aureus N315
ucuucuuuuuguccccagc

SEQ ID NO: 4050497 - RNA, 15 nt, Staphylococcus aureus subsp. aureus N315
ucuucuuuuuuuaac

SEQ ID NO: 4050498 - RNA, 21 nt, Staphylococcus aureus subsp. aureus N315
ucuucuuuuuuucuccuuugu

SEQ ID NO: 4050499 - RNA, 22 nt, Staphylococcus aureus subsp. aureus N315
ucuugaaauccguuaaaauuuu

SEQ ID NO: 4050500 - RNA, 19 nt, Staphylococcus aureus subsp. aureus N315
ucuugaaccccauucacua

SEQ ID NO: 4050501 - RNA, 15 nt, Staphylococcus aureus subsp. aureus N315
ucuugaauaaauuuu

SEQ ID NO: 4050502 - RNA, 19 nt, Staphylococcus aureus subsp. aureus N315
ucuugagcaaugucuuuaa

SEQ ID NO: 4050503 - RNA, 13 nt, Staphylococcus aureus subsp. aureus N315
ucuugaguacuaa

SEQ ID NO: 4050504 - RNA, 16 nt, Staphylococcus aureus subsp. aureus N315
ucuugauaaaauaaau

SEQ ID NO: 4050505 - RNA, 13 nt, Staphylococcus aureus subsp. aureus N315
ucuugauauucau

SEQ ID NO: 4050506 - RNA, 21 nt, Staphylococcus aureus subsp. aureus N315
ucuugauuauauuuuucuuca

SEQ ID NO: 4050507 - RNA, 14 nt, Staphylococcus aureus subsp. aureus N315
ucuugauuguaaau

SEQ ID NO: 4050508 - RNA, 16 nt, Staphylococcus aureus subsp. aureus N315
ucuugcaauagcaaca

SEQ ID NO: 4050509 - RNA, 22 nt, Staphylococcus aureus subsp. aureus N315
ucuugcauacgaauuaaaauaa

SEQ ID NO: 4050510 - RNA, 16 nt, Staphylococcus aureus subsp. aureus N315
ucuuggacauuguaaa

SEQ ID NO: 4050511 - RNA, 21 nt, Staphylococcus aureus subsp. aureus N315
ucuuggacauuguaaaaugcu

SEQ ID NO: 4050512 - RNA, 17 nt, Staphylococcus aureus subsp. aureus N315
ucuuggauguuuucguu

SEQ ID NO: 4050513 - RNA, 22 nt, Staphylococcus aureus subsp. aureus N315
ucuugguucagcuuuacguucu

SEQ ID NO: 4050514 - RNA, 13 nt, Staphylococcus aureus subsp. aureus N315
ucuugugaaauua

SEQ ID NO: 4050515 - RNA, 13 nt, Staphylococcus aureus subsp. aureus N315
ucuuguucuaaaa

SEQ ID NO: 4050516 - RNA, 16 nt, Staphylococcus aureus subsp. aureus N315
ucuuguuggauuuuaa

SEQ ID NO: 4050517 - RNA, 19 nt, Staphylococcus aureus subsp. aureus N315
ucuuguuucaaacaaagcu

SEQ ID NO: 4050518 - RNA, 17 nt, Staphylococcus aureus subsp. aureus N315
ucuuguuuucauuuaaa

SEQ ID NO: 4050519 - RNA, 20 nt, Staphylococcus aureus subsp. aureus N315
ucuuuaaacucguaaauuuu

SEQ ID NO: 4050520 - RNA, 21 nt, Staphylococcus aureus subsp. aureus N315
ucuuuaaagaaaauuucagua

SEQ ID NO: 4050521 - RNA, 17 nt, Staphylococcus aureus subsp. aureus N315
ucuuuaaagucuuuaau

SEQ ID NO: 4050522 - RNA, 16 nt, Staphylococcus aureus subsp. aureus N315
ucuuuaagcuuaaaua

SEQ ID NO: 4050523 - RNA, 18 nt, Staphylococcus aureus subsp. aureus N315
ucuuuaauauaaauuuug

SEQ ID NO: 4050524 - RNA, 15 nt, Staphylococcus aureus subsp. aureus N315
ucuuuaaugaaagca

SEQ ID NO: 4050525 - RNA, 15 nt, Staphylococcus aureus subsp. aureus N315
ucuuuaauuggcaug

SEQ ID NO: 4050526 - RNA, 16 nt, Staphylococcus aureus subsp. aureus N315
ucuuuaccauauaauu

SEQ ID NO: 4050527 - RNA, 15 nt, Staphylococcus aureus subsp. aureus N315
ucuuuacuaaagaua

SEQ ID NO: 4050528 - RNA, 16 nt, Staphylococcus aureus subsp. aureus N315
ucuuuacuaaagauag

SEQ ID NO: 4050529 - RNA, 18 nt, Staphylococcus aureus subsp. aureus N315
ucuuuacuuguaauuaau

SEQ ID NO: 4050530 - RNA, 20 nt, Staphylococcus aureus subsp. aureus N315
ucuuuacuuguaauuaauac

SEQ ID NO: 4050531 - RNA, 17 nt, Staphylococcus aureus subsp. aureus N315
ucuuuagauugaucagc

SEQ ID NO: 4050532 - RNA, 18 nt, Staphylococcus aureus subsp. aureus N315
ucuuuagcuauguaaaau

SEQ ID NO: 4050533 - RNA, 16 nt, Staphylococcus aureus subsp. aureus N315
ucuuuauaaaaaaauc

SEQ ID NO: 4050534 - RNA, 13 nt, Staphylococcus aureus subsp. aureus N315
ucuuuauaacgcu

SEQ ID NO: 4050535 - RNA, 22 nt, Staphylococcus aureus subsp. aureus N315
ucuuuauaacgcuuuaauauaa

SEQ ID NO: 4050536 - RNA, 19 nt, Staphylococcus aureus subsp. aureus N315
ucuuuauaagcuuuuucuu

SEQ ID NO: 4050537 - RNA, 22 nt, Staphylococcus aureus subsp. aureus N315
ucuuuauaagcuuuuucuuucu

SEQ ID NO: 4050538 - RNA, 15 nt, Staphylococcus aureus subsp. aureus N315
ucuuuauauucucca

SEQ ID NO: 4050539 - RNA, 13 nt, Staphylococcus aureus subsp. aureus N315
ucuuuauauuuau

SEQ ID NO: 4050540 - RNA, 14 nt, Staphylococcus aureus subsp. aureus N315
ucuuuauauuuauc

SEQ ID NO: 4050541 - RNA, 14 nt, Staphylococcus aureus subsp. aureus N315
ucuuuaugauaauu

SEQ ID NO: 4050542 - RNA, 16 nt, Staphylococcus aureus subsp. aureus N315
ucuuuaugauaauuaa

SEQ ID NO: 4050543 - RNA, 17 nt, Staphylococcus aureus subsp. aureus N315
ucuuuaugauaauuaau

SEQ ID NO: 4050544 - RNA, 22 nt, Staphylococcus aureus subsp. aureus N315
ucuuuaugauaauuaauuaaaa

SEQ ID NO: 4050545 - RNA, 17 nt, Staphylococcus aureus subsp. aureus N315
ucuuuauuaauaaauuc

SEQ ID NO: 4050546 - RNA, 23 nt, Staphylococcus aureus subsp. aureus N315
ucuuuauugggagcaaucaauac

SEQ ID NO: 4050547 - RNA, 13 nt, Staphylococcus aureus subsp. aureus N315
ucuuuauuuaaag

SEQ ID NO: 4050548 - RNA, 16 nt, Staphylococcus aureus subsp. aureus N315
ucuuuauuuuaaacau

SEQ ID NO: 4050549 - RNA, 21 nt, Staphylococcus aureus subsp. aureus N315
ucuuuauuuuuuaucauuuuu

SEQ ID NO: 4050550 - RNA, 14 nt, Staphylococcus aureus subsp. aureus N315
ucuuucaauuaauc

SEQ ID NO: 4050551 - RNA, 15 nt, Staphylococcus aureus subsp. aureus N315
ucuuucaauuaauuu

SEQ ID NO: 4050552 - RNA, 22 nt, Staphylococcus aureus subsp. aureus N315
ucuuucaauuaauuuaaaugcu

SEQ ID NO: 4050553 - RNA, 20 nt, Staphylococcus aureus subsp. aureus N315
ucuuucauagagguuaaccu

SEQ ID NO: 4050554 - RNA, 19 nt, Staphylococcus aureus subsp. aureus N315
ucuuucauaguuauuaaau

SEQ ID NO: 4050555 - RNA, 18 nt, Staphylococcus aureus subsp. aureus N315
ucuuuccucguauuuuau

SEQ ID NO: 4050556 - RNA, 19 nt, Staphylococcus aureus subsp. aureus N315
ucuuucgagguaauuucac

SEQ ID NO: 4050557 - RNA, 14 nt, Staphylococcus aureus subsp. aureus N315
ucuuucgucuugua

SEQ ID NO: 4050558 - RNA, 17 nt, Staphylococcus aureus subsp. aureus N315
ucuuucuaaaauaacua

SEQ ID NO: 4050559 - RNA, 16 nt, Staphylococcus aureus subsp. aureus N315
ucuuucuaaguuugaa

SEQ ID NO: 4050560 - RNA, 21 nt, Staphylococcus aureus subsp. aureus N315
ucuuucucggcgauaaaaugu

SEQ ID NO: 4050561 - RNA, 14 nt, Staphylococcus aureus subsp. aureus N315
ucuuucucuaacau

SEQ ID NO: 4050562 - RNA, 17 nt, Staphylococcus aureus subsp. aureus N315
ucuuucucuaacauuuu

SEQ ID NO: 4050563 - RNA, 19 nt, Staphylococcus aureus subsp. aureus N315
ucuuucucuaacauuuucu

SEQ ID NO: 4050564 - RNA, 16 nt, Staphylococcus aureus subsp. aureus N315
ucuuucucuauuaauu

SEQ ID NO: 4050565 - RNA, 22 nt, Staphylococcus aureus subsp. aureus N315
ucuuucuuagugaaucuucuaa

SEQ ID NO: 4050566 - RNA, 20 nt, Staphylococcus aureus subsp. aureus N315
ucuuucuucagaaccuugaa

SEQ ID NO: 4050567 - RNA, 13 nt, Staphylococcus aureus subsp. aureus N315
ucuuucuuuucug

SEQ ID NO: 4050568 - RNA, 20 nt, Staphylococcus aureus subsp. aureus N315
ucuuucuuuucugaauguau

SEQ ID NO: 4050569 - RNA, 19 nt, Staphylococcus aureus subsp. aureus N315
ucuuugaacauauuauaaa

SEQ ID NO: 4050570 - RNA, 22 nt, Staphylococcus aureus subsp. aureus N315
ucuuugacauguguuaaaccaa

SEQ ID NO: 4050571 - RNA, 20 nt, Staphylococcus aureus subsp. aureus N315
ucuuugauaacaauuuuaaa

SEQ ID NO: 4050572 - RNA, 18 nt, Staphylococcus aureus subsp. aureus N315
ucuuuggucuaaagcuua

SEQ ID NO: 4050573 - RNA, 13 nt, Staphylococcus aureus subsp. aureus N315
ucuuuguaaauuu

SEQ ID NO: 4050574 - RNA, 17 nt, Staphylococcus aureus subsp. aureus N315
ucuuuguauaccuauuc

SEQ ID NO: 4050575 - RNA, 13 nt, Staphylococcus aureus subsp. aureus N315
ucuuuguauuuau

SEQ ID NO: 4050576 - RNA, 18 nt, Staphylococcus aureus subsp. aureus N315
ucuuuguguuugcuuuua

SEQ ID NO: 4050577 - RNA, 19 nt, Staphylococcus aureus subsp. aureus N315
ucuuuguuuuuaauuuuua

SEQ ID NO: 4050578 - RNA, 18 nt, Staphylococcus aureus subsp. aureus N315
ucuuuuaacccacauuaa

SEQ ID NO: 4050579 - RNA, 18 nt, Staphylococcus aureus subsp. aureus N315
ucuuuuaauagaucuuug

SEQ ID NO: 4050580 - RNA, 16 nt, Staphylococcus aureus subsp. aureus N315
ucuuuuagcuuuugua

SEQ ID NO: 4050581 - RNA, 15 nt, Staphylococcus aureus subsp. aureus N315
ucuuuuauacaugua

SEQ ID NO: 4050582 - RNA, 22 nt, Staphylococcus aureus subsp. aureus N315
ucuuuuauggugggaagguaaa

SEQ ID NO: 4050583 - RNA, 21 nt, Staphylococcus aureus subsp. aureus N315
ucuuuuauuaugauauacgag

SEQ ID NO: 4050584 - RNA, 18 nt, Staphylococcus aureus subsp. aureus N315
ucuuuucacgaauaucuu

SEQ ID NO: 4050585 - RNA, 18 nt, Staphylococcus aureus subsp. aureus N315
ucuuuugaaucuuguuga

SEQ ID NO: 4050586 - RNA, 19 nt, Staphylococcus aureus subsp. aureus N315
ucuuuugauagcuaaugca

SEQ ID NO: 4050587 - RNA, 16 nt, Staphylococcus aureus subsp. aureus N315
ucuuuugcaagguuuu

SEQ ID NO: 4050588 - RNA, 15 nt, Staphylococcus aureus subsp. aureus N315
ucuuuuguuuuuaua

SEQ ID NO: 4050589 - RNA, 15 nt, Staphylococcus aureus subsp. aureus N315
ucuuuuuaucaugau

SEQ ID NO: 4050590 - RNA, 13 nt, Staphylococcus aureus subsp. aureus N315
ucuuuuuauuuau

SEQ ID NO: 4050591 - RNA, 22 nt, Staphylococcus aureus subsp. aureus N315
ucuuuuuauuuauaacuuuaaa

SEQ ID NO: 4050592 - RNA, 19 nt, Staphylococcus aureus subsp. aureus N315
ucuuuuucagcuaauuguc

SEQ ID NO: 4050593 - RNA, 15 nt, Staphylococcus aureus subsp. aureus N315
ucuuuuucuaaauaa

SEQ ID NO: 4050594 - RNA, 15 nt, Staphylococcus aureus subsp. aureus N315
ucuuuuucuugcaua

SEQ ID NO: 4050595 - RNA, 21 nt, Staphylococcus aureus subsp. aureus N315
ucuuuuugauaauguucccuu

SEQ ID NO: 4050596 - RNA, 20 nt, Staphylococcus aureus subsp. aureus N315
ucuuuuuguuguuuuaauuu

SEQ ID NO: 4050597 - RNA, 23 nt, Staphylococcus aureus subsp. aureus N315
ucuuuuuuaagcuuaucaacgau

SEQ ID NO: 4050598 - RNA, 12 nt, Staphylococcus aureus subsp. aureus N315
ucuuuuuuaauu

SEQ ID NO: 4050599 - RNA, 16 nt, Staphylococcus aureus subsp. aureus N315
ucuuuuuuacuaaaau

SEQ ID NO: 4050600 - RNA, 18 nt, Staphylococcus aureus subsp. aureus N315
ucuuuuuuacuaaaauca

SEQ ID NO: 4050601 - RNA, 12 nt, Staphylococcus aureus subsp. aureus N315
ucuuuuuuauua

SEQ ID NO: 4050602 - RNA, 18 nt, Staphylococcus aureus subsp. aureus N315
ucuuuuuugcuguauaua

SEQ ID NO: 4050603 - RNA, 12 nt, Staphylococcus aureus subsp. aureus N315
ucuuuuuuuaau

SEQ ID NO: 4050604 - RNA, 18 nt, Staphylococcus aureus subsp. aureus N315
ugaaaaaacgagcuggug

SEQ ID NO: 4050605 - RNA, 14 nt, Staphylococcus aureus subsp. aureus N315
ugaaaaaauaacug

SEQ ID NO: 4050606 - RNA, 22 nt, Staphylococcus aureus subsp. aureus N315
ugaaaaaauaacuguaaaacau

SEQ ID NO: 4050607 - RNA, 23 nt, Staphylococcus aureus subsp. aureus N315
ugaaaaaauaacuguaaaacauu

SEQ ID NO: 4050608 - RNA, 15 nt, Staphylococcus aureus subsp. aureus N315
ugaaaaacuucuuaa

SEQ ID NO: 4050609 - RNA, 20 nt, Staphylococcus aureus subsp. aureus N315
ugaaaaacuucuuaacuuga

SEQ ID NO: 4050610 - RNA, 17 nt, Staphylococcus aureus subsp. aureus N315
ugaaaaagauucggaaa

SEQ ID NO: 4050611 - RNA, 15 nt, Staphylococcus aureus subsp. aureus N315
ugaaaaaucuucucc

SEQ ID NO: 4050612 - RNA, 12 nt, Staphylococcus aureus subsp. aureus N315
ugaaaacuucuc

SEQ ID NO: 4050613 - RNA, 15 nt, Staphylococcus aureus subsp. aureus N315
ugaaaagaauaaguu

SEQ ID NO: 4050614 - RNA, 15 nt, Staphylococcus aureus subsp. aureus N315
ugaaaagauaaacaa

SEQ ID NO: 4050615 - RNA, 16 nt, Staphylococcus aureus subsp. aureus N315
ugaaaaggaaaaacuu

SEQ ID NO: 4050616 - RNA, 15 nt, Staphylococcus aureus subsp. aureus N315
ugaaaaguaaauuga

SEQ ID NO: 4050617 - RNA, 16 nt, Staphylococcus aureus subsp. aureus N315
ugaaaaguaaauugag

SEQ ID NO: 4050618 - RNA, 17 nt, Staphylococcus aureus subsp. aureus N315
ugaaaaguaauuaaaua

SEQ ID NO: 4050619 - RNA, 23 nt, Staphylococcus aureus subsp. aureus N315
ugaaaauaagcuuguaacaagca

SEQ ID NO: 4050620 - RNA, 22 nt, Staphylococcus aureus subsp. aureus N315
ugaaaauaccucuacauuauau

SEQ ID NO: 4050621 - RNA, 23 nt, Staphylococcus aureus subsp. aureus N315
ugaaaaucuaauccugguauaau

SEQ ID NO: 4050622 - RNA, 22 nt, Staphylococcus aureus subsp. aureus N315
ugaaaaucuuuaacucuugaaa

SEQ ID NO: 4050623 - RNA, 15 nt, Staphylococcus aureus subsp. aureus N315
ugaaaauuuguauaa

SEQ ID NO: 4050624 - RNA, 14 nt, Staphylococcus aureus subsp. aureus N315
ugaaacacaaaaag

SEQ ID NO: 4050625 - RNA, 14 nt, Staphylococcus aureus subsp. aureus N315
ugaaacaucuugau

SEQ ID NO: 4050626 - RNA, 14 nt, Staphylococcus aureus subsp. aureus N315
ugaaaccauacuaa

SEQ ID NO: 4050627 - RNA, 22 nt, Staphylococcus aureus subsp. aureus N315
ugaaaccuuugguucaaucauu

SEQ ID NO: 4050628 - RNA, 22 nt, Staphylococcus aureus subsp. aureus N315
ugaaacugauugggcugauaau

SEQ ID NO: 4050629 - RNA, 13 nt, Staphylococcus aureus subsp. aureus N315
ugaaacuuuaaua

SEQ ID NO: 4050630 - RNA, 21 nt, Staphylococcus aureus subsp. aureus N315
ugaaagcaucuugcaagccau

SEQ ID NO: 4050631 - RNA, 18 nt, Staphylococcus aureus subsp. aureus N315
ugaaaguaaauuacaguu

SEQ ID NO: 4050632 - RNA, 17 nt, Staphylococcus aureus subsp. aureus N315
ugaaaguaccuaaaaua

SEQ ID NO: 4050633 - RNA, 18 nt, Staphylococcus aureus subsp. aureus N315
ugaaaguaccuaaaauag

SEQ ID NO: 4050634 - RNA, 22 nt, Staphylococcus aureus subsp. aureus N315
ugaaaguaccuaaaauagaaaa

SEQ ID NO: 4050635 - RNA, 22 nt, Staphylococcus aureus subsp. aureus N315
ugaaaguacuuggaaaauacua

SEQ ID NO: 4050636 - RNA, 13 nt, Staphylococcus aureus subsp. aureus N315
ugaaaguauuaga

SEQ ID NO: 4050637 - RNA, 20 nt, Staphylococcus aureus subsp. aureus N315
ugaaaguauuagauauauuu

SEQ ID NO: 4050638 - RNA, 20 nt, Staphylococcus aureus subsp. aureus N315
ugaaagucaacaauugcuaa

SEQ ID NO: 4050639 - RNA, 22 nt, Staphylococcus aureus subsp. aureus N315
ugaaagucguuguugaaauuaa

SEQ ID NO: 4050640 - RNA, 16 nt, Staphylococcus aureus subsp. aureus N315
ugaaauauaccaacca

SEQ ID NO: 4050641 - RNA, 14 nt, Staphylococcus aureus subsp. aureus N315
ugaaauaucaagau

SEQ ID NO: 4050642 - RNA, 16 nt, Staphylococcus aureus subsp. aureus N315
ugaaauaucgagaggg

SEQ ID NO: 4050643 - RNA, 19 nt, Staphylococcus aureus subsp. aureus N315
ugaaauauuuaucuuuaga

SEQ ID NO: 4050644 - RNA, 14 nt, Staphylococcus aureus subsp. aureus N315
ugaaaucaaugguu

SEQ ID NO: 4050645 - RNA, 21 nt, Staphylococcus aureus subsp. aureus N315
ugaaaucaguuuuugaauauu

SEQ ID NO: 4050646 - RNA, 17 nt, Staphylococcus aureus subsp. aureus N315
ugaaaucauuuaaauua

SEQ ID NO: 4050647 - RNA, 17 nt, Staphylococcus aureus subsp. aureus N315
ugaaaucgauacuaaua

SEQ ID NO: 4050648 - RNA, 20 nt, Staphylococcus aureus subsp. aureus N315
ugaaaucuauugugauauau

SEQ ID NO: 4050649 - RNA, 15 nt, Staphylococcus aureus subsp. aureus N315
ugaaauggaaaguaa

SEQ ID NO: 4050650 - RNA, 12 nt, Staphylococcus aureus subsp. aureus N315
ugaaauguuuaa

SEQ ID NO: 4050651 - RNA, 16 nt, Staphylococcus aureus subsp. aureus N315
ugaaauuaaauucaaa

SEQ ID NO: 4050652 - RNA, 14 nt, Staphylococcus aureus subsp. aureus N315
ugaaauuaaauuug

SEQ ID NO: 4050653 - RNA, 16 nt, Staphylococcus aureus subsp. aureus N315
ugaaauuaauuaucuu

SEQ ID NO: 4050654 - RNA, 19 nt, Staphylococcus aureus subsp. aureus N315
ugaaauuagaaaaauauga

SEQ ID NO: 4050655 - RNA, 17 nt, Staphylococcus aureus subsp. aureus N315
ugaaauuauuauuuaaa

SEQ ID NO: 4050656 - RNA, 20 nt, Staphylococcus aureus subsp. aureus N315
ugaaauuauuauuuaaauuu

SEQ ID NO: 4050657 - RNA, 22 nt, Staphylococcus aureus subsp. aureus N315
ugaaauuauuauuuaaauuuuc

SEQ ID NO: 4050658 - RNA, 23 nt, Staphylococcus aureus subsp. aureus N315
ugaaauucgaacuaucaauauaa

SEQ ID NO: 4050659 - RNA, 14 nt, Staphylococcus aureus subsp. aureus N315
ugaaauuuauuaua

SEQ ID NO: 4050660 - RNA, 14 nt, Staphylococcus aureus subsp. aureus N315
ugaaauuucauaaa

SEQ ID NO: 4050661 - RNA, 15 nt, Staphylococcus aureus subsp. aureus N315
ugaaauuuuuaauau

SEQ ID NO: 4050662 - RNA, 20 nt, Staphylococcus aureus subsp. aureus N315
ugaaauuuuuaauauacccc

SEQ ID NO: 4050663 - RNA, 13 nt, Staphylococcus aureus subsp. aureus N315
ugaaauuuuuccg

SEQ ID NO: 4050664 - RNA, 19 nt, Staphylococcus aureus subsp. aureus N315
ugaaauuuuuuagugaaaa

SEQ ID NO: 4050665 - RNA, 22 nt, Staphylococcus aureus subsp. aureus N315
ugaacaaaaaauaaaaacuucu

SEQ ID NO: 4050666 - RNA, 13 nt, Staphylococcus aureus subsp. aureus N315
ugaacaauucuuc

SEQ ID NO: 4050667 - RNA, 19 nt, Staphylococcus aureus subsp. aureus N315
ugaacaauucuucaucaug

SEQ ID NO: 4050668 - RNA, 15 nt, Staphylococcus aureus subsp. aureus N315
ugaacagauucaccu

SEQ ID NO: 4050669 - RNA, 22 nt, Staphylococcus aureus subsp. aureus N315
ugaacagauucaccuaaucuug

SEQ ID NO: 4050670 - RNA, 13 nt, Staphylococcus aureus subsp. aureus N315
ugaacauaaaaaa

SEQ ID NO: 4050671 - RNA, 17 nt, Staphylococcus aureus subsp. aureus N315
ugaacaucauuuaauug

SEQ ID NO: 4050672 - RNA, 18 nt, Staphylococcus aureus subsp. aureus N315
ugaaccaauccaauauac

SEQ ID NO: 4050673 - RNA, 19 nt, Staphylococcus aureus subsp. aureus N315
ugaaccauuuaacucaccu

SEQ ID NO: 4050674 - RNA, 17 nt, Staphylococcus aureus subsp. aureus N315
ugaaccuuuacucauau

SEQ ID NO: 4050675 - RNA, 18 nt, Staphylococcus aureus subsp. aureus N315
ugaacgauaacaauuuau

SEQ ID NO: 4050676 - RNA, 22 nt, Staphylococcus aureus subsp. aureus N315
ugaacgauauucuacaugaauc

SEQ ID NO: 4050677 - RNA, 14 nt, Staphylococcus aureus subsp. aureus N315
ugaacgguagaaua

SEQ ID NO: 4050678 - RNA, 12 nt, Staphylococcus aureus subsp. aureus N315
ugaacguuuauu

SEQ ID NO: 4050679 - RNA, 13 nt, Staphylococcus aureus subsp. aureus N315
ugaacuaaaacga

SEQ ID NO: 4050680 - RNA, 22 nt, Staphylococcus aureus subsp. aureus N315
ugaacuaaaacgauaauaauaa

SEQ ID NO: 4050681 - RNA, 19 nt, Staphylococcus aureus subsp. aureus N315
ugaacuauuaaaaccaaaa

SEQ ID NO: 4050682 - RNA, 23 nt, Staphylococcus aureus subsp. aureus N315
ugaacuguuucuguaaaaguaua

SEQ ID NO: 4050683 - RNA, 15 nt, Staphylococcus aureus subsp. aureus N315
ugaacuuauaagucc

SEQ ID NO: 4050684 - RNA, 12 nt, Staphylococcus aureus subsp. aureus N315
ugaacuucuuuu

SEQ ID NO: 4050685 - RNA, 15 nt, Staphylococcus aureus subsp. aureus N315
ugaacuuuguaucuu

SEQ ID NO: 4050686 - RNA, 12 nt, Staphylococcus aureus subsp. aureus N315
ugaacuuuuauu

SEQ ID NO: 4050687 - RNA, 14 nt, Staphylococcus aureus subsp. aureus N315
ugaagaaaaaauga

SEQ ID NO: 4050688 - RNA, 16 nt, Staphylococcus aureus subsp. aureus N315
ugaagaaaaaaugaua

SEQ ID NO: 4050689 - RNA, 19 nt, Staphylococcus aureus subsp. aureus N315
ugaagaauacaaauauuaa

SEQ ID NO: 4050690 - RNA, 21 nt, Staphylococcus aureus subsp. aureus N315
ugaagaauguuucauaugcau

SEQ ID NO: 4050691 - RNA, 20 nt, Staphylococcus aureus subsp. aureus N315
ugaagaggucuccaauacuu

SEQ ID NO: 4050692 - RNA, 19 nt, Staphylococcus aureus subsp. aureus N315
ugaagaugcuuuaauuaaa

SEQ ID NO: 4050693 - RNA, 20 nt, Staphylococcus aureus subsp. aureus N315
ugaagcgcuuggauuuuuug

SEQ ID NO: 4050694 - RNA, 23 nt, Staphylococcus aureus subsp. aureus N315
ugaagcgcuuggauuuuuugguu

SEQ ID NO: 4050695 - RNA, 14 nt, Staphylococcus aureus subsp. aureus N315
ugaagcuaauucau

SEQ ID NO: 4050696 - RNA, 23 nt, Staphylococcus aureus subsp. aureus N315
ugaaggcuuugaagggagcauuu

SEQ ID NO: 4050697 - RNA, 16 nt, Staphylococcus aureus subsp. aureus N315
ugaagggagcauuuca

SEQ ID NO: 4050698 - RNA, 17 nt, Staphylococcus aureus subsp. aureus N315
ugaagggagcauuucau

SEQ ID NO: 4050699 - RNA, 20 nt, Staphylococcus aureus subsp. aureus N315
ugaaguaugcacaucauuga

SEQ ID NO: 4050700 - RNA, 15 nt, Staphylococcus aureus subsp. aureus N315
ugaaguauggaaguu

SEQ ID NO: 4050701 - RNA, 18 nt, Staphylococcus aureus subsp. aureus N315
ugaagucaauaauuuuau

SEQ ID NO: 4050702 - RNA, 23 nt, Staphylococcus aureus subsp. aureus N315
ugaagucuguuuagaagaaacuu

SEQ ID NO: 4050703 - RNA, 14 nt, Staphylococcus aureus subsp. aureus N315
ugaaguuacuauau

SEQ ID NO: 4050704 - RNA, 13 nt, Staphylococcus aureus subsp. aureus N315
ugaaguuguuucu

SEQ ID NO: 4050705 - RNA, 22 nt, Staphylococcus aureus subsp. aureus N315
ugaaguuuaaucguauuagcca

SEQ ID NO: 4050706 - RNA, 20 nt, Staphylococcus aureus subsp. aureus N315
ugaaguuugaacaacaucuu

SEQ ID NO: 4050707 - RNA, 14 nt, Staphylococcus aureus subsp. aureus N315
ugaauaaaauauau

SEQ ID NO: 4050708 - RNA, 17 nt, Staphylococcus aureus subsp. aureus N315
ugaauaaaauauaucuu

SEQ ID NO: 4050709 - RNA, 14 nt, Staphylococcus aureus subsp. aureus N315
ugaauaaaauugug

SEQ ID NO: 4050710 - RNA, 20 nt, Staphylococcus aureus subsp. aureus N315
ugaauaaagcuaacauaccu

SEQ ID NO: 4050711 - RNA, 14 nt, Staphylococcus aureus subsp. aureus N315
ugaauaaauaacuu

SEQ ID NO: 4050712 - RNA, 21 nt, Staphylococcus aureus subsp. aureus N315
ugaauaaauacaauguuauua

SEQ ID NO: 4050713 - RNA, 13 nt, Staphylococcus aureus subsp. aureus N315
ugaauaacaagaa

SEQ ID NO: 4050714 - RNA, 14 nt, Staphylococcus aureus subsp. aureus N315
ugaauaauauauuu

SEQ ID NO: 4050715 - RNA, 15 nt, Staphylococcus aureus subsp. aureus N315
ugaauaauuccagua

SEQ ID NO: 4050716 - RNA, 17 nt, Staphylococcus aureus subsp. aureus N315
ugaauaauugcuaaaau

SEQ ID NO: 4050717 - RNA, 14 nt, Staphylococcus aureus subsp. aureus N315
ugaauaauuucagu

SEQ ID NO: 4050718 - RNA, 21 nt, Staphylococcus aureus subsp. aureus N315
ugaauaauuucaguucuuaga

SEQ ID NO: 4050719 - RNA, 22 nt, Staphylococcus aureus subsp. aureus N315
ugaauaauuucaguucuuagau

SEQ ID NO: 4050720 - RNA, 14 nt, Staphylococcus aureus subsp. aureus N315
ugaauacuucuuua

SEQ ID NO: 4050721 - RNA, 13 nt, Staphylococcus aureus subsp. aureus N315
ugaauauaaaaaa

SEQ ID NO: 4050722 - RNA, 15 nt, Staphylococcus aureus subsp. aureus N315
ugaauauaaaaaaca

SEQ ID NO: 4050723 - RNA, 20 nt, Staphylococcus aureus subsp. aureus N315
ugaauauagcugugauuuga

SEQ ID NO: 4050724 - RNA, 14 nt, Staphylococcus aureus subsp. aureus N315
ugaauaucacuuua

SEQ ID NO: 4050725 - RNA, 21 nt, Staphylococcus aureus subsp. aureus N315
ugaauauggaaaauguauuau

SEQ ID NO: 4050726 - RNA, 15 nt, Staphylococcus aureus subsp. aureus N315
ugaauauuuuucaau

SEQ ID NO: 4050727 - RNA, 23 nt, Staphylococcus aureus subsp. aureus N315
ugaaucaacaguuuuauuaucuu

SEQ ID NO: 4050728 - RNA, 16 nt, Staphylococcus aureus subsp. aureus N315
ugaaucagaugauuua

SEQ ID NO: 4050729 - RNA, 16 nt, Staphylococcus aureus subsp. aureus N315
ugaaucaguuacugcg

SEQ ID NO: 4050730 - RNA, 16 nt, Staphylococcus aureus subsp. aureus N315
ugaaucccauaaugac

SEQ ID NO: 4050731 - RNA, 20 nt, Staphylococcus aureus subsp. aureus N315
ugaaucgaguuugaaauaau

SEQ ID NO: 4050732 - RNA, 14 nt, Staphylococcus aureus subsp. aureus N315
ugaaucgcauuuaa

SEQ ID NO: 4050733 - RNA, 18 nt, Staphylococcus aureus subsp. aureus N315
ugaaucgcauuuaaauau

SEQ ID NO: 4050734 - RNA, 14 nt, Staphylococcus aureus subsp. aureus N315
ugaaucuaaacuau

SEQ ID NO: 4050735 - RNA, 18 nt, Staphylococcus aureus subsp. aureus N315
ugaaucuaaacuauaaua

SEQ ID NO: 4050736 - RNA, 19 nt, Staphylococcus aureus subsp. aureus N315
ugaaucuagaauauaacaa

SEQ ID NO: 4050737 - RNA, 20 nt, Staphylococcus aureus subsp. aureus N315
ugaaucuagaauauaacaac

SEQ ID NO: 4050738 - RNA, 20 nt, Staphylococcus aureus subsp. aureus N315
ugaaucuuauuuuguuuuaa

SEQ ID NO: 4050739 - RNA, 23 nt, Staphylococcus aureus subsp. aureus N315
ugaaucuuauuuuguuuuaaaaa

SEQ ID NO: 4050740 - RNA, 23 nt, Staphylococcus aureus subsp. aureus N315
ugaaucuuguugaacucugauau

SEQ ID NO: 4050741 - RNA, 15 nt, Staphylococcus aureus subsp. aureus N315
ugaaucuuuguuaua

SEQ ID NO: 4050742 - RNA, 13 nt, Staphylococcus aureus subsp. aureus N315
ugaaugaaaauaa

SEQ ID NO: 4050743 - RNA, 14 nt, Staphylococcus aureus subsp. aureus N315
ugaaugaaaauaag

SEQ ID NO: 4050744 - RNA, 20 nt, Staphylococcus aureus subsp. aureus N315
ugaaugaaccuuuacucaua

SEQ ID NO: 4050745 - RNA, 22 nt, Staphylococcus aureus subsp. aureus N315
ugaaugaaccuuuacucauauu

SEQ ID NO: 4050746 - RNA, 14 nt, Staphylococcus aureus subsp. aureus N315
ugaaugaaguaaua

SEQ ID NO: 4050747 - RNA, 14 nt, Staphylococcus aureus subsp. aureus N315
ugaaugagugucau

SEQ ID NO: 4050748 - RNA, 14 nt, Staphylococcus aureus subsp. aureus N315
ugaaugauauuaac

SEQ ID NO: 4050749 - RNA, 17 nt, Staphylococcus aureus subsp. aureus N315
ugaaugauugcauugau

SEQ ID NO: 4050750 - RNA, 14 nt, Staphylococcus aureus subsp. aureus N315
ugaauggcaaauau

SEQ ID NO: 4050751 - RNA, 22 nt, Staphylococcus aureus subsp. aureus N315
ugaauggcaaucuauauaaaug

SEQ ID NO: 4050752 - RNA, 23 nt, Staphylococcus aureus subsp. aureus N315
ugaauggcaaucuauauaaaugu

SEQ ID NO: 4050753 - RNA, 12 nt, Staphylococcus aureus subsp. aureus N315
ugaauggcucgu

SEQ ID NO: 4050754 - RNA, 12 nt, Staphylococcus aureus subsp. aureus N315
ugaauuaaaaaa

SEQ ID NO: 4050755 - RNA, 13 nt, Staphylococcus aureus subsp. aureus N315
ugaauuaauagcu

SEQ ID NO: 4050756 - RNA, 15 nt, Staphylococcus aureus subsp. aureus N315
ugaauuaucuauaua

SEQ ID NO: 4050757 - RNA, 15 nt, Staphylococcus aureus subsp. aureus N315
ugaauuauuuaaaau

SEQ ID NO: 4050758 - RNA, 18 nt, Staphylococcus aureus subsp. aureus N315
ugaauugaaaaauuaaaa

SEQ ID NO: 4050759 - RNA, 16 nt, Staphylococcus aureus subsp. aureus N315
ugaauugaguauuaaa

SEQ ID NO: 4050760 - RNA, 21 nt, Staphylococcus aureus subsp. aureus N315
ugaauugaguauuaaauuuga

SEQ ID NO: 4050761 - RNA, 15 nt, Staphylococcus aureus subsp. aureus N315
ugaauugauuauaau

SEQ ID NO: 4050762 - RNA, 17 nt, Staphylococcus aureus subsp. aureus N315
ugaauuggauuaucgaa

SEQ ID NO: 4050763 - RNA, 18 nt, Staphylococcus aureus subsp. aureus N315
ugaauugguugaucaauu

SEQ ID NO: 4050764 - RNA, 18 nt, Staphylococcus aureus subsp. aureus N315
ugaauugucuuaauaugc

SEQ ID NO: 4050765 - RNA, 19 nt, Staphylococcus aureus subsp. aureus N315
ugaauuguuaguuuucuua

SEQ ID NO: 4050766 - RNA, 15 nt, Staphylococcus aureus subsp. aureus N315
ugaauuuaauacuau

SEQ ID NO: 4050767 - RNA, 14 nt, Staphylococcus aureus subsp. aureus N315
ugaauuuagcauca

SEQ ID NO: 4050768 - RNA, 16 nt, Staphylococcus aureus subsp. aureus N315
ugaauuuuaauauauu

SEQ ID NO: 4050769 - RNA, 21 nt, Staphylococcus aureus subsp. aureus N315
ugaauuuuauaaauuaaaugc

SEQ ID NO: 4050770 - RNA, 21 nt, Staphylococcus aureus subsp. aureus N315
ugaauuuuauaaguauauaau

SEQ ID NO: 4050771 - RNA, 13 nt, Staphylococcus aureus subsp. aureus N315
ugaauuuuuauuu

SEQ ID NO: 4050772 - RNA, 18 nt, Staphylococcus aureus subsp. aureus N315
ugacaaagcuaaagugaa

SEQ ID NO: 4050773 - RNA, 22 nt, Staphylococcus aureus subsp. aureus N315
ugacaaguugcugaauaaaaua

SEQ ID NO: 4050774 - RNA, 18 nt, Staphylococcus aureus subsp. aureus N315
ugacaaucgcuugcuucu

SEQ ID NO: 4050775 - RNA, 18 nt, Staphylococcus aureus subsp. aureus N315
ugacaauucaucuaaccu

SEQ ID NO: 4050776 - RNA, 13 nt, Staphylococcus aureus subsp. aureus N315
ugacaguuuccau

SEQ ID NO: 4050777 - RNA, 20 nt, Staphylococcus aureus subsp. aureus N315
ugacaguuuuaaaugaaacu

SEQ ID NO: 4050778 - RNA, 19 nt, Staphylococcus aureus subsp. aureus N315
ugacauaaaaaauaacucc

SEQ ID NO: 4050779 - RNA, 23 nt, Staphylococcus aureus subsp. aureus N315
ugacauaggcgcuuuuuuuuaua

SEQ ID NO: 4050780 - RNA, 16 nt, Staphylococcus aureus subsp. aureus N315
ugacauaucgauauuc

SEQ ID NO: 4050781 - RNA, 19 nt, Staphylococcus aureus subsp. aureus N315
ugacauaucgauauucucc

SEQ ID NO: 4050782 - RNA, 17 nt, Staphylococcus aureus subsp. aureus N315
ugacauauuuuuuaaau

SEQ ID NO: 4050783 - RNA, 19 nt, Staphylococcus aureus subsp. aureus N315
ugacauggcacgauaauug

SEQ ID NO: 4050784 - RNA, 20 nt, Staphylococcus aureus subsp. aureus N315
ugacauuucaucaauaauuu

SEQ ID NO: 4050785 - RNA, 18 nt, Staphylococcus aureus subsp. aureus N315
ugacauuugaccaaguau

SEQ ID NO: 4050786 - RNA, 16 nt, Staphylococcus aureus subsp. aureus N315
ugacauuuuaaaucua

SEQ ID NO: 4050787 - RNA, 21 nt, Staphylococcus aureus subsp. aureus N315
ugacauuuucaaguuuaaaau

SEQ ID NO: 4050788 - RNA, 18 nt, Staphylococcus aureus subsp. aureus N315
ugaccaagauuccaucac

SEQ ID NO: 4050789 - RNA, 19 nt, Staphylococcus aureus subsp. aureus N315
ugaccaauagcaauugaau

SEQ ID NO: 4050790 - RNA, 15 nt, Staphylococcus aureus subsp. aureus N315
ugaccaccacuuuca

SEQ ID NO: 4050791 - RNA, 22 nt, Staphylococcus aureus subsp. aureus N315
ugaccaccuuuaucuguaacaa

SEQ ID NO: 4050792 - RNA, 22 nt, Staphylococcus aureus subsp. aureus N315
ugaccauuaucaagaacuuuaa

SEQ ID NO: 4050793 - RNA, 14 nt, Staphylococcus aureus subsp. aureus N315
ugacccuugucagu

SEQ ID NO: 4050794 - RNA, 14 nt, Staphylococcus aureus subsp. aureus N315
ugaccuacuuuuuc

SEQ ID NO: 4050795 - RNA, 23 nt, Staphylococcus aureus subsp. aureus N315
ugaccuacuuuuucaauaugugg

SEQ ID NO: 4050796 - RNA, 13 nt, Staphylococcus aureus subsp. aureus N315
ugaccuuauauuu

SEQ ID NO: 4050797 - RNA, 20 nt, Staphylococcus aureus subsp. aureus N315
ugaccuuuacgccauucauc

SEQ ID NO: 4050798 - RNA, 13 nt, Staphylococcus aureus subsp. aureus N315
ugacgaguagauu

SEQ ID NO: 4050799 - RNA, 17 nt, Staphylococcus aureus subsp. aureus N315
ugacgauaaugaaauac

SEQ ID NO: 4050800 - RNA, 22 nt, Staphylococcus aureus subsp. aureus N315
ugacgauaccuuuaauaauauu

SEQ ID NO: 4050801 - RNA, 17 nt, Staphylococcus aureus subsp. aureus N315
ugacgaucuucaugaac

SEQ ID NO: 4050802 - RNA, 21 nt, Staphylococcus aureus subsp. aureus N315
ugacgcgugaauuaaaaaaug

SEQ ID NO: 4050803 - RNA, 20 nt, Staphylococcus aureus subsp. aureus N315
ugacgcugguaauauuuuug

SEQ ID NO: 4050804 - RNA, 15 nt, Staphylococcus aureus subsp. aureus N315
ugacguaauuaauag

SEQ ID NO: 4050805 - RNA, 20 nt, Staphylococcus aureus subsp. aureus N315
ugacguaauuaauagguuau

SEQ ID NO: 4050806 - RNA, 18 nt, Staphylococcus aureus subsp. aureus N315
ugacguuuugguuguucu

SEQ ID NO: 4050807 - RNA, 15 nt, Staphylococcus aureus subsp. aureus N315
ugacuaauaaaacuu

SEQ ID NO: 4050808 - RNA, 16 nt, Staphylococcus aureus subsp. aureus N315
ugacuagggguuuuua

SEQ ID NO: 4050809 - RNA, 18 nt, Staphylococcus aureus subsp. aureus N315
ugacuagggguuuuuaau

SEQ ID NO: 4050810 - RNA, 22 nt, Staphylococcus aureus subsp. aureus N315
ugacuauuucgcuuuuuuuauu

SEQ ID NO: 4050811 - RNA, 12 nt, Staphylococcus aureus subsp. aureus N315
ugacuauuuucc

SEQ ID NO: 4050812 - RNA, 18 nt, Staphylococcus aureus subsp. aureus N315
ugacucaaagauauacuu

SEQ ID NO: 4050813 - RNA, 20 nt, Staphylococcus aureus subsp. aureus N315
ugacucagaaucuuacauug

SEQ ID NO: 4050814 - RNA, 12 nt, Staphylococcus aureus subsp. aureus N315
ugacugagaaaa

SEQ ID NO: 4050815 - RNA, 16 nt, Staphylococcus aureus subsp. aureus N315
ugacuguagaaaacau

SEQ ID NO: 4050816 - RNA, 14 nt, Staphylococcus aureus subsp. aureus N315
ugacuguuaaacaa

SEQ ID NO: 4050817 - RNA, 22 nt, Staphylococcus aureus subsp. aureus N315
ugacuuaauaucauauucaaaa

SEQ ID NO: 4050818 - RNA, 14 nt, Staphylococcus aureus subsp. aureus N315
ugacuuauuuuuca

SEQ ID NO: 4050819 - RNA, 16 nt, Staphylococcus aureus subsp. aureus N315
ugacuuuaauugcucu

SEQ ID NO: 4050820 - RNA, 18 nt, Staphylococcus aureus subsp. aureus N315
ugacuuuccuaauucuug

SEQ ID NO: 4050821 - RNA, 16 nt, Staphylococcus aureus subsp. aureus N315
ugacuuugucauacua

SEQ ID NO: 4050822 - RNA, 14 nt, Staphylococcus aureus subsp. aureus N315
ugacuuuuaaaaaa

SEQ ID NO: 4050823 - RNA, 16 nt, Staphylococcus aureus subsp. aureus N315
ugacuuuuaaaaaaca

SEQ ID NO: 4050824 - RNA, 21 nt, Staphylococcus aureus subsp. aureus N315
ugacuuuuaaaaaacauaccu

SEQ ID NO: 4050825 - RNA, 23 nt, Staphylococcus aureus subsp. aureus N315
ugacuuuuaaaaaacauaccugc

SEQ ID NO: 4050826 - RNA, 14 nt, Staphylococcus aureus subsp. aureus N315
ugacuuuuauaauu

SEQ ID NO: 4050827 - RNA, 16 nt, Staphylococcus aureus subsp. aureus N315
ugacuuuuauaauucu

SEQ ID NO: 4050828 - RNA, 13 nt, Staphylococcus aureus subsp. aureus N315
ugacuuuuuaaua

SEQ ID NO: 4050829 - RNA, 18 nt, Staphylococcus aureus subsp. aureus N315
ugagaaaaauauuucuaa

SEQ ID NO: 4050830 - RNA, 20 nt, Staphylococcus aureus subsp. aureus N315
ugagaaaaauauuucuaaua

SEQ ID NO: 4050831 - RNA, 16 nt, Staphylococcus aureus subsp. aureus N315
ugagaaaguaaaaguu

SEQ ID NO: 4050832 - RNA, 16 nt, Staphylococcus aureus subsp. aureus N315
ugagaaaucuuaaaga

SEQ ID NO: 4050833 - RNA, 15 nt, Staphylococcus aureus subsp. aureus N315
ugagaagaaauauau

SEQ ID NO: 4050834 - RNA, 15 nt, Staphylococcus aureus subsp. aureus N315
ugagaaucuuggaag

SEQ ID NO: 4050835 - RNA, 17 nt, Staphylococcus aureus subsp. aureus N315
ugagaauugcaacgcau

SEQ ID NO: 4050836 - RNA, 13 nt, Staphylococcus aureus subsp. aureus N315
ugagaauuucuaa

SEQ ID NO: 4050837 - RNA, 15 nt, Staphylococcus aureus subsp. aureus N315
ugagaauuucuaauu

SEQ ID NO: 4050838 - RNA, 16 nt, Staphylococcus aureus subsp. aureus N315
ugagaauuucuaauua

SEQ ID NO: 4050839 - RNA, 23 nt, Staphylococcus aureus subsp. aureus N315
ugagacccaccguuaaaauauau

SEQ ID NO: 4050840 - RNA, 13 nt, Staphylococcus aureus subsp. aureus N315
ugagacgcauugc

SEQ ID NO: 4050841 - RNA, 16 nt, Staphylococcus aureus subsp. aureus N315
ugagagauuauuuaaa

SEQ ID NO: 4050842 - RNA, 12 nt, Staphylococcus aureus subsp. aureus N315
ugagauaaaauc

SEQ ID NO: 4050843 - RNA, 16 nt, Staphylococcus aureus subsp. aureus N315
ugagauaaaaucauau

SEQ ID NO: 4050844 - RNA, 19 nt, Staphylococcus aureus subsp. aureus N315
ugagauauauuaauguuug

SEQ ID NO: 4050845 - RNA, 17 nt, Staphylococcus aureus subsp. aureus N315
ugagauaucuuauaaca

SEQ ID NO: 4050846 - RNA, 13 nt, Staphylococcus aureus subsp. aureus N315
ugagauuaucuuu

SEQ ID NO: 4050847 - RNA, 16 nt, Staphylococcus aureus subsp. aureus N315
ugagauuaucuuuaga

SEQ ID NO: 4050848 - RNA, 16 nt, Staphylococcus aureus subsp. aureus N315
ugagauuauuuuuuua

SEQ ID NO: 4050849 - RNA, 22 nt, Staphylococcus aureus subsp. aureus N315
ugagauuauuuuuuuaaaucua

SEQ ID NO: 4050850 - RNA, 21 nt, Staphylococcus aureus subsp. aureus N315
ugagcaaagcaaauuaguaug

SEQ ID NO: 4050851 - RNA, 22 nt, Staphylococcus aureus subsp. aureus N315
ugagcaacaaaagauguugcuc

SEQ ID NO: 4050852 - RNA, 14 nt, Staphylococcus aureus subsp. aureus N315
ugagcaagucuucu

SEQ ID NO: 4050853 - RNA, 15 nt, Staphylococcus aureus subsp. aureus N315
ugagcacaaacuaaa

SEQ ID NO: 4050854 - RNA, 14 nt, Staphylococcus aureus subsp. aureus N315
ugagcaucuugucu

SEQ ID NO: 4050855 - RNA, 15 nt, Staphylococcus aureus subsp. aureus N315
ugagcguauuauuau

SEQ ID NO: 4050856 - RNA, 20 nt, Staphylococcus aureus subsp. aureus N315
ugagcuguuacacuuuucuu

SEQ ID NO: 4050857 - RNA, 23 nt, Staphylococcus aureus subsp. aureus N315
ugagcuguuacacuuuucuuauc

SEQ ID NO: 4050858 - RNA, 16 nt, Staphylococcus aureus subsp. aureus N315
ugagcuuaauaaauug

SEQ ID NO: 4050859 - RNA, 17 nt, Staphylococcus aureus subsp. aureus N315
ugagcuuaauaaauugu

SEQ ID NO: 4050860 - RNA, 17 nt, Staphylococcus aureus subsp. aureus N315
ugaggaauaugaauugc

SEQ ID NO: 4050861 - RNA, 18 nt, Staphylococcus aureus subsp. aureus N315
ugaggauacauaaaucua

SEQ ID NO: 4050862 - RNA, 18 nt, Staphylococcus aureus subsp. aureus N315
ugaggcccauaaauuacu

SEQ ID NO: 4050863 - RNA, 20 nt, Staphylococcus aureus subsp. aureus N315
ugaggcccauaaauuacuug

SEQ ID NO: 4050864 - RNA, 17 nt, Staphylococcus aureus subsp. aureus N315
ugaggcugggacauaaa

SEQ ID NO: 4050865 - RNA, 12 nt, Staphylococcus aureus subsp. aureus N315
ugagggccccaa

SEQ ID NO: 4050866 - RNA, 13 nt, Staphylococcus aureus subsp. aureus N315
ugagggccccaac

SEQ ID NO: 4050867 - RNA, 20 nt, Staphylococcus aureus subsp. aureus N315
ugaguaaauuaauagagaaa

SEQ ID NO: 4050868 - RNA, 11 nt, Staphylococcus aureus subsp. aureus N315
ugaguacaaca

SEQ ID NO: 4050869 - RNA, 18 nt, Staphylococcus aureus subsp. aureus N315
ugaguauauucaaaagga

SEQ ID NO: 4050870 - RNA, 16 nt, Staphylococcus aureus subsp. aureus N315
ugaguaucaugcuuuu

SEQ ID NO: 4050871 - RNA, 15 nt, Staphylococcus aureus subsp. aureus N315
ugaguaugacgaaau

SEQ ID NO: 4050872 - RNA, 17 nt, Staphylococcus aureus subsp. aureus N315
ugaguauuacuugaaaa

SEQ ID NO: 4050873 - RNA, 22 nt, Staphylococcus aureus subsp. aureus N315
ugaguauuugccuuuuuuauuu

SEQ ID NO: 4050874 - RNA, 16 nt, Staphylococcus aureus subsp. aureus N315
ugagucaauuucuuua

SEQ ID NO: 4050875 - RNA, 21 nt, Staphylococcus aureus subsp. aureus N315
ugagucuuggacauuguaaaa

SEQ ID NO: 4050876 - RNA, 23 nt, Staphylococcus aureus subsp. aureus N315
ugagugguuuucuuuauuuuaaa

SEQ ID NO: 4050877 - RNA, 21 nt, Staphylococcus aureus subsp. aureus N315
ugagugucaugcuuaauuuau

SEQ ID NO: 4050878 - RNA, 18 nt, Staphylococcus aureus subsp. aureus N315
ugaguguuucauaaucuc

SEQ ID NO: 4050879 - RNA, 15 nt, Staphylococcus aureus subsp. aureus N315
ugaguucguaaucuu

SEQ ID NO: 4050880 - RNA, 14 nt, Staphylococcus aureus subsp. aureus N315
ugaguuggcaucag

SEQ ID NO: 4050881 - RNA, 13 nt, Staphylococcus aureus subsp. aureus N315
ugaguuuaaaaau

SEQ ID NO: 4050882 - RNA, 14 nt, Staphylococcus aureus subsp. aureus N315
ugaguuuaaaaaua

SEQ ID NO: 4050883 - RNA, 14 nt, Staphylococcus aureus subsp. aureus N315
ugaguuuuuuaaaa

SEQ ID NO: 4050884 - RNA, 21 nt, Staphylococcus aureus subsp. aureus N315
ugauaaaaggggaaaucauuu

SEQ ID NO: 4050885 - RNA, 15 nt, Staphylococcus aureus subsp. aureus N315
ugauaaagagccacu

SEQ ID NO: 4050886 - RNA, 15 nt, Staphylococcus aureus subsp. aureus N315
ugauaaauaaugcau

SEQ ID NO: 4050887 - RNA, 21 nt, Staphylococcus aureus subsp. aureus N315
ugauaaaugaauugucuuaau

SEQ ID NO: 4050888 - RNA, 19 nt, Staphylococcus aureus subsp. aureus N315
ugauaacaauuuuaaaucu

SEQ ID NO: 4050889 - RNA, 20 nt, Staphylococcus aureus subsp. aureus N315
ugauaacaauuuuaaaucuu

SEQ ID NO: 4050890 - RNA, 23 nt, Staphylococcus aureus subsp. aureus N315
ugauaaccaaaccauaaguaaaa

SEQ ID NO: 4050891 - RNA, 22 nt, Staphylococcus aureus subsp. aureus N315
ugauaaccauuaugauuaaucc

SEQ ID NO: 4050892 - RNA, 14 nt, Staphylococcus aureus subsp. aureus N315
ugauaacgagcuaa

SEQ ID NO: 4050893 - RNA, 15 nt, Staphylococcus aureus subsp. aureus N315
ugauaacuuguaaua

SEQ ID NO: 4050894 - RNA, 15 nt, Staphylococcus aureus subsp. aureus N315
ugauaauccaccaaa

SEQ ID NO: 4050895 - RNA, 21 nt, Staphylococcus aureus subsp. aureus N315
ugauaauccaccaaauacagu

SEQ ID NO: 4050896 - RNA, 19 nt, Staphylococcus aureus subsp. aureus N315
ugauaauuaaugccauugu

SEQ ID NO: 4050897 - RNA, 16 nt, Staphylococcus aureus subsp. aureus N315
ugauaauuaauuaaaa

SEQ ID NO: 4050898 - RNA, 22 nt, Staphylococcus aureus subsp. aureus N315
ugauaauucgaaaucaaauauu

SEQ ID NO: 4050899 - RNA, 13 nt, Staphylococcus aureus subsp. aureus N315
ugauaauuuaaua

SEQ ID NO: 4050900 - RNA, 22 nt, Staphylococcus aureus subsp. aureus N315
ugauaauuuuucuucuuuuuua

SEQ ID NO: 4050901 - RNA, 20 nt, Staphylococcus aureus subsp. aureus N315
ugauacagaaccaacaauaa

SEQ ID NO: 4050902 - RNA, 14 nt, Staphylococcus aureus subsp. aureus N315
ugauacauaaaaug

SEQ ID NO: 4050903 - RNA, 13 nt, Staphylococcus aureus subsp. aureus N315
ugauacauuauua

SEQ ID NO: 4050904 - RNA, 20 nt, Staphylococcus aureus subsp. aureus N315
ugauacauuauuaaauagau

SEQ ID NO: 4050905 - RNA, 18 nt, Staphylococcus aureus subsp. aureus N315
ugauacccgcgauacugc

SEQ ID NO: 4050906 - RNA, 17 nt, Staphylococcus aureus subsp. aureus N315
ugauacgcacguauaua

SEQ ID NO: 4050907 - RNA, 22 nt, Staphylococcus aureus subsp. aureus N315
ugauacgccuaaauauuuaccu

SEQ ID NO: 4050908 - RNA, 17 nt, Staphylococcus aureus subsp. aureus N315
ugauacgcuuuuuaaaa

SEQ ID NO: 4050909 - RNA, 16 nt, Staphylococcus aureus subsp. aureus N315
ugauacguacguugau

SEQ ID NO: 4050910 - RNA, 17 nt, Staphylococcus aureus subsp. aureus N315
ugauacuucaccaucuu

SEQ ID NO: 4050911 - RNA, 15 nt, Staphylococcus aureus subsp. aureus N315
ugauagaugauacau

SEQ ID NO: 4050912 - RNA, 22 nt, Staphylococcus aureus subsp. aureus N315
ugauagcuaaacauuuuauacu

SEQ ID NO: 4050913 - RNA, 22 nt, Staphylococcus aureus subsp. aureus N315
ugauagugguagccaauaucau

SEQ ID NO: 4050914 - RNA, 20 nt, Staphylococcus aureus subsp. aureus N315
ugauaguuguaucauuaauu

SEQ ID NO: 4050915 - RNA, 17 nt, Staphylococcus aureus subsp. aureus N315
ugauaguuucuaaucuu

SEQ ID NO: 4050916 - RNA, 12 nt, Staphylococcus aureus subsp. aureus N315
ugauauaaaaag

SEQ ID NO: 4050917 - RNA, 17 nt, Staphylococcus aureus subsp. aureus N315
ugauauaaaaagugaaa

SEQ ID NO: 4050918 - RNA, 23 nt, Staphylococcus aureus subsp. aureus N315
ugauauaaaaagugaaaguauua

SEQ ID NO: 4050919 - RNA, 19 nt, Staphylococcus aureus subsp. aureus N315
ugauauaaccgcauacaga

SEQ ID NO: 4050920 - RNA, 17 nt, Staphylococcus aureus subsp. aureus N315
ugauauacuugaagaaa

SEQ ID NO: 4050921 - RNA, 17 nt, Staphylococcus aureus subsp. aureus N315
ugauauauaacaaguac

SEQ ID NO: 4050922 - RNA, 13 nt, Staphylococcus aureus subsp. aureus N315
ugauauauaacca

SEQ ID NO: 4050923 - RNA, 15 nt, Staphylococcus aureus subsp. aureus N315
ugauauaugaaauau

SEQ ID NO: 4050924 - RNA, 15 nt, Staphylococcus aureus subsp. aureus N315
ugauauauuacacca

SEQ ID NO: 4050925 - RNA, 23 nt, Staphylococcus aureus subsp. aureus N315
ugauaucgaaacgcuuugcagau

SEQ ID NO: 4050926 - RNA, 14 nt, Staphylococcus aureus subsp. aureus N315
ugauaugugaaaaa

SEQ ID NO: 4050927 - RNA, 18 nt, Staphylococcus aureus subsp. aureus N315
ugauaugugaaaaagcua

SEQ ID NO: 4050928 - RNA, 20 nt, Staphylococcus aureus subsp. aureus N315
ugauaugugaaaaagcuaau

SEQ ID NO: 4050929 - RNA, 14 nt, Staphylococcus aureus subsp. aureus N315
ugauauugaaagug

SEQ ID NO: 4050930 - RNA, 19 nt, Staphylococcus aureus subsp. aureus N315
ugauauugaucugauuuca

SEQ ID NO: 4050931 - RNA, 18 nt, Staphylococcus aureus subsp. aureus N315
ugauauuuaacaaaauua

SEQ ID NO: 4050932 - RNA, 15 nt, Staphylococcus aureus subsp. aureus N315
ugaucaaaaagacag

SEQ ID NO: 4050933 - RNA, 16 nt, Staphylococcus aureus subsp. aureus N315
ugaucagcauuuaagc

SEQ ID NO: 4050934 - RNA, 19 nt, Staphylococcus aureus subsp. aureus N315
ugaucauuugacauaaucc

SEQ ID NO: 4050935 - RNA, 20 nt, Staphylococcus aureus subsp. aureus N315
ugauccuggaaucgaaaaua

SEQ ID NO: 4050936 - RNA, 18 nt, Staphylococcus aureus subsp. aureus N315
ugaucgauuguuuauuag

SEQ ID NO: 4050937 - RNA, 20 nt, Staphylococcus aureus subsp. aureus N315
ugaucuuuuuuauauucaac

SEQ ID NO: 4050938 - RNA, 24 nt, Staphylococcus aureus subsp. aureus N315
ugaucuuuuuuauauucaacuuau

SEQ ID NO: 4050939 - RNA, 14 nt, Staphylococcus aureus subsp. aureus N315
ugaugaaagacuga

SEQ ID NO: 4050940 - RNA, 18 nt, Staphylococcus aureus subsp. aureus N315
ugaugaacauaccugcau

SEQ ID NO: 4050941 - RNA, 22 nt, Staphylococcus aureus subsp. aureus N315
ugaugagaugaggcgauaaaag

SEQ ID NO: 4050942 - RNA, 17 nt, Staphylococcus aureus subsp. aureus N315
ugaugaggcaauauuaa

SEQ ID NO: 4050943 - RNA, 19 nt, Staphylococcus aureus subsp. aureus N315
ugaugcauaagauuuugaa

SEQ ID NO: 4050944 - RNA, 16 nt, Staphylococcus aureus subsp. aureus N315
ugaugcgaaaccuuuc

SEQ ID NO: 4050945 - RNA, 19 nt, Staphylococcus aureus subsp. aureus N315
ugaugcgcuucuaacucac

SEQ ID NO: 4050946 - RNA, 15 nt, Staphylococcus aureus subsp. aureus N315
ugaugcuugaauguu

SEQ ID NO: 4050947 - RNA, 15 nt, Staphylococcus aureus subsp. aureus N315
ugauggauauucaau

SEQ ID NO: 4050948 - RNA, 12 nt, Staphylococcus aureus subsp. aureus N315
ugauguaauucu

SEQ ID NO: 4050949 - RNA, 15 nt, Staphylococcus aureus subsp. aureus N315
ugaugucauaugcac

SEQ ID NO: 4050950 - RNA, 13 nt, Staphylococcus aureus subsp. aureus N315
ugaugugaaaauu

SEQ ID NO: 4050951 - RNA, 14 nt, Staphylococcus aureus subsp. aureus N315
ugaugugaauguuu

SEQ ID NO: 4050952 - RNA, 13 nt, Staphylococcus aureus subsp. aureus N315
ugauguuaaaaaa

SEQ ID NO: 4050953 - RNA, 13 nt, Staphylococcus aureus subsp. aureus N315
ugauguuacaauc

SEQ ID NO: 4050954 - RNA, 20 nt, Staphylococcus aureus subsp. aureus N315
ugauguucaauauuuucaug

SEQ ID NO: 4050955 - RNA, 20 nt, Staphylococcus aureus subsp. aureus N315
ugauuaaaaaucaaagaggc

SEQ ID NO: 4050956 - RNA, 12 nt, Staphylococcus aureus subsp. aureus N315
ugauuaaaagug

SEQ ID NO: 4050957 - RNA, 17 nt, Staphylococcus aureus subsp. aureus N315
ugauuaaaguguuucaa

SEQ ID NO: 4050958 - RNA, 23 nt, Staphylococcus aureus subsp. aureus N315
ugauuaaaguguuucaacauauu

SEQ ID NO: 4050959 - RNA, 16 nt, Staphylococcus aureus subsp. aureus N315
ugauuaauuaaagauu

SEQ ID NO: 4050960 - RNA, 18 nt, Staphylococcus aureus subsp. aureus N315
ugauuaauuaaagauuaa

SEQ ID NO: 4050961 - RNA, 23 nt, Staphylococcus aureus subsp. aureus N315
ugauuaauuauugagaauauuua

SEQ ID NO: 4050962 - RNA, 14 nt, Staphylococcus aureus subsp. aureus N315
ugauuacauauacg

SEQ ID NO: 4050963 - RNA, 22 nt, Staphylococcus aureus subsp. aureus N315
ugauuacauucuauacuuuuaa

SEQ ID NO: 4050964 - RNA, 17 nt, Staphylococcus aureus subsp. aureus N315
ugauuaccuucucuuca

SEQ ID NO: 4050965 - RNA, 22 nt, Staphylococcus aureus subsp. aureus N315
ugauuacguugguuuaaaaauu

SEQ ID NO: 4050966 - RNA, 22 nt, Staphylococcus aureus subsp. aureus N315
ugauuagcgcaccaauuaucaa

SEQ ID NO: 4050967 - RNA, 23 nt, Staphylococcus aureus subsp. aureus N315
ugauuaguuucugacuuuuaaaa

SEQ ID NO: 4050968 - RNA, 13 nt, Staphylococcus aureus subsp. aureus N315
ugauuauaaauuc

SEQ ID NO: 4050969 - RNA, 15 nt, Staphylococcus aureus subsp. aureus N315
ugauuauaaauucua

SEQ ID NO: 4050970 - RNA, 17 nt, Staphylococcus aureus subsp. aureus N315
ugauuauaaugauuguc

SEQ ID NO: 4050971 - RNA, 15 nt, Staphylococcus aureus subsp. aureus N315
ugauuauauuuuucu

SEQ ID NO: 4050972 - RNA, 16 nt, Staphylococcus aureus subsp. aureus N315
ugauuauauuuuucuu

SEQ ID NO: 4050973 - RNA, 17 nt, Staphylococcus aureus subsp. aureus N315
ugauuauauuuuucuuc

SEQ ID NO: 4050974 - RNA, 13 nt, Staphylococcus aureus subsp. aureus N315
ugauuaucauaug

SEQ ID NO: 4050975 - RNA, 15 nt, Staphylococcus aureus subsp. aureus N315
ugauuauucuucauu

SEQ ID NO: 4050976 - RNA, 18 nt, Staphylococcus aureus subsp. aureus N315
ugauuauucuucauuuau

SEQ ID NO: 4050977 - RNA, 23 nt, Staphylococcus aureus subsp. aureus N315
ugauuauucuuugauuaaaucuu

SEQ ID NO: 4050978 - RNA, 12 nt, Staphylococcus aureus subsp. aureus N315
ugauucaaauaa

SEQ ID NO: 4050979 - RNA, 18 nt, Staphylococcus aureus subsp. aureus N315
ugauucauuacaaccauu

SEQ ID NO: 4050980 - RNA, 11 nt, Staphylococcus aureus subsp. aureus N315
ugauucccaaa

SEQ ID NO: 4050981 - RNA, 19 nt, Staphylococcus aureus subsp. aureus N315
ugauucgauaugaauaacc

SEQ ID NO: 4050982 - RNA, 14 nt, Staphylococcus aureus subsp. aureus N315
ugauucguauucaa

SEQ ID NO: 4050983 - RNA, 15 nt, Staphylococcus aureus subsp. aureus N315
ugauucguauucaaa

SEQ ID NO: 4050984 - RNA, 16 nt, Staphylococcus aureus subsp. aureus N315
ugauucuacagcacug

SEQ ID NO: 4050985 - RNA, 19 nt, Staphylococcus aureus subsp. aureus N315
ugauucuacagcacugaaa

SEQ ID NO: 4050986 - RNA, 14 nt, Staphylococcus aureus subsp. aureus N315
ugauucuagugaaa

SEQ ID NO: 4050987 - RNA, 21 nt, Staphylococcus aureus subsp. aureus N315
ugauucucuguagauaucaaa

SEQ ID NO: 4050988 - RNA, 12 nt, Staphylococcus aureus subsp. aureus N315
ugauugaacaau

SEQ ID NO: 4050989 - RNA, 18 nt, Staphylococcus aureus subsp. aureus N315
ugauugaacaauaauaug

SEQ ID NO: 4050990 - RNA, 17 nt, Staphylococcus aureus subsp. aureus N315
ugauugauaugguuaga

SEQ ID NO: 4050991 - RNA, 20 nt, Staphylococcus aureus subsp. aureus N315
ugauugauaugguuagagaa

SEQ ID NO: 4050992 - RNA, 17 nt, Staphylococcus aureus subsp. aureus N315
ugauugcaaaaaaacaa

SEQ ID NO: 4050993 - RNA, 22 nt, Staphylococcus aureus subsp. aureus N315
ugauugcaaaaaaacaaauauu

SEQ ID NO: 4050994 - RNA, 17 nt, Staphylococcus aureus subsp. aureus N315
ugauugcaaauuaucau

SEQ ID NO: 4050995 - RNA, 18 nt, Staphylococcus aureus subsp. aureus N315
ugauugcaaauuaucauu

SEQ ID NO: 4050996 - RNA, 21 nt, Staphylococcus aureus subsp. aureus N315
ugauugcauugauuucagcac

SEQ ID NO: 4050997 - RNA, 22 nt, Staphylococcus aureus subsp. aureus N315
ugauugcugcuguacaauuucg

SEQ ID NO: 4050998 - RNA, 16 nt, Staphylococcus aureus subsp. aureus N315
ugauuguaccaguaac

SEQ ID NO: 4050999 - RNA, 14 nt, Staphylococcus aureus subsp. aureus N315
ugauugucauauaa

SEQ ID NO: 4051000 - RNA, 17 nt, Staphylococcus aureus subsp. aureus N315
ugauuuaagauuuaaua

SEQ ID NO: 4051001 - RNA, 19 nt, Staphylococcus aureus subsp. aureus N315
ugauuuaagggucacaccc

SEQ ID NO: 4051002 - RNA, 15 nt, Staphylococcus aureus subsp. aureus N315
ugauuuaauugaaau

SEQ ID NO: 4051003 - RNA, 16 nt, Staphylococcus aureus subsp. aureus N315
ugauuuaauuuuuaau

SEQ ID NO: 4051004 - RNA, 14 nt, Staphylococcus aureus subsp. aureus N315
ugauuuacgugcau

SEQ ID NO: 4051005 - RNA, 21 nt, Staphylococcus aureus subsp. aureus N315
ugauuuacgugcauuguaaua

SEQ ID NO: 4051006 - RNA, 17 nt, Staphylococcus aureus subsp. aureus N315
ugauuuagcauacauua

SEQ ID NO: 4051007 - RNA, 19 nt, Staphylococcus aureus subsp. aureus N315
ugauuuagcauacauuaag

SEQ ID NO: 4051008 - RNA, 13 nt, Staphylococcus aureus subsp. aureus N315
ugauuuauaaaaa

SEQ ID NO: 4051009 - RNA, 21 nt, Staphylococcus aureus subsp. aureus N315
ugauuuauucuaaauauauuu

SEQ ID NO: 4051010 - RNA, 20 nt, Staphylococcus aureus subsp. aureus N315
ugauuuggguaauguuuuua

SEQ ID NO: 4051011 - RNA, 15 nt, Staphylococcus aureus subsp. aureus N315
ugauuuguuacuucu

SEQ ID NO: 4051012 - RNA, 19 nt, Staphylococcus aureus subsp. aureus N315
ugauuuguuacuucuaaua

SEQ ID NO: 4051013 - RNA, 23 nt, Staphylococcus aureus subsp. aureus N315
ugauuuguuacuucuaauaguaa

SEQ ID NO: 4051014 - RNA, 14 nt, Staphylococcus aureus subsp. aureus N315
ugauuuguuugauu

SEQ ID NO: 4051015 - RNA, 13 nt, Staphylococcus aureus subsp. aureus N315
ugauuuuaaucua

SEQ ID NO: 4051016 - RNA, 23 nt, Staphylococcus aureus subsp. aureus N315
ugauuuuaaucuauccuucaaaa

SEQ ID NO: 4051017 - RNA, 20 nt, Staphylococcus aureus subsp. aureus N315
ugauuuuaccuguuucuaua

SEQ ID NO: 4051018 - RNA, 18 nt, Staphylococcus aureus subsp. aureus N315
ugauuuuacuugaauaua

SEQ ID NO: 4051019 - RNA, 14 nt, Staphylococcus aureus subsp. aureus N315
ugauuuuaggcaau

SEQ ID NO: 4051020 - RNA, 17 nt, Staphylococcus aureus subsp. aureus N315
ugauuuuauaauauuau

SEQ ID NO: 4051021 - RNA, 21 nt, Staphylococcus aureus subsp. aureus N315
ugauuuuaucaaauucaucag

SEQ ID NO: 4051022 - RNA, 17 nt, Staphylococcus aureus subsp. aureus N315
ugauuuugaauaaaaaa

SEQ ID NO: 4051023 - RNA, 12 nt, Staphylococcus aureus subsp. aureus N315
ugauuuugcuuu

SEQ ID NO: 4051024 - RNA, 17 nt, Staphylococcus aureus subsp. aureus N315
ugauuuuggaacauauu

SEQ ID NO: 4051025 - RNA, 13 nt, Staphylococcus aureus subsp. aureus N315
ugauuuuguuuca

SEQ ID NO: 4051026 - RNA, 12 nt, Staphylococcus aureus subsp. aureus N315
ugauuuuuaaaa

SEQ ID NO: 4051027 - RNA, 15 nt, Staphylococcus aureus subsp. aureus N315
ugauuuuuaaaaaua

SEQ ID NO: 4051028 - RNA, 14 nt, Staphylococcus aureus subsp. aureus N315
ugauuuuuaauaau

SEQ ID NO: 4051029 - RNA, 16 nt, Staphylococcus aureus subsp. aureus N315
ugauuuuuaauaauuu

SEQ ID NO: 4051030 - RNA, 22 nt, Staphylococcus aureus subsp. aureus N315
ugauuuuuauuauugucaucau

SEQ ID NO: 4051031 - RNA, 12 nt, Staphylococcus aureus subsp. aureus N315
ugauuuuucaua

SEQ ID NO: 4051032 - RNA, 13 nt, Staphylococcus aureus subsp. aureus N315
ugauuuuuuauuc

SEQ ID NO: 4051033 - RNA, 15 nt, Staphylococcus aureus subsp. aureus N315
ugcaaaaaaacaaau

SEQ ID NO: 4051034 - RNA, 18 nt, Staphylococcus aureus subsp. aureus N315
ugcaaaaaaacaaauauu

SEQ ID NO: 4051035 - RNA, 19 nt, Staphylococcus aureus subsp. aureus N315
ugcaaaaaaacaaauauua

SEQ ID NO: 4051036 - RNA, 12 nt, Staphylococcus aureus subsp. aureus N315
ugcaaaaauaau

SEQ ID NO: 4051037 - RNA, 18 nt, Staphylococcus aureus subsp. aureus N315
ugcaaaacgcauuucaug

SEQ ID NO: 4051038 - RNA, 12 nt, Staphylococcus aureus subsp. aureus N315
ugcaaaaucaac

SEQ ID NO: 4051039 - RNA, 15 nt, Staphylococcus aureus subsp. aureus N315
ugcaaaauguuacac

SEQ ID NO: 4051040 - RNA, 13 nt, Staphylococcus aureus subsp. aureus N315
ugcaaaauuaaug

SEQ ID NO: 4051041 - RNA, 15 nt, Staphylococcus aureus subsp. aureus N315
ugcaaacacaguaca

SEQ ID NO: 4051042 - RNA, 19 nt, Staphylococcus aureus subsp. aureus N315
ugcaaacuugauucaauau

SEQ ID NO: 4051043 - RNA, 14 nt, Staphylococcus aureus subsp. aureus N315
ugcaaauaaaaaag

SEQ ID NO: 4051044 - RNA, 13 nt, Staphylococcus aureus subsp. aureus N315
ugcaaauacgagu

SEQ ID NO: 4051045 - RNA, 20 nt, Staphylococcus aureus subsp. aureus N315
ugcaaauacgaguguuuuaa

SEQ ID NO: 4051046 - RNA, 14 nt, Staphylococcus aureus subsp. aureus N315
ugcaaaugccucuu

SEQ ID NO: 4051047 - RNA, 20 nt, Staphylococcus aureus subsp. aureus N315
ugcaaauuaucauuaaauug

SEQ ID NO: 4051048 - RNA, 17 nt, Staphylococcus aureus subsp. aureus N315
ugcaacaauauaauaua

SEQ ID NO: 4051049 - RNA, 14 nt, Staphylococcus aureus subsp. aureus N315
ugcaacaauuugca

SEQ ID NO: 4051050 - RNA, 20 nt, Staphylococcus aureus subsp. aureus N315
ugcaacaccugguacauaaa

SEQ ID NO: 4051051 - RNA, 14 nt, Staphylococcus aureus subsp. aureus N315
ugcaacauuuugag

SEQ ID NO: 4051052 - RNA, 20 nt, Staphylococcus aureus subsp. aureus N315
ugcaacgaugcuacuuaaag

SEQ ID NO: 4051053 - RNA, 14 nt, Staphylococcus aureus subsp. aureus N315
ugcaacuuauaaua

SEQ ID NO: 4051054 - RNA, 16 nt, Staphylococcus aureus subsp. aureus N315
ugcaacuuauaauauu

SEQ ID NO: 4051055 - RNA, 19 nt, Staphylococcus aureus subsp. aureus N315
ugcaacuuauaauauuaaa

SEQ ID NO: 4051056 - RNA, 17 nt, Staphylococcus aureus subsp. aureus N315
ugcaacuugaucauuau

SEQ ID NO: 4051057 - RNA, 17 nt, Staphylococcus aureus subsp. aureus N315
ugcaaguaauuuaauug

SEQ ID NO: 4051058 - RNA, 12 nt, Staphylococcus aureus subsp. aureus N315
ugcaaguauuuu

SEQ ID NO: 4051059 - RNA, 19 nt, Staphylococcus aureus subsp. aureus N315
ugcaaguuggcggggcccc

SEQ ID NO: 4051060 - RNA, 19 nt, Staphylococcus aureus subsp. aureus N315
ugcaauaacaccaauugaa

SEQ ID NO: 4051061 - RNA, 21 nt, Staphylococcus aureus subsp. aureus N315
ugcaauaacaccaauugaaua

SEQ ID NO: 4051062 - RNA, 23 nt, Staphylococcus aureus subsp. aureus N315
ugcaauaacaccaauugaauauu

SEQ ID NO: 4051063 - RNA, 18 nt, Staphylococcus aureus subsp. aureus N315
ugcaauaauuacuaaccu

SEQ ID NO: 4051064 - RNA, 23 nt, Staphylococcus aureus subsp. aureus N315
ugcaauaccuccccaacuuaaua

SEQ ID NO: 4051065 - RNA, 16 nt, Staphylococcus aureus subsp. aureus N315
ugcaauagcuauaacu

SEQ ID NO: 4051066 - RNA, 13 nt, Staphylococcus aureus subsp. aureus N315
ugcaauauuauau

SEQ ID NO: 4051067 - RNA, 17 nt, Staphylococcus aureus subsp. aureus N315
ugcaaugaauaacaaga

SEQ ID NO: 4051068 - RNA, 15 nt, Staphylococcus aureus subsp. aureus N315
ugcaaugagcaucuu

SEQ ID NO: 4051069 - RNA, 22 nt, Staphylococcus aureus subsp. aureus N315
ugcaauuagaauauauguauaa

SEQ ID NO: 4051070 - RNA, 21 nt, Staphylococcus aureus subsp. aureus N315
ugcaauuauuucaauuaucaa

SEQ ID NO: 4051071 - RNA, 18 nt, Staphylococcus aureus subsp. aureus N315
ugcaauugccuuaucagc

SEQ ID NO: 4051072 - RNA, 17 nt, Staphylococcus aureus subsp. aureus N315
ugcaauuucauaguguu

SEQ ID NO: 4051073 - RNA, 18 nt, Staphylococcus aureus subsp. aureus N315
ugcaauuuguaauacaag

SEQ ID NO: 4051074 - RNA, 15 nt, Staphylococcus aureus subsp. aureus N315
ugcacaaauugcaau

SEQ ID NO: 4051075 - RNA, 15 nt, Staphylococcus aureus subsp. aureus N315
ugcacacauaccuca

SEQ ID NO: 4051076 - RNA, 22 nt, Staphylococcus aureus subsp. aureus N315
ugcacaccagccucuauaagua

SEQ ID NO: 4051077 - RNA, 17 nt, Staphylococcus aureus subsp. aureus N315
ugcacaguuucaucuuc

SEQ ID NO: 4051078 - RNA, 11 nt, Staphylococcus aureus subsp. aureus N315
ugcacaucaua

SEQ ID NO: 4051079 - RNA, 16 nt, Staphylococcus aureus subsp. aureus N315
ugcacaucauaauaaa

SEQ ID NO: 4051080 - RNA, 16 nt, Staphylococcus aureus subsp. aureus N315
ugcaccuauaauagcg

SEQ ID NO: 4051081 - RNA, 20 nt, Staphylococcus aureus subsp. aureus N315
ugcaccuggucguacuuuca

SEQ ID NO: 4051082 - RNA, 21 nt, Staphylococcus aureus subsp. aureus N315
ugcaccuggucguacuuucaa

SEQ ID NO: 4051083 - RNA, 15 nt, Staphylococcus aureus subsp. aureus N315
ugcacgagcaacauc

SEQ ID NO: 4051084 - RNA, 14 nt, Staphylococcus aureus subsp. aureus N315
ugcacgugagaaac

SEQ ID NO: 4051085 - RNA, 20 nt, Staphylococcus aureus subsp. aureus N315
ugcacuaauggcacuuaaua

SEQ ID NO: 4051086 - RNA, 19 nt, Staphylococcus aureus subsp. aureus N315
ugcacuaugcauaauacca

SEQ ID NO: 4051087 - RNA, 16 nt, Staphylococcus aureus subsp. aureus N315
ugcacugagcaacaaa

SEQ ID NO: 4051088 - RNA, 16 nt, Staphylococcus aureus subsp. aureus N315
ugcacugcuaauauua

SEQ ID NO: 4051089 - RNA, 23 nt, Staphylococcus aureus subsp. aureus N315
ugcacuugguucauaaugaucaa

SEQ ID NO: 4051090 - RNA, 13 nt, Staphylococcus aureus subsp. aureus N315
ugcacuuuauuaa

SEQ ID NO: 4051091 - RNA, 19 nt, Staphylococcus aureus subsp. aureus N315
ugcacuuuuuuuaaaucuu

SEQ ID NO: 4051092 - RNA, 23 nt, Staphylococcus aureus subsp. aureus N315
ugcagaagaaaacuauuuuaaaa

SEQ ID NO: 4051093 - RNA, 14 nt, Staphylococcus aureus subsp. aureus N315
ugcagagaauauag

SEQ ID NO: 4051094 - RNA, 18 nt, Staphylococcus aureus subsp. aureus N315
ugcagauaauugaaaauc

SEQ ID NO: 4051095 - RNA, 19 nt, Staphylococcus aureus subsp. aureus N315
ugcaggauaacguucacuu

SEQ ID NO: 4051096 - RNA, 19 nt, Staphylococcus aureus subsp. aureus N315
ugcaggcaucauaucauac

SEQ ID NO: 4051097 - RNA, 15 nt, Staphylococcus aureus subsp. aureus N315
ugcaguuaaauuaaa

SEQ ID NO: 4051098 - RNA, 22 nt, Staphylococcus aureus subsp. aureus N315
ugcauaauuaggauuaacauaa

SEQ ID NO: 4051099 - RNA, 13 nt, Staphylococcus aureus subsp. aureus N315
ugcauacauaucu

SEQ ID NO: 4051100 - RNA, 17 nt, Staphylococcus aureus subsp. aureus N315
ugcauacgaauuaaaau

SEQ ID NO: 4051101 - RNA, 19 nt, Staphylococcus aureus subsp. aureus N315
ugcauacgaauuaaaauaa

SEQ ID NO: 4051102 - RNA, 23 nt, Staphylococcus aureus subsp. aureus N315
ugcauagcgcucuggauuuuucu

SEQ ID NO: 4051103 - RNA, 23 nt, Staphylococcus aureus subsp. aureus N315
ugcauagguaaccuuaaauauag

SEQ ID NO: 4051104 - RNA, 16 nt, Staphylococcus aureus subsp. aureus N315
ugcauauaaagucaua

SEQ ID NO: 4051105 - RNA, 16 nt, Staphylococcus aureus subsp. aureus N315
ugcauauauugaggau

SEQ ID NO: 4051106 - RNA, 13 nt, Staphylococcus aureus subsp. aureus N315
ugcaucacagaua

SEQ ID NO: 4051107 - RNA, 16 nt, Staphylococcus aureus subsp. aureus N315
ugcaucagaccuauga

SEQ ID NO: 4051108 - RNA, 22 nt, Staphylococcus aureus subsp. aureus N315
ugcaucccgaaaguuagacuaa

SEQ ID NO: 4051109 - RNA, 13 nt, Staphylococcus aureus subsp. aureus N315
ugcaugacagcaa

SEQ ID NO: 4051110 - RNA, 20 nt, Staphylococcus aureus subsp. aureus N315
ugcaugacagcaaauuuucu

SEQ ID NO: 4051111 - RNA, 16 nt, Staphylococcus aureus subsp. aureus N315
ugcaugacgauaauga

SEQ ID NO: 4051112 - RNA, 17 nt, Staphylococcus aureus subsp. aureus N315
ugcaugacgauaaugaa

SEQ ID NO: 4051113 - RNA, 17 nt, Staphylococcus aureus subsp. aureus N315
ugcaugcuucucaauuu

SEQ ID NO: 4051114 - RNA, 18 nt, Staphylococcus aureus subsp. aureus N315
ugcauguaaaauuaaaug

SEQ ID NO: 4051115 - RNA, 12 nt, Staphylococcus aureus subsp. aureus N315
ugcauuaauuuc

SEQ ID NO: 4051116 - RNA, 14 nt, Staphylococcus aureus subsp. aureus N315
ugcauuacgcuguc

SEQ ID NO: 4051117 - RNA, 17 nt, Staphylococcus aureus subsp. aureus N315
ugcauuacuaucuucau

SEQ ID NO: 4051118 - RNA, 22 nt, Staphylococcus aureus subsp. aureus N315
ugcauugauuucagcaccgaca

SEQ ID NO: 4051119 - RNA, 23 nt, Staphylococcus aureus subsp. aureus N315
ugcauugcacuugucucaaauua

SEQ ID NO: 4051120 - RNA, 19 nt, Staphylococcus aureus subsp. aureus N315
ugcauuuagaugauucuua

SEQ ID NO: 4051121 - RNA, 21 nt, Staphylococcus aureus subsp. aureus N315
ugcauuuagaugauucuuauc

SEQ ID NO: 4051122 - RNA, 16 nt, Staphylococcus aureus subsp. aureus N315
ugccaaaaaguauuca

SEQ ID NO: 4051123 - RNA, 17 nt, Staphylococcus aureus subsp. aureus N315
ugccaaauauaguaauu

SEQ ID NO: 4051124 - RNA, 19 nt, Staphylococcus aureus subsp. aureus N315
ugccaacaaagcuuccaaa

SEQ ID NO: 4051125 - RNA, 20 nt, Staphylococcus aureus subsp. aureus N315
ugccaacaaagcuuccaaau

SEQ ID NO: 4051126 - RNA, 17 nt, Staphylococcus aureus subsp. aureus N315
ugccaauaaaaugcaau

SEQ ID NO: 4051127 - RNA, 15 nt, Staphylococcus aureus subsp. aureus N315
ugccacauucgagcu

SEQ ID NO: 4051128 - RNA, 18 nt, Staphylococcus aureus subsp. aureus N315
ugccauacccauauuaaa

SEQ ID NO: 4051129 - RNA, 11 nt, Staphylococcus aureus subsp. aureus N315
ugccauaccug

SEQ ID NO: 4051130 - RNA, 13 nt, Staphylococcus aureus subsp. aureus N315
ugccauauguuuu

SEQ ID NO: 4051131 - RNA, 13 nt, Staphylococcus aureus subsp. aureus N315
ugccaugcucuau

SEQ ID NO: 4051132 - RNA, 13 nt, Staphylococcus aureus subsp. aureus N315
ugccauucauuaa

SEQ ID NO: 4051133 - RNA, 17 nt, Staphylococcus aureus subsp. aureus N315
ugcccaccauguacauu

SEQ ID NO: 4051134 - RNA, 14 nt, Staphylococcus aureus subsp. aureus N315
ugcccgucuggcac

SEQ ID NO: 4051135 - RNA, 16 nt, Staphylococcus aureus subsp. aureus N315
ugcccgucuggcacau

SEQ ID NO: 4051136 - RNA, 15 nt, Staphylococcus aureus subsp. aureus N315
ugcccucauaaauca

SEQ ID NO: 4051137 - RNA, 19 nt, Staphylococcus aureus subsp. aureus N315
ugcccucauaaaucaugaa

SEQ ID NO: 4051138 - RNA, 16 nt, Staphylococcus aureus subsp. aureus N315
ugcccugcuguuuuau

SEQ ID NO: 4051139 - RNA, 12 nt, Staphylococcus aureus subsp. aureus N315
ugcccuuaaagc

SEQ ID NO: 4051140 - RNA, 20 nt, Staphylococcus aureus subsp. aureus N315
ugccgccuaauaauaaaaua

SEQ ID NO: 4051141 - RNA, 14 nt, Staphylococcus aureus subsp. aureus N315
ugccgcuucuacaa

SEQ ID NO: 4051142 - RNA, 14 nt, Staphylococcus aureus subsp. aureus N315
ugccggucauaaca

SEQ ID NO: 4051143 - RNA, 22 nt, Staphylococcus aureus subsp. aureus N315
ugccguaucuauaaaaagaaua

SEQ ID NO: 4051144 - RNA, 21 nt, Staphylococcus aureus subsp. aureus N315
ugccguauuucaaauguaauu

SEQ ID NO: 4051145 - RNA, 16 nt, Staphylococcus aureus subsp. aureus N315
ugccuagcauuacgcc

SEQ ID NO: 4051146 - RNA, 17 nt, Staphylococcus aureus subsp. aureus N315
ugccucaauaucuuuaa

SEQ ID NO: 4051147 - RNA, 20 nt, Staphylococcus aureus subsp. aureus N315
ugccucaguuagaagaugau

SEQ ID NO: 4051148 - RNA, 19 nt, Staphylococcus aureus subsp. aureus N315
ugccuggcaacguucuacu

SEQ ID NO: 4051149 - RNA, 17 nt, Staphylococcus aureus subsp. aureus N315
ugccuugucuauuguaa

SEQ ID NO: 4051150 - RNA, 16 nt, Staphylococcus aureus subsp. aureus N315
ugccuuuugaauaauu

SEQ ID NO: 4051151 - RNA, 22 nt, Staphylococcus aureus subsp. aureus N315
ugcgaaaccuuucgauaaacua

SEQ ID NO: 4051152 - RNA, 16 nt, Staphylococcus aureus subsp. aureus N315
ugcgaaagaaagaaac

SEQ ID NO: 4051153 - RNA, 22 nt, Staphylococcus aureus subsp. aureus N315
ugcgaacucguuauagauaagu

SEQ ID NO: 4051154 - RNA, 23 nt, Staphylococcus aureus subsp. aureus N315
ugcgaagaaaccuuuuuucucuu

SEQ ID NO: 4051155 - RNA, 14 nt, Staphylococcus aureus subsp. aureus N315
ugcgaauaauaaua

SEQ ID NO: 4051156 - RNA, 15 nt, Staphylococcus aureus subsp. aureus N315
ugcgaauuguuagau

SEQ ID NO: 4051157 - RNA, 14 nt, Staphylococcus aureus subsp. aureus N315
ugcgccuucuuuuu

SEQ ID NO: 4051158 - RNA, 19 nt, Staphylococcus aureus subsp. aureus N315
ugcggauuaucuaacucau

SEQ ID NO: 4051159 - RNA, 17 nt, Staphylococcus aureus subsp. aureus N315
ugcgguuuaaucuauau

SEQ ID NO: 4051160 - RNA, 21 nt, Staphylococcus aureus subsp. aureus N315
ugcguaagguauuucauugau

SEQ ID NO: 4051161 - RNA, 23 nt, Staphylococcus aureus subsp. aureus N315
ugcguggucuauuuuauaaaaua

SEQ ID NO: 4051162 - RNA, 13 nt, Staphylococcus aureus subsp. aureus N315
ugcguuaauaauu

SEQ ID NO: 4051163 - RNA, 13 nt, Staphylococcus aureus subsp. aureus N315
ugcguuuuuaaau

SEQ ID NO: 4051164 - RNA, 23 nt, Staphylococcus aureus subsp. aureus N315
ugcuaaaaaaauuaaaauguuaa

SEQ ID NO: 4051165 - RNA, 16 nt, Staphylococcus aureus subsp. aureus N315
ugcuaaaaaguuagca

SEQ ID NO: 4051166 - RNA, 13 nt, Staphylococcus aureus subsp. aureus N315
ugcuaaaaauauu

SEQ ID NO: 4051167 - RNA, 14 nt, Staphylococcus aureus subsp. aureus N315
ugcuaaaaauauug

SEQ ID NO: 4051168 - RNA, 20 nt, Staphylococcus aureus subsp. aureus N315
ugcuaaucuucucauaaaau

SEQ ID NO: 4051169 - RNA, 15 nt, Staphylococcus aureus subsp. aureus N315
ugcuaauuuauaaac

SEQ ID NO: 4051170 - RNA, 16 nt, Staphylococcus aureus subsp. aureus N315
ugcuaauuuuuucauc

SEQ ID NO: 4051171 - RNA, 13 nt, Staphylococcus aureus subsp. aureus N315
ugcuacaauuucc

SEQ ID NO: 4051172 - RNA, 14 nt, Staphylococcus aureus subsp. aureus N315
ugcuacaauuuccu

SEQ ID NO: 4051173 - RNA, 19 nt, Staphylococcus aureus subsp. aureus N315
ugcuagcuuucuuuuucau

SEQ ID NO: 4051174 - RNA, 16 nt, Staphylococcus aureus subsp. aureus N315
ugcuagucauaauuua

SEQ ID NO: 4051175 - RNA, 13 nt, Staphylococcus aureus subsp. aureus N315
ugcuagugcucuu

SEQ ID NO: 4051176 - RNA, 23 nt, Staphylococcus aureus subsp. aureus N315
ugcuauauuucgguauuuuaaau

SEQ ID NO: 4051177 - RNA, 18 nt, Staphylococcus aureus subsp. aureus N315
ugcuauccuugcuaucaa

SEQ ID NO: 4051178 - RNA, 14 nt, Staphylococcus aureus subsp. aureus N315
ugcuauguauuuuu

SEQ ID NO: 4051179 - RNA, 19 nt, Staphylococcus aureus subsp. aureus N315
ugcuauuucaacaaacaua

SEQ ID NO: 4051180 - RNA, 17 nt, Staphylococcus aureus subsp. aureus N315
ugcuauuuuggauaaua

SEQ ID NO: 4051181 - RNA, 21 nt, Staphylococcus aureus subsp. aureus N315
ugcucaaaaaugcuuauauaa

SEQ ID NO: 4051182 - RNA, 17 nt, Staphylococcus aureus subsp. aureus N315
ugcucaugagcacaaac

SEQ ID NO: 4051183 - RNA, 14 nt, Staphylococcus aureus subsp. aureus N315
ugcucauugcauuu

SEQ ID NO: 4051184 - RNA, 18 nt, Staphylococcus aureus subsp. aureus N315
ugcucgauauaugucuca

SEQ ID NO: 4051185 - RNA, 22 nt, Staphylococcus aureus subsp. aureus N315
ugcucuaaacuucuauuaauaa

SEQ ID NO: 4051186 - RNA, 17 nt, Staphylococcus aureus subsp. aureus N315
ugcucuaagcauucagu

SEQ ID NO: 4051187 - RNA, 20 nt, Staphylococcus aureus subsp. aureus N315
ugcucuauuuacggcauaau

SEQ ID NO: 4051188 - RNA, 23 nt, Staphylococcus aureus subsp. aureus N315
ugcugccggugcagauaauugaa

SEQ ID NO: 4051189 - RNA, 14 nt, Staphylococcus aureus subsp. aureus N315
ugcugcuaauugau

SEQ ID NO: 4051190 - RNA, 13 nt, Staphylococcus aureus subsp. aureus N315
ugcugguugcuuc

SEQ ID NO: 4051191 - RNA, 18 nt, Staphylococcus aureus subsp. aureus N315
ugcugguugcuucuuauc

SEQ ID NO: 4051192 - RNA, 13 nt, Staphylococcus aureus subsp. aureus N315
ugcuguuacuucu

SEQ ID NO: 4051193 - RNA, 14 nt, Staphylococcus aureus subsp. aureus N315
ugcuguuacuucuc

SEQ ID NO: 4051194 - RNA, 22 nt, Staphylococcus aureus subsp. aureus N315
ugcuguugaagaagguaauaaa

SEQ ID NO: 4051195 - RNA, 19 nt, Staphylococcus aureus subsp. aureus N315
ugcuguugcaauaaaauca

SEQ ID NO: 4051196 - RNA, 15 nt, Staphylococcus aureus subsp. aureus N315
ugcuguuuuauucaa

SEQ ID NO: 4051197 - RNA, 16 nt, Staphylococcus aureus subsp. aureus N315
ugcuguuuuauucaau

SEQ ID NO: 4051198 - RNA, 13 nt, Staphylococcus aureus subsp. aureus N315
ugcuguuuuuauu

SEQ ID NO: 4051199 - RNA, 14 nt, Staphylococcus aureus subsp. aureus N315
ugcuguuuuuauua

SEQ ID NO: 4051200 - RNA, 18 nt, Staphylococcus aureus subsp. aureus N315
ugcuuaauuuguuuuaaa

SEQ ID NO: 4051201 - RNA, 12 nt, Staphylococcus aureus subsp. aureus N315
ugcuuacaauaa

SEQ ID NO: 4051202 - RNA, 18 nt, Staphylococcus aureus subsp. aureus N315
ugcuuaguacacguguau

SEQ ID NO: 4051203 - RNA, 15 nt, Staphylococcus aureus subsp. aureus N315
ugcuuaucaacagcu

SEQ ID NO: 4051204 - RNA, 13 nt, Staphylococcus aureus subsp. aureus N315
ugcuuaucuguaa

SEQ ID NO: 4051205 - RNA, 19 nt, Staphylococcus aureus subsp. aureus N315
ugcuucaaaaauuaaucac

SEQ ID NO: 4051206 - RNA, 12 nt, Staphylococcus aureus subsp. aureus N315
ugcuucaacuac

SEQ ID NO: 4051207 - RNA, 16 nt, Staphylococcus aureus subsp. aureus N315
ugcuucacuguuuuau

SEQ ID NO: 4051208 - RNA, 17 nt, Staphylococcus aureus subsp. aureus N315
ugcuucauuauauaauu

SEQ ID NO: 4051209 - RNA, 22 nt, Staphylococcus aureus subsp. aureus N315
ugcuuccuuuuuguuauaucua

SEQ ID NO: 4051210 - RNA, 15 nt, Staphylococcus aureus subsp. aureus N315
ugcuucgaauuuaac

SEQ ID NO: 4051211 - RNA, 17 nt, Staphylococcus aureus subsp. aureus N315
ugcuucgcacaacugca

SEQ ID NO: 4051212 - RNA, 17 nt, Staphylococcus aureus subsp. aureus N315
ugcuucgcaucacugca

SEQ ID NO: 4051213 - RNA, 15 nt, Staphylococcus aureus subsp. aureus N315
ugcuucgcuaauauc

SEQ ID NO: 4051214 - RNA, 21 nt, Staphylococcus aureus subsp. aureus N315
ugcuucguuuuuaguguuaau

SEQ ID NO: 4051215 - RNA, 24 nt, Staphylococcus aureus subsp. aureus N315
ugcuucuacccuugcaaauauauc

SEQ ID NO: 4051216 - RNA, 21 nt, Staphylococcus aureus subsp. aureus N315
ugcuucuucagguguuuuacc

SEQ ID NO: 4051217 - RNA, 14 nt, Staphylococcus aureus subsp. aureus N315
ugcuucuuuccucu

SEQ ID NO: 4051218 - RNA, 16 nt, Staphylococcus aureus subsp. aureus N315
ugcuuggauaauugca

SEQ ID NO: 4051219 - RNA, 20 nt, Staphylococcus aureus subsp. aureus N315
ugcuuggauaauugcauuac

SEQ ID NO: 4051220 - RNA, 17 nt, Staphylococcus aureus subsp. aureus N315
ugcuuguccucuaaaac

SEQ ID NO: 4051221 - RNA, 12 nt, Staphylococcus aureus subsp. aureus N315
ugcuuuaauaaa

SEQ ID NO: 4051222 - RNA, 22 nt, Staphylococcus aureus subsp. aureus N315
ugcuuuagagauuguaagaauu

SEQ ID NO: 4051223 - RNA, 15 nt, Staphylococcus aureus subsp. aureus N315
ugcuuuauuuuauca

SEQ ID NO: 4051224 - RNA, 12 nt, Staphylococcus aureus subsp. aureus N315
ugcuuuccaaau

SEQ ID NO: 4051225 - RNA, 19 nt, Staphylococcus aureus subsp. aureus N315
ugcuuugcauacauaucuu

SEQ ID NO: 4051226 - RNA, 14 nt, Staphylococcus aureus subsp. aureus N315
ugcuuugguggcuu

SEQ ID NO: 4051227 - RNA, 22 nt, Staphylococcus aureus subsp. aureus N315
ugcuuuuaaauguauuuuuacu

SEQ ID NO: 4051228 - RNA, 15 nt, Staphylococcus aureus subsp. aureus N315
ugcuuuuaauauuau

SEQ ID NO: 4051229 - RNA, 14 nt, Staphylococcus aureus subsp. aureus N315
ugcuuuuccaguau

SEQ ID NO: 4051230 - RNA, 22 nt, Staphylococcus aureus subsp. aureus N315
ugcuuuuccauaaauauuuaaa

SEQ ID NO: 4051231 - RNA, 17 nt, Staphylococcus aureus subsp. aureus N315
ugcuuuuucaaaaucuu

SEQ ID NO: 4051232 - RNA, 22 nt, Staphylococcus aureus subsp. aureus N315
ugcuuuuuuauucuaauacaaa

SEQ ID NO: 4051233 - RNA, 19 nt, Staphylococcus aureus subsp. aureus N315
ugcuuuuuuuauaaguauu

SEQ ID NO: 4051234 - RNA, 18 nt, Staphylococcus aureus subsp. aureus N315
uggaaaauuacaauaagg

SEQ ID NO: 4051235 - RNA, 20 nt, Staphylococcus aureus subsp. aureus N315
uggaaagaugggauuucacu

SEQ ID NO: 4051236 - RNA, 16 nt, Staphylococcus aureus subsp. aureus N315
uggaaaguaauaagua

SEQ ID NO: 4051237 - RNA, 19 nt, Staphylococcus aureus subsp. aureus N315
uggaaaguugguuuuauua

SEQ ID NO: 4051238 - RNA, 13 nt, Staphylococcus aureus subsp. aureus N315
uggaaauuuauua

SEQ ID NO: 4051239 - RNA, 15 nt, Staphylococcus aureus subsp. aureus N315
uggaaauuuauuaua

SEQ ID NO: 4051240 - RNA, 23 nt, Staphylococcus aureus subsp. aureus N315
uggaaauuuauuauaaaauagaa

SEQ ID NO: 4051241 - RNA, 17 nt, Staphylococcus aureus subsp. aureus N315
uggaaguguuuuaaguu

SEQ ID NO: 4051242 - RNA, 23 nt, Staphylococcus aureus subsp. aureus N315
uggaauacucuucaaucuaccaa

SEQ ID NO: 4051243 - RNA, 22 nt, Staphylococcus aureus subsp. aureus N315
uggaaugauacgccuaaauauu

SEQ ID NO: 4051244 - RNA, 21 nt, Staphylococcus aureus subsp. aureus N315
uggaauuggcauccaggcaac

SEQ ID NO: 4051245 - RNA, 14 nt, Staphylococcus aureus subsp. aureus N315
uggaauuucauaua

SEQ ID NO: 4051246 - RNA, 22 nt, Staphylococcus aureus subsp. aureus N315
uggacaaucuuaucauaaucuu

SEQ ID NO: 4051247 - RNA, 15 nt, Staphylococcus aureus subsp. aureus N315
uggacagcuacaauu

SEQ ID NO: 4051248 - RNA, 23 nt, Staphylococcus aureus subsp. aureus N315
uggacagcuacaauuuucucauu

SEQ ID NO: 4051249 - RNA, 21 nt, Staphylococcus aureus subsp. aureus N315
uggacauauacucuaaaaaag

SEQ ID NO: 4051250 - RNA, 19 nt, Staphylococcus aureus subsp. aureus N315
uggacauuguaaaaugcuc

SEQ ID NO: 4051251 - RNA, 20 nt, Staphylococcus aureus subsp. aureus N315
uggaccucuugaaaaaguuu

SEQ ID NO: 4051252 - RNA, 19 nt, Staphylococcus aureus subsp. aureus N315
uggacgcggguucaaaucc

SEQ ID NO: 4051253 - RNA, 16 nt, Staphylococcus aureus subsp. aureus N315
uggacugaugcauuca

SEQ ID NO: 4051254 - RNA, 17 nt, Staphylococcus aureus subsp. aureus N315
uggacuucuaucuucac

SEQ ID NO: 4051255 - RNA, 19 nt, Staphylococcus aureus subsp. aureus N315
uggagccccuuguucuccg

SEQ ID NO: 4051256 - RNA, 16 nt, Staphylococcus aureus subsp. aureus N315
uggagcguaaaguuuu

SEQ ID NO: 4051257 - RNA, 17 nt, Staphylococcus aureus subsp. aureus N315
uggaguauaucagcuug

SEQ ID NO: 4051258 - RNA, 17 nt, Staphylococcus aureus subsp. aureus N315
uggauaaaaugauaucu

SEQ ID NO: 4051259 - RNA, 13 nt, Staphylococcus aureus subsp. aureus N315
uggauaauugcau

SEQ ID NO: 4051260 - RNA, 14 nt, Staphylococcus aureus subsp. aureus N315
uggauacaaaccua

SEQ ID NO: 4051261 - RNA, 18 nt, Staphylococcus aureus subsp. aureus N315
uggaugucaugucuagau

SEQ ID NO: 4051262 - RNA, 14 nt, Staphylococcus aureus subsp. aureus N315
uggauguguuuuaa

SEQ ID NO: 4051263 - RNA, 20 nt, Staphylococcus aureus subsp. aureus N315
uggauguguuuuaauaauau

SEQ ID NO: 4051264 - RNA, 17 nt, Staphylococcus aureus subsp. aureus N315
uggauuaccguuaaaaa

SEQ ID NO: 4051265 - RNA, 17 nt, Staphylococcus aureus subsp. aureus N315
uggauucaaaugacauu

SEQ ID NO: 4051266 - RNA, 22 nt, Staphylococcus aureus subsp. aureus N315
uggauucaaaugacauuuuaaa

SEQ ID NO: 4051267 - RNA, 22 nt, Staphylococcus aureus subsp. aureus N315
uggauugccccuaauuuauaaa

SEQ ID NO: 4051268 - RNA, 14 nt, Staphylococcus aureus subsp. aureus N315
uggauuucuuuuua

SEQ ID NO: 4051269 - RNA, 16 nt, Staphylococcus aureus subsp. aureus N315
uggauuucuuuuuaaa

SEQ ID NO: 4051270 - RNA, 14 nt, Staphylococcus aureus subsp. aureus N315
uggauuuuaacaag

SEQ ID NO: 4051271 - RNA, 15 nt, Staphylococcus aureus subsp. aureus N315
uggauuuuaauuauu

SEQ ID NO: 4051272 - RNA, 13 nt, Staphylococcus aureus subsp. aureus N315
uggauuuuucuua

SEQ ID NO: 4051273 - RNA, 13 nt, Staphylococcus aureus subsp. aureus N315
uggauuuuuuggu

SEQ ID NO: 4051274 - RNA, 14 nt, Staphylococcus aureus subsp. aureus N315
uggcaaagaauccu

SEQ ID NO: 4051275 - RNA, 14 nt, Staphylococcus aureus subsp. aureus N315
uggcaaauaugagu

SEQ ID NO: 4051276 - RNA, 14 nt, Staphylococcus aureus subsp. aureus N315
uggcaaaucaaaca

SEQ ID NO: 4051277 - RNA, 16 nt, Staphylococcus aureus subsp. aureus N315
uggcacauaaaucaau

SEQ ID NO: 4051278 - RNA, 16 nt, Staphylococcus aureus subsp. aureus N315
uggcauaaccuguaau

SEQ ID NO: 4051279 - RNA, 19 nt, Staphylococcus aureus subsp. aureus N315
uggcauaucgauaaaugua

SEQ ID NO: 4051280 - RNA, 23 nt, Staphylococcus aureus subsp. aureus N315
uggcauaucgauaaauguauuaa

SEQ ID NO: 4051281 - RNA, 19 nt, Staphylococcus aureus subsp. aureus N315
uggcauuuacgaaguuuaa

SEQ ID NO: 4051282 - RNA, 23 nt, Staphylococcus aureus subsp. aureus N315
uggccaaacaaccugugauaaaa

SEQ ID NO: 4051283 - RNA, 18 nt, Staphylococcus aureus subsp. aureus N315
uggccacuaaugcauaau

SEQ ID NO: 4051284 - RNA, 21 nt, Staphylococcus aureus subsp. aureus N315
uggcgaauagcgauuuuaaag

SEQ ID NO: 4051285 - RNA, 18 nt, Staphylococcus aureus subsp. aureus N315
uggcgauuccaaucuauu

SEQ ID NO: 4051286 - RNA, 22 nt, Staphylococcus aureus subsp. aureus N315
uggcgcaaugauaucuuuucca

SEQ ID NO: 4051287 - RNA, 18 nt, Staphylococcus aureus subsp. aureus N315
uggcuacuugaauaccuu

SEQ ID NO: 4051288 - RNA, 22 nt, Staphylococcus aureus subsp. aureus N315
uggcuagucuuuaacuuuaauu

SEQ ID NO: 4051289 - RNA, 15 nt, Staphylococcus aureus subsp. aureus N315
uggcucuuuuuauuu

SEQ ID NO: 4051290 - RNA, 14 nt, Staphylococcus aureus subsp. aureus N315
uggcuuacugucac

SEQ ID NO: 4051291 - RNA, 21 nt, Staphylococcus aureus subsp. aureus N315
uggcuuagguuuaauuuuaaa

SEQ ID NO: 4051292 - RNA, 21 nt, Staphylococcus aureus subsp. aureus N315
uggcuuuuuaauuguuuaaua

SEQ ID NO: 4051293 - RNA, 21 nt, Staphylococcus aureus subsp. aureus N315
uggcuuuuuauaccaauaauu

SEQ ID NO: 4051294 - RNA, 13 nt, Staphylococcus aureus subsp. aureus N315
uggcuuuuuuaau

SEQ ID NO: 4051295 - RNA, 14 nt, Staphylococcus aureus subsp. aureus N315
uggcuuuuuuauuu

SEQ ID NO: 4051296 - RNA, 18 nt, Staphylococcus aureus subsp. aureus N315
uggcuuuuuuauuuuaua

SEQ ID NO: 4051297 - RNA, 17 nt, Staphylococcus aureus subsp. aureus N315
ugggaauuguauuagca

SEQ ID NO: 4051298 - RNA, 23 nt, Staphylococcus aureus subsp. aureus N315
ugggcauuuugacgccagaauaa

SEQ ID NO: 4051299 - RNA, 14 nt, Staphylococcus aureus subsp. aureus N315
ugggcguucugcua

SEQ ID NO: 4051300 - RNA, 18 nt, Staphylococcus aureus subsp. aureus N315
uggggaugggccccaaca

SEQ ID NO: 4051301 - RNA, 22 nt, Staphylococcus aureus subsp. aureus N315
uggggaugggccccaacaaaga

SEQ ID NO: 4051302 - RNA, 17 nt, Staphylococcus aureus subsp. aureus N315
uggggcccacaccccaa

SEQ ID NO: 4051303 - RNA, 18 nt, Staphylococcus aureus subsp. aureus N315
ugggggauuuuuuuaugu

SEQ ID NO: 4051304 - RNA, 15 nt, Staphylococcus aureus subsp. aureus N315
uggguaauguuuuua

SEQ ID NO: 4051305 - RNA, 18 nt, Staphylococcus aureus subsp. aureus N315
ugguaaaaaaauaacguu

SEQ ID NO: 4051306 - RNA, 16 nt, Staphylococcus aureus subsp. aureus N315
ugguaaaaaugaacca

SEQ ID NO: 4051307 - RNA, 17 nt, Staphylococcus aureus subsp. aureus N315
ugguaaaucaugacaua

SEQ ID NO: 4051308 - RNA, 20 nt, Staphylococcus aureus subsp. aureus N315
ugguaacucuucaguacgaa

SEQ ID NO: 4051309 - RNA, 19 nt, Staphylococcus aureus subsp. aureus N315
ugguaaguauaauuaaacu

SEQ ID NO: 4051310 - RNA, 19 nt, Staphylococcus aureus subsp. aureus N315
ugguacuacuauccagucc

SEQ ID NO: 4051311 - RNA, 13 nt, Staphylococcus aureus subsp. aureus N315
ugguagcauuuua

SEQ ID NO: 4051312 - RNA, 16 nt, Staphylococcus aureus subsp. aureus N315
ugguagcauuuuagau

SEQ ID NO: 4051313 - RNA, 17 nt, Staphylococcus aureus subsp. aureus N315
ugguauaucgaaaggua

SEQ ID NO: 4051314 - RNA, 13 nt, Staphylococcus aureus subsp. aureus N315
ugguauuaauuac

SEQ ID NO: 4051315 - RNA, 14 nt, Staphylococcus aureus subsp. aureus N315
ugguauuuuuuaaa

SEQ ID NO: 4051316 - RNA, 15 nt, Staphylococcus aureus subsp. aureus N315
ugguauuuuuuaaau

SEQ ID NO: 4051317 - RNA, 16 nt, Staphylococcus aureus subsp. aureus N315
uggucauguguugcaa

SEQ ID NO: 4051318 - RNA, 17 nt, Staphylococcus aureus subsp. aureus N315
uggucauguguugcaau

SEQ ID NO: 4051319 - RNA, 18 nt, Staphylococcus aureus subsp. aureus N315
uggucuaaagcuuauuaa

SEQ ID NO: 4051320 - RNA, 14 nt, Staphylococcus aureus subsp. aureus N315
uggucuauuuuaua

SEQ ID NO: 4051321 - RNA, 24 nt, Staphylococcus aureus subsp. aureus N315
uggugaguguuucauaaucucuuu

SEQ ID NO: 4051322 - RNA, 15 nt, Staphylococcus aureus subsp. aureus N315
uggugcccaaguuuc

SEQ ID NO: 4051323 - RNA, 15 nt, Staphylococcus aureus subsp. aureus N315
ugguggaugucaugu

SEQ ID NO: 4051324 - RNA, 20 nt, Staphylococcus aureus subsp. aureus N315
uggugugccggcuuuuucuu

SEQ ID NO: 4051325 - RNA, 16 nt, Staphylococcus aureus subsp. aureus N315
ugguuaaaguuaaugc

SEQ ID NO: 4051326 - RNA, 18 nt, Staphylococcus aureus subsp. aureus N315
ugguuagagaaaaaucug

SEQ ID NO: 4051327 - RNA, 17 nt, Staphylococcus aureus subsp. aureus N315
ugguuauuaaaauuaaa

SEQ ID NO: 4051328 - RNA, 16 nt, Staphylococcus aureus subsp. aureus N315
ugguucaaaaaucaua

SEQ ID NO: 4051329 - RNA, 20 nt, Staphylococcus aureus subsp. aureus N315
ugguucauaaugaucaagua

SEQ ID NO: 4051330 - RNA, 16 nt, Staphylococcus aureus subsp. aureus N315
ugguucaucaaacaac

SEQ ID NO: 4051331 - RNA, 17 nt, Staphylococcus aureus subsp. aureus N315
ugguucaucaaacaaca

SEQ ID NO: 4051332 - RNA, 11 nt, Staphylococcus aureus subsp. aureus N315
ugguucccaau

SEQ ID NO: 4051333 - RNA, 19 nt, Staphylococcus aureus subsp. aureus N315
ugguucugacauuucugac

SEQ ID NO: 4051334 - RNA, 14 nt, Staphylococcus aureus subsp. aureus N315
ugguugaaauuaau

SEQ ID NO: 4051335 - RNA, 22 nt, Staphylococcus aureus subsp. aureus N315
ugguuguuuaucacuuuucaug

SEQ ID NO: 4051336 - RNA, 15 nt, Staphylococcus aureus subsp. aureus N315
ugguuuaaugagcuu

SEQ ID NO: 4051337 - RNA, 20 nt, Staphylococcus aureus subsp. aureus N315
ugguuuaaugagcuuuucua

SEQ ID NO: 4051338 - RNA, 19 nt, Staphylococcus aureus subsp. aureus N315
ugguuuaccuaguuuuacu

SEQ ID NO: 4051339 - RNA, 19 nt, Staphylococcus aureus subsp. aureus N315
ugguuuaucagcuuuaaua

SEQ ID NO: 4051340 - RNA, 18 nt, Staphylococcus aureus subsp. aureus N315
ugguuucauaaacugaau

SEQ ID NO: 4051341 - RNA, 14 nt, Staphylococcus aureus subsp. aureus N315
ugguuucaucauau

SEQ ID NO: 4051342 - RNA, 20 nt, Staphylococcus aureus subsp. aureus N315
ugguuugugauuuuuugaua

SEQ ID NO: 4051343 - RNA, 23 nt, Staphylococcus aureus subsp. aureus N315
ugguuuuauuugauuauucuuca

SEQ ID NO: 4051344 - RNA, 12 nt, Staphylococcus aureus subsp. aureus N315
ugguuuuuaauu

SEQ ID NO: 4051345 - RNA, 16 nt, Staphylococcus aureus subsp. aureus N315
uguaaaaacguucaau

SEQ ID NO: 4051346 - RNA, 15 nt, Staphylococcus aureus subsp. aureus N315
uguaaaaccauagau

SEQ ID NO: 4051347 - RNA, 21 nt, Staphylococcus aureus subsp. aureus N315
uguaaaaccuuacccaaaaaa

SEQ ID NO: 4051348 - RNA, 22 nt, Staphylococcus aureus subsp. aureus N315
uguaaaaccuuacccaaaaaau

SEQ ID NO: 4051349 - RNA, 14 nt, Staphylococcus aureus subsp. aureus N315
uguaaaauuaaaug

SEQ ID NO: 4051350 - RNA, 15 nt, Staphylococcus aureus subsp. aureus N315
uguaaaauuaaaugc

SEQ ID NO: 4051351 - RNA, 18 nt, Staphylococcus aureus subsp. aureus N315
uguaaacaguauguagcu

SEQ ID NO: 4051352 - RNA, 19 nt, Staphylococcus aureus subsp. aureus N315
uguaaacaugguuuucuuu

SEQ ID NO: 4051353 - RNA, 18 nt, Staphylococcus aureus subsp. aureus N315
uguaaacuucuuuucuuu

SEQ ID NO: 4051354 - RNA, 17 nt, Staphylococcus aureus subsp. aureus N315
uguaaagccaccuaaau

SEQ ID NO: 4051355 - RNA, 22 nt, Staphylococcus aureus subsp. aureus N315
uguaaagcuuuaguuaaauagu

SEQ ID NO: 4051356 - RNA, 15 nt, Staphylococcus aureus subsp. aureus N315
uguaaaguugauaau

SEQ ID NO: 4051357 - RNA, 14 nt, Staphylococcus aureus subsp. aureus N315
uguaaauaaaaauu

SEQ ID NO: 4051358 - RNA, 21 nt, Staphylococcus aureus subsp. aureus N315
uguaaauaaaaauuauauaaa

SEQ ID NO: 4051359 - RNA, 16 nt, Staphylococcus aureus subsp. aureus N315
uguaaauaguuaguuu

SEQ ID NO: 4051360 - RNA, 15 nt, Staphylococcus aureus subsp. aureus N315
uguaaauauaaauau

SEQ ID NO: 4051361 - RNA, 16 nt, Staphylococcus aureus subsp. aureus N315
uguaaauauaaauaug

SEQ ID NO: 4051362 - RNA, 19 nt, Staphylococcus aureus subsp. aureus N315
uguaaauauaguaauaaaa

SEQ ID NO: 4051363 - RNA, 17 nt, Staphylococcus aureus subsp. aureus N315
uguaaaucacgauuuuc

SEQ ID NO: 4051364 - RNA, 23 nt, Staphylococcus aureus subsp. aureus N315
uguaaaugaaaguaccuaaaaua

SEQ ID NO: 4051365 - RNA, 13 nt, Staphylococcus aureus subsp. aureus N315
uguaaaugaaaua

SEQ ID NO: 4051366 - RNA, 18 nt, Staphylococcus aureus subsp. aureus N315
uguaaaugaauuuugacg

SEQ ID NO: 4051367 - RNA, 21 nt, Staphylococcus aureus subsp. aureus N315
uguaaauuacaaaaguaugau

SEQ ID NO: 4051368 - RNA, 17 nt, Staphylococcus aureus subsp. aureus N315
uguaaauuuuuaagaag

SEQ ID NO: 4051369 - RNA, 13 nt, Staphylococcus aureus subsp. aureus N315
uguaacaaagucu

SEQ ID NO: 4051370 - RNA, 15 nt, Staphylococcus aureus subsp. aureus N315
uguaacacgcucuuu

SEQ ID NO: 4051371 - RNA, 20 nt, Staphylococcus aureus subsp. aureus N315
uguaacacgcucuuuucaaa

SEQ ID NO: 4051372 - RNA, 22 nt, Staphylococcus aureus subsp. aureus N315
uguaacauaaagcuguuuauug

SEQ ID NO: 4051373 - RNA, 21 nt, Staphylococcus aureus subsp. aureus N315
uguaacgugaggcccauaaau

SEQ ID NO: 4051374 - RNA, 18 nt, Staphylococcus aureus subsp. aureus N315
uguaacucaauaugaaac

SEQ ID NO: 4051375 - RNA, 21 nt, Staphylococcus aureus subsp. aureus N315
uguaacuuuagacauaaaaaa

SEQ ID NO: 4051376 - RNA, 15 nt, Staphylococcus aureus subsp. aureus N315
uguaagacaacaaau

SEQ ID NO: 4051377 - RNA, 19 nt, Staphylococcus aureus subsp. aureus N315
uguaagcuaucguaaacaa

SEQ ID NO: 4051378 - RNA, 21 nt, Staphylococcus aureus subsp. aureus N315
uguaagucgaaaguacccaga

SEQ ID NO: 4051379 - RNA, 20 nt, Staphylococcus aureus subsp. aureus N315
uguaagucgcucuagacauu

SEQ ID NO: 4051380 - RNA, 22 nt, Staphylococcus aureus subsp. aureus N315
uguaauaauaucaccuuuuuua

SEQ ID NO: 4051381 - RNA, 22 nt, Staphylococcus aureus subsp. aureus N315
uguaauaauugcauguaaaauu

SEQ ID NO: 4051382 - RNA, 22 nt, Staphylococcus aureus subsp. aureus N315
uguaauaccuuuacuuucauua

SEQ ID NO: 4051383 - RNA, 19 nt, Staphylococcus aureus subsp. aureus N315
uguaauauaacaaguauaa

SEQ ID NO: 4051384 - RNA, 15 nt, Staphylococcus aureus subsp. aureus N315
uguaauaugaaggcu

SEQ ID NO: 4051385 - RNA, 13 nt, Staphylococcus aureus subsp. aureus N315
uguaaucaauccu

SEQ ID NO: 4051386 - RNA, 23 nt, Staphylococcus aureus subsp. aureus N315
uguaaucacuaucuguuguuaua

SEQ ID NO: 4051387 - RNA, 22 nt, Staphylococcus aureus subsp. aureus N315
uguaaucauugguuucaucaua

SEQ ID NO: 4051388 - RNA, 22 nt, Staphylococcus aureus subsp. aureus N315
uguaaugaguaggcucuuaaug

SEQ ID NO: 4051389 - RNA, 21 nt, Staphylococcus aureus subsp. aureus N315
uguaaugcuuaaaaacaauau

SEQ ID NO: 4051390 - RNA, 17 nt, Staphylococcus aureus subsp. aureus N315
uguaauuccucuggaac

SEQ ID NO: 4051391 - RNA, 15 nt, Staphylococcus aureus subsp. aureus N315
uguaauugaaaugau

SEQ ID NO: 4051392 - RNA, 20 nt, Staphylococcus aureus subsp. aureus N315
uguaauuguuuuuucuuauu

SEQ ID NO: 4051393 - RNA, 12 nt, Staphylococcus aureus subsp. aureus N315
uguaauuuaaaa

SEQ ID NO: 4051394 - RNA, 22 nt, Staphylococcus aureus subsp. aureus N315
uguaauuuaaaauaguucuuua

SEQ ID NO: 4051395 - RNA, 23 nt, Staphylococcus aureus subsp. aureus N315
uguaauuuucacuuucaaugaca

SEQ ID NO: 4051396 - RNA, 14 nt, Staphylococcus aureus subsp. aureus N315
uguacaauuuuuaa

SEQ ID NO: 4051397 - RNA, 16 nt, Staphylococcus aureus subsp. aureus N315
uguacaauuuuuaaaa

SEQ ID NO: 4051398 - RNA, 16 nt, Staphylococcus aureus subsp. aureus N315
uguacaguaauauuca

SEQ ID NO: 4051399 - RNA, 16 nt, Staphylococcus aureus subsp. aureus N315
uguacauugguuuuua

SEQ ID NO: 4051400 - RNA, 19 nt, Staphylococcus aureus subsp. aureus N315
uguacauugguuuuuacua

SEQ ID NO: 4051401 - RNA, 17 nt, Staphylococcus aureus subsp. aureus N315
uguacauuguaaauaua

SEQ ID NO: 4051402 - RNA, 17 nt, Staphylococcus aureus subsp. aureus N315
uguacauuucuauacaa

SEQ ID NO: 4051403 - RNA, 21 nt, Staphylococcus aureus subsp. aureus N315
uguaccaucacuaaaguaaau

SEQ ID NO: 4051404 - RNA, 16 nt, Staphylococcus aureus subsp. aureus N315
uguaccgaauccuuca

SEQ ID NO: 4051405 - RNA, 17 nt, Staphylococcus aureus subsp. aureus N315
uguaccgucuuaucuaa

SEQ ID NO: 4051406 - RNA, 20 nt, Staphylococcus aureus subsp. aureus N315
uguacuuaaaccuaacauaa

SEQ ID NO: 4051407 - RNA, 23 nt, Staphylococcus aureus subsp. aureus N315
uguacuuuuauguuguuauaaag

SEQ ID NO: 4051408 - RNA, 13 nt, Staphylococcus aureus subsp. aureus N315
uguagaaaacaug

SEQ ID NO: 4051409 - RNA, 23 nt, Staphylococcus aureus subsp. aureus N315
uguagaaacacaaggaauauaca

SEQ ID NO: 4051410 - RNA, 12 nt, Staphylococcus aureus subsp. aureus N315
uguagagaugug

SEQ ID NO: 4051411 - RNA, 16 nt, Staphylococcus aureus subsp. aureus N315
uguagauuuuaauauu

SEQ ID NO: 4051412 - RNA, 18 nt, Staphylococcus aureus subsp. aureus N315
uguaggaagaccacuauu

SEQ ID NO: 4051413 - RNA, 15 nt, Staphylococcus aureus subsp. aureus N315
uguaguaaaaaucac

SEQ ID NO: 4051414 - RNA, 16 nt, Staphylococcus aureus subsp. aureus N315
uguaguaaaaaucaca

SEQ ID NO: 4051415 - RNA, 18 nt, Staphylococcus aureus subsp. aureus N315
uguaguuaagauaccuuu

SEQ ID NO: 4051416 - RNA, 21 nt, Staphylococcus aureus subsp. aureus N315
uguauaaauaauaaaugcuau

SEQ ID NO: 4051417 - RNA, 13 nt, Staphylococcus aureus subsp. aureus N315
uguauaacauuau

SEQ ID NO: 4051418 - RNA, 14 nt, Staphylococcus aureus subsp. aureus N315
uguauaacauuauu

SEQ ID NO: 4051419 - RNA, 17 nt, Staphylococcus aureus subsp. aureus N315
uguauagauuguauuua

SEQ ID NO: 4051420 - RNA, 20 nt, Staphylococcus aureus subsp. aureus N315
uguauagauuguauuuaaua

SEQ ID NO: 4051421 - RNA, 20 nt, Staphylococcus aureus subsp. aureus N315
uguauagcuggcuuuuuaau

SEQ ID NO: 4051422 - RNA, 15 nt, Staphylococcus aureus subsp. aureus N315
uguauaguaaccuuu

SEQ ID NO: 4051423 - RNA, 22 nt, Staphylococcus aureus subsp. aureus N315
uguauaguaaccuuuauuuuca

SEQ ID NO: 4051424 - RNA, 20 nt, Staphylococcus aureus subsp. aureus N315
uguauaugaauuuuauaaau

SEQ ID NO: 4051425 - RNA, 20 nt, Staphylococcus aureus subsp. aureus N315
uguauauggcgauaacaaga

SEQ ID NO: 4051426 - RNA, 14 nt, Staphylococcus aureus subsp. aureus N315
uguauauucuuuuu

SEQ ID NO: 4051427 - RNA, 15 nt, Staphylococcus aureus subsp. aureus N315
uguauauucuuuuua

SEQ ID NO: 4051428 - RNA, 18 nt, Staphylococcus aureus subsp. aureus N315
uguauauuuaacaucaau

SEQ ID NO: 4051429 - RNA, 24 nt, Staphylococcus aureus subsp. aureus N315
uguauauuuaacaucaauuacucu

SEQ ID NO: 4051430 - RNA, 22 nt, Staphylococcus aureus subsp. aureus N315
uguaucaaaaucgguuugauua

SEQ ID NO: 4051431 - RNA, 19 nt, Staphylococcus aureus subsp. aureus N315
uguaucaagaucaacaaug

SEQ ID NO: 4051432 - RNA, 18 nt, Staphylococcus aureus subsp. aureus N315
uguaucucugaaaaacuu

SEQ ID NO: 4051433 - RNA, 20 nt, Staphylococcus aureus subsp. aureus N315
uguaucucugaaaaacuucu

SEQ ID NO: 4051434 - RNA, 21 nt, Staphylococcus aureus subsp. aureus N315
uguaucucugaaaaacuucuu

SEQ ID NO: 4051435 - RNA, 19 nt, Staphylococcus aureus subsp. aureus N315
uguaugaaaggaguauuuu

SEQ ID NO: 4051436 - RNA, 19 nt, Staphylococcus aureus subsp. aureus N315
uguaugaguucguaaucuu

SEQ ID NO: 4051437 - RNA, 20 nt, Staphylococcus aureus subsp. aureus N315
uguaugauaaccauuaugau

SEQ ID NO: 4051438 - RNA, 20 nt, Staphylococcus aureus subsp. aureus N315
uguaugauagaauacuaaaa

SEQ ID NO: 4051439 - RNA, 16 nt, Staphylococcus aureus subsp. aureus N315
uguaugaugaacuuaa

SEQ ID NO: 4051440 - RNA, 14 nt, Staphylococcus aureus subsp. aureus N315
uguauggcauaacc

SEQ ID NO: 4051441 - RNA, 15 nt, Staphylococcus aureus subsp. aureus N315
uguauguugaaagug

SEQ ID NO: 4051442 - RNA, 23 nt, Staphylococcus aureus subsp. aureus N315
uguauuauucucucauuuguaua

SEQ ID NO: 4051443 - RNA, 17 nt, Staphylococcus aureus subsp. aureus N315
uguauucagucaguaaa

SEQ ID NO: 4051444 - RNA, 18 nt, Staphylococcus aureus subsp. aureus N315
uguauucauuuuaaauuu

SEQ ID NO: 4051445 - RNA, 16 nt, Staphylococcus aureus subsp. aureus N315
uguauucugaaacuuu

SEQ ID NO: 4051446 - RNA, 17 nt, Staphylococcus aureus subsp. aureus N315
uguauucugaaacuuua

SEQ ID NO: 4051447 - RNA, 18 nt, Staphylococcus aureus subsp. aureus N315
uguauucuucuaauucug

SEQ ID NO: 4051448 - RNA, 17 nt, Staphylococcus aureus subsp. aureus N315
uguauuguauuuuaaug

SEQ ID NO: 4051449 - RNA, 19 nt, Staphylococcus aureus subsp. aureus N315
uguauuguuugaaaauuaa

SEQ ID NO: 4051450 - RNA, 17 nt, Staphylococcus aureus subsp. aureus N315
uguauuguuuguuuuua

SEQ ID NO: 4051451 - RNA, 14 nt, Staphylococcus aureus subsp. aureus N315
uguauuuaauaagu

SEQ ID NO: 4051452 - RNA, 21 nt, Staphylococcus aureus subsp. aureus N315
uguauuuuaacgucauuuuua

SEQ ID NO: 4051453 - RNA, 13 nt, Staphylococcus aureus subsp. aureus N315
uguauuuuuauuu

SEQ ID NO: 4051454 - RNA, 14 nt, Staphylococcus aureus subsp. aureus N315
uguauuuuucaaau

SEQ ID NO: 4051455 - RNA, 13 nt, Staphylococcus aureus subsp. aureus N315
uguauuuuucuua

SEQ ID NO: 4051456 - RNA, 22 nt, Staphylococcus aureus subsp. aureus N315
ugucaaauacguaucaagaaaa

SEQ ID NO: 4051457 - RNA, 24 nt, Staphylococcus aureus subsp. aureus N315
ugucaaaucggcuauacauugaua

SEQ ID NO: 4051458 - RNA, 16 nt, Staphylococcus aureus subsp. aureus N315
ugucaauaaauuguuu

SEQ ID NO: 4051459 - RNA, 22 nt, Staphylococcus aureus subsp. aureus N315
ugucaauaaauuguuuacuaua

SEQ ID NO: 4051460 - RNA, 18 nt, Staphylococcus aureus subsp. aureus N315
ugucaauagcgguuuaaa

SEQ ID NO: 4051461 - RNA, 23 nt, Staphylococcus aureus subsp. aureus N315
ugucacauguaccacauuuuccu

SEQ ID NO: 4051462 - RNA, 20 nt, Staphylococcus aureus subsp. aureus N315
ugucacuaauggauaugaua

SEQ ID NO: 4051463 - RNA, 16 nt, Staphylococcus aureus subsp. aureus N315
ugucaguaacuuuguc

SEQ ID NO: 4051464 - RNA, 21 nt, Staphylococcus aureus subsp. aureus N315
ugucaguuuugaagaauaaaa

SEQ ID NO: 4051465 - RNA, 20 nt, Staphylococcus aureus subsp. aureus N315
ugucauaauagauaaugcac

SEQ ID NO: 4051466 - RNA, 19 nt, Staphylococcus aureus subsp. aureus N315
ugucauaauccauucuucu

SEQ ID NO: 4051467 - RNA, 19 nt, Staphylococcus aureus subsp. aureus N315
ugucauaguauacauaauu

SEQ ID NO: 4051468 - RNA, 15 nt, Staphylococcus aureus subsp. aureus N315
ugucaucauguucua

SEQ ID NO: 4051469 - RNA, 16 nt, Staphylococcus aureus subsp. aureus N315
ugucaucgcuuuaauu

SEQ ID NO: 4051470 - RNA, 20 nt, Staphylococcus aureus subsp. aureus N315
ugucaugaauuuucaucauu

SEQ ID NO: 4051471 - RNA, 15 nt, Staphylococcus aureus subsp. aureus N315
ugucaugccuucauu

SEQ ID NO: 4051472 - RNA, 20 nt, Staphylococcus aureus subsp. aureus N315
ugucauguguucaaauaacg

SEQ ID NO: 4051473 - RNA, 15 nt, Staphylococcus aureus subsp. aureus N315
ugucauuuucugcuu

SEQ ID NO: 4051474 - RNA, 16 nt, Staphylococcus aureus subsp. aureus N315
ugucauuuucugcuuu

SEQ ID NO: 4051475 - RNA, 15 nt, Staphylococcus aureus subsp. aureus N315
ugucauuuugauuaa

SEQ ID NO: 4051476 - RNA, 13 nt, Staphylococcus aureus subsp. aureus N315
uguccaaauaaau

SEQ ID NO: 4051477 - RNA, 17 nt, Staphylococcus aureus subsp. aureus N315
uguccacuauauccuuu

SEQ ID NO: 4051478 - RNA, 12 nt, Staphylococcus aureus subsp. aureus N315
uguccagacaac

SEQ ID NO: 4051479 - RNA, 19 nt, Staphylococcus aureus subsp. aureus N315
uguccaucuuuuauuaaag

SEQ ID NO: 4051480 - RNA, 18 nt, Staphylococcus aureus subsp. aureus N315
ugucccaagcccugacaa

SEQ ID NO: 4051481 - RNA, 21 nt, Staphylococcus aureus subsp. aureus N315
uguccuaacgcuaauuuuacu

SEQ ID NO: 4051482 - RNA, 22 nt, Staphylococcus aureus subsp. aureus N315
uguccuaacgcuaauuuuacuc

SEQ ID NO: 4051483 - RNA, 13 nt, Staphylococcus aureus subsp. aureus N315
uguccucuaaaac

SEQ ID NO: 4051484 - RNA, 16 nt, Staphylococcus aureus subsp. aureus N315
ugucgcuuucauaccu

SEQ ID NO: 4051485 - RNA, 18 nt, Staphylococcus aureus subsp. aureus N315
ugucggaauugguuuuua

SEQ ID NO: 4051486 - RNA, 15 nt, Staphylococcus aureus subsp. aureus N315
ugucgguucaucuaa

SEQ ID NO: 4051487 - RNA, 15 nt, Staphylococcus aureus subsp. aureus N315
ugucguauucuucaa

SEQ ID NO: 4051488 - RNA, 18 nt, Staphylococcus aureus subsp. aureus N315
ugucuaaaaacauaaaaa

SEQ ID NO: 4051489 - RNA, 19 nt, Staphylococcus aureus subsp. aureus N315
ugucucaaauuaaaucacc

SEQ ID NO: 4051490 - RNA, 20 nt, Staphylococcus aureus subsp. aureus N315
ugucugccaaaccuuuauau

SEQ ID NO: 4051491 - RNA, 15 nt, Staphylococcus aureus subsp. aureus N315
ugucuuaauaugcaa

SEQ ID NO: 4051492 - RNA, 13 nt, Staphylococcus aureus subsp. aureus N315
ugucuuacuuuua

SEQ ID NO: 4051493 - RNA, 15 nt, Staphylococcus aureus subsp. aureus N315
ugucuuacuuuuaaa

SEQ ID NO: 4051494 - RNA, 16 nt, Staphylococcus aureus subsp. aureus N315
ugucuuacuuuuaaau

SEQ ID NO: 4051495 - RNA, 20 nt, Staphylococcus aureus subsp. aureus N315
ugucuuaucaauuagccaau

SEQ ID NO: 4051496 - RNA, 19 nt, Staphylococcus aureus subsp. aureus N315
ugucuuccaaucaacuuca

SEQ ID NO: 4051497 - RNA, 21 nt, Staphylococcus aureus subsp. aureus N315
ugucuuccaaucaacuucaua

SEQ ID NO: 4051498 - RNA, 13 nt, Staphylococcus aureus subsp. aureus N315
ugucuucuuuuuu

SEQ ID NO: 4051499 - RNA, 19 nt, Staphylococcus aureus subsp. aureus N315
ugucuuucaaauacacaga

SEQ ID NO: 4051500 - RNA, 17 nt, Staphylococcus aureus subsp. aureus N315
ugucuuuuauauuuuua

SEQ ID NO: 4051501 - RNA, 13 nt, Staphylococcus aureus subsp. aureus N315
ugugaaaauacca

SEQ ID NO: 4051502 - RNA, 12 nt, Staphylococcus aureus subsp. aureus N315
ugugacauacca

SEQ ID NO: 4051503 - RNA, 14 nt, Staphylococcus aureus subsp. aureus N315
ugugacgauauuug

SEQ ID NO: 4051504 - RNA, 23 nt, Staphylococcus aureus subsp. aureus N315
ugugacucggggaauuuuuaugc

SEQ ID NO: 4051505 - RNA, 17 nt, Staphylococcus aureus subsp. aureus N315
ugugacuuguaucaucg

SEQ ID NO: 4051506 - RNA, 20 nt, Staphylococcus aureus subsp. aureus N315
ugugauaacuuguaauauaa

SEQ ID NO: 4051507 - RNA, 17 nt, Staphylococcus aureus subsp. aureus N315
ugugauaauucuucaac

SEQ ID NO: 4051508 - RNA, 17 nt, Staphylococcus aureus subsp. aureus N315
ugugauacuuucuaaga

SEQ ID NO: 4051509 - RNA, 15 nt, Staphylococcus aureus subsp. aureus N315
ugugauauauaacca

SEQ ID NO: 4051510 - RNA, 18 nt, Staphylococcus aureus subsp. aureus N315
ugugauauaugaaauauu

SEQ ID NO: 4051511 - RNA, 15 nt, Staphylococcus aureus subsp. aureus N315
ugugauuuguuacuu

SEQ ID NO: 4051512 - RNA, 18 nt, Staphylococcus aureus subsp. aureus N315
ugugauuuguuacuucua

SEQ ID NO: 4051513 - RNA, 19 nt, Staphylococcus aureus subsp. aureus N315
ugugauuuguuacuucuaa

SEQ ID NO: 4051514 - RNA, 23 nt, Staphylococcus aureus subsp. aureus N315
ugugauuuuuaauaauuugaaua

SEQ ID NO: 4051515 - RNA, 19 nt, Staphylococcus aureus subsp. aureus N315
ugugcaacgguuugaaaaa

SEQ ID NO: 4051516 - RNA, 15 nt, Staphylococcus aureus subsp. aureus N315
ugugcaauaccuguu

SEQ ID NO: 4051517 - RNA, 22 nt, Staphylococcus aureus subsp. aureus N315
ugugcaauuagaauauauguau

SEQ ID NO: 4051518 - RNA, 13 nt, Staphylococcus aureus subsp. aureus N315
ugugcaucauuua

SEQ ID NO: 4051519 - RNA, 14 nt, Staphylococcus aureus subsp. aureus N315
ugugcauucaucaa

SEQ ID NO: 4051520 - RNA, 20 nt, Staphylococcus aureus subsp. aureus N315
ugugccggcuuuuucuuuug

SEQ ID NO: 4051521 - RNA, 19 nt, Staphylococcus aureus subsp. aureus N315
ugugcugccaaauauaauu

SEQ ID NO: 4051522 - RNA, 19 nt, Staphylococcus aureus subsp. aureus N315
ugugcuuuuccauaaauau

SEQ ID NO: 4051523 - RNA, 21 nt, Staphylococcus aureus subsp. aureus N315
ugugcuuuuccauaaauauuu

SEQ ID NO: 4051524 - RNA, 17 nt, Staphylococcus aureus subsp. aureus N315
uguggauuuaauuuuua

SEQ ID NO: 4051525 - RNA, 17 nt, Staphylococcus aureus subsp. aureus N315
ugugggcguucugcuaa

SEQ ID NO: 4051526 - RNA, 11 nt, Staphylococcus aureus subsp. aureus N315
ugugguaaaag

SEQ ID NO: 4051527 - RNA, 14 nt, Staphylococcus aureus subsp. aureus N315
uguggucuaaccau

SEQ ID NO: 4051528 - RNA, 21 nt, Staphylococcus aureus subsp. aureus N315
uguguaugguuuuguacauau

SEQ ID NO: 4051529 - RNA, 15 nt, Staphylococcus aureus subsp. aureus N315
uguguauuuuuauug

SEQ ID NO: 4051530 - RNA, 22 nt, Staphylococcus aureus subsp. aureus N315
ugugucaaauaggcauaaugaa

SEQ ID NO: 4051531 - RNA, 22 nt, Staphylococcus aureus subsp. aureus N315
ugugucauaauccauucuucuu

SEQ ID NO: 4051532 - RNA, 20 nt, Staphylococcus aureus subsp. aureus N315
uguguccauaaauauuaaau

SEQ ID NO: 4051533 - RNA, 17 nt, Staphylococcus aureus subsp. aureus N315
uguguuaauacuucaua

SEQ ID NO: 4051534 - RNA, 19 nt, Staphylococcus aureus subsp. aureus N315
uguguucggaauuugcaca

SEQ ID NO: 4051535 - RNA, 20 nt, Staphylococcus aureus subsp. aureus N315
uguguugaaacugaguucaa

SEQ ID NO: 4051536 - RNA, 16 nt, Staphylococcus aureus subsp. aureus N315
uguguuggggcccaca

SEQ ID NO: 4051537 - RNA, 19 nt, Staphylococcus aureus subsp. aureus N315
uguguuggggcccacaccc

SEQ ID NO: 4051538 - RNA, 17 nt, Staphylococcus aureus subsp. aureus N315
uguguugugauuauaaa

SEQ ID NO: 4051539 - RNA, 13 nt, Staphylococcus aureus subsp. aureus N315
uguguuucuuuua

SEQ ID NO: 4051540 - RNA, 12 nt, Staphylococcus aureus subsp. aureus N315
uguguuugcuuu

SEQ ID NO: 4051541 - RNA, 18 nt, Staphylococcus aureus subsp. aureus N315
uguguuuuaaaauuauuu

SEQ ID NO: 4051542 - RNA, 18 nt, Staphylococcus aureus subsp. aureus N315
uguguuuucaacaguuuu

SEQ ID NO: 4051543 - RNA, 14 nt, Staphylococcus aureus subsp. aureus N315
uguguuuucuuuuc

SEQ ID NO: 4051544 - RNA, 16 nt, Staphylococcus aureus subsp. aureus N315
uguuaaaauaaugucu

SEQ ID NO: 4051545 - RNA, 12 nt, Staphylococcus aureus subsp. aureus N315
uguuaaaucacc

SEQ ID NO: 4051546 - RNA, 14 nt, Staphylococcus aureus subsp. aureus N315
uguuaaaugacgcu

SEQ ID NO: 4051547 - RNA, 15 nt, Staphylococcus aureus subsp. aureus N315
uguuaaauucuaaaa

SEQ ID NO: 4051548 - RNA, 17 nt, Staphylococcus aureus subsp. aureus N315
uguuaacugaauuucgu

SEQ ID NO: 4051549 - RNA, 15 nt, Staphylococcus aureus subsp. aureus N315
uguuaacugauaaaa

SEQ ID NO: 4051550 - RNA, 16 nt, Staphylococcus aureus subsp. aureus N315
uguuaacugauaaaag

SEQ ID NO: 4051551 - RNA, 21 nt, Staphylococcus aureus subsp. aureus N315
uguuaacugauaaaaggggaa

SEQ ID NO: 4051552 - RNA, 14 nt, Staphylococcus aureus subsp. aureus N315
uguuaaucaaaauu

SEQ ID NO: 4051553 - RNA, 13 nt, Staphylococcus aureus subsp. aureus N315
uguuaauuucaac

SEQ ID NO: 4051554 - RNA, 17 nt, Staphylococcus aureus subsp. aureus N315
uguuaauuuuuuauuaa

SEQ ID NO: 4051555 - RNA, 15 nt, Staphylococcus aureus subsp. aureus N315
uguuacacaaauuaa

SEQ ID NO: 4051556 - RNA, 17 nt, Staphylococcus aureus subsp. aureus N315
uguuacacaaauuaaaa

SEQ ID NO: 4051557 - RNA, 15 nt, Staphylococcus aureus subsp. aureus N315
uguuacacuuuucuu

SEQ ID NO: 4051558 - RNA, 16 nt, Staphylococcus aureus subsp. aureus N315
uguuacacuuuucuua

SEQ ID NO: 4051559 - RNA, 22 nt, Staphylococcus aureus subsp. aureus N315
uguuacauauugcauuuagacu

SEQ ID NO: 4051560 - RNA, 18 nt, Staphylococcus aureus subsp. aureus N315
uguuacuaguuuguaaua

SEQ ID NO: 4051561 - RNA, 13 nt, Staphylococcus aureus subsp. aureus N315
uguuacuuauaua

SEQ ID NO: 4051562 - RNA, 24 nt, Staphylococcus aureus subsp. aureus N315
uguuacuuauauauucaauaauua

SEQ ID NO: 4051563 - RNA, 18 nt, Staphylococcus aureus subsp. aureus N315
uguuacuucuaauaguaa

SEQ ID NO: 4051564 - RNA, 15 nt, Staphylococcus aureus subsp. aureus N315
uguuacuugagaacc

SEQ ID NO: 4051565 - RNA, 22 nt, Staphylococcus aureus subsp. aureus N315
uguuacuuucacauuuucaaau

SEQ ID NO: 4051566 - RNA, 19 nt, Staphylococcus aureus subsp. aureus N315
uguuaggagagauguauaa

SEQ ID NO: 4051567 - RNA, 22 nt, Staphylococcus aureus subsp. aureus N315
uguuaggagagauguauaaaac

SEQ ID NO: 4051568 - RNA, 16 nt, Staphylococcus aureus subsp. aureus N315
uguuaggggcucuuau

SEQ ID NO: 4051569 - RNA, 23 nt, Staphylococcus aureus subsp. aureus N315
uguuaguuuucuuaaaagagcaa

SEQ ID NO: 4051570 - RNA, 17 nt, Staphylococcus aureus subsp. aureus N315
uguuauagcguuuaaga

SEQ ID NO: 4051571 - RNA, 15 nt, Staphylococcus aureus subsp. aureus N315
uguuauaucuaauuc

SEQ ID NO: 4051572 - RNA, 23 nt, Staphylococcus aureus subsp. aureus N315
uguuauauuggcaguguuugacu

SEQ ID NO: 4051573 - RNA, 17 nt, Staphylococcus aureus subsp. aureus N315
uguuauccaaaacauuu

SEQ ID NO: 4051574 - RNA, 14 nt, Staphylococcus aureus subsp. aureus N315
uguuaugaaguauc

SEQ ID NO: 4051575 - RNA, 16 nt, Staphylococcus aureus subsp. aureus N315
uguuauuauaaauauu

SEQ ID NO: 4051576 - RNA, 22 nt, Staphylococcus aureus subsp. aureus N315
uguuauuaucguaaaaaaacgu

SEQ ID NO: 4051577 - RNA, 13 nt, Staphylococcus aureus subsp. aureus N315
uguuauugcuuau

SEQ ID NO: 4051578 - RNA, 15 nt, Staphylococcus aureus subsp. aureus N315
uguucaaagacacgg

SEQ ID NO: 4051579 - RNA, 21 nt, Staphylococcus aureus subsp. aureus N315
uguucaaaucacaaguuuaca

SEQ ID NO: 4051580 - RNA, 17 nt, Staphylococcus aureus subsp. aureus N315
uguucaacuaaauuuuc

SEQ ID NO: 4051581 - RNA, 13 nt, Staphylococcus aureus subsp. aureus N315
uguucaauauuua

SEQ ID NO: 4051582 - RNA, 16 nt, Staphylococcus aureus subsp. aureus N315
uguucaaugauuuuau

SEQ ID NO: 4051583 - RNA, 17 nt, Staphylococcus aureus subsp. aureus N315
uguucaaugauuuuaua

SEQ ID NO: 4051584 - RNA, 19 nt, Staphylococcus aureus subsp. aureus N315
uguucaaugauuuuauaau

SEQ ID NO: 4051585 - RNA, 23 nt, Staphylococcus aureus subsp. aureus N315
uguucaaugauuuuauaauauua

SEQ ID NO: 4051586 - RNA, 17 nt, Staphylococcus aureus subsp. aureus N315
uguucaauuguuacuuu

SEQ ID NO: 4051587 - RNA, 16 nt, Staphylococcus aureus subsp. aureus N315
uguucacauucuugaa

SEQ ID NO: 4051588 - RNA, 22 nt, Staphylococcus aureus subsp. aureus N315
uguucagaacuacaauucauaa

SEQ ID NO: 4051589 - RNA, 15 nt, Staphylococcus aureus subsp. aureus N315
uguucagguucaaaa

SEQ ID NO: 4051590 - RNA, 18 nt, Staphylococcus aureus subsp. aureus N315
uguucagguucaaaauug

SEQ ID NO: 4051591 - RNA, 16 nt, Staphylococcus aureus subsp. aureus N315
uguucaguuaaaucug

SEQ ID NO: 4051592 - RNA, 16 nt, Staphylococcus aureus subsp. aureus N315
uguucaguuguuuuuu

SEQ ID NO: 4051593 - RNA, 23 nt, Staphylococcus aureus subsp. aureus N315
uguucauaaucauaauaagauuu

SEQ ID NO: 4051594 - RNA, 21 nt, Staphylococcus aureus subsp. aureus N315
uguucaucugauaauucgaaa

SEQ ID NO: 4051595 - RNA, 22 nt, Staphylococcus aureus subsp. aureus N315
uguucaucugauaauucgaaau

SEQ ID NO: 4051596 - RNA, 16 nt, Staphylococcus aureus subsp. aureus N315
uguucauuggcaauau

SEQ ID NO: 4051597 - RNA, 17 nt, Staphylococcus aureus subsp. aureus N315
uguucccauuuuuaaaa

SEQ ID NO: 4051598 - RNA, 17 nt, Staphylococcus aureus subsp. aureus N315
uguuccgcuacaaaaca

SEQ ID NO: 4051599 - RNA, 18 nt, Staphylococcus aureus subsp. aureus N315
uguuccgcuacaaaacau

SEQ ID NO: 4051600 - RNA, 20 nt, Staphylococcus aureus subsp. aureus N315
uguuccuccaccaccugcaa

SEQ ID NO: 4051601 - RNA, 22 nt, Staphylococcus aureus subsp. aureus N315
uguuccugcuacaacuucuucu

SEQ ID NO: 4051602 - RNA, 23 nt, Staphylococcus aureus subsp. aureus N315
uguuccugcuacaacuucuucuc

SEQ ID NO: 4051603 - RNA, 22 nt, Staphylococcus aureus subsp. aureus N315
uguucuaaguuugcguuuuaau

SEQ ID NO: 4051604 - RNA, 14 nt, Staphylococcus aureus subsp. aureus N315
uguucuaaugcugc

SEQ ID NO: 4051605 - RNA, 15 nt, Staphylococcus aureus subsp. aureus N315
uguucucauuauaau

SEQ ID NO: 4051606 - RNA, 18 nt, Staphylococcus aureus subsp. aureus N315
uguucucgucuuucgucc

SEQ ID NO: 4051607 - RNA, 15 nt, Staphylococcus aureus subsp. aureus N315
uguucucuauuuaua

SEQ ID NO: 4051608 - RNA, 23 nt, Staphylococcus aureus subsp. aureus N315
uguucucuauuuauaacacuucg

SEQ ID NO: 4051609 - RNA, 16 nt, Staphylococcus aureus subsp. aureus N315
uguucugcuuuuucuu

SEQ ID NO: 4051610 - RNA, 21 nt, Staphylococcus aureus subsp. aureus N315
uguucuggaauugggaaauau

SEQ ID NO: 4051611 - RNA, 14 nt, Staphylococcus aureus subsp. aureus N315
uguucuuauaaaaa

SEQ ID NO: 4051612 - RNA, 21 nt, Staphylococcus aureus subsp. aureus N315
uguucuucugcauagcgcucu

SEQ ID NO: 4051613 - RNA, 19 nt, Staphylococcus aureus subsp. aureus N315
uguucuugaaaacaauaaa

SEQ ID NO: 4051614 - RNA, 18 nt, Staphylococcus aureus subsp. aureus N315
uguucuuucuuucuuuuc

SEQ ID NO: 4051615 - RNA, 20 nt, Staphylococcus aureus subsp. aureus N315
uguugaaauuaaauucaaau

SEQ ID NO: 4051616 - RNA, 18 nt, Staphylococcus aureus subsp. aureus N315
uguugaacgguagauuua

SEQ ID NO: 4051617 - RNA, 18 nt, Staphylococcus aureus subsp. aureus N315
uguugaauaauuaauguu

SEQ ID NO: 4051618 - RNA, 19 nt, Staphylococcus aureus subsp. aureus N315
uguugacauuugaccaagu

SEQ ID NO: 4051619 - RNA, 21 nt, Staphylococcus aureus subsp. aureus N315
uguugaggcguuucagaaguu

SEQ ID NO: 4051620 - RNA, 22 nt, Staphylococcus aureus subsp. aureus N315
uguugaggcguuucagaaguug

SEQ ID NO: 4051621 - RNA, 14 nt, Staphylococcus aureus subsp. aureus N315
uguugauaaaaagg

SEQ ID NO: 4051622 - RNA, 16 nt, Staphylococcus aureus subsp. aureus N315
uguugcguuaaauaug

SEQ ID NO: 4051623 - RNA, 22 nt, Staphylococcus aureus subsp. aureus N315
uguuggaagccuucaauaguuu

SEQ ID NO: 4051624 - RNA, 16 nt, Staphylococcus aureus subsp. aureus N315
uguuggcaaacuauua

SEQ ID NO: 4051625 - RNA, 16 nt, Staphylococcus aureus subsp. aureus N315
uguuggcuuuuugagu

SEQ ID NO: 4051626 - RNA, 20 nt, Staphylococcus aureus subsp. aureus N315
uguugguucaucaaacaaca

SEQ ID NO: 4051627 - RNA, 20 nt, Staphylococcus aureus subsp. aureus N315
uguuguaagguggacuucua

SEQ ID NO: 4051628 - RNA, 17 nt, Staphylococcus aureus subsp. aureus N315
uguuguacauguauugg

SEQ ID NO: 4051629 - RNA, 14 nt, Staphylococcus aureus subsp. aureus N315
uguuguuauauaaa

SEQ ID NO: 4051630 - RNA, 15 nt, Staphylococcus aureus subsp. aureus N315
uguuuaaacauguac

SEQ ID NO: 4051631 - RNA, 16 nt, Staphylococcus aureus subsp. aureus N315
uguuuaaacauguaca

SEQ ID NO: 4051632 - RNA, 15 nt, Staphylococcus aureus subsp. aureus N315
uguuuaaauaaaauu

SEQ ID NO: 4051633 - RNA, 14 nt, Staphylococcus aureus subsp. aureus N315
uguuuaaauaucau

SEQ ID NO: 4051634 - RNA, 17 nt, Staphylococcus aureus subsp. aureus N315
uguuuaauuaaaauaca

SEQ ID NO: 4051635 - RNA, 13 nt, Staphylococcus aureus subsp. aureus N315
uguuuacagaugc

SEQ ID NO: 4051636 - RNA, 22 nt, Staphylococcus aureus subsp. aureus N315
uguuuacgccauaagaaaauac

SEQ ID NO: 4051637 - RNA, 15 nt, Staphylococcus aureus subsp. aureus N315
uguuuauauugcaaa

SEQ ID NO: 4051638 - RNA, 16 nt, Staphylococcus aureus subsp. aureus N315
uguuuauauugcaaaa

SEQ ID NO: 4051639 - RNA, 16 nt, Staphylococcus aureus subsp. aureus N315
uguuuauuacauaauu

SEQ ID NO: 4051640 - RNA, 20 nt, Staphylococcus aureus subsp. aureus N315
uguuuauuacauaauuuauc

SEQ ID NO: 4051641 - RNA, 14 nt, Staphylococcus aureus subsp. aureus N315
uguuuauuuagaau

SEQ ID NO: 4051642 - RNA, 15 nt, Staphylococcus aureus subsp. aureus N315
uguuuauuuuuauau

SEQ ID NO: 4051643 - RNA, 13 nt, Staphylococcus aureus subsp. aureus N315
uguuucaaacaaa

SEQ ID NO: 4051644 - RNA, 14 nt, Staphylococcus aureus subsp. aureus N315
uguuucaacauauu

SEQ ID NO: 4051645 - RNA, 19 nt, Staphylococcus aureus subsp. aureus N315
uguuucaacauauuauaua

SEQ ID NO: 4051646 - RNA, 15 nt, Staphylococcus aureus subsp. aureus N315
uguuucaggauaaug

SEQ ID NO: 4051647 - RNA, 19 nt, Staphylococcus aureus subsp. aureus N315
uguuucauaugcaucaaca

SEQ ID NO: 4051648 - RNA, 14 nt, Staphylococcus aureus subsp. aureus N315
uguuucuaaugcuc

SEQ ID NO: 4051649 - RNA, 23 nt, Staphylococcus aureus subsp. aureus N315
uguuucuauauuaauaaucuucu

SEQ ID NO: 4051650 - RNA, 17 nt, Staphylococcus aureus subsp. aureus N315
uguuucuucaauuuaau

SEQ ID NO: 4051651 - RNA, 18 nt, Staphylococcus aureus subsp. aureus N315
uguuugaauguuuuugau

SEQ ID NO: 4051652 - RNA, 14 nt, Staphylococcus aureus subsp. aureus N315
uguuugagauauau

SEQ ID NO: 4051653 - RNA, 17 nt, Staphylococcus aureus subsp. aureus N315
uguuugcaacauauuuu

SEQ ID NO: 4051654 - RNA, 14 nt, Staphylococcus aureus subsp. aureus N315
uguuugcuuuuugu

SEQ ID NO: 4051655 - RNA, 16 nt, Staphylococcus aureus subsp. aureus N315
uguuuggaugaacaaa

SEQ ID NO: 4051656 - RNA, 13 nt, Staphylococcus aureus subsp. aureus N315
uguuuggcauaau

SEQ ID NO: 4051657 - RNA, 19 nt, Staphylococcus aureus subsp. aureus N315
uguuuguaaaucaaguguu

SEQ ID NO: 4051658 - RNA, 21 nt, Staphylococcus aureus subsp. aureus N315
uguuuguuacauauugcauuu

SEQ ID NO: 4051659 - RNA, 12 nt, Staphylococcus aureus subsp. aureus N315
uguuuuaaaaaa

SEQ ID NO: 4051660 - RNA, 12 nt, Staphylococcus aureus subsp. aureus N315
uguuuuaaaauu

SEQ ID NO: 4051661 - RNA, 16 nt, Staphylococcus aureus subsp. aureus N315
uguuuuaaaauuauuu

SEQ ID NO: 4051662 - RNA, 16 nt, Staphylococcus aureus subsp. aureus N315
uguuuuaaaucauaaa

SEQ ID NO: 4051663 - RNA, 12 nt, Staphylococcus aureus subsp. aureus N315
uguuuuaaauuu

SEQ ID NO: 4051664 - RNA, 12 nt, Staphylococcus aureus subsp. aureus N315
uguuuuaauaau

SEQ ID NO: 4051665 - RNA, 15 nt, Staphylococcus aureus subsp. aureus N315
uguuuuaucaauauu

SEQ ID NO: 4051666 - RNA, 19 nt, Staphylococcus aureus subsp. aureus N315
uguuuuaugauuuucuuua

SEQ ID NO: 4051667 - RNA, 13 nt, Staphylococcus aureus subsp. aureus N315
uguuuuauucaau

SEQ ID NO: 4051668 - RNA, 21 nt, Staphylococcus aureus subsp. aureus N315
uguuuucaacaguuuuaaaga

SEQ ID NO: 4051669 - RNA, 14 nt, Staphylococcus aureus subsp. aureus N315
uguuuucaauaauu

SEQ ID NO: 4051670 - RNA, 16 nt, Staphylococcus aureus subsp. aureus N315
uguuuucauuuaaaag

SEQ ID NO: 4051671 - RNA, 20 nt, Staphylococcus aureus subsp. aureus N315
uguuuugagagauuauuuaa

SEQ ID NO: 4051672 - RNA, 21 nt, Staphylococcus aureus subsp. aureus N315
uguuuugagagauuauuuaaa

SEQ ID NO: 4051673 - RNA, 19 nt, Staphylococcus aureus subsp. aureus N315
uguuuuuaacagcuuuuuc

SEQ ID NO: 4051674 - RNA, 21 nt, Staphylococcus aureus subsp. aureus N315
uguuuuuaacagcuuuuucua

SEQ ID NO: 4051675 - RNA, 21 nt, Staphylococcus aureus subsp. aureus N315
uguuuuucacuguuaaagucu

SEQ ID NO: 4051676 - RNA, 17 nt, Staphylococcus aureus subsp. aureus N315
uguuuuucaucauuaaa

SEQ ID NO: 4051677 - RNA, 18 nt, Staphylococcus aureus subsp. aureus N315
uguuuuucaucauuaaaa

SEQ ID NO: 4051678 - RNA, 19 nt, Staphylococcus aureus subsp. aureus N315
uguuuuucaucauuaaaau

SEQ ID NO: 4051679 - RNA, 20 nt, Staphylococcus aureus subsp. aureus N315
uguuuuugauaguaauaguu

SEQ ID NO: 4051680 - RNA, 15 nt, Staphylococcus aureus subsp. aureus N315
uuaaaaaacagugua

SEQ ID NO: 4051681 - RNA, 19 nt, Staphylococcus aureus subsp. aureus N315
uuaaaaaacauaccugcau

SEQ ID NO: 4051682 - RNA, 12 nt, Staphylococcus aureus subsp. aureus N315
uuaaaaaauaug

SEQ ID NO: 4051683 - RNA, 16 nt, Staphylococcus aureus subsp. aureus N315
uuaaaaaauuuaaaua

SEQ ID NO: 4051684 - RNA, 12 nt, Staphylococcus aureus subsp. aureus N315
uuaaaaauaaaa

SEQ ID NO: 4051685 - RNA, 17 nt, Staphylococcus aureus subsp. aureus N315
uuaaaaauacagcuaca

SEQ ID NO: 4051686 - RNA, 17 nt, Staphylococcus aureus subsp. aureus N315
uuaaaaaucaaagaggc

SEQ ID NO: 4051687 - RNA, 19 nt, Staphylococcus aureus subsp. aureus N315
uuaaaacaaugauuaaaau

SEQ ID NO: 4051688 - RNA, 12 nt, Staphylococcus aureus subsp. aureus N315
uuaaaacaucau

SEQ ID NO: 4051689 - RNA, 15 nt, Staphylococcus aureus subsp. aureus N315
uuaaaacaucauuca

SEQ ID NO: 4051690 - RNA, 19 nt, Staphylococcus aureus subsp. aureus N315
uuaaaacaugacaacuuca

SEQ ID NO: 4051691 - RNA, 15 nt, Staphylococcus aureus subsp. aureus N315
uuaaaaccuuuucaa

SEQ ID NO: 4051692 - RNA, 13 nt, Staphylococcus aureus subsp. aureus N315
uuaaaacuauaau

SEQ ID NO: 4051693 - RNA, 14 nt, Staphylococcus aureus subsp. aureus N315
uuaaaacuuguaaa

SEQ ID NO: 4051694 - RNA, 20 nt, Staphylococcus aureus subsp. aureus N315
uuaaaagacauccacagaau

SEQ ID NO: 4051695 - RNA, 13 nt, Staphylococcus aureus subsp. aureus N315
uuaaaagugcaag

SEQ ID NO: 4051696 - RNA, 20 nt, Staphylococcus aureus subsp. aureus N315
uuaaaagugguuuuacugcu

SEQ ID NO: 4051697 - RNA, 21 nt, Staphylococcus aureus subsp. aureus N315
uuaaaagugucugguucuuua

SEQ ID NO: 4051698 - RNA, 20 nt, Staphylococcus aureus subsp. aureus N315
uuaaaauaaccauuuuuuca

SEQ ID NO: 4051699 - RNA, 15 nt, Staphylococcus aureus subsp. aureus N315
uuaaaauauauuugu

SEQ ID NO: 4051700 - RNA, 21 nt, Staphylococcus aureus subsp. aureus N315
uuaaaauaugauuuaaaauau

SEQ ID NO: 4051701 - RNA, 18 nt, Staphylococcus aureus subsp. aureus N315
uuaaaauauuauuuuuaa

SEQ ID NO: 4051702 - RNA, 23 nt, Staphylococcus aureus subsp. aureus N315
uuaaaaucggacaacugagaaau

SEQ ID NO: 4051703 - RNA, 22 nt, Staphylococcus aureus subsp. aureus N315
uuaaaaugauagcuaaacauuu

SEQ ID NO: 4051704 - RNA, 21 nt, Staphylococcus aureus subsp. aureus N315
uuaaaaugauuguuuuaagug

SEQ ID NO: 4051705 - RNA, 11 nt, Staphylococcus aureus subsp. aureus N315
uuaaaaugcuu

SEQ ID NO: 4051706 - RNA, 18 nt, Staphylococcus aureus subsp. aureus N315
uuaaaauuaaaccuacaa

SEQ ID NO: 4051707 - RNA, 11 nt, Staphylococcus aureus subsp. aureus N315
uuaaaauuauu

SEQ ID NO: 4051708 - RNA, 22 nt, Staphylococcus aureus subsp. aureus N315
uuaaaauugguuuggauaaaau

SEQ ID NO: 4051709 - RNA, 14 nt, Staphylococcus aureus subsp. aureus N315
uuaaaauuuaaaua

SEQ ID NO: 4051710 - RNA, 17 nt, Staphylococcus aureus subsp. aureus N315
uuaaaauuuuaauuaau

SEQ ID NO: 4051711 - RNA, 17 nt, Staphylococcus aureus subsp. aureus N315
uuaaacaaauaaauguc

SEQ ID NO: 4051712 - RNA, 16 nt, Staphylococcus aureus subsp. aureus N315
uuaaacaagcaucaug

SEQ ID NO: 4051713 - RNA, 16 nt, Staphylococcus aureus subsp. aureus N315
uuaaacaguuuaauuc

SEQ ID NO: 4051714 - RNA, 20 nt, Staphylococcus aureus subsp. aureus N315
uuaaacauccaauuauguuu

SEQ ID NO: 4051715 - RNA, 14 nt, Staphylococcus aureus subsp. aureus N315
uuaaacaucuauaa

SEQ ID NO: 4051716 - RNA, 19 nt, Staphylococcus aureus subsp. aureus N315
uuaaacaugaacaaucaga

SEQ ID NO: 4051717 - RNA, 16 nt, Staphylococcus aureus subsp. aureus N315
uuaaacauuuagauuu

SEQ ID NO: 4051718 - RNA, 22 nt, Staphylococcus aureus subsp. aureus N315
uuaaacauuuuuagaaucaaaa

SEQ ID NO: 4051719 - RNA, 23 nt, Staphylococcus aureus subsp. aureus N315
uuaaaccgcacuucuauauuaau

SEQ ID NO: 4051720 - RNA, 20 nt, Staphylococcus aureus subsp. aureus N315
uuaaaccgccaccaccuaau

SEQ ID NO: 4051721 - RNA, 14 nt, Staphylococcus aureus subsp. aureus N315
uuaaacgcaauuaa

SEQ ID NO: 4051722 - RNA, 14 nt, Staphylococcus aureus subsp. aureus N315
uuaaacguaucauu

SEQ ID NO: 4051723 - RNA, 22 nt, Staphylococcus aureus subsp. aureus N315
uuaaacgugaauucgaugacuu

SEQ ID NO: 4051724 - RNA, 17 nt, Staphylococcus aureus subsp. aureus N315
uuaaacuacgaauucuc

SEQ ID NO: 4051725 - RNA, 16 nt, Staphylococcus aureus subsp. aureus N315
uuaaacucucuaaaaa

SEQ ID NO: 4051726 - RNA, 12 nt, Staphylococcus aureus subsp. aureus N315
uuaaacuuauua

SEQ ID NO: 4051727 - RNA, 14 nt, Staphylococcus aureus subsp. aureus N315
uuaaacuuauuaau

SEQ ID NO: 4051728 - RNA, 20 nt, Staphylococcus aureus subsp. aureus N315
uuaaagaaaauaucugaaaa

SEQ ID NO: 4051729 - RNA, 21 nt, Staphylococcus aureus subsp. aureus N315
uuaaagaaaauaucugaaaaa

SEQ ID NO: 4051730 - RNA, 18 nt, Staphylococcus aureus subsp. aureus N315
uuaaagaaaauuucagua

SEQ ID NO: 4051731 - RNA, 14 nt, Staphylococcus aureus subsp. aureus N315
uuaaagaacuauuu

SEQ ID NO: 4051732 - RNA, 20 nt, Staphylococcus aureus subsp. aureus N315
uuaaagaacuauuuuaaauu

SEQ ID NO: 4051733 - RNA, 20 nt, Staphylococcus aureus subsp. aureus N315
uuaaagacugaaccguauaa

SEQ ID NO: 4051734 - RNA, 21 nt, Staphylococcus aureus subsp. aureus N315
uuaaagagcaauuaaagucaa

SEQ ID NO: 4051735 - RNA, 18 nt, Staphylococcus aureus subsp. aureus N315
uuaaagauggcugcauca

SEQ ID NO: 4051736 - RNA, 19 nt, Staphylococcus aureus subsp. aureus N315
uuaaagauggcugcaucaa

SEQ ID NO: 4051737 - RNA, 20 nt, Staphylococcus aureus subsp. aureus N315
uuaaagaugucgaaaaguau

SEQ ID NO: 4051738 - RNA, 15 nt, Staphylococcus aureus subsp. aureus N315
uuaaagauuaaaaua

SEQ ID NO: 4051739 - RNA, 18 nt, Staphylococcus aureus subsp. aureus N315
uuaaagauuuacccauua

SEQ ID NO: 4051740 - RNA, 15 nt, Staphylococcus aureus subsp. aureus N315
uuaaagcaucuucaa

SEQ ID NO: 4051741 - RNA, 22 nt, Staphylococcus aureus subsp. aureus N315
uuaaagcuaguaaugccauuaa

SEQ ID NO: 4051742 - RNA, 17 nt, Staphylococcus aureus subsp. aureus N315
uuaaagcuaucuucaga

SEQ ID NO: 4051743 - RNA, 24 nt, Staphylococcus aureus subsp. aureus N315
uuaaaggaaaucaauccaucaaua

SEQ ID NO: 4051744 - RNA, 15 nt, Staphylococcus aureus subsp. aureus N315
uuaaagguuaaauau

SEQ ID NO: 4051745 - RNA, 22 nt, Staphylococcus aureus subsp. aureus N315
uuaaaguaaaauauacuugaag

SEQ ID NO: 4051746 - RNA, 17 nt, Staphylococcus aureus subsp. aureus N315
uuaaaguagaaccuaua

SEQ ID NO: 4051747 - RNA, 22 nt, Staphylococcus aureus subsp. aureus N315
uuaaaguagaaccuauauuaag

SEQ ID NO: 4051748 - RNA, 22 nt, Staphylococcus aureus subsp. aureus N315
uuaaagucuguugguuuaucag

SEQ ID NO: 4051749 - RNA, 18 nt, Staphylococcus aureus subsp. aureus N315
cuaauuugcaaaaucaac

SEQ ID NO: 4051750 - RNA, 18 nt, Staphylococcus aureus subsp. aureus N315
cuaauuuuaauuuucaga

SEQ ID NO: 4051751 - RNA, 20 nt, Staphylococcus aureus subsp. aureus N315
cuaauuuugugaauuuauuu

SEQ ID NO: 4051752 - RNA, 19 nt, Staphylococcus aureus subsp. aureus N315
cuacaauauuaaaauuaaa

SEQ ID NO: 4051753 - RNA, 13 nt, Staphylococcus aureus subsp. aureus N315
cuacaauccuaug

SEQ ID NO: 4051754 - RNA, 15 nt, Staphylococcus aureus subsp. aureus N315
cuacaauuaaaguga

SEQ ID NO: 4051755 - RNA, 21 nt, Staphylococcus aureus subsp. aureus N315
cuacaauuauaaaugauuaaa

SEQ ID NO: 4051756 - RNA, 18 nt, Staphylococcus aureus subsp. aureus N315
cuacaauucauaagaaaa

SEQ ID NO: 4051757 - RNA, 22 nt, Staphylococcus aureus subsp. aureus N315
cuacaauuuuccuuccaauaau

SEQ ID NO: 4051758 - RNA, 12 nt, Staphylococcus aureus subsp. aureus N315
cuacacccauuu

SEQ ID NO: 4051759 - RNA, 19 nt, Staphylococcus aureus subsp. aureus N315
cuacacgaguauuaucaca

SEQ ID NO: 4051760 - RNA, 17 nt, Staphylococcus aureus subsp. aureus N315
cuacacuccccuuauca

SEQ ID NO: 4051761 - RNA, 23 nt, Staphylococcus aureus subsp. aureus N315
cuacagaauggauaccuaaagcu

SEQ ID NO: 4051762 - RNA, 15 nt, Staphylococcus aureus subsp. aureus N315
cuacagagaaucaau

SEQ ID NO: 4051763 - RNA, 23 nt, Staphylococcus aureus subsp. aureus N315
cuacagcacugaaaucuagaccu

SEQ ID NO: 4051764 - RNA, 17 nt, Staphylococcus aureus subsp. aureus N315
cuacagguaaugcaagu

SEQ ID NO: 4051765 - RNA, 19 nt, Staphylococcus aureus subsp. aureus N315
cuacauaauuuaucaauuu

SEQ ID NO: 4051766 - RNA, 23 nt, Staphylococcus aureus subsp. aureus N315
cuacauaauuuaucaauuucuau

SEQ ID NO: 4051767 - RNA, 22 nt, Staphylococcus aureus subsp. aureus N315
cuacauacaacucguuuuucca

SEQ ID NO: 4051768 - RNA, 14 nt, Staphylococcus aureus subsp. aureus N315
cuacccuauuuuac

SEQ ID NO: 4051769 - RNA, 22 nt, Staphylococcus aureus subsp. aureus N315
cuaccgauuguuaauuuaaagu

SEQ ID NO: 4051770 - RNA, 14 nt, Staphylococcus aureus subsp. aureus N315
cuaccgcuaaaauu

SEQ ID NO: 4051771 - RNA, 21 nt, Staphylococcus aureus subsp. aureus N315
cuaccuacuuguucaauacuu

SEQ ID NO: 4051772 - RNA, 15 nt, Staphylococcus aureus subsp. aureus N315
cuaccuguuggcuuu

SEQ ID NO: 4051773 - RNA, 16 nt, Staphylococcus aureus subsp. aureus N315
cuacgaaguuauauug

SEQ ID NO: 4051774 - RNA, 19 nt, Staphylococcus aureus subsp. aureus N315
cuacuaaaaaugcuuuaac

SEQ ID NO: 4051775 - RNA, 15 nt, Staphylococcus aureus subsp. aureus N315
cuacuauuaaauaau

SEQ ID NO: 4051776 - RNA, 16 nt, Staphylococcus aureus subsp. aureus N315
cuacuauuuaaucuua

SEQ ID NO: 4051777 - RNA, 14 nt, Staphylococcus aureus subsp. aureus N315
cuacugcuugugug

SEQ ID NO: 4051778 - RNA, 18 nt, Staphylococcus aureus subsp. aureus N315
cuacugucucaucuucua

SEQ ID NO: 4051779 - RNA, 21 nt, Staphylococcus aureus subsp. aureus N315
cuacuugauucuacuucaccu

SEQ ID NO: 4051780 - RNA, 20 nt, Staphylococcus aureus subsp. aureus N315
cuacuuuauaaauaucuuuu

SEQ ID NO: 4051781 - RNA, 21 nt, Staphylococcus aureus subsp. aureus N315
cuacuuugauauguuuccucu

SEQ ID NO: 4051782 - RNA, 18 nt, Staphylococcus aureus subsp. aureus N315
cuacuuugucugcaauuu

SEQ ID NO: 4051783 - RNA, 17 nt, Staphylococcus aureus subsp. aureus N315
cuacuuuuucaacugua

SEQ ID NO: 4051784 - RNA, 15 nt, Staphylococcus aureus subsp. aureus N315
cuacuuuuucaucuu

SEQ ID NO: 4051785 - RNA, 19 nt, Staphylococcus aureus subsp. aureus N315
cuagaaaacauaaauacaa

SEQ ID NO: 4051786 - RNA, 22 nt, Staphylococcus aureus subsp. aureus N315
cuagaaaacauaaauacaaaaa

SEQ ID NO: 4051787 - RNA, 14 nt, Staphylococcus aureus subsp. aureus N315
cuagaaaguaaugc

SEQ ID NO: 4051788 - RNA, 21 nt, Staphylococcus aureus subsp. aureus N315
cuagaaaguaaugcuguacua

SEQ ID NO: 4051789 - RNA, 19 nt, Staphylococcus aureus subsp. aureus N315
cuagagcguuuugcuuuag

SEQ ID NO: 4051790 - RNA, 17 nt, Staphylococcus aureus subsp. aureus N315
cuagauaccaaacugcc

SEQ ID NO: 4051791 - RNA, 16 nt, Staphylococcus aureus subsp. aureus N315
cuagauuuuaaacgcu

SEQ ID NO: 4051792 - RNA, 16 nt, Staphylococcus aureus subsp. aureus N315
cuagauuuuaaaucaa

SEQ ID NO: 4051793 - RNA, 22 nt, Staphylococcus aureus subsp. aureus N315
cuagcaaaaauacuuuuugaug

SEQ ID NO: 4051794 - RNA, 12 nt, Staphylococcus aureus subsp. aureus N315
cuagcaaaugca

SEQ ID NO: 4051795 - RNA, 17 nt, Staphylococcus aureus subsp. aureus N315
cuagcauaucuuuauca

SEQ ID NO: 4051796 - RNA, 14 nt, Staphylococcus aureus subsp. aureus N315
cuagccugaaauag

SEQ ID NO: 4051797 - RNA, 18 nt, Staphylococcus aureus subsp. aureus N315
cuagcggaacguaaguuu

SEQ ID NO: 4051798 - RNA, 20 nt, Staphylococcus aureus subsp. aureus N315
cuagcuacaaagucauuuuc

SEQ ID NO: 4051799 - RNA, 17 nt, Staphylococcus aureus subsp. aureus N315
cuaggaaauaaaaaaua

SEQ ID NO: 4051800 - RNA, 17 nt, Staphylococcus aureus subsp. aureus N315
cuaggauguucaucaac

SEQ ID NO: 4051801 - RNA, 14 nt, Staphylococcus aureus subsp. aureus N315
cuaggguuaaaauu

SEQ ID NO: 4051802 - RNA, 17 nt, Staphylococcus aureus subsp. aureus N315
cuagguuagaauuauuu

SEQ ID NO: 4051803 - RNA, 14 nt, Staphylococcus aureus subsp. aureus N315
cuaguagcuugaau

SEQ ID NO: 4051804 - RNA, 16 nt, Staphylococcus aureus subsp. aureus N315
cuagucuuuaacuuua

SEQ ID NO: 4051805 - RNA, 18 nt, Staphylococcus aureus subsp. aureus N315
cuaguguucucauuauaa

SEQ ID NO: 4051806 - RNA, 15 nt, Staphylococcus aureus subsp. aureus N315
cuaguuauuucauag

SEQ ID NO: 4051807 - RNA, 15 nt, Staphylococcus aureus subsp. aureus N315
cuaguucagcuucua

SEQ ID NO: 4051808 - RNA, 16 nt, Staphylococcus aureus subsp. aureus N315
cuaguucgauuuuuua

SEQ ID NO: 4051809 - RNA, 21 nt, Staphylococcus aureus subsp. aureus N315
cuaguucuaaguguugaccau

SEQ ID NO: 4051810 - RNA, 12 nt, Staphylococcus aureus subsp. aureus N315
cuaguuguuuua

SEQ ID NO: 4051811 - RNA, 15 nt, Staphylococcus aureus subsp. aureus N315
cuaguuguuuuauag

SEQ ID NO: 4051812 - RNA, 22 nt, Staphylococcus aureus subsp. aureus N315
cuaguuguuuuauagcauuucu

SEQ ID NO: 4051813 - RNA, 16 nt, Staphylococcus aureus subsp. aureus N315
cuaguuuuuuuuauau

SEQ ID NO: 4051814 - RNA, 19 nt, Staphylococcus aureus subsp. aureus N315
cuauaaaaauuuauucaaa

SEQ ID NO: 4051815 - RNA, 17 nt, Staphylococcus aureus subsp. aureus N315
cuauaaaaguacuuuaa

SEQ ID NO: 4051816 - RNA, 11 nt, Staphylococcus aureus subsp. aureus N315
cuauaaacaua

SEQ ID NO: 4051817 - RNA, 23 nt, Staphylococcus aureus subsp. aureus N315
cuauaaagaaugauuuauaaaaa

SEQ ID NO: 4051818 - RNA, 16 nt, Staphylococcus aureus subsp. aureus N315
cuauaaauacaaauau

SEQ ID NO: 4051819 - RNA, 21 nt, Staphylococcus aureus subsp. aureus N315
cuauaaauacgucaucuuuau

SEQ ID NO: 4051820 - RNA, 23 nt, Staphylococcus aureus subsp. aureus N315
cuauaaauacgucaucuuuauuu

SEQ ID NO: 4051821 - RNA, 16 nt, Staphylococcus aureus subsp. aureus N315
cuauaacaccaauuaa

SEQ ID NO: 4051822 - RNA, 16 nt, Staphylococcus aureus subsp. aureus N315
cuauaaccuauuaaau

SEQ ID NO: 4051823 - RNA, 19 nt, Staphylococcus aureus subsp. aureus N315
cuauaacucuaaauauaau

SEQ ID NO: 4051824 - RNA, 17 nt, Staphylococcus aureus subsp. aureus N315
cuauaaucauuaaguaa

SEQ ID NO: 4051825 - RNA, 20 nt, Staphylococcus aureus subsp. aureus N315
cuauaauuggcagauagaau

SEQ ID NO: 4051826 - RNA, 19 nt, Staphylococcus aureus subsp. aureus N315
cuauacaaucauaaagugc

SEQ ID NO: 4051827 - RNA, 15 nt, Staphylococcus aureus subsp. aureus N315
cuauacaaucauuua

SEQ ID NO: 4051828 - RNA, 17 nt, Staphylococcus aureus subsp. aureus N315
cuauaccauuccaaaaa

SEQ ID NO: 4051829 - RNA, 21 nt, Staphylococcus aureus subsp. aureus N315
cuauaccauuccaaaaauugu

SEQ ID NO: 4051830 - RNA, 13 nt, Staphylococcus aureus subsp. aureus N315
cuauaccauuuuu

SEQ ID NO: 4051831 - RNA, 18 nt, Staphylococcus aureus subsp. aureus N315
cuauacuccaguuuauaa

SEQ ID NO: 4051832 - RNA, 14 nt, Staphylococcus aureus subsp. aureus N315
cuauacuuuuaauu

SEQ ID NO: 4051833 - RNA, 11 nt, Staphylococcus aureus subsp. aureus N315
cuauagaaaaa

SEQ ID NO: 4051834 - RNA, 16 nt, Staphylococcus aureus subsp. aureus N315
cuauagaauuuuucau

SEQ ID NO: 4051835 - RNA, 19 nt, Staphylococcus aureus subsp. aureus N315
cuauagauaggauauuuuu

SEQ ID NO: 4051836 - RNA, 17 nt, Staphylococcus aureus subsp. aureus N315
cuauagguuuauaaaaa

SEQ ID NO: 4051837 - RNA, 19 nt, Staphylococcus aureus subsp. aureus N315
cuauagguuuauaaaaaau

SEQ ID NO: 4051838 - RNA, 16 nt, Staphylococcus aureus subsp. aureus N315
cuauagucauucauaa

SEQ ID NO: 4051839 - RNA, 13 nt, Staphylococcus aureus subsp. aureus N315
cuauauaaaguug

SEQ ID NO: 4051840 - RNA, 17 nt, Staphylococcus aureus subsp. aureus N315
cuauauaaaguugacaa

SEQ ID NO: 4051841 - RNA, 23 nt, Staphylococcus aureus subsp. aureus N315
cuauauaaauguuuauaucuuuu

SEQ ID NO: 4051842 - RNA, 14 nt, Staphylococcus aureus subsp. aureus N315
cuauauaauuuauu

SEQ ID NO: 4051843 - RNA, 18 nt, Staphylococcus aureus subsp. aureus N315
cuauauaguaaaauaaau

SEQ ID NO: 4051844 - RNA, 19 nt, Staphylococcus aureus subsp. aureus N315
cuauauaugaauugaguau

SEQ ID NO: 4051845 - RNA, 13 nt, Staphylococcus aureus subsp. aureus N315
cuauaugaaaaga

SEQ ID NO: 4051846 - RNA, 11 nt, Staphylococcus aureus subsp. aureus N315
cuauaugcaua

SEQ ID NO: 4051847 - RNA, 13 nt, Staphylococcus aureus subsp. aureus N315
cuauauuuauuag

SEQ ID NO: 4051848 - RNA, 22 nt, Staphylococcus aureus subsp. aureus N315
cuauauuucgguauuuuaaauu

SEQ ID NO: 4051849 - RNA, 12 nt, Staphylococcus aureus subsp. aureus N315
cuaucaaauaau

SEQ ID NO: 4051850 - RNA, 18 nt, Staphylococcus aureus subsp. aureus N315
cuaucaauauaauuuggu

SEQ ID NO: 4051851 - RNA, 17 nt, Staphylococcus aureus subsp. aureus N315
cuaucccuguaaaacca

SEQ ID NO: 4051852 - RNA, 16 nt, Staphylococcus aureus subsp. aureus N315
cuaucgccuaaaaaua

SEQ ID NO: 4051853 - RNA, 18 nt, Staphylococcus aureus subsp. aureus N315
cuaucgccuaaaaauaaa

SEQ ID NO: 4051854 - RNA, 21 nt, Staphylococcus aureus subsp. aureus N315
cuaucgccuaaaaauaaaauc

SEQ ID NO: 4051855 - RNA, 15 nt, Staphylococcus aureus subsp. aureus N315
cuaucuacaccauua

SEQ ID NO: 4051856 - RNA, 14 nt, Staphylococcus aureus subsp. aureus N315
cuaucuauaaacgu

SEQ ID NO: 4051857 - RNA, 16 nt, Staphylococcus aureus subsp. aureus N315
cuaucuauaaacguca

SEQ ID NO: 4051858 - RNA, 22 nt, Staphylococcus aureus subsp. aureus N315
cuaucuccgcuacaauuauaug

SEQ ID NO: 4051859 - RNA, 24 nt, Staphylococcus aureus subsp. aureus N315
cuaucuccgcuacaauuauaugua

SEQ ID NO: 4051860 - RNA, 20 nt, Staphylococcus aureus subsp. aureus N315
cuaucucuuuaguuaaaagu

SEQ ID NO: 4051861 - RNA, 19 nt, Staphylococcus aureus subsp. aureus N315
cuaugaagaaaucuauaac

SEQ ID NO: 4051862 - RNA, 11 nt, Staphylococcus aureus subsp. aureus N315
cuaugauauau

SEQ ID NO: 4051863 - RNA, 23 nt, Staphylococcus aureus subsp. aureus N315
cuaugaugcuucuaacugaauua

SEQ ID NO: 4051864 - RNA, 16 nt, Staphylococcus aureus subsp. aureus N315
cuaugcauaauaccaa

SEQ ID NO: 4051865 - RNA, 23 nt, Staphylococcus aureus subsp. aureus N315
cuaugcuuagcgaacgcuagcau

SEQ ID NO: 4051866 - RNA, 16 nt, Staphylococcus aureus subsp. aureus N315
cuauggcacaaaugaa

SEQ ID NO: 4051867 - RNA, 16 nt, Staphylococcus aureus subsp. aureus N315
cuauguaaaauuauug

SEQ ID NO: 4051868 - RNA, 12 nt, Staphylococcus aureus subsp. aureus N315
cuauguaacuuu

SEQ ID NO: 4051869 - RNA, 13 nt, Staphylococcus aureus subsp. aureus N315
cuauguaacuuua

SEQ ID NO: 4051870 - RNA, 12 nt, Staphylococcus aureus subsp. aureus N315
cuauguggcuac

SEQ ID NO: 4051871 - RNA, 17 nt, Staphylococcus aureus subsp. aureus N315
cuauguguugcaccgac

SEQ ID NO: 4051872 - RNA, 22 nt, Staphylococcus aureus subsp. aureus N315
cuauuaaacuuccuuuuuuuau

SEQ ID NO: 4051873 - RNA, 21 nt, Staphylococcus aureus subsp. aureus N315
cuauuaaaggaaaucaaucca

SEQ ID NO: 4051874 - RNA, 12 nt, Staphylococcus aureus subsp. aureus N315
cuauuaaauaau

SEQ ID NO: 4051875 - RNA, 20 nt, Staphylococcus aureus subsp. aureus N315
cuauuaacugaccuaacaau

SEQ ID NO: 4051876 - RNA, 20 nt, Staphylococcus aureus subsp. aureus N315
cuauuaauaucauaguuguc

SEQ ID NO: 4051877 - RNA, 19 nt, Staphylococcus aureus subsp. aureus N315
cuauuaauuacgucauaaa

SEQ ID NO: 4051878 - RNA, 18 nt, Staphylococcus aureus subsp. aureus N315
cuauuaggauccaauuca

SEQ ID NO: 4051879 - RNA, 11 nt, Staphylococcus aureus subsp. aureus N315
cuauucaacug

SEQ ID NO: 4051880 - RNA, 19 nt, Staphylococcus aureus subsp. aureus N315
cuauucauagaccuaugaa

SEQ ID NO: 4051881 - RNA, 17 nt, Staphylococcus aureus subsp. aureus N315
cuauugauauucuaaaa

SEQ ID NO: 4051882 - RNA, 19 nt, Staphylococcus aureus subsp. aureus N315
cuauugauauucuaaaaaa

SEQ ID NO: 4051883 - RNA, 14 nt, Staphylococcus aureus subsp. aureus N315
cuauuguaagcuga

SEQ ID NO: 4051884 - RNA, 17 nt, Staphylococcus aureus subsp. aureus N315
cuauuuauugagauaga

SEQ ID NO: 4051885 - RNA, 17 nt, Staphylococcus aureus subsp. aureus N315
cuauuucacucuacaau

SEQ ID NO: 4051886 - RNA, 23 nt, Staphylococcus aureus subsp. aureus N315
cuauuuuauaaaauauauuuaau

SEQ ID NO: 4051887 - RNA, 14 nt, Staphylococcus aureus subsp. aureus N315
cuauuuuuaaugua

SEQ ID NO: 4051888 - RNA, 18 nt, Staphylococcus aureus subsp. aureus N315
cuauuuuucgauuuugag

SEQ ID NO: 4051889 - RNA, 19 nt, Staphylococcus aureus subsp. aureus N315
cuauuuuuuauguuuuaau

SEQ ID NO: 4051890 - RNA, 15 nt, Staphylococcus aureus subsp. aureus N315
cucaaaacaauuuaa

SEQ ID NO: 4051891 - RNA, 18 nt, Staphylococcus aureus subsp. aureus N315
cucaaagaaacuauagau

SEQ ID NO: 4051892 - RNA, 18 nt, Staphylococcus aureus subsp. aureus N315
cucaaagguuuacuauua

SEQ ID NO: 4051893 - RNA, 19 nt, Staphylococcus aureus subsp. aureus N315
cucaaagguuuacuauuaa

SEQ ID NO: 4051894 - RNA, 18 nt, Staphylococcus aureus subsp. aureus N315
cucaacagcaaaaaauaa

SEQ ID NO: 4051895 - RNA, 17 nt, Staphylococcus aureus subsp. aureus N315
cucaacauuaaaaugug

SEQ ID NO: 4051896 - RNA, 12 nt, Staphylococcus aureus subsp. aureus N315
cucaacauuuuu

SEQ ID NO: 4051897 - RNA, 13 nt, Staphylococcus aureus subsp. aureus N315
cucaacauuuuuu

SEQ ID NO: 4051898 - RNA, 14 nt, Staphylococcus aureus subsp. aureus N315
cucaacauuuuuuc

SEQ ID NO: 4051899 - RNA, 17 nt, Staphylococcus aureus subsp. aureus N315
cucaacuugccuggcaa

SEQ ID NO: 4051900 - RNA, 18 nt, Staphylococcus aureus subsp. aureus N315
cucaaguaacucaaguga

SEQ ID NO: 4051901 - RNA, 16 nt, Staphylococcus aureus subsp. aureus N315
cucaagugauuuccca

SEQ ID NO: 4051902 - RNA, 15 nt, Staphylococcus aureus subsp. aureus N315
cucaauaucuuuaau

SEQ ID NO: 4051903 - RNA, 16 nt, Staphylococcus aureus subsp. aureus N315
cucaauaucuuuaauu

SEQ ID NO: 4051904 - RNA, 15 nt, Staphylococcus aureus subsp. aureus N315
cucaaugaauuuacu

SEQ ID NO: 4051905 - RNA, 22 nt, Staphylococcus aureus subsp. aureus N315
cucaauuaauuuagucauuaca

SEQ ID NO: 4051906 - RNA, 18 nt, Staphylococcus aureus subsp. aureus N315
cucaauucucuaacuuua

SEQ ID NO: 4051907 - RNA, 14 nt, Staphylococcus aureus subsp. aureus N315
cucaauuuaguaua

SEQ ID NO: 4051908 - RNA, 19 nt, Staphylococcus aureus subsp. aureus N315
cucaauuuaguauaaauaa

SEQ ID NO: 4051909 - RNA, 24 nt, Staphylococcus aureus subsp. aureus N315
cucaauuucauuugaaauaguuaa

SEQ ID NO: 4051910 - RNA, 16 nt, Staphylococcus aureus subsp. aureus N315
cucaccuuuaucauua

SEQ ID NO: 4051911 - RNA, 15 nt, Staphylococcus aureus subsp. aureus N315
cucagccucuuuuua

SEQ ID NO: 4051912 - RNA, 22 nt, Staphylococcus aureus subsp. aureus N315
cucagccucuuuuuacauugcc

SEQ ID NO: 4051913 - RNA, 20 nt, Staphylococcus aureus subsp. aureus N315
cucagguauaggugcaguua

SEQ ID NO: 4051914 - RNA, 17 nt, Staphylococcus aureus subsp. aureus N315
cucaguguugggggcca

SEQ ID NO: 4051915 - RNA, 18 nt, Staphylococcus aureus subsp. aureus N315
cucauaaccgcuucuuuu

SEQ ID NO: 4051916 - RNA, 10 nt, Staphylococcus aureus subsp. aureus N315
cucauaauaa

SEQ ID NO: 4051917 - RNA, 12 nt, Staphylococcus aureus subsp. aureus N315
cucauaauaauu

SEQ ID NO: 4051918 - RNA, 14 nt, Staphylococcus aureus subsp. aureus N315
cucauaaucaaguc

SEQ ID NO: 4051919 - RNA, 14 nt, Staphylococcus aureus subsp. aureus N315
cucauaauuaucau

SEQ ID NO: 4051920 - RNA, 19 nt, Staphylococcus aureus subsp. aureus N315
cucauaauuaucauauaaa

SEQ ID NO: 4051921 - RNA, 18 nt, Staphylococcus aureus subsp. aureus N315
cucauaccaaaaacauua

SEQ ID NO: 4051922 - RNA, 15 nt, Staphylococcus aureus subsp. aureus N315
cucauagucaucuua

SEQ ID NO: 4051923 - RNA, 11 nt, Staphylococcus aureus subsp. aureus N315
cucaucauuua

SEQ ID NO: 4051924 - RNA, 15 nt, Staphylococcus aureus subsp. aureus N315
cucaucauuuaaaau

SEQ ID NO: 4051925 - RNA, 18 nt, Staphylococcus aureus subsp. aureus N315
cucaucccucuaucaaau

SEQ ID NO: 4051926 - RNA, 20 nt, Staphylococcus aureus subsp. aureus N315
cucauccgccaauuaaaauu

SEQ ID NO: 4051927 - RNA, 17 nt, Staphylococcus aureus subsp. aureus N315
cucaucgaauucauuug

SEQ ID NO: 4051928 - RNA, 20 nt, Staphylococcus aureus subsp. aureus N315
cucaucgaguuuguuucuaa

SEQ ID NO: 4051929 - RNA, 21 nt, Staphylococcus aureus subsp. aureus N315
cucaucuguccgauaucuuuu

SEQ ID NO: 4051930 - RNA, 17 nt, Staphylococcus aureus subsp. aureus N315
cucaucuucuaaaucaa

SEQ ID NO: 4051931 - RNA, 18 nt, Staphylococcus aureus subsp. aureus N315
cucaugagcacaaacuaa

SEQ ID NO: 4051932 - RNA, 19 nt, Staphylococcus aureus subsp. aureus N315
cucaugcugaaauguagac

SEQ ID NO: 4051933 - RNA, 14 nt, Staphylococcus aureus subsp. aureus N315
cucauguuucagua

SEQ ID NO: 4051934 - RNA, 20 nt, Staphylococcus aureus subsp. aureus N315
cucauuagcgaaaacuaaag

SEQ ID NO: 4051935 - RNA, 20 nt, Staphylococcus aureus subsp. aureus N315
cucauuauaaugauuuuuau

SEQ ID NO: 4051936 - RNA, 16 nt, Staphylococcus aureus subsp. aureus N315
cucauugugcuugaua

SEQ ID NO: 4051937 - RNA, 13 nt, Staphylococcus aureus subsp. aureus N315
cucauuuauaaac

SEQ ID NO: 4051938 - RNA, 17 nt, Staphylococcus aureus subsp. aureus N315
cucauuuauaaacauug

SEQ ID NO: 4051939 - RNA, 14 nt, Staphylococcus aureus subsp. aureus N315
cucauuuuuuuaau

SEQ ID NO: 4051940 - RNA, 22 nt, Staphylococcus aureus subsp. aureus N315
cucauuuuuuuaauuauuuccc

SEQ ID NO: 4051941 - RNA, 23 nt, Staphylococcus aureus subsp. aureus N315
cucauuuuuuuaauuauuucccu

SEQ ID NO: 4051942 - RNA, 17 nt, Staphylococcus aureus subsp. aureus N315
cuccaaaaauaauuaaa

SEQ ID NO: 4051943 - RNA, 20 nt, Staphylococcus aureus subsp. aureus N315
cuccaaaaauaauuaaaucc

SEQ ID NO: 4051944 - RNA, 12 nt, Staphylococcus aureus subsp. aureus N315
cuccaaauauug

SEQ ID NO: 4051945 - RNA, 22 nt, Staphylococcus aureus subsp. aureus N315
cuccaagauuaugacaacauaa

SEQ ID NO: 4051946 - RNA, 18 nt, Staphylococcus aureus subsp. aureus N315
cuccaccaccugcaauuu

SEQ ID NO: 4051947 - RNA, 16 nt, Staphylococcus aureus subsp. aureus N315
cucccuuuuaucuuua

SEQ ID NO: 4051948 - RNA, 14 nt, Staphylococcus aureus subsp. aureus N315
cuccgaucaugccu

SEQ ID NO: 4051949 - RNA, 15 nt, Staphylococcus aureus subsp. aureus N315
cuccgaucaugccuu

SEQ ID NO: 4051950 - RNA, 19 nt, Staphylococcus aureus subsp. aureus N315
cuccguauuuaccuucuuc

SEQ ID NO: 4051951 - RNA, 14 nt, Staphylococcus aureus subsp. aureus N315
cuccguuaauuuaa

SEQ ID NO: 4051952 - RNA, 18 nt, Staphylococcus aureus subsp. aureus N315
cuccuaaagcugcaauua

SEQ ID NO: 4051953 - RNA, 23 nt, Staphylococcus aureus subsp. aureus N315
cuccuaaagcugcaauuaugcca

SEQ ID NO: 4051954 - RNA, 20 nt, Staphylococcus aureus subsp. aureus N315
cuccuaccgcuaaaauucuu

SEQ ID NO: 4051955 - RNA, 13 nt, Staphylococcus aureus subsp. aureus N315
cuccucuauuuua

SEQ ID NO: 4051956 - RNA, 15 nt, Staphylococcus aureus subsp. aureus N315
cuccucuauuuuaug

SEQ ID NO: 4051957 - RNA, 12 nt, Staphylococcus aureus subsp. aureus N315
cuccuuacaaua

SEQ ID NO: 4051958 - RNA, 23 nt, Staphylococcus aureus subsp. aureus N315
cucgaaaauaaaacaaauuauua

SEQ ID NO: 4051959 - RNA, 15 nt, Staphylococcus aureus subsp. aureus N315
cucgaagucagcgau

SEQ ID NO: 4051960 - RNA, 21 nt, Staphylococcus aureus subsp. aureus N315
cucgacuucagauacauuauc

SEQ ID NO: 4051961 - RNA, 21 nt, Staphylococcus aureus subsp. aureus N315
cucgauacaaaggauuauuaa

SEQ ID NO: 4051962 - RNA, 15 nt, Staphylococcus aureus subsp. aureus N315
cucgauauaugucuc

SEQ ID NO: 4051963 - RNA, 12 nt, Staphylococcus aureus subsp. aureus N315
cucgcuuacuca

SEQ ID NO: 4051964 - RNA, 23 nt, Staphylococcus aureus subsp. aureus N315
cucgguuuuuucgguuuauuuaa

SEQ ID NO: 4051965 - RNA, 18 nt, Staphylococcus aureus subsp. aureus N315
cucguaaauuuuaucuaa

SEQ ID NO: 4051966 - RNA, 12 nt, Staphylococcus aureus subsp. aureus N315
cucguaauaaug

SEQ ID NO: 4051967 - RNA, 15 nt, Staphylococcus aureus subsp. aureus N315
cucguuuuuccaugu

SEQ ID NO: 4051968 - RNA, 15 nt, Staphylococcus aureus subsp. aureus N315
cucuaaaacuuuuuc

SEQ ID NO: 4051969 - RNA, 15 nt, Staphylococcus aureus subsp. aureus N315
cucuaaauaauuucu

SEQ ID NO: 4051970 - RNA, 16 nt, Staphylococcus aureus subsp. aureus N315
cucuaaauauaauaga

SEQ ID NO: 4051971 - RNA, 23 nt, Staphylococcus aureus subsp. aureus N315
cucuaacauuuucuuauuugauu

SEQ ID NO: 4051972 - RNA, 18 nt, Staphylococcus aureus subsp. aureus N315
cucuaacguuaacaauau

SEQ ID NO: 4051973 - RNA, 20 nt, Staphylococcus aureus subsp. aureus N315
cucuaaugauuaaaaaucaa

SEQ ID NO: 4051974 - RNA, 22 nt, Staphylococcus aureus subsp. aureus N315
cucuaauucaaugauuuuuaaa

SEQ ID NO: 4051975 - RNA, 19 nt, Staphylococcus aureus subsp. aureus N315
cucuaucaaauuaccauuc

SEQ ID NO: 4051976 - RNA, 16 nt, Staphylococcus aureus subsp. aureus N315
cucuauuaauuuacuc

SEQ ID NO: 4051977 - RNA, 17 nt, Staphylococcus aureus subsp. aureus N315
cucuauuuauaacacuu

SEQ ID NO: 4051978 - RNA, 17 nt, Staphylococcus aureus subsp. aureus N315
cucuauuuuuuauguuu

SEQ ID NO: 4051979 - RNA, 16 nt, Staphylococcus aureus subsp. aureus N315
cucucaacauuuugau

SEQ ID NO: 4051980 - RNA, 12 nt, Staphylococcus aureus subsp. aureus N315
cucucguaaauu

SEQ ID NO: 4051981 - RNA, 20 nt, Staphylococcus aureus subsp. aureus N315
cucugaaaaacuucuuaacu

SEQ ID NO: 4051982 - RNA, 19 nt, Staphylococcus aureus subsp. aureus N315
cucugauacuucaccaucu

SEQ ID NO: 4051983 - RNA, 12 nt, Staphylococcus aureus subsp. aureus N315
cucugaucuaaa

SEQ ID NO: 4051984 - RNA, 22 nt, Staphylococcus aureus subsp. aureus N315
cucugcgauuucuaaagcgauu

SEQ ID NO: 4051985 - RNA, 21 nt, Staphylococcus aureus subsp. aureus N315
cucuggauuuuucuuauaaaa

SEQ ID NO: 4051986 - RNA, 19 nt, Staphylococcus aureus subsp. aureus N315
cucuguauugaggcccgac

SEQ ID NO: 4051987 - RNA, 14 nt, Staphylococcus aureus subsp. aureus N315
cucuguuuaacagg

SEQ ID NO: 4051988 - RNA, 23 nt, Staphylococcus aureus subsp. aureus N315
cucuuaaaucacuagcuaaugca

SEQ ID NO: 4051989 - RNA, 16 nt, Staphylococcus aureus subsp. aureus N315
cucuucaaaguagaua

SEQ ID NO: 4051990 - RNA, 21 nt, Staphylococcus aureus subsp. aureus N315
cucuucaaaguagauauugaa

SEQ ID NO: 4051991 - RNA, 16 nt, Staphylococcus aureus subsp. aureus N315
cucuucaaucuaccaa

SEQ ID NO: 4051992 - RNA, 22 nt, Staphylococcus aureus subsp. aureus N315
cucuucaaucuaccaauacguu

SEQ ID NO: 4051993 - RNA, 23 nt, Staphylococcus aureus subsp. aureus N315
cucuucaguacgaacaacuaaca

SEQ ID NO: 4051994 - RNA, 15 nt, Staphylococcus aureus subsp. aureus N315
cucuugauaaaauaa

SEQ ID NO: 4051995 - RNA, 18 nt, Staphylococcus aureus subsp. aureus N315
cucuugggaauugaccac

SEQ ID NO: 4051996 - RNA, 22 nt, Staphylococcus aureus subsp. aureus N315
cucuuguaccgucuuaucuaaa

SEQ ID NO: 4051997 - RNA, 13 nt, Staphylococcus aureus subsp. aureus N315
cucuuguguuuca

SEQ ID NO: 4051998 - RNA, 12 nt, Staphylococcus aureus subsp. aureus N315
cucuuuaaacuc

SEQ ID NO: 4051999 - RNA, 21 nt, Staphylococcus aureus subsp. aureus N315
cucuuuguuggggcccacacc

SEQ ID NO: 4052000 - RNA, 23 nt, Staphylococcus aureus subsp. aureus N315
cucuuuuaccucugauaaaugaa

SEQ ID NO: 4052001 - RNA, 15 nt, Staphylococcus aureus subsp. aureus N315
cugaaaaacuucuua

SEQ ID NO: 4052002 - RNA, 18 nt, Staphylococcus aureus subsp. aureus N315
cugaaaagaauaaguugu

SEQ ID NO: 4052003 - RNA, 21 nt, Staphylococcus aureus subsp. aureus N315
cugaaacuaaauuaaaagugu

SEQ ID NO: 4052004 - RNA, 17 nt, Staphylococcus aureus subsp. aureus N315
cugaaacuuuaauacua

SEQ ID NO: 4052005 - RNA, 16 nt, Staphylococcus aureus subsp. aureus N315
cugaaaucuagaccuu

SEQ ID NO: 4052006 - RNA, 14 nt, Staphylococcus aureus subsp. aureus N315
cugaaauguagaca

SEQ ID NO: 4052007 - RNA, 19 nt, Staphylococcus aureus subsp. aureus N315
cugaaauuucauaaaguuu

SEQ ID NO: 4052008 - RNA, 14 nt, Staphylococcus aureus subsp. aureus N315
cugaaauuuuuccg

SEQ ID NO: 4052009 - RNA, 20 nt, Staphylococcus aureus subsp. aureus N315
cugaaauuuuuuagugaaaa

SEQ ID NO: 4052010 - RNA, 21 nt, Staphylococcus aureus subsp. aureus N315
cugaacgaaaauucgcuugua

SEQ ID NO: 4052011 - RNA, 17 nt, Staphylococcus aureus subsp. aureus N315
cugaagcgcuuggauuu

SEQ ID NO: 4052012 - RNA, 20 nt, Staphylococcus aureus subsp. aureus N315
cugaaggagacauuucccau

SEQ ID NO: 4052013 - RNA, 14 nt, Staphylococcus aureus subsp. aureus N315
cugaauaaaauaua

SEQ ID NO: 4052014 - RNA, 21 nt, Staphylococcus aureus subsp. aureus N315
cugaaucaguuacugcgcuuu

SEQ ID NO: 4052015 - RNA, 21 nt, Staphylococcus aureus subsp. aureus N315
cugaaucugaagguaauuuaa

SEQ ID NO: 4052016 - RNA, 18 nt, Staphylococcus aureus subsp. aureus N315
cugaaucugcuaauuuau

SEQ ID NO: 4052017 - RNA, 17 nt, Staphylococcus aureus subsp. aureus N315
cugaaugcuaauacuaa

SEQ ID NO: 4052018 - RNA, 23 nt, Staphylococcus aureus subsp. aureus N315
cugaauguucgaagauuuuuuuc

SEQ ID NO: 4052019 - RNA, 18 nt, Staphylococcus aureus subsp. aureus N315
cugaauuaauauccaaaa

SEQ ID NO: 4052020 - RNA, 21 nt, Staphylococcus aureus subsp. aureus N315
cugacauuguugcuaaucuca

SEQ ID NO: 4052021 - RNA, 18 nt, Staphylococcus aureus subsp. aureus N315
cugacauuucaucaauaa

SEQ ID NO: 4052022 - RNA, 17 nt, Staphylococcus aureus subsp. aureus N315
cugacauuuuuggcuua

SEQ ID NO: 4052023 - RNA, 18 nt, Staphylococcus aureus subsp. aureus N315
cugaccuaacaauuugag

SEQ ID NO: 4052024 - RNA, 12 nt, Staphylococcus aureus subsp. aureus N315
cugacuaauaaa

SEQ ID NO: 4052025 - RNA, 18 nt, Staphylococcus aureus subsp. aureus N315
cugagauugagaauucag

SEQ ID NO: 4052026 - RNA, 23 nt, Staphylococcus aureus subsp. aureus N315
cugagcaacaaaagauguugcuc

SEQ ID NO: 4052027 - RNA, 18 nt, Staphylococcus aureus subsp. aureus N315
cugagcuuuaauuuuuug

SEQ ID NO: 4052028 - RNA, 20 nt, Staphylococcus aureus subsp. aureus N315
cugaguauaccaauugcuga

SEQ ID NO: 4052029 - RNA, 13 nt, Staphylococcus aureus subsp. aureus N315
cugaguucaauua

SEQ ID NO: 4052030 - RNA, 15 nt, Staphylococcus aureus subsp. aureus N315
cugauaauucgaaau

SEQ ID NO: 4052031 - RNA, 15 nt, Staphylococcus aureus subsp. aureus N315
cugauaauuuuucuu

SEQ ID NO: 4052032 - RNA, 17 nt, Staphylococcus aureus subsp. aureus N315
cugauacagaaccaaca

SEQ ID NO: 4052033 - RNA, 22 nt, Staphylococcus aureus subsp. aureus N315
cugauauugaucugauuucacu

SEQ ID NO: 4052034 - RNA, 21 nt, Staphylococcus aureus subsp. aureus N315
cugaucauuuucauuuaaucc

SEQ ID NO: 4052035 - RNA, 14 nt, Staphylococcus aureus subsp. aureus N315
cugaucguaacauu

SEQ ID NO: 4052036 - RNA, 15 nt, Staphylococcus aureus subsp. aureus N315
cugaucguaacauua

SEQ ID NO: 4052037 - RNA, 15 nt, Staphylococcus aureus subsp. aureus N315
cugaucuaaaaccau

SEQ ID NO: 4052038 - RNA, 16 nt, Staphylococcus aureus subsp. aureus N315
cugaugaacauaccug

SEQ ID NO: 4052039 - RNA, 22 nt, Staphylococcus aureus subsp. aureus N315
cugaugcuagcuuucuuuuuca

SEQ ID NO: 4052040 - RNA, 23 nt, Staphylococcus aureus subsp. aureus N315
cugaugcuagcuuucuuuuucau

SEQ ID NO: 4052041 - RNA, 22 nt, Staphylococcus aureus subsp. aureus N315
cugaugcuucgaauuuaacauc

SEQ ID NO: 4052042 - RNA, 22 nt, Staphylococcus aureus subsp. aureus N315
cugauguaccacucauaaucaa

SEQ ID NO: 4052043 - RNA, 15 nt, Staphylococcus aureus subsp. aureus N315
cugauguguuauguu

SEQ ID NO: 4052044 - RNA, 21 nt, Staphylococcus aureus subsp. aureus N315
cugauguguuauguuagauga

SEQ ID NO: 4052045 - RNA, 16 nt, Staphylococcus aureus subsp. aureus N315
cugauuaauuauugag

SEQ ID NO: 4052046 - RNA, 13 nt, Staphylococcus aureus subsp. aureus N315
cugauucauuaaa

SEQ ID NO: 4052047 - RNA, 16 nt, Staphylococcus aureus subsp. aureus N315
cugauucuucacuaaa

SEQ ID NO: 4052048 - RNA, 20 nt, Staphylococcus aureus subsp. aureus N315
cugauuuuauaaaguuugua

SEQ ID NO: 4052049 - RNA, 19 nt, Staphylococcus aureus subsp. aureus N315
cugcaaaauguuacacaaa

SEQ ID NO: 4052050 - RNA, 22 nt, Staphylococcus aureus subsp. aureus N315
cugcaaaauguuacacaaauua

SEQ ID NO: 4052051 - RNA, 19 nt, Staphylococcus aureus subsp. aureus N315
cugcaaacacaguacaaau

SEQ ID NO: 4052052 - RNA, 21 nt, Staphylococcus aureus subsp. aureus N315
cugcaaacuugauucaauaua

SEQ ID NO: 4052053 - RNA, 16 nt, Staphylococcus aureus subsp. aureus N315
cugcaaaugccucuuu

SEQ ID NO: 4052054 - RNA, 20 nt, Staphylococcus aureus subsp. aureus N315
cugcaacauuugauaaccaa

SEQ ID NO: 4052055 - RNA, 21 nt, Staphylococcus aureus subsp. aureus N315
cugcaagugcuuccacuucau

SEQ ID NO: 4052056 - RNA, 17 nt, Staphylococcus aureus subsp. aureus N315
cugcaauuauuuuucaa

SEQ ID NO: 4052057 - RNA, 21 nt, Staphylococcus aureus subsp. aureus N315
cugcaauuauuuuucaaauau

SEQ ID NO: 4052058 - RNA, 13 nt, Staphylococcus aureus subsp. aureus N315
cugcaccaagaaa

SEQ ID NO: 4052059 - RNA, 16 nt, Staphylococcus aureus subsp. aureus N315
cugcacuuaugauacu

SEQ ID NO: 4052060 - RNA, 17 nt, Staphylococcus aureus subsp. aureus N315
cugcagcaauuacaccu

SEQ ID NO: 4052061 - RNA, 19 nt, Staphylococcus aureus subsp. aureus N315
cugcauagcgcucuggauu

SEQ ID NO: 4052062 - RNA, 13 nt, Staphylococcus aureus subsp. aureus N315
cugcauauaaagu

SEQ ID NO: 4052063 - RNA, 23 nt, Staphylococcus aureus subsp. aureus N315
cugcauauucacgauauaacauu

SEQ ID NO: 4052064 - RNA, 21 nt, Staphylococcus aureus subsp. aureus N315
cugcaucaauaugaccuuuau

SEQ ID NO: 4052065 - RNA, 18 nt, Staphylococcus aureus subsp. aureus N315
cugcauuacgcugucuca

SEQ ID NO: 4052066 - RNA, 13 nt, Staphylococcus aureus subsp. aureus N315
cugccaaaaagua

SEQ ID NO: 4052067 - RNA, 16 nt, Staphylococcus aureus subsp. aureus N315
cugccaaaaugguuaa

SEQ ID NO: 4052068 - RNA, 15 nt, Staphylococcus aureus subsp. aureus N315
cugccaaaccuuuau

SEQ ID NO: 4052069 - RNA, 14 nt, Staphylococcus aureus subsp. aureus N315
cugccaauauauuc

SEQ ID NO: 4052070 - RNA, 15 nt, Staphylococcus aureus subsp. aureus N315
cugccauuaaacgaa

SEQ ID NO: 4052071 - RNA, 24 nt, Staphylococcus aureus subsp. aureus N315
cugccauucuuuuucucaauguga

SEQ ID NO: 4052072 - RNA, 13 nt, Staphylococcus aureus subsp. aureus N315
cugcuaacucuga

SEQ ID NO: 4052073 - RNA, 15 nt, Staphylococcus aureus subsp. aureus N315
cugcuaauuuuuuca

SEQ ID NO: 4052074 - RNA, 20 nt, Staphylococcus aureus subsp. aureus N315
cugcuaauuuuuucaucauu

SEQ ID NO: 4052075 - RNA, 21 nt, Staphylococcus aureus subsp. aureus N315
cugcuaauuuuuucaucauuc

SEQ ID NO: 4052076 - RNA, 20 nt, Staphylococcus aureus subsp. aureus N315
cugcugguaacucuucagua

SEQ ID NO: 4052077 - RNA, 16 nt, Staphylococcus aureus subsp. aureus N315
cugcuuaucauuacuu

SEQ ID NO: 4052078 - RNA, 16 nt, Staphylococcus aureus subsp. aureus N315
cugcuucgcuaauauc

SEQ ID NO: 4052079 - RNA, 17 nt, Staphylococcus aureus subsp. aureus N315
cugcuucuacccuugca

SEQ ID NO: 4052080 - RNA, 18 nt, Staphylococcus aureus subsp. aureus N315
cugcuucuacccuugcaa

SEQ ID NO: 4052081 - RNA, 14 nt, Staphylococcus aureus subsp. aureus N315
cugcuucugcugua

SEQ ID NO: 4052082 - RNA, 21 nt, Staphylococcus aureus subsp. aureus N315
cugcuucuucagguguuuuac

SEQ ID NO: 4052083 - RNA, 14 nt, Staphylococcus aureus subsp. aureus N315
cugcuuuaacugua

SEQ ID NO: 4052084 - RNA, 16 nt, Staphylococcus aureus subsp. aureus N315
cugcuuuauuuuauca

SEQ ID NO: 4052085 - RNA, 21 nt, Staphylococcus aureus subsp. aureus N315
cugcuuuauuuuaucaucuau

SEQ ID NO: 4052086 - RNA, 20 nt, Staphylococcus aureus subsp. aureus N315
cugcuuuuuauuauuaugug

SEQ ID NO: 4052087 - RNA, 21 nt, Staphylococcus aureus subsp. aureus N315
cuggaaaugauaauuuaauaa

SEQ ID NO: 4052088 - RNA, 18 nt, Staphylococcus aureus subsp. aureus N315
cuggaacuuuaauaccag

SEQ ID NO: 4052089 - RNA, 14 nt, Staphylococcus aureus subsp. aureus N315
cuggaauaccuaac

SEQ ID NO: 4052090 - RNA, 14 nt, Staphylococcus aureus subsp. aureus N315
cuggaauugggaaa

SEQ ID NO: 4052091 - RNA, 20 nt, Staphylococcus aureus subsp. aureus N315
cuggaucgcccauacuaaau

SEQ ID NO: 4052092 - RNA, 21 nt, Staphylococcus aureus subsp. aureus N315
cuggcaaauugccuuucauuu

SEQ ID NO: 4052093 - RNA, 19 nt, Staphylococcus aureus subsp. aureus N315
cuggcaacguucuacucua

SEQ ID NO: 4052094 - RNA, 12 nt, Staphylococcus aureus subsp. aureus N315
cuggcuuuuuaa

SEQ ID NO: 4052095 - RNA, 13 nt, Staphylococcus aureus subsp. aureus N315
cugggacauuaau

SEQ ID NO: 4052096 - RNA, 15 nt, Staphylococcus aureus subsp. aureus N315
cuggggaagaccauu

SEQ ID NO: 4052097 - RNA, 16 nt, Staphylococcus aureus subsp. aureus N315
cugguaauauuuuugu

SEQ ID NO: 4052098 - RNA, 16 nt, Staphylococcus aureus subsp. aureus N315
cugguacuacuaucca

SEQ ID NO: 4052099 - RNA, 22 nt, Staphylococcus aureus subsp. aureus N315
cuggugcaggcaucauaucaua

SEQ ID NO: 4052100 - RNA, 20 nt, Staphylococcus aureus subsp. aureus N315
cuguaaaaccauagauaauu

SEQ ID NO: 4052101 - RNA, 13 nt, Staphylococcus aureus subsp. aureus N315
cuguaaaauucua

SEQ ID NO: 4052102 - RNA, 17 nt, Staphylococcus aureus subsp. aureus N315
cuguaaauuaucuaaag

SEQ ID NO: 4052103 - RNA, 21 nt, Staphylococcus aureus subsp. aureus N315
cuguaacauaaacaauaacug

SEQ ID NO: 4052104 - RNA, 15 nt, Staphylococcus aureus subsp. aureus N315
cuguaaccaaaagaa

SEQ ID NO: 4052105 - RNA, 15 nt, Staphylococcus aureus subsp. aureus N315
cuguaauaauuauua

SEQ ID NO: 4052106 - RNA, 19 nt, Staphylococcus aureus subsp. aureus N315
cuguaauaauuauuaauaa

SEQ ID NO: 4052107 - RNA, 18 nt, Staphylococcus aureus subsp. aureus N315
cuguacgauucaauuuaa

SEQ ID NO: 4052108 - RNA, 18 nt, Staphylococcus aureus subsp. aureus N315
cuguacguuuuaaauaaa

SEQ ID NO: 4052109 - RNA, 13 nt, Staphylococcus aureus subsp. aureus N315
cuguacuauauuc

SEQ ID NO: 4052110 - RNA, 19 nt, Staphylococcus aureus subsp. aureus N315
cuguaguuucaacuuuuga

SEQ ID NO: 4052111 - RNA, 14 nt, Staphylococcus aureus subsp. aureus N315
cuguaguuucuuaa

SEQ ID NO: 4052112 - RNA, 18 nt, Staphylococcus aureus subsp. aureus N315
cuguauaaccauaaugaa

SEQ ID NO: 4052113 - RNA, 22 nt, Staphylococcus aureus subsp. aureus N315
cuguauacgacgucgcaacagg

SEQ ID NO: 4052114 - RNA, 19 nt, Staphylococcus aureus subsp. aureus N315
cuguauagcuggcuuuuua

SEQ ID NO: 4052115 - RNA, 23 nt, Staphylococcus aureus subsp. aureus N315
cuguauaguaaccuuuauuuuca

SEQ ID NO: 4052116 - RNA, 22 nt, Staphylococcus aureus subsp. aureus N315
cuguauauggcgauaacaagaa

SEQ ID NO: 4052117 - RNA, 20 nt, Staphylococcus aureus subsp. aureus N315
cuguaugccgccuaauaaua

SEQ ID NO: 4052118 - RNA, 14 nt, Staphylococcus aureus subsp. aureus N315
cuguauuuaauaaa

SEQ ID NO: 4052119 - RNA, 17 nt, Staphylococcus aureus subsp. aureus N315
cugucaccuucuauauu

SEQ ID NO: 4052120 - RNA, 18 nt, Staphylococcus aureus subsp. aureus N315
cugucaccuucuauauug

SEQ ID NO: 4052121 - RNA, 14 nt, Staphylococcus aureus subsp. aureus N315
cuguccgauuuuua

SEQ ID NO: 4052122 - RNA, 19 nt, Staphylococcus aureus subsp. aureus N315
cugucucaucuucuaaauc

SEQ ID NO: 4052123 - RNA, 16 nt, Staphylococcus aureus subsp. aureus N315
cugugauauuaauuga

SEQ ID NO: 4052124 - RNA, 20 nt, Staphylococcus aureus subsp. aureus N315
cugugauauuaauugaaaaa

SEQ ID NO: 4052125 - RNA, 23 nt, Staphylococcus aureus subsp. aureus N315
cuguggcucgaaaauaaaacaaa

SEQ ID NO: 4052126 - RNA, 18 nt, Staphylococcus aureus subsp. aureus N315
cuguguacguuucaaugu

SEQ ID NO: 4052127 - RNA, 13 nt, Staphylococcus aureus subsp. aureus N315
cuguguaucauca

SEQ ID NO: 4052128 - RNA, 15 nt, Staphylococcus aureus subsp. aureus N315
cuguguuggggccca

SEQ ID NO: 4052129 - RNA, 16 nt, Staphylococcus aureus subsp. aureus N315
cuguguuggggcccac

SEQ ID NO: 4052130 - RNA, 14 nt, Staphylococcus aureus subsp. aureus N315
cuguuaaacucaua

SEQ ID NO: 4052131 - RNA, 14 nt, Staphylococcus aureus subsp. aureus N315
cuguuaauaaauca

SEQ ID NO: 4052132 - RNA, 16 nt, Staphylococcus aureus subsp. aureus N315
cuguuaauaaaucauu

SEQ ID NO: 4052133 - RNA, 15 nt, Staphylococcus aureus subsp. aureus N315
cuguuaauguuccaa

SEQ ID NO: 4052134 - RNA, 16 nt, Staphylococcus aureus subsp. aureus N315
cuguuacacuuuucuu

SEQ ID NO: 4052135 - RNA, 16 nt, Staphylococcus aureus subsp. aureus N315
cuguuauugcaauaaa

SEQ ID NO: 4052136 - RNA, 15 nt, Staphylococcus aureus subsp. aureus N315
cuguuccaaauucau

SEQ ID NO: 4052137 - RNA, 21 nt, Staphylococcus aureus subsp. aureus N315
cuguucucuauuuauacaaua

SEQ ID NO: 4052138 - RNA, 21 nt, Staphylococcus aureus subsp. aureus N315
cuguucuuucgucuuguaaac

SEQ ID NO: 4052139 - RNA, 20 nt, Staphylococcus aureus subsp. aureus N315
cuguuggaauaccuuuuucu

SEQ ID NO: 4052140 - RNA, 21 nt, Staphylococcus aureus subsp. aureus N315
cuguuggaauaccuuuuucua

SEQ ID NO: 4052141 - RNA, 13 nt, Staphylococcus aureus subsp. aureus N315
cuguuucaucacc

SEQ ID NO: 4052142 - RNA, 16 nt, Staphylococcus aureus subsp. aureus N315
cuguuucaucaccgac

SEQ ID NO: 4052143 - RNA, 19 nt, Staphylococcus aureus subsp. aureus N315
cuguuugagauauauuaau

SEQ ID NO: 4052144 - RNA, 13 nt, Staphylococcus aureus subsp. aureus N315
cuguuugcuuuau

SEQ ID NO: 4052145 - RNA, 18 nt, Staphylococcus aureus subsp. aureus N315
cuguuuuaucuacaguuu

SEQ ID NO: 4052146 - RNA, 19 nt, Staphylococcus aureus subsp. aureus N315
cuguuuugcgguuuuuuug

SEQ ID NO: 4052147 - RNA, 20 nt, Staphylococcus aureus subsp. aureus N315
cuuaaaagacauccacagaa

SEQ ID NO: 4052148 - RNA, 22 nt, Staphylococcus aureus subsp. aureus N315
cuuaaaagacauccacagaauu

SEQ ID NO: 4052149 - RNA, 21 nt, Staphylococcus aureus subsp. aureus N315
cuuaaaauaugauuuaaaaua

SEQ ID NO: 4052150 - RNA, 17 nt, Staphylococcus aureus subsp. aureus N315
cuuaaaaugauuguuuu

SEQ ID NO: 4052151 - RNA, 15 nt, Staphylococcus aureus subsp. aureus N315
cuuaaaauuuaaaua

SEQ ID NO: 4052152 - RNA, 18 nt, Staphylococcus aureus subsp. aureus N315
cuuaaaauuuaaauauug

SEQ ID NO: 4052153 - RNA, 21 nt, Staphylococcus aureus subsp. aureus N315
cuuaaaauuuaaauauugaag

SEQ ID NO: 4052154 - RNA, 13 nt, Staphylococcus aureus subsp. aureus N315
cuuaaacaaauaa

SEQ ID NO: 4052155 - RNA, 21 nt, Staphylococcus aureus subsp. aureus N315
cuuaaagauuuacccauuaca

SEQ ID NO: 4052156 - RNA, 22 nt, Staphylococcus aureus subsp. aureus N315
cuuaaauacaauuucuucauuu

SEQ ID NO: 4052157 - RNA, 19 nt, Staphylococcus aureus subsp. aureus N315
cuuaaauagugcuuuuuca

SEQ ID NO: 4052158 - RNA, 11 nt, Staphylococcus aureus subsp. aureus N315
cuuaaauauuc

SEQ ID NO: 4052159 - RNA, 23 nt, Staphylococcus aureus subsp. aureus N315
cuuaaauggagauucucgguuuu

SEQ ID NO: 4052160 - RNA, 15 nt, Staphylococcus aureus subsp. aureus N315
cuuaaauggaugaua

SEQ ID NO: 4052161 - RNA, 13 nt, Staphylococcus aureus subsp. aureus N315
cuuaaauuaagaa

SEQ ID NO: 4052162 - RNA, 16 nt, Staphylococcus aureus subsp. aureus N315
cuuaaauuaagaauaa

SEQ ID NO: 4052163 - RNA, 12 nt, Staphylococcus aureus subsp. aureus N315
cuuaacaacaug

SEQ ID NO: 4052164 - RNA, 16 nt, Staphylococcus aureus subsp. aureus N315
cuuaacauaaaaugag

SEQ ID NO: 4052165 - RNA, 22 nt, Staphylococcus aureus subsp. aureus N315
cuuaaccauuuaaaaauugaag

SEQ ID NO: 4052166 - RNA, 15 nt, Staphylococcus aureus subsp. aureus N315
cuuaacucaaagaaa

SEQ ID NO: 4052167 - RNA, 16 nt, Staphylococcus aureus subsp. aureus N315
cuuaacucaaagaaac

SEQ ID NO: 4052168 - RNA, 14 nt, Staphylococcus aureus subsp. aureus N315
cuuaacuuccuuuu

SEQ ID NO: 4052169 - RNA, 21 nt, Staphylococcus aureus subsp. aureus N315
cuuaagcuuuaaucauagcau

SEQ ID NO: 4052170 - RNA, 21 nt, Staphylococcus aureus subsp. aureus N315
cuuaaguaagauuuaaacauc

SEQ ID NO: 4052171 - RNA, 16 nt, Staphylococcus aureus subsp. aureus N315
cuuaauaagcugaaau

SEQ ID NO: 4052172 - RNA, 18 nt, Staphylococcus aureus subsp. aureus N315
cuuaauacgauaauaacu

SEQ ID NO: 4052173 - RNA, 14 nt, Staphylococcus aureus subsp. aureus N315
cuuaauagaaagag

SEQ ID NO: 4052174 - RNA, 21 nt, Staphylococcus aureus subsp. aureus N315
cuuaauaggauaugcuaaaca

SEQ ID NO: 4052175 - RNA, 15 nt, Staphylococcus aureus subsp. aureus N315
cuuaaucaagcuagc

SEQ ID NO: 4052176 - RNA, 22 nt, Staphylococcus aureus subsp. aureus N315
cuuaaucagcuauaaaaguacu

SEQ ID NO: 4052177 - RNA, 21 nt, Staphylococcus aureus subsp. aureus N315
cuuaaugguaaacaaaaaacu

SEQ ID NO: 4052178 - RNA, 12 nt, Staphylococcus aureus subsp. aureus N315
cuuaauucuuca

SEQ ID NO: 4052179 - RNA, 17 nt, Staphylococcus aureus subsp. aureus N315
cuuaauucuucaucaau

SEQ ID NO: 4052180 - RNA, 14 nt, Staphylococcus aureus subsp. aureus N315
cuuacaaauauacu

SEQ ID NO: 4052181 - RNA, 15 nt, Staphylococcus aureus subsp. aureus N315
cuuacaacuuuaguu

SEQ ID NO: 4052182 - RNA, 14 nt, Staphylococcus aureus subsp. aureus N315
cuuacaauaaucac

SEQ ID NO: 4052183 - RNA, 23 nt, Staphylococcus aureus subsp. aureus N315
cuuacaauagugugcaaguuggc

SEQ ID NO: 4052184 - RNA, 17 nt, Staphylococcus aureus subsp. aureus N315
cuuacagacaaacauua

SEQ ID NO: 4052185 - RNA, 13 nt, Staphylococcus aureus subsp. aureus N315
cuuacauugauaa

SEQ ID NO: 4052186 - RNA, 16 nt, Staphylococcus aureus subsp. aureus N315
cuuacauuuuaauaaa

SEQ ID NO: 4052187 - RNA, 15 nt, Staphylococcus aureus subsp. aureus N315
cuuacccaaaaaauu

SEQ ID NO: 4052188 - RNA, 18 nt, Staphylococcus aureus subsp. aureus N315
cuuacccaaaaaauugua

SEQ ID NO: 4052189 - RNA, 17 nt, Staphylococcus aureus subsp. aureus N315
cuuaccuacuuuuuugg

SEQ ID NO: 4052190 - RNA, 19 nt, Staphylococcus aureus subsp. aureus N315
cuuaccuuuauguucaaau

SEQ ID NO: 4052191 - RNA, 18 nt, Staphylococcus aureus subsp. aureus N315
cuuaccuuucaaauauau

SEQ ID NO: 4052192 - RNA, 20 nt, Staphylococcus aureus subsp. aureus N315
cuuacuaaguaaccaagucu

SEQ ID NO: 4052193 - RNA, 19 nt, Staphylococcus aureus subsp. aureus N315
cuuacuacgcauuauuaag

SEQ ID NO: 4052194 - RNA, 14 nt, Staphylococcus aureus subsp. aureus N315
cuuacucauuuuuc

SEQ ID NO: 4052195 - RNA, 13 nt, Staphylococcus aureus subsp. aureus N315
cuuacugaaacua

SEQ ID NO: 4052196 - RNA, 17 nt, Staphylococcus aureus subsp. aureus N315
cuuacugaaacuaaauu

SEQ ID NO: 4052197 - RNA, 23 nt, Staphylococcus aureus subsp. aureus N315
cuuacugaaacuaaauuaaaagu

SEQ ID NO: 4052198 - RNA, 19 nt, Staphylococcus aureus subsp. aureus N315
cuuacugcuguucucuauu

SEQ ID NO: 4052199 - RNA, 22 nt, Staphylococcus aureus subsp. aureus N315
cuuacugcuguuuuuuauagua

SEQ ID NO: 4052200 - RNA, 20 nt, Staphylococcus aureus subsp. aureus N315
cuuacugcuuuuuuauucua

SEQ ID NO: 4052201 - RNA, 17 nt, Staphylococcus aureus subsp. aureus N315
cuuacugucaccuucua

SEQ ID NO: 4052202 - RNA, 17 nt, Staphylococcus aureus subsp. aureus N315
cuuacugugaaaauacc

SEQ ID NO: 4052203 - RNA, 16 nt, Staphylococcus aureus subsp. aureus N315
cuuacuuuucuaaaca

SEQ ID NO: 4052204 - RNA, 16 nt, Staphylococcus aureus subsp. aureus N315
cuuagaauuuacaagu

SEQ ID NO: 4052205 - RNA, 19 nt, Staphylococcus aureus subsp. aureus N315
cuuagacgcuguuuuaaau

SEQ ID NO: 4052206 - RNA, 21 nt, Staphylococcus aureus subsp. aureus N315
cuuagauuuucacuaauauuu

SEQ ID NO: 4052207 - RNA, 17 nt, Staphylococcus aureus subsp. aureus N315
cuuagcaaacaauuuug

SEQ ID NO: 4052208 - RNA, 22 nt, Staphylococcus aureus subsp. aureus N315
cuuagcacuuggauuuuaauua

SEQ ID NO: 4052209 - RNA, 18 nt, Staphylococcus aureus subsp. aureus N315
cuuaggugucaucgcuuu

SEQ ID NO: 4052210 - RNA, 22 nt, Staphylococcus aureus subsp. aureus N315
cuuaggugucaucgcuuuaauu

SEQ ID NO: 4052211 - RNA, 21 nt, Staphylococcus aureus subsp. aureus N315
cuuagguuauuauaaaauaaa

SEQ ID NO: 4052212 - RNA, 13 nt, Staphylococcus aureus subsp. aureus N315
cuuaguacaaaau

SEQ ID NO: 4052213 - RNA, 23 nt, Staphylococcus aureus subsp. aureus N315
cuuaguacacguguauuguauuu

SEQ ID NO: 4052214 - RNA, 22 nt, Staphylococcus aureus subsp. aureus N315
cuuaguagauuuauuaaauaua

SEQ ID NO: 4052215 - RNA, 18 nt, Staphylococcus aureus subsp. aureus N315
cuuagucaauguauauuu

SEQ ID NO: 4052216 - RNA, 17 nt, Staphylococcus aureus subsp. aureus N315
cuuaguuugacaucuau

SEQ ID NO: 4052217 - RNA, 19 nt, Staphylococcus aureus subsp. aureus N315
cuuaguuugacaucuauuu

SEQ ID NO: 4052218 - RNA, 14 nt, Staphylococcus aureus subsp. aureus N315
cuuauaaaaaacaa

SEQ ID NO: 4052219 - RNA, 15 nt, Staphylococcus aureus subsp. aureus N315
cuuauaaacaaaaga

SEQ ID NO: 4052220 - RNA, 21 nt, Staphylococcus aureus subsp. aureus N315
cuuauaaagacaccuucaaua

SEQ ID NO: 4052221 - RNA, 21 nt, Staphylococcus aureus subsp. aureus N315
cuuauaaguucaaccauauga

SEQ ID NO: 4052222 - RNA, 16 nt, Staphylococcus aureus subsp. aureus N315
cuuauacguuacggcu

SEQ ID NO: 4052223 - RNA, 22 nt, Staphylococcus aureus subsp. aureus N315
cuuauauacguugauuaacaca

SEQ ID NO: 4052224 - RNA, 16 nt, Staphylococcus aureus subsp. aureus N315
cuuauauauucaauaa

SEQ ID NO: 4052225 - RNA, 22 nt, Staphylococcus aureus subsp. aureus N315
cuuauauauucaauaauuauua

SEQ ID NO: 4052226 - RNA, 22 nt, Staphylococcus aureus subsp. aureus N315
cuuauauuuuauuuaaaaauag

SEQ ID NO: 4052227 - RNA, 22 nt, Staphylococcus aureus subsp. aureus N315
cuuaucaaaaccgcuauaaaau

SEQ ID NO: 4052228 - RNA, 21 nt, Staphylococcus aureus subsp. aureus N315
cuuaucagcauuaaucguauu

SEQ ID NO: 4052229 - RNA, 12 nt, Staphylococcus aureus subsp. aureus N315
cuuaucagugua

SEQ ID NO: 4052230 - RNA, 14 nt, Staphylococcus aureus subsp. aureus N315
cuuaucauuacuug

SEQ ID NO: 4052231 - RNA, 15 nt, Staphylococcus aureus subsp. aureus N315
cuuaucauuucaaau

SEQ ID NO: 4052232 - RNA, 20 nt, Staphylococcus aureus subsp. aureus N315
cuuaucugaagcuaaaugcu

SEQ ID NO: 4052233 - RNA, 15 nt, Staphylococcus aureus subsp. aureus N315
cuuaucuguaaauaa

SEQ ID NO: 4052234 - RNA, 18 nt, Staphylococcus aureus subsp. aureus N315
cuuaucuguaaauaacuu

SEQ ID NO: 4052235 - RNA, 18 nt, Staphylococcus aureus subsp. aureus N315
cuuaugggggauuuuuuu

SEQ ID NO: 4052236 - RNA, 19 nt, Staphylococcus aureus subsp. aureus N315
cuuaugucauauacuauau

SEQ ID NO: 4052237 - RNA, 12 nt, Staphylococcus aureus subsp. aureus N315
cuuauuauuuau

SEQ ID NO: 4052238 - RNA, 18 nt, Staphylococcus aureus subsp. aureus N315
cuuauuccgcaacuugua

SEQ ID NO: 4052239 - RNA, 17 nt, Staphylococcus aureus subsp. aureus N315
cuuauucgcaccacugg

SEQ ID NO: 4052240 - RNA, 21 nt, Staphylococcus aureus subsp. aureus N315
cuuauucgcaccacuggccuu

SEQ ID NO: 4052241 - RNA, 17 nt, Staphylococcus aureus subsp. aureus N315
cuuauugaaaagauaaa

SEQ ID NO: 4052242 - RNA, 13 nt, Staphylococcus aureus subsp. aureus N315
cuuauuuauuuua

SEQ ID NO: 4052243 - RNA, 19 nt, Staphylococcus aureus subsp. aureus N315
cuuauuucaaaaauaguaa

SEQ ID NO: 4052244 - RNA, 20 nt, Staphylococcus aureus subsp. aureus N315
cuuauuugauucuauuucuu

SEQ ID NO: 4052245 - RNA, 14 nt, Staphylococcus aureus subsp. aureus N315
cuuauuuguuuaau

SEQ ID NO: 4052246 - RNA, 22 nt, Staphylococcus aureus subsp. aureus N315
cuuauuuguuuaauuaucuuua

SEQ ID NO: 4052247 - RNA, 13 nt, Staphylococcus aureus subsp. aureus N315
cuuauuuuacuau

SEQ ID NO: 4052248 - RNA, 15 nt, Staphylococcus aureus subsp. aureus N315
cuuauuuuguuuuaa

SEQ ID NO: 4052249 - RNA, 13 nt, Staphylococcus aureus subsp. aureus N315
cuucaaaaaauaa

SEQ ID NO: 4052250 - RNA, 13 nt, Staphylococcus aureus subsp. aureus N315
cuucaaaaugccg

SEQ ID NO: 4052251 - RNA, 15 nt, Staphylococcus aureus subsp. aureus N315
cuucaaaauuuugac

SEQ ID NO: 4052252 - RNA, 17 nt, Staphylococcus aureus subsp. aureus N315
cuucaaauguaacauua

SEQ ID NO: 4052253 - RNA, 13 nt, Staphylococcus aureus subsp. aureus N315
cuucaacauaacu

SEQ ID NO: 4052254 - RNA, 22 nt, Staphylococcus aureus subsp. aureus N315
cuucaacauagacacuuaacuu

SEQ ID NO: 4052255 - RNA, 17 nt, Staphylococcus aureus subsp. aureus N315
cuucaaccauuuguucu

SEQ ID NO: 4052256 - RNA, 16 nt, Staphylococcus aureus subsp. aureus N315
cuucaacgucaucugc

SEQ ID NO: 4052257 - RNA, 19 nt, Staphylococcus aureus subsp. aureus N315
cuucaagagaaccaccuac

SEQ ID NO: 4052258 - RNA, 19 nt, Staphylococcus aureus subsp. aureus N315
cuucaagugccauuuuuaa

SEQ ID NO: 4052259 - RNA, 23 nt, Staphylococcus aureus subsp. aureus N315
cuucaaguuggugugcaauuaau

SEQ ID NO: 4052260 - RNA, 19 nt, Staphylococcus aureus subsp. aureus N315
cuucaauaucuucagcuaa

SEQ ID NO: 4052261 - RNA, 13 nt, Staphylococcus aureus subsp. aureus N315
cuucaauauuuaa

SEQ ID NO: 4052262 - RNA, 16 nt, Staphylococcus aureus subsp. aureus N315
cuucaauccaagcaau

SEQ ID NO: 4052263 - RNA, 19 nt, Staphylococcus aureus subsp. aureus N315
cuucaaucgucacaucacg

SEQ ID NO: 4052264 - RNA, 12 nt, Staphylococcus aureus subsp. aureus N315
cuucaauuauuu

SEQ ID NO: 4052265 - RNA, 18 nt, Staphylococcus aureus subsp. aureus N315
cuucaauucuuacaccug

SEQ ID NO: 4052266 - RNA, 16 nt, Staphylococcus aureus subsp. aureus N315
cuucaauugucucaau

SEQ ID NO: 4052267 - RNA, 15 nt, Staphylococcus aureus subsp. aureus N315
cuucaauuuaaugua

SEQ ID NO: 4052268 - RNA, 19 nt, Staphylococcus aureus subsp. aureus N315
cuucaccaucuguaacuaa

SEQ ID NO: 4052269 - RNA, 18 nt, Staphylococcus aureus subsp. aureus N315
cuucacugaaaauuugua

SEQ ID NO: 4052270 - RNA, 22 nt, Staphylococcus aureus subsp. aureus N315
cuucagcuaaaaguuucccaag

SEQ ID NO: 4052271 - RNA, 19 nt, Staphylococcus aureus subsp. aureus N315
cuucaggaauaucuuucaa

SEQ ID NO: 4052272 - RNA, 15 nt, Staphylococcus aureus subsp. aureus N315
cuucaguacgguuau

SEQ ID NO: 4052273 - RNA, 20 nt, Staphylococcus aureus subsp. aureus N315
cuucaguacgguuauuuaau

SEQ ID NO: 4052274 - RNA, 16 nt, Staphylococcus aureus subsp. aureus N315
cuucaguuaaaucuuu

SEQ ID NO: 4052275 - RNA, 20 nt, Staphylococcus aureus subsp. aureus N315
cuucauaagucacaguaucu

SEQ ID NO: 4052276 - RNA, 15 nt, Staphylococcus aureus subsp. aureus N315
cuucauaguucaaau

SEQ ID NO: 4052277 - RNA, 22 nt, Staphylococcus aureus subsp. aureus N315
cuucauaguucaaauugaacuu

SEQ ID NO: 4052278 - RNA, 17 nt, Staphylococcus aureus subsp. aureus N315
cuucauauccuucauua

SEQ ID NO: 4052279 - RNA, 15 nt, Staphylococcus aureus subsp. aureus N315
cuucauauuuugccu

SEQ ID NO: 4052280 - RNA, 13 nt, Staphylococcus aureus subsp. aureus N315
cuucaucaauaaa

SEQ ID NO: 4052281 - RNA, 22 nt, Staphylococcus aureus subsp. aureus N315
cuucauuaguugcauaaucaau

SEQ ID NO: 4052282 - RNA, 22 nt, Staphylococcus aureus subsp. aureus N315
cuucauuaguugccccuagcaa

SEQ ID NO: 4052283 - RNA, 20 nt, Staphylococcus aureus subsp. aureus N315
cuucauuaucaauagaugaa

SEQ ID NO: 4052284 - RNA, 15 nt, Staphylococcus aureus subsp. aureus N315
cuucauugaugaugu

SEQ ID NO: 4052285 - RNA, 15 nt, Staphylococcus aureus subsp. aureus N315
cuucauuugcgauuu

SEQ ID NO: 4052286 - RNA, 22 nt, Staphylococcus aureus subsp. aureus N315
cuucauuugcgauuucuucugc

SEQ ID NO: 4052287 - RNA, 17 nt, Staphylococcus aureus subsp. aureus N315
cuuccaacacccauaua

SEQ ID NO: 4052288 - RNA, 19 nt, Staphylococcus aureus subsp. aureus N315
cuuccaauaaccccuguca

SEQ ID NO: 4052289 - RNA, 21 nt, Staphylococcus aureus subsp. aureus N315
cuuccaauaaccccugucacu

SEQ ID NO: 4052290 - RNA, 16 nt, Staphylococcus aureus subsp. aureus N315
cuuccaauaauaaauc

SEQ ID NO: 4052291 - RNA, 17 nt, Staphylococcus aureus subsp. aureus N315
cuuccaauaauaaauca

SEQ ID NO: 4052292 - RNA, 19 nt, Staphylococcus aureus subsp. aureus N315
cuuccaauacuguugucuu

SEQ ID NO: 4052293 - RNA, 21 nt, Staphylococcus aureus subsp. aureus N315
cuuccaaucaacuucauauaa

SEQ ID NO: 4052294 - RNA, 20 nt, Staphylococcus aureus subsp. aureus N315
cuuccaauuuaaaaugauuc

SEQ ID NO: 4052295 - RNA, 14 nt, Staphylococcus aureus subsp. aureus N315
cuuccacuucaucu

SEQ ID NO: 4052296 - RNA, 16 nt, Staphylococcus aureus subsp. aureus N315
cuuccaucacaucaua

SEQ ID NO: 4052297 - RNA, 19 nt, Staphylococcus aureus subsp. aureus N315
cuucccagucaugucccau

SEQ ID NO: 4052298 - RNA, 14 nt, Staphylococcus aureus subsp. aureus N315
cuucccaucuuuua

SEQ ID NO: 4052299 - RNA, 22 nt, Staphylococcus aureus subsp. aureus N315
cuucccaucuuuuagguaauaa

SEQ ID NO: 4052300 - RNA, 16 nt, Staphylococcus aureus subsp. aureus N315
cuuccccuacaaaguu

SEQ ID NO: 4052301 - RNA, 21 nt, Staphylococcus aureus subsp. aureus N315
cuuccuccgccaucaauauuu

SEQ ID NO: 4052302 - RNA, 23 nt, Staphylococcus aureus subsp. aureus N315
cuucgaagucauaugcauacacu

SEQ ID NO: 4052303 - RNA, 20 nt, Staphylococcus aureus subsp. aureus N315
cuucgauaguuuauuaauau

SEQ ID NO: 4052304 - RNA, 18 nt, Staphylococcus aureus subsp. aureus N315
cuucgauggcugcaacaa

SEQ ID NO: 4052305 - RNA, 19 nt, Staphylococcus aureus subsp. aureus N315
cuucgauggcugcaacaau

SEQ ID NO: 4052306 - RNA, 18 nt, Staphylococcus aureus subsp. aureus N315
cuucgccaagccaucuuu

SEQ ID NO: 4052307 - RNA, 21 nt, Staphylococcus aureus subsp. aureus N315
cuucgccaagccaucuuucuu

SEQ ID NO: 4052308 - RNA, 14 nt, Staphylococcus aureus subsp. aureus N315
cuucuaaccacuuc

SEQ ID NO: 4052309 - RNA, 17 nt, Staphylococcus aureus subsp. aureus N315
cuucuaaccacuucuuc

SEQ ID NO: 4052310 - RNA, 17 nt, Staphylococcus aureus subsp. aureus N315
cuucuaauuugcaaaau

SEQ ID NO: 4052311 - RNA, 14 nt, Staphylococcus aureus subsp. aureus N315
cuucuaguaauucu

SEQ ID NO: 4052312 - RNA, 13 nt, Staphylococcus aureus subsp. aureus N315
cuucuaucucuuu

SEQ ID NO: 4052313 - RNA, 14 nt, Staphylococcus aureus subsp. aureus N315
cuucuaucuucaca

SEQ ID NO: 4052314 - RNA, 14 nt, Staphylococcus aureus subsp. aureus N315
cuucuauuaagaaa

SEQ ID NO: 4052315 - RNA, 14 nt, Staphylococcus aureus subsp. aureus N315
cuucuauuauauug

SEQ ID NO: 4052316 - RNA, 18 nt, Staphylococcus aureus subsp. aureus N315
cuucuauuuuauaauaaa

SEQ ID NO: 4052317 - RNA, 16 nt, Staphylococcus aureus subsp. aureus N315
cuucucacaacugcau

SEQ ID NO: 4052318 - RNA, 13 nt, Staphylococcus aureus subsp. aureus N315
cuucuccaaucau

SEQ ID NO: 4052319 - RNA, 16 nt, Staphylococcus aureus subsp. aureus N315
cuucugcauagcgcuc

SEQ ID NO: 4052320 - RNA, 11 nt, Staphylococcus aureus subsp. aureus N315
cuucugcuaac

SEQ ID NO: 4052321 - RNA, 20 nt, Staphylococcus aureus subsp. aureus N315
cuucuggagccccuuguucu

SEQ ID NO: 4052322 - RNA, 21 nt, Staphylococcus aureus subsp. aureus N315
cuucuggagccccuuguucuc

SEQ ID NO: 4052323 - RNA, 23 nt, Staphylococcus aureus subsp. aureus N315
cuucuggauagguaucacuagga

SEQ ID NO: 4052324 - RNA, 23 nt, Staphylococcus aureus subsp. aureus N315
cuucuguguuggggcccacaccc

SEQ ID NO: 4052325 - RNA, 24 nt, Staphylococcus aureus subsp. aureus N315
cuucuuaaaucaacaucaucuuua

SEQ ID NO: 4052326 - RNA, 13 nt, Staphylococcus aureus subsp. aureus N315
cuucuucaacaau

SEQ ID NO: 4052327 - RNA, 21 nt, Staphylococcus aureus subsp. aureus N315
cuucuucaggaauaucuuuca

SEQ ID NO: 4052328 - RNA, 22 nt, Staphylococcus aureus subsp. aureus N315
cuucuucaggaauaucuuucaa

SEQ ID NO: 4052329 - RNA, 15 nt, Staphylococcus aureus subsp. aureus N315
cuucuuguuucaaac

SEQ ID NO: 4052330 - RNA, 14 nt, Staphylococcus aureus subsp. aureus N315
cuucuuguuuuaaa

SEQ ID NO: 4052331 - RNA, 15 nt, Staphylococcus aureus subsp. aureus N315
cuucuuucaauuaau

SEQ ID NO: 4052332 - RNA, 16 nt, Staphylococcus aureus subsp. aureus N315
cuucuuucaauuaauc

SEQ ID NO: 4052333 - RNA, 20 nt, Staphylococcus aureus subsp. aureus N315
cuucuuucuaaaauaacuaa

SEQ ID NO: 4052334 - RNA, 13 nt, Staphylococcus aureus subsp. aureus N315
cuucuuuuaaguu

SEQ ID NO: 4052335 - RNA, 15 nt, Staphylococcus aureus subsp. aureus N315
cuucuuuugcaaaac

SEQ ID NO: 4052336 - RNA, 19 nt, Staphylococcus aureus subsp. aureus N315
cuucuuuugcaaaacgcau

SEQ ID NO: 4052337 - RNA, 19 nt, Staphylococcus aureus subsp. aureus N315
cuucuuuuguuuuaccauc

SEQ ID NO: 4052338 - RNA, 17 nt, Staphylococcus aureus subsp. aureus N315
cuucuuuuuuguaucuc

SEQ ID NO: 4052339 - RNA, 16 nt, Staphylococcus aureus subsp. aureus N315
cuugaaacacaaaaag

SEQ ID NO: 4052340 - RNA, 17 nt, Staphylococcus aureus subsp. aureus N315
cuugaaccccauucacu

SEQ ID NO: 4052341 - RNA, 22 nt, Staphylococcus aureus subsp. aureus N315
cuugaaguuguuucuccaguuu

SEQ ID NO: 4052342 - RNA, 20 nt, Staphylococcus aureus subsp. aureus N315
cuugaauaaauuuuauucuu

SEQ ID NO: 4052343 - RNA, 15 nt, Staphylococcus aureus subsp. aureus N315
cuugaauaauauauu

SEQ ID NO: 4052344 - RNA, 23 nt, Staphylococcus aureus subsp. aureus N315
cuugaccacuuuuguuaaaaaau

SEQ ID NO: 4052345 - RNA, 14 nt, Staphylococcus aureus subsp. aureus N315
cuugagcaucacuc

SEQ ID NO: 4052346 - RNA, 15 nt, Staphylococcus aureus subsp. aureus N315
cuugagcuauucaua

SEQ ID NO: 4052347 - RNA, 13 nt, Staphylococcus aureus subsp. aureus N315
cuugauaaaaaau

SEQ ID NO: 4052348 - RNA, 15 nt, Staphylococcus aureus subsp. aureus N315
cuugauaaaauaaau

SEQ ID NO: 4052349 - RNA, 22 nt, Staphylococcus aureus subsp. aureus N315
cuugauggugguaccacauaca

SEQ ID NO: 4052350 - RNA, 19 nt, Staphylococcus aureus subsp. aureus N315
cuugauuauauuuuucuuc

SEQ ID NO: 4052351 - RNA, 12 nt, Staphylococcus aureus subsp. aureus N315
cuugauucuuau

SEQ ID NO: 4052352 - RNA, 15 nt, Staphylococcus aureus subsp. aureus N315
cuugauuguaaauaa

SEQ ID NO: 4052353 - RNA, 15 nt, Staphylococcus aureus subsp. aureus N315
cuugauuuaauuuuu

SEQ ID NO: 4052354 - RNA, 17 nt, Staphylococcus aureus subsp. aureus N315
cuugauuuaauuuuuaa

SEQ ID NO: 4052355 - RNA, 12 nt, Staphylococcus aureus subsp. aureus N315
cuugauuuaguu

SEQ ID NO: 4052356 - RNA, 17 nt, Staphylococcus aureus subsp. aureus N315
cuugauuuuauaaauca

SEQ ID NO: 4052357 - RNA, 22 nt, Staphylococcus aureus subsp. aureus N315
cuugcaaauauaucaucucuau

SEQ ID NO: 4052358 - RNA, 14 nt, Staphylococcus aureus subsp. aureus N315
cuugcacaccagug

SEQ ID NO: 4052359 - RNA, 14 nt, Staphylococcus aureus subsp. aureus N315
cuugccuggcaacg

SEQ ID NO: 4052360 - RNA, 14 nt, Staphylococcus aureus subsp. aureus N315
cuugccuucaaauu

SEQ ID NO: 4052361 - RNA, 20 nt, Staphylococcus aureus subsp. aureus N315
cuugccuucaaauucucaau

SEQ ID NO: 4052362 - RNA, 17 nt, Staphylococcus aureus subsp. aureus N315
cuugcgauaaguucauc

SEQ ID NO: 4052363 - RNA, 12 nt, Staphylococcus aureus subsp. aureus N315
cuugcuuacaau

SEQ ID NO: 4052364 - RNA, 22 nt, Staphylococcus aureus subsp. aureus N315
cuugcuucauuauauaauucuu

SEQ ID NO: 4052365 - RNA, 22 nt, Staphylococcus aureus subsp. aureus N315
cuuggaauaauacguuuugcua

SEQ ID NO: 4052366 - RNA, 17 nt, Staphylococcus aureus subsp. aureus N315
cuuggauucaaaugaca

SEQ ID NO: 4052367 - RNA, 17 nt, Staphylococcus aureus subsp. aureus N315
cuuggcgacauuuguaa

SEQ ID NO: 4052368 - RNA, 16 nt, Staphylococcus aureus subsp. aureus N315
cuuggcguauuuuuug

SEQ ID NO: 4052369 - RNA, 17 nt, Staphylococcus aureus subsp. aureus N315
cuugggcugacauuuuu

SEQ ID NO: 4052370 - RNA, 19 nt, Staphylococcus aureus subsp. aureus N315
cuugggcugacauuuuugg

SEQ ID NO: 4052371 - RNA, 23 nt, Staphylococcus aureus subsp. aureus N315
cuugguacaccuacaaauauuuc

SEQ ID NO: 4052372 - RNA, 13 nt, Staphylococcus aureus subsp. aureus N315
cuugguuaaaguu

SEQ ID NO: 4052373 - RNA, 20 nt, Staphylococcus aureus subsp. aureus N315
cuuguaaacucaugacacgu

SEQ ID NO: 4052374 - RNA, 15 nt, Staphylococcus aureus subsp. aureus N315
cuuguaaacuucuuu

SEQ ID NO: 4052375 - RNA, 19 nt, Staphylococcus aureus subsp. aureus N315
cuuguaaauuuauuuuuaa

SEQ ID NO: 4052376 - RNA, 21 nt, Staphylococcus aureus subsp. aureus N315
cuuguaacaagcauuuuucaa

SEQ ID NO: 4052377 - RNA, 16 nt, Staphylococcus aureus subsp. aureus N315
cuuguaccgucuuauc

SEQ ID NO: 4052378 - RNA, 18 nt, Staphylococcus aureus subsp. aureus N315
cuuguaccgucuuaucua

SEQ ID NO: 4052379 - RNA, 17 nt, Staphylococcus aureus subsp. aureus N315
cuuguccucuaaaacau

SEQ ID NO: 4052380 - RNA, 19 nt, Staphylococcus aureus subsp. aureus N315
cuugugauaauucuucaac

SEQ ID NO: 4052381 - RNA, 17 nt, Staphylococcus aureus subsp. aureus N315
cuugugccaacaaagcu

SEQ ID NO: 4052382 - RNA, 15 nt, Staphylococcus aureus subsp. aureus N315
cuugugcuuaagaac

SEQ ID NO: 4052383 - RNA, 22 nt, Staphylococcus aureus subsp. aureus N315
cuuguucgauaaucguuaaaac

SEQ ID NO: 4052384 - RNA, 15 nt, Staphylococcus aureus subsp. aureus N315
cuuguucuaaaauaa

SEQ ID NO: 4052385 - RNA, 13 nt, Staphylococcus aureus subsp. aureus N315
cuuguucuaauug

SEQ ID NO: 4052386 - RNA, 13 nt, Staphylococcus aureus subsp. aureus N315
cuuguucuuuacu

SEQ ID NO: 4052387 - RNA, 20 nt, Staphylococcus aureus subsp. aureus N315
cuuguugaacucugauauug

SEQ ID NO: 4052388 - RNA, 16 nt, Staphylococcus aureus subsp. aureus N315
cuuguuggauuuuaac

SEQ ID NO: 4052389 - RNA, 18 nt, Staphylococcus aureus subsp. aureus N315
cuuguuggcuuuuuuaau

SEQ ID NO: 4052390 - RNA, 18 nt, Staphylococcus aureus subsp. aureus N315
cuuguuuagggaauccca

SEQ ID NO: 4052391 - RNA, 13 nt, Staphylococcus aureus subsp. aureus N315
cuuguuuuaaacu

SEQ ID NO: 4052392 - RNA, 17 nt, Staphylococcus aureus subsp. aureus N315
cuuuaaaaauuaaguaa

SEQ ID NO: 4052393 - RNA, 19 nt, Staphylococcus aureus subsp. aureus N315
cuuuaaaacaucauucaca

SEQ ID NO: 4052394 - RNA, 23 nt, Staphylococcus aureus subsp. aureus N315
cuuuaaaacguuaguacuuugau

SEQ ID NO: 4052395 - RNA, 14 nt, Staphylococcus aureus subsp. aureus N315
cuuuaaaauucucu

SEQ ID NO: 4052396 - RNA, 19 nt, Staphylococcus aureus subsp. aureus N315
cuuuaaaauuguauagaau

SEQ ID NO: 4052397 - RNA, 14 nt, Staphylococcus aureus subsp. aureus N315
cuuuaaacaagcau

SEQ ID NO: 4052398 - RNA, 17 nt, Staphylococcus aureus subsp. aureus N315
cuuuaaacucguaaauu

SEQ ID NO: 4052399 - RNA, 16 nt, Staphylococcus aureus subsp. aureus N315
cuuuaaaucuuguucu

SEQ ID NO: 4052400 - RNA, 14 nt, Staphylococcus aureus subsp. aureus N315
cuuuaaauuauaua

SEQ ID NO: 4052401 - RNA, 16 nt, Staphylococcus aureus subsp. aureus N315
cuuuaaguaauucauu

SEQ ID NO: 4052402 - RNA, 20 nt, Staphylococcus aureus subsp. aureus N315
cuuuaaguaauucauuugcu

SEQ ID NO: 4052403 - RNA, 14 nt, Staphylococcus aureus subsp. aureus N315
cuuuaaguuauuuu

SEQ ID NO: 4052404 - RNA, 15 nt, Staphylococcus aureus subsp. aureus N315
cuuuaauaaccuuua

SEQ ID NO: 4052405 - RNA, 22 nt, Staphylococcus aureus subsp. aureus N315
cuuuaauaaccuuuaaaacauc

SEQ ID NO: 4052406 - RNA, 12 nt, Staphylococcus aureus subsp. aureus N315
cuuuaauacuac

SEQ ID NO: 4052407 - RNA, 17 nt, Staphylococcus aureus subsp. aureus N315
cuuuaauguaauuauuu

SEQ ID NO: 4052408 - RNA, 14 nt, Staphylococcus aureus subsp. aureus N315
cuuuaauugcucuu

SEQ ID NO: 4052409 - RNA, 19 nt, Staphylococcus aureus subsp. aureus N315
cuuuaauugcucuuuaaca

SEQ ID NO: 4052410 - RNA, 17 nt, Staphylococcus aureus subsp. aureus N315
cuuuaauugucucauca

SEQ ID NO: 4052411 - RNA, 13 nt, Staphylococcus aureus subsp. aureus N315
cuuuaauuuucuu

SEQ ID NO: 4052412 - RNA, 17 nt, Staphylococcus aureus subsp. aureus N315
cuuuaauuuuucauuaa

SEQ ID NO: 4052413 - RNA, 13 nt, Staphylococcus aureus subsp. aureus N315
cuuuaauuuuuug

SEQ ID NO: 4052414 - RNA, 12 nt, Staphylococcus aureus subsp. aureus N315
cuuuaccaucuu

SEQ ID NO: 4052415 - RNA, 15 nt, Staphylococcus aureus subsp. aureus N315
cuuuacuaaagauag

SEQ ID NO: 4052416 - RNA, 19 nt, Staphylococcus aureus subsp. aureus N315
cuuuacuccaaaguaacau

SEQ ID NO: 4052417 - RNA, 19 nt, Staphylococcus aureus subsp. aureus N315
cuuuacucuacacucaaac

SEQ ID NO: 4052418 - RNA, 23 nt, Staphylococcus aureus subsp. aureus N315
cuuuacuugcuuuuucaaauaau

SEQ ID NO: 4052419 - RNA, 13 nt, Staphylococcus aureus subsp. aureus N315
cuuuacuuucauu

SEQ ID NO: 4052420 - RNA, 14 nt, Staphylococcus aureus subsp. aureus N315
cuuuacuuucauua

SEQ ID NO: 4052421 - RNA, 14 nt, Staphylococcus aureus subsp. aureus N315
cuuuagcaauugaa

SEQ ID NO: 4052422 - RNA, 15 nt, Staphylococcus aureus subsp. aureus N315
cuuuagcucuuuuuu

SEQ ID NO: 4052423 - RNA, 21 nt, Staphylococcus aureus subsp. aureus N315
cuuuaguaguguauucauuuu

SEQ ID NO: 4052424 - RNA, 19 nt, Staphylococcus aureus subsp. aureus N315
cuuuagucgguguuuucuu

SEQ ID NO: 4052425 - RNA, 12 nt, Staphylococcus aureus subsp. aureus N315
cuuuaguuacua

SEQ ID NO: 4052426 - RNA, 18 nt, Staphylococcus aureus subsp. aureus N315
cuuuaguuguuaggggcu

SEQ ID NO: 4052427 - RNA, 14 nt, Staphylococcus aureus subsp. aureus N315
cuuuauauauaaag

SEQ ID NO: 4052428 - RNA, 21 nt, Staphylococcus aureus subsp. aureus N315
cuuuauauauaaagaaauaau

SEQ ID NO: 4052429 - RNA, 14 nt, Staphylococcus aureus subsp. aureus N315
cuuuauaugagaaa

SEQ ID NO: 4052430 - RNA, 19 nt, Staphylococcus aureus subsp. aureus N315
cuuuaucaacauaaaauuu

SEQ ID NO: 4052431 - RNA, 13 nt, Staphylococcus aureus subsp. aureus N315
cuuuaucaauaau

SEQ ID NO: 4052432 - RNA, 13 nt, Staphylococcus aureus subsp. aureus N315
cuuuaucuauaug

SEQ ID NO: 4052433 - RNA, 21 nt, Staphylococcus aureus subsp. aureus N315
cuuuaugcaaaauuaaugaac

SEQ ID NO: 4052434 - RNA, 23 nt, Staphylococcus aureus subsp. aureus N315
cuuuaugggagugggacagaaau

SEQ ID NO: 4052435 - RNA, 15 nt, Staphylococcus aureus subsp. aureus N315
cuuuauuacuuuaau

SEQ ID NO: 4052436 - RNA, 14 nt, Staphylococcus aureus subsp. aureus N315
cuuuauucuuccca

SEQ ID NO: 4052437 - RNA, 22 nt, Staphylococcus aureus subsp. aureus N315
cuuuauucuucccaaaaauugu

SEQ ID NO: 4052438 - RNA, 15 nt, Staphylococcus aureus subsp. aureus N315
cuuuauuugauucuu

SEQ ID NO: 4052439 - RNA, 18 nt, Staphylococcus aureus subsp. aureus N315
cuuuauuuuaaacaugaa

SEQ ID NO: 4052440 - RNA, 15 nt, Staphylococcus aureus subsp. aureus N315
cuuuauuuucaguua

SEQ ID NO: 4052441 - RNA, 16 nt, Staphylococcus aureus subsp. aureus N315
cuuucaccauuuacuu

SEQ ID NO: 4052442 - RNA, 21 nt, Staphylococcus aureus subsp. aureus N315
cuuucaggcuuuguuuuucac

SEQ ID NO: 4052443 - RNA, 20 nt, Staphylococcus aureus subsp. aureus N315
cuuucauaaauuguuuuaca

SEQ ID NO: 4052444 - RNA, 17 nt, Staphylococcus aureus subsp. aureus N315
cuuucauacauaacaca

SEQ ID NO: 4052445 - RNA, 13 nt, Staphylococcus aureus subsp. aureus N315
cuuuccaccauau

SEQ ID NO: 4052446 - RNA, 21 nt, Staphylococcus aureus subsp. aureus N315
cuuuccucacuagauaguuua

SEQ ID NO: 4052447 - RNA, 13 nt, Staphylococcus aureus subsp. aureus N315
cuuucgauaaacu

SEQ ID NO: 4052448 - RNA, 20 nt, Staphylococcus aureus subsp. aureus N315
cuuucgcagcuucuuuaaca

SEQ ID NO: 4052449 - RNA, 16 nt, Staphylococcus aureus subsp. aureus N315
cuuucguauuuuucuu

SEQ ID NO: 4052450 - RNA, 16 nt, Staphylococcus aureus subsp. aureus N315
cuuucguccaacaugu

SEQ ID NO: 4052451 - RNA, 20 nt, Staphylococcus aureus subsp. aureus N315
cuuucguuucuguuucauca

SEQ ID NO: 4052452 - RNA, 12 nt, Staphylococcus aureus subsp. aureus N315
cuuucuauuaau

SEQ ID NO: 4052453 - RNA, 16 nt, Staphylococcus aureus subsp. aureus N315
cuuucucaucuauuua

SEQ ID NO: 4052454 - RNA, 18 nt, Staphylococcus aureus subsp. aureus N315
cuuucucaucuauuuaau

SEQ ID NO: 4052455 - RNA, 16 nt, Staphylococcus aureus subsp. aureus N315
cuuucucggcgauaaa

SEQ ID NO: 4052456 - RNA, 21 nt, Staphylococcus aureus subsp. aureus N315
cuuucucggcgauaaaauguu

SEQ ID NO: 4052457 - RNA, 22 nt, Staphylococcus aureus subsp. aureus N315
cuuucuugaugaauuaaacuga

SEQ ID NO: 4052458 - RNA, 12 nt, Staphylococcus aureus subsp. aureus N315
cuuucuuuucug

SEQ ID NO: 4052459 - RNA, 16 nt, Staphylococcus aureus subsp. aureus N315
cuuucuuuuucaucuu

SEQ ID NO: 4052460 - RNA, 17 nt, Staphylococcus aureus subsp. aureus N315
cuuucuuuuucaucuuu

SEQ ID NO: 4052461 - RNA, 19 nt, Staphylococcus aureus subsp. aureus N315
cuuugaagggagcauuuca

SEQ ID NO: 4052462 - RNA, 19 nt, Staphylococcus aureus subsp. aureus N315
cuuugaagggguuuuuucu

SEQ ID NO: 4052463 - RNA, 20 nt, Staphylococcus aureus subsp. aureus N315
cuuugaagggguuuuuucuu

SEQ ID NO: 4052464 - RNA, 21 nt, Staphylococcus aureus subsp. aureus N315
cuuugaauauaguccuuccca

SEQ ID NO: 4052465 - RNA, 19 nt, Staphylococcus aureus subsp. aureus N315
cuuugauaacaauuuuaaa

SEQ ID NO: 4052466 - RNA, 20 nt, Staphylococcus aureus subsp. aureus N315
cuuugauaacaauuuuaaau

SEQ ID NO: 4052467 - RNA, 17 nt, Staphylococcus aureus subsp. aureus N315
cuuugauauguuuccuc

SEQ ID NO: 4052468 - RNA, 20 nt, Staphylococcus aureus subsp. aureus N315
cuuugauauguuuccucuuu

SEQ ID NO: 4052469 - RNA, 19 nt, Staphylococcus aureus subsp. aureus N315
cuuugauguucacuaaaug

SEQ ID NO: 4052470 - RNA, 21 nt, Staphylococcus aureus subsp. aureus N315
cuuugauguucacuaaaugug

SEQ ID NO: 4052471 - RNA, 23 nt, Staphylococcus aureus subsp. aureus N315
cuuugcccgucuggcacauuacu

SEQ ID NO: 4052472 - RNA, 20 nt, Staphylococcus aureus subsp. aureus N315
cuuugccguauuucaaaugu

SEQ ID NO: 4052473 - RNA, 14 nt, Staphylococcus aureus subsp. aureus N315
cuuugcuaaaucaa

SEQ ID NO: 4052474 - RNA, 14 nt, Staphylococcus aureus subsp. aureus N315
cuuugcucaccuuu

SEQ ID NO: 4052475 - RNA, 22 nt, Staphylococcus aureus subsp. aureus N315
cuuuggaaauuuauuauaaaau

SEQ ID NO: 4052476 - RNA, 15 nt, Staphylococcus aureus subsp. aureus N315
cuuuggauuucuuuu

SEQ ID NO: 4052477 - RNA, 18 nt, Staphylococcus aureus subsp. aureus N315
cuuuggauuucuuuuuaa

SEQ ID NO: 4052478 - RNA, 20 nt, Staphylococcus aureus subsp. aureus N315
cuuuggauuucuuuuuaaaa

SEQ ID NO: 4052479 - RNA, 17 nt, Staphylococcus aureus subsp. aureus N315
cuuuggcaccaguacuu

SEQ ID NO: 4052480 - RNA, 14 nt, Staphylococcus aureus subsp. aureus N315
cuuuggcuauuuua

SEQ ID NO: 4052481 - RNA, 14 nt, Staphylococcus aureus subsp. aureus N315
cuuuguaaauuuuu

SEQ ID NO: 4052482 - RNA, 18 nt, Staphylococcus aureus subsp. aureus N315
cuuuguaaccuaaaaaca

SEQ ID NO: 4052483 - RNA, 23 nt, Staphylococcus aureus subsp. aureus N315
cuuuguauggaaauggugguuac

SEQ ID NO: 4052484 - RNA, 19 nt, Staphylococcus aureus subsp. aureus N315
cuuugucacgauagauuua

SEQ ID NO: 4052485 - RNA, 18 nt, Staphylococcus aureus subsp. aureus N315
cuuugucauacuaacuau

SEQ ID NO: 4052486 - RNA, 17 nt, Staphylococcus aureus subsp. aureus N315
cuuuguggauucucuuu

SEQ ID NO: 4052487 - RNA, 14 nt, Staphylococcus aureus subsp. aureus N315
cuuuguguuugcuu

SEQ ID NO: 4052488 - RNA, 16 nt, Staphylococcus aureus subsp. aureus N315
cuuuguguuugcuuuu

SEQ ID NO: 4052489 - RNA, 14 nt, Staphylococcus aureus subsp. aureus N315
cuuuguuggggccc

SEQ ID NO: 4052490 - RNA, 20 nt, Staphylococcus aureus subsp. aureus N315
cuuuguuggggcccacaccc

SEQ ID NO: 4052491 - RNA, 22 nt, Staphylococcus aureus subsp. aureus N315
cuuuguuggggcccacacccca

SEQ ID NO: 4052492 - RNA, 19 nt, Staphylococcus aureus subsp. aureus N315
cuuuguuguaagguggacu

SEQ ID NO: 4052493 - RNA, 12 nt, Staphylococcus aureus subsp. aureus N315
cuuuuaaaaaac

SEQ ID NO: 4052494 - RNA, 21 nt, Staphylococcus aureus subsp. aureus N315
cuuuuaaaaucguugcagauu

SEQ ID NO: 4052495 - RNA, 18 nt, Staphylococcus aureus subsp. aureus N315
cuuuuaaaccguguucuu

SEQ ID NO: 4052496 - RNA, 22 nt, Staphylococcus aureus subsp. aureus N315
cuuuuaaaccguguucuuuaau

SEQ ID NO: 4052497 - RNA, 13 nt, Staphylococcus aureus subsp. aureus N315
cuuuuaaauuaaa

SEQ ID NO: 4052498 - RNA, 16 nt, Staphylococcus aureus subsp. aureus N315
cuuuuaauucuuaauc

SEQ ID NO: 4052499 - RNA, 19 nt, Staphylococcus aureus subsp. aureus N315
cuuuuaauuguauuuucug

SEQ ID NO: 4052500 - RNA, 14 nt, Staphylococcus aureus subsp. aureus N315
cuuuuaauuuuuuu

SEQ ID NO: 4052501 - RNA, 18 nt, Staphylococcus aureus subsp. aureus N315
cuuuuacaaacuucacau

SEQ ID NO: 4052502 - RNA, 15 nt, Staphylococcus aureus subsp. aureus N315
cuuuuacaaucauca

SEQ ID NO: 4052503 - RNA, 14 nt, Staphylococcus aureus subsp. aureus N315
cuuuuacauuugua

SEQ ID NO: 4052504 - RNA, 20 nt, Staphylococcus aureus subsp. aureus N315
cuuuuaccucugauaaauga

SEQ ID NO: 4052505 - RNA, 14 nt, Staphylococcus aureus subsp. aureus N315
cuuuuacuaaauga

SEQ ID NO: 4052506 - RNA, 18 nt, Staphylococcus aureus subsp. aureus N315
cuuuuagauuaucuuuca

SEQ ID NO: 4052507 - RNA, 15 nt, Staphylococcus aureus subsp. aureus N315
cuuuuauauuuuuau

SEQ ID NO: 4052508 - RNA, 20 nt, Staphylococcus aureus subsp. aureus N315
cuuuuauccaauguauaaaa

SEQ ID NO: 4052509 - RNA, 12 nt, Staphylococcus aureus subsp. aureus N315
cuuuuaugcaug

SEQ ID NO: 4052510 - RNA, 13 nt, Staphylococcus aureus subsp. aureus N315
cuuuuaugcaugc

SEQ ID NO: 4052511 - RNA, 15 nt, Staphylococcus aureus subsp. aureus N315
cuuuuaugcaugcgc

SEQ ID NO: 4052512 - RNA, 18 nt, Staphylococcus aureus subsp. aureus N315
cuuuuaugucuaguucuu

SEQ ID NO: 4052513 - RNA, 23 nt, Staphylococcus aureus subsp. aureus N315
cuuuuauuaaagaaacaugauug

SEQ ID NO: 4052514 - RNA, 19 nt, Staphylococcus aureus subsp. aureus N315
cuuuuauuacuuauuucuu

SEQ ID NO: 4052515 - RNA, 12 nt, Staphylococcus aureus subsp. aureus N315
cuuuuauuuuca

SEQ ID NO: 4052516 - RNA, 12 nt, Staphylococcus aureus subsp. aureus N315
cuuuucaaaaua

SEQ ID NO: 4052517 - RNA, 17 nt, Staphylococcus aureus subsp. aureus N315
cuuuucaaacauauuca

SEQ ID NO: 4052518 - RNA, 18 nt, Staphylococcus aureus subsp. aureus N315
cuuuucaaacauauucau

SEQ ID NO: 4052519 - RNA, 15 nt, Staphylococcus aureus subsp. aureus N315
cuuuucaaagccaca

SEQ ID NO: 4052520 - RNA, 22 nt, Staphylococcus aureus subsp. aureus N315
cuuuucaucaguugagugauuu

SEQ ID NO: 4052521 - RNA, 19 nt, Staphylococcus aureus subsp. aureus N315
cuuuucauuaucauuaagu

SEQ ID NO: 4052522 - RNA, 21 nt, Staphylococcus aureus subsp. aureus N315
cuuuuccauaaauauuuaaaa

SEQ ID NO: 4052523 - RNA, 14 nt, Staphylococcus aureus subsp. aureus N315
cuuuuccauucaua

SEQ ID NO: 4052524 - RNA, 16 nt, Staphylococcus aureus subsp. aureus N315
cuuuuccuugauucuu

SEQ ID NO: 4052525 - RNA, 21 nt, Staphylococcus aureus subsp. aureus N315
cuuuugagacguuuuccauga

SEQ ID NO: 4052526 - RNA, 19 nt, Staphylococcus aureus subsp. aureus N315
cuuuugauagcuaaugcau

SEQ ID NO: 4052527 - RNA, 20 nt, Staphylococcus aureus subsp. aureus N315
cuuuugauguuuaugacaaa

SEQ ID NO: 4052528 - RNA, 14 nt, Staphylococcus aureus subsp. aureus N315
cuuuugauuuugaa

SEQ ID NO: 4052529 - RNA, 16 nt, Staphylococcus aureus subsp. aureus N315
cuuuugcuguaucuuc

SEQ ID NO: 4052530 - RNA, 13 nt, Staphylococcus aureus subsp. aureus N315
cuuuuguaaaaaa

SEQ ID NO: 4052531 - RNA, 21 nt, Staphylococcus aureus subsp. aureus N315
cuuuuguaaagcuuuaguuaa

SEQ ID NO: 4052532 - RNA, 15 nt, Staphylococcus aureus subsp. aureus N315
cuuuuguaauugaaa

SEQ ID NO: 4052533 - RNA, 20 nt, Staphylococcus aureus subsp. aureus N315
cuuuuguguuugcccugcug

SEQ ID NO: 4052534 - RNA, 13 nt, Staphylococcus aureus subsp. aureus N315
cuuuuguuaaaaa

SEQ ID NO: 4052535 - RNA, 14 nt, Staphylococcus aureus subsp. aureus N315
cuuuuguuaaaaaa

SEQ ID NO: 4052536 - RNA, 19 nt, Staphylococcus aureus subsp. aureus N315
cuuuuguuuaguauggaau

SEQ ID NO: 4052537 - RNA, 18 nt, Staphylococcus aureus subsp. aureus N315
cuuuuguuuucacuguuu

SEQ ID NO: 4052538 - RNA, 12 nt, Staphylococcus aureus subsp. aureus N315
cuuuuuaaaaaa

SEQ ID NO: 4052539 - RNA, 15 nt, Staphylococcus aureus subsp. aureus N315
cuuuuuaaaaaauuu

SEQ ID NO: 4052540 - RNA, 12 nt, Staphylococcus aureus subsp. aureus N315
cuuuuuaaaaua

SEQ ID NO: 4052541 - RNA, 15 nt, Staphylococcus aureus subsp. aureus N315
cuuuuuaaaaucguu

SEQ ID NO: 4052542 - RNA, 21 nt, Staphylococcus aureus subsp. aureus N315
cuuuuuaaaaucguuaaggaa

SEQ ID NO: 4052543 - RNA, 12 nt, Staphylococcus aureus subsp. aureus N315
cuuuuuaaagua

SEQ ID NO: 4052544 - RNA, 21 nt, Staphylococcus aureus subsp. aureus N315
cuuuuuaacuauguuacuuau

SEQ ID NO: 4052545 - RNA, 23 nt, Staphylococcus aureus subsp. aureus N315
cuuuuuaacuauguuacuuauau

SEQ ID NO: 4052546 - RNA, 21 nt, Staphylococcus aureus subsp. aureus N315
cuuuuuacuaggaauauaaaa

SEQ ID NO: 4052547 - RNA, 20 nt, Staphylococcus aureus subsp. aureus N315
cuuuuuacuauguaacuuua

SEQ ID NO: 4052548 - RNA, 17 nt, Staphylococcus aureus subsp. aureus N315
cuuuuuagccccagcaa

SEQ ID NO: 4052549 - RNA, 23 nt, Staphylococcus aureus subsp. aureus N315
cuuuuuagccccagcaaauacuu

SEQ ID NO: 4052550 - RNA, 13 nt, Staphylococcus aureus subsp. aureus N315
cuuuuuauauaau

SEQ ID NO: 4052551 - RNA, 15 nt, Staphylococcus aureus subsp. aureus N315
cuuuuuauaucaaaa

SEQ ID NO: 4052552 - RNA, 19 nt, Staphylococcus aureus subsp. aureus N315
cuuuuuaucaacaaauuua

SEQ ID NO: 4052553 - RNA, 17 nt, Staphylococcus aureus subsp. aureus N315
cuuuuuauuauacuuua

SEQ ID NO: 4052554 - RNA, 17 nt, Staphylococcus aureus subsp. aureus N315
cuuuuuauuuuaauauu

SEQ ID NO: 4052555 - RNA, 14 nt, Staphylococcus aureus subsp. aureus N315
cuuuuuauuuuguu

SEQ ID NO: 4052556 - RNA, 14 nt, Staphylococcus aureus subsp. aureus N315
cuuuuuauuuuuug

SEQ ID NO: 4052557 - RNA, 22 nt, Staphylococcus aureus subsp. aureus N315
cuuuuucacgauuuuuaaaaug

SEQ ID NO: 4052558 - RNA, 15 nt, Staphylococcus aureus subsp. aureus N315
cuuuuucauagaaca

SEQ ID NO: 4052559 - RNA, 16 nt, Staphylococcus aureus subsp. aureus N315
cuuuuuccauuuuuuu

SEQ ID NO: 4052560 - RNA, 16 nt, Staphylococcus aureus subsp. aureus N315
cuuuuucuaaauaaac

SEQ ID NO: 4052561 - RNA, 17 nt, Staphylococcus aureus subsp. aureus N315
cuuuuucuaccaauaau

SEQ ID NO: 4052562 - RNA, 14 nt, Staphylococcus aureus subsp. aureus N315
cuuuuucuauacaa

SEQ ID NO: 4052563 - RNA, 17 nt, Staphylococcus aureus subsp. aureus N315
cuuuuucuauacaauga

SEQ ID NO: 4052564 - RNA, 13 nt, Staphylococcus aureus subsp. aureus N315
cuuuuucuuucau

SEQ ID NO: 4052565 - RNA, 21 nt, Staphylococcus aureus subsp. aureus N315
cuuuuugacauauuuuuuaaa

SEQ ID NO: 4052566 - RNA, 21 nt, Staphylococcus aureus subsp. aureus N315
cuuuuugcguuuuuaaauaau

SEQ ID NO: 4052567 - RNA, 15 nt, Staphylococcus aureus subsp. aureus N315
cuuuuugcuuaguac

SEQ ID NO: 4052568 - RNA, 15 nt, Staphylococcus aureus subsp. aureus N315
cuuuuuguguaucug

SEQ ID NO: 4052569 - RNA, 13 nt, Staphylococcus aureus subsp. aureus N315
cuuuuuguuuauc

SEQ ID NO: 4052570 - RNA, 14 nt, Staphylococcus aureus subsp. aureus N315
cuuuuuuaaauuua

SEQ ID NO: 4052571 - RNA, 14 nt, Staphylococcus aureus subsp. aureus N315
cuuuuuuaacuuua

SEQ ID NO: 4052572 - RNA, 20 nt, Staphylococcus aureus subsp. aureus N315
cuuuuuuauuuuauaagaau

SEQ ID NO: 4052573 - RNA, 20 nt, Staphylococcus aureus subsp. aureus N315
cuuuuuucucuucuugaggu

SEQ ID NO: 4052574 - RNA, 13 nt, Staphylococcus aureus subsp. aureus N315
cuuuuuugugauu

SEQ ID NO: 4052575 - RNA, 17 nt, Staphylococcus aureus subsp. aureus N315
cuuuuuuguuauugcuu

SEQ ID NO: 4052576 - RNA, 23 nt, Staphylococcus aureus subsp. aureus N315
cuuuuuuuaaaucuucuauuuuc

SEQ ID NO: 4052577 - RNA, 21 nt, Staphylococcus aureus subsp. aureus N315
cuuuuuuuguuuauuuagaau

SEQ ID NO: 4052578 - RNA, 13 nt, Staphylococcus aureus subsp. aureus N315
cuuuuuuuuauaa

SEQ ID NO: 4052579 - RNA, 19 nt, Staphylococcus aureus subsp. aureus N315
gaaaaaccaaguuuugcac

SEQ ID NO: 4052580 - RNA, 19 nt, Staphylococcus aureus subsp. aureus N315
gaaaaacuguaaaucauca

SEQ ID NO: 4052581 - RNA, 20 nt, Staphylococcus aureus subsp. aureus N315
gaaaaacuuuucauggaguc

SEQ ID NO: 4052582 - RNA, 20 nt, Staphylococcus aureus subsp. aureus N315
gaaaaagauucggaaaauau

SEQ ID NO: 4052583 - RNA, 20 nt, Staphylococcus aureus subsp. aureus N315
gaaaaagugauaauuaaaau

SEQ ID NO: 4052584 - RNA, 11 nt, Staphylococcus aureus subsp. aureus N315
gaaaaauaauu

SEQ ID NO: 4052585 - RNA, 19 nt, Staphylococcus aureus subsp. aureus N315
gaaaaauguguuaaaauau

SEQ ID NO: 4052586 - RNA, 12 nt, Staphylococcus aureus subsp. aureus N315
gaaaaauuaaaa

SEQ ID NO: 4052587 - RNA, 16 nt, Staphylococcus aureus subsp. aureus N315
gaaaaauuucaaaaau

SEQ ID NO: 4052588 - RNA, 20 nt, Staphylococcus aureus subsp. aureus N315
gaaaaauuucaaaaauagcg

SEQ ID NO: 4052589 - RNA, 13 nt, Staphylococcus aureus subsp. aureus N315
gaaaacaaacaag

SEQ ID NO: 4052590 - RNA, 14 nt, Staphylococcus aureus subsp. aureus N315
gaaaacagguggaa

SEQ ID NO: 4052591 - RNA, 23 nt, Staphylococcus aureus subsp. aureus N315
gaaaacguugaguauuacuugaa

SEQ ID NO: 4052592 - RNA, 16 nt, Staphylococcus aureus subsp. aureus N315
gaaaacuauuuuaaaa

SEQ ID NO: 4052593 - RNA, 16 nt, Staphylococcus aureus subsp. aureus N315
gaaaagaaauucuaca

SEQ ID NO: 4052594 - RNA, 19 nt, Staphylococcus aureus subsp. aureus N315
gaaaagaaauucuacaggu

SEQ ID NO: 4052595 - RNA, 14 nt, Staphylococcus aureus subsp. aureus N315
gaaaaguauaugaa

SEQ ID NO: 4052596 - RNA, 18 nt, Staphylococcus aureus subsp. aureus N315
gaaaagugaaaacuucuc

SEQ ID NO: 4052597 - RNA, 16 nt, Staphylococcus aureus subsp. aureus N315
gaaaaguuacagugua

SEQ ID NO: 4052598 - RNA, 14 nt, Staphylococcus aureus subsp. aureus N315
gaaaauaaaaacca

SEQ ID NO: 4052599 - RNA, 19 nt, Staphylococcus aureus subsp. aureus N315
gaaaauaagcaucacauau

SEQ ID NO: 4052600 - RNA, 16 nt, Staphylococcus aureus subsp. aureus N315
gaaaauaagcuuguaa

SEQ ID NO: 4052601 - RNA, 20 nt, Staphylococcus aureus subsp. aureus N315
gaaaauaaucgaacagaaaa

SEQ ID NO: 4052602 - RNA, 21 nt, Staphylococcus aureus subsp. aureus N315
gaaaauaaucgaacagaaaau

SEQ ID NO: 4052603 - RNA, 19 nt, Staphylococcus aureus subsp. aureus N315
gaaaauaccucuacauuau

SEQ ID NO: 4052604 - RNA, 21 nt, Staphylococcus aureus subsp. aureus N315
gaaaauaccucuacauuauau

SEQ ID NO: 4052605 - RNA, 15 nt, Staphylococcus aureus subsp. aureus N315
gaaaauagaaagaaa

SEQ ID NO: 4052606 - RNA, 18 nt, Staphylococcus aureus subsp. aureus N315
gaaaauagcuauuaaaau

SEQ ID NO: 4052607 - RNA, 21 nt, Staphylococcus aureus subsp. aureus N315
gaaaauagcuauuaaaauaga

SEQ ID NO: 4052608 - RNA, 22 nt, Staphylococcus aureus subsp. aureus N315
gaaaauagcuauuaaaauagag

SEQ ID NO: 4052609 - RNA, 13 nt, Staphylococcus aureus subsp. aureus N315
gaaaauagcuguu

SEQ ID NO: 4052610 - RNA, 20 nt, Staphylococcus aureus subsp. aureus N315
gaaaauagcuguuugauauu

SEQ ID NO: 4052611 - RNA, 20 nt, Staphylococcus aureus subsp. aureus N315
gaaaauauaguggugguacu

SEQ ID NO: 4052612 - RNA, 12 nt, Staphylococcus aureus subsp. aureus N315
gaaaauaucauu

SEQ ID NO: 4052613 - RNA, 18 nt, Staphylococcus aureus subsp. aureus N315
gaaaaugacgauacguau

SEQ ID NO: 4052614 - RNA, 22 nt, Staphylococcus aureus subsp. aureus N315
gaaaauucgcuuguaacaagcu

SEQ ID NO: 4052615 - RNA, 18 nt, Staphylococcus aureus subsp. aureus N315
gaaaauugaguauauuca

SEQ ID NO: 4052616 - RNA, 14 nt, Staphylococcus aureus subsp. aureus N315
gaaaauugcuaaaa

SEQ ID NO: 4052617 - RNA, 13 nt, Staphylococcus aureus subsp. aureus N315
gaaacaaauuagu

SEQ ID NO: 4052618 - RNA, 15 nt, Staphylococcus aureus subsp. aureus N315
gaaacacacuaaaag

SEQ ID NO: 4052619 - RNA, 16 nt, Staphylococcus aureus subsp. aureus N315
gaaacaucuugauauu

SEQ ID NO: 4052620 - RNA, 14 nt, Staphylococcus aureus subsp. aureus N315
gaaacauuaaaaua

SEQ ID NO: 4052621 - RNA, 21 nt, Staphylococcus aureus subsp. aureus N315
gaaaccgcuucucgccuaauu

SEQ ID NO: 4052622 - RNA, 21 nt, Staphylococcus aureus subsp. aureus N315
gaaaccuuucgauaaacuaca

SEQ ID NO: 4052623 - RNA, 13 nt, Staphylococcus aureus subsp. aureus N315
gaaacuaaauuaa

SEQ ID NO: 4052624 - RNA, 17 nt, Staphylococcus aureus subsp. aureus N315
gaaacuuccaacauaua

SEQ ID NO: 4052625 - RNA, 13 nt, Staphylococcus aureus subsp. aureus N315
gaaacuuguccgu

SEQ ID NO: 4052626 - RNA, 14 nt, Staphylococcus aureus subsp. aureus N315
gaaacuuuaauacu

SEQ ID NO: 4052627 - RNA, 20 nt, Staphylococcus aureus subsp. aureus N315
gaaacuuucguauuuuucuu

SEQ ID NO: 4052628 - RNA, 21 nt, Staphylococcus aureus subsp. aureus N315
gaaacuuucguauuuuucuug

SEQ ID NO: 4052629 - RNA, 22 nt, Staphylococcus aureus subsp. aureus N315
gaaagaugggauuucacuugac

SEQ ID NO: 4052630 - RNA, 22 nt, Staphylococcus aureus subsp. aureus N315
gaaagcuaauggcuaauacaaa

SEQ ID NO: 4052631 - RNA, 21 nt, Staphylococcus aureus subsp. aureus N315
gaaagguauaucuucauuuaa

SEQ ID NO: 4052632 - RNA, 22 nt, Staphylococcus aureus subsp. aureus N315
gaaaguaccuaaaauagaaaaa

SEQ ID NO: 4052633 - RNA, 20 nt, Staphylococcus aureus subsp. aureus N315
gaaaguauuagauauauuug

SEQ ID NO: 4052634 - RNA, 23 nt, Staphylococcus aureus subsp. aureus N315
gaaagucuuuaacccaaauugau

SEQ ID NO: 4052635 - RNA, 22 nt, Staphylococcus aureus subsp. aureus N315
gaaaguugguuuuauuaauucu

SEQ ID NO: 4052636 - RNA, 16 nt, Staphylococcus aureus subsp. aureus N315
gaaauaaaaaaacacc

SEQ ID NO: 4052637 - RNA, 16 nt, Staphylococcus aureus subsp. aureus N315
gaaauaccuccugauu

SEQ ID NO: 4052638 - RNA, 17 nt, Staphylococcus aureus subsp. aureus N315
gaaauacuugaauuuaa

SEQ ID NO: 4052639 - RNA, 22 nt, Staphylococcus aureus subsp. aureus N315
gaaauacuugaauuuaauaagu

SEQ ID NO: 4052640 - RNA, 18 nt, Staphylococcus aureus subsp. aureus N315
gaaauaggcgcuuguaaa

SEQ ID NO: 4052641 - RNA, 23 nt, Staphylococcus aureus subsp. aureus N315
gaaauauaccaaccaaaaccaaa

SEQ ID NO: 4052642 - RNA, 17 nt, Staphylococcus aureus subsp. aureus N315
gaaauauuguaaucacu

SEQ ID NO: 4052643 - RNA, 19 nt, Staphylococcus aureus subsp. aureus N315
gaaauauuugaaaauuuca

SEQ ID NO: 4052644 - RNA, 14 nt, Staphylococcus aureus subsp. aureus N315
gaaaucaaaaauaa

SEQ ID NO: 4052645 - RNA, 20 nt, Staphylococcus aureus subsp. aureus N315
gaaaucaaaaauaauuauga

SEQ ID NO: 4052646 - RNA, 17 nt, Staphylococcus aureus subsp. aureus N315
gaaaucaccagauuuua

SEQ ID NO: 4052647 - RNA, 19 nt, Staphylococcus aureus subsp. aureus N315
gaaauccgcauaaauuaga

SEQ ID NO: 4052648 - RNA, 16 nt, Staphylococcus aureus subsp. aureus N315
gaaauccguuaaaauu

SEQ ID NO: 4052649 - RNA, 18 nt, Staphylococcus aureus subsp. aureus N315
gaaaucucggcauuuuua

SEQ ID NO: 4052650 - RNA, 19 nt, Staphylococcus aureus subsp. aureus N315
gaaaugacgauaccuuuaa

SEQ ID NO: 4052651 - RNA, 20 nt, Staphylococcus aureus subsp. aureus N315
gaaaugauaagaaucaucua

SEQ ID NO: 4052652 - RNA, 15 nt, Staphylococcus aureus subsp. aureus N315
gaaaugauaauuuaa

SEQ ID NO: 4052653 - RNA, 21 nt, Staphylococcus aureus subsp. aureus N315
gaaaugauacauuauuaaaua

SEQ ID NO: 4052654 - RNA, 13 nt, Staphylococcus aureus subsp. aureus N315
gaaaugcaaugag

SEQ ID NO: 4052655 - RNA, 11 nt, Staphylococcus aureus subsp. aureus N315
gaaauguagau

SEQ ID NO: 4052656 - RNA, 19 nt, Staphylococcus aureus subsp. aureus N315
gaaauguauaugagguuca

SEQ ID NO: 4052657 - RNA, 21 nt, Staphylococcus aureus subsp. aureus N315
gaaauguaugauauaaaccau

SEQ ID NO: 4052658 - RNA, 21 nt, Staphylococcus aureus subsp. aureus N315
gaaauguuuaucaauucccug

SEQ ID NO: 4052659 - RNA, 16 nt, Staphylococcus aureus subsp. aureus N315
gaaauguuuuggaaaa

SEQ ID NO: 4052660 - RNA, 14 nt, Staphylococcus aureus subsp. aureus N315
gaaauuaaaucgac

SEQ ID NO: 4052661 - RNA, 13 nt, Staphylococcus aureus subsp. aureus N315
gaaauuaaauuca

SEQ ID NO: 4052662 - RNA, 17 nt, Staphylococcus aureus subsp. aureus N315
gaaauuagaaccaucau

SEQ ID NO: 4052663 - RNA, 21 nt, Staphylococcus aureus subsp. aureus N315
gaaauucuacaaacaaugcaa

SEQ ID NO: 4052664 - RNA, 17 nt, Staphylococcus aureus subsp. aureus N315
gaaauucuacaggcaau

SEQ ID NO: 4052665 - RNA, 21 nt, Staphylococcus aureus subsp. aureus N315
gaaauucuacaggcaaugcaa

SEQ ID NO: 4052666 - RNA, 22 nt, Staphylococcus aureus subsp. aureus N315
gaaauucuacaggcaaugcaag

SEQ ID NO: 4052667 - RNA, 15 nt, Staphylococcus aureus subsp. aureus N315
gaaauucuacaggua

SEQ ID NO: 4052668 - RNA, 17 nt, Staphylococcus aureus subsp. aureus N315
gaaauucuacagguaau

SEQ ID NO: 4052669 - RNA, 21 nt, Staphylococcus aureus subsp. aureus N315
gaaauucuacagguaaugcaa

SEQ ID NO: 4052670 - RNA, 22 nt, Staphylococcus aureus subsp. aureus N315
gaaauucuacagguaaugcaag

SEQ ID NO: 4052671 - RNA, 23 nt, Staphylococcus aureus subsp. aureus N315
gaaauucuacagguaaugcaagu

SEQ ID NO: 4052672 - RNA, 20 nt, Staphylococcus aureus subsp. aureus N315
gaaauucucaguguuggggg

SEQ ID NO: 4052673 - RNA, 16 nt, Staphylococcus aureus subsp. aureus N315
gaaauugacaguuucc

SEQ ID NO: 4052674 - RNA, 18 nt, Staphylococcus aureus subsp. aureus N315
gaaauuguguuucuuuua

SEQ ID NO: 4052675 - RNA, 13 nt, Staphylococcus aureus subsp. aureus N315
gaaauuuauuaua

SEQ ID NO: 4052676 - RNA, 16 nt, Staphylococcus aureus subsp. aureus N315
gaaauuucgacaucua

SEQ ID NO: 4052677 - RNA, 22 nt, Staphylococcus aureus subsp. aureus N315
gaaauuuuuuagugaaaaaguu

SEQ ID NO: 4052678 - RNA, 15 nt, Staphylococcus aureus subsp. aureus N315
gaacaaaauaacaug

SEQ ID NO: 4052679 - RNA, 20 nt, Staphylococcus aureus subsp. aureus N315
gaacaacauugagauuaucu

SEQ ID NO: 4052680 - RNA, 16 nt, Staphylococcus aureus subsp. aureus N315
gaacaagucuugcaau

SEQ ID NO: 4052681 - RNA, 19 nt, Staphylococcus aureus subsp. aureus N315
gaacaauaccgccuacugu

SEQ ID NO: 4052682 - RNA, 22 nt, Staphylococcus aureus subsp. aureus N315
gaacaaucggaagcauauuucu

SEQ ID NO: 4052683 - RNA, 17 nt, Staphylococcus aureus subsp. aureus N315
gaacacgaaauggugaa

SEQ ID NO: 4052684 - RNA, 21 nt, Staphylococcus aureus subsp. aureus N315
gaacagauauacuacuuguuu

SEQ ID NO: 4052685 - RNA, 16 nt, Staphylococcus aureus subsp. aureus N315
gaacagcacauuuuua

SEQ ID NO: 4052686 - RNA, 19 nt, Staphylococcus aureus subsp. aureus N315
gaacagcaucuuguucuuc

SEQ ID NO: 4052687 - RNA, 14 nt, Staphylococcus aureus subsp. aureus N315
gaacaguacgauua

SEQ ID NO: 4052688 - RNA, 17 nt, Staphylococcus aureus subsp. aureus N315
gaacaguuagugcuugu

SEQ ID NO: 4052689 - RNA, 13 nt, Staphylococcus aureus subsp. aureus N315
gaacauaaauaaa

SEQ ID NO: 4052690 - RNA, 16 nt, Staphylococcus aureus subsp. aureus N315
gaacauaccugcauau

SEQ ID NO: 4052691 - RNA, 22 nt, Staphylococcus aureus subsp. aureus N315
gaacauaccugcauauguguuu

SEQ ID NO: 4052692 - RNA, 15 nt, Staphylococcus aureus subsp. aureus N315
gaacauauuauaaaa

SEQ ID NO: 4052693 - RNA, 13 nt, Staphylococcus aureus subsp. aureus N315
gaacaucaucuau

SEQ ID NO: 4052694 - RNA, 12 nt, Staphylococcus aureus subsp. aureus N315
gaacaucugaaa

SEQ ID NO: 4052695 - RNA, 15 nt, Staphylococcus aureus subsp. aureus N315
gaacaucugaaaaaa

SEQ ID NO: 4052696 - RNA, 16 nt, Staphylococcus aureus subsp. aureus N315
gaacaucugaaaaaau

SEQ ID NO: 4052697 - RNA, 18 nt, Staphylococcus aureus subsp. aureus N315
gaacaugguaucuuuaau

SEQ ID NO: 4052698 - RNA, 14 nt, Staphylococcus aureus subsp. aureus N315
gaacauuaaaagga

SEQ ID NO: 4052699 - RNA, 23 nt, Staphylococcus aureus subsp. aureus N315
gaacauuuaucgugaagaaaaaa

SEQ ID NO: 4052700 - RNA, 23 nt, Staphylococcus aureus subsp. aureus N315
gaaccaauccaauauacaaugcu

SEQ ID NO: 4052701 - RNA, 16 nt, Staphylococcus aureus subsp. aureus N315
gaaccugcugaaguuu

SEQ ID NO: 4052702 - RNA, 21 nt, Staphylococcus aureus subsp. aureus N315
gaacgauauuuuaaaaaguaa

SEQ ID NO: 4052703 - RNA, 19 nt, Staphylococcus aureus subsp. aureus N315
gaacgcuagcauaucuuua

SEQ ID NO: 4052704 - RNA, 18 nt, Staphylococcus aureus subsp. aureus N315
gaacguaaguuuaguuca

SEQ ID NO: 4052705 - RNA, 15 nt, Staphylococcus aureus subsp. aureus N315
gaacuaacauaauuu

SEQ ID NO: 4052706 - RNA, 16 nt, Staphylococcus aureus subsp. aureus N315
gaacuaagaugugcau

SEQ ID NO: 4052707 - RNA, 19 nt, Staphylococcus aureus subsp. aureus N315
gaacuacaauucauaagaa

SEQ ID NO: 4052708 - RNA, 17 nt, Staphylococcus aureus subsp. aureus N315
gaacuagacaagaugcu

SEQ ID NO: 4052709 - RNA, 18 nt, Staphylococcus aureus subsp. aureus N315
gaacuaguacgaaaugca

SEQ ID NO: 4052710 - RNA, 16 nt, Staphylococcus aureus subsp. aureus N315
gaacucugagcacuua

SEQ ID NO: 4052711 - RNA, 20 nt, Staphylococcus aureus subsp. aureus N315
gaacugccaauauaacauuu

SEQ ID NO: 4052712 - RNA, 16 nt, Staphylococcus aureus subsp. aureus N315
gaacuuaaugcuucaa

SEQ ID NO: 4052713 - RNA, 23 nt, Staphylococcus aureus subsp. aureus N315
gaacuuauaaguccgauuugaua

SEQ ID NO: 4052714 - RNA, 13 nt, Staphylococcus aureus subsp. aureus N315
gaacuuuaaaaau

SEQ ID NO: 4052715 - RNA, 15 nt, Staphylococcus aureus subsp. aureus N315
gaacuuuaauaccag

SEQ ID NO: 4052716 - RNA, 19 nt, Staphylococcus aureus subsp. aureus N315
gaagaaacuuaaucaagcu

SEQ ID NO: 4052717 - RNA, 15 nt, Staphylococcus aureus subsp. aureus N315
gaagaauacaaauau

SEQ ID NO: 4052718 - RNA, 21 nt, Staphylococcus aureus subsp. aureus N315
gaagaaucaggaccaaauaga

SEQ ID NO: 4052719 - RNA, 15 nt, Staphylococcus aureus subsp. aureus N315
gaagaaugauacugu

SEQ ID NO: 4052720 - RNA, 13 nt, Staphylococcus aureus subsp. aureus N315
gaagaccauuuua

SEQ ID NO: 4052721 - RNA, 17 nt, Staphylococcus aureus subsp. aureus N315
gaagauaggauuuacac

SEQ ID NO: 4052722 - RNA, 23 nt, Staphylococcus aureus subsp. aureus N315
gaagauauuuauaagaggagaaa

SEQ ID NO: 4052723 - RNA, 18 nt, Staphylococcus aureus subsp. aureus N315
gaagcaaaagaugaaaau

SEQ ID NO: 4052724 - RNA, 14 nt, Staphylococcus aureus subsp. aureus N315
gaagcacagaaaau

SEQ ID NO: 4052725 - RNA, 15 nt, Staphylococcus aureus subsp. aureus N315
gaagcacagaaaauu

SEQ ID NO: 4052726 - RNA, 20 nt, Staphylococcus aureus subsp. aureus N315
gaagcaguuguugguuuugc

SEQ ID NO: 4052727 - RNA, 20 nt, Staphylococcus aureus subsp. aureus N315
gaagcuaaaugcucaagcca

SEQ ID NO: 4052728 - RNA, 21 nt, Staphylococcus aureus subsp. aureus N315
gaaggaauaauuuuaaaaaua

SEQ ID NO: 4052729 - RNA, 19 nt, Staphylococcus aureus subsp. aureus N315
gaaggaauguauucuaaga

SEQ ID NO: 4052730 - RNA, 20 nt, Staphylococcus aureus subsp. aureus N315
gaaggacaggaauaaauuuu

SEQ ID NO: 4052731 - RNA, 17 nt, Staphylococcus aureus subsp. aureus N315
gaaggagauauuuucuu

SEQ ID NO: 4052732 - RNA, 22 nt, Staphylococcus aureus subsp. aureus N315
gaaggccauuuuuauuuaacac

SEQ ID NO: 4052733 - RNA, 16 nt, Staphylococcus aureus subsp. aureus N315
gaagggaguauuuuuu

SEQ ID NO: 4052734 - RNA, 22 nt, Staphylococcus aureus subsp. aureus N315
gaagucuugugauaauucuuca

SEQ ID NO: 4052735 - RNA, 13 nt, Staphylococcus aureus subsp. aureus N315
gaauaaaaaaguu

SEQ ID NO: 4052736 - RNA, 13 nt, Staphylococcus aureus subsp. aureus N315
gaauaaaauauau

SEQ ID NO: 4052737 - RNA, 14 nt, Staphylococcus aureus subsp. aureus N315
gaauaaaucgggca

SEQ ID NO: 4052738 - RNA, 21 nt, Staphylococcus aureus subsp. aureus N315
gaauaaauuuugcgaaaauau

SEQ ID NO: 4052739 - RNA, 13 nt, Staphylococcus aureus subsp. aureus N315
gaauaacaagaaa

SEQ ID NO: 4052740 - RNA, 13 nt, Staphylococcus aureus subsp. aureus N315
gaauaacacuaga

SEQ ID NO: 4052741 - RNA, 15 nt, Staphylococcus aureus subsp. aureus N315
gaauaacgucauaug

SEQ ID NO: 4052742 - RNA, 21 nt, Staphylococcus aureus subsp. aureus N315
gaauaagugguuguucccauu

SEQ ID NO: 4052743 - RNA, 12 nt, Staphylococcus aureus subsp. aureus N315
gaauaauauauu

SEQ ID NO: 4052744 - RNA, 13 nt, Staphylococcus aureus subsp. aureus N315
gaauaauauauuu

SEQ ID NO: 4052745 - RNA, 13 nt, Staphylococcus aureus subsp. aureus N315
gaauaaucaucca

SEQ ID NO: 4052746 - RNA, 13 nt, Staphylococcus aureus subsp. aureus N315
gaauaauuaaaaa

SEQ ID NO: 4052747 - RNA, 23 nt, Staphylococcus aureus subsp. aureus N315
gaauaauuagauuuaaaauguca

SEQ ID NO: 4052748 - RNA, 18 nt, Staphylococcus aureus subsp. aureus N315
gaauacagaugaugcuuc

SEQ ID NO: 4052749 - RNA, 19 nt, Staphylococcus aureus subsp. aureus N315
gaauacaugaguaaaacuc

SEQ ID NO: 4052750 - RNA, 15 nt, Staphylococcus aureus subsp. aureus N315
gaauacuaaaagugu

SEQ ID NO: 4052751 - RNA, 20 nt, Staphylococcus aureus subsp. aureus N315
gaauacucuucaaucuacca

SEQ ID NO: 4052752 - RNA, 17 nt, Staphylococcus aureus subsp. aureus N315
gaauacuuuauuugaua

SEQ ID NO: 4052753 - RNA, 13 nt, Staphylococcus aureus subsp. aureus N315
gaauacuuuuuaa

SEQ ID NO: 4052754 - RNA, 19 nt, Staphylococcus aureus subsp. aureus N315
gaauagaugucacuguuaa

SEQ ID NO: 4052755 - RNA, 23 nt, Staphylococcus aureus subsp. aureus N315
gaauagugagcguauuauuauug

SEQ ID NO: 4052756 - RNA, 15 nt, Staphylococcus aureus subsp. aureus N315
gaauauaaaaaacac

SEQ ID NO: 4052757 - RNA, 22 nt, Staphylococcus aureus subsp. aureus N315
gaauauaaguaaucauaauaau

SEQ ID NO: 4052758 - RNA, 23 nt, Staphylococcus aureus subsp. aureus N315
gaauauagauuuuguauuagcau

SEQ ID NO: 4052759 - RNA, 21 nt, Staphylococcus aureus subsp. aureus N315
gaauaugaauugcuuguuuua

SEQ ID NO: 4052760 - RNA, 23 nt, Staphylococcus aureus subsp. aureus N315
gaauauuuauuguuuuuaaaauc

SEQ ID NO: 4052761 - RNA, 12 nt, Staphylococcus aureus subsp. aureus N315
gaaucaacaauu

SEQ ID NO: 4052762 - RNA, 22 nt, Staphylococcus aureus subsp. aureus N315
gaaucaacaauuuaaacgcacu

SEQ ID NO: 4052763 - RNA, 21 nt, Staphylococcus aureus subsp. aureus N315
gaaucagaugauuuaauucug

SEQ ID NO: 4052764 - RNA, 19 nt, Staphylococcus aureus subsp. aureus N315
gaauccaauuucucuaugu

SEQ ID NO: 4052765 - RNA, 14 nt, Staphylococcus aureus subsp. aureus N315
gaaucccauaauga

SEQ ID NO: 4052766 - RNA, 12 nt, Staphylococcus aureus subsp. aureus N315
gaauccuuaauu

SEQ ID NO: 4052767 - RNA, 13 nt, Staphylococcus aureus subsp. aureus N315
gaauccuucauca

SEQ ID NO: 4052768 - RNA, 14 nt, Staphylococcus aureus subsp. aureus N315
gaaucuagaauaua

SEQ ID NO: 4052769 - RNA, 13 nt, Staphylococcus aureus subsp. aureus N315
gaaucucauugau

SEQ ID NO: 4052770 - RNA, 17 nt, Staphylococcus aureus subsp. aureus N315
gaaucuuauuuuguuuu

SEQ ID NO: 4052771 - RNA, 22 nt, Staphylococcus aureus subsp. aureus N315
gaaucuuauuuuguuuuaaaaa

SEQ ID NO: 4052772 - RNA, 16 nt, Staphylococcus aureus subsp. aureus N315
gaaucuuggaaguauc

SEQ ID NO: 4052773 - RNA, 14 nt, Staphylococcus aureus subsp. aureus N315
gaaugaauaauucc

SEQ ID NO: 4052774 - RNA, 19 nt, Staphylococcus aureus subsp. aureus N315
gaaugagugucaugcuuaa

SEQ ID NO: 4052775 - RNA, 13 nt, Staphylococcus aureus subsp. aureus N315
gaaugaugaguau

SEQ ID NO: 4052776 - RNA, 17 nt, Staphylococcus aureus subsp. aureus N315
gaaugaugaguauacuu

SEQ ID NO: 4052777 - RNA, 23 nt, Staphylococcus aureus subsp. aureus N315
gaaugaugguguguacugauucc

SEQ ID NO: 4052778 - RNA, 14 nt, Staphylococcus aureus subsp. aureus N315
gaaugauuuauaaa

SEQ ID NO: 4052779 - RNA, 21 nt, Staphylococcus aureus subsp. aureus N315
gaaugcaaaucaaauacauca

SEQ ID NO: 4052780 - RNA, 13 nt, Staphylococcus aureus subsp. aureus N315
gaaugguauaauu

SEQ ID NO: 4052781 - RNA, 13 nt, Staphylococcus aureus subsp. aureus N315
gaauguacaauuu

SEQ ID NO: 4052782 - RNA, 18 nt, Staphylococcus aureus subsp. aureus N315
gaauguauucuaagaguu

SEQ ID NO: 4052783 - RNA, 13 nt, Staphylococcus aureus subsp. aureus N315
gaauguuccuugu

SEQ ID NO: 4052784 - RNA, 22 nt, Staphylococcus aureus subsp. aureus N315
gaauuaacuagugccucuuuua

SEQ ID NO: 4052785 - RNA, 16 nt, Staphylococcus aureus subsp. aureus N315
gaauuaguacuugaaa

SEQ ID NO: 4052786 - RNA, 18 nt, Staphylococcus aureus subsp. aureus N315
gaauuaucuauauaugaa

SEQ ID NO: 4052787 - RNA, 17 nt, Staphylococcus aureus subsp. aureus N315
gaauuauucaaguaaua

SEQ ID NO: 4052788 - RNA, 17 nt, Staphylococcus aureus subsp. aureus N315
gaauuauuuaaaaugcu

SEQ ID NO: 4052789 - RNA, 16 nt, Staphylococcus aureus subsp. aureus N315
gaauucaaccaauuau

SEQ ID NO: 4052790 - RNA, 11 nt, Staphylococcus aureus subsp. aureus N315
gaauucaacgu

SEQ ID NO: 4052791 - RNA, 22 nt, Staphylococcus aureus subsp. aureus N315
gaauucaacgucgaauguuucu

SEQ ID NO: 4052792 - RNA, 18 nt, Staphylococcus aureus subsp. aureus N315
gaauucacgcaauaucau

SEQ ID NO: 4052793 - RNA, 18 nt, Staphylococcus aureus subsp. aureus N315
gaauucauucaauacgaa

SEQ ID NO: 4052794 - RNA, 21 nt, Staphylococcus aureus subsp. aureus N315
gaauucuaaaagaauuauuca

SEQ ID NO: 4052795 - RNA, 13 nt, Staphylococcus aureus subsp. aureus N315
gaauucucgauuu

SEQ ID NO: 4052796 - RNA, 20 nt, Staphylococcus aureus subsp. aureus N315
gaauuuacuccuuacaauaa

SEQ ID NO: 4052797 - RNA, 23 nt, Staphylococcus aureus subsp. aureus N315
gaauuuagaugcauaaaaaaaga

SEQ ID NO: 4052798 - RNA, 18 nt, Staphylococcus aureus subsp. aureus N315
gaauuuagcaucaaaaau

SEQ ID NO: 4052799 - RNA, 21 nt, Staphylococcus aureus subsp. aureus N315
gaauuuaggaaugaauaaagc

SEQ ID NO: 4052800 - RNA, 22 nt, Staphylococcus aureus subsp. aureus N315
gaauuuaggaaugaauaaagcu

SEQ ID NO: 4052801 - RNA, 17 nt, Staphylococcus aureus subsp. aureus N315
gaauuucgaaaagaaau

SEQ ID NO: 4052802 - RNA, 18 nt, Staphylococcus aureus subsp. aureus N315
gaauuucgaaaagaaauu

SEQ ID NO: 4052803 - RNA, 19 nt, Staphylococcus aureus subsp. aureus N315
gaauuucguuauuaaacua

SEQ ID NO: 4052804 - RNA, 23 nt, Staphylococcus aureus subsp. aureus N315
gaauuucguuauuaaacuacgaa

SEQ ID NO: 4052805 - RNA, 18 nt, Staphylococcus aureus subsp. aureus N315
gaauuucuaauuaaacgc

SEQ ID NO: 4052806 - RNA, 16 nt, Staphylococcus aureus subsp. aureus N315
gaauuugcacaaagau

SEQ ID NO: 4052807 - RNA, 13 nt, Staphylococcus aureus subsp. aureus N315
gaauuuuaauaua

SEQ ID NO: 4052808 - RNA, 12 nt, Staphylococcus aureus subsp. aureus N315
gaauuuuauaaa

SEQ ID NO: 4052809 - RNA, 15 nt, Staphylococcus aureus subsp. aureus N315
gacaaaacuuguaau

SEQ ID NO: 4052810 - RNA, 13 nt, Staphylococcus aureus subsp. aureus N315
gacaaauguucua

SEQ ID NO: 4052811 - RNA, 18 nt, Staphylococcus aureus subsp. aureus N315
gacaaauguucuauagaa

SEQ ID NO: 4052812 - RNA, 23 nt, Staphylococcus aureus subsp. aureus N315
gacaaccgauauaauuaauuugu

SEQ ID NO: 4052813 - RNA, 14 nt, Staphylococcus aureus subsp. aureus N315
gacaaguaugucau

SEQ ID NO: 4052814 - RNA, 22 nt, Staphylococcus aureus subsp. aureus N315
gacaaguugcugaauaaaauau

SEQ ID NO: 4052815 - RNA, 17 nt, Staphylococcus aureus subsp. aureus N315
gacaaucuuaucauaau

SEQ ID NO: 4052816 - RNA, 23 nt, Staphylococcus aureus subsp. aureus N315
gacaauugcgaccauuaguacua

SEQ ID NO: 4052817 - RNA, 20 nt, Staphylococcus aureus subsp. aureus N315
gacacaucacuauacgcaau

SEQ ID NO: 4052818 - RNA, 17 nt, Staphylococcus aureus subsp. aureus N315
gacacauuuacuuaaga

SEQ ID NO: 4052819 - RNA, 23 nt, Staphylococcus aureus subsp. aureus N315
gacacgcccgacaucauaaauga

SEQ ID NO: 4052820 - RNA, 21 nt, Staphylococcus aureus subsp. aureus N315
gacacuauaccauuuuuauag

SEQ ID NO: 4052821 - RNA, 18 nt, Staphylococcus aureus subsp. aureus N315
gacacuuaacuuguguua

SEQ ID NO: 4052822 - RNA, 22 nt, Staphylococcus aureus subsp. aureus N315
gacagcaguaggauaauuucaa

SEQ ID NO: 4052823 - RNA, 19 nt, Staphylococcus aureus subsp. aureus N315
gacagcuacaauuuucuca

SEQ ID NO: 4052824 - RNA, 18 nt, Staphylococcus aureus subsp. aureus N315
gacaguuuccauaaauaa

SEQ ID NO: 4052825 - RNA, 11 nt, Staphylococcus aureus subsp. aureus N315
gacaguuuuua

SEQ ID NO: 4052826 - RNA, 14 nt, Staphylococcus aureus subsp. aureus N315
gacauaaaaaauaa

SEQ ID NO: 4052827 - RNA, 16 nt, Staphylococcus aureus subsp. aureus N315
gacauaaaacuuacau

SEQ ID NO: 4052828 - RNA, 14 nt, Staphylococcus aureus subsp. aureus N315
gacauaaggucuug

SEQ ID NO: 4052829 - RNA, 18 nt, Staphylococcus aureus subsp. aureus N315
gacauagaucaauauucu

SEQ ID NO: 4052830 - RNA, 20 nt, Staphylococcus aureus subsp. aureus N315
gacauagguauaaucauuua

SEQ ID NO: 4052831 - RNA, 16 nt, Staphylococcus aureus subsp. aureus N315
gacauaugcagugacu

SEQ ID NO: 4052832 - RNA, 18 nt, Staphylococcus aureus subsp. aureus N315
gacauuacauuuaguaca

SEQ ID NO: 4052833 - RNA, 13 nt, Staphylococcus aureus subsp. aureus N315
gacauugaauaaa

SEQ ID NO: 4052834 - RNA, 17 nt, Staphylococcus aureus subsp. aureus N315
gacauuuaaauauaacc

SEQ ID NO: 4052835 - RNA, 15 nt, Staphylococcus aureus subsp. aureus N315
gacauuuguaaauau

SEQ ID NO: 4052836 - RNA, 15 nt, Staphylococcus aureus subsp. aureus N315
gacauuuucaaguuu

SEQ ID NO: 4052837 - RNA, 23 nt, Staphylococcus aureus subsp. aureus N315
gacauuuuuggcuuaucaagcac

SEQ ID NO: 4052838 - RNA, 11 nt, Staphylococcus aureus subsp. aureus N315
gaccaacuugc

SEQ ID NO: 4052839 - RNA, 18 nt, Staphylococcus aureus subsp. aureus N315
gaccaacuugcacauuau

SEQ ID NO: 4052840 - RNA, 14 nt, Staphylococcus aureus subsp. aureus N315
gaccaaguaugaga

SEQ ID NO: 4052841 - RNA, 14 nt, Staphylococcus aureus subsp. aureus N315
gaccaauagcaauu

SEQ ID NO: 4052842 - RNA, 17 nt, Staphylococcus aureus subsp. aureus N315
gaccacggucuugauau

SEQ ID NO: 4052843 - RNA, 14 nt, Staphylococcus aureus subsp. aureus N315
gaccacuauuuuua

SEQ ID NO: 4052844 - RNA, 18 nt, Staphylococcus aureus subsp. aureus N315
gaccacucaauucucuaa

SEQ ID NO: 4052845 - RNA, 18 nt, Staphylococcus aureus subsp. aureus N315
gaccagucgcauauuuug

SEQ ID NO: 4052846 - RNA, 18 nt, Staphylococcus aureus subsp. aureus N315
gaccaugcaaacucauuu

SEQ ID NO: 4052847 - RNA, 19 nt, Staphylococcus aureus subsp. aureus N315
gaccaugcaaacucauuua

SEQ ID NO: 4052848 - RNA, 17 nt, Staphylococcus aureus subsp. aureus N315
gaccauuuuauauuuua

SEQ ID NO: 4052849 - RNA, 21 nt, Staphylococcus aureus subsp. aureus N315
gaccucagguuguuaggggcu

SEQ ID NO: 4052850 - RNA, 23 nt, Staphylococcus aureus subsp. aureus N315
gaccuuaucugaccaguauacga

SEQ ID NO: 4052851 - RNA, 19 nt, Staphylococcus aureus subsp. aureus N315
gacgaaacacacuaaaagc

SEQ ID NO: 4052852 - RNA, 20 nt, Staphylococcus aureus subsp. aureus N315
gacgaucuucaugaacagca

SEQ ID NO: 4052853 - RNA, 21 nt, Staphylococcus aureus subsp. aureus N315
gacgaucuucaugaacagcau

SEQ ID NO: 4052854 - RNA, 19 nt, Staphylococcus aureus subsp. aureus N315
gacgauuuauuaguuuuua

SEQ ID NO: 4052855 - RNA, 14 nt, Staphylococcus aureus subsp. aureus N315
gacguaauuaauag

SEQ ID NO: 4052856 - RNA, 17 nt, Staphylococcus aureus subsp. aureus N315
gacgugucauuggugga

SEQ ID NO: 4052857 - RNA, 16 nt, Staphylococcus aureus subsp. aureus N315
gacguuuuuuuauaaa

SEQ ID NO: 4052858 - RNA, 14 nt, Staphylococcus aureus subsp. aureus N315
gacuauauaacaca

SEQ ID NO: 4052859 - RNA, 17 nt, Staphylococcus aureus subsp. aureus N315
gacuaugcaaaugaaau

SEQ ID NO: 4052860 - RNA, 20 nt, Staphylococcus aureus subsp. aureus N315
gacuauuuuugaaaagagcg

SEQ ID NO: 4052861 - RNA, 16 nt, Staphylococcus aureus subsp. aureus N315
gacucuccuuuuuuaa

SEQ ID NO: 4052862 - RNA, 11 nt, Staphylococcus aureus subsp. aureus N315
gacugaaagaa

SEQ ID NO: 4052863 - RNA, 19 nt, Staphylococcus aureus subsp. aureus N315
gacugaacgaaaaugcgcu

SEQ ID NO: 4052864 - RNA, 20 nt, Staphylococcus aureus subsp. aureus N315
gacugaacgaaaaugcgcuu

SEQ ID NO: 4052865 - RNA, 20 nt, Staphylococcus aureus subsp. aureus N315
gacugaacgaaaauucgcuu

SEQ ID NO: 4052866 - RNA, 21 nt, Staphylococcus aureus subsp. aureus N315
gacugaaugagaaugugcuug

SEQ ID NO: 4052867 - RNA, 18 nt, Staphylococcus aureus subsp. aureus N315
gacugccaauaaaaugca

SEQ ID NO: 4052868 - RNA, 15 nt, Staphylococcus aureus subsp. aureus N315
gacuggguuguuauu

SEQ ID NO: 4052869 - RNA, 14 nt, Staphylococcus aureus subsp. aureus N315
gacuguagaaaaca

SEQ ID NO: 4052870 - RNA, 23 nt, Staphylococcus aureus subsp. aureus N315
gacuguuuuuuuguuugguguga

SEQ ID NO: 4052871 - RNA, 16 nt, Staphylococcus aureus subsp. aureus N315
gacuuaucguaagcuu

SEQ ID NO: 4052872 - RNA, 20 nt, Staphylococcus aureus subsp. aureus N315
gacuuauucaacguauaagu

SEQ ID NO: 4052873 - RNA, 19 nt, Staphylococcus aureus subsp. aureus N315
gacuuauuccgcaacuugu

SEQ ID NO: 4052874 - RNA, 14 nt, Staphylococcus aureus subsp. aureus N315
gacuuauuuuucau

SEQ ID NO: 4052875 - RNA, 18 nt, Staphylococcus aureus subsp. aureus N315
gacuucuaucuucacacu

SEQ ID NO: 4052876 - RNA, 14 nt, Staphylococcus aureus subsp. aureus N315
gacuucuuuauauu

SEQ ID NO: 4052877 - RNA, 19 nt, Staphylococcus aureus subsp. aureus N315
gacuucuuucaauuaaucg

SEQ ID NO: 4052878 - RNA, 17 nt, Staphylococcus aureus subsp. aureus N315
gacuugauaaaaaauga

SEQ ID NO: 4052879 - RNA, 16 nt, Staphylococcus aureus subsp. aureus N315
gacuugauagcauuuc

SEQ ID NO: 4052880 - RNA, 15 nt, Staphylococcus aureus subsp. aureus N315
gacuuggugcccaag

SEQ ID NO: 4052881 - RNA, 16 nt, Staphylococcus aureus subsp. aureus N315
gacuuggugcccaagu

SEQ ID NO: 4052882 - RNA, 18 nt, Staphylococcus aureus subsp. aureus N315
gacuuuaaaucuuguucu

SEQ ID NO: 4052883 - RNA, 16 nt, Staphylococcus aureus subsp. aureus N315
gacuuucuugaugaau

SEQ ID NO: 4052884 - RNA, 15 nt, Staphylococcus aureus subsp. aureus N315
gacuuugucauacua

SEQ ID NO: 4052885 - RNA, 18 nt, Staphylococcus aureus subsp. aureus N315
gacuuuuaaaaaacauac

SEQ ID NO: 4052886 - RNA, 23 nt, Staphylococcus aureus subsp. aureus N315
gacuuuuaaaaaacauaccugca

SEQ ID NO: 4052887 - RNA, 23 nt, Staphylococcus aureus subsp. aureus N315
gacuuuuacagaacguucauaua

SEQ ID NO: 4052888 - RNA, 17 nt, Staphylococcus aureus subsp. aureus N315
gacuuuuagauuaucuu

SEQ ID NO: 4052889 - RNA, 19 nt, Staphylococcus aureus subsp. aureus N315
gagaaauucgaaaagaaau

SEQ ID NO: 4052890 - RNA, 20 nt, Staphylococcus aureus subsp. aureus N315
gagaaccauccauaggauuc

SEQ ID NO: 4052891 - RNA, 14 nt, Staphylococcus aureus subsp. aureus N315
gagaaccuuuaaaa

SEQ ID NO: 4052892 - RNA, 14 nt, Staphylococcus aureus subsp. aureus N315
gagaaucuccauuu

SEQ ID NO: 4052893 - RNA, 17 nt, Staphylococcus aureus subsp. aureus N315
gagaauuucgaaaagaa

SEQ ID NO: 4052894 - RNA, 18 nt, Staphylococcus aureus subsp. aureus N315
gagacaaaaauaaaccau

SEQ ID NO: 4052895 - RNA, 14 nt, Staphylococcus aureus subsp. aureus N315
gagacaacauuguu

SEQ ID NO: 4052896 - RNA, 16 nt, Staphylococcus aureus subsp. aureus N315
gagacguuuuccauga

SEQ ID NO: 4052897 - RNA, 15 nt, Staphylococcus aureus subsp. aureus N315
gagacuauauucaau

SEQ ID NO: 4052898 - RNA, 14 nt, Staphylococcus aureus subsp. aureus N315
gagauauaaaggaa

SEQ ID NO: 4052899 - RNA, 21 nt, Staphylococcus aureus subsp. aureus N315
gagauauauuaauguuugaug

SEQ ID NO: 4052900 - RNA, 13 nt, Staphylococcus aureus subsp. aureus N315
gagaucuaacaau

SEQ ID NO: 4052901 - RNA, 20 nt, Staphylococcus aureus subsp. aureus N315
gagaugaggcgauaaaagaa

SEQ ID NO: 4052902 - RNA, 23 nt, Staphylococcus aureus subsp. aureus N315
gagaugaucagggaaaucaucug

SEQ ID NO: 4052903 - RNA, 20 nt, Staphylococcus aureus subsp. aureus N315
gagauuaucuuuagacauaa

SEQ ID NO: 4052904 - RNA, 21 nt, Staphylococcus aureus subsp. aureus N315
gagauuauuuuuuuaaaucua

SEQ ID NO: 4052905 - RNA, 18 nt, Staphylococcus aureus subsp. aureus N315
gagauucucgguuuuuuc

SEQ ID NO: 4052906 - RNA, 15 nt, Staphylococcus aureus subsp. aureus N315
gagauuguaagaauu

SEQ ID NO: 4052907 - RNA, 14 nt, Staphylococcus aureus subsp. aureus N315
gagauuuucuucau

SEQ ID NO: 4052908 - RNA, 15 nt, Staphylococcus aureus subsp. aureus N315
gagcaauucuucaau

SEQ ID NO: 4052909 - RNA, 19 nt, Staphylococcus aureus subsp. aureus N315
gagcaauucuucaauuuca

SEQ ID NO: 4052910 - RNA, 22 nt, Staphylococcus aureus subsp. aureus N315
gagcaguauauaucaaauacau

SEQ ID NO: 4052911 - RNA, 21 nt, Staphylococcus aureus subsp. aureus N315
gagcauuuuuauauccaucuc

SEQ ID NO: 4052912 - RNA, 22 nt, Staphylococcus aureus subsp. aureus N315
gagccauuauuauuuuuuucuu

SEQ ID NO: 4052913 - RNA, 20 nt, Staphylococcus aureus subsp. aureus N315
gagcgaccgugguucaaaaa

SEQ ID NO: 4052914 - RNA, 15 nt, Staphylococcus aureus subsp. aureus N315
gagcggaaauaugau

SEQ ID NO: 4052915 - RNA, 15 nt, Staphylococcus aureus subsp. aureus N315
gagcggaagauagga

SEQ ID NO: 4052916 - RNA, 16 nt, Staphylococcus aureus subsp. aureus N315
gagcucauguuucagu

SEQ ID NO: 4052917 - RNA, 14 nt, Staphylococcus aureus subsp. aureus N315
gagcuuuaauuuuu

SEQ ID NO: 4052918 - RNA, 19 nt, Staphylococcus aureus subsp. aureus N315
gaggauacauaaaucuaau

SEQ ID NO: 4052919 - RNA, 15 nt, Staphylococcus aureus subsp. aureus N315
gaggauauuuauucu

SEQ ID NO: 4052920 - RNA, 22 nt, Staphylococcus aureus subsp. aureus N315
gaggcacagcggaauacagaug

SEQ ID NO: 4052921 - RNA, 17 nt, Staphylococcus aureus subsp. aureus N315
gaggcgccacaacaugu

SEQ ID NO: 4052922 - RNA, 16 nt, Staphylococcus aureus subsp. aureus N315
gagggccccaacacag

SEQ ID NO: 4052923 - RNA, 19 nt, Staphylococcus aureus subsp. aureus N315
gagguguggaguaaagauc

SEQ ID NO: 4052924 - RNA, 22 nt, Staphylococcus aureus subsp. aureus N315
gaguaccaagaaauacucaguu

SEQ ID NO: 4052925 - RNA, 19 nt, Staphylococcus aureus subsp. aureus N315
gaguacuaaucaauacuaa

SEQ ID NO: 4052926 - RNA, 15 nt, Staphylococcus aureus subsp. aureus N315
gaguaguuucucuac

SEQ ID NO: 4052927 - RNA, 20 nt, Staphylococcus aureus subsp. aureus N315
gaguauacuuacugaaacua

SEQ ID NO: 4052928 - RNA, 11 nt, Staphylococcus aureus subsp. aureus N315
gaguauauucg

SEQ ID NO: 4052929 - RNA, 20 nt, Staphylococcus aureus subsp. aureus N315
gagucaaagucauuuagaua

SEQ ID NO: 4052930 - RNA, 14 nt, Staphylococcus aureus subsp. aureus N315
gagucuuauuuuua

SEQ ID NO: 4052931 - RNA, 15 nt, Staphylococcus aureus subsp. aureus N315
gagugaaaauaagau

SEQ ID NO: 4052932 - RNA, 12 nt, Staphylococcus aureus subsp. aureus N315
gagugauagaaa

SEQ ID NO: 4052933 - RNA, 19 nt, Staphylococcus aureus subsp. aureus N315
gaguguguccaucauuugu

SEQ ID NO: 4052934 - RNA, 14 nt, Staphylococcus aureus subsp. aureus N315
gaguuaauccucau

SEQ ID NO: 4052935 - RNA, 20 nt, Staphylococcus aureus subsp. aureus N315
gaguucuuuuugaugaucau

SEQ ID NO: 4052936 - RNA, 19 nt, Staphylococcus aureus subsp. aureus N315
gaguuggcaucagacuaaa

SEQ ID NO: 4052937 - RNA, 15 nt, Staphylococcus aureus subsp. aureus N315
gauaaaaguuguauu

SEQ ID NO: 4052938 - RNA, 20 nt, Staphylococcus aureus subsp. aureus N315
gauaaaaguuguauucugaa

SEQ ID NO: 4052939 - RNA, 13 nt, Staphylococcus aureus subsp. aureus N315
gauaaaaugauau

SEQ ID NO: 4052940 - RNA, 21 nt, Staphylococcus aureus subsp. aureus N315
gauaaacaagccaagauaaau

SEQ ID NO: 4052941 - RNA, 14 nt, Staphylococcus aureus subsp. aureus N315
gauaaacuacacac

SEQ ID NO: 4052942 - RNA, 16 nt, Staphylococcus aureus subsp. aureus N315
gauaaaugaauugucu

SEQ ID NO: 4052943 - RNA, 19 nt, Staphylococcus aureus subsp. aureus N315
gauaaaugaauugucuuaa

SEQ ID NO: 4052944 - RNA, 15 nt, Staphylococcus aureus subsp. aureus N315
gauaacaaaacgauu

SEQ ID NO: 4052945 - RNA, 21 nt, Staphylococcus aureus subsp. aureus N315
gauaacaagaaguaauguuaa

SEQ ID NO: 4052946 - RNA, 22 nt, Staphylococcus aureus subsp. aureus N315
gauaacaauuuuaaaucuuuua

SEQ ID NO: 4052947 - RNA, 21 nt, Staphylococcus aureus subsp. aureus N315
gauaacagcuacaaauaauga

SEQ ID NO: 4052948 - RNA, 20 nt, Staphylococcus aureus subsp. aureus N315
gauaacuacacuuaauauau

SEQ ID NO: 4052949 - RNA, 21 nt, Staphylococcus aureus subsp. aureus N315
gauaacuguaacgugaggccc

SEQ ID NO: 4052950 - RNA, 13 nt, Staphylococcus aureus subsp. aureus N315
gauaagaaaauac

SEQ ID NO: 4052951 - RNA, 21 nt, Staphylococcus aureus subsp. aureus N315
gauaagaaucaucuaaaugca

SEQ ID NO: 4052952 - RNA, 19 nt, Staphylococcus aureus subsp. aureus N315
gauaauaaagucaguuaac

SEQ ID NO: 4052953 - RNA, 18 nt, Staphylococcus aureus subsp. aureus N315
gauaauaaggaagcguau

SEQ ID NO: 4052954 - RNA, 18 nt, Staphylococcus aureus subsp. aureus N315
gauaauacuguuuaaaua

SEQ ID NO: 4052955 - RNA, 18 nt, Staphylococcus aureus subsp. aureus N315
gauaauagcuugagcauc

SEQ ID NO: 4052956 - RNA, 18 nt, Staphylococcus aureus subsp. aureus N315
gauaauccaccaaauaca

SEQ ID NO: 4052957 - RNA, 16 nt, Staphylococcus aureus subsp. aureus N315
gauaaucguuaaaaca

SEQ ID NO: 4052958 - RNA, 22 nt, Staphylococcus aureus subsp. aureus N315
gauaaucucauucuuuaauaua

SEQ ID NO: 4052959 - RNA, 22 nt, Staphylococcus aureus subsp. aureus N315
gauaauguaauuguuuuuucuu

SEQ ID NO: 4052960 - RNA, 22 nt, Staphylococcus aureus subsp. aureus N315
gauaauguacauguauaaaaga

SEQ ID NO: 4052961 - RNA, 23 nt, Staphylococcus aureus subsp. aureus N315
gauaauuaaaauaagauauauaa

SEQ ID NO: 4052962 - RNA, 20 nt, Staphylococcus aureus subsp. aureus N315
gauaauuauacguuacuaaa

SEQ ID NO: 4052963 - RNA, 23 nt, Staphylococcus aureus subsp. aureus N315
gauaauuucuucuucuguaauau

SEQ ID NO: 4052964 - RNA, 13 nt, Staphylococcus aureus subsp. aureus N315
gauacaaaccuaa

SEQ ID NO: 4052965 - RNA, 18 nt, Staphylococcus aureus subsp. aureus N315
gauacaaaggauuauuaa

SEQ ID NO: 4052966 - RNA, 21 nt, Staphylococcus aureus subsp. aureus N315
gauacacguaacgcaguugaa

SEQ ID NO: 4052967 - RNA, 13 nt, Staphylococcus aureus subsp. aureus N315
gauacagaaccaa

SEQ ID NO: 4052968 - RNA, 14 nt, Staphylococcus aureus subsp. aureus N315
gauaccaaacugcc

SEQ ID NO: 4052969 - RNA, 14 nt, Staphylococcus aureus subsp. aureus N315
gauaccuaaaauac

SEQ ID NO: 4052970 - RNA, 20 nt, Staphylococcus aureus subsp. aureus N315
gauaccuaagcugauuaaaa

SEQ ID NO: 4052971 - RNA, 18 nt, Staphylococcus aureus subsp. aureus N315
gauaccuuuaauaucuaa

SEQ ID NO: 4052972 - RNA, 14 nt, Staphylococcus aureus subsp. aureus N315
gauacgcuuuuuaa

SEQ ID NO: 4052973 - RNA, 19 nt, Staphylococcus aureus subsp. aureus N315
gauacgcuuuuuaaaaaau

SEQ ID NO: 4052974 - RNA, 21 nt, Staphylococcus aureus subsp. aureus N315
gauacgugguuuuauuugauu

SEQ ID NO: 4052975 - RNA, 20 nt, Staphylococcus aureus subsp. aureus N315
gauacuaaacgauaaauuaa

SEQ ID NO: 4052976 - RNA, 16 nt, Staphylococcus aureus subsp. aureus N315
gauacuaauaucuucu

SEQ ID NO: 4052977 - RNA, 17 nt, Staphylococcus aureus subsp. aureus N315
gauacuaauaucuucuu

SEQ ID NO: 4052978 - RNA, 15 nt, Staphylococcus aureus subsp. aureus N315
gauacugccauaugu

SEQ ID NO: 4052979 - RNA, 22 nt, Staphylococcus aureus subsp. aureus N315
gauacuuuuuguaguccuucuu

SEQ ID NO: 4052980 - RNA, 14 nt, Staphylococcus aureus subsp. aureus N315
gauagaaaggcagg

SEQ ID NO: 4052981 - RNA, 22 nt, Staphylococcus aureus subsp. aureus N315
gauagaaguuuuuugauuagua

SEQ ID NO: 4052982 - RNA, 18 nt, Staphylococcus aureus subsp. aureus N315
gauagaaugucgauauuu

SEQ ID NO: 4052983 - RNA, 14 nt, Staphylococcus aureus subsp. aureus N315
gauagaugaaaaug

SEQ ID NO: 4052984 - RNA, 19 nt, Staphylococcus aureus subsp. aureus N315
gauagauucugauacagaa

SEQ ID NO: 4052985 - RNA, 22 nt, Staphylococcus aureus subsp. aureus N315
gauaggauuuacaccuauaccu

SEQ ID NO: 4052986 - RNA, 22 nt, Staphylococcus aureus subsp. aureus N315
gauaggauuugcaccuauaccu

SEQ ID NO: 4052987 - RNA, 16 nt, Staphylococcus aureus subsp. aureus N315
gauagucauaacgauu

SEQ ID NO: 4052988 - RNA, 14 nt, Staphylococcus aureus subsp. aureus N315
gauauaaacauuua

SEQ ID NO: 4052989 - RNA, 19 nt, Staphylococcus aureus subsp. aureus N315
gauauaagauucauauuua

SEQ ID NO: 4052990 - RNA, 15 nt, Staphylococcus aureus subsp. aureus N315
gauauagaaaaggga

SEQ ID NO: 4052991 - RNA, 18 nt, Staphylococcus aureus subsp. aureus N315
gauauagaauucacgcaa

SEQ ID NO: 4052992 - RNA, 20 nt, Staphylococcus aureus subsp. aureus N315
gauauagauggcuuuuuuug

SEQ ID NO: 4052993 - RNA, 23 nt, Staphylococcus aureus subsp. aureus N315
gauauauaacuauggucaucaau

SEQ ID NO: 4052994 - RNA, 21 nt, Staphylococcus aureus subsp. aureus N315
gauaucuaagucgauaaguuu

SEQ ID NO: 4052995 - RNA, 20 nt, Staphylococcus aureus subsp. aureus N315
gauaucugacauuucaucaa

SEQ ID NO: 4052996 - RNA, 21 nt, Staphylococcus aureus subsp. aureus N315
gauaucuuaaucuaaaaauag

SEQ ID NO: 4052997 - RNA, 12 nt, Staphylococcus aureus subsp. aureus N315
gauaucuuuuaa

SEQ ID NO: 4052998 - RNA, 19 nt, Staphylococcus aureus subsp. aureus N315
gauaucuuuuaauucuuaa

SEQ ID NO: 4052999 - RNA, 21 nt, Staphylococcus aureus subsp. aureus N315
gauaucuuuuccaaaacaaaa

SEQ ID NO: 4053000 - RNA, 21 nt, Staphylococcus aureus subsp. aureus N315
gauaugaauaaccaucuucuu

SEQ ID NO: 4053001 - RNA, 19 nt, Staphylococcus aureus subsp. aureus N315
gauaugcucucuucaaagu

SEQ ID NO: 4053002 - RNA, 15 nt, Staphylococcus aureus subsp. aureus N315
gauauggaucauaau

SEQ ID NO: 4053003 - RNA, 17 nt, Staphylococcus aureus subsp. aureus N315
gauauggcguauucacc

SEQ ID NO: 4053004 - RNA, 20 nt, Staphylococcus aureus subsp. aureus N315
gauauuaauugaaaaaccaa

SEQ ID NO: 4053005 - RNA, 22 nt, Staphylococcus aureus subsp. aureus N315
gauauuaauugaaaaaccaagu

SEQ ID NO: 4053006 - RNA, 16 nt, Staphylococcus aureus subsp. aureus N315
gauauuaggcuuaaau

SEQ ID NO: 4053007 - RNA, 15 nt, Staphylococcus aureus subsp. aureus N315
gauauugaaaacacg

SEQ ID NO: 4053008 - RNA, 20 nt, Staphylococcus aureus subsp. aureus N315
gauauugaccaccuguaucu

SEQ ID NO: 4053009 - RNA, 16 nt, Staphylococcus aureus subsp. aureus N315
gauauugaucugauuu

SEQ ID NO: 4053010 - RNA, 13 nt, Staphylococcus aureus subsp. aureus N315
gauauuuaacaaa

SEQ ID NO: 4053011 - RNA, 23 nt, Staphylococcus aureus subsp. aureus N315
gauauuuaacaaaauuaagaaga

SEQ ID NO: 4053012 - RNA, 22 nt, Staphylococcus aureus subsp. aureus N315
gauauuuagaauaagaaauaaa

SEQ ID NO: 4053013 - RNA, 20 nt, Staphylococcus aureus subsp. aureus N315
gauauuuauucuaaguuaaa

SEQ ID NO: 4053014 - RNA, 23 nt, Staphylococcus aureus subsp. aureus N315
gauauuucaacuuuuuaauaaua

SEQ ID NO: 4053015 - RNA, 18 nt, Staphylococcus aureus subsp. aureus N315
gauauuucuaaauugucg

SEQ ID NO: 4053016 - RNA, 14 nt, Staphylococcus aureus subsp. aureus N315
gaucaacaaugcca

SEQ ID NO: 4053017 - RNA, 15 nt, Staphylococcus aureus subsp. aureus N315
gaucaacuauauaua

SEQ ID NO: 4053018 - RNA, 16 nt, Staphylococcus aureus subsp. aureus N315
gaucaagcugagcuuu

SEQ ID NO: 4053019 - RNA, 14 nt, Staphylococcus aureus subsp. aureus N315
gaucaagugcagau

SEQ ID NO: 4053020 - RNA, 14 nt, Staphylococcus aureus subsp. aureus N315
gaucacacgacaug

SEQ ID NO: 4053021 - RNA, 19 nt, Staphylococcus aureus subsp. aureus N315
gaucacaguacacuaaguu

SEQ ID NO: 4053022 - RNA, 17 nt, Staphylococcus aureus subsp. aureus N315
gaucauuaguguagaaa

SEQ ID NO: 4053023 - RNA, 19 nt, Staphylococcus aureus subsp. aureus N315
gaucauuugacauaaucca

SEQ ID NO: 4053024 - RNA, 17 nt, Staphylococcus aureus subsp. aureus N315
gaucauuuucaacauaa

SEQ ID NO: 4053025 - RNA, 19 nt, Staphylococcus aureus subsp. aureus N315
gauccaaaguacucaagua

SEQ ID NO: 4053026 - RNA, 12 nt, Staphylococcus aureus subsp. aureus N315
gaucccaaaauc

SEQ ID NO: 4053027 - RNA, 19 nt, Staphylococcus aureus subsp. aureus N315
gaucgcccauacuaaauaa

SEQ ID NO: 4053028 - RNA, 20 nt, Staphylococcus aureus subsp. aureus N315
gaucgcccauacuaaauaag

SEQ ID NO: 4053029 - RNA, 13 nt, Staphylococcus aureus subsp. aureus N315
gaucuaaaaccau

SEQ ID NO: 4053030 - RNA, 16 nt, Staphylococcus aureus subsp. aureus N315
gaucuaaaauaucauc

SEQ ID NO: 4053031 - RNA, 16 nt, Staphylococcus aureus subsp. aureus N315
gaucuaaaugaucuuu

SEQ ID NO: 4053032 - RNA, 18 nt, Staphylococcus aureus subsp. aureus N315
gaucuucaugaacagcau

SEQ ID NO: 4053033 - RNA, 18 nt, Staphylococcus aureus subsp. aureus N315
gaucuucccaucuuuuag

SEQ ID NO: 4053034 - RNA, 14 nt, Staphylococcus aureus subsp. aureus N315
gaucuucuuguuuu

SEQ ID NO: 4053035 - RNA, 12 nt, Staphylococcus aureus subsp. aureus N315
gaugaaaaagau

SEQ ID NO: 4053036 - RNA, 12 nt, Staphylococcus aureus subsp. aureus N315
gaugaaaacaaa

SEQ ID NO: 4053037 - RNA, 14 nt, Staphylococcus aureus subsp. aureus N315
gaugaaaauauagu

SEQ ID NO: 4053038 - RNA, 17 nt, Staphylococcus aureus subsp. aureus N315
gaugaaaaucuuuaacu

SEQ ID NO: 4053039 - RNA, 21 nt, Staphylococcus aureus subsp. aureus N315
gaugaaagacugacuaauaaa

SEQ ID NO: 4053040 - RNA, 19 nt, Staphylococcus aureus subsp. aureus N315
gaugaacaaaauaacaugu

SEQ ID NO: 4053041 - RNA, 18 nt, Staphylococcus aureus subsp. aureus N315
gaugaacuuaaugcuuca

SEQ ID NO: 4053042 - RNA, 18 nt, Staphylococcus aureus subsp. aureus N315
gaugaauuuuuauuuuua

SEQ ID NO: 4053043 - RNA, 21 nt, Staphylococcus aureus subsp. aureus N315
gaugacugaaccaauccaaua

SEQ ID NO: 4053044 - RNA, 18 nt, Staphylococcus aureus subsp. aureus N315
gaugacuguagaaaacau

SEQ ID NO: 4053045 - RNA, 16 nt, Staphylococcus aureus subsp. aureus N315
gaugagauaaaaucau

SEQ ID NO: 4053046 - RNA, 19 nt, Staphylococcus aureus subsp. aureus N315
gaugauaaaaauaaaaccg

SEQ ID NO: 4053047 - RNA, 12 nt, Staphylococcus aureus subsp. aureus N315
gaugaugcuucg

SEQ ID NO: 4053048 - RNA, 14 nt, Staphylococcus aureus subsp. aureus N315
gaugauucuuauca

SEQ ID NO: 4053049 - RNA, 18 nt, Staphylococcus aureus subsp. aureus N315
gaugauuuauuaacucau

SEQ ID NO: 4053050 - RNA, 19 nt, Staphylococcus aureus subsp. aureus N315
gaugauuuauuaacucaug

SEQ ID NO: 4053051 - RNA, 23 nt, Staphylococcus aureus subsp. aureus N315
gaugcuaaaaauauugaauaauc

SEQ ID NO: 4053052 - RNA, 20 nt, Staphylococcus aureus subsp. aureus N315
gaugcuaauguaaucugaac

SEQ ID NO: 4053053 - RNA, 16 nt, Staphylococcus aureus subsp. aureus N315
gaugcucguauagaaa

SEQ ID NO: 4053054 - RNA, 22 nt, Staphylococcus aureus subsp. aureus N315
gaugcuucgaauuuaacaucuu

SEQ ID NO: 4053055 - RNA, 19 nt, Staphylococcus aureus subsp. aureus N315
gaugcuucgcacaacugca

SEQ ID NO: 4053056 - RNA, 19 nt, Staphylococcus aureus subsp. aureus N315
gaugcuucgcaucacugca

SEQ ID NO: 4053057 - RNA, 19 nt, Staphylococcus aureus subsp. aureus N315
gaugcuucucacaacugca

SEQ ID NO: 4053058 - RNA, 22 nt, Staphylococcus aureus subsp. aureus N315
gauggcguaagcaguuaauaag

SEQ ID NO: 4053059 - RNA, 19 nt, Staphylococcus aureus subsp. aureus N315
gaugggaaaucaguaauau

SEQ ID NO: 4053060 - RNA, 13 nt, Staphylococcus aureus subsp. aureus N315
gauggucuuuuaa

SEQ ID NO: 4053061 - RNA, 16 nt, Staphylococcus aureus subsp. aureus N315
gaugguggggucauaa

SEQ ID NO: 4053062 - RNA, 13 nt, Staphylococcus aureus subsp. aureus N315
gaugguugcuuca

SEQ ID NO: 4053063 - RNA, 13 nt, Staphylococcus aureus subsp. aureus N315
gauguaauucugu

SEQ ID NO: 4053064 - RNA, 17 nt, Staphylococcus aureus subsp. aureus N315
gauguaccacucauaau

SEQ ID NO: 4053065 - RNA, 17 nt, Staphylococcus aureus subsp. aureus N315
gauguacuauaaauccu

SEQ ID NO: 4053066 - RNA, 16 nt, Staphylococcus aureus subsp. aureus N315
gaugucacauaugacu

SEQ ID NO: 4053067 - RNA, 13 nt, Staphylococcus aureus subsp. aureus N315
gaugucauguauu

SEQ ID NO: 4053068 - RNA, 15 nt, Staphylococcus aureus subsp. aureus N315
gaugucgaaaaguau

SEQ ID NO: 4053069 - RNA, 16 nt, Staphylococcus aureus subsp. aureus N315
gaugucuguacuuuua

SEQ ID NO: 4053070 - RNA, 18 nt, Staphylococcus aureus subsp. aureus N315
gaugugaauguuuugugu

SEQ ID NO: 4053071 - RNA, 14 nt, Staphylococcus aureus subsp. aureus N315
gaugugacaaauac

SEQ ID NO: 4053072 - RNA, 13 nt, Staphylococcus aureus subsp. aureus N315
gauguguugaaac

SEQ ID NO: 4053073 - RNA, 14 nt, Staphylococcus aureus subsp. aureus N315
gauguuaaaaaaua

SEQ ID NO: 4053074 - RNA, 14 nt, Staphylococcus aureus subsp. aureus N315
gauguuauaaaaug

SEQ ID NO: 4053075 - RNA, 15 nt, Staphylococcus aureus subsp. aureus N315
gauguucaucaacau

SEQ ID NO: 4053076 - RNA, 16 nt, Staphylococcus aureus subsp. aureus N315
gauguugguucaucaa

SEQ ID NO: 4053077 - RNA, 18 nt, Staphylococcus aureus subsp. aureus N315
gauuaaaauaugacacau

SEQ ID NO: 4053078 - RNA, 17 nt, Staphylococcus aureus subsp. aureus N315
gauuaaauaaucaacaa

SEQ ID NO: 4053079 - RNA, 12 nt, Staphylococcus aureus subsp. aureus N315
gauuaacauuau

SEQ ID NO: 4053080 - RNA, 15 nt, Staphylococcus aureus subsp. aureus N315
gauuaacuuucuaau

SEQ ID NO: 4053081 - RNA, 16 nt, Staphylococcus aureus subsp. aureus N315
gauuaauuuucuuuuu

SEQ ID NO: 4053082 - RNA, 14 nt, Staphylococcus aureus subsp. aureus N315
gauuacuuugcuaa

SEQ ID NO: 4053083 - RNA, 21 nt, Staphylococcus aureus subsp. aureus N315
gauuagugucacaaagaaauu

SEQ ID NO: 4053084 - RNA, 16 nt, Staphylococcus aureus subsp. aureus N315
gauuauagguauaaga

SEQ ID NO: 4053085 - RNA, 18 nt, Staphylococcus aureus subsp. aureus N315
gauuauagguauaagaau

SEQ ID NO: 4053086 - RNA, 11 nt, Staphylococcus aureus subsp. aureus N315
gauuauauaua

SEQ ID NO: 4053087 - RNA, 18 nt, Staphylococcus aureus subsp. aureus N315
gauuauauuuuucuucag

SEQ ID NO: 4053088 - RNA, 15 nt, Staphylococcus aureus subsp. aureus N315
gauuaucuaacucau

SEQ ID NO: 4053089 - RNA, 17 nt, Staphylococcus aureus subsp. aureus N315
gauuaucuaacucauaa

SEQ ID NO: 4053090 - RNA, 20 nt, Staphylococcus aureus subsp. aureus N315
gauuaucuacuauuuguuuu

SEQ ID NO: 4053091 - RNA, 17 nt, Staphylococcus aureus subsp. aureus N315
gauuauguaauucuagc

SEQ ID NO: 4053092 - RNA, 21 nt, Staphylococcus aureus subsp. aureus N315
gauuauguucagaacuacaau

SEQ ID NO: 4053093 - RNA, 16 nt, Staphylococcus aureus subsp. aureus N315
gauuauuaacuuuaau

SEQ ID NO: 4053094 - RNA, 15 nt, Staphylococcus aureus subsp. aureus N315
gauuauuaccauaua

SEQ ID NO: 4053095 - RNA, 20 nt, Staphylococcus aureus subsp. aureus N315
gauuauuaugccuuugauuu

SEQ ID NO: 4053096 - RNA, 13 nt, Staphylococcus aureus subsp. aureus N315
gauuauucuucau

SEQ ID NO: 4053097 - RNA, 22 nt, Staphylococcus aureus subsp. aureus N315
gauuauucuucauuuauaacau

SEQ ID NO: 4053098 - RNA, 22 nt, Staphylococcus aureus subsp. aureus N315
gauuauuuaaaacuuguaaauu

SEQ ID NO: 4053099 - RNA, 18 nt, Staphylococcus aureus subsp. aureus N315
gauuauuuagauaaaaau

SEQ ID NO: 4053100 - RNA, 20 nt, Staphylococcus aureus subsp. aureus N315
gauuauuuagauaaaaauua

SEQ ID NO: 4053101 - RNA, 14 nt, Staphylococcus aureus subsp. aureus N315
gauucaaaugacau

SEQ ID NO: 4053102 - RNA, 16 nt, Staphylococcus aureus subsp. aureus N315
gauucaacuuguuucc

SEQ ID NO: 4053103 - RNA, 12 nt, Staphylococcus aureus subsp. aureus N315
gauucauauuua

SEQ ID NO: 4053104 - RNA, 18 nt, Staphylococcus aureus subsp. aureus N315
gauuccuguaacaagaac

SEQ ID NO: 4053105 - RNA, 20 nt, Staphylococcus aureus subsp. aureus N315
gauucgauuauuuagauaaa

SEQ ID NO: 4053106 - RNA, 14 nt, Staphylococcus aureus subsp. aureus N315
gauucggaaaauau

SEQ ID NO: 4053107 - RNA, 23 nt, Staphylococcus aureus subsp. aureus N315
gauucguauucaaaguuuucauu

SEQ ID NO: 4053108 - RNA, 22 nt, Staphylococcus aureus subsp. aureus N315
gauucuaacggcguuuguuucu

SEQ ID NO: 4053109 - RNA, 16 nt, Staphylococcus aureus subsp. aureus N315
gauucuacagcacuga

SEQ ID NO: 4053110 - RNA, 17 nt, Staphylococcus aureus subsp. aureus N315
gauucuuauauguuuua

SEQ ID NO: 4053111 - RNA, 19 nt, Staphylococcus aureus subsp. aureus N315
gauucuucacuaaaaauau

SEQ ID NO: 4053112 - RNA, 22 nt, Staphylococcus aureus subsp. aureus N315
gauucuuuauaagcuuuuucuu

SEQ ID NO: 4053113 - RNA, 12 nt, Staphylococcus aureus subsp. aureus N315
gauugaaaaaau

SEQ ID NO: 4053114 - RNA, 21 nt, Staphylococcus aureus subsp. aureus N315
gauugacuaaguuuguuuucu

SEQ ID NO: 4053115 - RNA, 22 nt, Staphylococcus aureus subsp. aureus N315
gauugauauaaauuaucagaau

SEQ ID NO: 4053116 - RNA, 21 nt, Staphylococcus aureus subsp. aureus N315
gauugaucagcucuuaaauca

SEQ ID NO: 4053117 - RNA, 14 nt, Staphylococcus aureus subsp. aureus N315
gauugcaaaaaaac

SEQ ID NO: 4053118 - RNA, 20 nt, Staphylococcus aureus subsp. aureus N315
gauugcaaaaaaacaaauau

SEQ ID NO: 4053119 - RNA, 21 nt, Staphylococcus aureus subsp. aureus N315
gauugcaaauuaucauuaaau

SEQ ID NO: 4053120 - RNA, 19 nt, Staphylococcus aureus subsp. aureus N315
gauuggcugugcuauaauc

SEQ ID NO: 4053121 - RNA, 21 nt, Staphylococcus aureus subsp. aureus N315
gauuggcuugaaguuguuucu

SEQ ID NO: 4053122 - RNA, 14 nt, Staphylococcus aureus subsp. aureus N315
gauugguaaaucua

SEQ ID NO: 4053123 - RNA, 12 nt, Staphylococcus aureus subsp. aureus N315
gauuguaaauaa

SEQ ID NO: 4053124 - RNA, 14 nt, Staphylococcus aureus subsp. aureus N315
gauuguaaauaaaa

SEQ ID NO: 4053125 - RNA, 15 nt, Staphylococcus aureus subsp. aureus N315
gauugucuuauaaga

SEQ ID NO: 4053126 - RNA, 16 nt, Staphylococcus aureus subsp. aureus N315
gauuuaaguuuauaau

SEQ ID NO: 4053127 - RNA, 20 nt, Staphylococcus aureus subsp. aureus N315
gauuuaauaucacgaucuuu

SEQ ID NO: 4053128 - RNA, 21 nt, Staphylococcus aureus subsp. aureus N315
gauuuaauugaaauagaaacu

SEQ ID NO: 4053129 - RNA, 16 nt, Staphylococcus aureus subsp. aureus N315
gauuuagcauacauua

SEQ ID NO: 4053130 - RNA, 20 nt, Staphylococcus aureus subsp. aureus N315
gauuuaguuuuuuuaaaguu

SEQ ID NO: 4053131 - RNA, 21 nt, Staphylococcus aureus subsp. aureus N315
gauuuaucaccuuuaggcaaa

SEQ ID NO: 4053132 - RNA, 15 nt, Staphylococcus aureus subsp. aureus N315
gauuuauuaaauaua

SEQ ID NO: 4053133 - RNA, 13 nt, Staphylococcus aureus subsp. aureus N315
gauuuauucuaaa

SEQ ID NO: 4053134 - RNA, 18 nt, Staphylococcus aureus subsp. aureus N315
gauuuauuuuuuucuuca

SEQ ID NO: 4053135 - RNA, 14 nt, Staphylococcus aureus subsp. aureus N315
gauuucaaugagaa

SEQ ID NO: 4053136 - RNA, 15 nt, Staphylococcus aureus subsp. aureus N315
gauuucacuucuaaa

SEQ ID NO: 4053137 - RNA, 22 nt, Staphylococcus aureus subsp. aureus N315
gauuucacuugaccacuuuugu

SEQ ID NO: 4053138 - RNA, 20 nt, Staphylococcus aureus subsp. aureus N315
gauuucccacgugccucauc

SEQ ID NO: 4053139 - RNA, 15 nt, Staphylococcus aureus subsp. aureus N315
gauuuccucgguuuu

SEQ ID NO: 4053140 - RNA, 23 nt, Staphylococcus aureus subsp. aureus N315
gauuucguuagacucacuucuua

SEQ ID NO: 4053141 - RNA, 15 nt, Staphylococcus aureus subsp. aureus N315
gauuucuaucaaaua

SEQ ID NO: 4053142 - RNA, 17 nt, Staphylococcus aureus subsp. aureus N315
gauuucuaucaaauaau

SEQ ID NO: 4053143 - RNA, 12 nt, Staphylococcus aureus subsp. aureus N315
gauuucuuauuu

SEQ ID NO: 4053144 - RNA, 14 nt, Staphylococcus aureus subsp. aureus N315
gauuucuucugcua

SEQ ID NO: 4053145 - RNA, 14 nt, Staphylococcus aureus subsp. aureus N315
gauuugcaccuaua

SEQ ID NO: 4053146 - RNA, 23 nt, Staphylococcus aureus subsp. aureus N315
gauuugccaaaaguuauauaaau

SEQ ID NO: 4053147 - RNA, 17 nt, Staphylococcus aureus subsp. aureus N315
gauuuuaaaagauaaau

SEQ ID NO: 4053148 - RNA, 17 nt, Staphylococcus aureus subsp. aureus N315
gauuuuaaagaaaaguu

SEQ ID NO: 4053149 - RNA, 14 nt, Staphylococcus aureus subsp. aureus N315
gauuuuaaucuauc

SEQ ID NO: 4053150 - RNA, 12 nt, Staphylococcus aureus subsp. aureus N315
gauuuuaauuau

SEQ ID NO: 4053151 - RNA, 14 nt, Staphylococcus aureus subsp. aureus N315
gauuuuacuugaau

SEQ ID NO: 4053152 - RNA, 11 nt, Staphylococcus aureus subsp. aureus N315
gauuuuauaau

SEQ ID NO: 4053153 - RNA, 15 nt, Staphylococcus aureus subsp. aureus N315
gauuuugaauaaaaa

SEQ ID NO: 4053154 - RNA, 22 nt, Staphylococcus aureus subsp. aureus N315
gauuuugcugccaaaaaguauu

SEQ ID NO: 4053155 - RNA, 10 nt, Staphylococcus aureus subsp. aureus N315
gauuuugcuu

SEQ ID NO: 4053156 - RNA, 12 nt, Staphylococcus aureus subsp. aureus N315
gauuuuguuuca

SEQ ID NO: 4053157 - RNA, 16 nt, Staphylococcus aureus subsp. aureus N315
gauuuuucauauuuuu

SEQ ID NO: 4053158 - RNA, 13 nt, Staphylococcus aureus subsp. aureus N315
gauuuuucuuaua

SEQ ID NO: 4053159 - RNA, 15 nt, Staphylococcus aureus subsp. aureus N315
gauuuuuugguuucu

SEQ ID NO: 4053160 - RNA, 18 nt, Staphylococcus aureus subsp. aureus N315
gcaaaaauaauaugaauu

SEQ ID NO: 4053161 - RNA, 13 nt, Staphylococcus aureus subsp. aureus N315
gcaaaaauacuuu

SEQ ID NO: 4053162 - RNA, 18 nt, Staphylococcus aureus subsp. aureus N315
gcaaaaauauuuaaacua

SEQ ID NO: 4053163 - RNA, 22 nt, Staphylococcus aureus subsp. aureus N315
gcaaaacgcauuucauguguca

SEQ ID NO: 4053164 - RNA, 14 nt, Staphylococcus aureus subsp. aureus N315
gcaaaagcgcaggc

SEQ ID NO: 4053165 - RNA, 19 nt, Staphylococcus aureus subsp. aureus N315
gcaaaauacgauuuguuca

SEQ ID NO: 4053166 - RNA, 18 nt, Staphylococcus aureus subsp. aureus N315
gcaaaauuauguaaaaaa

SEQ ID NO: 4053167 - RNA, 18 nt, Staphylococcus aureus subsp. aureus N315
gcaaacacaguacaaaua

SEQ ID NO: 4053168 - RNA, 17 nt, Staphylococcus aureus subsp. aureus N315
gcaaacgcacuaucaau

SEQ ID NO: 4053169 - RNA, 23 nt, Staphylococcus aureus subsp. aureus N315
gcaaacgcacuaucaaugacauc

SEQ ID NO: 4053170 - RNA, 17 nt, Staphylococcus aureus subsp. aureus N315
gcaaacucauuuauaaa

SEQ ID NO: 4053171 - RNA, 15 nt, Staphylococcus aureus subsp. aureus N315
gcaaagaauccuuaa

SEQ ID NO: 4053172 - RNA, 13 nt, Staphylococcus aureus subsp. aureus N315
gcaaagacucaau

SEQ ID NO: 4053173 - RNA, 20 nt, Staphylococcus aureus subsp. aureus N315
gcaaaggcgcaccaugugcc

SEQ ID NO: 4053174 - RNA, 15 nt, Staphylococcus aureus subsp. aureus N315
gcaaauaaaaaaguu

SEQ ID NO: 4053175 - RNA, 17 nt, Staphylococcus aureus subsp. aureus N315
gcaaauaaaaucauaac

SEQ ID NO: 4053176 - RNA, 11 nt, Staphylococcus aureus subsp. aureus N315
gcaaauacuuc

SEQ ID NO: 4053177 - RNA, 13 nt, Staphylococcus aureus subsp. aureus N315
gcaaauauuaaau

SEQ ID NO: 4053178 - RNA, 15 nt, Staphylococcus aureus subsp. aureus N315
gcaaauauuauuaaa

SEQ ID NO: 4053179 - RNA, 16 nt, Staphylococcus aureus subsp. aureus N315
gcaaauauuauuaaau

SEQ ID NO: 4053180 - RNA, 19 nt, Staphylococcus aureus subsp. aureus N315
gcaaauauuauuaaaucaa

SEQ ID NO: 4053181 - RNA, 13 nt, Staphylococcus aureus subsp. aureus N315
gcaaauauuucug

SEQ ID NO: 4053182 - RNA, 18 nt, Staphylococcus aureus subsp. aureus N315
gcaaauuauauagaaaac

SEQ ID NO: 4053183 - RNA, 13 nt, Staphylococcus aureus subsp. aureus N315
gcaaauuaucauu

SEQ ID NO: 4053184 - RNA, 21 nt, Staphylococcus aureus subsp. aureus N315
gcaaauuaucauuaaauugcu

SEQ ID NO: 4053185 - RNA, 20 nt, Staphylococcus aureus subsp. aureus N315
gcaaauucaacuuuaaucaa

SEQ ID NO: 4053186 - RNA, 13 nt, Staphylococcus aureus subsp. aureus N315
gcaaauuggaaaa

SEQ ID NO: 4053187 - RNA, 13 nt, Staphylococcus aureus subsp. aureus N315
gcaacaacuuuuc

SEQ ID NO: 4053188 - RNA, 15 nt, Staphylococcus aureus subsp. aureus N315
gcaacaacuuuucau

SEQ ID NO: 4053189 - RNA, 22 nt, Staphylococcus aureus subsp. aureus N315
gcaacauauuuucacaaucaua

SEQ ID NO: 4053190 - RNA, 21 nt, Staphylococcus aureus subsp. aureus N315
gcaacgcgauugcuaaacgcu

SEQ ID NO: 4053191 - RNA, 13 nt, Staphylococcus aureus subsp. aureus N315
gcaacuuauaaua

SEQ ID NO: 4053192 - RNA, 14 nt, Staphylococcus aureus subsp. aureus N315
gcaacuuguauugu

SEQ ID NO: 4053193 - RNA, 22 nt, Staphylococcus aureus subsp. aureus N315
gcaacuuguauuguuuguagaa

SEQ ID NO: 4053194 - RNA, 21 nt, Staphylococcus aureus subsp. aureus N315
gcaagaauagauugauuguau

SEQ ID NO: 4053195 - RNA, 14 nt, Staphylococcus aureus subsp. aureus N315
gcaagccaucaaua

SEQ ID NO: 4053196 - RNA, 22 nt, Staphylococcus aureus subsp. aureus N315
gcaagugcuuccacuucaucua

SEQ ID NO: 4053197 - RNA, 14 nt, Staphylococcus aureus subsp. aureus N315
gcaaguuggcgggg

SEQ ID NO: 4053198 - RNA, 12 nt, Staphylococcus aureus subsp. aureus N315
gcaaguugggga

SEQ ID NO: 4053199 - RNA, 13 nt, Staphylococcus aureus subsp. aureus N315
gcaaguuggggau

SEQ ID NO: 4053200 - RNA, 15 nt, Staphylococcus aureus subsp. aureus N315
gcaauacgcaauguu

SEQ ID NO: 4053201 - RNA, 14 nt, Staphylococcus aureus subsp. aureus N315
gcaauagcaccaua

SEQ ID NO: 4053202 - RNA, 15 nt, Staphylococcus aureus subsp. aureus N315
gcaauagcuauaacu

SEQ ID NO: 4053203 - RNA, 16 nt, Staphylococcus aureus subsp. aureus N315
gcaauaggaugaaacu

SEQ ID NO: 4053204 - RNA, 14 nt, Staphylococcus aureus subsp. aureus N315
gcaaucauaauacu

SEQ ID NO: 4053205 - RNA, 14 nt, Staphylococcus aureus subsp. aureus N315
gcaaucuauauaaa

SEQ ID NO: 4053206 - RNA, 14 nt, Staphylococcus aureus subsp. aureus N315
gcaaucuuaguaca

SEQ ID NO: 4053207 - RNA, 14 nt, Staphylococcus aureus subsp. aureus N315
gcaaugcauauugu

SEQ ID NO: 4053208 - RNA, 17 nt, Staphylococcus aureus subsp. aureus N315
gcaaugcgaguuggggu

SEQ ID NO: 4053209 - RNA, 14 nt, Staphylococcus aureus subsp. aureus N315
gcaauuaaagucaa

SEQ ID NO: 4053210 - RNA, 21 nt, Staphylococcus aureus subsp. aureus N315
gcaauuaaagucaauuuaaau

SEQ ID NO: 4053211 - RNA, 20 nt, Staphylococcus aureus subsp. aureus N315
gcaauuaaccuugauuuaau

SEQ ID NO: 4053212 - RNA, 16 nt, Staphylococcus aureus subsp. aureus N315
gcaauuauuuuucaaa

SEQ ID NO: 4053213 - RNA, 19 nt, Staphylococcus aureus subsp. aureus N315
gcaauugaaucaaauacau

SEQ ID NO: 4053214 - RNA, 13 nt, Staphylococcus aureus subsp. aureus N315
gcaauuucauagu

SEQ ID NO: 4053215 - RNA, 19 nt, Staphylococcus aureus subsp. aureus N315
gcaauuuuucacuuauaac

SEQ ID NO: 4053216 - RNA, 16 nt, Staphylococcus aureus subsp. aureus N315
gcacaaaaaaaucucc

SEQ ID NO: 4053217 - RNA, 13 nt, Staphylococcus aureus subsp. aureus N315
gcacaaaugaaug

SEQ ID NO: 4053218 - RNA, 19 nt, Staphylococcus aureus subsp. aureus N315
gcacaacugcauaaaagcc

SEQ ID NO: 4053219 - RNA, 22 nt, Staphylococcus aureus subsp. aureus N315
gcacaauauuuaccacaaauau

SEQ ID NO: 4053220 - RNA, 19 nt, Staphylococcus aureus subsp. aureus N315
gcacagcgauuaaaugaug

SEQ ID NO: 4053221 - RNA, 19 nt, Staphylococcus aureus subsp. aureus N315
gcacagcggaauacagaug

SEQ ID NO: 4053222 - RNA, 13 nt, Staphylococcus aureus subsp. aureus N315
gcacauaaaucaa

SEQ ID NO: 4053223 - RNA, 19 nt, Staphylococcus aureus subsp. aureus N315
gcacaucagauauaaguag

SEQ ID NO: 4053224 - RNA, 16 nt, Staphylococcus aureus subsp. aureus N315
gcacaucauugauaga

SEQ ID NO: 4053225 - RNA, 16 nt, Staphylococcus aureus subsp. aureus N315
gcacauuauuguaagu

SEQ ID NO: 4053226 - RNA, 21 nt, Staphylococcus aureus subsp. aureus N315
gcacauuccaucuuaaaacaa

SEQ ID NO: 4053227 - RNA, 19 nt, Staphylococcus aureus subsp. aureus N315
gcacauucccguuaauauc

SEQ ID NO: 4053228 - RNA, 13 nt, Staphylococcus aureus subsp. aureus N315
gcaccaugugccu

SEQ ID NO: 4053229 - RNA, 16 nt, Staphylococcus aureus subsp. aureus N315
gcaccgacaauuauaa

SEQ ID NO: 4053230 - RNA, 23 nt, Staphylococcus aureus subsp. aureus N315
gcaccgacaauuauaauaaaacu

SEQ ID NO: 4053231 - RNA, 21 nt, Staphylococcus aureus subsp. aureus N315
gcaccgauuuggucagcgaca

SEQ ID NO: 4053232 - RNA, 14 nt, Staphylococcus aureus subsp. aureus N315
gcacgagaaauguc

SEQ ID NO: 4053233 - RNA, 15 nt, Staphylococcus aureus subsp. aureus N315
gcacgagcaacaucu

SEQ ID NO: 4053234 - RNA, 21 nt, Staphylococcus aureus subsp. aureus N315
gcacuauaaaauucaccaacu

SEQ ID NO: 4053235 - RNA, 13 nt, Staphylococcus aureus subsp. aureus N315
gcacuaucuuuug

SEQ ID NO: 4053236 - RNA, 19 nt, Staphylococcus aureus subsp. aureus N315
gcacuaugcauaauaccaa

SEQ ID NO: 4053237 - RNA, 15 nt, Staphylococcus aureus subsp. aureus N315
gcacugagcaacaaa

SEQ ID NO: 4053238 - RNA, 18 nt, Staphylococcus aureus subsp. aureus N315
gcacuucuauauuaauag

SEQ ID NO: 4053239 - RNA, 20 nt, Staphylococcus aureus subsp. aureus N315
gcacuucuauauuaauagaa

SEQ ID NO: 4053240 - RNA, 19 nt, Staphylococcus aureus subsp. aureus N315
gcacuuggauuuuaauuau

SEQ ID NO: 4053241 - RNA, 22 nt, Staphylococcus aureus subsp. aureus N315
gcacuugucucaaauuaaauca

SEQ ID NO: 4053242 - RNA, 15 nt, Staphylococcus aureus subsp. aureus N315
gcacuuuaacauaac

SEQ ID NO: 4053243 - RNA, 22 nt, Staphylococcus aureus subsp. aureus N315
gcacuuuauuaaaaauccucac

SEQ ID NO: 4053244 - RNA, 23 nt, Staphylococcus aureus subsp. aureus N315
gcagaagaaaacuauuuuaaaaa

SEQ ID NO: 4053245 - RNA, 15 nt, Staphylococcus aureus subsp. aureus N315
gcagcaaugacacua

SEQ ID NO: 4053246 - RNA, 13 nt, Staphylococcus aureus subsp. aureus N315
gcagcaucauaau

SEQ ID NO: 4053247 - RNA, 16 nt, Staphylococcus aureus subsp. aureus N315
gcagcgauacguuuau

SEQ ID NO: 4053248 - RNA, 14 nt, Staphylococcus aureus subsp. aureus N315
gcagcgaucuuuuu

SEQ ID NO: 4053249 - RNA, 15 nt, Staphylococcus aureus subsp. aureus N315
gcagcuaaaaaguau

SEQ ID NO: 4053250 - RNA, 13 nt, Staphylococcus aureus subsp. aureus N315
gcagcuucuuuaa

SEQ ID NO: 4053251 - RNA, 13 nt, Staphylococcus aureus subsp. aureus N315
gcagcuuuauaau

SEQ ID NO: 4053252 - RNA, 14 nt, Staphylococcus aureus subsp. aureus N315
gcaggcgaaccgaa

SEQ ID NO: 4053253 - RNA, 13 nt, Staphylococcus aureus subsp. aureus N315
gcagggugcuaaa

SEQ ID NO: 4053254 - RNA, 18 nt, Staphylococcus aureus subsp. aureus N315
gcagggugcuaaauuuac

SEQ ID NO: 4053255 - RNA, 12 nt, Staphylococcus aureus subsp. aureus N315
gcaguaaaacca

SEQ ID NO: 4053256 - RNA, 22 nt, Staphylococcus aureus subsp. aureus N315
gcaguaguugacugaacgaaaa

SEQ ID NO: 4053257 - RNA, 15 nt, Staphylococcus aureus subsp. aureus N315
gcaguauauaucaaa

SEQ ID NO: 4053258 - RNA, 19 nt, Staphylococcus aureus subsp. aureus N315
gcaguauauaucaaauaca

SEQ ID NO: 4053259 - RNA, 22 nt, Staphylococcus aureus subsp. aureus N315
gcagugaaguuaacuauaacaa

SEQ ID NO: 4053260 - RNA, 14 nt, Staphylococcus aureus subsp. aureus N315
gcauaaaaaaagaa

SEQ ID NO: 4053261 - RNA, 22 nt, Staphylococcus aureus subsp. aureus N315
gcauaacgagcaguauauauca

SEQ ID NO: 4053262 - RNA, 19 nt, Staphylococcus aureus subsp. aureus N315
gcauaauuaggauuaacau

SEQ ID NO: 4053263 - RNA, 16 nt, Staphylococcus aureus subsp. aureus N315
gcauaauucaacuuaa

SEQ ID NO: 4053264 - RNA, 16 nt, Staphylococcus aureus subsp. aureus N315
gcauaccuauaaacau

SEQ ID NO: 4053265 - RNA, 18 nt, Staphylococcus aureus subsp. aureus N315
gcauauaauauuugaaaa

SEQ ID NO: 4053266 - RNA, 16 nt, Staphylococcus aureus subsp. aureus N315
gcauaucuuuaucauu

SEQ ID NO: 4053267 - RNA, 18 nt, Staphylococcus aureus subsp. aureus N315
gcauaucuuuaucauuau

SEQ ID NO: 4053268 - RNA, 22 nt, Staphylococcus aureus subsp. aureus N315
gcauaugguaaaucgucauuau

SEQ ID NO: 4053269 - RNA, 16 nt, Staphylococcus aureus subsp. aureus N315
gcauauguaauacaaa

SEQ ID NO: 4053270 - RNA, 14 nt, Staphylococcus aureus subsp. aureus N315
gcauauucacgaua

SEQ ID NO: 4053271 - RNA, 21 nt, Staphylococcus aureus subsp. aureus N315
gcauauucgcuuaaaaacgcu

SEQ ID NO: 4053272 - RNA, 23 nt, Staphylococcus aureus subsp. aureus N315
gcauauucgcuuaaaaacgcuuu

SEQ ID NO: 4053273 - RNA, 16 nt, Staphylococcus aureus subsp. aureus N315
gcauauucuauuguug

SEQ ID NO: 4053274 - RNA, 16 nt, Staphylococcus aureus subsp. aureus N315
gcaucaacagauacuu

SEQ ID NO: 4053275 - RNA, 16 nt, Staphylococcus aureus subsp. aureus N315
gcaucuuuuacugcuu

SEQ ID NO: 4053276 - RNA, 17 nt, Staphylococcus aureus subsp. aureus N315
gcaugacagcaaauuuu

SEQ ID NO: 4053277 - RNA, 17 nt, Staphylococcus aureus subsp. aureus N315
gcaugacuguaaguaug

SEQ ID NO: 4053278 - RNA, 15 nt, Staphylococcus aureus subsp. aureus N315
gcaugccagaugcaa

SEQ ID NO: 4053279 - RNA, 13 nt, Staphylococcus aureus subsp. aureus N315
gcaugcgcaaaag

SEQ ID NO: 4053280 - RNA, 15 nt, Staphylococcus aureus subsp. aureus N315
gcaugcgcaaaagcg

SEQ ID NO: 4053281 - RNA, 19 nt, Staphylococcus aureus subsp. aureus N315
gcaugcgcaaaagcgcagg

SEQ ID NO: 4053282 - RNA, 16 nt, Staphylococcus aureus subsp. aureus N315
gcaugcuucucaauuu

SEQ ID NO: 4053283 - RNA, 15 nt, Staphylococcus aureus subsp. aureus N315
gcauuaaauuccaug

SEQ ID NO: 4053284 - RNA, 18 nt, Staphylococcus aureus subsp. aureus N315
gcauuaagaugauugucu

SEQ ID NO: 4053285 - RNA, 13 nt, Staphylococcus aureus subsp. aureus N315
gcauuaaugauuc

SEQ ID NO: 4053286 - RNA, 17 nt, Staphylococcus aureus subsp. aureus N315
gcauuaauguucaauuu

SEQ ID NO: 4053287 - RNA, 17 nt, Staphylococcus aureus subsp. aureus N315
gcauuacgccaccaguu

SEQ ID NO: 4053288 - RNA, 18 nt, Staphylococcus aureus subsp. aureus N315
gcauuacuacuuuauaaa

SEQ ID NO: 4053289 - RNA, 21 nt, Staphylococcus aureus subsp. aureus N315
gcauuauagaugacuguagaa

SEQ ID NO: 4053290 - RNA, 16 nt, Staphylococcus aureus subsp. aureus N315
gcauuauuauuucauu

SEQ ID NO: 4053291 - RNA, 20 nt, Staphylococcus aureus subsp. aureus N315
gcauuauuauuucauuagaa

SEQ ID NO: 4053292 - RNA, 21 nt, Staphylococcus aureus subsp. aureus N315
gcauuauuauuucauuagaaa

SEQ ID NO: 4053293 - RNA, 14 nt, Staphylococcus aureus subsp. aureus N315
gcauugaccaccuu

SEQ ID NO: 4053294 - RNA, 16 nt, Staphylococcus aureus subsp. aureus N315
gcauuuaaacaaagcu

SEQ ID NO: 4053295 - RNA, 19 nt, Staphylococcus aureus subsp. aureus N315
gcauuuuguuucaacauuu

SEQ ID NO: 4053296 - RNA, 18 nt, Staphylococcus aureus subsp. aureus N315
gcauuuuuucauuauuaa

SEQ ID NO: 4053297 - RNA, 19 nt, Staphylococcus aureus subsp. aureus N315
gccaaauaucaguaauaau

SEQ ID NO: 4053298 - RNA, 16 nt, Staphylococcus aureus subsp. aureus N315
gccaacaaagcuucca

SEQ ID NO: 4053299 - RNA, 22 nt, Staphylococcus aureus subsp. aureus N315
gccaacaaagcuuccaaauguu

SEQ ID NO: 4053300 - RNA, 21 nt, Staphylococcus aureus subsp. aureus N315
gccaaucuauugcaauauagu

SEQ ID NO: 4053301 - RNA, 13 nt, Staphylococcus aureus subsp. aureus N315
gccaauuaaaauu

SEQ ID NO: 4053302 - RNA, 22 nt, Staphylococcus aureus subsp. aureus N315
gccaccuuguuuaaguuuuuca

SEQ ID NO: 4053303 - RNA, 22 nt, Staphylococcus aureus subsp. aureus N315
gccacugucauguguucaaaua

SEQ ID NO: 4053304 - RNA, 14 nt, Staphylococcus aureus subsp. aureus N315
gccauaaucuucau

SEQ ID NO: 4053305 - RNA, 18 nt, Staphylococcus aureus subsp. aureus N315
gccauacccauauuaaau

SEQ ID NO: 4053306 - RNA, 16 nt, Staphylococcus aureus subsp. aureus N315
gccauaguaauaaugg

SEQ ID NO: 4053307 - RNA, 12 nt, Staphylococcus aureus subsp. aureus N315
gccauauuuauu

SEQ ID NO: 4053308 - RNA, 21 nt, Staphylococcus aureus subsp. aureus N315
gccaucaauauugauaucgaa

SEQ ID NO: 4053309 - RNA, 16 nt, Staphylococcus aureus subsp. aureus N315
gccaucaauuucugua

SEQ ID NO: 4053310 - RNA, 15 nt, Staphylococcus aureus subsp. aureus N315
gccaucuuaccuuua

SEQ ID NO: 4053311 - RNA, 11 nt, Staphylococcus aureus subsp. aureus N315
gccaucuuuuu

SEQ ID NO: 4053312 - RNA, 23 nt, Staphylococcus aureus subsp. aureus N315
gccaugaaaaggaaaaacuuuuc

SEQ ID NO: 4053313 - RNA, 14 nt, Staphylococcus aureus subsp. aureus N315
gccaugauacgaug

SEQ ID NO: 4053314 - RNA, 17 nt, Staphylococcus aureus subsp. aureus N315
gccauuggauucuuuug

SEQ ID NO: 4053315 - RNA, 20 nt, Staphylococcus aureus subsp. aureus N315
gccauuuuuauuuaacacuu

SEQ ID NO: 4053316 - RNA, 12 nt, Staphylococcus aureus subsp. aureus N315
gcccacacccca

SEQ ID NO: 4053317 - RNA, 14 nt, Staphylococcus aureus subsp. aureus N315
gcccacaccccaac

SEQ ID NO: 4053318 - RNA, 18 nt, Staphylococcus aureus subsp. aureus N315
gcccacaccccaacuugc

SEQ ID NO: 4053319 - RNA, 15 nt, Staphylococcus aureus subsp. aureus N315
gcccagaauguguug

SEQ ID NO: 4053320 - RNA, 13 nt, Staphylococcus aureus subsp. aureus N315
gcccauaccacca

SEQ ID NO: 4053321 - RNA, 15 nt, Staphylococcus aureus subsp. aureus N315
gcccaucaucacugu

SEQ ID NO: 4053322 - RNA, 22 nt, Staphylococcus aureus subsp. aureus N315
gcccauucugcagcgacaucuu

SEQ ID NO: 4053323 - RNA, 15 nt, Staphylococcus aureus subsp. aureus N315
gccccaacaaagaag

SEQ ID NO: 4053324 - RNA, 15 nt, Staphylococcus aureus subsp. aureus N315
gccccaacaaagaga

SEQ ID NO: 4053325 - RNA, 11 nt, Staphylococcus aureus subsp. aureus N315
gccccaacaca

SEQ ID NO: 4053326 - RNA, 12 nt, Staphylococcus aureus subsp. aureus N315
gccccaacacag

SEQ ID NO: 4053327 - RNA, 13 nt, Staphylococcus aureus subsp. aureus N315
gccccaacacaga

SEQ ID NO: 4053328 - RNA, 14 nt, Staphylococcus aureus subsp. aureus N315
gccccaacacagaa

SEQ ID NO: 4053329 - RNA, 16 nt, Staphylococcus aureus subsp. aureus N315
gcccccaacacaaaga

SEQ ID NO: 4053330 - RNA, 20 nt, Staphylococcus aureus subsp. aureus N315
gccccuagcaaaaauacuuu

SEQ ID NO: 4053331 - RNA, 19 nt, Staphylococcus aureus subsp. aureus N315
gccccuuacaacuuuaguu

SEQ ID NO: 4053332 - RNA, 15 nt, Staphylococcus aureus subsp. aureus N315
gcccgacaucauaaa

SEQ ID NO: 4053333 - RNA, 18 nt, Staphylococcus aureus subsp. aureus N315
gcccgucuggcacauuac

SEQ ID NO: 4053334 - RNA, 18 nt, Staphylococcus aureus subsp. aureus N315
gcccugacaauucaucua

SEQ ID NO: 4053335 - RNA, 19 nt, Staphylococcus aureus subsp. aureus N315
gcccugacaauucaucuaa

SEQ ID NO: 4053336 - RNA, 21 nt, Staphylococcus aureus subsp. aureus N315
gccgagauuauuauguggaaa

SEQ ID NO: 4053337 - RNA, 18 nt, Staphylococcus aureus subsp. aureus N315
gccguauuucaaauguaa

SEQ ID NO: 4053338 - RNA, 22 nt, Staphylococcus aureus subsp. aureus N315
gccgucuccauauuuguagccu

SEQ ID NO: 4053339 - RNA, 14 nt, Staphylococcus aureus subsp. aureus N315
gccguuauuuucaa

SEQ ID NO: 4053340 - RNA, 16 nt, Staphylococcus aureus subsp. aureus N315
gccuaaaaauaaaauc

SEQ ID NO: 4053341 - RNA, 13 nt, Staphylococcus aureus subsp. aureus N315
gccuaauaauaaa

SEQ ID NO: 4053342 - RNA, 23 nt, Staphylococcus aureus subsp. aureus N315
gccuaauacacuugauaaaacua

SEQ ID NO: 4053343 - RNA, 22 nt, Staphylococcus aureus subsp. aureus N315
gccuacuauaaauacgucaucu

SEQ ID NO: 4053344 - RNA, 14 nt, Staphylococcus aureus subsp. aureus N315
gccuaggaguaucu

SEQ ID NO: 4053345 - RNA, 16 nt, Staphylococcus aureus subsp. aureus N315
gccuauccauucaaau

SEQ ID NO: 4053346 - RNA, 13 nt, Staphylococcus aureus subsp. aureus N315
gccuauuuaaaag

SEQ ID NO: 4053347 - RNA, 15 nt, Staphylococcus aureus subsp. aureus N315
gccucaauaucuuua

SEQ ID NO: 4053348 - RNA, 18 nt, Staphylococcus aureus subsp. aureus N315
gccucuaaugauuaaaaa

SEQ ID NO: 4053349 - RNA, 17 nt, Staphylococcus aureus subsp. aureus N315
gccugcaagucguucuc

SEQ ID NO: 4053350 - RNA, 13 nt, Staphylococcus aureus subsp. aureus N315
gccuucauuagcc

SEQ ID NO: 4053351 - RNA, 15 nt, Staphylococcus aureus subsp. aureus N315
gccuucuauauagua

SEQ ID NO: 4053352 - RNA, 17 nt, Staphylococcus aureus subsp. aureus N315
gccuucuaucucuuuag

SEQ ID NO: 4053353 - RNA, 14 nt, Staphylococcus aureus subsp. aureus N315
gccuuguucaauuc

SEQ ID NO: 4053354 - RNA, 11 nt, Staphylococcus aureus subsp. aureus N315
gccuuucucua

SEQ ID NO: 4053355 - RNA, 17 nt, Staphylococcus aureus subsp. aureus N315
gccuuucucuaaauaau

SEQ ID NO: 4053356 - RNA, 18 nt, Staphylococcus aureus subsp. aureus N315
gccuuucucuaaauaauu

SEQ ID NO: 4053357 - RNA, 15 nt, Staphylococcus aureus subsp. aureus N315
gccuuuugaauaauu

SEQ ID NO: 4053358 - RNA, 17 nt, Staphylococcus aureus subsp. aureus N315
gccuuuuuuauuguaau

SEQ ID NO: 4053359 - RNA, 23 nt, Staphylococcus aureus subsp. aureus N315
gcgaaaacguugaguauuacuug

SEQ ID NO: 4053360 - RNA, 15 nt, Staphylococcus aureus subsp. aureus N315
gcgaagaaaccuuuu

SEQ ID NO: 4053361 - RNA, 23 nt, Staphylococcus aureus subsp. aureus N315
gcgacguuuaaaugcccaccaug

SEQ ID NO: 4053362 - RNA, 16 nt, Staphylococcus aureus subsp. aureus N315
gcgacuuaacuuaagc

SEQ ID NO: 4053363 - RNA, 13 nt, Staphylococcus aureus subsp. aureus N315
gcgauaaaguaug

SEQ ID NO: 4053364 - RNA, 18 nt, Staphylococcus aureus subsp. aureus N315
gcgauacguuuauaucuu

SEQ ID NO: 4053365 - RNA, 13 nt, Staphylococcus aureus subsp. aureus N315
gcgcaaaagcgca

SEQ ID NO: 4053366 - RNA, 14 nt, Staphylococcus aureus subsp. aureus N315
gcgccauaaucauu

SEQ ID NO: 4053367 - RNA, 15 nt, Staphylococcus aureus subsp. aureus N315
gcgccauaaucauua

SEQ ID NO: 4053368 - RNA, 21 nt, Staphylococcus aureus subsp. aureus N315
gcgccuuguucaauucagcaa

SEQ ID NO: 4053369 - RNA, 23 nt, Staphylococcus aureus subsp. aureus N315
gcgcucuggauuuuucuuauaaa

SEQ ID NO: 4053370 - RNA, 19 nt, Staphylococcus aureus subsp. aureus N315
gcgcuguuccaaauucauu

SEQ ID NO: 4053371 - RNA, 21 nt, Staphylococcus aureus subsp. aureus N315
gcgcuuuuuaauuuguauuua

SEQ ID NO: 4053372 - RNA, 17 nt, Staphylococcus aureus subsp. aureus N315
gcgcuuuuuuuuauaag

SEQ ID NO: 4053373 - RNA, 13 nt, Staphylococcus aureus subsp. aureus N315
gcggaaauaugau

SEQ ID NO: 4053374 - RNA, 17 nt, Staphylococcus aureus subsp. aureus N315
gcggaagauaggauuua

SEQ ID NO: 4053375 - RNA, 18 nt, Staphylococcus aureus subsp. aureus N315
gcggaagauaggauuugc

SEQ ID NO: 4053376 - RNA, 20 nt, Staphylococcus aureus subsp. aureus N315
gcggaauacagaugaugcuu

SEQ ID NO: 4053377 - RNA, 15 nt, Staphylococcus aureus subsp. aureus N315
gcggauaguguugcg

SEQ ID NO: 4053378 - RNA, 19 nt, Staphylococcus aureus subsp. aureus N315
gcggauuaucuaacucaua

SEQ ID NO: 4053379 - RNA, 23 nt, Staphylococcus aureus subsp. aureus N315
gcggucaauuuuaccauguuuua

SEQ ID NO: 4053380 - RNA, 13 nt, Staphylococcus aureus subsp. aureus N315
gcguacauauaau

SEQ ID NO: 4053381 - RNA, 18 nt, Staphylococcus aureus subsp. aureus N315
gcguauccccauuuaugu

SEQ ID NO: 4053382 - RNA, 13 nt, Staphylococcus aureus subsp. aureus N315
gcguauuuuaaug

SEQ ID NO: 4053383 - RNA, 18 nt, Staphylococcus aureus subsp. aureus N315
gcgucauuuguucaucug

SEQ ID NO: 4053384 - RNA, 20 nt, Staphylococcus aureus subsp. aureus N315
gcgucauuuguucaucugau

SEQ ID NO: 4053385 - RNA, 15 nt, Staphylococcus aureus subsp. aureus N315
gcguuaaauauggau

SEQ ID NO: 4053386 - RNA, 21 nt, Staphylococcus aureus subsp. aureus N315
gcguucgugauagaaguuuuu

SEQ ID NO: 4053387 - RNA, 15 nt, Staphylococcus aureus subsp. aureus N315
gcguugguauucauc

SEQ ID NO: 4053388 - RNA, 20 nt, Staphylococcus aureus subsp. aureus N315
gcguuuaaucacaucuuuuu

SEQ ID NO: 4053389 - RNA, 11 nt, Staphylococcus aureus subsp. aureus N315
gcuaaaaaaau

SEQ ID NO: 4053390 - RNA, 13 nt, Staphylococcus aureus subsp. aureus N315
gcuaaaaaaauua

SEQ ID NO: 4053391 - RNA, 11 nt, Staphylococcus aureus subsp. aureus N315
gcuaaaaauau

SEQ ID NO: 4053392 - RNA, 18 nt, Staphylococcus aureus subsp. aureus N315
gcuaaacgcaauacgaau

SEQ ID NO: 4053393 - RNA, 19 nt, Staphylococcus aureus subsp. aureus N315
gcuaaauuuacgaaaguag

SEQ ID NO: 4053394 - RNA, 18 nt, Staphylococcus aureus subsp. aureus N315
gcuaacauucagugcaau

SEQ ID NO: 4053395 - RNA, 20 nt, Staphylococcus aureus subsp. aureus N315
gcuaauaaaaccgguacuuu

SEQ ID NO: 4053396 - RNA, 13 nt, Staphylococcus aureus subsp. aureus N315
gcuaaucuucuca

SEQ ID NO: 4053397 - RNA, 18 nt, Staphylococcus aureus subsp. aureus N315
gcuaaugcaacuaaaacu

SEQ ID NO: 4053398 - RNA, 18 nt, Staphylococcus aureus subsp. aureus N315
gcuaaugcauuauuauaa

SEQ ID NO: 4053399 - RNA, 18 nt, Staphylococcus aureus subsp. aureus N315
gcuaauguguacuuaaaa

SEQ ID NO: 4053400 - RNA, 21 nt, Staphylococcus aureus subsp. aureus N315
gcuaauguguacuuaaaaaua

SEQ ID NO: 4053401 - RNA, 20 nt, Staphylococcus aureus subsp. aureus N315
gcuaauuuuaauuuucagaa

SEQ ID NO: 4053402 - RNA, 14 nt, Staphylococcus aureus subsp. aureus N315
gcuacaauuauaaa

SEQ ID NO: 4053403 - RNA, 14 nt, Staphylococcus aureus subsp. aureus N315
gcuacaauuuccua

SEQ ID NO: 4053404 - RNA, 15 nt, Staphylococcus aureus subsp. aureus N315
gcuacuauuaaauaa

SEQ ID NO: 4053405 - RNA, 19 nt, Staphylococcus aureus subsp. aureus N315
gcuacuuuuucaucuuuca

SEQ ID NO: 4053406 - RNA, 16 nt, Staphylococcus aureus subsp. aureus N315
gcuagaacagauauac

SEQ ID NO: 4053407 - RNA, 17 nt, Staphylococcus aureus subsp. aureus N315
gcuagcuuucuuuuuca

SEQ ID NO: 4053408 - RNA, 19 nt, Staphylococcus aureus subsp. aureus N315
gcuagucauaauuuaaaag

SEQ ID NO: 4053409 - RNA, 15 nt, Staphylococcus aureus subsp. aureus N315
gcuaguucagcuucu

SEQ ID NO: 4053410 - RNA, 18 nt, Staphylococcus aureus subsp. aureus N315
gcuauaaaaaaucuuuug

SEQ ID NO: 4053411 - RNA, 20 nt, Staphylococcus aureus subsp. aureus N315
gcuauaaaauuuugaagaag

SEQ ID NO: 4053412 - RNA, 19 nt, Staphylococcus aureus subsp. aureus N315
gcuauaagaacuaaugguu

SEQ ID NO: 4053413 - RNA, 18 nt, Staphylococcus aureus subsp. aureus N315
gcuauauaauuuauaaaa

SEQ ID NO: 4053414 - RNA, 15 nt, Staphylococcus aureus subsp. aureus N315
gcuaugaagaaaucu

SEQ ID NO: 4053415 - RNA, 15 nt, Staphylococcus aureus subsp. aureus N315
gcuauguauuuuucu

SEQ ID NO: 4053416 - RNA, 21 nt, Staphylococcus aureus subsp. aureus N315
gcuauuauuuccuguuacuuu

SEQ ID NO: 4053417 - RNA, 19 nt, Staphylococcus aureus subsp. aureus N315
gcuauuucaacaaacauaa

SEQ ID NO: 4053418 - RNA, 15 nt, Staphylococcus aureus subsp. aureus N315
gcucaacuauauaua

SEQ ID NO: 4053419 - RNA, 16 nt, Staphylococcus aureus subsp. aureus N315
gcucauaugucuguuc

SEQ ID NO: 4053420 - RNA, 15 nt, Staphylococcus aureus subsp. aureus N315
gcucauugugcuuga

SEQ ID NO: 4053421 - RNA, 18 nt, Staphylococcus aureus subsp. aureus N315
gcucauuucaauauuaaa

SEQ ID NO: 4053422 - RNA, 17 nt, Staphylococcus aureus subsp. aureus N315
gcuccagucauuuguug

SEQ ID NO: 4053423 - RNA, 13 nt, Staphylococcus aureus subsp. aureus N315
gcuccuacuuuuc

SEQ ID NO: 4053424 - RNA, 13 nt, Staphylococcus aureus subsp. aureus N315
gcucguuaaauca

SEQ ID NO: 4053425 - RNA, 19 nt, Staphylococcus aureus subsp. aureus N315
gcucguugcagauuuugca

SEQ ID NO: 4053426 - RNA, 23 nt, Staphylococcus aureus subsp. aureus N315
gcucguuuuuuuagcuauagaaa

SEQ ID NO: 4053427 - RNA, 20 nt, Staphylococcus aureus subsp. aureus N315
gcucuaauccaaaauaaucg

SEQ ID NO: 4053428 - RNA, 18 nt, Staphylococcus aureus subsp. aureus N315
gcucuaauucaaugauuu

SEQ ID NO: 4053429 - RNA, 15 nt, Staphylococcus aureus subsp. aureus N315
gcucuggauuuuucu

SEQ ID NO: 4053430 - RNA, 22 nt, Staphylococcus aureus subsp. aureus N315
gcucuggauuuuucuuauaaaa

SEQ ID NO: 4053431 - RNA, 20 nt, Staphylococcus aureus subsp. aureus N315
gcucuuaauguacuuuucug

SEQ ID NO: 4053432 - RNA, 13 nt, Staphylococcus aureus subsp. aureus N315
gcucuugcuaaag

SEQ ID NO: 4053433 - RNA, 21 nt, Staphylococcus aureus subsp. aureus N315
gcugaaauuuuuuagugaaaa

SEQ ID NO: 4053434 - RNA, 20 nt, Staphylococcus aureus subsp. aureus N315
gcugaaucgaguuugaaaua

SEQ ID NO: 4053435 - RNA, 19 nt, Staphylococcus aureus subsp. aureus N315
gcugacaccuauauuuuua

SEQ ID NO: 4053436 - RNA, 13 nt, Staphylococcus aureus subsp. aureus N315
gcugauaauaaaa

SEQ ID NO: 4053437 - RNA, 12 nt, Staphylococcus aureus subsp. aureus N315
gcugcaacauuc

SEQ ID NO: 4053438 - RNA, 21 nt, Staphylococcus aureus subsp. aureus N315
gcugcaagucucauaucuauu

SEQ ID NO: 4053439 - RNA, 18 nt, Staphylococcus aureus subsp. aureus N315
gcugcaaucguugaaaaa

SEQ ID NO: 4053440 - RNA, 15 nt, Staphylococcus aureus subsp. aureus N315
gcugccaaauauaau

SEQ ID NO: 4053441 - RNA, 16 nt, Staphylococcus aureus subsp. aureus N315
gcugccaaauauaauu

SEQ ID NO: 4053442 - RNA, 19 nt, Staphylococcus aureus subsp. aureus N315
gcugccaaauauaauuuca

SEQ ID NO: 4053443 - RNA, 23 nt, Staphylococcus aureus subsp. aureus N315
gcugcuauccuugcuaucaaacu

SEQ ID NO: 4053444 - RNA, 17 nt, Staphylococcus aureus subsp. aureus N315
gcugcuguacaauuucg

SEQ ID NO: 4053445 - RNA, 21 nt, Staphylococcus aureus subsp. aureus N315
gcuggacaaucuuaucauaau

SEQ ID NO: 4053446 - RNA, 15 nt, Staphylococcus aureus subsp. aureus N315
gcuggcccccaacac

SEQ ID NO: 4053447 - RNA, 22 nt, Staphylococcus aureus subsp. aureus N315
gcuggcgcaaugauaucuuuuc

SEQ ID NO: 4053448 - RNA, 18 nt, Staphylococcus aureus subsp. aureus N315
gcugguaauauuuuuguu

SEQ ID NO: 4053449 - RNA, 19 nt, Staphylococcus aureus subsp. aureus N315
gcugguaauauuuuuguug

SEQ ID NO: 4053450 - RNA, 22 nt, Staphylococcus aureus subsp. aureus N315
gcugguugcuucuuaucaacaa

SEQ ID NO: 4053451 - RNA, 12 nt, Staphylococcus aureus subsp. aureus N315
gcugucauaccu

SEQ ID NO: 4053452 - RNA, 15 nt, Staphylococcus aureus subsp. aureus N315
gcugucauaccuuuu

SEQ ID NO: 4053453 - RNA, 17 nt, Staphylococcus aureus subsp. aureus N315
gcugucauuuucugcuu

SEQ ID NO: 4053454 - RNA, 17 nt, Staphylococcus aureus subsp. aureus N315
gcuguccacuauauccu

SEQ ID NO: 4053455 - RNA, 21 nt, Staphylococcus aureus subsp. aureus N315
gcuguguacguuucaauguau

SEQ ID NO: 4053456 - RNA, 17 nt, Staphylococcus aureus subsp. aureus N315
gcuguuacacuuuucuu

SEQ ID NO: 4053457 - RNA, 21 nt, Staphylococcus aureus subsp. aureus N315
gcuguuggcaaaacaauauac

SEQ ID NO: 4053458 - RNA, 23 nt, Staphylococcus aureus subsp. aureus N315
gcuguuuuuauuauaauagagaa

SEQ ID NO: 4053459 - RNA, 16 nt, Staphylococcus aureus subsp. aureus N315
gcuuaagaaauuuuuu

SEQ ID NO: 4053460 - RNA, 18 nt, Staphylococcus aureus subsp. aureus N315
gcuuaagaaauuuuuucu

SEQ ID NO: 4053461 - RNA, 19 nt, Staphylococcus aureus subsp. aureus N315
gcuuaauaagcugaaauaa

SEQ ID NO: 4053462 - RNA, 14 nt, Staphylococcus aureus subsp. aureus N315
gcuuaauucuucau

SEQ ID NO: 4053463 - RNA, 13 nt, Staphylococcus aureus subsp. aureus N315
gcuuaauuuaugu

SEQ ID NO: 4053464 - RNA, 16 nt, Staphylococcus aureus subsp. aureus N315
gcuuaauuuuauuauu

SEQ ID NO: 4053465 - RNA, 22 nt, Staphylococcus aureus subsp. aureus N315
gcuuagcaguucuauugucagc

SEQ ID NO: 4053466 - RNA, 17 nt, Staphylococcus aureus subsp. aureus N315
gcuuauugaaaagauaa

SEQ ID NO: 4053467 - RNA, 21 nt, Staphylococcus aureus subsp. aureus N315
gcuuauugaaaagauaaacaa

SEQ ID NO: 4053468 - RNA, 15 nt, Staphylococcus aureus subsp. aureus N315
gcuucaaauguaaca

SEQ ID NO: 4053469 - RNA, 18 nt, Staphylococcus aureus subsp. aureus N315
gcuucauagucacuuuua

SEQ ID NO: 4053470 - RNA, 22 nt, Staphylococcus aureus subsp. aureus N315
gcuucauuaguugcauaaucaa

SEQ ID NO: 4053471 - RNA, 21 nt, Staphylococcus aureus subsp. aureus N315
gcuuccaauuuaaaaugauuc

SEQ ID NO: 4053472 - RNA, 20 nt, Staphylococcus aureus subsp. aureus N315
gcuuccucucguaaauuguu

SEQ ID NO: 4053473 - RNA, 18 nt, Staphylococcus aureus subsp. aureus N315
gcuucgcuagaaccugcu

SEQ ID NO: 4053474 - RNA, 22 nt, Staphylococcus aureus subsp. aureus N315
gcuucuguguuggggcccacac

SEQ ID NO: 4053475 - RNA, 17 nt, Staphylococcus aureus subsp. aureus N315
gcuucuuucuaaaauaa

SEQ ID NO: 4053476 - RNA, 21 nt, Staphylococcus aureus subsp. aureus N315
gcuugaaauuauuauuuaaau

SEQ ID NO: 4053477 - RNA, 23 nt, Staphylococcus aureus subsp. aureus N315
gcuugagcaucuuuuacugcuuc

SEQ ID NO: 4053478 - RNA, 15 nt, Staphylococcus aureus subsp. aureus N315
gcuugauuaacauuu

SEQ ID NO: 4053479 - RNA, 13 nt, Staphylococcus aureus subsp. aureus N315
gcuuggauuuuuu

SEQ ID NO: 4053480 - RNA, 14 nt, Staphylococcus aureus subsp. aureus N315
gcuuguaaaauuuu

SEQ ID NO: 4053481 - RNA, 18 nt, Staphylococcus aureus subsp. aureus N315
gcuuguaacaagcauuuu

SEQ ID NO: 4053482 - RNA, 23 nt, Staphylococcus aureus subsp. aureus N315
gcuuguacgauaacuacacuuaa

SEQ ID NO: 4053483 - RNA, 17 nt, Staphylococcus aureus subsp. aureus N315
gcuugugugaaauuaga

SEQ ID NO: 4053484 - RNA, 13 nt, Staphylococcus aureus subsp. aureus N315
gcuuuaauauaaa

SEQ ID NO: 4053485 - RNA, 13 nt, Staphylococcus aureus subsp. aureus N315
gcuuuaauuuuuu

SEQ ID NO: 4053486 - RNA, 19 nt, Staphylococcus aureus subsp. aureus N315
gcuuuacguucugauucau

SEQ ID NO: 4053487 - RNA, 20 nt, Staphylococcus aureus subsp. aureus N315
gcuuuagucgguguuuucuu

SEQ ID NO: 4053488 - RNA, 18 nt, Staphylococcus aureus subsp. aureus N315
gcuuuaucaacaaauuuu

SEQ ID NO: 4053489 - RNA, 22 nt, Staphylococcus aureus subsp. aureus N315
gcuuugaguguguccaucauuu

SEQ ID NO: 4053490 - RNA, 19 nt, Staphylococcus aureus subsp. aureus N315
gcuuugcugcuuuuccagu

SEQ ID NO: 4053491 - RNA, 22 nt, Staphylococcus aureus subsp. aureus N315
gcuuuguaaaauugugacgcug

SEQ ID NO: 4053492 - RNA, 20 nt, Staphylococcus aureus subsp. aureus N315
gcuuugucacgauagauuua

SEQ ID NO: 4053493 - RNA, 23 nt, Staphylococcus aureus subsp. aureus N315
gcuuugucacgauagauuuauca

SEQ ID NO: 4053494 - RNA, 14 nt, Staphylococcus aureus subsp. aureus N315
gcuuuguuuuucac

SEQ ID NO: 4053495 - RNA, 13 nt, Staphylococcus aureus subsp. aureus N315
gcuuuuaugcaug

SEQ ID NO: 4053496 - RNA, 14 nt, Staphylococcus aureus subsp. aureus N315
gcuuuuaugcaugc

SEQ ID NO: 4053497 - RNA, 19 nt, Staphylococcus aureus subsp. aureus N315
gcuuuuaugcaugcgcaaa

SEQ ID NO: 4053498 - RNA, 14 nt, Staphylococcus aureus subsp. aureus N315
gcuuuuauuuauau

SEQ ID NO: 4053499 - RNA, 20 nt, Staphylococcus aureus subsp. aureus N315
gcuuuuauuuauauuauuac

SEQ ID NO: 4053500 - RNA, 17 nt, Staphylococcus aureus subsp. aureus N315
gcuuuuguaaagcuuua

SEQ ID NO: 4053501 - RNA, 23 nt, Staphylococcus aureus subsp. aureus N315
gcuuuuuauuuuguuuaucugua

SEQ ID NO: 4053502 - RNA, 18 nt, Staphylococcus aureus subsp. aureus N315
gcuuuuucaaaaucuuua

SEQ ID NO: 4053503 - RNA, 18 nt, Staphylococcus aureus subsp. aureus N315
gcuuuuucaaauaauaua

SEQ ID NO: 4053504 - RNA, 17 nt, Staphylococcus aureus subsp. aureus N315
gcuuuuucuuuuguuuu

SEQ ID NO: 4053505 - RNA, 21 nt, Staphylococcus aureus subsp. aureus N315
gcuuuuuuauucuaauacaaa

SEQ ID NO: 4053506 - RNA, 14 nt, Staphylococcus aureus subsp. aureus N315
gcuuuuuucaauuc

SEQ ID NO: 4053507 - RNA, 20 nt, Staphylococcus aureus subsp. aureus N315
gcuuuuuucaauucuaguca

SEQ ID NO: 4053508 - RNA, 21 nt, Staphylococcus aureus subsp. aureus N315
gcuuuuuugugauuuuuaaua

SEQ ID NO: 4053509 - RNA, 15 nt, Staphylococcus aureus subsp. aureus N315
gcuuuuuuuuauaag

SEQ ID NO: 4053510 - RNA, 15 nt, Staphylococcus aureus subsp. aureus N315
ggaaaaagaugaaaa

SEQ ID NO: 4053511 - RNA, 16 nt, Staphylococcus aureus subsp. aureus N315
ggaaaaagaugaaaaa

SEQ ID NO: 4053512 - RNA, 19 nt, Staphylococcus aureus subsp. aureus N315
ggaaaauaaaaaccagcua

SEQ ID NO: 4053513 - RNA, 15 nt, Staphylococcus aureus subsp. aureus N315
ggaaaauacuauacu

SEQ ID NO: 4053514 - RNA, 23 nt, Staphylococcus aureus subsp. aureus N315
ggaaaauacuauacugaugaaaa

SEQ ID NO: 4053515 - RNA, 13 nt, Staphylococcus aureus subsp. aureus N315
ggaaagucagcuu

SEQ ID NO: 4053516 - RNA, 22 nt, Staphylococcus aureus subsp. aureus N315
ggaaauuuauuauaaaauagaa

SEQ ID NO: 4053517 - RNA, 16 nt, Staphylococcus aureus subsp. aureus N315
ggaacaugauucauga

SEQ ID NO: 4053518 - RNA, 18 nt, Staphylococcus aureus subsp. aureus N315
ggaacuacuacauuauua

SEQ ID NO: 4053519 - RNA, 18 nt, Staphylococcus aureus subsp. aureus N315
ggaagaccacuauuuuua

SEQ ID NO: 4053520 - RNA, 15 nt, Staphylococcus aureus subsp. aureus N315
ggaagaccauuuuau

SEQ ID NO: 4053521 - RNA, 15 nt, Staphylococcus aureus subsp. aureus N315
ggaagcauauuucua

SEQ ID NO: 4053522 - RNA, 18 nt, Staphylococcus aureus subsp. aureus N315
ggaaguuaggcaacuaaa

SEQ ID NO: 4053523 - RNA, 15 nt, Staphylococcus aureus subsp. aureus N315
ggaauaacuuuuuaa

SEQ ID NO: 4053524 - RNA, 20 nt, Staphylococcus aureus subsp. aureus N315
ggaauacagaugaugcuucg

SEQ ID NO: 4053525 - RNA, 20 nt, Staphylococcus aureus subsp. aureus N315
ggaauacagaugaugcuucu

SEQ ID NO: 4053526 - RNA, 15 nt, Staphylococcus aureus subsp. aureus N315
ggaauauaaaacugu

SEQ ID NO: 4053527 - RNA, 18 nt, Staphylococcus aureus subsp. aureus N315
ggaauccaauuucucuau

SEQ ID NO: 4053528 - RNA, 23 nt, Staphylococcus aureus subsp. aureus N315
ggaauguuccuccaccaccugca

SEQ ID NO: 4053529 - RNA, 21 nt, Staphylococcus aureus subsp. aureus N315
ggaauugguuuuuagugaaaa

SEQ ID NO: 4053530 - RNA, 19 nt, Staphylococcus aureus subsp. aureus N315
ggacaacuaauaacaaaua

SEQ ID NO: 4053531 - RNA, 10 nt, Staphylococcus aureus subsp. aureus N315
ggacaaguuu

SEQ ID NO: 4053532 - RNA, 20 nt, Staphylococcus aureus subsp. aureus N315
ggacagaaaagggcaaaaaa

SEQ ID NO: 4053533 - RNA, 19 nt, Staphylococcus aureus subsp. aureus N315
ggacauagguauaaucauu

SEQ ID NO: 4053534 - RNA, 17 nt, Staphylococcus aureus subsp. aureus N315
ggaccuuguaaauuuaa

SEQ ID NO: 4053535 - RNA, 23 nt, Staphylococcus aureus subsp. aureus N315
ggacgauaacagcuacaaauaau

SEQ ID NO: 4053536 - RNA, 12 nt, Staphylococcus aureus subsp. aureus N315
ggacugaaagaa

SEQ ID NO: 4053537 - RNA, 12 nt, Staphylococcus aureus subsp. aureus N315
ggagaaccuuua

SEQ ID NO: 4053538 - RNA, 12 nt, Staphylococcus aureus subsp. aureus N315
ggagaaccuuuu

SEQ ID NO: 4053539 - RNA, 19 nt, Staphylococcus aureus subsp. aureus N315
ggagccccuuacaacuuua

SEQ ID NO: 4053540 - RNA, 18 nt, Staphylococcus aureus subsp. aureus N315
ggagcggaagauaggauu

SEQ ID NO: 4053541 - RNA, 15 nt, Staphylococcus aureus subsp. aureus N315
ggagugggacagaaa

SEQ ID NO: 4053542 - RNA, 20 nt, Staphylococcus aureus subsp. aureus N315
ggauaauuuuuaacagcgug

SEQ ID NO: 4053543 - RNA, 15 nt, Staphylococcus aureus subsp. aureus N315
ggaucuuucaaagua

SEQ ID NO: 4053544 - RNA, 17 nt, Staphylococcus aureus subsp. aureus N315
ggaugaguuuaaaaaua

SEQ ID NO: 4053545 - RNA, 19 nt, Staphylococcus aureus subsp. aureus N315
ggaugaguuuaaaaauaug

SEQ ID NO: 4053546 - RNA, 22 nt, Staphylococcus aureus subsp. aureus N315
ggaugggccccaacaaagagaa

SEQ ID NO: 4053547 - RNA, 22 nt, Staphylococcus aureus subsp. aureus N315
ggauguuauaaaaugaauaauu

SEQ ID NO: 4053548 - RNA, 13 nt, Staphylococcus aureus subsp. aureus N315
ggauucaaaugac

SEQ ID NO: 4053549 - RNA, 20 nt, Staphylococcus aureus subsp. aureus N315
ggauuuccucgguuuuauuu

SEQ ID NO: 4053550 - RNA, 22 nt, Staphylococcus aureus subsp. aureus N315
ggauuuuuuuauguuugggaua

SEQ ID NO: 4053551 - RNA, 11 nt, Staphylococcus aureus subsp. aureus N315
ggcaaauaggc

SEQ ID NO: 4053552 - RNA, 17 nt, Staphylococcus aureus subsp. aureus N315
ggcaacacucggaaaca

SEQ ID NO: 4053553 - RNA, 21 nt, Staphylococcus aureus subsp. aureus N315
ggcaauauugaacaauucuuc

SEQ ID NO: 4053554 - RNA, 15 nt, Staphylococcus aureus subsp. aureus N315
ggcacauaaaucaau

SEQ ID NO: 4053555 - RNA, 21 nt, Staphylococcus aureus subsp. aureus N315
ggcacuuaagcuuuaaucaua

SEQ ID NO: 4053556 - RNA, 21 nt, Staphylococcus aureus subsp. aureus N315
ggcagacguaucaucaaaguu

SEQ ID NO: 4053557 - RNA, 22 nt, Staphylococcus aureus subsp. aureus N315
ggcauuuugacgccagaauaaa

SEQ ID NO: 4053558 - RNA, 18 nt, Staphylococcus aureus subsp. aureus N315
ggccccgacuauuuuuga

SEQ ID NO: 4053559 - RNA, 13 nt, Staphylococcus aureus subsp. aureus N315
ggcgacauuugua

SEQ ID NO: 4053560 - RNA, 23 nt, Staphylococcus aureus subsp. aureus N315
ggcgcuguuccaaauucauuugu

SEQ ID NO: 4053561 - RNA, 12 nt, Staphylococcus aureus subsp. aureus N315
ggcguaaugaua

SEQ ID NO: 4053562 - RNA, 18 nt, Staphylococcus aureus subsp. aureus N315
ggcuucuuucuaaaauaa

SEQ ID NO: 4053563 - RNA, 11 nt, Staphylococcus aureus subsp. aureus N315
ggcuuuaaaau

SEQ ID NO: 4053564 - RNA, 14 nt, Staphylococcus aureus subsp. aureus N315
ggcuuuguuuuuca

SEQ ID NO: 4053565 - RNA, 22 nt, Staphylococcus aureus subsp. aureus N315
ggcuuuuuauaccaauaauuac

SEQ ID NO: 4053566 - RNA, 19 nt, Staphylococcus aureus subsp. aureus N315
ggcuuuuuguuuugaaugu

SEQ ID NO: 4053567 - RNA, 21 nt, Staphylococcus aureus subsp. aureus N315
ggcuuuuuuauuuuauaagaa

SEQ ID NO: 4053568 - RNA, 16 nt, Staphylococcus aureus subsp. aureus N315
gggaaauauuugaaaa

SEQ ID NO: 4053569 - RNA, 14 nt, Staphylococcus aureus subsp. aureus N315
gggacagaaaacaa

SEQ ID NO: 4053570 - RNA, 17 nt, Staphylococcus aureus subsp. aureus N315
gggagugggacagaaau

SEQ ID NO: 4053571 - RNA, 24 nt, Staphylococcus aureus subsp. aureus N315
gggaugggccccaacacagagaau

SEQ ID NO: 4053572 - RNA, 18 nt, Staphylococcus aureus subsp. aureus N315
gggauuuuuuuauguuug

SEQ ID NO: 4053573 - RNA, 13 nt, Staphylococcus aureus subsp. aureus N315
gggcaaaaaagga

SEQ ID NO: 4053574 - RNA, 15 nt, Staphylococcus aureus subsp. aureus N315
gggccagccaacuug

SEQ ID NO: 4053575 - RNA, 16 nt, Staphylococcus aureus subsp. aureus N315
gggcccacaccccaac

SEQ ID NO: 4053576 - RNA, 17 nt, Staphylococcus aureus subsp. aureus N315
gggccccaacacagaga

SEQ ID NO: 4053577 - RNA, 13 nt, Staphylococcus aureus subsp. aureus N315
gggcccccaacac

SEQ ID NO: 4053578 - RNA, 14 nt, Staphylococcus aureus subsp. aureus N315
gggcccccaacaca

SEQ ID NO: 4053579 - RNA, 13 nt, Staphylococcus aureus subsp. aureus N315
gggcguucugcua

SEQ ID NO: 4053580 - RNA, 20 nt, Staphylococcus aureus subsp. aureus N315
gggcuagagcguuuugcuuu

SEQ ID NO: 4053581 - RNA, 12 nt, Staphylococcus aureus subsp. aureus N315
gggcuucugcua

SEQ ID NO: 4053582 - RNA, 17 nt, Staphylococcus aureus subsp. aureus N315
ggggacuuaaccauuua

SEQ ID NO: 4053583 - RNA, 15 nt, Staphylococcus aureus subsp. aureus N315
ggggccccaacacag

SEQ ID NO: 4053584 - RNA, 18 nt, Staphylococcus aureus subsp. aureus N315
ggggccccaacacagaga

SEQ ID NO: 4053585 - RNA, 19 nt, Staphylococcus aureus subsp. aureus N315
ggggcuuuuaugcaugcgc

SEQ ID NO: 4053586 - RNA, 16 nt, Staphylococcus aureus subsp. aureus N315
ggggugagggccccaa

SEQ ID NO: 4053587 - RNA, 18 nt, Staphylococcus aureus subsp. aureus N315
ggggugggacgacgaaau

SEQ ID NO: 4053588 - RNA, 23 nt, Staphylococcus aureus subsp. aureus N315
gggucacacccauacucugggca

SEQ ID NO: 4053589 - RNA, 19 nt, Staphylococcus aureus subsp. aureus N315
gggugagggccccaacaca

SEQ ID NO: 4053590 - RNA, 18 nt, Staphylococcus aureus subsp. aureus N315
gguaaaaaucucaaaauu

SEQ ID NO: 4053591 - RNA, 22 nt, Staphylococcus aureus subsp. aureus N315
gguaaaucuguuuaaauuuaaa

SEQ ID NO: 4053592 - RNA, 19 nt, Staphylococcus aureus subsp. aureus N315
gguaagaccccgaaaagag

SEQ ID NO: 4053593 - RNA, 17 nt, Staphylococcus aureus subsp. aureus N315
gguaaguauaauuaaac

SEQ ID NO: 4053594 - RNA, 10 nt, Staphylococcus aureus subsp. aureus N315
gguaauaauu

SEQ ID NO: 4053595 - RNA, 21 nt, Staphylococcus aureus subsp. aureus N315
gguaauacuauaugaaaagag

SEQ ID NO: 4053596 - RNA, 12 nt, Staphylococcus aureus subsp. aureus N315
gguaauacuuuu

SEQ ID NO: 4053597 - RNA, 14 nt, Staphylococcus aureus subsp. aureus N315
gguaauuuaacauu

SEQ ID NO: 4053598 - RNA, 23 nt, Staphylococcus aureus subsp. aureus N315
gguacacauguacguuuuuuuaa

SEQ ID NO: 4053599 - RNA, 22 nt, Staphylococcus aureus subsp. aureus N315
gguacaccuacaaauauuucua

SEQ ID NO: 4053600 - RNA, 19 nt, Staphylococcus aureus subsp. aureus N315
gguacacuucaacauauaa

SEQ ID NO: 4053601 - RNA, 22 nt, Staphylococcus aureus subsp. aureus N315
gguaccuuuuuauuaucuuuaa

SEQ ID NO: 4053602 - RNA, 13 nt, Staphylococcus aureus subsp. aureus N315
gguacuuuuuuga

SEQ ID NO: 4053603 - RNA, 21 nt, Staphylococcus aureus subsp. aureus N315
gguaugauauuucuaaauugu

SEQ ID NO: 4053604 - RNA, 20 nt, Staphylococcus aureus subsp. aureus N315
gguaugcguggucuauuuua

SEQ ID NO: 4053605 - RNA, 14 nt, Staphylococcus aureus subsp. aureus N315
gguauucaaauaaa

SEQ ID NO: 4053606 - RNA, 19 nt, Staphylococcus aureus subsp. aureus N315
gguauucaaauaaacacau

SEQ ID NO: 4053607 - RNA, 15 nt, Staphylococcus aureus subsp. aureus N315
ggucaauuuuaccau

SEQ ID NO: 4053608 - RNA, 18 nt, Staphylococcus aureus subsp. aureus N315
ggucauagaaauuuuaaa

SEQ ID NO: 4053609 - RNA, 21 nt, Staphylococcus aureus subsp. aureus N315
gguccaaaucgugauaucuug

SEQ ID NO: 4053610 - RNA, 20 nt, Staphylococcus aureus subsp. aureus N315
ggucgugagccccucccaag

SEQ ID NO: 4053611 - RNA, 21 nt, Staphylococcus aureus subsp. aureus N315
ggucuacgaucaaaaucaugc

SEQ ID NO: 4053612 - RNA, 13 nt, Staphylococcus aureus subsp. aureus N315
ggucugcuguauc

SEQ ID NO: 4053613 - RNA, 17 nt, Staphylococcus aureus subsp. aureus N315
ggucuucgcaaucauua

SEQ ID NO: 4053614 - RNA, 18 nt, Staphylococcus aureus subsp. aureus N315
ggucuuuuaauuaaaagu

SEQ ID NO: 4053615 - RNA, 23 nt, Staphylococcus aureus subsp. aureus N315
ggugaauuaguaaacuaauccuc

SEQ ID NO: 4053616 - RNA, 13 nt, Staphylococcus aureus subsp. aureus N315
ggugagggcccca

SEQ ID NO: 4053617 - RNA, 20 nt, Staphylococcus aureus subsp. aureus N315
ggugagggccccaacacaga

SEQ ID NO: 4053618 - RNA, 21 nt, Staphylococcus aureus subsp. aureus N315
ggugagggccccaacacagaa

SEQ ID NO: 4053619 - RNA, 21 nt, Staphylococcus aureus subsp. aureus N315
ggugcuuuuggaugauuggua

SEQ ID NO: 4053620 - RNA, 23 nt, Staphylococcus aureus subsp. aureus N315
gguguagauaaaucgauaaaaug

SEQ ID NO: 4053621 - RNA, 18 nt, Staphylococcus aureus subsp. aureus N315
gguguuuauaucuuugug

SEQ ID NO: 4053622 - RNA, 12 nt, Staphylococcus aureus subsp. aureus N315
gguuaaauuacu

SEQ ID NO: 4053623 - RNA, 12 nt, Staphylococcus aureus subsp. aureus N315
gguuaacacguu

SEQ ID NO: 4053624 - RNA, 20 nt, Staphylococcus aureus subsp. aureus N315
gguuaaugacuaugcaaaug

SEQ ID NO: 4053625 - RNA, 14 nt, Staphylococcus aureus subsp. aureus N315
gguuauuaaaauua

SEQ ID NO: 4053626 - RNA, 11 nt, Staphylococcus aureus subsp. aureus N315
gguucaaaucc

SEQ ID NO: 4053627 - RNA, 15 nt, Staphylococcus aureus subsp. aureus N315
gguuguuaggggcuu

SEQ ID NO: 4053628 - RNA, 19 nt, Staphylococcus aureus subsp. aureus N315
gguuguuuuucaucauuaa

SEQ ID NO: 4053629 - RNA, 21 nt, Staphylococcus aureus subsp. aureus N315
gguuuaucagcuuuaauaaua

SEQ ID NO: 4053630 - RNA, 11 nt, Staphylococcus aureus subsp. aureus N315
gguuugagaau

SEQ ID NO: 4053631 - RNA, 19 nt, Staphylococcus aureus subsp. aureus N315
gguuuucuuaauuauggua

SEQ ID NO: 4053632 - RNA, 17 nt, Staphylococcus aureus subsp. aureus N315
gguuuuuuauuuucaua

SEQ ID NO: 4053633 - RNA, 20 nt, Staphylococcus aureus subsp. aureus N315
guaaaaaaagacaugagauu

SEQ ID NO: 4053634 - RNA, 18 nt, Staphylococcus aureus subsp. aureus N315
guaaaaacguucaaucgu

SEQ ID NO: 4053635 - RNA, 16 nt, Staphylococcus aureus subsp. aureus N315
guaaaaacucuuggau

SEQ ID NO: 4053636 - RNA, 20 nt, Staphylococcus aureus subsp. aureus N315
guaaaaccuguaucuuaaau

SEQ ID NO: 4053637 - RNA, 20 nt, Staphylococcus aureus subsp. aureus N315
guaaaaguuuugagccaagu

SEQ ID NO: 4053638 - RNA, 15 nt, Staphylococcus aureus subsp. aureus N315
guaaaauuaaaugcu

SEQ ID NO: 4053639 - RNA, 21 nt, Staphylococcus aureus subsp. aureus N315
guaaacaacaucgauuuauca

SEQ ID NO: 4053640 - RNA, 14 nt, Staphylococcus aureus subsp. aureus N315
guaaacacuauaaa

SEQ ID NO: 4053641 - RNA, 17 nt, Staphylococcus aureus subsp. aureus N315
guaaacacuauaaaagc

SEQ ID NO: 4053642 - RNA, 18 nt, Staphylococcus aureus subsp. aureus N315
guaaaccagcuaaaccau

SEQ ID NO: 4053643 - RNA, 18 nt, Staphylococcus aureus subsp. aureus N315
guaaaccuacuaauauau

SEQ ID NO: 4053644 - RNA, 13 nt, Staphylococcus aureus subsp. aureus N315
guaaacuaauccu

SEQ ID NO: 4053645 - RNA, 16 nt, Staphylococcus aureus subsp. aureus N315
guaaacuaauccucac

SEQ ID NO: 4053646 - RNA, 16 nt, Staphylococcus aureus subsp. aureus N315
guaaacuucuuuucuu

SEQ ID NO: 4053647 - RNA, 14 nt, Staphylococcus aureus subsp. aureus N315
guaaagcaugaaua

SEQ ID NO: 4053648 - RNA, 16 nt, Staphylococcus aureus subsp. aureus N315
guaaagccaccuaaau

SEQ ID NO: 4053649 - RNA, 21 nt, Staphylococcus aureus subsp. aureus N315
guaaaggugauauuugcuagu

SEQ ID NO: 4053650 - RNA, 19 nt, Staphylococcus aureus subsp. aureus N315
guaaauaaaaauuauauaa

SEQ ID NO: 4053651 - RNA, 20 nt, Staphylococcus aureus subsp. aureus N315
guaaauaaaaauuauauaaa

SEQ ID NO: 4053652 - RNA, 14 nt, Staphylococcus aureus subsp. aureus N315
guaaauaaaacuau

SEQ ID NO: 4053653 - RNA, 13 nt, Staphylococcus aureus subsp. aureus N315
guaaauaacuuau

SEQ ID NO: 4053654 - RNA, 13 nt, Staphylococcus aureus subsp. aureus N315
guaaauaauagua

SEQ ID NO: 4053655 - RNA, 12 nt, Staphylococcus aureus subsp. aureus N315
guaaauauaaau

SEQ ID NO: 4053656 - RNA, 21 nt, Staphylococcus aureus subsp. aureus N315
guaaauauaguaauaaaaguc

SEQ ID NO: 4053657 - RNA, 22 nt, Staphylococcus aureus subsp. aureus N315
guaaauauuuuuuaaaaugaua

SEQ ID NO: 4053658 - RNA, 18 nt, Staphylococcus aureus subsp. aureus N315
guaaaucacgauuuucaa

SEQ ID NO: 4053659 - RNA, 15 nt, Staphylococcus aureus subsp. aureus N315
guaaaugaaauaggc

SEQ ID NO: 4053660 - RNA, 14 nt, Staphylococcus aureus subsp. aureus N315
guaaauguuaaauu

SEQ ID NO: 4053661 - RNA, 16 nt, Staphylococcus aureus subsp. aureus N315
guaaauguuaaauucu

SEQ ID NO: 4053662 - RNA, 22 nt, Staphylococcus aureus subsp. aureus N315
guaaauuaauagagaaagaaua

SEQ ID NO: 4053663 - RNA, 13 nt, Staphylococcus aureus subsp. aureus N315
guaaauuacaaaa

SEQ ID NO: 4053664 - RNA, 14 nt, Staphylococcus aureus subsp. aureus N315
guaaauuuaaaaua

SEQ ID NO: 4053665 - RNA, 12 nt, Staphylococcus aureus subsp. aureus N315
guaaauuuauca

SEQ ID NO: 4053666 - RNA, 16 nt, Staphylococcus aureus subsp. aureus N315
guaacaauaacaccug

SEQ ID NO: 4053667 - RNA, 13 nt, Staphylococcus aureus subsp. aureus N315
guaacaauacgca

SEQ ID NO: 4053668 - RNA, 23 nt, Staphylococcus aureus subsp. aureus N315
guaacacacuuauaaucuauaaa

SEQ ID NO: 4053669 - RNA, 17 nt, Staphylococcus aureus subsp. aureus N315
guaacacgcucuuuuca

SEQ ID NO: 4053670 - RNA, 18 nt, Staphylococcus aureus subsp. aureus N315
guaacacgcucuuuucaa

SEQ ID NO: 4053671 - RNA, 15 nt, Staphylococcus aureus subsp. aureus N315
guaacagugacugau

SEQ ID NO: 4053672 - RNA, 21 nt, Staphylococcus aureus subsp. aureus N315
guaacauaucagcuuuuucau

SEQ ID NO: 4053673 - RNA, 18 nt, Staphylococcus aureus subsp. aureus N315
guaacauuaaaaauaaaa

SEQ ID NO: 4053674 - RNA, 19 nt, Staphylococcus aureus subsp. aureus N315
guaacauuagcaugauaaa

SEQ ID NO: 4053675 - RNA, 13 nt, Staphylococcus aureus subsp. aureus N315
guaacauuuaaaa

SEQ ID NO: 4053676 - RNA, 19 nt, Staphylococcus aureus subsp. aureus N315
guaacauuuaaaaaaugcg

SEQ ID NO: 4053677 - RNA, 17 nt, Staphylococcus aureus subsp. aureus N315
guaaccauuuuuuuauc

SEQ ID NO: 4053678 - RNA, 16 nt, Staphylococcus aureus subsp. aureus N315
guaaccuuuauuuuca

SEQ ID NO: 4053679 - RNA, 17 nt, Staphylococcus aureus subsp. aureus N315
guaacgcgcaaugagua

SEQ ID NO: 4053680 - RNA, 22 nt, Staphylococcus aureus subsp. aureus N315
guaacgcucaugaguuucucau

SEQ ID NO: 4053681 - RNA, 13 nt, Staphylococcus aureus subsp. aureus N315
guaacuaaaaugu

SEQ ID NO: 4053682 - RNA, 23 nt, Staphylococcus aureus subsp. aureus N315
guaacuaacauguuauugcuuau

SEQ ID NO: 4053683 - RNA, 22 nt, Staphylococcus aureus subsp. aureus N315
guaacuauaugaaauguucccu

SEQ ID NO: 4053684 - RNA, 23 nt, Staphylococcus aureus subsp. aureus N315
guaacugauuuuguuucaaacgu

SEQ ID NO: 4053685 - RNA, 17 nt, Staphylococcus aureus subsp. aureus N315
guaacuuuaucacugua

SEQ ID NO: 4053686 - RNA, 20 nt, Staphylococcus aureus subsp. aureus N315
guaacuuuuuacauuuucaa

SEQ ID NO: 4053687 - RNA, 18 nt, Staphylococcus aureus subsp. aureus N315
guaagaccccgaaaagag

SEQ ID NO: 4053688 - RNA, 16 nt, Staphylococcus aureus subsp. aureus N315
guaagacgauuucaau

SEQ ID NO: 4053689 - RNA, 22 nt, Staphylococcus aureus subsp. aureus N315
guaagcaccuguuauugcaaua

SEQ ID NO: 4053690 - RNA, 17 nt, Staphylococcus aureus subsp. aureus N315
guaagcagagccauaau

SEQ ID NO: 4053691 - RNA, 20 nt, Staphylococcus aureus subsp. aureus N315
guaagcuucuguguuggggc

SEQ ID NO: 4053692 - RNA, 23 nt, Staphylococcus aureus subsp. aureus N315
guaaguaaaauaaaaaaugcacu

SEQ ID NO: 4053693 - RNA, 16 nt, Staphylococcus aureus subsp. aureus N315
guaaguaauaaaauaa

SEQ ID NO: 4053694 - RNA, 13 nt, Staphylococcus aureus subsp. aureus N315
guaagugcucaaa

SEQ ID NO: 4053695 - RNA, 15 nt, Staphylococcus aureus subsp. aureus N315
guaaguguaaaugaa

SEQ ID NO: 4053696 - RNA, 17 nt, Staphylococcus aureus subsp. aureus N315
guaaguuggcuuacugu

SEQ ID NO: 4053697 - RNA, 20 nt, Staphylococcus aureus subsp. aureus N315
guaaguuuaguucaaagcga

SEQ ID NO: 4053698 - RNA, 16 nt, Staphylococcus aureus subsp. aureus N315
guaaguuugguuucuu

SEQ ID NO: 4053699 - RNA, 23 nt, Staphylococcus aureus subsp. aureus N315
guaauaaaagucgauaaauauga

SEQ ID NO: 4053700 - RNA, 15 nt, Staphylococcus aureus subsp. aureus N315
guaauaaaaugauga

SEQ ID NO: 4053701 - RNA, 14 nt, Staphylococcus aureus subsp. aureus N315
guaauaaagaaggg

SEQ ID NO: 4053702 - RNA, 18 nt, Staphylococcus aureus subsp. aureus N315
guaauaacaucuaaauuu

SEQ ID NO: 4053703 - RNA, 22 nt, Staphylococcus aureus subsp. aureus N315
guaauaaccaugccagcuucua

SEQ ID NO: 4053704 - RNA, 15 nt, Staphylococcus aureus subsp. aureus N315
guaauaauaucaccu

SEQ ID NO: 4053705 - RNA, 17 nt, Staphylococcus aureus subsp. aureus N315
guaauaauuauuaauaa

SEQ ID NO: 4053706 - RNA, 19 nt, Staphylococcus aureus subsp. aureus N315
guaauaauucagaugaaua

SEQ ID NO: 4053707 - RNA, 16 nt, Staphylococcus aureus subsp. aureus N315
guaauaauuuuguuca

SEQ ID NO: 4053708 - RNA, 19 nt, Staphylococcus aureus subsp. aureus N315
guaauacaucaucaaguuc

SEQ ID NO: 4053709 - RNA, 19 nt, Staphylococcus aureus subsp. aureus N315
guaauacuauaugaaaaga

SEQ ID NO: 4053710 - RNA, 15 nt, Staphylococcus aureus subsp. aureus N315
guaauagaacgaaau

SEQ ID NO: 4053711 - RNA, 22 nt, Staphylococcus aureus subsp. aureus N315
guaauagaacgaaauaguucaa

SEQ ID NO: 4053712 - RNA, 16 nt, Staphylococcus aureus subsp. aureus N315
guaauagcaaccauau

SEQ ID NO: 4053713 - RNA, 17 nt, Staphylococcus aureus subsp. aureus N315
guaauagcaaccauauu

SEQ ID NO: 4053714 - RNA, 17 nt, Staphylococcus aureus subsp. aureus N315
guaauaguuaacgauag

SEQ ID NO: 4053715 - RNA, 12 nt, Staphylococcus aureus subsp. aureus N315
guaauauuuuug

SEQ ID NO: 4053716 - RNA, 12 nt, Staphylococcus aureus subsp. aureus N315
guaaucaauccu

SEQ ID NO: 4053717 - RNA, 15 nt, Staphylococcus aureus subsp. aureus N315
guaaucaauccucua

SEQ ID NO: 4053718 - RNA, 22 nt, Staphylococcus aureus subsp. aureus N315
guaaucacuaucuguuguuaua

SEQ ID NO: 4053719 - RNA, 21 nt, Staphylococcus aureus subsp. aureus N315
guaaucagguuuaaacaguuu

SEQ ID NO: 4053720 - RNA, 18 nt, Staphylococcus aureus subsp. aureus N315
guaaucauagcaacaucg

SEQ ID NO: 4053721 - RNA, 15 nt, Staphylococcus aureus subsp. aureus N315
guaaucccauuuuaa

SEQ ID NO: 4053722 - RNA, 20 nt, Staphylococcus aureus subsp. aureus N315
guaaucuaauacauacggca

SEQ ID NO: 4053723 - RNA, 12 nt, Staphylococcus aureus subsp. aureus N315
guaaucuuuuaa

SEQ ID NO: 4053724 - RNA, 17 nt, Staphylococcus aureus subsp. aureus N315
guaaugaaucaauugca

SEQ ID NO: 4053725 - RNA, 12 nt, Staphylococcus aureus subsp. aureus N315
guaaugauuuug

SEQ ID NO: 4053726 - RNA, 16 nt, Staphylococcus aureus subsp. aureus N315
guaaugcuguacuaua

SEQ ID NO: 4053727 - RNA, 11 nt, Staphylococcus aureus subsp. aureus N315
guaauguguua

SEQ ID NO: 4053728 - RNA, 20 nt, Staphylococcus aureus subsp. aureus N315
guaauguuccccugaaaaga

SEQ ID NO: 4053729 - RNA, 21 nt, Staphylococcus aureus subsp. aureus N315
guaauguuccccugaaaagaa

SEQ ID NO: 4053730 - RNA, 13 nt, Staphylococcus aureus subsp. aureus N315
guaauuauuuuuc

SEQ ID NO: 4053731 - RNA, 18 nt, Staphylococcus aureus subsp. aureus N315
guaauugaugauuacucc

SEQ ID NO: 4053732 - RNA, 11 nt, Staphylococcus aureus subsp. aureus N315
guaauuguaau

SEQ ID NO: 4053733 - RNA, 15 nt, Staphylococcus aureus subsp. aureus N315
guaauuguaaucuau

SEQ ID NO: 4053734 - RNA, 17 nt, Staphylococcus aureus subsp. aureus N315
guaauuguaaucuauuu

SEQ ID NO: 4053735 - RNA, 18 nt, Staphylococcus aureus subsp. aureus N315
guaauugucuuuauaaaa

SEQ ID NO: 4053736 - RNA, 21 nt, Staphylococcus aureus subsp. aureus N315
guaauuguuauaaguaaauaa

SEQ ID NO: 4053737 - RNA, 13 nt, Staphylococcus aureus subsp. aureus N315
guaauuuaaaaua

SEQ ID NO: 4053738 - RNA, 14 nt, Staphylococcus aureus subsp. aureus N315
guaauuuaaaauag

SEQ ID NO: 4053739 - RNA, 15 nt, Staphylococcus aureus subsp. aureus N315
guaauuuaaaauagu

SEQ ID NO: 4053740 - RNA, 17 nt, Staphylococcus aureus subsp. aureus N315
guaauuuaauugguucu

SEQ ID NO: 4053741 - RNA, 23 nt, Staphylococcus aureus subsp. aureus N315
guaauuuuuaaaucuacaauauu

SEQ ID NO: 4053742 - RNA, 12 nt, Staphylococcus aureus subsp. aureus N315
guacaaauaaua

SEQ ID NO: 4053743 - RNA, 14 nt, Staphylococcus aureus subsp. aureus N315
guacaaauaauaca

SEQ ID NO: 4053744 - RNA, 21 nt, Staphylococcus aureus subsp. aureus N315
guacaauaauaccuucaauug

SEQ ID NO: 4053745 - RNA, 19 nt, Staphylococcus aureus subsp. aureus N315
guacaauaauuagucauca

SEQ ID NO: 4053746 - RNA, 19 nt, Staphylococcus aureus subsp. aureus N315
guacacauccucauaauua

SEQ ID NO: 4053747 - RNA, 15 nt, Staphylococcus aureus subsp. aureus N315
guacaccuacaaaua

SEQ ID NO: 4053748 - RNA, 17 nt, Staphylococcus aureus subsp. aureus N315
guacacgaauucauuaa

SEQ ID NO: 4053749 - RNA, 17 nt, Staphylococcus aureus subsp. aureus N315
guacacuuuugauuguu

SEQ ID NO: 4053750 - RNA, 14 nt, Staphylococcus aureus subsp. aureus N315
guacagauaagaau

SEQ ID NO: 4053751 - RNA, 15 nt, Staphylococcus aureus subsp. aureus N315
guacaguaauauuca

SEQ ID NO: 4053752 - RNA, 15 nt, Staphylococcus aureus subsp. aureus N315
guacauaaauaccug

SEQ ID NO: 4053753 - RNA, 18 nt, Staphylococcus aureus subsp. aureus N315
guacauaaauagugaaau

SEQ ID NO: 4053754 - RNA, 18 nt, Staphylococcus aureus subsp. aureus N315
guacauauguguaugaua

SEQ ID NO: 4053755 - RNA, 15 nt, Staphylococcus aureus subsp. aureus N315
guacauugguuuuua

SEQ ID NO: 4053756 - RNA, 16 nt, Staphylococcus aureus subsp. aureus N315
guacauuguaaauaua

SEQ ID NO: 4053757 - RNA, 20 nt, Staphylococcus aureus subsp. aureus N315
guacauuuauuuucaauaaa

SEQ ID NO: 4053758 - RNA, 13 nt, Staphylococcus aureus subsp. aureus N315
guaccaaauaaau

SEQ ID NO: 4053759 - RNA, 14 nt, Staphylococcus aureus subsp. aureus N315
guaccaauuagcau

SEQ ID NO: 4053760 - RNA, 13 nt, Staphylococcus aureus subsp. aureus N315
guaccaauugauu

SEQ ID NO: 4053761 - RNA, 15 nt, Staphylococcus aureus subsp. aureus N315
guaccaccccaacuu

SEQ ID NO: 4053762 - RNA, 13 nt, Staphylococcus aureus subsp. aureus N315
guaccguauuuua

SEQ ID NO: 4053763 - RNA, 14 nt, Staphylococcus aureus subsp. aureus N315
guaccgucuuaucu

SEQ ID NO: 4053764 - RNA, 12 nt, Staphylococcus aureus subsp. aureus N315
guaccuaaaaua

SEQ ID NO: 4053765 - RNA, 15 nt, Staphylococcus aureus subsp. aureus N315
guaccuaaaauagaa

SEQ ID NO: 4053766 - RNA, 15 nt, Staphylococcus aureus subsp. aureus N315
guacgaggaccaucu

SEQ ID NO: 4053767 - RNA, 16 nt, Staphylococcus aureus subsp. aureus N315
guacguuaaucaguga

SEQ ID NO: 4053768 - RNA, 21 nt, Staphylococcus aureus subsp. aureus N315
guacuaggaccuacaauuuuc

SEQ ID NO: 4053769 - RNA, 14 nt, Staphylococcus aureus subsp. aureus N315
guacuuacaaauau

SEQ ID NO: 4053770 - RNA, 23 nt, Staphylococcus aureus subsp. aureus N315
guacuuugauaucuacagagaau

SEQ ID NO: 4053771 - RNA, 20 nt, Staphylococcus aureus subsp. aureus N315
guagaaucuacgauuuucaa

SEQ ID NO: 4053772 - RNA, 21 nt, Staphylococcus aureus subsp. aureus N315
guagacguaaguguaaaugaa

SEQ ID NO: 4053773 - RNA, 22 nt, Staphylococcus aureus subsp. aureus N315
guagauugauauccuuaacaug

SEQ ID NO: 4053774 - RNA, 18 nt, Staphylococcus aureus subsp. aureus N315
guagauuuauuaaauaua

SEQ ID NO: 4053775 - RNA, 20 nt, Staphylococcus aureus subsp. aureus N315
guagcaacauuauuuuuguc

SEQ ID NO: 4053776 - RNA, 16 nt, Staphylococcus aureus subsp. aureus N315
guagccuacaaccuuu

SEQ ID NO: 4053777 - RNA, 22 nt, Staphylococcus aureus subsp. aureus N315
guagcuuaacguugcagagaau

SEQ ID NO: 4053778 - RNA, 14 nt, Staphylococcus aureus subsp. aureus N315
guagcuugaauaau

SEQ ID NO: 4053779 - RNA, 18 nt, Staphylococcus aureus subsp. aureus N315
guagcuugaauaauauau

SEQ ID NO: 4053780 - RNA, 16 nt, Staphylococcus aureus subsp. aureus N315
guaggauaauuucaau

SEQ ID NO: 4053781 - RNA, 19 nt, Staphylococcus aureus subsp. aureus N315
guaguacacgaauucauua

SEQ ID NO: 4053782 - RNA, 22 nt, Staphylococcus aureus subsp. aureus N315
guaguuaagauaccuuuuucua

SEQ ID NO: 4053783 - RNA, 13 nt, Staphylococcus aureus subsp. aureus N315
guaguuaauauaa

SEQ ID NO: 4053784 - RNA, 18 nt, Staphylococcus aureus subsp. aureus N315
guaguucggaugagaaau

SEQ ID NO: 4053785 - RNA, 22 nt, Staphylococcus aureus subsp. aureus N315
guauaaagggcuauuugauaca

SEQ ID NO: 4053786 - RNA, 12 nt, Staphylococcus aureus subsp. aureus N315
guauaaauaaaa

SEQ ID NO: 4053787 - RNA, 22 nt, Staphylococcus aureus subsp. aureus N315
guauaaauaucauaaaugcaua

SEQ ID NO: 4053788 - RNA, 13 nt, Staphylococcus aureus subsp. aureus N315
guauaaaugcagc

SEQ ID NO: 4053789 - RNA, 19 nt, Staphylococcus aureus subsp. aureus N315
guauaaccauaaugaacag

SEQ ID NO: 4053790 - RNA, 21 nt, Staphylococcus aureus subsp. aureus N315
guauaauggacgguauuuuca

SEQ ID NO: 4053791 - RNA, 22 nt, Staphylococcus aureus subsp. aureus N315
guauaauggacgguauuuucaa

SEQ ID NO: 4053792 - RNA, 16 nt, Staphylococcus aureus subsp. aureus N315
guauacaacaugugua

SEQ ID NO: 4053793 - RNA, 22 nt, Staphylococcus aureus subsp. aureus N315
guauacaguuuuacuauaauga

SEQ ID NO: 4053794 - RNA, 22 nt, Staphylococcus aureus subsp. aureus N315
guauauaaguuaaaauugguuu

SEQ ID NO: 4053795 - RNA, 13 nt, Staphylococcus aureus subsp. aureus N315
guauauacgauug

SEQ ID NO: 4053796 - RNA, 20 nt, Staphylococcus aureus subsp. aureus N315
guauauauauauuaaaacaa

SEQ ID NO: 4053797 - RNA, 16 nt, Staphylococcus aureus subsp. aureus N315
guauaugaaucgauau

SEQ ID NO: 4053798 - RNA, 17 nt, Staphylococcus aureus subsp. aureus N315
guauauggcgauaacaa

SEQ ID NO: 4053799 - RNA, 19 nt, Staphylococcus aureus subsp. aureus N315
guauauuaaaaauuucaau

SEQ ID NO: 4053800 - RNA, 21 nt, Staphylococcus aureus subsp. aureus N315
guauauucaacagggguaaaa

SEQ ID NO: 4053801 - RNA, 18 nt, Staphylococcus aureus subsp. aureus N315
guauauugcuuauguaca

SEQ ID NO: 4053802 - RNA, 13 nt, Staphylococcus aureus subsp. aureus N315
guaucaaaauuuu

SEQ ID NO: 4053803 - RNA, 16 nt, Staphylococcus aureus subsp. aureus N315
guaucaacauuaauaa

SEQ ID NO: 4053804 - RNA, 19 nt, Staphylococcus aureus subsp. aureus N315
guaucaacauuaauaaaua

SEQ ID NO: 4053805 - RNA, 16 nt, Staphylococcus aureus subsp. aureus N315
guaucaagaaaaaguu

SEQ ID NO: 4053806 - RNA, 22 nt, Staphylococcus aureus subsp. aureus N315
guaucaagaaaaaguuuuucug

SEQ ID NO: 4053807 - RNA, 21 nt, Staphylococcus aureus subsp. aureus N315
guaucacuaggauguucauca

SEQ ID NO: 4053808 - RNA, 15 nt, Staphylococcus aureus subsp. aureus N315
guaucauuuaaaaua

SEQ ID NO: 4053809 - RNA, 14 nt, Staphylococcus aureus subsp. aureus N315
guaucauuucagaa

SEQ ID NO: 4053810 - RNA, 20 nt, Staphylococcus aureus subsp. aureus N315
guauccccauuuauguguug

SEQ ID NO: 4053811 - RNA, 15 nt, Staphylococcus aureus subsp. aureus N315
guaucgccaaucuau

SEQ ID NO: 4053812 - RNA, 15 nt, Staphylococcus aureus subsp. aureus N315
guaucguuaccuuuu

SEQ ID NO: 4053813 - RNA, 16 nt, Staphylococcus aureus subsp. aureus N315
guaucuauacaauuau

SEQ ID NO: 4053814 - RNA, 21 nt, Staphylococcus aureus subsp. aureus N315
guaucucugaaaaacuucuua

SEQ ID NO: 4053815 - RNA, 16 nt, Staphylococcus aureus subsp. aureus N315
guaucuugucauuuga

SEQ ID NO: 4053816 - RNA, 14 nt, Staphylococcus aureus subsp. aureus N315
guaugcgguuauau

SEQ ID NO: 4053817 - RNA, 22 nt, Staphylococcus aureus subsp. aureus N315
guaugcuuguacaaaaaauugu

SEQ ID NO: 4053818 - RNA, 13 nt, Staphylococcus aureus subsp. aureus N315
guauggaauaaau

SEQ ID NO: 4053819 - RNA, 18 nt, Staphylococcus aureus subsp. aureus N315
guauggaauaaaugguuu

SEQ ID NO: 4053820 - RNA, 17 nt, Staphylococcus aureus subsp. aureus N315
guauggacuaagauaua

SEQ ID NO: 4053821 - RNA, 15 nt, Staphylococcus aureus subsp. aureus N315
guauuaaacauugcu

SEQ ID NO: 4053822 - RNA, 16 nt, Staphylococcus aureus subsp. aureus N315
guauuacuugaaaaua

SEQ ID NO: 4053823 - RNA, 19 nt, Staphylococcus aureus subsp. aureus N315
guauuagccaauaaaaugu

SEQ ID NO: 4053824 - RNA, 22 nt, Staphylococcus aureus subsp. aureus N315
guauuaugauugcuuauuuauu

SEQ ID NO: 4053825 - RNA, 19 nt, Staphylococcus aureus subsp. aureus N315
guauuauucucucauuugu

SEQ ID NO: 4053826 - RNA, 20 nt, Staphylococcus aureus subsp. aureus N315
guauucaaaguuuucauuua

SEQ ID NO: 4053827 - RNA, 21 nt, Staphylococcus aureus subsp. aureus N315
guauucagucaguaaaaauac

SEQ ID NO: 4053828 - RNA, 23 nt, Staphylococcus aureus subsp. aureus N315
guauucagucaguaaaaauacau

SEQ ID NO: 4053829 - RNA, 15 nt, Staphylococcus aureus subsp. aureus N315
guauucuauuuuuca

SEQ ID NO: 4053830 - RNA, 19 nt, Staphylococcus aureus subsp. aureus N315
guauucuauuuuucaauuc

SEQ ID NO: 4053831 - RNA, 23 nt, Staphylococcus aureus subsp. aureus N315
guauucuuggcguauuuuuuguu

SEQ ID NO: 4053832 - RNA, 18 nt, Staphylococcus aureus subsp. aureus N315
guauugaaugaauucauu

SEQ ID NO: 4053833 - RNA, 19 nt, Staphylococcus aureus subsp. aureus N315
guauuguuuguagaaauua

SEQ ID NO: 4053834 - RNA, 15 nt, Staphylococcus aureus subsp. aureus N315
guauuuaguaucaug

SEQ ID NO: 4053835 - RNA, 18 nt, Staphylococcus aureus subsp. aureus N315
guauuugccuuuugaaua

SEQ ID NO: 4053836 - RNA, 13 nt, Staphylococcus aureus subsp. aureus N315
guauuuuaaauuu

SEQ ID NO: 4053837 - RNA, 17 nt, Staphylococcus aureus subsp. aureus N315
guauuuuaaugauuuuu

SEQ ID NO: 4053838 - RNA, 23 nt, Staphylococcus aureus subsp. aureus N315
guauuuuauuuauuuugauuaac

SEQ ID NO: 4053839 - RNA, 22 nt, Staphylococcus aureus subsp. aureus N315
guauuuucugcuguauggaaag

SEQ ID NO: 4053840 - RNA, 21 nt, Staphylococcus aureus subsp. aureus N315
guauuuuguucaguuaaaucu

SEQ ID NO: 4053841 - RNA, 14 nt, Staphylococcus aureus subsp. aureus N315
guauuuuuaagcug

SEQ ID NO: 4053842 - RNA, 22 nt, Staphylococcus aureus subsp. aureus N315
guauuuuuauuguuuuggcuuu

SEQ ID NO: 4053843 - RNA, 15 nt, Staphylococcus aureus subsp. aureus N315
guauuuuucaaauaa

SEQ ID NO: 4053844 - RNA, 23 nt, Staphylococcus aureus subsp. aureus N315
guauuuuuugugccuuucucuaa

SEQ ID NO: 4053845 - RNA, 18 nt, Staphylococcus aureus subsp. aureus N315
gucaaaucgaaauuucca

SEQ ID NO: 4053846 - RNA, 18 nt, Staphylococcus aureus subsp. aureus N315
gucaaauuggacuuaugg

SEQ ID NO: 4053847 - RNA, 23 nt, Staphylococcus aureus subsp. aureus N315
gucaacuuagcuuagucaaugua

SEQ ID NO: 4053848 - RNA, 17 nt, Staphylococcus aureus subsp. aureus N315
gucaaguaaauguuuua

SEQ ID NO: 4053849 - RNA, 16 nt, Staphylococcus aureus subsp. aureus N315
gucaauauuguaggga

SEQ ID NO: 4053850 - RNA, 21 nt, Staphylococcus aureus subsp. aureus N315
gucaaugacugagaaaaauau

SEQ ID NO: 4053851 - RNA, 16 nt, Staphylococcus aureus subsp. aureus N315
gucaauucaaacugau

SEQ ID NO: 4053852 - RNA, 16 nt, Staphylococcus aureus subsp. aureus N315
gucacauuuauaacau

SEQ ID NO: 4053853 - RNA, 14 nt, Staphylococcus aureus subsp. aureus N315
gucaccuucuauau

SEQ ID NO: 4053854 - RNA, 13 nt, Staphylococcus aureus subsp. aureus N315
gucaccuuuaaau

SEQ ID NO: 4053855 - RNA, 15 nt, Staphylococcus aureus subsp. aureus N315
gucacgaucaaauuu

SEQ ID NO: 4053856 - RNA, 14 nt, Staphylococcus aureus subsp. aureus N315
gucacuuuauuaaa

SEQ ID NO: 4053857 - RNA, 15 nt, Staphylococcus aureus subsp. aureus N315
gucacuuuauuaaau

SEQ ID NO: 4053858 - RNA, 12 nt, Staphylococcus aureus subsp. aureus N315
gucagauucaaa

SEQ ID NO: 4053859 - RNA, 14 nt, Staphylococcus aureus subsp. aureus N315
gucaggggccccaa

SEQ ID NO: 4053860 - RNA, 18 nt, Staphylococcus aureus subsp. aureus N315
gucauaauagauaaugca

SEQ ID NO: 4053861 - RNA, 14 nt, Staphylococcus aureus subsp. aureus N315
gucauaccuuuuaa

SEQ ID NO: 4053862 - RNA, 23 nt, Staphylococcus aureus subsp. aureus N315
gucauacgcaaugauuauaaaua

SEQ ID NO: 4053863 - RNA, 18 nt, Staphylococcus aureus subsp. aureus N315
gucauagaaauuuuaaaa

SEQ ID NO: 4053864 - RNA, 20 nt, Staphylococcus aureus subsp. aureus N315
gucauaguauacauaauuca

SEQ ID NO: 4053865 - RNA, 12 nt, Staphylococcus aureus subsp. aureus N315
gucauauaaaca

SEQ ID NO: 4053866 - RNA, 20 nt, Staphylococcus aureus subsp. aureus N315
gucauauacuauaugucuua

SEQ ID NO: 4053867 - RNA, 18 nt, Staphylococcus aureus subsp. aureus N315
gucauauguuuuauaaua

SEQ ID NO: 4053868 - RNA, 21 nt, Staphylococcus aureus subsp. aureus N315
gucaucaaaaguuuguauauu

SEQ ID NO: 4053869 - RNA, 16 nt, Staphylococcus aureus subsp. aureus N315
gucaugaaaauaagca

SEQ ID NO: 4053870 - RNA, 23 nt, Staphylococcus aureus subsp. aureus N315
gucaugaauuuucaucauuaaac

SEQ ID NO: 4053871 - RNA, 12 nt, Staphylococcus aureus subsp. aureus N315
gucaugccuuca

SEQ ID NO: 4053872 - RNA, 21 nt, Staphylococcus aureus subsp. aureus N315
gucaugcguuguguaacuuua

SEQ ID NO: 4053873 - RNA, 13 nt, Staphylococcus aureus subsp. aureus N315
gucauuacaaauc

SEQ ID NO: 4053874 - RNA, 21 nt, Staphylococcus aureus subsp. aureus N315
gucauugguggagauuguaaa

SEQ ID NO: 4053875 - RNA, 18 nt, Staphylococcus aureus subsp. aureus N315
gucauuuguucaucugau

SEQ ID NO: 4053876 - RNA, 14 nt, Staphylococcus aureus subsp. aureus N315
gucauuuugauuaa

SEQ ID NO: 4053877 - RNA, 14 nt, Staphylococcus aureus subsp. aureus N315
guccagcuaauaac

SEQ ID NO: 4053878 - RNA, 18 nt, Staphylococcus aureus subsp. aureus N315
guccauaaucuuuauuaa

SEQ ID NO: 4053879 - RNA, 20 nt, Staphylococcus aureus subsp. aureus N315
guccaucauuuguguuuuua

SEQ ID NO: 4053880 - RNA, 18 nt, Staphylococcus aureus subsp. aureus N315
guccaucgucaucacuuu

SEQ ID NO: 4053881 - RNA, 23 nt, Staphylococcus aureus subsp. aureus N315
gucccacucccauuggcauuuac

SEQ ID NO: 4053882 - RNA, 17 nt, Staphylococcus aureus subsp. aureus N315
gucccauaaaagacaga

SEQ ID NO: 4053883 - RNA, 20 nt, Staphylococcus aureus subsp. aureus N315
guccgacuuaauauugaaua

SEQ ID NO: 4053884 - RNA, 14 nt, Staphylococcus aureus subsp. aureus N315
guccggggccccaa

SEQ ID NO: 4053885 - RNA, 18 nt, Staphylococcus aureus subsp. aureus N315
guccguuuauagauaggu

SEQ ID NO: 4053886 - RNA, 15 nt, Staphylococcus aureus subsp. aureus N315
guccucuugugaaau

SEQ ID NO: 4053887 - RNA, 22 nt, Staphylococcus aureus subsp. aureus N315
guccuguacauccacuuuauaa

SEQ ID NO: 4053888 - RNA, 19 nt, Staphylococcus aureus subsp. aureus N315
gucgaaaauagcuauuaaa

SEQ ID NO: 4053889 - RNA, 16 nt, Staphylococcus aureus subsp. aureus N315
gucgagauuuuauaag

SEQ ID NO: 4053890 - RNA, 22 nt, Staphylococcus aureus subsp. aureus N315
gucgcacuauaaaauucaccaa

SEQ ID NO: 4053891 - RNA, 15 nt, Staphylococcus aureus subsp. aureus N315
gucgguuaauccagc

SEQ ID NO: 4053892 - RNA, 14 nt, Staphylococcus aureus subsp. aureus N315
gucgguucaucuaa

SEQ ID NO: 4053893 - RNA, 15 nt, Staphylococcus aureus subsp. aureus N315
gucguucaagaacaa

SEQ ID NO: 4053894 - RNA, 21 nt, Staphylococcus aureus subsp. aureus N315
gucguuuaccgucuuuugcaa

SEQ ID NO: 4053895 - RNA, 12 nt, Staphylococcus aureus subsp. aureus N315
gucuaaaaaugu

SEQ ID NO: 4053896 - RNA, 19 nt, Staphylococcus aureus subsp. aureus N315
gucuaaucgacuuuuacaa

SEQ ID NO: 4053897 - RNA, 16 nt, Staphylococcus aureus subsp. aureus N315
gucuaauguuggaaaa

SEQ ID NO: 4053898 - RNA, 14 nt, Staphylococcus aureus subsp. aureus N315
gucuacgaucaaaa

SEQ ID NO: 4053899 - RNA, 23 nt, Staphylococcus aureus subsp. aureus N315
gucuacuauuuuuucuaauucaa

SEQ ID NO: 4053900 - RNA, 21 nt, Staphylococcus aureus subsp. aureus N315
gucuaucuccgcuacaauuau

SEQ ID NO: 4053901 - RNA, 10 nt, Staphylococcus aureus subsp. aureus N315
gucuaugaau

SEQ ID NO: 4053902 - RNA, 15 nt, Staphylococcus aureus subsp. aureus N315
gucuauguacaauaa

SEQ ID NO: 4053903 - RNA, 14 nt, Staphylococcus aureus subsp. aureus N315
gucuauuuuauaaa

SEQ ID NO: 4053904 - RNA, 15 nt, Staphylococcus aureus subsp. aureus N315
gucuauuuuauaaaa

SEQ ID NO: 4053905 - RNA, 19 nt, Staphylococcus aureus subsp. aureus N315
gucugaugucgaaaauagc

SEQ ID NO: 4053906 - RNA, 18 nt, Staphylococcus aureus subsp. aureus N315
gucugcauuaauuucaug

SEQ ID NO: 4053907 - RNA, 14 nt, Staphylococcus aureus subsp. aureus N315
gucuggcacauuac

SEQ ID NO: 4053908 - RNA, 15 nt, Staphylococcus aureus subsp. aureus N315
gucuggcacauuacu

SEQ ID NO: 4053909 - RNA, 23 nt, Staphylococcus aureus subsp. aureus N315
gucuguaaauuaucuaaagaaau

SEQ ID NO: 4053910 - RNA, 12 nt, Staphylococcus aureus subsp. aureus N315
gucuuaaacaua

SEQ ID NO: 4053911 - RNA, 14 nt, Staphylococcus aureus subsp. aureus N315
gucuugaguacuaa

SEQ ID NO: 4053912 - RNA, 16 nt, Staphylococcus aureus subsp. aureus N315
gucuugcaauaccucc

SEQ ID NO: 4053913 - RNA, 19 nt, Staphylococcus aureus subsp. aureus N315
gucuuguaaacucaugaca

SEQ ID NO: 4053914 - RNA, 15 nt, Staphylococcus aureus subsp. aureus N315
gucuuguaaacuucu

SEQ ID NO: 4053915 - RNA, 14 nt, Staphylococcus aureus subsp. aureus N315
gucuugugauaauu

SEQ ID NO: 4053916 - RNA, 20 nt, Staphylococcus aureus subsp. aureus N315
gucuuguggcacauaaccga

SEQ ID NO: 4053917 - RNA, 20 nt, Staphylococcus aureus subsp. aureus N315
gucuuucucggcgauaaaau

SEQ ID NO: 4053918 - RNA, 12 nt, Staphylococcus aureus subsp. aureus N315
gucuuuuuauuu

SEQ ID NO: 4053919 - RNA, 12 nt, Staphylococcus aureus subsp. aureus N315
gugaaaaguguu

SEQ ID NO: 4053920 - RNA, 21 nt, Staphylococcus aureus subsp. aureus N315
gugaaaauuuauucaaaucau

SEQ ID NO: 4053921 - RNA, 23 nt, Staphylococcus aureus subsp. aureus N315
gugaaaguacuuggaaaauacua

SEQ ID NO: 4053922 - RNA, 19 nt, Staphylococcus aureus subsp. aureus N315
gugaaaguuuuugucuuaa

SEQ ID NO: 4053923 - RNA, 20 nt, Staphylococcus aureus subsp. aureus N315
gugaaauucgaacuaucaau

SEQ ID NO: 4053924 - RNA, 22 nt, Staphylococcus aureus subsp. aureus N315
gugaaauugcgugcguuuaaca

SEQ ID NO: 4053925 - RNA, 18 nt, Staphylococcus aureus subsp. aureus N315
gugaagaaaaaaugauau

SEQ ID NO: 4053926 - RNA, 17 nt, Staphylococcus aureus subsp. aureus N315
gugaagagaugaaagau

SEQ ID NO: 4053927 - RNA, 23 nt, Staphylococcus aureus subsp. aureus N315
gugaauauaaguaaucauaauaa

SEQ ID NO: 4053928 - RNA, 20 nt, Staphylococcus aureus subsp. aureus N315
gugaaucuuauuuuguuuua

SEQ ID NO: 4053929 - RNA, 21 nt, Staphylococcus aureus subsp. aureus N315
gugaauucgaugacuuuuuaa

SEQ ID NO: 4053930 - RNA, 13 nt, Staphylococcus aureus subsp. aureus N315
gugacauuuucaa

SEQ ID NO: 4053931 - RNA, 21 nt, Staphylococcus aureus subsp. aureus N315
gugaccaauagaauucauuaa

SEQ ID NO: 4053932 - RNA, 20 nt, Staphylococcus aureus subsp. aureus N315
gugagauacguuauuucaau

SEQ ID NO: 4053933 - RNA, 14 nt, Staphylococcus aureus subsp. aureus N315
gugagguaaaacua

SEQ ID NO: 4053934 - RNA, 20 nt, Staphylococcus aureus subsp. aureus N315
gugaguuuccauauuuuuua

SEQ ID NO: 4053935 - RNA, 11 nt, Staphylococcus aureus subsp. aureus N315
gugauaaaaau

SEQ ID NO: 4053936 - RNA, 17 nt, Staphylococcus aureus subsp. aureus N315
gugauaauguacaugua

SEQ ID NO: 4053937 - RNA, 15 nt, Staphylococcus aureus subsp. aureus N315
gugauaauuaaaaua

SEQ ID NO: 4053938 - RNA, 22 nt, Staphylococcus aureus subsp. aureus N315
gugauaauuaaaauaagauaua

SEQ ID NO: 4053939 - RNA, 21 nt, Staphylococcus aureus subsp. aureus N315
gugauagaaguuuuuugauua

SEQ ID NO: 4053940 - RNA, 17 nt, Staphylococcus aureus subsp. aureus N315
gugauauagauggcuuu

SEQ ID NO: 4053941 - RNA, 19 nt, Staphylococcus aureus subsp. aureus N315
gugauauaugaaauauuua

SEQ ID NO: 4053942 - RNA, 19 nt, Staphylococcus aureus subsp. aureus N315
gugauaucuugcuuggaua

SEQ ID NO: 4053943 - RNA, 19 nt, Staphylococcus aureus subsp. aureus N315
gugaucuuuuuuauauuca

SEQ ID NO: 4053944 - RNA, 12 nt, Staphylococcus aureus subsp. aureus N315
gugauuauaaau

SEQ ID NO: 4053945 - RNA, 21 nt, Staphylococcus aureus subsp. aureus N315
gugauuucccacgugccucau

SEQ ID NO: 4053946 - RNA, 15 nt, Staphylococcus aureus subsp. aureus N315
gugauuuuaaucuau

SEQ ID NO: 4053947 - RNA, 14 nt, Staphylococcus aureus subsp. aureus N315
gugauuuuaccugu

SEQ ID NO: 4053948 - RNA, 22 nt, Staphylococcus aureus subsp. aureus N315
gugauuuuggaacauauucaua

SEQ ID NO: 4053949 - RNA, 18 nt, Staphylococcus aureus subsp. aureus N315
gugcaacuuuaagacuuu

SEQ ID NO: 4053950 - RNA, 16 nt, Staphylococcus aureus subsp. aureus N315
gugcaaguauaaucca

SEQ ID NO: 4053951 - RNA, 22 nt, Staphylococcus aureus subsp. aureus N315
gugcaagugguaaaaaugaacc

SEQ ID NO: 4053952 - RNA, 22 nt, Staphylococcus aureus subsp. aureus N315
gugcaauaauaaauaggaugaa

SEQ ID NO: 4053953 - RNA, 17 nt, Staphylococcus aureus subsp. aureus N315
gugcaggauaacguuca

SEQ ID NO: 4053954 - RNA, 12 nt, Staphylococcus aureus subsp. aureus N315
gugcaugacgau

SEQ ID NO: 4053955 - RNA, 13 nt, Staphylococcus aureus subsp. aureus N315
gugcauucaucaa

SEQ ID NO: 4053956 - RNA, 14 nt, Staphylococcus aureus subsp. aureus N315
gugccauuaaaauu

SEQ ID NO: 4053957 - RNA, 13 nt, Staphylococcus aureus subsp. aureus N315
gugccuuucucua

SEQ ID NO: 4053958 - RNA, 15 nt, Staphylococcus aureus subsp. aureus N315
gugccuuucucuaaa

SEQ ID NO: 4053959 - RNA, 15 nt, Staphylococcus aureus subsp. aureus N315
gugcuaaguuagggc

SEQ ID NO: 4053960 - RNA, 20 nt, Staphylococcus aureus subsp. aureus N315
gugcuauuaauuugauaaau

SEQ ID NO: 4053961 - RNA, 22 nt, Staphylococcus aureus subsp. aureus N315
gugcucgaaucucauugauuug

SEQ ID NO: 4053962 - RNA, 13 nt, Staphylococcus aureus subsp. aureus N315
gugcuuacuuuua

SEQ ID NO: 4053963 - RNA, 18 nt, Staphylococcus aureus subsp. aureus N315
gugcuuauuuguuuauua

SEQ ID NO: 4053964 - RNA, 14 nt, Staphylococcus aureus subsp. aureus N315
gugcuuuaaaguug

SEQ ID NO: 4053965 - RNA, 15 nt, Staphylococcus aureus subsp. aureus N315
guggaaagucagcuu

SEQ ID NO: 4053966 - RNA, 20 nt, Staphylococcus aureus subsp. aureus N315
guggaaaucucggcauuuuu

SEQ ID NO: 4053967 - RNA, 17 nt, Staphylococcus aureus subsp. aureus N315
guggacguugaucuuug

SEQ ID NO: 4053968 - RNA, 17 nt, Staphylococcus aureus subsp. aureus N315
guggagaaccuuuaaaa

SEQ ID NO: 4053969 - RNA, 22 nt, Staphylococcus aureus subsp. aureus N315
guggcaccucuuuuguuuagua

SEQ ID NO: 4053970 - RNA, 12 nt, Staphylococcus aureus subsp. aureus N315
guggcauuuuau

SEQ ID NO: 4053971 - RNA, 16 nt, Staphylococcus aureus subsp. aureus N315
guggcauuuuaucaug

SEQ ID NO: 4053972 - RNA, 17 nt, Staphylococcus aureus subsp. aureus N315
guggcauuuuaucauga

SEQ ID NO: 4053973 - RNA, 21 nt, Staphylococcus aureus subsp. aureus N315
guggcguaguuugaauuggga

SEQ ID NO: 4053974 - RNA, 21 nt, Staphylococcus aureus subsp. aureus N315
guggcuacuugaauaccuuuu

SEQ ID NO: 4053975 - RNA, 20 nt, Staphylococcus aureus subsp. aureus N315
guggcuuuuuuuauggugug

SEQ ID NO: 4053976 - RNA, 12 nt, Staphylococcus aureus subsp. aureus N315
gugguacuuuuu

SEQ ID NO: 4053977 - RNA, 16 nt, Staphylococcus aureus subsp. aureus N315
gugguaugacugcaaa

SEQ ID NO: 4053978 - RNA, 20 nt, Staphylococcus aureus subsp. aureus N315
guguaaauauaaauaugaau

SEQ ID NO: 4053979 - RNA, 20 nt, Staphylococcus aureus subsp. aureus N315
guguaaucucguuuuuacau

SEQ ID NO: 4053980 - RNA, 22 nt, Staphylococcus aureus subsp. aureus N315
guguacguuaaucagugaaaua

SEQ ID NO: 4053981 - RNA, 14 nt, Staphylococcus aureus subsp. aureus N315
guguauauuauuuu

SEQ ID NO: 4053982 - RNA, 22 nt, Staphylococcus aureus subsp. aureus N315
guguauauuauuuugcuuuaau

SEQ ID NO: 4053983 - RNA, 22 nt, Staphylococcus aureus subsp. aureus N315
guguaugauagaauacuaaaag

SEQ ID NO: 4053984 - RNA, 17 nt, Staphylococcus aureus subsp. aureus N315
guguauucauuuuaaau

SEQ ID NO: 4053985 - RNA, 14 nt, Staphylococcus aureus subsp. aureus N315
guguccuaauaagu

SEQ ID NO: 4053986 - RNA, 18 nt, Staphylococcus aureus subsp. aureus N315
guguggauuuaauuuuua

SEQ ID NO: 4053987 - RNA, 21 nt, Staphylococcus aureus subsp. aureus N315
guguuaaaccaacuuucucaa

SEQ ID NO: 4053988 - RNA, 20 nt, Staphylococcus aureus subsp. aureus N315
guguuaaucaacguauauaa

SEQ ID NO: 4053989 - RNA, 15 nt, Staphylococcus aureus subsp. aureus N315
guguuaugaauuaga

SEQ ID NO: 4053990 - RNA, 23 nt, Staphylococcus aureus subsp. aureus N315
guguugaaaaguaauuaaauacu

SEQ ID NO: 4053991 - RNA, 17 nt, Staphylococcus aureus subsp. aureus N315
guguuggggcccacacc

SEQ ID NO: 4053992 - RNA, 13 nt, Staphylococcus aureus subsp. aureus N315
guguuugcucaaa

SEQ ID NO: 4053993 - RNA, 22 nt, Staphylococcus aureus subsp. aureus N315
guuaaaaaauauguauguuuua

SEQ ID NO: 4053994 - RNA, 21 nt, Staphylococcus aureus subsp. aureus N315
guuaaaaccuuuucaaauuau

SEQ ID NO: 4053995 - RNA, 17 nt, Staphylococcus aureus subsp. aureus N315
guuaaaauaaugucuua

SEQ ID NO: 4053996 - RNA, 21 nt, Staphylococcus aureus subsp. aureus N315
guuaaacgcugauuuuauaaa

SEQ ID NO: 4053997 - RNA, 18 nt, Staphylococcus aureus subsp. aureus N315
guuaaacuagaaaacaua

SEQ ID NO: 4053998 - RNA, 23 nt, Staphylococcus aureus subsp. aureus N315
guuaaagaugucgaaaaguauau

SEQ ID NO: 4053999 - RNA, 19 nt, Staphylococcus aureus subsp. aureus N315
guuaaaguacuuacaaaua

SEQ ID NO: 4054000 - RNA, 22 nt, Staphylococcus aureus subsp. aureus N315
guuaaagucuguugguuuauca

SEQ ID NO: 4054001 - RNA, 15 nt, Staphylococcus aureus subsp. aureus N315
guuaaaguuuuguuc

SEQ ID NO: 4054002 - RNA, 19 nt, Staphylococcus aureus subsp. aureus N315
guuaaauauggaugauauu

SEQ ID NO: 4054003 - RNA, 13 nt, Staphylococcus aureus subsp. aureus N315
guuaaaucaccaa

SEQ ID NO: 4054004 - RNA, 22 nt, Staphylococcus aureus subsp. aureus N315
guuaacaauauucguaaauccu

SEQ ID NO: 4054005 - RNA, 13 nt, Staphylococcus aureus subsp. aureus N315
guuaaccauacau

SEQ ID NO: 4054006 - RNA, 18 nt, Staphylococcus aureus subsp. aureus N315
guuaaccauacauaugcu

SEQ ID NO: 4054007 - RNA, 18 nt, Staphylococcus aureus subsp. aureus N315
guuaagauaccuuuuucu

SEQ ID NO: 4054008 - RNA, 16 nt, Staphylococcus aureus subsp. aureus N315
guuaaguauuuaaaua

SEQ ID NO: 4054009 - RNA, 22 nt, Staphylococcus aureus subsp. aureus N315
guuaauaaugacugacacuuua

SEQ ID NO: 4054010 - RNA, 21 nt, Staphylococcus aureus subsp. aureus N315
guuaauacaaccaucagcauu

SEQ ID NO: 4054011 - RNA, 18 nt, Staphylococcus aureus subsp. aureus N315
guuaauauaacuucuauu

SEQ ID NO: 4054012 - RNA, 16 nt, Staphylococcus aureus subsp. aureus N315
guuaauuauguauuuu

SEQ ID NO: 4054013 - RNA, 23 nt, Staphylococcus aureus subsp. aureus N315
guuaauuuuauuuuagcagcagu

SEQ ID NO: 4054014 - RNA, 15 nt, Staphylococcus aureus subsp. aureus N315
guuacauauugcauu

SEQ ID NO: 4054015 - RNA, 17 nt, Staphylococcus aureus subsp. aureus N315
guuaccaaguaaugaua

SEQ ID NO: 4054016 - RNA, 20 nt, Staphylococcus aureus subsp. aureus N315
guuaccaucuuuaauacgaa

SEQ ID NO: 4054017 - RNA, 21 nt, Staphylococcus aureus subsp. aureus N315
guuaccuacuacauucuaugu

SEQ ID NO: 4054018 - RNA, 20 nt, Staphylococcus aureus subsp. aureus N315
guuacuaaacuuuucuucaa

SEQ ID NO: 4054019 - RNA, 23 nt, Staphylococcus aureus subsp. aureus N315
guuacuauacaugguacugcuuc

SEQ ID NO: 4054020 - RNA, 16 nt, Staphylococcus aureus subsp. aureus N315
guuacuucuaauagua

SEQ ID NO: 4054021 - RNA, 15 nt, Staphylococcus aureus subsp. aureus N315
guuaggagagaugua

SEQ ID NO: 4054022 - RNA, 21 nt, Staphylococcus aureus subsp. aureus N315
guuaguauaaacguccaaaca

SEQ ID NO: 4054023 - RNA, 22 nt, Staphylococcus aureus subsp. aureus N315
guuagugauaccuuuaauuguu

SEQ ID NO: 4054024 - RNA, 23 nt, Staphylococcus aureus subsp. aureus N315
guuauaaguacaaauaauacagg

SEQ ID NO: 4054025 - RNA, 23 nt, Staphylococcus aureus subsp. aureus N315
guuauaauggcgggcccccaaca

SEQ ID NO: 4054026 - RNA, 21 nt, Staphylococcus aureus subsp. aureus N315
guuauaccauauuuauggugu

SEQ ID NO: 4054027 - RNA, 12 nt, Staphylococcus aureus subsp. aureus N315
guuauauuuuua

SEQ ID NO: 4054028 - RNA, 14 nt, Staphylococcus aureus subsp. aureus N315
guuaugguguguug

SEQ ID NO: 4054029 - RNA, 17 nt, Staphylococcus aureus subsp. aureus N315
guuaugugcuaaucuau

SEQ ID NO: 4054030 - RNA, 17 nt, Staphylococcus aureus subsp. aureus N315
guuauuaaaauuaaaua

SEQ ID NO: 4054031 - RNA, 15 nt, Staphylococcus aureus subsp. aureus N315
guuauuaaccaucau

SEQ ID NO: 4054032 - RNA, 16 nt, Staphylococcus aureus subsp. aureus N315
guuauuaaccaucaug

SEQ ID NO: 4054033 - RNA, 15 nt, Staphylococcus aureus subsp. aureus N315
guuauuauaaaauaa

SEQ ID NO: 4054034 - RNA, 17 nt, Staphylococcus aureus subsp. aureus N315
guuauuaucguaaaaaa

SEQ ID NO: 4054035 - RNA, 17 nt, Staphylococcus aureus subsp. aureus N315
guuauuuauaugauuaa

SEQ ID NO: 4054036 - RNA, 15 nt, Staphylococcus aureus subsp. aureus N315
guucaaaauacucaa

SEQ ID NO: 4054037 - RNA, 18 nt, Staphylococcus aureus subsp. aureus N315
guucaagcuuuauuuuuu

SEQ ID NO: 4054038 - RNA, 16 nt, Staphylococcus aureus subsp. aureus N315
guucaauauuuaucaa

SEQ ID NO: 4054039 - RNA, 19 nt, Staphylococcus aureus subsp. aureus N315
guucaaucacuauauuuca

SEQ ID NO: 4054040 - RNA, 17 nt, Staphylococcus aureus subsp. aureus N315
guucacaugaauuuuaa

SEQ ID NO: 4054041 - RNA, 18 nt, Staphylococcus aureus subsp. aureus N315
guucagauuuguauuuug

SEQ ID NO: 4054042 - RNA, 15 nt, Staphylococcus aureus subsp. aureus N315
guucagguucaaaau

SEQ ID NO: 4054043 - RNA, 14 nt, Staphylococcus aureus subsp. aureus N315
guucaguaggaauu

SEQ ID NO: 4054044 - RNA, 13 nt, Staphylococcus aureus subsp. aureus N315
guucauaaugauc

SEQ ID NO: 4054045 - RNA, 22 nt, Staphylococcus aureus subsp. aureus N315
guucauaaugaucaaguaguua

SEQ ID NO: 4054046 - RNA, 13 nt, Staphylococcus aureus subsp. aureus N315
guucaucaaacaa

SEQ ID NO: 4054047 - RNA, 14 nt, Staphylococcus aureus subsp. aureus N315
guucaucaacauga

SEQ ID NO: 4054048 - RNA, 17 nt, Staphylococcus aureus subsp. aureus N315
guucaucugauaauucg

SEQ ID NO: 4054049 - RNA, 17 nt, Staphylococcus aureus subsp. aureus N315
guucauuggcaauauac

SEQ ID NO: 4054050 - RNA, 22 nt, Staphylococcus aureus subsp. aureus N315
guucauuggcaauauacuuuuu

SEQ ID NO: 4054051 - RNA, 14 nt, Staphylococcus aureus subsp. aureus N315
guuccaaucuuuuu

SEQ ID NO: 4054052 - RNA, 18 nt, Staphylococcus aureus subsp. aureus N315
guuccaccgaauccuguu

SEQ ID NO: 4054053 - RNA, 19 nt, Staphylococcus aureus subsp. aureus N315
guucgauuguaauaaccau

SEQ ID NO: 4054054 - RNA, 19 nt, Staphylococcus aureus subsp. aureus N315
guucuaguuuuuuuuauau

SEQ ID NO: 4054055 - RNA, 13 nt, Staphylococcus aureus subsp. aureus N315
guucuauaauaaa

SEQ ID NO: 4054056 - RNA, 15 nt, Staphylococcus aureus subsp. aureus N315
guucuauauaauuua

SEQ ID NO: 4054057 - RNA, 22 nt, Staphylococcus aureus subsp. aureus N315
guucucauuauaaugauuuuua

SEQ ID NO: 4054058 - RNA, 15 nt, Staphylococcus aureus subsp. aureus N315
guucucccuuuuauc

SEQ ID NO: 4054059 - RNA, 14 nt, Staphylococcus aureus subsp. aureus N315
guucuccgaucaug

SEQ ID NO: 4054060 - RNA, 19 nt, Staphylococcus aureus subsp. aureus N315
guucuccgaucaugccuuc

SEQ ID NO: 4054061 - RNA, 15 nt, Staphylococcus aureus subsp. aureus N315
guucucgucuuucgu

SEQ ID NO: 4054062 - RNA, 14 nt, Staphylococcus aureus subsp. aureus N315
guucugcuuuuucu

SEQ ID NO: 4054063 - RNA, 21 nt, Staphylococcus aureus subsp. aureus N315
guucuucaucuuuuauggugg

SEQ ID NO: 4054064 - RNA, 17 nt, Staphylococcus aureus subsp. aureus N315
guucuugguauuuuuua

SEQ ID NO: 4054065 - RNA, 18 nt, Staphylococcus aureus subsp. aureus N315
guucuugguauuuuuuaa

SEQ ID NO: 4054066 - RNA, 16 nt, Staphylococcus aureus subsp. aureus N315
guucuuuacuccaaag

SEQ ID NO: 4054067 - RNA, 18 nt, Staphylococcus aureus subsp. aureus N315
guucuuucuuguucuaaa

SEQ ID NO: 4054068 - RNA, 13 nt, Staphylococcus aureus subsp. aureus N315
guucuuuuuguug

SEQ ID NO: 4054069 - RNA, 22 nt, Staphylococcus aureus subsp. aureus N315
guugaauaauuaauguuucuuc

SEQ ID NO: 4054070 - RNA, 16 nt, Staphylococcus aureus subsp. aureus N315
guugaauuaacaauau

SEQ ID NO: 4054071 - RNA, 19 nt, Staphylococcus aureus subsp. aureus N315
guugauauauauuuugcaa

SEQ ID NO: 4054072 - RNA, 21 nt, Staphylococcus aureus subsp. aureus N315
guugaucuuugacauguguua

SEQ ID NO: 4054073 - RNA, 21 nt, Staphylococcus aureus subsp. aureus N315
guugauugcaugacagcaaau

SEQ ID NO: 4054074 - RNA, 22 nt, Staphylococcus aureus subsp. aureus N315
guugcaaauuggauaauuucuu

SEQ ID NO: 4054075 - RNA, 21 nt, Staphylococcus aureus subsp. aureus N315
guugcaauugaagugaaauug

SEQ ID NO: 4054076 - RNA, 23 nt, Staphylococcus aureus subsp. aureus N315
guugcacaaauugcaauggcaac

SEQ ID NO: 4054077 - RNA, 19 nt, Staphylococcus aureus subsp. aureus N315
guugcauaaucaauuucac

SEQ ID NO: 4054078 - RNA, 22 nt, Staphylococcus aureus subsp. aureus N315
guugccauuaguucuguugaua

SEQ ID NO: 4054079 - RNA, 16 nt, Staphylococcus aureus subsp. aureus N315
guugcguuaaauaugg

SEQ ID NO: 4054080 - RNA, 13 nt, Staphylococcus aureus subsp. aureus N315
guugcucgugcau

SEQ ID NO: 4054081 - RNA, 14 nt, Staphylococcus aureus subsp. aureus N315
guuggaaaauuaca

SEQ ID NO: 4054082 - RNA, 12 nt, Staphylococcus aureus subsp. aureus N315
guuggggcccac

SEQ ID NO: 4054083 - RNA, 15 nt, Staphylococcus aureus subsp. aureus N315
guuggggcccacacc

SEQ ID NO: 4054084 - RNA, 17 nt, Staphylococcus aureus subsp. aureus N315
guuggggcccacacccc

SEQ ID NO: 4054085 - RNA, 16 nt, Staphylococcus aureus subsp. aureus N315
guugguucaucaaaca

SEQ ID NO: 4054086 - RNA, 15 nt, Staphylococcus aureus subsp. aureus N315
guugguugugauuug

SEQ ID NO: 4054087 - RNA, 13 nt, Staphylococcus aureus subsp. aureus N315
guugguuuaucag

SEQ ID NO: 4054088 - RNA, 15 nt, Staphylococcus aureus subsp. aureus N315
guuguaauuuaaaau

SEQ ID NO: 4054089 - RNA, 21 nt, Staphylococcus aureus subsp. aureus N315
guuguauucugaaacuuuaau

SEQ ID NO: 4054090 - RNA, 18 nt, Staphylococcus aureus subsp. aureus N315
guugucacgaucaaauuu

SEQ ID NO: 4054091 - RNA, 15 nt, Staphylococcus aureus subsp. aureus N315
guugugauauauagu

SEQ ID NO: 4054092 - RNA, 23 nt, Staphylococcus aureus subsp. aureus N315
guugugauauauaguaggguauu

SEQ ID NO: 4054093 - RNA, 15 nt, Staphylococcus aureus subsp. aureus N315
guuguucuuuuuguu

SEQ ID NO: 4054094 - RNA, 13 nt, Staphylococcus aureus subsp. aureus N315
guuguugaaauuu

SEQ ID NO: 4054095 - RNA, 20 nt, Staphylococcus aureus subsp. aureus N315
guuguugcaacuugugguug

SEQ ID NO: 4054096 - RNA, 13 nt, Staphylococcus aureus subsp. aureus N315
guuguuucuccag

SEQ ID NO: 4054097 - RNA, 14 nt, Staphylococcus aureus subsp. aureus N315
guuuaaaaauaugu

SEQ ID NO: 4054098 - RNA, 14 nt, Staphylococcus aureus subsp. aureus N315
guuuaaaaaugcug

SEQ ID NO: 4054099 - RNA, 13 nt, Staphylococcus aureus subsp. aureus N315
guuuaaauucauu

SEQ ID NO: 4054100 - RNA, 19 nt, Staphylococcus aureus subsp. aureus N315
guuuaaauuuaaaagaaaa

SEQ ID NO: 4054101 - RNA, 23 nt, Staphylococcus aureus subsp. aureus N315
guuuaauuaaaauacaaauuaca

SEQ ID NO: 4054102 - RNA, 14 nt, Staphylococcus aureus subsp. aureus N315
guuuaauuuuaaau

SEQ ID NO: 4054103 - RNA, 15 nt, Staphylococcus aureus subsp. aureus N315
guuuaauuuuaaaua

SEQ ID NO: 4054104 - RNA, 17 nt, Staphylococcus aureus subsp. aureus N315
guuuacuauuaaaggaa

SEQ ID NO: 4054105 - RNA, 23 nt, Staphylococcus aureus subsp. aureus N315
guuuagaaaaguaaguaaaauaa

SEQ ID NO: 4054106 - RNA, 23 nt, Staphylococcus aureus subsp. aureus N315
guuuagaaagaauacaguuacuu

SEQ ID NO: 4054107 - RNA, 18 nt, Staphylococcus aureus subsp. aureus N315
guuuauaaauuaauugcu

SEQ ID NO: 4054108 - RNA, 23 nt, Staphylococcus aureus subsp. aureus N315
guuuauaaucuuuuuuacuaaaa

SEQ ID NO: 4054109 - RNA, 16 nt, Staphylococcus aureus subsp. aureus N315
guuuauauugcaaaaa

SEQ ID NO: 4054110 - RNA, 19 nt, Staphylococcus aureus subsp. aureus N315
guuuauauugcaaaaauaa

SEQ ID NO: 4054111 - RNA, 13 nt, Staphylococcus aureus subsp. aureus N315
guuuaucagcuuu

SEQ ID NO: 4054112 - RNA, 16 nt, Staphylococcus aureus subsp. aureus N315
guuuaucagcuuuaau

SEQ ID NO: 4054113 - RNA, 16 nt, Staphylococcus aureus subsp. aureus N315
guuuauccauauauga

SEQ ID NO: 4054114 - RNA, 22 nt, Staphylococcus aureus subsp. aureus N315
guuuauccauauaugaugauuu

SEQ ID NO: 4054115 - RNA, 15 nt, Staphylococcus aureus subsp. aureus N315
guuuauccuuuaaau

SEQ ID NO: 4054116 - RNA, 22 nt, Staphylococcus aureus subsp. aureus N315
guuuaucgaucgguauuuucau

SEQ ID NO: 4054117 - RNA, 23 nt, Staphylococcus aureus subsp. aureus N315
guuuaucgaucgguauuuucauu

SEQ ID NO: 4054118 - RNA, 17 nt, Staphylococcus aureus subsp. aureus N315
guuuauuacauaauuua

SEQ ID NO: 4054119 - RNA, 21 nt, Staphylococcus aureus subsp. aureus N315
guuucaagcguuucuugaucu

SEQ ID NO: 4054120 - RNA, 15 nt, Staphylococcus aureus subsp. aureus N315
guuucacaaauucuu

SEQ ID NO: 4054121 - RNA, 19 nt, Staphylococcus aureus subsp. aureus N315
guuucauaugcaucaacag

SEQ ID NO: 4054122 - RNA, 19 nt, Staphylococcus aureus subsp. aureus N315
guuucauauggugaacugu

SEQ ID NO: 4054123 - RNA, 21 nt, Staphylococcus aureus subsp. aureus N315
guuucaugcacuuuaacauaa

SEQ ID NO: 4054124 - RNA, 13 nt, Staphylococcus aureus subsp. aureus N315
guuuccaaucuau

SEQ ID NO: 4054125 - RNA, 11 nt, Staphylococcus aureus subsp. aureus N315
guuucccaagc

SEQ ID NO: 4054126 - RNA, 21 nt, Staphylococcus aureus subsp. aureus N315
guuucuaaauucuuuuuguuc

SEQ ID NO: 4054127 - RNA, 14 nt, Staphylococcus aureus subsp. aureus N315
guuucuccaguuuu

SEQ ID NO: 4054128 - RNA, 17 nt, Staphylococcus aureus subsp. aureus N315
guuucuguuucaucacc

SEQ ID NO: 4054129 - RNA, 17 nt, Staphylococcus aureus subsp. aureus N315
guuucuuccgcacugcc

SEQ ID NO: 4054130 - RNA, 17 nt, Staphylococcus aureus subsp. aureus N315
guuucuuuuauuuucau

SEQ ID NO: 4054131 - RNA, 20 nt, Staphylococcus aureus subsp. aureus N315
guuugaaggagauauuuucu

SEQ ID NO: 4054132 - RNA, 15 nt, Staphylococcus aureus subsp. aureus N315
guuugaauggcaaau

SEQ ID NO: 4054133 - RNA, 21 nt, Staphylococcus aureus subsp. aureus N315
guuugaauguuuuugauagua

SEQ ID NO: 4054134 - RNA, 23 nt, Staphylococcus aureus subsp. aureus N315
guuugacaaagcuaaagugaagu

SEQ ID NO: 4054135 - RNA, 14 nt, Staphylococcus aureus subsp. aureus N315
guuugaccacaacu

SEQ ID NO: 4054136 - RNA, 13 nt, Staphylococcus aureus subsp. aureus N315
guuugaucauaau

SEQ ID NO: 4054137 - RNA, 16 nt, Staphylococcus aureus subsp. aureus N315
guuugaucauaauuca

SEQ ID NO: 4054138 - RNA, 22 nt, Staphylococcus aureus subsp. aureus N315
guuuggaugaacaaaauaacau

SEQ ID NO: 4054139 - RNA, 22 nt, Staphylococcus aureus subsp. aureus N315
guuuggucaccuacagauaaag

SEQ ID NO: 4054140 - RNA, 21 nt, Staphylococcus aureus subsp. aureus N315
guuuguaagacaacaaaucga

SEQ ID NO: 4054141 - RNA, 13 nt, Staphylococcus aureus subsp. aureus N315
guuuguccuuuaa

SEQ ID NO: 4054142 - RNA, 22 nt, Staphylococcus aureus subsp. aureus N315
guuugucguuacuaccuauuaa

SEQ ID NO: 4054143 - RNA, 21 nt, Staphylococcus aureus subsp. aureus N315
guuugugguaaugauuuugcu

SEQ ID NO: 4054144 - RNA, 17 nt, Staphylococcus aureus subsp. aureus N315
guuuguuuauugagaau

SEQ ID NO: 4054145 - RNA, 12 nt, Staphylococcus aureus subsp. aureus N315
guuuuaaaagua

SEQ ID NO: 4054146 - RNA, 17 nt, Staphylococcus aureus subsp. aureus N315
guuuuaaagguuaaaua

SEQ ID NO: 4054147 - RNA, 17 nt, Staphylococcus aureus subsp. aureus N315
guuuuaaauaaaugacu

SEQ ID NO: 4054148 - RNA, 17 nt, Staphylococcus aureus subsp. aureus N315
guuuuaaauugaaaugu

SEQ ID NO: 4054149 - RNA, 14 nt, Staphylococcus aureus subsp. aureus N315
guuuuaaucuuauu

SEQ ID NO: 4054150 - RNA, 13 nt, Staphylococcus aureus subsp. aureus N315
guuuuaauuucuu

SEQ ID NO: 4054151 - RNA, 19 nt, Staphylococcus aureus subsp. aureus N315
guuuuagaauaguuaccaa

SEQ ID NO: 4054152 - RNA, 23 nt, Staphylococcus aureus subsp. aureus N315
guuuuauauuuauuuuauaauaa

SEQ ID NO: 4054153 - RNA, 17 nt, Staphylococcus aureus subsp. aureus N315
guuuuaucuacaguuuu

SEQ ID NO: 4054154 - RNA, 23 nt, Staphylococcus aureus subsp. aureus N315
guuuuauggcgguuugaaaauga

SEQ ID NO: 4054155 - RNA, 17 nt, Staphylococcus aureus subsp. aureus N315
guuuuauucaauugauu

SEQ ID NO: 4054156 - RNA, 18 nt, Staphylococcus aureus subsp. aureus N315
guuuuauucgauaauaua

SEQ ID NO: 4054157 - RNA, 15 nt, Staphylococcus aureus subsp. aureus N315
guuuuauuuauaaac

SEQ ID NO: 4054158 - RNA, 20 nt, Staphylococcus aureus subsp. aureus N315
guuuuauuuuuaucaucaug

SEQ ID NO: 4054159 - RNA, 17 nt, Staphylococcus aureus subsp. aureus N315
guuuucacuguuuuauc

SEQ ID NO: 4054160 - RNA, 22 nt, Staphylococcus aureus subsp. aureus N315
guuuucacuguuuuaucuacag

SEQ ID NO: 4054161 - RNA, 15 nt, Staphylococcus aureus subsp. aureus N315
guuuucaguaacuga

SEQ ID NO: 4054162 - RNA, 16 nt, Staphylococcus aureus subsp. aureus N315
guuuucauuuuuucaa

SEQ ID NO: 4054163 - RNA, 10 nt, Staphylococcus aureus subsp. aureus N315
guuuucuagu

SEQ ID NO: 4054164 - RNA, 15 nt, Staphylococcus aureus subsp. aureus N315
guuuugaagaauaaa

SEQ ID NO: 4054165 - RNA, 12 nt, Staphylococcus aureus subsp. aureus N315
guuuugagagau

SEQ ID NO: 4054166 - RNA, 20 nt, Staphylococcus aureus subsp. aureus N315
guuuugagagauuauuuaaa

SEQ ID NO: 4054167 - RNA, 19 nt, Staphylococcus aureus subsp. aureus N315
guuuugcaacauuuugagu

SEQ ID NO: 4054168 - RNA, 17 nt, Staphylococcus aureus subsp. aureus N315
guuuuggucaaguaaau

SEQ ID NO: 4054169 - RNA, 15 nt, Staphylococcus aureus subsp. aureus N315
guuuugguucugaca

SEQ ID NO: 4054170 - RNA, 14 nt, Staphylococcus aureus subsp. aureus N315
guuuuuaaauaauc

SEQ ID NO: 4054171 - RNA, 19 nt, Staphylococcus aureus subsp. aureus N315
guuuuuacuguaaucaauc

SEQ ID NO: 4054172 - RNA, 21 nt, Staphylococcus aureus subsp. aureus N315
guuuuuagguuauauuuaaau

SEQ ID NO: 4054173 - RNA, 12 nt, Staphylococcus aureus subsp. aureus N315
guuuuuccaugu

SEQ ID NO: 4054174 - RNA, 18 nt, Staphylococcus aureus subsp. aureus N315
guuuuuguggaaaauuga

SEQ ID NO: 4054175 - RNA, 21 nt, Staphylococcus aureus subsp. aureus N315
guuuuuuagauuugaaauuua

SEQ ID NO: 4054176 - RNA, 21 nt, Staphylococcus aureus subsp. aureus N315
guuuuuucauuguaauaauaa

SEQ ID NO: 4054177 - RNA, 18 nt, Staphylococcus aureus subsp. aureus N315
guuuuuugauuaguaaau

SEQ ID NO: 4054178 - RNA, 21 nt, Staphylococcus aureus subsp. aureus N315
guuuuuugauuaguaaauaua

SEQ ID NO: 4054179 - RNA, 12 nt, Staphylococcus aureus subsp. aureus N315
guuuuuuuaaau

SEQ ID NO: 4054180 - RNA, 23 nt, Staphylococcus aureus subsp. aureus N315
uaaaaaaacgucuuuccauuuau

SEQ ID NO: 4054181 - RNA, 12 nt, Staphylococcus aureus subsp. aureus N315
uaaaaaaauaau

SEQ ID NO: 4054182 - RNA, 20 nt, Staphylococcus aureus subsp. aureus N315
uaaaaaaaucccucaauccg

SEQ ID NO: 4054183 - RNA, 15 nt, Staphylococcus aureus subsp. aureus N315
uaaaaaaauuaaaau

SEQ ID NO: 4054184 - RNA, 15 nt, Staphylococcus aureus subsp. aureus N315
uaaaaaaauuaacua

SEQ ID NO: 4054185 - RNA, 13 nt, Staphylococcus aureus subsp. aureus N315
uaaaaaacaauag

SEQ ID NO: 4054186 - RNA, 21 nt, Staphylococcus aureus subsp. aureus N315
uaaaaaacagcaguaagauau

SEQ ID NO: 4054187 - RNA, 20 nt, Staphylococcus aureus subsp. aureus N315
uaaaaaaccugaaacaaauu

SEQ ID NO: 4054188 - RNA, 16 nt, Staphylococcus aureus subsp. aureus N315
uaaaaaaggaagaaca

SEQ ID NO: 4054189 - RNA, 20 nt, Staphylococcus aureus subsp. aureus N315
uaaaaaaucaguuuuuaaau

SEQ ID NO: 4054190 - RNA, 23 nt, Staphylococcus aureus subsp. aureus N315
uaaaaaauccggaacauuaaaag

SEQ ID NO: 4054191 - RNA, 13 nt, Staphylococcus aureus subsp. aureus N315
uaaaaaaugaaug

SEQ ID NO: 4054192 - RNA, 18 nt, Staphylococcus aureus subsp. aureus N315
uaaaaaaugcgcuuccaa

SEQ ID NO: 4054193 - RNA, 16 nt, Staphylococcus aureus subsp. aureus N315
uaaaaaauuauuaaaa

SEQ ID NO: 4054194 - RNA, 13 nt, Staphylococcus aureus subsp. aureus N315
uaaaaaauuuaaa

SEQ ID NO: 4054195 - RNA, 18 nt, Staphylococcus aureus subsp. aureus N315
uaaaaaauuuaaauaaua

SEQ ID NO: 4054196 - RNA, 20 nt, Staphylococcus aureus subsp. aureus N315
uaaaaaauuuaaauaauaau

SEQ ID NO: 4054197 - RNA, 13 nt, Staphylococcus aureus subsp. aureus N315
uaaaaaauuuaau

SEQ ID NO: 4054198 - RNA, 14 nt, Staphylococcus aureus subsp. aureus N315
uaaaaaccuauucc

SEQ ID NO: 4054199 - RNA, 23 nt, Staphylococcus aureus subsp. aureus N315
uaaaaacggacaaguugcacauu

SEQ ID NO: 4054200 - RNA, 15 nt, Staphylococcus aureus subsp. aureus N315
uaaaaacguucaauc

SEQ ID NO: 4054201 - RNA, 17 nt, Staphylococcus aureus subsp. aureus N315
uaaaaacguucaaucgu

SEQ ID NO: 4054202 - RNA, 20 nt, Staphylococcus aureus subsp. aureus N315
uaaaaacugugauucauucg

SEQ ID NO: 4054203 - RNA, 12 nt, Staphylococcus aureus subsp. aureus N315
uaaaaagaaaau

SEQ ID NO: 4054204 - RNA, 19 nt, Staphylococcus aureus subsp. aureus N315
uaaaaagaagaucccucaa

SEQ ID NO: 4054205 - RNA, 18 nt, Staphylococcus aureus subsp. aureus N315
uaaaaagagaugggcuaa

SEQ ID NO: 4054206 - RNA, 15 nt, Staphylococcus aureus subsp. aureus N315
uaaaaagcagcagua

SEQ ID NO: 4054207 - RNA, 21 nt, Staphylococcus aureus subsp. aureus N315
uaaaaagguacuaauguuaau

SEQ ID NO: 4054208 - RNA, 16 nt, Staphylococcus aureus subsp. aureus N315
uaaaaaguaauuaauu

SEQ ID NO: 4054209 - RNA, 21 nt, Staphylococcus aureus subsp. aureus N315
uaaaaagugaaaguauuagau

SEQ ID NO: 4054210 - RNA, 17 nt, Staphylococcus aureus subsp. aureus N315
uaaaaagugaagauauu

SEQ ID NO: 4054211 - RNA, 20 nt, Staphylococcus aureus subsp. aureus N315
uaaaaagugaagauauuuau

SEQ ID NO: 4054212 - RNA, 19 nt, Staphylococcus aureus subsp. aureus N315
uaaaaaguuuaaaguauaa

SEQ ID NO: 4054213 - RNA, 20 nt, Staphylococcus aureus subsp. aureus N315
uaaaaauacauaauaaaaag

SEQ ID NO: 4054214 - RNA, 21 nt, Staphylococcus aureus subsp. aureus N315
uaaaaauacauuuugcucuaa

SEQ ID NO: 4054215 - RNA, 13 nt, Staphylococcus aureus subsp. aureus N315
uaaaaauauauuu

SEQ ID NO: 4054216 - RNA, 15 nt, Staphylococcus aureus subsp. aureus N315
uaaaaauauugaaua

SEQ ID NO: 4054217 - RNA, 11 nt, Staphylococcus aureus subsp. aureus N315
uaaaaaucaaa

SEQ ID NO: 4054218 - RNA, 18 nt, Staphylococcus aureus subsp. aureus N315
uaaaaaucaaagaggcac

SEQ ID NO: 4054219 - RNA, 19 nt, Staphylococcus aureus subsp. aureus N315
uaaaaaucaaagaggcuuu

SEQ ID NO: 4054220 - RNA, 14 nt, Staphylococcus aureus subsp. aureus N315
uaaaaaucauaaau

SEQ ID NO: 4054221 - RNA, 19 nt, Staphylococcus aureus subsp. aureus N315
uaaaaauccacacauuaag

SEQ ID NO: 4054222 - RNA, 21 nt, Staphylococcus aureus subsp. aureus N315
uaaaaaucuuggugauagucu

SEQ ID NO: 4054223 - RNA, 20 nt, Staphylococcus aureus subsp. aureus N315
uaaaaaugcugguaaauguu

SEQ ID NO: 4054224 - RNA, 13 nt, Staphylococcus aureus subsp. aureus N315
uaaaaauguaaau

SEQ ID NO: 4054225 - RNA, 16 nt, Staphylococcus aureus subsp. aureus N315
uaaaaauuaaguaaua

SEQ ID NO: 4054226 - RNA, 17 nt, Staphylococcus aureus subsp. aureus N315
uaaaaauuaaguaauag

SEQ ID NO: 4054227 - RNA, 15 nt, Staphylococcus aureus subsp. aureus N315
uaaaaauuauauaaa

SEQ ID NO: 4054228 - RNA, 19 nt, Staphylococcus aureus subsp. aureus N315
uaaaaauugauauugcaaa

SEQ ID NO: 4054229 - RNA, 22 nt, Staphylococcus aureus subsp. aureus N315
uaaaaauugcaaugcuaucaug

SEQ ID NO: 4054230 - RNA, 17 nt, Staphylococcus aureus subsp. aureus N315
uaaaaauuuauucaaaa

SEQ ID NO: 4054231 - RNA, 24 nt, Staphylococcus aureus subsp. aureus N315
uaaaaauuuauucaaaauucaaua

SEQ ID NO: 4054232 - RNA, 21 nt, Staphylococcus aureus subsp. aureus N315
uaaaaauuucgccucaucuaa

SEQ ID NO: 4054233 - RNA, 14 nt, Staphylococcus aureus subsp. aureus N315
uaaaacaaauuauu

SEQ ID NO: 4054234 - RNA, 18 nt, Staphylococcus aureus subsp. aureus N315
uaaaacaaauucauauua

SEQ ID NO: 4054235 - RNA, 20 nt, Staphylococcus aureus subsp. aureus N315
uaaaacagaauuucaucaaa

SEQ ID NO: 4054236 - RNA, 14 nt, Staphylococcus aureus subsp. aureus N315
uaaaacagcaaaua

SEQ ID NO: 4054237 - RNA, 21 nt, Staphylococcus aureus subsp. aureus N315
uaaaacagcaaauaaaaucau

SEQ ID NO: 4054238 - RNA, 22 nt, Staphylococcus aureus subsp. aureus N315
uaaaacaguaaguaauaaaaua

SEQ ID NO: 4054239 - RNA, 22 nt, Staphylococcus aureus subsp. aureus N315
uaaaacauucccuuaauaauaa

SEQ ID NO: 4054240 - RNA, 21 nt, Staphylococcus aureus subsp. aureus N315
uaaaaccaaaagaaauuuaau

SEQ ID NO: 4054241 - RNA, 18 nt, Staphylococcus aureus subsp. aureus N315
uaaaaccuuacccaaaaa

SEQ ID NO: 4054242 - RNA, 14 nt, Staphylococcus aureus subsp. aureus N315
uaaaaccuucaauc

SEQ ID NO: 4054243 - RNA, 17 nt, Staphylococcus aureus subsp. aureus N315
uaaaaccuuuucaaauu

SEQ ID NO: 4054244 - RNA, 22 nt, Staphylococcus aureus subsp. aureus N315
uaaaaccuuuucaaauuauaac

SEQ ID NO: 4054245 - RNA, 19 nt, Staphylococcus aureus subsp. aureus N315
uaaaacgaaguuauuuauu

SEQ ID NO: 4054246 - RNA, 16 nt, Staphylococcus aureus subsp. aureus N315
uaaaacgacucauuau

SEQ ID NO: 4054247 - RNA, 20 nt, Staphylococcus aureus subsp. aureus N315
uaaaacgacucauuauaaau

SEQ ID NO: 4054248 - RNA, 15 nt, Staphylococcus aureus subsp. aureus N315
uaaaacgcuucauau

SEQ ID NO: 4054249 - RNA, 20 nt, Staphylococcus aureus subsp. aureus N315
uaaaacgugcaaauaaaaaa

SEQ ID NO: 4054250 - RNA, 15 nt, Staphylococcus aureus subsp. aureus N315
uaaaacuaaguuauu

SEQ ID NO: 4054251 - RNA, 16 nt, Staphylococcus aureus subsp. aureus N315
uaaaacuaaugauagu

SEQ ID NO: 4054252 - RNA, 20 nt, Staphylococcus aureus subsp. aureus N315
uaaaacuacugauuuauuga

SEQ ID NO: 4054253 - RNA, 16 nt, Staphylococcus aureus subsp. aureus N315
uaaaacuauaauaaag

SEQ ID NO: 4054254 - RNA, 15 nt, Staphylococcus aureus subsp. aureus N315
uaaaacugcaauaau

SEQ ID NO: 4054255 - RNA, 12 nt, Staphylococcus aureus subsp. aureus N315
uaaaacuuacau

SEQ ID NO: 4054256 - RNA, 13 nt, Staphylococcus aureus subsp. aureus N315
uaaaagaaaaauu

SEQ ID NO: 4054257 - RNA, 15 nt, Staphylococcus aureus subsp. aureus N315
uaaaagaauuauuca

SEQ ID NO: 4054258 - RNA, 14 nt, Staphylococcus aureus subsp. aureus N315
uaaaagacagaaau

SEQ ID NO: 4054259 - RNA, 19 nt, Staphylococcus aureus subsp. aureus N315
uaaaagacagaaauuacua

SEQ ID NO: 4054260 - RNA, 19 nt, Staphylococcus aureus subsp. aureus N315
uaaaagagaauuuuaauua

SEQ ID NO: 4054261 - RNA, 14 nt, Staphylococcus aureus subsp. aureus N315
uaaaagauuagaug

SEQ ID NO: 4054262 - RNA, 14 nt, Staphylococcus aureus subsp. aureus N315
uaaaagcaaaggcg

SEQ ID NO: 4054263 - RNA, 18 nt, Staphylococcus aureus subsp. aureus N315
uaaaagccaacacauaaa

SEQ ID NO: 4054264 - RNA, 15 nt, Staphylococcus aureus subsp. aureus N315
uaaaagcugauguga

SEQ ID NO: 4054265 - RNA, 20 nt, Staphylococcus aureus subsp. aureus N315
uaaaaggaugugacaaauac

SEQ ID NO: 4054266 - RNA, 17 nt, Staphylococcus aureus subsp. aureus N315
uaaaaggcgaaacauua

SEQ ID NO: 4054267 - RNA, 21 nt, Staphylococcus aureus subsp. aureus N315
uaaaaggcgaaacauuaaaau

SEQ ID NO: 4054268 - RNA, 22 nt, Staphylococcus aureus subsp. aureus N315
uaaaaggcgaaacauuaaaaua

SEQ ID NO: 4054269 - RNA, 22 nt, Staphylococcus aureus subsp. aureus N315
uaaaaguaacauacuauaaaaa

SEQ ID NO: 4054270 - RNA, 21 nt, Staphylococcus aureus subsp. aureus N315
uaaaaguacuaacccaacgau

SEQ ID NO: 4054271 - RNA, 16 nt, Staphylococcus aureus subsp. aureus N315
uaaaaguauagauaga

SEQ ID NO: 4054272 - RNA, 19 nt, Staphylococcus aureus subsp. aureus N315
uaaaaguuaccuacuacau

SEQ ID NO: 4054273 - RNA, 18 nt, Staphylococcus aureus subsp. aureus N315
uaaaaguuucccaagcau

SEQ ID NO: 4054274 - RNA, 18 nt, Staphylococcus aureus subsp. aureus N315
uaaaauaaaaaaugcacu

SEQ ID NO: 4054275 - RNA, 20 nt, Staphylococcus aureus subsp. aureus N315
uaaaauaaaaaaugcacuga

SEQ ID NO: 4054276 - RNA, 12 nt, Staphylococcus aureus subsp. aureus N315
uaaaauaaaaug

SEQ ID NO: 4054277 - RNA, 15 nt, Staphylococcus aureus subsp. aureus N315
uaaaauaaaaugcaa

SEQ ID NO: 4054278 - RNA, 14 nt, Staphylococcus aureus subsp. aureus N315
uaaaauaaaauuaa

SEQ ID NO: 4054279 - RNA, 12 nt, Staphylococcus aureus subsp. aureus N315
uaaaauaaacca

SEQ ID NO: 4054280 - RNA, 18 nt, Staphylococcus aureus subsp. aureus N315
uaaaauaaaccacgcaca

SEQ ID NO: 4054281 - RNA, 19 nt, Staphylococcus aureus subsp. aureus N315
uaaaauaaaguuugggcau

SEQ ID NO: 4054282 - RNA, 13 nt, Staphylococcus aureus subsp. aureus N315
uaaaauaaaucau

SEQ ID NO: 4054283 - RNA, 15 nt, Staphylococcus aureus subsp. aureus N315
uaaaauaagauauau

SEQ ID NO: 4054284 - RNA, 18 nt, Staphylococcus aureus subsp. aureus N315
uaaaauaagauauauaau

SEQ ID NO: 4054285 - RNA, 13 nt, Staphylococcus aureus subsp. aureus N315
uaaaauaaucggu

SEQ ID NO: 4054286 - RNA, 11 nt, Staphylococcus aureus subsp. aureus N315
uaaaauaauga

SEQ ID NO: 4054287 - RNA, 15 nt, Staphylococcus aureus subsp. aureus N315
uaaaauaauuaaaua

SEQ ID NO: 4054288 - RNA, 20 nt, Staphylococcus aureus subsp. aureus N315
uaaaauaauuaaauaaaaau

SEQ ID NO: 4054289 - RNA, 17 nt, Staphylococcus aureus subsp. aureus N315
uaaaauagaguagacgu

SEQ ID NO: 4054290 - RNA, 21 nt, Staphylococcus aureus subsp. aureus N315
uaaaauagaguagacguaagu

SEQ ID NO: 4054291 - RNA, 15 nt, Staphylococcus aureus subsp. aureus N315
uaaaauagcugcaau

SEQ ID NO: 4054292 - RNA, 15 nt, Staphylococcus aureus subsp. aureus N315
uaaaauaguucuuua

SEQ ID NO: 4054293 - RNA, 16 nt, Staphylococcus aureus subsp. aureus N315
uaaaauaguucuuuaa

SEQ ID NO: 4054294 - RNA, 20 nt, Staphylococcus aureus subsp. aureus N315
uaaaauaguucuuuaaauua

SEQ ID NO: 4054295 - RNA, 21 nt, Staphylococcus aureus subsp. aureus N315
uaaaauaguucuuuaaauuau

SEQ ID NO: 4054296 - RNA, 13 nt, Staphylococcus aureus subsp. aureus N315
uaaaauauaucuu

SEQ ID NO: 4054297 - RNA, 14 nt, Staphylococcus aureus subsp. aureus N315
uaaaauauaugaau

SEQ ID NO: 4054298 - RNA, 21 nt, Staphylococcus aureus subsp. aureus N315
uaaaauauauuuguaguaagu

SEQ ID NO: 4054299 - RNA, 15 nt, Staphylococcus aureus subsp. aureus N315
uaaaauaucaaaaua

SEQ ID NO: 4054300 - RNA, 20 nt, Staphylococcus aureus subsp. aureus N315
uaaaauaucaaaauauaaaa

SEQ ID NO: 4054301 - RNA, 15 nt, Staphylococcus aureus subsp. aureus N315
uaaaauaugauuuaa

SEQ ID NO: 4054302 - RNA, 15 nt, Staphylococcus aureus subsp. aureus N315
uaaaaucaacaccaa

SEQ ID NO: 4054303 - RNA, 14 nt, Staphylococcus aureus subsp. aureus N315
uaaaaucaacuuuu

SEQ ID NO: 4054304 - RNA, 15 nt, Staphylococcus aureus subsp. aureus N315
uaaaaucaacuuuuc

SEQ ID NO: 4054305 - RNA, 21 nt, Staphylococcus aureus subsp. aureus N315
uaaaaucacuugguaaaacau

SEQ ID NO: 4054306 - RNA, 16 nt, Staphylococcus aureus subsp. aureus N315
uaaaaucuauaccauu

SEQ ID NO: 4054307 - RNA, 22 nt, Staphylococcus aureus subsp. aureus N315
uaaaaucuauaccauuccaaaa

SEQ ID NO: 4054308 - RNA, 13 nt, Staphylococcus aureus subsp. aureus N315
uaaaaucucauaa

SEQ ID NO: 4054309 - RNA, 20 nt, Staphylococcus aureus subsp. aureus N315
uaaaaucugcuuuauuuuau

SEQ ID NO: 4054310 - RNA, 12 nt, Staphylococcus aureus subsp. aureus N315
uaaaaugaaaua

SEQ ID NO: 4054311 - RNA, 16 nt, Staphylococcus aureus subsp. aureus N315
uaaaaugaaugaagac

SEQ ID NO: 4054312 - RNA, 18 nt, Staphylococcus aureus subsp. aureus N315
uaaaaugcuacaauuucc

SEQ ID NO: 4054313 - RNA, 17 nt, Staphylococcus aureus subsp. aureus N315
uaaaaugcucccuucaa

SEQ ID NO: 4054314 - RNA, 18 nt, Staphylococcus aureus subsp. aureus N315
uaaaauggcaucuggcaa

SEQ ID NO: 4054315 - RNA, 19 nt, Staphylococcus aureus subsp. aureus N315
uaaaaugucuuugaaaaac

SEQ ID NO: 4054316 - RNA, 20 nt, Staphylococcus aureus subsp. aureus N315
uaaaauguuaggugaaacca

SEQ ID NO: 4054317 - RNA, 15 nt, Staphylococcus aureus subsp. aureus N315
uaaaauuaaaacagc

SEQ ID NO: 4054318 - RNA, 14 nt, Staphylococcus aureus subsp. aureus N315
uaaaauuaaaacuu

SEQ ID NO: 4054319 - RNA, 13 nt, Staphylococcus aureus subsp. aureus N315
uaaaauuaugauu

SEQ ID NO: 4054320 - RNA, 22 nt, Staphylococcus aureus subsp. aureus N315
uaaaauucucuuuuaaauucuu

SEQ ID NO: 4054321 - RNA, 11 nt, Staphylococcus aureus subsp. aureus N315
uaaaauucuuu

SEQ ID NO: 4054322 - RNA, 20 nt, Staphylococcus aureus subsp. aureus N315
uaaaauugccaguaucucuu

SEQ ID NO: 4054323 - RNA, 22 nt, Staphylococcus aureus subsp. aureus N315
uaaaauugccaguaucucuuuu

SEQ ID NO: 4054324 - RNA, 22 nt, Staphylococcus aureus subsp. aureus N315
uaaaauuggaacacgaaauggu

SEQ ID NO: 4054325 - RNA, 15 nt, Staphylococcus aureus subsp. aureus N315
uaaaauuuaaaacaa

SEQ ID NO: 4054326 - RNA, 16 nt, Staphylococcus aureus subsp. aureus N315
uaaaauuuaaaacaau

SEQ ID NO: 4054327 - RNA, 15 nt, Staphylococcus aureus subsp. aureus N315
uaaaauuuaaauauu

SEQ ID NO: 4054328 - RNA, 15 nt, Staphylococcus aureus subsp. aureus N315
uaaaauuuacaaaug

SEQ ID NO: 4054329 - RNA, 20 nt, Staphylococcus aureus subsp. aureus N315
uaaaauuucugcuucuuuua

SEQ ID NO: 4054330 - RNA, 22 nt, Staphylococcus aureus subsp. aureus N315
uaaaauuugaauugacuuacau

SEQ ID NO: 4054331 - RNA, 23 nt, Staphylococcus aureus subsp. aureus N315
uaaaauuugugcauucaucaaug

SEQ ID NO: 4054332 - RNA, 16 nt, Staphylococcus aureus subsp. aureus N315
uaaaauuuguuaauuu

SEQ ID NO: 4054333 - RNA, 12 nt, Staphylococcus aureus subsp. aureus N315
uaaaauuuuaau

SEQ ID NO: 4054334 - RNA, 18 nt, Staphylococcus aureus subsp. aureus N315
uaaaauuuugaagaagug

SEQ ID NO: 4054335 - RNA, 23 nt, Staphylococcus aureus subsp. aureus N315
uaaaauuuuuuucauaauuaaua

SEQ ID NO: 4054336 - RNA, 15 nt, Staphylococcus aureus subsp. aureus N315
uaaacaaauaaaugu

SEQ ID NO: 4054337 - RNA, 14 nt, Staphylococcus aureus subsp. aureus N315
uaaacaacauacag

SEQ ID NO: 4054338 - RNA, 21 nt, Staphylococcus aureus subsp. aureus N315
uaaacaacugagucaaaguca

SEQ ID NO: 4054339 - RNA, 23 nt, Staphylococcus aureus subsp. aureus N315
uaaacaacugagucaaagucauu

SEQ ID NO: 4054340 - RNA, 21 nt, Staphylococcus aureus subsp. aureus N315
uaaacaacugcaauagcuaua

SEQ ID NO: 4054341 - RNA, 20 nt, Staphylococcus aureus subsp. aureus N315
uaaacaagcaucaugaaauu

SEQ ID NO: 4054342 - RNA, 17 nt, Staphylococcus aureus subsp. aureus N315
uaaacaauacguuuucg

SEQ ID NO: 4054343 - RNA, 22 nt, Staphylococcus aureus subsp. aureus N315
uaaacacgcgguaaaacgaagu

SEQ ID NO: 4054344 - RNA, 17 nt, Staphylococcus aureus subsp. aureus N315
uaaacacuauaaaagcc

SEQ ID NO: 4054345 - RNA, 18 nt, Staphylococcus aureus subsp. aureus N315
uaaacacuauaaaagcca

SEQ ID NO: 4054346 - RNA, 23 nt, Staphylococcus aureus subsp. aureus N315
uaaacacuauaaaagccaugaua

SEQ ID NO: 4054347 - RNA, 17 nt, Staphylococcus aureus subsp. aureus N315
uaaacauaaugacauca

SEQ ID NO: 4054348 - RNA, 19 nt, Staphylococcus aureus subsp. aureus N315
uaaacaugggcaaucacuc

SEQ ID NO: 4054349 - RNA, 15 nt, Staphylococcus aureus subsp. aureus N315
uaaacauguacaauu

SEQ ID NO: 4054350 - RNA, 14 nt, Staphylococcus aureus subsp. aureus N315
uaaacauugcuuaa

SEQ ID NO: 4054351 - RNA, 14 nt, Staphylococcus aureus subsp. aureus N315
uaaacauuuagauu

SEQ ID NO: 4054352 - RNA, 19 nt, Staphylococcus aureus subsp. aureus N315
uaaacauuuagauuucaug

SEQ ID NO: 4054353 - RNA, 20 nt, Staphylococcus aureus subsp. aureus N315
uaaacauuuuugaauuuaau

SEQ ID NO: 4054354 - RNA, 21 nt, Staphylococcus aureus subsp. aureus N315
uaaaccaaaucggaauaaaau

SEQ ID NO: 4054355 - RNA, 19 nt, Staphylococcus aureus subsp. aureus N315
uaaaccagcugauuccauu

SEQ ID NO: 4054356 - RNA, 14 nt, Staphylococcus aureus subsp. aureus N315
uaaacccaaagcuc

SEQ ID NO: 4054357 - RNA, 18 nt, Staphylococcus aureus subsp. aureus N315
uaaaccgauuaauauaau

SEQ ID NO: 4054358 - RNA, 23 nt, Staphylococcus aureus subsp. aureus N315
uaaaccgcacuucuauauuaaua

SEQ ID NO: 4054359 - RNA, 17 nt, Staphylococcus aureus subsp. aureus N315
uaaaccggcacuuauuu

SEQ ID NO: 4054360 - RNA, 16 nt, Staphylococcus aureus subsp. aureus N315
uaaaccuaaugcuuua

SEQ ID NO: 4054361 - RNA, 16 nt, Staphylococcus aureus subsp. aureus N315
uaaaccuacaauauag

SEQ ID NO: 4054362 - RNA, 18 nt, Staphylococcus aureus subsp. aureus N315
uaaaccucuaaauaaaau

SEQ ID NO: 4054363 - RNA, 22 nt, Staphylococcus aureus subsp. aureus N315
uaaaccucuaaauaaaauuaaa

SEQ ID NO: 4054364 - RNA, 11 nt, Staphylococcus aureus subsp. aureus N315
uaaaccuguua

SEQ ID NO: 4054365 - RNA, 15 nt, Staphylococcus aureus subsp. aureus N315
uaaaccuuaauaaug

SEQ ID NO: 4054366 - RNA, 17 nt, Staphylococcus aureus subsp. aureus N315
uaaaccuuuuuuaaguu

SEQ ID NO: 4054367 - RNA, 21 nt, Staphylococcus aureus subsp. aureus N315
uaaacgcaauacgaauaucug

SEQ ID NO: 4054368 - RNA, 19 nt, Staphylococcus aureus subsp. aureus N315
uaaacgcugauuuuauaaa

SEQ ID NO: 4054369 - RNA, 17 nt, Staphylococcus aureus subsp. aureus N315
uaaacguacauuuuuau

SEQ ID NO: 4054370 - RNA, 14 nt, Staphylococcus aureus subsp. aureus N315
uaaacuaauccuca

SEQ ID NO: 4054371 - RNA, 20 nt, Staphylococcus aureus subsp. aureus N315
uaaacuagaaaacauaaaua

SEQ ID NO: 4054372 - RNA, 23 nt, Staphylococcus aureus subsp. aureus N315
uaaacuagaaaacauaaauacaa

SEQ ID NO: 4054373 - RNA, 14 nt, Staphylococcus aureus subsp. aureus N315
uaaacuaguaauag

SEQ ID NO: 4054374 - RNA, 19 nt, Staphylococcus aureus subsp. aureus N315
uaaacuaguaauagaauag

SEQ ID NO: 4054375 - RNA, 14 nt, Staphylococcus aureus subsp. aureus N315
uaaacuauaauaau

SEQ ID NO: 4054376 - RNA, 24 nt, Staphylococcus aureus subsp. aureus N315
uaaacucaaaaagccaacacauuc

SEQ ID NO: 4054377 - RNA, 14 nt, Staphylococcus aureus subsp. aureus N315
uaaacucauaccaa

SEQ ID NO: 4054378 - RNA, 16 nt, Staphylococcus aureus subsp. aureus N315
uaaacucauaccaaaa

SEQ ID NO: 4054379 - RNA, 20 nt, Staphylococcus aureus subsp. aureus N315
uaaacucguugcacucuuuu

SEQ ID NO: 4054380 - RNA, 13 nt, Staphylococcus aureus subsp. aureus N315
uaaacuuaagaau

SEQ ID NO: 4054381 - RNA, 13 nt, Staphylococcus aureus subsp. aureus N315
uaaacuuauuaau

SEQ ID NO: 4054382 - RNA, 19 nt, Staphylococcus aureus subsp. aureus N315
uaaacuuauuaauuaauag

SEQ ID NO: 4054383 - RNA, 16 nt, Staphylococcus aureus subsp. aureus N315
uaaacuucuauuaaua

SEQ ID NO: 4054384 - RNA, 12 nt, Staphylococcus aureus subsp. aureus N315
uaaacuucuuuu

SEQ ID NO: 4054385 - RNA, 15 nt, Staphylococcus aureus subsp. aureus N315
uaaacuuuaugaaau

SEQ ID NO: 4054386 - RNA, 16 nt, Staphylococcus aureus subsp. aureus N315
uaaacuuuucuucaag

SEQ ID NO: 4054387 - RNA, 21 nt, Staphylococcus aureus subsp. aureus N315
uaaacuuuucuucaaguuguu

SEQ ID NO: 4054388 - RNA, 20 nt, Staphylococcus aureus subsp. aureus N315
uaaagaacuauuuuaaauua

SEQ ID NO: 4054389 - RNA, 23 nt, Staphylococcus aureus subsp. aureus N315
uaaagaaguauguuuuauacauu

SEQ ID NO: 4054390 - RNA, 19 nt, Staphylococcus aureus subsp. aureus N315
uaaagaaugauuuauaaaa

SEQ ID NO: 4054391 - RNA, 21 nt, Staphylococcus aureus subsp. aureus N315
uaaagaaugauuuauaaaaaa

SEQ ID NO: 4054392 - RNA, 13 nt, Staphylococcus aureus subsp. aureus N315
uaaagaauuaagu

SEQ ID NO: 4054393 - RNA, 15 nt, Staphylococcus aureus subsp. aureus N315
uaaagaauuaaguag

SEQ ID NO: 4054394 - RNA, 16 nt, Staphylococcus aureus subsp. aureus N315
uaaagaauuaaguagu

SEQ ID NO: 4054395 - RNA, 15 nt, Staphylococcus aureus subsp. aureus N315
uaaagacaccuucaa

SEQ ID NO: 4054396 - RNA, 15 nt, Staphylococcus aureus subsp. aureus N315
uaaagagcaauuaaa

SEQ ID NO: 4054397 - RNA, 16 nt, Staphylococcus aureus subsp. aureus N315
uaaagagcaauuaaag

SEQ ID NO: 4054398 - RNA, 21 nt, Staphylococcus aureus subsp. aureus N315
uaaagaguuauguuugucguu

SEQ ID NO: 4054399 - RNA, 18 nt, Staphylococcus aureus subsp. aureus N315
uaaagaugucgaaaagua

SEQ ID NO: 4054400 - RNA, 16 nt, Staphylococcus aureus subsp. aureus N315
uaaagauuaaaauaug

SEQ ID NO: 4054401 - RNA, 18 nt, Staphylococcus aureus subsp. aureus N315
uaaagauuaaaauaugac

SEQ ID NO: 4054402 - RNA, 22 nt, Staphylococcus aureus subsp. aureus N315
uaaagauuauuauuacaaugaa

SEQ ID NO: 4054403 - RNA, 14 nt, Staphylococcus aureus subsp. aureus N315
uaaagauuuaaguc

SEQ ID NO: 4054404 - RNA, 17 nt, Staphylococcus aureus subsp. aureus N315
uaaagauuuacccauua

SEQ ID NO: 4054405 - RNA, 16 nt, Staphylococcus aureus subsp. aureus N315
uaaagcaauguugcau

SEQ ID NO: 4054406 - RNA, 16 nt, Staphylococcus aureus subsp. aureus N315
uaaagcauaucucaag

SEQ ID NO: 4054407 - RNA, 20 nt, Staphylococcus aureus subsp. aureus N315
uaaagcauaucucaagauau

SEQ ID NO: 4054408 - RNA, 19 nt, Staphylococcus aureus subsp. aureus N315
uaaagccaccuaaaucucc

SEQ ID NO: 4054409 - RNA, 16 nt, Staphylococcus aureus subsp. aureus N315
uaaagcgauuuccauc

SEQ ID NO: 4054410 - RNA, 21 nt, Staphylococcus aureus subsp. aureus N315
uaaagcguucucuaauuucac

SEQ ID NO: 4054411 - RNA, 15 nt, Staphylococcus aureus subsp. aureus N315
uaaagcuaaugcaag

SEQ ID NO: 4054412 - RNA, 23 nt, Staphylococcus aureus subsp. aureus N315
uaaagcuagggugaauuaguaaa

SEQ ID NO: 4054413 - RNA, 17 nt, Staphylococcus aureus subsp. aureus N315
uaaagcugauuuuucau

SEQ ID NO: 4054414 - RNA, 15 nt, Staphylococcus aureus subsp. aureus N315
uaaagcugcaauuau

SEQ ID NO: 4054415 - RNA, 21 nt, Staphylococcus aureus subsp. aureus N315
uaaagcugcaauuaugccaac

SEQ ID NO: 4054416 - RNA, 18 nt, Staphylococcus aureus subsp. aureus N315
uaaagcugcgauauaacu

SEQ ID NO: 4054417 - RNA, 22 nt, Staphylococcus aureus subsp. aureus N315
uaaaggaauagcuacaauuaaa

SEQ ID NO: 4054418 - RNA, 19 nt, Staphylococcus aureus subsp. aureus N315
uaaagggcuauuugauaca

SEQ ID NO: 4054419 - RNA, 22 nt, Staphylococcus aureus subsp. aureus N315
uaaaggguguuuagauagcucu

SEQ ID NO: 4054420 - RNA, 15 nt, Staphylococcus aureus subsp. aureus N315
uaaagguaccacugu

SEQ ID NO: 4054421 - RNA, 15 nt, Staphylococcus aureus subsp. aureus N315
uaaaguaaaauauac

SEQ ID NO: 4054422 - RNA, 21 nt, Staphylococcus aureus subsp. aureus N315
uaaaguauaagguugaagaag

SEQ ID NO: 4054423 - RNA, 16 nt, Staphylococcus aureus subsp. aureus N315
uaaaguauguugucau

SEQ ID NO: 4054424 - RNA, 17 nt, Staphylococcus aureus subsp. aureus N315
uaaaguauguugucaua

SEQ ID NO: 4054425 - RNA, 18 nt, Staphylococcus aureus subsp. aureus N315
uaaagucaauuuaaauaa

SEQ ID NO: 4054426 - RNA, 23 nt, Staphylococcus aureus subsp. aureus N315
uaaagucuucaucuuuaaagaaa

SEQ ID NO: 4054427 - RNA, 17 nt, Staphylococcus aureus subsp. aureus N315
uaaaguguuucaacaua

SEQ ID NO: 4054428 - RNA, 14 nt, Staphylococcus aureus subsp. aureus N315
uaaaguuaaagacu

SEQ ID NO: 4054429 - RNA, 19 nt, Staphylococcus aureus subsp. aureus N315
uaaaguuccaaguuaaugc

SEQ ID NO: 4054430 - RNA, 15 nt, Staphylococcus aureus subsp. aureus N315
uaaaguuuaaauauu

SEQ ID NO: 4054431 - RNA, 19 nt, Staphylococcus aureus subsp. aureus N315
uaaaguuuaaauauucacg

SEQ ID NO: 4054432 - RNA, 15 nt, Staphylococcus aureus subsp. aureus N315
uaaaguuuauuuaug

SEQ ID NO: 4054433 - RNA, 21 nt, Staphylococcus aureus subsp. aureus N315
uaaaguuuugaaccuaaauuc

SEQ ID NO: 4054434 - RNA, 20 nt, Staphylococcus aureus subsp. aureus N315
uaaauaaaaauuauauaaau

SEQ ID NO: 4054435 - RNA, 15 nt, Staphylococcus aureus subsp. aureus N315
uaaauaaaacuaucu

SEQ ID NO: 4054436 - RNA, 18 nt, Staphylococcus aureus subsp. aureus N315
uaaauaaaaggcauucuu

SEQ ID NO: 4054437 - RNA, 15 nt, Staphylococcus aureus subsp. aureus N315
uaaauaaaaguucaa

SEQ ID NO: 4054438 - RNA, 14 nt, Staphylococcus aureus subsp. aureus N315
uaaauaaaaugcau

SEQ ID NO: 4054439 - RNA, 13 nt, Staphylococcus aureus subsp. aureus N315
uaaauaaaaugcu

SEQ ID NO: 4054440 - RNA, 14 nt, Staphylococcus aureus subsp. aureus N315
uaaauaaaauuguu

SEQ ID NO: 4054441 - RNA, 11 nt, Staphylococcus aureus subsp. aureus N315
uaaauaaacaa

SEQ ID NO: 4054442 - RNA, 16 nt, Staphylococcus aureus subsp. aureus N315
uaaauaaacucaccaa

SEQ ID NO: 4054443 - RNA, 21 nt, Staphylococcus aureus subsp. aureus N315
uaaauaacuucguuuuaauaa

SEQ ID NO: 4054444 - RNA, 19 nt, Staphylococcus aureus subsp. aureus N315
uaaauaacuuuuuaaagga

SEQ ID NO: 4054445 - RNA, 12 nt, Staphylococcus aureus subsp. aureus N315
uaaauaaguagu

SEQ ID NO: 4054446 - RNA, 17 nt, Staphylococcus aureus subsp. aureus N315
uaaauaagugauaaaua

SEQ ID NO: 4054447 - RNA, 19 nt, Staphylococcus aureus subsp. aureus N315
uaaauaagugauaaauaau

SEQ ID NO: 4054448 - RNA, 19 nt, Staphylococcus aureus subsp. aureus N315
uaaauaaucgaagauagag

SEQ ID NO: 4054449 - RNA, 20 nt, Staphylococcus aureus subsp. aureus N315
uaaauaaugauaaauuaaag

SEQ ID NO: 4054450 - RNA, 18 nt, Staphylococcus aureus subsp. aureus N315
uaaauaaugcauggaaaa

SEQ ID NO: 4054451 - RNA, 14 nt, Staphylococcus aureus subsp. aureus N315
uaaauaauuucuca

SEQ ID NO: 4054452 - RNA, 14 nt, Staphylococcus aureus subsp. aureus N315
uaaauacaaaaaua

SEQ ID NO: 4054453 - RNA, 17 nt, Staphylococcus aureus subsp. aureus N315
uaaauacaaaaauauag

SEQ ID NO: 4054454 - RNA, 19 nt, Staphylococcus aureus subsp. aureus N315
uaaauacaaaaauauagcu

SEQ ID NO: 4054455 - RNA, 16 nt, Staphylococcus aureus subsp. aureus N315
uaaauacaauguuauu

SEQ ID NO: 4054456 - RNA, 17 nt, Staphylococcus aureus subsp. aureus N315
uaaauacaauuucuuca

SEQ ID NO: 4054457 - RNA, 13 nt, Staphylococcus aureus subsp. aureus N315
uaaauacaucgga

SEQ ID NO: 4054458 - RNA, 19 nt, Staphylococcus aureus subsp. aureus N315
uaaauacgccaaauaucag

SEQ ID NO: 4054459 - RNA, 15 nt, Staphylococcus aureus subsp. aureus N315
uaaauagcaaagucu

SEQ ID NO: 4054460 - RNA, 13 nt, Staphylococcus aureus subsp. aureus N315
uaaauaggaugaa

SEQ ID NO: 4054461 - RNA, 19 nt, Staphylococcus aureus subsp. aureus N315
uaaauaggaugaaaaagau

SEQ ID NO: 4054462 - RNA, 19 nt, Staphylococcus aureus subsp. aureus N315
uaaauaggugauuauauau

SEQ ID NO: 4054463 - RNA, 16 nt, Staphylococcus aureus subsp. aureus N315
uaaauaguuuuucaua

SEQ ID NO: 4054464 - RNA, 20 nt, Staphylococcus aureus subsp. aureus N315
uaaauaguuuuucauauuca

SEQ ID NO: 4054465 - RNA, 14 nt, Staphylococcus aureus subsp. aureus N315
uaaauauaaaaagu

SEQ ID NO: 4054466 - RNA, 20 nt, Staphylococcus aureus subsp. aureus N315
uaaauauaaaccagcugauu

SEQ ID NO: 4054467 - RNA, 22 nt, Staphylococcus aureus subsp. aureus N315
uaaauauaauagaaauaaucac

SEQ ID NO: 4054468 - RNA, 17 nt, Staphylococcus aureus subsp. aureus N315
uaaauauaguaauaaaa

SEQ ID NO: 4054469 - RNA, 16 nt, Staphylococcus aureus subsp. aureus N315
uaaauaucauaaaugc

SEQ ID NO: 4054470 - RNA, 20 nt, Staphylococcus aureus subsp. aureus N315
uaaauaucauaaaugcauac

SEQ ID NO: 4054471 - RNA, 21 nt, Staphylococcus aureus subsp. aureus N315
uaaauaucauaccguacaaag

SEQ ID NO: 4054472 - RNA, 16 nt, Staphylococcus aureus subsp. aureus N315
uaaauaucaugcaaaa

SEQ ID NO: 4054473 - RNA, 13 nt, Staphylococcus aureus subsp. aureus N315
uaaauaugaaucu

SEQ ID NO: 4054474 - RNA, 21 nt, Staphylococcus aureus subsp. aureus N315
uaaauaugacgcgugaauuaa

SEQ ID NO: 4054475 - RNA, 19 nt, Staphylococcus aureus subsp. aureus N315
uaaauaugauguuaaaaaa

SEQ ID NO: 4054476 - RNA, 13 nt, Staphylococcus aureus subsp. aureus N315
uaaauauugaaca

SEQ ID NO: 4054477 - RNA, 13 nt, Staphylococcus aureus subsp. aureus N315
uaaauauugaaga

SEQ ID NO: 4054478 - RNA, 19 nt, Staphylococcus aureus subsp. aureus N315
uaaauauugauauaaaaaa

SEQ ID NO: 4054479 - RNA, 18 nt, Staphylococcus aureus subsp. aureus N315
uaaauauuggaauacucu

SEQ ID NO: 4054480 - RNA, 19 nt, Staphylococcus aureus subsp. aureus N315
uaaauauuggaauacucuu

SEQ ID NO: 4054481 - RNA, 22 nt, Staphylococcus aureus subsp. aureus N315
uaaauauuggaauacucuucaa

SEQ ID NO: 4054482 - RNA, 13 nt, Staphylococcus aureus subsp. aureus N315
uaaauauuuaauu

SEQ ID NO: 4054483 - RNA, 18 nt, Staphylococcus aureus subsp. aureus N315
uaaauauuuaauuggauu

SEQ ID NO: 4054484 - RNA, 15 nt, Staphylococcus aureus subsp. aureus N315
uaaauauuuuuaauu

SEQ ID NO: 4054485 - RNA, 16 nt, Staphylococcus aureus subsp. aureus N315
uaaauauuuuuaauua

SEQ ID NO: 4054486 - RNA, 16 nt, Staphylococcus aureus subsp. aureus N315
uaaauauuuuuuaaaa

SEQ ID NO: 4054487 - RNA, 12 nt, Staphylococcus aureus subsp. aureus N315
uaaaucaaagag

SEQ ID NO: 4054488 - RNA, 14 nt, Staphylococcus aureus subsp. aureus N315
uaaaucaaagcuau

SEQ ID NO: 4054489 - RNA, 22 nt, Staphylococcus aureus subsp. aureus N315
uaaaucaaagggcuucgauuca

SEQ ID NO: 4054490 - RNA, 14 nt, Staphylococcus aureus subsp. aureus N315
uaaaucaacaagaa

SEQ ID NO: 4054491 - RNA, 14 nt, Staphylococcus aureus subsp. aureus N315
uaaaucaagaaaug

SEQ ID NO: 4054492 - RNA, 17 nt, Staphylococcus aureus subsp. aureus N315
uaaaucaagaaauguua

SEQ ID NO: 4054493 - RNA, 21 nt, Staphylococcus aureus subsp. aureus N315
uaaaucacauaugauaauuaa

SEQ ID NO: 4054494 - RNA, 14 nt, Staphylococcus aureus subsp. aureus N315
uaaaucaccaacaa

SEQ ID NO: 4054495 - RNA, 20 nt, Staphylococcus aureus subsp. aureus N315
uaaaucacgauuuucaagua

SEQ ID NO: 4054496 - RNA, 23 nt, Staphylococcus aureus subsp. aureus N315
uaaaucacgccauaaucuucauu

SEQ ID NO: 4054497 - RNA, 18 nt, Staphylococcus aureus subsp. aureus N315
uaaaucacugcuuucaag

SEQ ID NO: 4054498 - RNA, 22 nt, Staphylococcus aureus subsp. aureus N315
uaaaucacugcuuucaaguaau

SEQ ID NO: 4054499 - RNA, 15 nt, Staphylococcus aureus subsp. aureus N315
uaaaucaguaguuuu

SEQ ID NO: 4054500 - RNA, 22 nt, Staphylococcus aureus subsp. aureus N315
uaaaucauacgagaaauuagaa

SEQ ID NO: 4054501 - RNA, 12 nt, Staphylococcus aureus subsp. aureus N315
uaaaucaucauu

SEQ ID NO: 4054502 - RNA, 14 nt, Staphylococcus aureus subsp. aureus N315
uaaaucaugacaua

SEQ ID NO: 4054503 - RNA, 12 nt, Staphylococcus aureus subsp. aureus N315
uaaaucauucuu

SEQ ID NO: 4054504 - RNA, 14 nt, Staphylococcus aureus subsp. aureus N315
uaaaucauucuuua

SEQ ID NO: 4054505 - RNA, 16 nt, Staphylococcus aureus subsp. aureus N315
uaaaucauuucguuca

SEQ ID NO: 4054506 - RNA, 23 nt, Staphylococcus aureus subsp. aureus N315
uaaaucauuucguucauauggca

SEQ ID NO: 4054507 - RNA, 21 nt, Staphylococcus aureus subsp. aureus N315
uaaaucccuaaaaaaacagca

SEQ ID NO: 4054508 - RNA, 20 nt, Staphylococcus aureus subsp. aureus N315
uaaaucgaauugauggaaaa

SEQ ID NO: 4054509 - RNA, 17 nt, Staphylococcus aureus subsp. aureus N315
uaaaucgauaaaaugua

SEQ ID NO: 4054510 - RNA, 14 nt, Staphylococcus aureus subsp. aureus N315
uaaaucgauaacag

SEQ ID NO: 4054511 - RNA, 16 nt, Staphylococcus aureus subsp. aureus N315
uaaaucgggcaaccuc

SEQ ID NO: 4054512 - RNA, 22 nt, Staphylococcus aureus subsp. aureus N315
uaaaucuaauacuuucaaacaa

SEQ ID NO: 4054513 - RNA, 16 nt, Staphylococcus aureus subsp. aureus N315
uaaaucuacuacuaau

SEQ ID NO: 4054514 - RNA, 22 nt, Staphylococcus aureus subsp. aureus N315
uaaaucuauauaaaguugacaa

SEQ ID NO: 4054515 - RNA, 20 nt, Staphylococcus aureus subsp. aureus N315
uaaaucuccauuaaucauuu

SEQ ID NO: 4054516 - RNA, 16 nt, Staphylococcus aureus subsp. aureus N315
uaaaucuguuuaaauu

SEQ ID NO: 4054517 - RNA, 19 nt, Staphylococcus aureus subsp. aureus N315
uaaaucuguuuaaauuuaa

SEQ ID NO: 4054518 - RNA, 13 nt, Staphylococcus aureus subsp. aureus N315
uaaaucuucauca

SEQ ID NO: 4054519 - RNA, 20 nt, Staphylococcus aureus subsp. aureus N315
uaaaucuuguuggauuuuaa

SEQ ID NO: 4054520 - RNA, 20 nt, Staphylococcus aureus subsp. aureus N315
uaaaucuuuaacuucugauu

SEQ ID NO: 4054521 - RNA, 20 nt, Staphylococcus aureus subsp. aureus N315
uaaaucuuuuacuaaaugaa

SEQ ID NO: 4054522 - RNA, 23 nt, Staphylococcus aureus subsp. aureus N315
uaaaugaaaguaccuaaaauaga

SEQ ID NO: 4054523 - RNA, 16 nt, Staphylococcus aureus subsp. aureus N315
uaaaugaauuauuuaa

SEQ ID NO: 4054524 - RNA, 15 nt, Staphylococcus aureus subsp. aureus N315
uaaaugacauuuaau

SEQ ID NO: 4054525 - RNA, 18 nt, Staphylococcus aureus subsp. aureus N315
uaaaugaccuuuacgcca

SEQ ID NO: 4054526 - RNA, 16 nt, Staphylococcus aureus subsp. aureus N315
uaaaugacuucacauu

SEQ ID NO: 4054527 - RNA, 21 nt, Staphylococcus aureus subsp. aureus N315
uaaaugacuucacauuuaucc

SEQ ID NO: 4054528 - RNA, 23 nt, Staphylococcus aureus subsp. aureus N315
uaaaugauggguaguuaauauaa

SEQ ID NO: 4054529 - RNA, 12 nt, Staphylococcus aureus subsp. aureus N315
uaaaugauuuaa

SEQ ID NO: 4054530 - RNA, 12 nt, Staphylococcus aureus subsp. aureus N315
uaaaugauuuau

SEQ ID NO: 4054531 - RNA, 22 nt, Staphylococcus aureus subsp. aureus N315
uaaaugcaauacauuaauauaa

SEQ ID NO: 4054532 - RNA, 21 nt, Staphylococcus aureus subsp. aureus N315
uaaaugcacgagcaacaucuu

SEQ ID NO: 4054533 - RNA, 20 nt, Staphylococcus aureus subsp. aureus N315
uaaaugcccaccauguacau

SEQ ID NO: 4054534 - RNA, 21 nt, Staphylococcus aureus subsp. aureus N315
uaaaugcuuaauuuguuuuaa

SEQ ID NO: 4054535 - RNA, 22 nt, Staphylococcus aureus subsp. aureus N315
uaaaugcuuaauuuguuuuaaa

SEQ ID NO: 4054536 - RNA, 21 nt, Staphylococcus aureus subsp. aureus N315
uaaaugcuucugguucuucaa

SEQ ID NO: 4054537 - RNA, 18 nt, Staphylococcus aureus subsp. aureus N315
uaaauggugucgauacuc

SEQ ID NO: 4054538 - RNA, 12 nt, Staphylococcus aureus subsp. aureus N315
uaaauguaucac

SEQ ID NO: 4054539 - RNA, 19 nt, Staphylococcus aureus subsp. aureus N315
uaaaugucacugcaaacac

SEQ ID NO: 4054540 - RNA, 17 nt, Staphylococcus aureus subsp. aureus N315
uaaaugucuuucaaaua

SEQ ID NO: 4054541 - RNA, 20 nt, Staphylococcus aureus subsp. aureus N315
uaaaugucuuucaaauacac

SEQ ID NO: 4054542 - RNA, 21 nt, Staphylococcus aureus subsp. aureus N315
uaaaugucuuucaaauacaca

SEQ ID NO: 4054543 - RNA, 13 nt, Staphylococcus aureus subsp. aureus N315
uaaaugugacuuu

SEQ ID NO: 4054544 - RNA, 16 nt, Staphylococcus aureus subsp. aureus N315
uaaaugugacuuuaaa

SEQ ID NO: 4054545 - RNA, 18 nt, Staphylococcus aureus subsp. aureus N315
uaaauguuaaauucuaaa

SEQ ID NO: 4054546 - RNA, 19 nt, Staphylococcus aureus subsp. aureus N315
uaaauguuaaauucuaaaa

SEQ ID NO: 4054547 - RNA, 19 nt, Staphylococcus aureus subsp. aureus N315
uaaauguuauuaaccauca

SEQ ID NO: 4054548 - RNA, 16 nt, Staphylococcus aureus subsp. aureus N315
uaaauguuuauaucuu

SEQ ID NO: 4054549 - RNA, 19 nt, Staphylococcus aureus subsp. aureus N315
uaaauguuuauaucuuuua

SEQ ID NO: 4054550 - RNA, 22 nt, Staphylococcus aureus subsp. aureus N315
uaaauguuuuauguauuuauuu

SEQ ID NO: 4054551 - RNA, 13 nt, Staphylococcus aureus subsp. aureus N315
uaaauuaaaugca

SEQ ID NO: 4054552 - RNA, 21 nt, Staphylococcus aureus subsp. aureus N315
uaaauuaagcaugacacucau

SEQ ID NO: 4054553 - RNA, 14 nt, Staphylococcus aureus subsp. aureus N315
uaaauuaauagaga

SEQ ID NO: 4054554 - RNA, 13 nt, Staphylococcus aureus subsp. aureus N315
uaaauuacuauau

SEQ ID NO: 4054555 - RNA, 15 nt, Staphylococcus aureus subsp. aureus N315
uaaauuacuauauuu

SEQ ID NO: 4054556 - RNA, 19 nt, Staphylococcus aureus subsp. aureus N315
uaaauuacucaauuugaag

SEQ ID NO: 4054557 - RNA, 18 nt, Staphylococcus aureus subsp. aureus N315
uaaauuagaugaaaugga

SEQ ID NO: 4054558 - RNA, 18 nt, Staphylococcus aureus subsp. aureus N315
uaaauuaucuaaagaaau

SEQ ID NO: 4054559 - RNA, 14 nt, Staphylococcus aureus subsp. aureus N315
uaaauuauuuaauu

SEQ ID NO: 4054560 - RNA, 18 nt, Staphylococcus aureus subsp. aureus N315
uaaauucaaaucuggcac

SEQ ID NO: 4054561 - RNA, 16 nt, Staphylococcus aureus subsp. aureus N315
uaaauucaauaaucuu

SEQ ID NO: 4054562 - RNA, 20 nt, Staphylococcus aureus subsp. aureus N315
uaaauuccaagagaauuaau

SEQ ID NO: 4054563 - RNA, 22 nt, Staphylococcus aureus subsp. aureus N315
uaaauuccaagagaauuaauaa

SEQ ID NO: 4054564 - RNA, 22 nt, Staphylococcus aureus subsp. aureus N315
uaaauucccauguauucuuaga

SEQ ID NO: 4054565 - RNA, 16 nt, Staphylococcus aureus subsp. aureus N315
uaaauucuaaaacgga

SEQ ID NO: 4054566 - RNA, 14 nt, Staphylococcus aureus subsp. aureus N315
uaaauugaaauguu

SEQ ID NO: 4054567 - RNA, 23 nt, Staphylococcus aureus subsp. aureus N315
uaaauugacucaaagauauacuu

SEQ ID NO: 4054568 - RNA, 21 nt, Staphylococcus aureus subsp. aureus N315
uaaauugagcaacucaggaau

SEQ ID NO: 4054569 - RNA, 22 nt, Staphylococcus aureus subsp. aureus N315
uaaauugaguuuuuuaaaauaa

SEQ ID NO: 4054570 - RNA, 19 nt, Staphylococcus aureus subsp. aureus N315
uaaauuguaugaauaauau

SEQ ID NO: 4054571 - RNA, 15 nt, Staphylococcus aureus subsp. aureus N315
uaaauuguguuucuu

SEQ ID NO: 4054572 - RNA, 16 nt, Staphylococcus aureus subsp. aureus N315
uaaauuguguuucuuu

SEQ ID NO: 4054573 - RNA, 20 nt, Staphylococcus aureus subsp. aureus N315
uaaauuguguuucuuucaua

SEQ ID NO: 4054574 - RNA, 17 nt, Staphylococcus aureus subsp. aureus N315
uaaauuguuuacuauac

SEQ ID NO: 4054575 - RNA, 19 nt, Staphylococcus aureus subsp. aureus N315
uaaauuguuuacuauacuu

SEQ ID NO: 4054576 - RNA, 14 nt, Staphylococcus aureus subsp. aureus N315
uaaauuguuuuaca

SEQ ID NO: 4054577 - RNA, 17 nt, Staphylococcus aureus subsp. aureus N315
uaaauuuaaaagaaaaa

SEQ ID NO: 4054578 - RNA, 17 nt, Staphylococcus aureus subsp. aureus N315
uaaauuuaaaauaauag

SEQ ID NO: 4054579 - RNA, 16 nt, Staphylococcus aureus subsp. aureus N315
uaaauuuaaauguguu

SEQ ID NO: 4054580 - RNA, 18 nt, Staphylococcus aureus subsp. aureus N315
uaaauuuaacguuauuca

SEQ ID NO: 4054581 - RNA, 19 nt, Staphylococcus aureus subsp. aureus N315
uaaauuuaccauaaccuuc

SEQ ID NO: 4054582 - RNA, 16 nt, Staphylococcus aureus subsp. aureus N315
uaaauuuacgaaagua

SEQ ID NO: 4054583 - RNA, 19 nt, Staphylococcus aureus subsp. aureus N315
uaaauuuagauauuauaaa

SEQ ID NO: 4054584 - RNA, 14 nt, Staphylococcus aureus subsp. aureus N315
uaaauuuaguaucu

SEQ ID NO: 4054585 - RNA, 16 nt, Staphylococcus aureus subsp. aureus N315
uaaauuuauuuuuaau

SEQ ID NO: 4054586 - RNA, 17 nt, Staphylococcus aureus subsp. aureus N315
uaaauuuauuuuuaauu

SEQ ID NO: 4054587 - RNA, 15 nt, Staphylococcus aureus subsp. aureus N315
uaaauuugaaaguaa

SEQ ID NO: 4054588 - RNA, 19 nt, Staphylococcus aureus subsp. aureus N315
uaaauuuguaccaaauaaa

SEQ ID NO: 4054589 - RNA, 18 nt, Staphylococcus aureus subsp. aureus N315
uaaauuuuacgaaaauau

SEQ ID NO: 4054590 - RNA, 20 nt, Staphylococcus aureus subsp. aureus N315
uaaauuuuacgaaaauauca

SEQ ID NO: 4054591 - RNA, 17 nt, Staphylococcus aureus subsp. aureus N315
uaaauuuuauauauccu

SEQ ID NO: 4054592 - RNA, 18 nt, Staphylococcus aureus subsp. aureus N315
uaaauuuuauauauccug

SEQ ID NO: 4054593 - RNA, 12 nt, Staphylococcus aureus subsp. aureus N315
uaaauuuucauc

SEQ ID NO: 4054594 - RNA, 14 nt, Staphylococcus aureus subsp. aureus N315
uaaauuuucaucau

SEQ ID NO: 4054595 - RNA, 20 nt, Staphylococcus aureus subsp. aureus N315
uaaauuuucuguuuaauuaa

SEQ ID NO: 4054596 - RNA, 21 nt, Staphylococcus aureus subsp. aureus N315
uaaauuuucuguuuaauuaaa

SEQ ID NO: 4054597 - RNA, 22 nt, Staphylococcus aureus subsp. aureus N315
uaaauuuucuguuuaauuaaaa

SEQ ID NO: 4054598 - RNA, 17 nt, Staphylococcus aureus subsp. aureus N315
uaaauuuugaauuacag

SEQ ID NO: 4054599 - RNA, 21 nt, Staphylococcus aureus subsp. aureus N315
uaaauuuugcgaaaauaucau

SEQ ID NO: 4054600 - RNA, 23 nt, Staphylococcus aureus subsp. aureus N315
uaaauuuugcgaaaauaucauuu

SEQ ID NO: 4054601 - RNA, 15 nt, Staphylococcus aureus subsp. aureus N315
uaaauuuuguuagga

SEQ ID NO: 4054602 - RNA, 20 nt, Staphylococcus aureus subsp. aureus N315
uaacaaaauuaagaagaaau

SEQ ID NO: 4054603 - RNA, 21 nt, Staphylococcus aureus subsp. aureus N315
uaacaaaauuaagaagaaaua

SEQ ID NO: 4054604 - RNA, 13 nt, Staphylococcus aureus subsp. aureus N315
uaacaaacauuaa

SEQ ID NO: 4054605 - RNA, 17 nt, Staphylococcus aureus subsp. aureus N315
uaacaaacauuaaucua

SEQ ID NO: 4054606 - RNA, 23 nt, Staphylococcus aureus subsp. aureus N315
uaacaaacauuaaucuauauaaa

SEQ ID NO: 4054607 - RNA, 13 nt, Staphylococcus aureus subsp. aureus N315
uaacaaagucucu

SEQ ID NO: 4054608 - RNA, 14 nt, Staphylococcus aureus subsp. aureus N315
uaacaaauuagaau

SEQ ID NO: 4054609 - RNA, 17 nt, Staphylococcus aureus subsp. aureus N315
uaacaacacuacccaca

SEQ ID NO: 4054610 - RNA, 20 nt, Staphylococcus aureus subsp. aureus N315
uaacaagaaguaauguuaaa

SEQ ID NO: 4054611 - RNA, 12 nt, Staphylococcus aureus subsp. aureus N315
uaacaagcauuu

SEQ ID NO: 4054612 - RNA, 23 nt, Staphylococcus aureus subsp. aureus N315
uaacaagcauuuuucaauuauag

SEQ ID NO: 4054613 - RNA, 18 nt, Staphylococcus aureus subsp. aureus N315
uaacaaggccugcaucac

SEQ ID NO: 4054614 - RNA, 17 nt, Staphylococcus aureus subsp. aureus N315
uaacaaguacaauaaua

SEQ ID NO: 4054615 - RNA, 13 nt, Staphylococcus aureus subsp. aureus N315
uaacaaguauaaa

SEQ ID NO: 4054616 - RNA, 16 nt, Staphylococcus aureus subsp. aureus N315
uaacaaguauaaaugc

SEQ ID NO: 4054617 - RNA, 16 nt, Staphylococcus aureus subsp. aureus N315
uaacaauaacaccugu

SEQ ID NO: 4054618 - RNA, 19 nt, Staphylococcus aureus subsp. aureus N315
uaacaauaguuuucuucac

SEQ ID NO: 4054619 - RNA, 17 nt, Staphylococcus aureus subsp. aureus N315
uaacaaucguuuuaaug

SEQ ID NO: 4054620 - RNA, 23 nt, Staphylococcus aureus subsp. aureus N315
uaacaaugcagcuguauuuaaua

SEQ ID NO: 4054621 - RNA, 13 nt, Staphylococcus aureus subsp. aureus N315
uaacaaugcgauu

SEQ ID NO: 4054622 - RNA, 21 nt, Staphylococcus aureus subsp. aureus N315
uaacaauuacgacaagaauua

SEQ ID NO: 4054623 - RNA, 16 nt, Staphylococcus aureus subsp. aureus N315
uaacaauuuauuaaaa

SEQ ID NO: 4054624 - RNA, 17 nt, Staphylococcus aureus subsp. aureus N315
uaacaauuuauuaaaac

SEQ ID NO: 4054625 - RNA, 22 nt, Staphylococcus aureus subsp. aureus N315
uaacaauuuauuaaaacgaagu

SEQ ID NO: 4054626 - RNA, 13 nt, Staphylococcus aureus subsp. aureus N315
uaacaauuuuaaa

SEQ ID NO: 4054627 - RNA, 15 nt, Staphylococcus aureus subsp. aureus N315
uaacaauuuuaucug

SEQ ID NO: 4054628 - RNA, 19 nt, Staphylococcus aureus subsp. aureus N315
uaacaccaauuaaaucgau

SEQ ID NO: 4054629 - RNA, 17 nt, Staphylococcus aureus subsp. aureus N315
uaacaccaauugaauau

SEQ ID NO: 4054630 - RNA, 14 nt, Staphylococcus aureus subsp. aureus N315
uaacacgaacugca

SEQ ID NO: 4054631 - RNA, 20 nt, Staphylococcus aureus subsp. aureus N315
uaacacugccggcgcacuua

SEQ ID NO: 4054632 - RNA, 15 nt, Staphylococcus aureus subsp. aureus N315
uaacagcuaaaaauu

SEQ ID NO: 4054633 - RNA, 18 nt, Staphylococcus aureus subsp. aureus N315
uaacagcuacaaauaaug

SEQ ID NO: 4054634 - RNA, 23 nt, Staphylococcus aureus subsp. aureus N315
uaacagcugcagucgcaauggca

SEQ ID NO: 4054635 - RNA, 21 nt, Staphylococcus aureus subsp. aureus N315
uaacaggugcuuacuuuuaaa

SEQ ID NO: 4054636 - RNA, 15 nt, Staphylococcus aureus subsp. aureus N315
uaacauaaaaugagu

SEQ ID NO: 4054637 - RNA, 17 nt, Staphylococcus aureus subsp. aureus N315
uaacauacuauaaaaau

SEQ ID NO: 4054638 - RNA, 21 nt, Staphylococcus aureus subsp. aureus N315
uaacauacuauaaaaauuuau

SEQ ID NO: 4054639 - RNA, 15 nt, Staphylococcus aureus subsp. aureus N315
uaacauaucagcuuu

SEQ ID NO: 4054640 - RNA, 20 nt, Staphylococcus aureus subsp. aureus N315
uaacauaucgucaauuuuaa

SEQ ID NO: 4054641 - RNA, 22 nt, Staphylococcus aureus subsp. aureus N315
uaacaucaaauagacaccaaaa

SEQ ID NO: 4054642 - RNA, 20 nt, Staphylococcus aureus subsp. aureus N315
uaacaucacauaaaauacau

SEQ ID NO: 4054643 - RNA, 21 nt, Staphylococcus aureus subsp. aureus N315
uaacaucacauaaaauacauu

SEQ ID NO: 4054644 - RNA, 21 nt, Staphylococcus aureus subsp. aureus N315
uaacauccccaaaaauagauu

SEQ ID NO: 4054645 - RNA, 20 nt, Staphylococcus aureus subsp. aureus N315
uaacauccugcuuauuaauu

SEQ ID NO: 4054646 - RNA, 14 nt, Staphylococcus aureus subsp. aureus N315
uaacaucuaaauuu

SEQ ID NO: 4054647 - RNA, 21 nt, Staphylococcus aureus subsp. aureus N315
uaacaucuucauguaugaagu

SEQ ID NO: 4054648 - RNA, 23 nt, Staphylococcus aureus subsp. aureus N315
uaacauguauuuaguaucaugau

SEQ ID NO: 4054649 - RNA, 19 nt, Staphylococcus aureus subsp. aureus N315
uaacaugugcaaguauaau

SEQ ID NO: 4054650 - RNA, 21 nt, Staphylococcus aureus subsp. aureus N315
uaacaugugcaaguauaaucc

SEQ ID NO: 4054651 - RNA, 13 nt, Staphylococcus aureus subsp. aureus N315
uaacauuauuaaa

SEQ ID NO: 4054652 - RNA, 18 nt, Staphylococcus aureus subsp. aureus N315
uaacauucuucaaaaaau

SEQ ID NO: 4054653 - RNA, 19 nt, Staphylococcus aureus subsp. aureus N315
uaacauucuucaaaaaaua

SEQ ID NO: 4054654 - RNA, 13 nt, Staphylococcus aureus subsp. aureus N315
uaacauuugucau

SEQ ID NO: 4054655 - RNA, 14 nt, Staphylococcus aureus subsp. aureus N315
uaacauuugucaua

SEQ ID NO: 4054656 - RNA, 22 nt, Staphylococcus aureus subsp. aureus N315
uaaccaaucaucgcaaauacau

SEQ ID NO: 4054657 - RNA, 21 nt, Staphylococcus aureus subsp. aureus N315
uaaccacaccaugcugcacau

SEQ ID NO: 4054658 - RNA, 18 nt, Staphylococcus aureus subsp. aureus N315
uaaccacuccuuaaacaa

SEQ ID NO: 4054659 - RNA, 18 nt, Staphylococcus aureus subsp. aureus N315
uaaccauaguaauaaaau

SEQ ID NO: 4054660 - RNA, 16 nt, Staphylococcus aureus subsp. aureus N315
uaaccaucauaaaugu

SEQ ID NO: 4054661 - RNA, 21 nt, Staphylococcus aureus subsp. aureus N315
uaaccauuaugauuaauccua

SEQ ID NO: 4054662 - RNA, 14 nt, Staphylococcus aureus subsp. aureus N315
uaaccauuuaaaaa

SEQ ID NO: 4054663 - RNA, 16 nt, Staphylococcus aureus subsp. aureus N315
uaaccauuuuuucaaa

SEQ ID NO: 4054664 - RNA, 14 nt, Staphylococcus aureus subsp. aureus N315
uaacccacauuaaa

SEQ ID NO: 4054665 - RNA, 15 nt, Staphylococcus aureus subsp. aureus N315
uaacccacauuaaau

SEQ ID NO: 4054666 - RNA, 16 nt, Staphylococcus aureus subsp. aureus N315
uaaccccuccuggugc

SEQ ID NO: 4054667 - RNA, 16 nt, Staphylococcus aureus subsp. aureus N315
uaacccuaaaaugaau

SEQ ID NO: 4054668 - RNA, 18 nt, Staphylococcus aureus subsp. aureus N315
uaacccuaaaaugaauag

SEQ ID NO: 4054669 - RNA, 15 nt, Staphylococcus aureus subsp. aureus N315
uaaccgaaauauugu

SEQ ID NO: 4054670 - RNA, 14 nt, Staphylococcus aureus subsp. aureus N315
uaaccgaugugauu

SEQ ID NO: 4054671 - RNA, 15 nt, Staphylococcus aureus subsp. aureus N315
uaaccgcauacagau

SEQ ID NO: 4054672 - RNA, 19 nt, Staphylococcus aureus subsp. aureus N315
uaaccgcuucuuuuaaguu

SEQ ID NO: 4054673 - RNA, 14 nt, Staphylococcus aureus subsp. aureus N315
uaaccuacuuugau

SEQ ID NO: 4054674 - RNA, 15 nt, Staphylococcus aureus subsp. aureus N315
uaaccuuguucuuua

SEQ ID NO: 4054675 - RNA, 19 nt, Staphylococcus aureus subsp. aureus N315
uaaccuuuaaaacaucauu

SEQ ID NO: 4054676 - RNA, 15 nt, Staphylococcus aureus subsp. aureus N315
uaaccuuuucaucag

SEQ ID NO: 4054677 - RNA, 18 nt, Staphylococcus aureus subsp. aureus N315
uaacgaguccauuuucuu

SEQ ID NO: 4054678 - RNA, 22 nt, Staphylococcus aureus subsp. aureus N315
uaacgagugaaaauaagauuau

SEQ ID NO: 4054679 - RNA, 22 nt, Staphylococcus aureus subsp. aureus N315
uaacgauaagcacgauaaaaau

SEQ ID NO: 4054680 - RNA, 21 nt, Staphylococcus aureus subsp. aureus N315
uaacgcucaugaguuucucau

SEQ ID NO: 4054681 - RNA, 12 nt, Staphylococcus aureus subsp. aureus N315
uaacggcucgcg

SEQ ID NO: 4054682 - RNA, 16 nt, Staphylococcus aureus subsp. aureus N315
uaacguacaauguauu

SEQ ID NO: 4054683 - RNA, 20 nt, Staphylococcus aureus subsp. aureus N315
uaacgucaacagcauaaaua

SEQ ID NO: 4054684 - RNA, 15 nt, Staphylococcus aureus subsp. aureus N315
uaacguuaauauaau

SEQ ID NO: 4054685 - RNA, 14 nt, Staphylococcus aureus subsp. aureus N315
uaacguuauucauu

SEQ ID NO: 4054686 - RNA, 15 nt, Staphylococcus aureus subsp. aureus N315
uaacguucacuuggu

SEQ ID NO: 4054687 - RNA, 15 nt, Staphylococcus aureus subsp. aureus N315
uaacguucuguuuug

SEQ ID NO: 4054688 - RNA, 20 nt, Staphylococcus aureus subsp. aureus N315
uaacguugcagagaauauag

SEQ ID NO: 4054689 - RNA, 21 nt, Staphylococcus aureus subsp. aureus N315
uaacguuucuuuguauaccua

SEQ ID NO: 4054690 - RNA, 13 nt, Staphylococcus aureus subsp. aureus N315
uaacuaaaauguc

SEQ ID NO: 4054691 - RNA, 21 nt, Staphylococcus aureus subsp. aureus N315
uaacuaaaaugucuuugaaaa

SEQ ID NO: 4054692 - RNA, 17 nt, Staphylococcus aureus subsp. aureus N315
uaacuaaaccauugaau

SEQ ID NO: 4054693 - RNA, 17 nt, Staphylococcus aureus subsp. aureus N315
uaacuagaaugauuaaa

SEQ ID NO: 4054694 - RNA, 17 nt, Staphylococcus aureus subsp. aureus N315
uaacuagcaaaugcacu

SEQ ID NO: 4054695 - RNA, 22 nt, Staphylococcus aureus subsp. aureus N315
uaacuauauugugcuaaguuag

SEQ ID NO: 4054696 - RNA, 14 nt, Staphylococcus aureus subsp. aureus N315
uaacuauggucauc

SEQ ID NO: 4054697 - RNA, 22 nt, Staphylococcus aureus subsp. aureus N315
uaacucaaauaucuaaacaauu

SEQ ID NO: 4054698 - RNA, 15 nt, Staphylococcus aureus subsp. aureus N315
uaacucaagugauuu

SEQ ID NO: 4054699 - RNA, 17 nt, Staphylococcus aureus subsp. aureus N315
uaacucaauaugauaau

SEQ ID NO: 4054700 - RNA, 20 nt, Staphylococcus aureus subsp. aureus N315
uaacucuaaauauaauagaa

SEQ ID NO: 4054701 - RNA, 16 nt, Staphylococcus aureus subsp. aureus N315
uaacucuuuguauaag

SEQ ID NO: 4054702 - RNA, 15 nt, Staphylococcus aureus subsp. aureus N315
uaacugaccuaacaa

SEQ ID NO: 4054703 - RNA, 14 nt, Staphylococcus aureus subsp. aureus N315
uaacugauaauacu

SEQ ID NO: 4054704 - RNA, 12 nt, Staphylococcus aureus subsp. aureus N315
uaacugauuuug

SEQ ID NO: 4054705 - RNA, 16 nt, Staphylococcus aureus subsp. aureus N315
uaacugcaaacuugau

SEQ ID NO: 4054706 - RNA, 21 nt, Staphylococcus aureus subsp. aureus N315
uaacugccauauagauauuag

SEQ ID NO: 4054707 - RNA, 20 nt, Staphylococcus aureus subsp. aureus N315
uaacuggcaaaucaaacaau

SEQ ID NO: 4054708 - RNA, 14 nt, Staphylococcus aureus subsp. aureus N315
uaacuguaaaacau

SEQ ID NO: 4054709 - RNA, 15 nt, Staphylococcus aureus subsp. aureus N315
uaacuguaaaacauu

SEQ ID NO: 4054710 - RNA, 22 nt, Staphylococcus aureus subsp. aureus N315
uaacugugauauuaauugaaaa

SEQ ID NO: 4054711 - RNA, 13 nt, Staphylococcus aureus subsp. aureus N315
uaacuguucuuuc

SEQ ID NO: 4054712 - RNA, 21 nt, Staphylococcus aureus subsp. aureus N315
uaacuguucuuucgucuugua

SEQ ID NO: 4054713 - RNA, 15 nt, Staphylococcus aureus subsp. aureus N315
uaacuguuuaucaug

SEQ ID NO: 4054714 - RNA, 15 nt, Staphylococcus aureus subsp. aureus N315
uaacuuacuuuugua

SEQ ID NO: 4054715 - RNA, 16 nt, Staphylococcus aureus subsp. aureus N315
uaacuucauaauauau

SEQ ID NO: 4054716 - RNA, 20 nt, Staphylococcus aureus subsp. aureus N315
uaacuucauaauauauccug

SEQ ID NO: 4054717 - RNA, 15 nt, Staphylococcus aureus subsp. aureus N315
uaacuuccuaaaauu

SEQ ID NO: 4054718 - RNA, 21 nt, Staphylococcus aureus subsp. aureus N315
uaacuucuauuaagaaauacu

SEQ ID NO: 4054719 - RNA, 20 nt, Staphylococcus aureus subsp. aureus N315
uaacuugaacagauucaccu

SEQ ID NO: 4054720 - RNA, 14 nt, Staphylococcus aureus subsp. aureus N315
uaacuuuaccaaua

SEQ ID NO: 4054721 - RNA, 18 nt, Staphylococcus aureus subsp. aureus N315
uaacuuuaccaauaucau

SEQ ID NO: 4054722 - RNA, 18 nt, Staphylococcus aureus subsp. aureus N315
uaacuuucagcaccagaa

SEQ ID NO: 4054723 - RNA, 22 nt, Staphylococcus aureus subsp. aureus N315
uaacuuuccgccuucaauccaa

SEQ ID NO: 4054724 - RNA, 22 nt, Staphylococcus aureus subsp. aureus N315
uaacuuucuaauuguuucauug

SEQ ID NO: 4054725 - RNA, 20 nt, Staphylococcus aureus subsp. aureus N315
uaacuuucuuuuguuuuuau

SEQ ID NO: 4054726 - RNA, 16 nt, Staphylococcus aureus subsp. aureus N315
uaacuuuuuaaaggac

SEQ ID NO: 4054727 - RNA, 23 nt, Staphylococcus aureus subsp. aureus N315
uaagaaaaauguguuaaaauaua

SEQ ID NO: 4054728 - RNA, 15 nt, Staphylococcus aureus subsp. aureus N315
uaagaaaauacuaac

SEQ ID NO: 4054729 - RNA, 15 nt, Staphylococcus aureus subsp. aureus N315
uaagaagaaauacuu

SEQ ID NO: 4054730 - RNA, 14 nt, Staphylococcus aureus subsp. aureus N315
uaagaagcuuucug

SEQ ID NO: 4054731 - RNA, 22 nt, Staphylococcus aureus subsp. aureus N315
uaagaauauuuaaguuuccuau

SEQ ID NO: 4054732 - RNA, 20 nt, Staphylococcus aureus subsp. aureus N315
uaagaauguacaauuuuuua

SEQ ID NO: 4054733 - RNA, 22 nt, Staphylococcus aureus subsp. aureus N315
uaagaaugugagauacguuauu

SEQ ID NO: 4054734 - RNA, 15 nt, Staphylococcus aureus subsp. aureus N315
uaagaauuaacaaca

SEQ ID NO: 4054735 - RNA, 13 nt, Staphylococcus aureus subsp. aureus N315
uaagaauuuaaaa

SEQ ID NO: 4054736 - RNA, 17 nt, Staphylococcus aureus subsp. aureus N315
uaagacagcuucucauu

SEQ ID NO: 4054737 - RNA, 22 nt, Staphylococcus aureus subsp. aureus N315
uaagacagcuucucauugaaau

SEQ ID NO: 4054738 - RNA, 14 nt, Staphylococcus aureus subsp. aureus N315
uaagacauaugcag

SEQ ID NO: 4054739 - RNA, 16 nt, Staphylococcus aureus subsp. aureus N315
uaagacauaugcagug

SEQ ID NO: 4054740 - RNA, 13 nt, Staphylococcus aureus subsp. aureus N315
uaagacgauuuca

SEQ ID NO: 4054741 - RNA, 16 nt, Staphylococcus aureus subsp. aureus N315
uaagacugauuaauua

SEQ ID NO: 4054742 - RNA, 24 nt, Staphylococcus aureus subsp. aureus N315
uaagacugccauucuuuuucucaa

SEQ ID NO: 4054743 - RNA, 16 nt, Staphylococcus aureus subsp. aureus N315
uaagaggagaaagcua

SEQ ID NO: 4054744 - RNA, 21 nt, Staphylococcus aureus subsp. aureus N315
uaagagucuucuuacugcaau

SEQ ID NO: 4054745 - RNA, 23 nt, Staphylococcus aureus subsp. aureus N315
uaagagucuucuuacugcaauua

SEQ ID NO: 4054746 - RNA, 18 nt, Staphylococcus aureus subsp. aureus N315
uaagauaacgagugaaaa

SEQ ID NO: 4054747 - RNA, 15 nt, Staphylococcus aureus subsp. aureus N315
uaagauaauuuucaa

SEQ ID NO: 4054748 - RNA, 18 nt, Staphylococcus aureus subsp. aureus N315
uaagauaauuuucaauua

SEQ ID NO: 4054749 - RNA, 21 nt, Staphylococcus aureus subsp. aureus N315
uaagauaauuuucaauuagaa

SEQ ID NO: 4054750 - RNA, 23 nt, Staphylococcus aureus subsp. aureus N315
uaagauaauuuucaauuagaaaa

SEQ ID NO: 4054751 - RNA, 14 nt, Staphylococcus aureus subsp. aureus N315
uaagauacaggcug

SEQ ID NO: 4054752 - RNA, 18 nt, Staphylococcus aureus subsp. aureus N315
uaagauagauaaaucaag

SEQ ID NO: 4054753 - RNA, 20 nt, Staphylococcus aureus subsp. aureus N315
uaagauauuuccaaauugaa

SEQ ID NO: 4054754 - RNA, 16 nt, Staphylococcus aureus subsp. aureus N315
uaagaugacugaacca

SEQ ID NO: 4054755 - RNA, 17 nt, Staphylococcus aureus subsp. aureus N315
uaagaugauuuagacuc

SEQ ID NO: 4054756 - RNA, 21 nt, Staphylococcus aureus subsp. aureus N315
uaagauguauaugaauuuuau

SEQ ID NO: 4054757 - RNA, 15 nt, Staphylococcus aureus subsp. aureus N315
uaagauuuaaacauc

SEQ ID NO: 4054758 - RNA, 19 nt, Staphylococcus aureus subsp. aureus N315
uaagauuuugaauuuuaua

SEQ ID NO: 4054759 - RNA, 22 nt, Staphylococcus aureus subsp. aureus N315
uaagauuuuuuauguuuaauuu

SEQ ID NO: 4054760 - RNA, 22 nt, Staphylococcus aureus subsp. aureus N315
uaagcagagccauaaugagagu

SEQ ID NO: 4054761 - RNA, 19 nt, Staphylococcus aureus subsp. aureus N315
uaagcaguuaauaagaaac

SEQ ID NO: 4054762 - RNA, 21 nt, Staphylococcus aureus subsp. aureus N315
uaagcaguuaauaagaaacuu

SEQ ID NO: 4054763 - RNA, 23 nt, Staphylococcus aureus subsp. aureus N315
uaagcauuaauguucaauuuaua

SEQ ID NO: 4054764 - RNA, 17 nt, Staphylococcus aureus subsp. aureus N315
uaagccuuuucaaacau

SEQ ID NO: 4054765 - RNA, 16 nt, Staphylococcus aureus subsp. aureus N315
uaagcguuuaaucaca

SEQ ID NO: 4054766 - RNA, 23 nt, Staphylococcus aureus subsp. aureus N315
uaagcuaguguuuuuauuuuuau

SEQ ID NO: 4054767 - RNA, 17 nt, Staphylococcus aureus subsp. aureus N315
uaagcucauuucaauau

SEQ ID NO: 4054768 - RNA, 23 nt, Staphylococcus aureus subsp. aureus N315
uaagcucauuucaauauuaaaau

SEQ ID NO: 4054769 - RNA, 21 nt, Staphylococcus aureus subsp. aureus N315
uaagcugaaaaucaucauuau

SEQ ID NO: 4054770 - RNA, 15 nt, Staphylococcus aureus subsp. aureus N315
uaagcuuuguuugac

SEQ ID NO: 4054771 - RNA, 21 nt, Staphylococcus aureus subsp. aureus N315
uaagcuuuuucuuucucuaac

SEQ ID NO: 4054772 - RNA, 23 nt, Staphylococcus aureus subsp. aureus N315
uaaggcuaaugauaauccaccaa

SEQ ID NO: 4054773 - RNA, 20 nt, Staphylococcus aureus subsp. aureus N315
uaaggugauugaacaauaau

SEQ ID NO: 4054774 - RNA, 15 nt, Staphylococcus aureus subsp. aureus N315
uaagguuugaacucu

SEQ ID NO: 4054775 - RNA, 16 nt, Staphylococcus aureus subsp. aureus N315
uaaguaaaacugcaau

SEQ ID NO: 4054776 - RNA, 20 nt, Staphylococcus aureus subsp. aureus N315
uaaguaaaauaaaaaaugca

SEQ ID NO: 4054777 - RNA, 18 nt, Staphylococcus aureus subsp. aureus N315
uaaguaagauuuaaacau

SEQ ID NO: 4054778 - RNA, 14 nt, Staphylococcus aureus subsp. aureus N315
uaaguaauaaaaua

SEQ ID NO: 4054779 - RNA, 16 nt, Staphylococcus aureus subsp. aureus N315
uaaguaauaauauaaa

SEQ ID NO: 4054780 - RNA, 20 nt, Staphylococcus aureus subsp. aureus N315
uaaguaauaauauaaauaaa

SEQ ID NO: 4054781 - RNA, 13 nt, Staphylococcus aureus subsp. aureus N315
uaaguaauauaau

SEQ ID NO: 4054782 - RNA, 15 nt, Staphylococcus aureus subsp. aureus N315
uaaguacuuuuacaa

SEQ ID NO: 4054783 - RNA, 17 nt, Staphylococcus aureus subsp. aureus N315
uaaguagaaaauaugac

SEQ ID NO: 4054784 - RNA, 14 nt, Staphylococcus aureus subsp. aureus N315
uaaguagaagcaaa

SEQ ID NO: 4054785 - RNA, 17 nt, Staphylococcus aureus subsp. aureus N315
uaaguagcucaaaacaa

SEQ ID NO: 4054786 - RNA, 15 nt, Staphylococcus aureus subsp. aureus N315
uaaguaguuguuaua

SEQ ID NO: 4054787 - RNA, 20 nt, Staphylococcus aureus subsp. aureus N315
uaaguaguuguuauauucua

SEQ ID NO: 4054788 - RNA, 21 nt, Staphylococcus aureus subsp. aureus N315
uaaguaucggugauuuaauug

SEQ ID NO: 4054789 - RNA, 21 nt, Staphylococcus aureus subsp. aureus N315
uaaguauuuaaauaacaagua

SEQ ID NO: 4054790 - RNA, 19 nt, Staphylococcus aureus subsp. aureus N315
uaagucuaauguuggaaaa

SEQ ID NO: 4054791 - RNA, 20 nt, Staphylococcus aureus subsp. aureus N315
uaagucugaugucgaaaaua

SEQ ID NO: 4054792 - RNA, 19 nt, Staphylococcus aureus subsp. aureus N315
uaagucuuaacaaauuaaa

SEQ ID NO: 4054793 - RNA, 16 nt, Staphylococcus aureus subsp. aureus N315
uaagucuuuuaaauga

SEQ ID NO: 4054794 - RNA, 17 nt, Staphylococcus aureus subsp. aureus N315
uaagucuuuuaaaugau

SEQ ID NO: 4054795 - RNA, 17 nt, Staphylococcus aureus subsp. aureus N315
uaagugaacuauuaaaa

SEQ ID NO: 4054796 - RNA, 20 nt, Staphylococcus aureus subsp. aureus N315
uaagugaauuaucuauauau

SEQ ID NO: 4054797 - RNA, 13 nt, Staphylococcus aureus subsp. aureus N315
uaagugauaaaua

SEQ ID NO: 4054798 - RNA, 19 nt, Staphylococcus aureus subsp. aureus N315
uaagugauaaauaaugcau

SEQ ID NO: 4054799 - RNA, 22 nt, Staphylococcus aureus subsp. aureus N315
uaagugauauacgacaaucaca

SEQ ID NO: 4054800 - RNA, 23 nt, Staphylococcus aureus subsp. aureus N315
uaagugaugaccaauauucugga

SEQ ID NO: 4054801 - RNA, 22 nt, Staphylococcus aureus subsp. aureus N315
uaagugguuaucacgugcuucg

SEQ ID NO: 4054802 - RNA, 17 nt, Staphylococcus aureus subsp. aureus N315
uaaguguaaaugaaagu

SEQ ID NO: 4054803 - RNA, 23 nt, Staphylococcus aureus subsp. aureus N315
uaaguuaaaaccuuuucaaauua

SEQ ID NO: 4054804 - RNA, 21 nt, Staphylococcus aureus subsp. aureus N315
uaaguuaugacuaacgaaaaa

SEQ ID NO: 4054805 - RNA, 16 nt, Staphylococcus aureus subsp. aureus N315
uaaguugaauauaaaa

SEQ ID NO: 4054806 - RNA, 15 nt, Staphylococcus aureus subsp. aureus N315
uaaguugauuucuac

SEQ ID NO: 4054807 - RNA, 22 nt, Staphylococcus aureus subsp. aureus N315
uaaguuggcuuacugucaccuu

SEQ ID NO: 4054808 - RNA, 22 nt, Staphylococcus aureus subsp. aureus N315
uaaguuucgcugcuacaccacc

SEQ ID NO: 4054809 - RNA, 21 nt, Staphylococcus aureus subsp. aureus N315
uaaguuugaaggagauauuuu

SEQ ID NO: 4054810 - RNA, 14 nt, Staphylococcus aureus subsp. aureus N315
uaaguuugaaucau

SEQ ID NO: 4054811 - RNA, 23 nt, Staphylococcus aureus subsp. aureus N315
uaauaaaaaccaauauuucuggg

SEQ ID NO: 4054812 - RNA, 16 nt, Staphylococcus aureus subsp. aureus N315
uaauaaaacuugugau

SEQ ID NO: 4054813 - RNA, 13 nt, Staphylococcus aureus subsp. aureus N315
uaauaaaaucauc

SEQ ID NO: 4054814 - RNA, 16 nt, Staphylococcus aureus subsp. aureus N315
uaauaaaccuacaaua

SEQ ID NO: 4054815 - RNA, 21 nt, Staphylococcus aureus subsp. aureus N315
uaauaaacgacgcaagugacu

SEQ ID NO: 4054816 - RNA, 16 nt, Staphylococcus aureus subsp. aureus N315
uaauaaagaauaaaca

SEQ ID NO: 4054817 - RNA, 15 nt, Staphylococcus aureus subsp. aureus N315
uaauaaaucauuagu

SEQ ID NO: 4054818 - RNA, 19 nt, Staphylococcus aureus subsp. aureus N315
uaauaaaucgaauugaugg

SEQ ID NO: 4054819 - RNA, 22 nt, Staphylococcus aureus subsp. aureus N315
uaauaaaucuaucuacucaaau

SEQ ID NO: 4054820 - RNA, 22 nt, Staphylococcus aureus subsp. aureus N315
uaauaaauuguuaucguucaau

SEQ ID NO: 4054821 - RNA, 13 nt, Staphylococcus aureus subsp. aureus N315
uaauaaauuuaac

SEQ ID NO: 4054822 - RNA, 15 nt, Staphylococcus aureus subsp. aureus N315
uaauaaauuuaacgu

SEQ ID NO: 4054823 - RNA, 12 nt, Staphylococcus aureus subsp. aureus N315
uaauaacaaaau

SEQ ID NO: 4054824 - RNA, 14 nt, Staphylococcus aureus subsp. aureus N315
uaauaacaaauagu

SEQ ID NO: 4054825 - RNA, 17 nt, Staphylococcus aureus subsp. aureus N315
uaauaacaucuaaauuu

SEQ ID NO: 4054826 - RNA, 18 nt, Staphylococcus aureus subsp. aureus N315
uaauaaccauguaaaauu

SEQ ID NO: 4054827 - RNA, 20 nt, Staphylococcus aureus subsp. aureus N315
uaauaacccgaacacaaaaa

SEQ ID NO: 4054828 - RNA, 15 nt, Staphylococcus aureus subsp. aureus N315
uaauaacgauaagca

SEQ ID NO: 4054829 - RNA, 19 nt, Staphylococcus aureus subsp. aureus N315
uaauaacgcugcaccuaag

SEQ ID NO: 4054830 - RNA, 16 nt, Staphylococcus aureus subsp. aureus N315
uaauaagcugaaauaa

SEQ ID NO: 4054831 - RNA, 16 nt, Staphylococcus aureus subsp. aureus N315
uaauaaguaauaauuu

SEQ ID NO: 4054832 - RNA, 19 nt, Staphylococcus aureus subsp. aureus N315
uaauaaguugaauauaaaa

SEQ ID NO: 4054833 - RNA, 15 nt, Staphylococcus aureus subsp. aureus N315
uaauaauacuucuaa

SEQ ID NO: 4054834 - RNA, 19 nt, Staphylococcus aureus subsp. aureus N315
uaauaauacuucuaaucgu

SEQ ID NO: 4054835 - RNA, 13 nt, Staphylococcus aureus subsp. aureus N315
uaauaauaucuuu

SEQ ID NO: 4054836 - RNA, 18 nt, Staphylococcus aureus subsp. aureus N315
uaauaauauugaauggua

SEQ ID NO: 4054837 - RNA, 17 nt, Staphylococcus aureus subsp. aureus N315
uaauaaucuuuaacauu

SEQ ID NO: 4054838 - RNA, 15 nt, Staphylococcus aureus subsp. aureus N315
uaauaaugacgagaa

SEQ ID NO: 4054839 - RNA, 20 nt, Staphylococcus aureus subsp. aureus N315
uaauaaugacgagaauuaaa

SEQ ID NO: 4054840 - RNA, 20 nt, Staphylococcus aureus subsp. aureus N315
uaauaauggcaauuaaaacu

SEQ ID NO: 4054841 - RNA, 18 nt, Staphylococcus aureus subsp. aureus N315
uaauaaugggaauuguau

SEQ ID NO: 4054842 - RNA, 16 nt, Staphylococcus aureus subsp. aureus N315
uaauaauguaucauuu

SEQ ID NO: 4054843 - RNA, 13 nt, Staphylococcus aureus subsp. aureus N315
uaauaauuaauaa

SEQ ID NO: 4054844 - RNA, 18 nt, Staphylococcus aureus subsp. aureus N315
uaauaauuaauaagcauu

SEQ ID NO: 4054845 - RNA, 14 nt, Staphylococcus aureus subsp. aureus N315
uaauaauuauuaau

SEQ ID NO: 4054846 - RNA, 16 nt, Staphylococcus aureus subsp. aureus N315
uaauaauuauuaauaa

SEQ ID NO: 4054847 - RNA, 20 nt, Staphylococcus aureus subsp. aureus N315
uaauaauugcauguaaaauu

SEQ ID NO: 4054848 - RNA, 21 nt, Staphylococcus aureus subsp. aureus N315
uaauaauugcauguaaaauua

SEQ ID NO: 4054849 - RNA, 14 nt, Staphylococcus aureus subsp. aureus N315
uaauaauuguccau

SEQ ID NO: 4054850 - RNA, 12 nt, Staphylococcus aureus subsp. aureus N315
uaauaauuuaac

SEQ ID NO: 4054851 - RNA, 19 nt, Staphylococcus aureus subsp. aureus N315
uaauaauuuaacuaaucaa

SEQ ID NO: 4054852 - RNA, 13 nt, Staphylococcus aureus subsp. aureus N315
uaauacaauucaa

SEQ ID NO: 4054853 - RNA, 19 nt, Staphylococcus aureus subsp. aureus N315
uaauacacuugauaaaacu

SEQ ID NO: 4054854 - RNA, 21 nt, Staphylococcus aureus subsp. aureus N315
uaauacaucaucaaguucacc

SEQ ID NO: 4054855 - RNA, 13 nt, Staphylococcus aureus subsp. aureus N315
uaauacaucuaau

SEQ ID NO: 4054856 - RNA, 18 nt, Staphylococcus aureus subsp. aureus N315
uaauacaugacauucauu

SEQ ID NO: 4054857 - RNA, 13 nt, Staphylococcus aureus subsp. aureus N315
uaauacauuaugu

SEQ ID NO: 4054858 - RNA, 19 nt, Staphylococcus aureus subsp. aureus N315
uaauaccaauuuuuagcau

SEQ ID NO: 4054859 - RNA, 17 nt, Staphylococcus aureus subsp. aureus N315
uaauaccagcauccauu

SEQ ID NO: 4054860 - RNA, 20 nt, Staphylococcus aureus subsp. aureus N315
uaauaccuaugauauaugcu

SEQ ID NO: 4054861 - RNA, 17 nt, Staphylococcus aureus subsp. aureus N315
uaauaccuuuacuuuca

SEQ ID NO: 4054862 - RNA, 20 nt, Staphylococcus aureus subsp. aureus N315
uaauaccuuuacuuucauua

SEQ ID NO: 4054863 - RNA, 17 nt, Staphylococcus aureus subsp. aureus N315
uaauacgucguaaugaa

SEQ ID NO: 4054864 - RNA, 21 nt, Staphylococcus aureus subsp. aureus N315
uaauacguguguuuucuuuuc

SEQ ID NO: 4054865 - RNA, 17 nt, Staphylococcus aureus subsp. aureus N315
uaauacguuuaauaaug

SEQ ID NO: 4054866 - RNA, 22 nt, Staphylococcus aureus subsp. aureus N315
uaauacguuuugcuaauucaag

SEQ ID NO: 4054867 - RNA, 16 nt, Staphylococcus aureus subsp. aureus N315
uaauacuguuuaaaua

SEQ ID NO: 4054868 - RNA, 22 nt, Staphylococcus aureus subsp. aureus N315
uaauacuucauauccuucauua

SEQ ID NO: 4054869 - RNA, 17 nt, Staphylococcus aureus subsp. aureus N315
uaauacuuucaaacaaa

SEQ ID NO: 4054870 - RNA, 14 nt, Staphylococcus aureus subsp. aureus N315
uaauacuuucacuu

SEQ ID NO: 4054871 - RNA, 22 nt, Staphylococcus aureus subsp. aureus N315
uaauacuuuuugaguauccaau

SEQ ID NO: 4054872 - RNA, 14 nt, Staphylococcus aureus subsp. aureus N315
uaauagaaauaauc

SEQ ID NO: 4054873 - RNA, 17 nt, Staphylococcus aureus subsp. aureus N315
uaauagaacgaaauagu

SEQ ID NO: 4054874 - RNA, 24 nt, Staphylococcus aureus subsp. aureus N315
uaauagagacauuuuaucugaaaa

SEQ ID NO: 4054875 - RNA, 15 nt, Staphylococcus aureus subsp. aureus N315
uaauagauaaugcac

SEQ ID NO: 4054876 - RNA, 15 nt, Staphylococcus aureus subsp. aureus N315
uaauagcgucaaguu

SEQ ID NO: 4054877 - RNA, 14 nt, Staphylococcus aureus subsp. aureus N315
uaauagcuauauuu

SEQ ID NO: 4054878 - RNA, 21 nt, Staphylococcus aureus subsp. aureus N315
uaauaggauaugcuaaacacu

SEQ ID NO: 4054879 - RNA, 20 nt, Staphylococcus aureus subsp. aureus N315
uaauaggcuauguaaaucgu

SEQ ID NO: 4054880 - RNA, 21 nt, Staphylococcus aureus subsp. aureus N315
uaauagguuauuugauaauga

SEQ ID NO: 4054881 - RNA, 17 nt, Staphylococcus aureus subsp. aureus N315
uaauaguguuauauugu

SEQ ID NO: 4054882 - RNA, 14 nt, Staphylococcus aureus subsp. aureus N315
uaauaguuaacgau

SEQ ID NO: 4054883 - RNA, 19 nt, Staphylococcus aureus subsp. aureus N315
uaauauaaaaacaaaagaa

SEQ ID NO: 4054884 - RNA, 20 nt, Staphylococcus aureus subsp. aureus N315
uaauauaaaaacaaaagaaa

SEQ ID NO: 4054885 - RNA, 14 nt, Staphylococcus aureus subsp. aureus N315
uaauauaaaauaaa

SEQ ID NO: 4054886 - RNA, 17 nt, Staphylococcus aureus subsp. aureus N315
uaauauaacuucuauua

SEQ ID NO: 4054887 - RNA, 13 nt, Staphylococcus aureus subsp. aureus N315
uaauauaauuaaa

SEQ ID NO: 4054888 - RNA, 15 nt, Staphylococcus aureus subsp. aureus N315
uaauauaauuauuaa

SEQ ID NO: 4054889 - RNA, 14 nt, Staphylococcus aureus subsp. aureus N315
uaauauauaaaagu

SEQ ID NO: 4054890 - RNA, 17 nt, Staphylococcus aureus subsp. aureus N315
uaauauauccugccaau

SEQ ID NO: 4054891 - RNA, 14 nt, Staphylococcus aureus subsp. aureus N315
uaauauauuuggag

SEQ ID NO: 4054892 - RNA, 21 nt, Staphylococcus aureus subsp. aureus N315
uaauaucauauucaaaauaac

SEQ ID NO: 4054893 - RNA, 18 nt, Staphylococcus aureus subsp. aureus N315
uaauaucaugcuuaucug

SEQ ID NO: 4054894 - RNA, 21 nt, Staphylococcus aureus subsp. aureus N315
uaauaucuuacuacuuaauua

SEQ ID NO: 4054895 - RNA, 14 nt, Staphylococcus aureus subsp. aureus N315
uaauaucuucuuua

SEQ ID NO: 4054896 - RNA, 13 nt, Staphylococcus aureus subsp. aureus N315
uaauaucuuuugc

SEQ ID NO: 4054897 - RNA, 21 nt, Staphylococcus aureus subsp. aureus N315
uaauaugaauuuagaugcaua

SEQ ID NO: 4054898 - RNA, 23 nt, Staphylococcus aureus subsp. aureus N315
uaauaugaauuuagaugcauaaa

SEQ ID NO: 4054899 - RNA, 12 nt, Staphylococcus aureus subsp. aureus N315
uaauauuauaaa

SEQ ID NO: 4054900 - RNA, 12 nt, Staphylococcus aureus subsp. aureus N315
uaauauuauaag

SEQ ID NO: 4054901 - RNA, 13 nt, Staphylococcus aureus subsp. aureus N315
uaauauucaacuu

SEQ ID NO: 4054902 - RNA, 12 nt, Staphylococcus aureus subsp. aureus N315
uaauauugaaua

SEQ ID NO: 4054903 - RNA, 14 nt, Staphylococcus aureus subsp. aureus N315
uaauauugacauuu

SEQ ID NO: 4054904 - RNA, 17 nt, Staphylococcus aureus subsp. aureus N315
uaauauugacauuuaca

SEQ ID NO: 4054905 - RNA, 17 nt, Staphylococcus aureus subsp. aureus N315
uaauauuggacuuugcu

SEQ ID NO: 4054906 - RNA, 14 nt, Staphylococcus aureus subsp. aureus N315
uaauauuucuuaga

SEQ ID NO: 4054907 - RNA, 15 nt, Staphylococcus aureus subsp. aureus N315
uaauauuucuuagau

SEQ ID NO: 4054908 - RNA, 18 nt, Staphylococcus aureus subsp. aureus N315
uaauauuugauaacaaaa

SEQ ID NO: 4054909 - RNA, 12 nt, Staphylococcus aureus subsp. aureus N315
uaauauuuuaaa

SEQ ID NO: 4054910 - RNA, 15 nt, Staphylococcus aureus subsp. aureus N315
uaauauuuuaaacgu

SEQ ID NO: 4054911 - RNA, 12 nt, Staphylococcus aureus subsp. aureus N315
uaauauuuucuu

SEQ ID NO: 4054912 - RNA, 16 nt, Staphylococcus aureus subsp. aureus N315
uaauauuuucuuagaa

SEQ ID NO: 4054913 - RNA, 12 nt, Staphylococcus aureus subsp. aureus N315
uaauauuuuggc

SEQ ID NO: 4054914 - RNA, 13 nt, Staphylococcus aureus subsp. aureus N315
uaaucaaaauuau

SEQ ID NO: 4054915 - RNA, 17 nt, Staphylococcus aureus subsp. aureus N315
uaaucaaaauuaugacu

SEQ ID NO: 4054916 - RNA, 20 nt, Staphylococcus aureus subsp. aureus N315
uaaucaaaguaucagucauu

SEQ ID NO: 4054917 - RNA, 15 nt, Staphylococcus aureus subsp. aureus N315
uaaucaaauuaguca

SEQ ID NO: 4054918 - RNA, 22 nt, Staphylococcus aureus subsp. aureus N315
uaaucaacaaagugcaauuauu

SEQ ID NO: 4054919 - RNA, 15 nt, Staphylococcus aureus subsp. aureus N315
uaaucaagcaaugca

SEQ ID NO: 4054920 - RNA, 18 nt, Staphylococcus aureus subsp. aureus N315
uaaucaagcaaugcaugc

SEQ ID NO: 4054921 - RNA, 14 nt, Staphylococcus aureus subsp. aureus N315
uaaucacauuaauu

SEQ ID NO: 4054922 - RNA, 17 nt, Staphylococcus aureus subsp. aureus N315
uaaucacauuaauugga

SEQ ID NO: 4054923 - RNA, 16 nt, Staphylococcus aureus subsp. aureus N315
uaaucaccuuauugau

SEQ ID NO: 4054924 - RNA, 22 nt, Staphylococcus aureus subsp. aureus N315
uaaucacuuggcgacauuugua

SEQ ID NO: 4054925 - RNA, 15 nt, Staphylococcus aureus subsp. aureus N315
uaaucagaaaagcag

SEQ ID NO: 4054926 - RNA, 18 nt, Staphylococcus aureus subsp. aureus N315
uaaucagcuauaaaagua

SEQ ID NO: 4054927 - RNA, 16 nt, Staphylococcus aureus subsp. aureus N315
uaaucagcuuuuucac

SEQ ID NO: 4054928 - RNA, 15 nt, Staphylococcus aureus subsp. aureus N315
uaaucagugaaauau

SEQ ID NO: 4054929 - RNA, 14 nt, Staphylococcus aureus subsp. aureus N315
uaaucauaaugaau

SEQ ID NO: 4054930 - RNA, 17 nt, Staphylococcus aureus subsp. aureus N315
uaaucauaaugaauaau

SEQ ID NO: 4054931 - RNA, 16 nt, Staphylococcus aureus subsp. aureus N315
uaaucauguaaugcuu

SEQ ID NO: 4054932 - RNA, 20 nt, Staphylococcus aureus subsp. aureus N315
uaaucauugguuucaucaua

SEQ ID NO: 4054933 - RNA, 14 nt, Staphylococcus aureus subsp. aureus N315
uaaucauuguguau

SEQ ID NO: 4054934 - RNA, 18 nt, Staphylococcus aureus subsp. aureus N315
uaaucauuguguauuguu

SEQ ID NO: 4054935 - RNA, 21 nt, Staphylococcus aureus subsp. aureus N315
uaaucauuguguauuguuuua

SEQ ID NO: 4054936 - RNA, 13 nt, Staphylococcus aureus subsp. aureus N315
uaauccagccaca

SEQ ID NO: 4054937 - RNA, 19 nt, Staphylococcus aureus subsp. aureus N315
uaauccaguaaucaaagau

SEQ ID NO: 4054938 - RNA, 17 nt, Staphylococcus aureus subsp. aureus N315
uaaucccaucgcuuuuu

SEQ ID NO: 4054939 - RNA, 17 nt, Staphylococcus aureus subsp. aureus N315
uaaucccauuuuaaagu

SEQ ID NO: 4054940 - RNA, 21 nt, Staphylococcus aureus subsp. aureus N315
uaaucccuucaaaauuuugac

SEQ ID NO: 4054941 - RNA, 23 nt, Staphylococcus aureus subsp. aureus N315
uaauccgagucauacucaucaga

SEQ ID NO: 4054942 - RNA, 15 nt, Staphylococcus aureus subsp. aureus N315
uaaucgaacagaaaa

SEQ ID NO: 4054943 - RNA, 23 nt, Staphylococcus aureus subsp. aureus N315
uaaucgauugguaaaucuacuac

SEQ ID NO: 4054944 - RNA, 15 nt, Staphylococcus aureus subsp. aureus N315
uaaucgcauucuugg

SEQ ID NO: 4054945 - RNA, 19 nt, Staphylococcus aureus subsp. aureus N315
uaaucguauucauaucauu

SEQ ID NO: 4054946 - RNA, 15 nt, Staphylococcus aureus subsp. aureus N315
uaaucguauuuuuaa

SEQ ID NO: 4054947 - RNA, 15 nt, Staphylococcus aureus subsp. aureus N315
uaaucguuuuuacug

SEQ ID NO: 4054948 - RNA, 17 nt, Staphylococcus aureus subsp. aureus N315
uaaucguuuuuacugua

SEQ ID NO: 4054949 - RNA, 22 nt, Staphylococcus aureus subsp. aureus N315
uaaucuaaaaauagauguacaa

SEQ ID NO: 4054950 - RNA, 16 nt, Staphylococcus aureus subsp. aureus N315
uaaucuaaauucaguu

SEQ ID NO: 4054951 - RNA, 14 nt, Staphylococcus aureus subsp. aureus N315
uaaucuauauauau

SEQ ID NO: 4054952 - RNA, 23 nt, Staphylococcus aureus subsp. aureus N315
uaaucuauggaaaauguuaucaa

SEQ ID NO: 4054953 - RNA, 16 nt, Staphylococcus aureus subsp. aureus N315
uaaucuauuuucugcc

SEQ ID NO: 4054954 - RNA, 15 nt, Staphylococcus aureus subsp. aureus N315
uaaucuucacgcuua

SEQ ID NO: 4054955 - RNA, 17 nt, Staphylococcus aureus subsp. aureus N315
uaaucuugauuauauuu

SEQ ID NO: 4054956 - RNA, 22 nt, Staphylococcus aureus subsp. aureus N315
uaaucuugauuauauuuuucuu

SEQ ID NO: 4054957 - RNA, 16 nt, Staphylococcus aureus subsp. aureus N315
uaaucuuguuuucauu

SEQ ID NO: 4054958 - RNA, 13 nt, Staphylococcus aureus subsp. aureus N315
uaaugaaaugaag

SEQ ID NO: 4054959 - RNA, 19 nt, Staphylococcus aureus subsp. aureus N315
uaaugaagauuuuguugaa

SEQ ID NO: 4054960 - RNA, 18 nt, Staphylococcus aureus subsp. aureus N315
uaaugaauucauucaaua

SEQ ID NO: 4054961 - RNA, 16 nt, Staphylococcus aureus subsp. aureus N315
uaaugacugacacuuu

SEQ ID NO: 4054962 - RNA, 16 nt, Staphylococcus aureus subsp. aureus N315
uaaugagaguaauguu

SEQ ID NO: 4054963 - RNA, 17 nt, Staphylococcus aureus subsp. aureus N315
uaaugaguaguuucucu

SEQ ID NO: 4054964 - RNA, 18 nt, Staphylococcus aureus subsp. aureus N315
uaaugauaaauuaaagcu

SEQ ID NO: 4054965 - RNA, 18 nt, Staphylococcus aureus subsp. aureus N315
uaaugauaauccaccaaa

SEQ ID NO: 4054966 - RNA, 20 nt, Staphylococcus aureus subsp. aureus N315
uaaugauacaaacccauaua

SEQ ID NO: 4054967 - RNA, 13 nt, Staphylococcus aureus subsp. aureus N315
uaaugauauuaag

SEQ ID NO: 4054968 - RNA, 20 nt, Staphylococcus aureus subsp. aureus N315
uaaugaugacaucaauaucu

SEQ ID NO: 4054969 - RNA, 12 nt, Staphylococcus aureus subsp. aureus N315
uaaugauuaacu

SEQ ID NO: 4054970 - RNA, 22 nt, Staphylococcus aureus subsp. aureus N315
uaaugauugacgauuuaauuaa

SEQ ID NO: 4054971 - RNA, 16 nt, Staphylococcus aureus subsp. aureus N315
uaaugauugucuuaua

SEQ ID NO: 4054972 - RNA, 11 nt, Staphylococcus aureus subsp. aureus N315
uaaugauuuug

SEQ ID NO: 4054973 - RNA, 19 nt, Staphylococcus aureus subsp. aureus N315
uaaugauuuuuauuauugu

SEQ ID NO: 4054974 - RNA, 14 nt, Staphylococcus aureus subsp. aureus N315
uaaugauuuuucau

SEQ ID NO: 4054975 - RNA, 18 nt, Staphylococcus aureus subsp. aureus N315
uaaugcaccugugauaac

SEQ ID NO: 4054976 - RNA, 15 nt, Staphylococcus aureus subsp. aureus N315
uaaugcauuauuaua

SEQ ID NO: 4054977 - RNA, 15 nt, Staphylococcus aureus subsp. aureus N315
uaaugccaaauauag

SEQ ID NO: 4054978 - RNA, 17 nt, Staphylococcus aureus subsp. aureus N315
uaaugcuacuauuaaau

SEQ ID NO: 4054979 - RNA, 16 nt, Staphylococcus aureus subsp. aureus N315
uaaugcugcuucuuca

SEQ ID NO: 4054980 - RNA, 17 nt, Staphylococcus aureus subsp. aureus N315
uaauggcaccauacuuc

SEQ ID NO: 4054981 - RNA, 18 nt, Staphylococcus aureus subsp. aureus N315
uaauggcacuuaauauaa

SEQ ID NO: 4054982 - RNA, 22 nt, Staphylococcus aureus subsp. aureus N315
uaauggcgggcccccaacacaa

SEQ ID NO: 4054983 - RNA, 20 nt, Staphylococcus aureus subsp. aureus N315
uaauggcuaauacaaaacaa

SEQ ID NO: 4054984 - RNA, 22 nt, Staphylococcus aureus subsp. aureus N315
uaaugguucuauaauaaaucga

SEQ ID NO: 4054985 - RNA, 20 nt, Staphylococcus aureus subsp. aureus N315
uaauguaaaguugauaaugu

SEQ ID NO: 4054986 - RNA, 16 nt, Staphylococcus aureus subsp. aureus N315
uaauguacauguauaa

SEQ ID NO: 4054987 - RNA, 20 nt, Staphylococcus aureus subsp. aureus N315
uaauguaccaaucaaugacu

SEQ ID NO: 4054988 - RNA, 11 nt, Staphylococcus aureus subsp. aureus N315
uaauguauaaa

SEQ ID NO: 4054989 - RNA, 16 nt, Staphylococcus aureus subsp. aureus N315
uaaugucaugaaaaua

SEQ ID NO: 4054990 - RNA, 22 nt, Staphylococcus aureus subsp. aureus N315
uaaugucgcacuauaaaauuca

SEQ ID NO: 4054991 - RNA, 19 nt, Staphylococcus aureus subsp. aureus N315
uaaugucucuuuucacgaa

SEQ ID NO: 4054992 - RNA, 13 nt, Staphylococcus aureus subsp. aureus N315
uaaugucuucaua

SEQ ID NO: 4054993 - RNA, 23 nt, Staphylococcus aureus subsp. aureus N315
uaaugucuucauaaucguauuca

SEQ ID NO: 4054994 - RNA, 20 nt, Staphylococcus aureus subsp. aureus N315
uaaugugcgucacucacuuc

SEQ ID NO: 4054995 - RNA, 22 nt, Staphylococcus aureus subsp. aureus N315
uaaugugcgucacucacuucaa

SEQ ID NO: 4054996 - RNA, 22 nt, Staphylococcus aureus subsp. aureus N315
uaauguuaaaauaacugcuaau

SEQ ID NO: 4054997 - RNA, 18 nt, Staphylococcus aureus subsp. aureus N315
uaauguuggcaaacuauu

SEQ ID NO: 4054998 - RNA, 21 nt, Staphylococcus aureus subsp. aureus N315
uaauguuuccugauauuucaa

SEQ ID NO: 4054999 - RNA, 23 nt, Staphylococcus aureus subsp. aureus N315
uaauguuuccugauauuucaacu

SEQ ID NO: 4055000 - RNA, 23 nt, Staphylococcus aureus subsp. aureus N315
uaauguuucuucaauugucucaa

SEQ ID NO: 4055001 - RNA, 18 nt, Staphylococcus aureus subsp. aureus N315
uaauguuugcuuuuugua

SEQ ID NO: 4055002 - RNA, 13 nt, Staphylococcus aureus subsp. aureus N315
uaauuaaaacaug

SEQ ID NO: 4055003 - RNA, 13 nt, Staphylococcus aureus subsp. aureus N315
uaauuaaaauaca

SEQ ID NO: 4055004 - RNA, 21 nt, Staphylococcus aureus subsp. aureus N315
uaauuaaacgcucaacuauau

SEQ ID NO: 4055005 - RNA, 15 nt, Staphylococcus aureus subsp. aureus N315
uaauuaaagcaucuu

SEQ ID NO: 4055006 - RNA, 16 nt, Staphylococcus aureus subsp. aureus N315
uaauuaaauaaaaaua

SEQ ID NO: 4055007 - RNA, 21 nt, Staphylococcus aureus subsp. aureus N315
uaauuaacacauucaaauaaa

SEQ ID NO: 4055008 - RNA, 22 nt, Staphylococcus aureus subsp. aureus N315
uaauuaacacauucaaauaaau

SEQ ID NO: 4055009 - RNA, 17 nt, Staphylococcus aureus subsp. aureus N315
uaauuaagaaaaucauu

SEQ ID NO: 4055010 - RNA, 15 nt, Staphylococcus aureus subsp. aureus N315
uaauuaauaagcauu

SEQ ID NO: 4055011 - RNA, 13 nt, Staphylococcus aureus subsp. aureus N315
uaauuaauaauuu

SEQ ID NO: 4055012 - RNA, 15 nt, Staphylococcus aureus subsp. aureus N315
uaauuaauaauuuaa

SEQ ID NO: 4055013 - RNA, 21 nt, Staphylococcus aureus subsp. aureus N315
uaauuaauacaucaauaucuu

SEQ ID NO: 4055014 - RNA, 15 nt, Staphylococcus aureus subsp. aureus N315
uaauuaauguuucuu

SEQ ID NO: 4055015 - RNA, 13 nt, Staphylococcus aureus subsp. aureus N315
uaauuaauuaaaa

SEQ ID NO: 4055016 - RNA, 15 nt, Staphylococcus aureus subsp. aureus N315
uaauuaauuaaaauu

SEQ ID NO: 4055017 - RNA, 23 nt, Staphylococcus aureus subsp. aureus N315
uaauuaauuacuuucauuguaaa

SEQ ID NO: 4055018 - RNA, 16 nt, Staphylococcus aureus subsp. aureus N315
uaauuaauuuuguaau

SEQ ID NO: 4055019 - RNA, 16 nt, Staphylococcus aureus subsp. aureus N315
uaauuaccuuuccauu

SEQ ID NO: 4055020 - RNA, 20 nt, Staphylococcus aureus subsp. aureus N315
uaauuacuuucauuguaaau

SEQ ID NO: 4055021 - RNA, 18 nt, Staphylococcus aureus subsp. aureus N315
uaauuagauuuaaaaugu

SEQ ID NO: 4055022 - RNA, 16 nt, Staphylococcus aureus subsp. aureus N315
uaauuaggauuaacau

SEQ ID NO: 4055023 - RNA, 17 nt, Staphylococcus aureus subsp. aureus N315
uaauuaggauuuccgga

SEQ ID NO: 4055024 - RNA, 22 nt, Staphylococcus aureus subsp. aureus N315
uaauuaggauuuccggaacaau

SEQ ID NO: 4055025 - RNA, 23 nt, Staphylococcus aureus subsp. aureus N315
uaauuaggauuuccggaacaaua

SEQ ID NO: 4055026 - RNA, 21 nt, Staphylococcus aureus subsp. aureus N315
uaauuagguauaguguuugac

SEQ ID NO: 4055027 - RNA, 16 nt, Staphylococcus aureus subsp. aureus N315
uaauuaguguuucaug

SEQ ID NO: 4055028 - RNA, 21 nt, Staphylococcus aureus subsp. aureus N315
uaauuaucauaugugauuuaa

SEQ ID NO: 4055029 - RNA, 11 nt, Staphylococcus aureus subsp. aureus N315
uaauuaucauu

SEQ ID NO: 4055030 - RNA, 14 nt, Staphylococcus aureus subsp. aureus N315
uaauuauuauauaa

SEQ ID NO: 4055031 - RNA, 15 nt, Staphylococcus aureus subsp. aureus N315
uaauuauucaugaau

SEQ ID NO: 4055032 - RNA, 13 nt, Staphylococcus aureus subsp. aureus N315
uaauuauuucucu

SEQ ID NO: 4055033 - RNA, 17 nt, Staphylococcus aureus subsp. aureus N315
uaauuauuucucuuucc

SEQ ID NO: 4055034 - RNA, 15 nt, Staphylococcus aureus subsp. aureus N315
uaauuauuuuaaaaa

SEQ ID NO: 4055035 - RNA, 20 nt, Staphylococcus aureus subsp. aureus N315
uaauuauuuuaaaaaaugau

SEQ ID NO: 4055036 - RNA, 19 nt, Staphylococcus aureus subsp. aureus N315
uaauucaaguguauuaaag

SEQ ID NO: 4055037 - RNA, 21 nt, Staphylococcus aureus subsp. aureus N315
uaauucaaugauuuuuaaaaa

SEQ ID NO: 4055038 - RNA, 14 nt, Staphylococcus aureus subsp. aureus N315
uaauucaaugcuau

SEQ ID NO: 4055039 - RNA, 13 nt, Staphylococcus aureus subsp. aureus N315
uaauucauauuca

SEQ ID NO: 4055040 - RNA, 23 nt, Staphylococcus aureus subsp. aureus N315
uaauucaucuugcgccuuguuca

SEQ ID NO: 4055041 - RNA, 18 nt, Staphylococcus aureus subsp. aureus N315
uaauucauuuauuuucuu

SEQ ID NO: 4055042 - RNA, 12 nt, Staphylococcus aureus subsp. aureus N315
uaauuccuggug

SEQ ID NO: 4055043 - RNA, 18 nt, Staphylococcus aureus subsp. aureus N315
uaauucgaaaucaaauau

SEQ ID NO: 4055044 - RNA, 20 nt, Staphylococcus aureus subsp. aureus N315
uaauucgaaaucaaauauuu

SEQ ID NO: 4055045 - RNA, 15 nt, Staphylococcus aureus subsp. aureus N315
uaauucgccaucuuu

SEQ ID NO: 4055046 - RNA, 23 nt, Staphylococcus aureus subsp. aureus N315
uaauucguuuugcuaaccaucau

SEQ ID NO: 4055047 - RNA, 13 nt, Staphylococcus aureus subsp. aureus N315
uaauucuaagucu

SEQ ID NO: 4055048 - RNA, 22 nt, Staphylococcus aureus subsp. aureus N315
uaauucuagagauaacuagaau

SEQ ID NO: 4055049 - RNA, 12 nt, Staphylococcus aureus subsp. aureus N315
uaauucugaaau

SEQ ID NO: 4055050 - RNA, 14 nt, Staphylococcus aureus subsp. aureus N315
uaauucugaaauca

SEQ ID NO: 4055051 - RNA, 16 nt, Staphylococcus aureus subsp. aureus N315
uaauucuuaaucgagu

SEQ ID NO: 4055052 - RNA, 17 nt, Staphylococcus aureus subsp. aureus N315
uaauucuucaaccauuu

SEQ ID NO: 4055053 - RNA, 14 nt, Staphylococcus aureus subsp. aureus N315
uaauucuucaucaa

SEQ ID NO: 4055054 - RNA, 23 nt, Staphylococcus aureus subsp. aureus N315
uaauucuucaucaauaacuauaa

SEQ ID NO: 4055055 - RNA, 19 nt, Staphylococcus aureus subsp. aureus N315
uaauucuucaucuucuuca

SEQ ID NO: 4055056 - RNA, 23 nt, Staphylococcus aureus subsp. aureus N315
uaauucuucucgcauacugucau

SEQ ID NO: 4055057 - RNA, 22 nt, Staphylococcus aureus subsp. aureus N315
uaauugaaguaugcacaucauu

SEQ ID NO: 4055058 - RNA, 12 nt, Staphylococcus aureus subsp. aureus N315
uaauugaaugaa

SEQ ID NO: 4055059 - RNA, 20 nt, Staphylococcus aureus subsp. aureus N315
uaauugauauggaucauaau

SEQ ID NO: 4055060 - RNA, 16 nt, Staphylococcus aureus subsp. aureus N315
uaauugaugaaagacu

SEQ ID NO: 4055061 - RNA, 22 nt, Staphylococcus aureus subsp. aureus N315
uaauugaugaugaugugcuuua

SEQ ID NO: 4055062 - RNA, 15 nt, Staphylococcus aureus subsp. aureus N315
uaauugaugucacau

SEQ ID NO: 4055063 - RNA, 19 nt, Staphylococcus aureus subsp. aureus N315
uaauugauucucuguagau

SEQ ID NO: 4055064 - RNA, 22 nt, Staphylococcus aureus subsp. aureus N315
uaauugcauagcuaaauaaauu

SEQ ID NO: 4055065 - RNA, 15 nt, Staphylococcus aureus subsp. aureus N315
uaauugcauguaaaa

SEQ ID NO: 4055066 - RNA, 15 nt, Staphylococcus aureus subsp. aureus N315
uaauuggaaucaucu

SEQ ID NO: 4055067 - RNA, 17 nt, Staphylococcus aureus subsp. aureus N315
uaauuggaaucaucuuu

SEQ ID NO: 4055068 - RNA, 15 nt, Staphylococcus aureus subsp. aureus N315
uaauuggauuaaaua

SEQ ID NO: 4055069 - RNA, 13 nt, Staphylococcus aureus subsp. aureus N315
uaauuggcagaua

SEQ ID NO: 4055070 - RNA, 20 nt, Staphylococcus aureus subsp. aureus N315
uaauugguucuucuuucaua

SEQ ID NO: 4055071 - RNA, 16 nt, Staphylococcus aureus subsp. aureus N315
uaauuguaaucuauuu

SEQ ID NO: 4055072 - RNA, 19 nt, Staphylococcus aureus subsp. aureus N315
uaauuguaaucuauuuucu

SEQ ID NO: 4055073 - RNA, 16 nt, Staphylococcus aureus subsp. aureus N315
uaauugucucaucauu

SEQ ID NO: 4055074 - RNA, 19 nt, Staphylococcus aureus subsp. aureus N315
uaauugucucaucauuuaa

SEQ ID NO: 4055075 - RNA, 22 nt, Staphylococcus aureus subsp. aureus N315
uaauugucucaucauuuaaaau

SEQ ID NO: 4055076 - RNA, 15 nt, Staphylococcus aureus subsp. aureus N315
uaauuguuaaaucac

SEQ ID NO: 4055077 - RNA, 23 nt, Staphylococcus aureus subsp. aureus N315
uaauuguuauaaguaaauaauag

SEQ ID NO: 4055078 - RNA, 14 nt, Staphylococcus aureus subsp. aureus N315
uaauuguuuaauaa

SEQ ID NO: 4055079 - RNA, 15 nt, Staphylococcus aureus subsp. aureus N315
uaauuuaaaauaguu

SEQ ID NO: 4055080 - RNA, 11 nt, Staphylococcus aureus subsp. aureus N315
uaauuuaaaga

SEQ ID NO: 4055081 - RNA, 14 nt, Staphylococcus aureus subsp. aureus N315
uaauuuaaaugcuu

SEQ ID NO: 4055082 - RNA, 15 nt, Staphylococcus aureus subsp. aureus N315
uaauuuaauaauuaa

SEQ ID NO: 4055083 - RNA, 22 nt, Staphylococcus aureus subsp. aureus N315
uaauuuaguuauaauuucuguu

SEQ ID NO: 4055084 - RNA, 15 nt, Staphylococcus aureus subsp. aureus N315
uaauuuauaaaaaga

SEQ ID NO: 4055085 - RNA, 12 nt, Staphylococcus aureus subsp. aureus N315
uaauuuauaaac

SEQ ID NO: 4055086 - RNA, 17 nt, Staphylococcus aureus subsp. aureus N315
uaauuuauaaacaauua

SEQ ID NO: 4055087 - RNA, 19 nt, Staphylococcus aureus subsp. aureus N315
uaauuuaucaauuucuauu

SEQ ID NO: 4055088 - RNA, 15 nt, Staphylococcus aureus subsp. aureus N315
uaauuuaucuuaauc

SEQ ID NO: 4055089 - RNA, 17 nt, Staphylococcus aureus subsp. aureus N315
uaauuuccaauaucuuc

SEQ ID NO: 4055090 - RNA, 10 nt, Staphylococcus aureus subsp. aureus N315
uaauuucuau

SEQ ID NO: 4055091 - RNA, 18 nt, Staphylococcus aureus subsp. aureus N315
uaauuucugguaaaaaaa

SEQ ID NO: 4055092 - RNA, 13 nt, Staphylococcus aureus subsp. aureus N315
uaauuucuucuuc

SEQ ID NO: 4055093 - RNA, 22 nt, Staphylococcus aureus subsp. aureus N315
uaauuucuugauggauauucaa

SEQ ID NO: 4055094 - RNA, 15 nt, Staphylococcus aureus subsp. aureus N315
uaauuugauaaaugc

SEQ ID NO: 4055095 - RNA, 23 nt, Staphylococcus aureus subsp. aureus N315
uaauuugauguucuugaaaacaa

SEQ ID NO: 4055096 - RNA, 12 nt, Staphylococcus aureus subsp. aureus N315
uaauuugauuaa

SEQ ID NO: 4055097 - RNA, 10 nt, Staphylococcus aureus subsp. aureus N315
uaauuuguua

SEQ ID NO: 4055098 - RNA, 17 nt, Staphylococcus aureus subsp. aureus N315
uaauuuguuaguuuaag

SEQ ID NO: 4055099 - RNA, 16 nt, Staphylococcus aureus subsp. aureus N315
uaauuuguuuuaaaua

SEQ ID NO: 4055100 - RNA, 18 nt, Staphylococcus aureus subsp. aureus N315
uaauuuuaccuguuucuu

SEQ ID NO: 4055101 - RNA, 22 nt, Staphylococcus aureus subsp. aureus N315
uaauuuucaauuagaaaauauc

SEQ ID NO: 4055102 - RNA, 13 nt, Staphylococcus aureus subsp. aureus N315
uaauuuucagaau

SEQ ID NO: 4055103 - RNA, 16 nt, Staphylococcus aureus subsp. aureus N315
uaauuuucuaaauaua

SEQ ID NO: 4055104 - RNA, 14 nt, Staphylococcus aureus subsp. aureus N315
uaauuuucuuuuuu

SEQ ID NO: 4055105 - RNA, 20 nt, Staphylococcus aureus subsp. aureus N315
uaauuuuggauuuuuuugua

SEQ ID NO: 4055106 - RNA, 13 nt, Staphylococcus aureus subsp. aureus N315
uaauuuuguaauu

SEQ ID NO: 4055107 - RNA, 19 nt, Staphylococcus aureus subsp. aureus N315
uaauuuugugaauuuauuu

SEQ ID NO: 4055108 - RNA, 13 nt, Staphylococcus aureus subsp. aureus N315
uaauuuuuaaauc

SEQ ID NO: 4055109 - RNA, 15 nt, Staphylococcus aureus subsp. aureus N315
uaauuuuuaacagcg

SEQ ID NO: 4055110 - RNA, 14 nt, Staphylococcus aureus subsp. aureus N315
uaauuuuuaaucuu

SEQ ID NO: 4055111 - RNA, 17 nt, Staphylococcus aureus subsp. aureus N315
uaauuuuucuaaaugau

SEQ ID NO: 4055112 - RNA, 18 nt, Staphylococcus aureus subsp. aureus N315
uaauuuuucuaaaugauu

SEQ ID NO: 4055113 - RNA, 14 nt, Staphylococcus aureus subsp. aureus N315
uaauuuuucuucuu

SEQ ID NO: 4055114 - RNA, 15 nt, Staphylococcus aureus subsp. aureus N315
uaauuuuucuucuuu

SEQ ID NO: 4055115 - RNA, 13 nt, Staphylococcus aureus subsp. aureus N315
uaauuuuuugaca

SEQ ID NO: 4055116 - RNA, 22 nt, Staphylococcus aureus subsp. aureus N315
uaauuuuuuuccuuucuuuuuc

SEQ ID NO: 4055117 - RNA, 12 nt, Staphylococcus aureus subsp. aureus N315
uacaaaacaaau

SEQ ID NO: 4055118 - RNA, 15 nt, Staphylococcus aureus subsp. aureus N315
uacaaaacaaaucca

SEQ ID NO: 4055119 - RNA, 21 nt, Staphylococcus aureus subsp. aureus N315
uacaaaacaccucgauauuau

SEQ ID NO: 4055120 - RNA, 13 nt, Staphylococcus aureus subsp. aureus N315
uacaaaacauauu

SEQ ID NO: 4055121 - RNA, 17 nt, Staphylococcus aureus subsp. aureus N315
uacaaaacauauucagu

SEQ ID NO: 4055122 - RNA, 17 nt, Staphylococcus aureus subsp. aureus N315
uacaaacaaugcaaguu

SEQ ID NO: 4055123 - RNA, 22 nt, Staphylococcus aureus subsp. aureus N315
uacaaacauuccucuauuguau

SEQ ID NO: 4055124 - RNA, 16 nt, Staphylococcus aureus subsp. aureus N315
uacaaacuugguauug

SEQ ID NO: 4055125 - RNA, 17 nt, Staphylococcus aureus subsp. aureus N315
uacaaagccuuaauauc

SEQ ID NO: 4055126 - RNA, 22 nt, Staphylococcus aureus subsp. aureus N315
uacaaagccuuaauaucaugca

SEQ ID NO: 4055127 - RNA, 16 nt, Staphylococcus aureus subsp. aureus N315
uacaaagucauuuuca

SEQ ID NO: 4055128 - RNA, 17 nt, Staphylococcus aureus subsp. aureus N315
uacaaagucauuuucau

SEQ ID NO: 4055129 - RNA, 15 nt, Staphylococcus aureus subsp. aureus N315
uacaaagugauuuaa

SEQ ID NO: 4055130 - RNA, 20 nt, Staphylococcus aureus subsp. aureus N315
uacaaaguuuauacuuaaua

SEQ ID NO: 4055131 - RNA, 19 nt, Staphylococcus aureus subsp. aureus N315
uacaaauaacaaacauuaa

SEQ ID NO: 4055132 - RNA, 23 nt, Staphylococcus aureus subsp. aureus N315
uacaaauaacaaacauuaaucua

SEQ ID NO: 4055133 - RNA, 17 nt, Staphylococcus aureus subsp. aureus N315
uacaaauauguaaucag

SEQ ID NO: 4055134 - RNA, 22 nt, Staphylococcus aureus subsp. aureus N315
uacaaauauuguggaaaacgug

SEQ ID NO: 4055135 - RNA, 20 nt, Staphylococcus aureus subsp. aureus N315
uacaaaucaugacauaaaac

SEQ ID NO: 4055136 - RNA, 14 nt, Staphylococcus aureus subsp. aureus N315
uacaaaucgauauu

SEQ ID NO: 4055137 - RNA, 18 nt, Staphylococcus aureus subsp. aureus N315
uacaaaucguaaacauaa

SEQ ID NO: 4055138 - RNA, 18 nt, Staphylococcus aureus subsp. aureus N315
uacaaauuacaauaagcg

SEQ ID NO: 4055139 - RNA, 13 nt, Staphylococcus aureus subsp. aureus N315
uacaaauugauuu

SEQ ID NO: 4055140 - RNA, 18 nt, Staphylococcus aureus subsp. aureus N315
uacaaauuuuuuuuauua

SEQ ID NO: 4055141 - RNA, 15 nt, Staphylococcus aureus subsp. aureus N315
uacaacaguaaucau

SEQ ID NO: 4055142 - RNA, 18 nt, Staphylococcus aureus subsp. aureus N315
uacaacucguuuuuccau

SEQ ID NO: 4055143 - RNA, 19 nt, Staphylococcus aureus subsp. aureus N315
uacaacucguuuuuccaug

SEQ ID NO: 4055144 - RNA, 20 nt, Staphylococcus aureus subsp. aureus N315
uacaacucguuuuuccaugu

SEQ ID NO: 4055145 - RNA, 19 nt, Staphylococcus aureus subsp. aureus N315
uacaacuguuggaauaccu

SEQ ID NO: 4055146 - RNA, 20 nt, Staphylococcus aureus subsp. aureus N315
uacaacuguuggaauaccuu

SEQ ID NO: 4055147 - RNA, 23 nt, Staphylococcus aureus subsp. aureus N315
uacaagucuuauuuguuuaauua

SEQ ID NO: 4055148 - RNA, 21 nt, Staphylococcus aureus subsp. aureus N315
uacaaguugaucaaaaauguu

SEQ ID NO: 4055149 - RNA, 18 nt, Staphylococcus aureus subsp. aureus N315
uacaaguuuauaaucuuu

SEQ ID NO: 4055150 - RNA, 19 nt, Staphylococcus aureus subsp. aureus N315
uacaauaagcgcaauuaaa

SEQ ID NO: 4055151 - RNA, 20 nt, Staphylococcus aureus subsp. aureus N315
uacaauaagcgcaauuaaaa

SEQ ID NO: 4055152 - RNA, 21 nt, Staphylococcus aureus subsp. aureus N315
uacaauaagcgcaauuaaaag

SEQ ID NO: 4055153 - RNA, 13 nt, Staphylococcus aureus subsp. aureus N315
uacaauaaucacu

SEQ ID NO: 4055154 - RNA, 14 nt, Staphylococcus aureus subsp. aureus N315
uacaauaaugugca

SEQ ID NO: 4055155 - RNA, 22 nt, Staphylococcus aureus subsp. aureus N315
uacaauaaugugcaaguugggg

SEQ ID NO: 4055156 - RNA, 19 nt, Staphylococcus aureus subsp. aureus N315
uacaauacuucguauugaa

SEQ ID NO: 4055157 - RNA, 17 nt, Staphylococcus aureus subsp. aureus N315
uacaauaguauaaauau

SEQ ID NO: 4055158 - RNA, 13 nt, Staphylococcus aureus subsp. aureus N315
uacaauauaauuu

SEQ ID NO: 4055159 - RNA, 14 nt, Staphylococcus aureus subsp. aureus N315
uacaauaugauuaa

SEQ ID NO: 4055160 - RNA, 18 nt, Staphylococcus aureus subsp. aureus N315
uacaauauuaaaauuaaa

SEQ ID NO: 4055161 - RNA, 20 nt, Staphylococcus aureus subsp. aureus N315
uacaauauucaauaauucau

SEQ ID NO: 4055162 - RNA, 19 nt, Staphylococcus aureus subsp. aureus N315
uacaaucauuuauguagau

SEQ ID NO: 4055163 - RNA, 14 nt, Staphylococcus aureus subsp. aureus N315
uacaaugaaaaaac

SEQ ID NO: 4055164 - RNA, 22 nt, Staphylococcus aureus subsp. aureus N315
uacaaugaauuguuaguuuucu

SEQ ID NO: 4055165 - RNA, 23 nt, Staphylococcus aureus subsp. aureus N315
uacaaugaauuguuaguuuucuu

SEQ ID NO: 4055166 - RNA, 17 nt, Staphylococcus aureus subsp. aureus N315
uacaauuaaagugaaua

SEQ ID NO: 4055167 - RNA, 13 nt, Staphylococcus aureus subsp. aureus N315
uacaauuaauuac

SEQ ID NO: 4055168 - RNA, 16 nt, Staphylococcus aureus subsp. aureus N315
uacaauuauaaaugau

SEQ ID NO: 4055169 - RNA, 16 nt, Staphylococcus aureus subsp. aureus N315
uacaauucauaagaaa

SEQ ID NO: 4055170 - RNA, 18 nt, Staphylococcus aureus subsp. aureus N315
uacaauucauaagaaaaa

SEQ ID NO: 4055171 - RNA, 19 nt, Staphylococcus aureus subsp. aureus N315
uacaauucauaagaaaaau

SEQ ID NO: 4055172 - RNA, 13 nt, Staphylococcus aureus subsp. aureus N315
uacaauuuccuac

SEQ ID NO: 4055173 - RNA, 21 nt, Staphylococcus aureus subsp. aureus N315
uacaauuucuucauuuucauu

SEQ ID NO: 4055174 - RNA, 17 nt, Staphylococcus aureus subsp. aureus N315
uacaauuuuccuuccaa

SEQ ID NO: 4055175 - RNA, 22 nt, Staphylococcus aureus subsp. aureus N315
uacaauuuuccuuccaauaaua

SEQ ID NO: 4055176 - RNA, 23 nt, Staphylococcus aureus subsp. aureus N315
uacaauuuuccuuccaauaauaa

SEQ ID NO: 4055177 - RNA, 16 nt, Staphylococcus aureus subsp. aureus N315
uacaauuuuuaaaaac

SEQ ID NO: 4055178 - RNA, 15 nt, Staphylococcus aureus subsp. aureus N315
uacacaaauuaaaac

SEQ ID NO: 4055179 - RNA, 22 nt, Staphylococcus aureus subsp. aureus N315
uacacaaauuuuuuguaaacau

SEQ ID NO: 4055180 - RNA, 15 nt, Staphylococcus aureus subsp. aureus N315
uacaccacuuaggau

SEQ ID NO: 4055181 - RNA, 14 nt, Staphylococcus aureus subsp. aureus N315
uacaccuauaccuc

SEQ ID NO: 4055182 - RNA, 17 nt, Staphylococcus aureus subsp. aureus N315
uacaccugcaauauagc

SEQ ID NO: 4055183 - RNA, 14 nt, Staphylococcus aureus subsp. aureus N315
uacacgcauuacuu

SEQ ID NO: 4055184 - RNA, 19 nt, Staphylococcus aureus subsp. aureus N315
uacacguuucguugcugau

SEQ ID NO: 4055185 - RNA, 22 nt, Staphylococcus aureus subsp. aureus N315
uacacuaaaaccuauuccuaau

SEQ ID NO: 4055186 - RNA, 23 nt, Staphylococcus aureus subsp. aureus N315
uacacuaaguuuucuuucuuuug

SEQ ID NO: 4055187 - RNA, 17 nt, Staphylococcus aureus subsp. aureus N315
uacacuaucguuuuuau

SEQ ID NO: 4055188 - RNA, 18 nt, Staphylococcus aureus subsp. aureus N315
uacacucaaacaagauuc

SEQ ID NO: 4055189 - RNA, 22 nt, Staphylococcus aureus subsp. aureus N315
uacacugcacaucauaauaaau

SEQ ID NO: 4055190 - RNA, 17 nt, Staphylococcus aureus subsp. aureus N315
uacacuguuuuauaaau

SEQ ID NO: 4055191 - RNA, 16 nt, Staphylococcus aureus subsp. aureus N315
uacacuuacaaauauu

SEQ ID NO: 4055192 - RNA, 14 nt, Staphylococcus aureus subsp. aureus N315
uacacuugauuauc

SEQ ID NO: 4055193 - RNA, 16 nt, Staphylococcus aureus subsp. aureus N315
uacacuugauuaucau

SEQ ID NO: 4055194 - RNA, 22 nt, Staphylococcus aureus subsp. aureus N315
uacacuuggcuuaggaugaaaa

SEQ ID NO: 4055195 - RNA, 12 nt, Staphylococcus aureus subsp. aureus N315
uacacuuuugau

SEQ ID NO: 4055196 - RNA, 21 nt, Staphylococcus aureus subsp. aureus N315
uacagaauggauaccuaaagc

SEQ ID NO: 4055197 - RNA, 16 nt, Staphylococcus aureus subsp. aureus N315
uacagacaaacauuac

SEQ ID NO: 4055198 - RNA, 21 nt, Staphylococcus aureus subsp. aureus N315
uacagagaaucaauuauugaa

SEQ ID NO: 4055199 - RNA, 18 nt, Staphylococcus aureus subsp. aureus N315
uacagauaaguaauaaua

SEQ ID NO: 4055200 - RNA, 14 nt, Staphylococcus aureus subsp. aureus N315
uacagauaauuauu

SEQ ID NO: 4055201 - RNA, 15 nt, Staphylococcus aureus subsp. aureus N315
uacagauaauuauuu

SEQ ID NO: 4055202 - RNA, 22 nt, Staphylococcus aureus subsp. aureus N315
uacagauaggaaacuuaaauau

SEQ ID NO: 4055203 - RNA, 21 nt, Staphylococcus aureus subsp. aureus N315
uacagauuccugcaaaauguu

SEQ ID NO: 4055204 - RNA, 17 nt, Staphylococcus aureus subsp. aureus N315
uacagauuuuaaaaauu

SEQ ID NO: 4055205 - RNA, 19 nt, Staphylococcus aureus subsp. aureus N315
uacagauuuuaaaaauuca

SEQ ID NO: 4055206 - RNA, 13 nt, Staphylococcus aureus subsp. aureus N315
uacagcauauaau

SEQ ID NO: 4055207 - RNA, 16 nt, Staphylococcus aureus subsp. aureus N315
uacagccauugacaca

SEQ ID NO: 4055208 - RNA, 23 nt, Staphylococcus aureus subsp. aureus N315
uacagcguauuuuaaugauuuuu

SEQ ID NO: 4055209 - RNA, 22 nt, Staphylococcus aureus subsp. aureus N315
uacagcgugauucaucuauuau

SEQ ID NO: 4055210 - RNA, 15 nt, Staphylococcus aureus subsp. aureus N315
uacagguaaugcaag

SEQ ID NO: 4055211 - RNA, 16 nt, Staphylococcus aureus subsp. aureus N315
uacagguuuaaacauc

SEQ ID NO: 4055212 - RNA, 21 nt, Staphylococcus aureus subsp. aureus N315
uacagguuuaauaaauuuaac

SEQ ID NO: 4055213 - RNA, 19 nt, Staphylococcus aureus subsp. aureus N315
uacagguuuuaaaauuaaa

SEQ ID NO: 4055214 - RNA, 12 nt, Staphylococcus aureus subsp. aureus N315
uacaguaauauu

SEQ ID NO: 4055215 - RNA, 17 nt, Staphylococcus aureus subsp. aureus N315
uacaguaauauucaacu

SEQ ID NO: 4055216 - RNA, 20 nt, Staphylococcus aureus subsp. aureus N315
uacagucaauacaaagaauu

SEQ ID NO: 4055217 - RNA, 18 nt, Staphylococcus aureus subsp. aureus N315
uacauaaaauggcaucug

SEQ ID NO: 4055218 - RNA, 12 nt, Staphylococcus aureus subsp. aureus N315
uacauaaaucua

SEQ ID NO: 4055219 - RNA, 13 nt, Staphylococcus aureus subsp. aureus N315
uacauaaaucuaa

SEQ ID NO: 4055220 - RNA, 22 nt, Staphylococcus aureus subsp. aureus N315
uacauaaaugcuaaaaguauaa

SEQ ID NO: 4055221 - RNA, 15 nt, Staphylococcus aureus subsp. aureus N315
uacauaacccuaaaa

SEQ ID NO: 4055222 - RNA, 18 nt, Staphylococcus aureus subsp. aureus N315
uacauaacccuaaaauga

SEQ ID NO: 4055223 - RNA, 14 nt, Staphylococcus aureus subsp. aureus N315
uacauaauaaaaag

SEQ ID NO: 4055224 - RNA, 14 nt, Staphylococcus aureus subsp. aureus N315
uacauaaugguuca

SEQ ID NO: 4055225 - RNA, 20 nt, Staphylococcus aureus subsp. aureus N315
uacauaauuuaucaauuucu

SEQ ID NO: 4055226 - RNA, 22 nt, Staphylococcus aureus subsp. aureus N315
uacauaauuuaucugcaaaaug

SEQ ID NO: 4055227 - RNA, 15 nt, Staphylococcus aureus subsp. aureus N315
uacauaauuugaauu

SEQ ID NO: 4055228 - RNA, 21 nt, Staphylococcus aureus subsp. aureus N315
uacauaccacacuuuaaacaa

SEQ ID NO: 4055229 - RNA, 22 nt, Staphylococcus aureus subsp. aureus N315
uacauaccgauuuucaaccauc

SEQ ID NO: 4055230 - RNA, 18 nt, Staphylococcus aureus subsp. aureus N315
uacauacggcaaauucaa

SEQ ID NO: 4055231 - RNA, 21 nt, Staphylococcus aureus subsp. aureus N315
uacauacggcaaauucaacuu

SEQ ID NO: 4055232 - RNA, 15 nt, Staphylococcus aureus subsp. aureus N315
uacauaggauaucua

SEQ ID NO: 4055233 - RNA, 16 nt, Staphylococcus aureus subsp. aureus N315
uacauaggauaucuac

SEQ ID NO: 4055234 - RNA, 17 nt, Staphylococcus aureus subsp. aureus N315
uacauauaauaugugca

SEQ ID NO: 4055235 - RNA, 14 nt, Staphylococcus aureus subsp. aureus N315
uacauauguguaug

SEQ ID NO: 4055236 - RNA, 16 nt, Staphylococcus aureus subsp. aureus N315
uacauauguguaugau

SEQ ID NO: 4055237 - RNA, 17 nt, Staphylococcus aureus subsp. aureus N315
uacauauucucugcuuc

SEQ ID NO: 4055238 - RNA, 21 nt, Staphylococcus aureus subsp. aureus N315
uacauauucucugcuucuaaa

SEQ ID NO: 4055239 - RNA, 13 nt, Staphylococcus aureus subsp. aureus N315
uacaucaauuucu

SEQ ID NO: 4055240 - RNA, 17 nt, Staphylococcus aureus subsp. aureus N315
uacaucauuaaauauuu

SEQ ID NO: 4055241 - RNA, 21 nt, Staphylococcus aureus subsp. aureus N315
uacaucauuaaauauuuagau

SEQ ID NO: 4055242 - RNA, 14 nt, Staphylococcus aureus subsp. aureus N315
uacauccauacuuc

SEQ ID NO: 4055243 - RNA, 14 nt, Staphylococcus aureus subsp. aureus N315
uacaucguguugcu

SEQ ID NO: 4055244 - RNA, 14 nt, Staphylococcus aureus subsp. aureus N315
uacaucuaauaaau

SEQ ID NO: 4055245 - RNA, 19 nt, Staphylococcus aureus subsp. aureus N315
uacaugcaccuuuacaaca

SEQ ID NO: 4055246 - RNA, 14 nt, Staphylococcus aureus subsp. aureus N315
uacauguacauuau

SEQ ID NO: 4055247 - RNA, 16 nt, Staphylococcus aureus subsp. aureus N315
uacauguauaaaagau

SEQ ID NO: 4055248 - RNA, 18 nt, Staphylococcus aureus subsp. aureus N315
uacauuaaagaaaauauc

SEQ ID NO: 4055249 - RNA, 15 nt, Staphylococcus aureus subsp. aureus N315
uacauuaauauaaau

SEQ ID NO: 4055250 - RNA, 17 nt, Staphylococcus aureus subsp. aureus N315
uacauuaauauaaauau

SEQ ID NO: 4055251 - RNA, 17 nt, Staphylococcus aureus subsp. aureus N315
uacauuacauauaucaa

SEQ ID NO: 4055252 - RNA, 18 nt, Staphylococcus aureus subsp. aureus N315
uacauuacgcucaucacc

SEQ ID NO: 4055253 - RNA, 22 nt, Staphylococcus aureus subsp. aureus N315
uacauucuauguagcaggcaac

SEQ ID NO: 4055254 - RNA, 14 nt, Staphylococcus aureus subsp. aureus N315
uacauugauaaaau

SEQ ID NO: 4055255 - RNA, 15 nt, Staphylococcus aureus subsp. aureus N315
uacauugauaaaaua

SEQ ID NO: 4055256 - RNA, 17 nt, Staphylococcus aureus subsp. aureus N315
uacauuguaaauauagu

SEQ ID NO: 4055257 - RNA, 23 nt, Staphylococcus aureus subsp. aureus N315
uacauuuaauggucuaauaucaa

SEQ ID NO: 4055258 - RNA, 20 nt, Staphylococcus aureus subsp. aureus N315
uacauuuauuuucaauaaau

SEQ ID NO: 4055259 - RNA, 22 nt, Staphylococcus aureus subsp. aureus N315
uacauuuauuuucaauaaauaa

SEQ ID NO: 4055260 - RNA, 20 nt, Staphylococcus aureus subsp. aureus N315
uacauuucuauacaaucauu

SEQ ID NO: 4055261 - RNA, 23 nt, Staphylococcus aureus subsp. aureus N315
uacauuucucguuucgucagauu

SEQ ID NO: 4055262 - RNA, 14 nt, Staphylococcus aureus subsp. aureus N315
uacauuuguagaga

SEQ ID NO: 4055263 - RNA, 17 nt, Staphylococcus aureus subsp. aureus N315
uacauuuugcucuaaac

SEQ ID NO: 4055264 - RNA, 17 nt, Staphylococcus aureus subsp. aureus N315
uaccaaaaaguauugcc

SEQ ID NO: 4055265 - RNA, 14 nt, Staphylococcus aureus subsp. aureus N315
uaccaaacaauaca

SEQ ID NO: 4055266 - RNA, 13 nt, Staphylococcus aureus subsp. aureus N315
uaccaaacugccu

SEQ ID NO: 4055267 - RNA, 18 nt, Staphylococcus aureus subsp. aureus N315
uaccaaagaaaucaccag

SEQ ID NO: 4055268 - RNA, 12 nt, Staphylococcus aureus subsp. aureus N315
uaccaaauauau

SEQ ID NO: 4055269 - RNA, 15 nt, Staphylococcus aureus subsp. aureus N315
uaccaagaaauacuc

SEQ ID NO: 4055270 - RNA, 19 nt, Staphylococcus aureus subsp. aureus N315
uaccaagugcuuuuuuacc

SEQ ID NO: 4055271 - RNA, 18 nt, Staphylococcus aureus subsp. aureus N315
uaccaauacguuuccaau

SEQ ID NO: 4055272 - RNA, 22 nt, Staphylococcus aureus subsp. aureus N315
uaccaauaucaugcaaaauaau

SEQ ID NO: 4055273 - RNA, 15 nt, Staphylococcus aureus subsp. aureus N315
uaccaaugaauaaau

SEQ ID NO: 4055274 - RNA, 17 nt, Staphylococcus aureus subsp. aureus N315
uaccaauugauuuugcu

SEQ ID NO: 4055275 - RNA, 17 nt, Staphylococcus aureus subsp. aureus N315
uaccaauugcuucuucg

SEQ ID NO: 4055276 - RNA, 17 nt, Staphylococcus aureus subsp. aureus N315
uaccaauuuuuagcauu

SEQ ID NO: 4055277 - RNA, 13 nt, Staphylococcus aureus subsp. aureus N315
uaccacaaauauc

SEQ ID NO: 4055278 - RNA, 20 nt, Staphylococcus aureus subsp. aureus N315
uaccacacuuuaaacaagca

SEQ ID NO: 4055279 - RNA, 20 nt, Staphylococcus aureus subsp. aureus N315
uaccacaucgcauaauaucu

SEQ ID NO: 4055280 - RNA, 16 nt, Staphylococcus aureus subsp. aureus N315
uaccaccagccccaau

SEQ ID NO: 4055281 - RNA, 12 nt, Staphylococcus aureus subsp. aureus N315
uaccaccccaac

SEQ ID NO: 4055282 - RNA, 20 nt, Staphylococcus aureus subsp. aureus N315
uaccacgaacaagucuugca

SEQ ID NO: 4055283 - RNA, 15 nt, Staphylococcus aureus subsp. aureus N315
uaccacuugaauacu

SEQ ID NO: 4055284 - RNA, 19 nt, Staphylococcus aureus subsp. aureus N315
uaccacuugaauacuuuuu

SEQ ID NO: 4055285 - RNA, 22 nt, Staphylococcus aureus subsp. aureus N315
uaccacuugaauacuuuuuaac

SEQ ID NO: 4055286 - RNA, 19 nt, Staphylococcus aureus subsp. aureus N315
uaccacuuuuucuguaaua

SEQ ID NO: 4055287 - RNA, 12 nt, Staphylococcus aureus subsp. aureus N315
uaccagcaugaa

SEQ ID NO: 4055288 - RNA, 15 nt, Staphylococcus aureus subsp. aureus N315
uaccaguucaacaug

SEQ ID NO: 4055289 - RNA, 15 nt, Staphylococcus aureus subsp. aureus N315
uaccauauaauucuu

SEQ ID NO: 4055290 - RNA, 22 nt, Staphylococcus aureus subsp. aureus N315
uaccaucuucgacuacaaguuu

SEQ ID NO: 4055291 - RNA, 14 nt, Staphylococcus aureus subsp. aureus N315
uaccaucuuuaaua

SEQ ID NO: 4055292 - RNA, 15 nt, Staphylococcus aureus subsp. aureus N315
uaccaucuuuaauac

SEQ ID NO: 4055293 - RNA, 23 nt, Staphylococcus aureus subsp. aureus N315
uaccaugaugagauaaaaucaua

SEQ ID NO: 4055294 - RNA, 17 nt, Staphylococcus aureus subsp. aureus N315
uaccauguuuuuuaagu

SEQ ID NO: 4055295 - RNA, 18 nt, Staphylococcus aureus subsp. aureus N315
uaccauguuuuuuaagua

SEQ ID NO: 4055296 - RNA, 16 nt, Staphylococcus aureus subsp. aureus N315
uaccauugugaauaau

SEQ ID NO: 4055297 - RNA, 23 nt, Staphylococcus aureus subsp. aureus N315
uaccauugugaugauaauuaaug

SEQ ID NO: 4055298 - RNA, 12 nt, Staphylococcus aureus subsp. aureus N315
uaccauuugcug

SEQ ID NO: 4055299 - RNA, 19 nt, Staphylococcus aureus subsp. aureus N315
uacccaaaaaauuguauaa

SEQ ID NO: 4055300 - RNA, 20 nt, Staphylococcus aureus subsp. aureus N315
uacccacaucuuuuuaaaag

SEQ ID NO: 4055301 - RNA, 19 nt, Staphylococcus aureus subsp. aureus N315
uacccauuuuuuuccaagc

SEQ ID NO: 4055302 - RNA, 17 nt, Staphylococcus aureus subsp. aureus N315
uaccccaaguccaauuc

SEQ ID NO: 4055303 - RNA, 15 nt, Staphylococcus aureus subsp. aureus N315
uacccuauuuuacaa

SEQ ID NO: 4055304 - RNA, 22 nt, Staphylococcus aureus subsp. aureus N315
uacccuugcaaauauaucaucu

SEQ ID NO: 4055305 - RNA, 18 nt, Staphylococcus aureus subsp. aureus N315
uaccguauuuuaauauug

SEQ ID NO: 4055306 - RNA, 11 nt, Staphylococcus aureus subsp. aureus N315
uaccuaaaaua

SEQ ID NO: 4055307 - RNA, 14 nt, Staphylococcus aureus subsp. aureus N315
uaccuaaaauaccc

SEQ ID NO: 4055308 - RNA, 16 nt, Staphylococcus aureus subsp. aureus N315
uaccuaaaauagaaaa

SEQ ID NO: 4055309 - RNA, 19 nt, Staphylococcus aureus subsp. aureus N315
uaccuaaaauagaaaaauu

SEQ ID NO: 4055310 - RNA, 19 nt, Staphylococcus aureus subsp. aureus N315
uaccuaaagcuaauacacc

SEQ ID NO: 4055311 - RNA, 17 nt, Staphylococcus aureus subsp. aureus N315
uaccuaaccauaacaau

SEQ ID NO: 4055312 - RNA, 19 nt, Staphylococcus aureus subsp. aureus N315
uaccuaagcugauuaaaau

SEQ ID NO: 4055313 - RNA, 15 nt, Staphylococcus aureus subsp. aureus N315
uaccuaauaggauuu

SEQ ID NO: 4055314 - RNA, 14 nt, Staphylococcus aureus subsp. aureus N315
uaccuacaaauaug

SEQ ID NO: 4055315 - RNA, 15 nt, Staphylococcus aureus subsp. aureus N315
uaccuacagaaugga

SEQ ID NO: 4055316 - RNA, 21 nt, Staphylococcus aureus subsp. aureus N315
uaccuacagaauggauaccua

SEQ ID NO: 4055317 - RNA, 20 nt, Staphylococcus aureus subsp. aureus N315
uaccuaguaacucaacauuu

SEQ ID NO: 4055318 - RNA, 14 nt, Staphylococcus aureus subsp. aureus N315
uaccuauaaacaua

SEQ ID NO: 4055319 - RNA, 16 nt, Staphylococcus aureus subsp. aureus N315
uaccuauuaauaucau

SEQ ID NO: 4055320 - RNA, 17 nt, Staphylococcus aureus subsp. aureus N315
uaccuauuaauaucaua

SEQ ID NO: 4055321 - RNA, 18 nt, Staphylococcus aureus subsp. aureus N315
uaccuccccaacuuaaua

SEQ ID NO: 4055322 - RNA, 20 nt, Staphylococcus aureus subsp. aureus N315
uaccuggguuaccaaguaau

SEQ ID NO: 4055323 - RNA, 20 nt, Staphylococcus aureus subsp. aureus N315
uaccugguucgauuguaaua

SEQ ID NO: 4055324 - RNA, 20 nt, Staphylococcus aureus subsp. aureus N315
uaccuugauucauuucgauu

SEQ ID NO: 4055325 - RNA, 18 nt, Staphylococcus aureus subsp. aureus N315
uaccuuuaaaucuacuuu

SEQ ID NO: 4055326 - RNA, 13 nt, Staphylococcus aureus subsp. aureus N315
uaccuuuaauaau

SEQ ID NO: 4055327 - RNA, 16 nt, Staphylococcus aureus subsp. aureus N315
uaccuuuaauaauauu

SEQ ID NO: 4055328 - RNA, 14 nt, Staphylococcus aureus subsp. aureus N315
uaccuuuaauaucu

SEQ ID NO: 4055329 - RNA, 15 nt, Staphylococcus aureus subsp. aureus N315
uaccuuuacuuucau

SEQ ID NO: 4055330 - RNA, 16 nt, Staphylococcus aureus subsp. aureus N315
uaccuuuacuuucauu

SEQ ID NO: 4055331 - RNA, 14 nt, Staphylococcus aureus subsp. aureus N315
uaccuuuauuauuu

SEQ ID NO: 4055332 - RNA, 15 nt, Staphylococcus aureus subsp. aureus N315
uaccuuugucuuuuu

SEQ ID NO: 4055333 - RNA, 16 nt, Staphylococcus aureus subsp. aureus N315
uaccuuugucuuuuuu

SEQ ID NO: 4055334 - RNA, 20 nt, Staphylococcus aureus subsp. aureus N315
uaccuuuuucuaaaccaaca

SEQ ID NO: 4055335 - RNA, 19 nt, Staphylococcus aureus subsp. aureus N315
uacgaaaguagaauuauuu

SEQ ID NO: 4055336 - RNA, 13 nt, Staphylococcus aureus subsp. aureus N315
uacgaaaugcaau

SEQ ID NO: 4055337 - RNA, 23 nt, Staphylococcus aureus subsp. aureus N315
uacgaaguuuaaaugugcaauua

SEQ ID NO: 4055338 - RNA, 22 nt, Staphylococcus aureus subsp. aureus N315
uacgaaucacaguuauauauuc

SEQ ID NO: 4055339 - RNA, 11 nt, Staphylococcus aureus subsp. aureus N315
uacgacucucc

SEQ ID NO: 4055340 - RNA, 19 nt, Staphylococcus aureus subsp. aureus N315
uacgaucaaaaucaugcuc

SEQ ID NO: 4055341 - RNA, 17 nt, Staphylococcus aureus subsp. aureus N315
uacgaucauaaauauuu

SEQ ID NO: 4055342 - RNA, 20 nt, Staphylococcus aureus subsp. aureus N315
uacgaugaugauuuauaaaa

SEQ ID NO: 4055343 - RNA, 20 nt, Staphylococcus aureus subsp. aureus N315
uacgauugaguugaaaauaa

SEQ ID NO: 4055344 - RNA, 22 nt, Staphylococcus aureus subsp. aureus N315
uacgcaaugauuauaaauacau

SEQ ID NO: 4055345 - RNA, 21 nt, Staphylococcus aureus subsp. aureus N315
uacgcauuuuaaauaaaaugc

SEQ ID NO: 4055346 - RNA, 20 nt, Staphylococcus aureus subsp. aureus N315
uacgccaccaguuucaagug

SEQ ID NO: 4055347 - RNA, 19 nt, Staphylococcus aureus subsp. aureus N315
uacgccuucuuuauaacuu

SEQ ID NO: 4055348 - RNA, 21 nt, Staphylococcus aureus subsp. aureus N315
uacgcuaaacaaugaugggaa

SEQ ID NO: 4055349 - RNA, 16 nt, Staphylococcus aureus subsp. aureus N315
uacgcugucucauuaa

SEQ ID NO: 4055350 - RNA, 15 nt, Staphylococcus aureus subsp. aureus N315
uacgcuuuuuaaaaa

SEQ ID NO: 4055351 - RNA, 16 nt, Staphylococcus aureus subsp. aureus N315
uacgcuuuuuaaaaaa

SEQ ID NO: 4055352 - RNA, 16 nt, Staphylococcus aureus subsp. aureus N315
uacggagacaaguaua

SEQ ID NO: 4055353 - RNA, 14 nt, Staphylococcus aureus subsp. aureus N315
uacgucauaaaaua

SEQ ID NO: 4055354 - RNA, 17 nt, Staphylococcus aureus subsp. aureus N315
uacgucauaaaauacca

SEQ ID NO: 4055355 - RNA, 23 nt, Staphylococcus aureus subsp. aureus N315
uacguuacuaaacuuuucuucaa

SEQ ID NO: 4055356 - RNA, 18 nt, Staphylococcus aureus subsp. aureus N315
uacguuauuucaauaaua

SEQ ID NO: 4055357 - RNA, 17 nt, Staphylococcus aureus subsp. aureus N315
uacguuuaauaaugguu

SEQ ID NO: 4055358 - RNA, 19 nt, Staphylococcus aureus subsp. aureus N315
uacguuuaauaaugguucu

SEQ ID NO: 4055359 - RNA, 14 nt, Staphylococcus aureus subsp. aureus N315
uacguuuuaaauaa

SEQ ID NO: 4055360 - RNA, 18 nt, Staphylococcus aureus subsp. aureus N315
uacuaaaaguguuaugaa

SEQ ID NO: 4055361 - RNA, 21 nt, Staphylococcus aureus subsp. aureus N315
uacuaaaaguguuaugaauua

SEQ ID NO: 4055362 - RNA, 17 nt, Staphylococcus aureus subsp. aureus N315
uacuaaaccucaacauu

SEQ ID NO: 4055363 - RNA, 14 nt, Staphylococcus aureus subsp. aureus N315
uacuaaacuuuuuu

SEQ ID NO: 4055364 - RNA, 13 nt, Staphylococcus aureus subsp. aureus N315
uacuaaaucauuu

SEQ ID NO: 4055365 - RNA, 15 nt, Staphylococcus aureus subsp. aureus N315
uacuaaauugagaag

SEQ ID NO: 4055366 - RNA, 15 nt, Staphylococcus aureus subsp. aureus N315
uacuaacugaagaca

SEQ ID NO: 4055367 - RNA, 21 nt, Staphylococcus aureus subsp. aureus N315
uacuaauauucuaggcaaaua

SEQ ID NO: 4055368 - RNA, 23 nt, Staphylococcus aureus subsp. aureus N315
uacuaauuucuauagaaaaagua

SEQ ID NO: 4055369 - RNA, 20 nt, Staphylococcus aureus subsp. aureus N315
uacuacaaacuugauuaugu

SEQ ID NO: 4055370 - RNA, 13 nt, Staphylococcus aureus subsp. aureus N315
uacuacauuauua

SEQ ID NO: 4055371 - RNA, 16 nt, Staphylococcus aureus subsp. aureus N315
uacuacgcauuauuaa

SEQ ID NO: 4055372 - RNA, 16 nt, Staphylococcus aureus subsp. aureus N315
uacuacuuaauuaaua

SEQ ID NO: 4055373 - RNA, 23 nt, Staphylococcus aureus subsp. aureus N315
uacuagaaagcacaccuaauuca

SEQ ID NO: 4055374 - RNA, 20 nt, Staphylococcus aureus subsp. aureus N315
uacuauaaaaucaucguauu

SEQ ID NO: 4055375 - RNA, 24 nt, Staphylococcus aureus subsp. aureus N315
uacuauaaaaucaucguauuucau

SEQ ID NO: 4055376 - RNA, 17 nt, Staphylococcus aureus subsp. aureus N315
uacuauaaauccuaagu

SEQ ID NO: 4055377 - RNA, 13 nt, Staphylococcus aureus subsp. aureus N315
uacuauacuuuga

SEQ ID NO: 4055378 - RNA, 13 nt, Staphylococcus aureus subsp. aureus N315
uacuauauauaau

SEQ ID NO: 4055379 - RNA, 15 nt, Staphylococcus aureus subsp. aureus N315
uacuauauucaauga

SEQ ID NO: 4055380 - RNA, 13 nt, Staphylococcus aureus subsp. aureus N315
uacuauauuuauu

SEQ ID NO: 4055381 - RNA, 16 nt, Staphylococcus aureus subsp. aureus N315
uacuaucuucaucaua

SEQ ID NO: 4055382 - RNA, 14 nt, Staphylococcus aureus subsp. aureus N315
uacuauggcauuau

SEQ ID NO: 4055383 - RNA, 15 nt, Staphylococcus aureus subsp. aureus N315
uacuauggcauuauu

SEQ ID NO: 4055384 - RNA, 23 nt, Staphylococcus aureus subsp. aureus N315
uacuauuaaaggaaaucaaucca

SEQ ID NO: 4055385 - RNA, 16 nt, Staphylococcus aureus subsp. aureus N315
uacuauuaaauaaucg

SEQ ID NO: 4055386 - RNA, 17 nt, Staphylococcus aureus subsp. aureus N315
uacuauuaguaugcaua

SEQ ID NO: 4055387 - RNA, 20 nt, Staphylococcus aureus subsp. aureus N315
uacuauuccguuucauugau

SEQ ID NO: 4055388 - RNA, 17 nt, Staphylococcus aureus subsp. aureus N315
uacuauuuguuuuaggu

SEQ ID NO: 4055389 - RNA, 23 nt, Staphylococcus aureus subsp. aureus N315
uacuauuuuugacuguuaaacaa

SEQ ID NO: 4055390 - RNA, 13 nt, Staphylococcus aureus subsp. aureus N315
uacucacaaaaaa

SEQ ID NO: 4055391 - RNA, 20 nt, Staphylococcus aureus subsp. aureus N315
uacucacugcacuuaugaua

SEQ ID NO: 4055392 - RNA, 22 nt, Staphylococcus aureus subsp. aureus N315
uacucacugcacuuaugauacu

SEQ ID NO: 4055393 - RNA, 13 nt, Staphylococcus aureus subsp. aureus N315
uacucauuuagcu

SEQ ID NO: 4055394 - RNA, 18 nt, Staphylococcus aureus subsp. aureus N315
uacucauuuagcucuacu

SEQ ID NO: 4055395 - RNA, 14 nt, Staphylococcus aureus subsp. aureus N315
uacucuaacuuacc

SEQ ID NO: 4055396 - RNA, 16 nt, Staphylococcus aureus subsp. aureus N315
uacucuaacuuaccau

SEQ ID NO: 4055397 - RNA, 19 nt, Staphylococcus aureus subsp. aureus N315
uacucugaaaagccuacuu

SEQ ID NO: 4055398 - RNA, 17 nt, Staphylococcus aureus subsp. aureus N315
uacucugggcauuuuga

SEQ ID NO: 4055399 - RNA, 17 nt, Staphylococcus aureus subsp. aureus N315
uacucuggucugugaua

SEQ ID NO: 4055400 - RNA, 23 nt, Staphylococcus aureus subsp. aureus N315
uacucuuuuucuuucauaauuaa

SEQ ID NO: 4055401 - RNA, 21 nt, Staphylococcus aureus subsp. aureus N315
uacugaaacaugagcuccucu

SEQ ID NO: 4055402 - RNA, 19 nt, Staphylococcus aureus subsp. aureus N315
uacugaugaacauaccugc

SEQ ID NO: 4055403 - RNA, 17 nt, Staphylococcus aureus subsp. aureus N315
uacugcaauuauuuuuc

SEQ ID NO: 4055404 - RNA, 22 nt, Staphylococcus aureus subsp. aureus N315
uacugcaauuauuuuucaaaua

SEQ ID NO: 4055405 - RNA, 22 nt, Staphylococcus aureus subsp. aureus N315
uacugcccaauguguuuaacuu

SEQ ID NO: 4055406 - RNA, 15 nt, Staphylococcus aureus subsp. aureus N315
uacugcugucuuuuu

SEQ ID NO: 4055407 - RNA, 16 nt, Staphylococcus aureus subsp. aureus N315
uacugcuguucucuau

SEQ ID NO: 4055408 - RNA, 19 nt, Staphylococcus aureus subsp. aureus N315
uacugcuguuuuuuauagu

SEQ ID NO: 4055409 - RNA, 18 nt, Staphylococcus aureus subsp. aureus N315
uacugcuucaaucgucac

SEQ ID NO: 4055410 - RNA, 16 nt, Staphylococcus aureus subsp. aureus N315
uacugguuaguaaaau

SEQ ID NO: 4055411 - RNA, 13 nt, Staphylococcus aureus subsp. aureus N315
uacuguaaucaau

SEQ ID NO: 4055412 - RNA, 21 nt, Staphylococcus aureus subsp. aureus N315
uacuguaguacuauagucauu

SEQ ID NO: 4055413 - RNA, 20 nt, Staphylococcus aureus subsp. aureus N315
uacugucucaucuucuaaau

SEQ ID NO: 4055414 - RNA, 16 nt, Staphylococcus aureus subsp. aureus N315
uacugugaaaauacca

SEQ ID NO: 4055415 - RNA, 21 nt, Staphylococcus aureus subsp. aureus N315
uacuguuuaaauaaaauuguu

SEQ ID NO: 4055416 - RNA, 13 nt, Staphylococcus aureus subsp. aureus N315
uacuguuugcuuu

SEQ ID NO: 4055417 - RNA, 16 nt, Staphylococcus aureus subsp. aureus N315
uacuuaaauuaagaau

SEQ ID NO: 4055418 - RNA, 20 nt, Staphylococcus aureus subsp. aureus N315
uacuuaaugacuucuuuaua

SEQ ID NO: 4055419 - RNA, 15 nt, Staphylococcus aureus subsp. aureus N315
uacuuaauuaauaau

SEQ ID NO: 4055420 - RNA, 16 nt, Staphylococcus aureus subsp. aureus N315
uacuuaauuaauaauu

SEQ ID NO: 4055421 - RNA, 21 nt, Staphylococcus aureus subsp. aureus N315
uacuuaauuuaaaucuguacu

SEQ ID NO: 4055422 - RNA, 21 nt, Staphylococcus aureus subsp. aureus N315
uacuuacuccguugaauucaa

SEQ ID NO: 4055423 - RNA, 14 nt, Staphylococcus aureus subsp. aureus N315
uacuuacugaaacu

SEQ ID NO: 4055424 - RNA, 19 nt, Staphylococcus aureus subsp. aureus N315
uacuuagcguacgauauag

SEQ ID NO: 4055425 - RNA, 23 nt, Staphylococcus aureus subsp. aureus N315
uacuuauauauucaauaauuauu

SEQ ID NO: 4055426 - RNA, 15 nt, Staphylococcus aureus subsp. aureus N315
uacuuauuucuuuuc

SEQ ID NO: 4055427 - RNA, 14 nt, Staphylococcus aureus subsp. aureus N315
uacuucaauaacaa

SEQ ID NO: 4055428 - RNA, 20 nt, Staphylococcus aureus subsp. aureus N315
uacuucaguuugguuugcuu

SEQ ID NO: 4055429 - RNA, 14 nt, Staphylococcus aureus subsp. aureus N315
uacuucauaaguca

SEQ ID NO: 4055430 - RNA, 19 nt, Staphylococcus aureus subsp. aureus N315
uacuucuaauuugcaaaau

SEQ ID NO: 4055431 - RNA, 20 nt, Staphylococcus aureus subsp. aureus N315
uacuucuauuuuauaauaaa

SEQ ID NO: 4055432 - RNA, 15 nt, Staphylococcus aureus subsp. aureus N315
uacuucucaauuuag

SEQ ID NO: 4055433 - RNA, 18 nt, Staphylococcus aureus subsp. aureus N315
uacuucucccuuaaauac

SEQ ID NO: 4055434 - RNA, 17 nt, Staphylococcus aureus subsp. aureus N315
uacuucuuuugcaaaac

SEQ ID NO: 4055435 - RNA, 17 nt, Staphylococcus aureus subsp. aureus N315
uacuugccuucaaauuc

SEQ ID NO: 4055436 - RNA, 17 nt, Staphylococcus aureus subsp. aureus N315
uacuuguaauuaauaca

SEQ ID NO: 4055437 - RNA, 18 nt, Staphylococcus aureus subsp. aureus N315
uacuuguaauuaauacau

SEQ ID NO: 4055438 - RNA, 19 nt, Staphylococcus aureus subsp. aureus N315
uacuuguaauuaauacauc

SEQ ID NO: 4055439 - RNA, 20 nt, Staphylococcus aureus subsp. aureus N315
uacuuguaauuaauacauca

SEQ ID NO: 4055440 - RNA, 15 nt, Staphylococcus aureus subsp. aureus N315
uacuuuaaaauugua

SEQ ID NO: 4055441 - RNA, 20 nt, Staphylococcus aureus subsp. aureus N315
uacuuuaaaauuguauagaa

SEQ ID NO: 4055442 - RNA, 13 nt, Staphylococcus aureus subsp. aureus N315
uacuuuaacaguu

SEQ ID NO: 4055443 - RNA, 17 nt, Staphylococcus aureus subsp. aureus N315
uacuuuacauuucucgu

SEQ ID NO: 4055444 - RNA, 14 nt, Staphylococcus aureus subsp. aureus N315
uacuuuauaaauau

SEQ ID NO: 4055445 - RNA, 15 nt, Staphylococcus aureus subsp. aureus N315
uacuuuaucguugua

SEQ ID NO: 4055446 - RNA, 19 nt, Staphylococcus aureus subsp. aureus N315
uacuuucaaauaaugugaa

SEQ ID NO: 4055447 - RNA, 17 nt, Staphylococcus aureus subsp. aureus N315
uacuuucacauuuucaa

SEQ ID NO: 4055448 - RNA, 17 nt, Staphylococcus aureus subsp. aureus N315
uacuuucacuuuuuaua

SEQ ID NO: 4055449 - RNA, 15 nt, Staphylococcus aureus subsp. aureus N315
uacuuucuaagauac

SEQ ID NO: 4055450 - RNA, 18 nt, Staphylococcus aureus subsp. aureus N315
uacuuuggaaauuuauua

SEQ ID NO: 4055451 - RNA, 22 nt, Staphylococcus aureus subsp. aureus N315
uacuuuggaaauuuauuauaaa

SEQ ID NO: 4055452 - RNA, 18 nt, Staphylococcus aureus subsp. aureus N315
uacuuuggacuuuaaagu

SEQ ID NO: 4055453 - RNA, 19 nt, Staphylococcus aureus subsp. aureus N315
uacuuuggacuuuaaaguu

SEQ ID NO: 4055454 - RNA, 18 nt, Staphylococcus aureus subsp. aureus N315
uacuuuguucugcuuuuu

SEQ ID NO: 4055455 - RNA, 15 nt, Staphylococcus aureus subsp. aureus N315
uacuuuuauaaucuu

SEQ ID NO: 4055456 - RNA, 21 nt, Staphylococcus aureus subsp. aureus N315
uacuuuuccuugauucuuaua

SEQ ID NO: 4055457 - RNA, 12 nt, Staphylococcus aureus subsp. aureus N315
uacuuuucuaaa

SEQ ID NO: 4055458 - RNA, 19 nt, Staphylococcus aureus subsp. aureus N315
uacuuuucucgauuaauuu

SEQ ID NO: 4055459 - RNA, 20 nt, Staphylococcus aureus subsp. aureus N315
uacuuuucucgauuaauuuu

SEQ ID NO: 4055460 - RNA, 18 nt, Staphylococcus aureus subsp. aureus N315
uacuuuucugucuguaaa

SEQ ID NO: 4055461 - RNA, 15 nt, Staphylococcus aureus subsp. aureus N315
uacuuuuuauauaau

SEQ ID NO: 4055462 - RNA, 15 nt, Staphylococcus aureus subsp. aureus N315
uacuuuuucaucuuu

SEQ ID NO: 4055463 - RNA, 11 nt, Staphylococcus aureus subsp. aureus N315
uagaaaacuag

SEQ ID NO: 4055464 - RNA, 14 nt, Staphylococcus aureus subsp. aureus N315
uagaaaacuagaac

SEQ ID NO: 4055465 - RNA, 18 nt, Staphylococcus aureus subsp. aureus N315
uagaaaagcaguaagaga

SEQ ID NO: 4055466 - RNA, 14 nt, Staphylococcus aureus subsp. aureus N315
uagaaaauaugacg

SEQ ID NO: 4055467 - RNA, 21 nt, Staphylococcus aureus subsp. aureus N315
uagaaaauaugacgaucuuca

SEQ ID NO: 4055468 - RNA, 12 nt, Staphylococcus aureus subsp. aureus N315
uagaaaauuaac

SEQ ID NO: 4055469 - RNA, 15 nt, Staphylococcus aureus subsp. aureus N315
uagaaacacuuuuag

SEQ ID NO: 4055470 - RNA, 16 nt, Staphylococcus aureus subsp. aureus N315
uagaaagcgcauuugu

SEQ ID NO: 4055471 - RNA, 15 nt, Staphylococcus aureus subsp. aureus N315
uagaaaggcaggcau

SEQ ID NO: 4055472 - RNA, 18 nt, Staphylococcus aureus subsp. aureus N315
uagaaagugauucccaaa

SEQ ID NO: 4055473 - RNA, 15 nt, Staphylococcus aureus subsp. aureus N315
uagaaaguugugguc

SEQ ID NO: 4055474 - RNA, 19 nt, Staphylococcus aureus subsp. aureus N315
uagaaauuaccguuuauuu

SEQ ID NO: 4055475 - RNA, 16 nt, Staphylococcus aureus subsp. aureus N315
uagaacauuuaucgug

SEQ ID NO: 4055476 - RNA, 17 nt, Staphylococcus aureus subsp. aureus N315
uagaacauuuaucguga

SEQ ID NO: 4055477 - RNA, 21 nt, Staphylococcus aureus subsp. aureus N315
uagaagaugauuauucucuuu

SEQ ID NO: 4055478 - RNA, 15 nt, Staphylococcus aureus subsp. aureus N315
uagaaguuuuuugau

SEQ ID NO: 4055479 - RNA, 18 nt, Staphylococcus aureus subsp. aureus N315
uagaauacuaaaaguguu

SEQ ID NO: 4055480 - RNA, 19 nt, Staphylococcus aureus subsp. aureus N315
uagaauaguuaccaaaauu

SEQ ID NO: 4055481 - RNA, 20 nt, Staphylococcus aureus subsp. aureus N315
uagaauauauguauaacauu

SEQ ID NO: 4055482 - RNA, 14 nt, Staphylococcus aureus subsp. aureus N315
uagaauauuaacgu

SEQ ID NO: 4055483 - RNA, 20 nt, Staphylococcus aureus subsp. aureus N315
uagaaucaaccguuuuauug

SEQ ID NO: 4055484 - RNA, 19 nt, Staphylococcus aureus subsp. aureus N315
uagaaucuacgauuuucaa

SEQ ID NO: 4055485 - RNA, 15 nt, Staphylococcus aureus subsp. aureus N315
uagaauuauuuagaa

SEQ ID NO: 4055486 - RNA, 19 nt, Staphylococcus aureus subsp. aureus N315
uagaauuauuuagaaacuu

SEQ ID NO: 4055487 - RNA, 16 nt, Staphylococcus aureus subsp. aureus N315
uagaauucuaaaagaa

SEQ ID NO: 4055488 - RNA, 17 nt, Staphylococcus aureus subsp. aureus N315
uagaauucuaaaagaau

SEQ ID NO: 4055489 - RNA, 19 nt, Staphylococcus aureus subsp. aureus N315
uagaauucuaaaagaauua

SEQ ID NO: 4055490 - RNA, 19 nt, Staphylococcus aureus subsp. aureus N315
uagaauuucuuuucgaaaa

SEQ ID NO: 4055491 - RNA, 20 nt, Staphylococcus aureus subsp. aureus N315
uagacaauuguaguaaugaa

SEQ ID NO: 4055492 - RNA, 18 nt, Staphylococcus aureus subsp. aureus N315
uagacaguaguuaauuga

SEQ ID NO: 4055493 - RNA, 14 nt, Staphylococcus aureus subsp. aureus N315
uagacauaaaaaaa

SEQ ID NO: 4055494 - RNA, 19 nt, Staphylococcus aureus subsp. aureus N315
uagacauugaauaaaugaa

SEQ ID NO: 4055495 - RNA, 20 nt, Staphylococcus aureus subsp. aureus N315
uagacuaacuguacuuugcc

SEQ ID NO: 4055496 - RNA, 20 nt, Staphylococcus aureus subsp. aureus N315
uagacucaaggaaaucauau

SEQ ID NO: 4055497 - RNA, 22 nt, Staphylococcus aureus subsp. aureus N315
uagacugccaauaaaaugcaau

SEQ ID NO: 4055498 - RNA, 20 nt, Staphylococcus aureus subsp. aureus N315
uagacuuauuugaaugcaaa

SEQ ID NO: 4055499 - RNA, 18 nt, Staphylococcus aureus subsp. aureus N315
uagacuuggauaaaaauu

SEQ ID NO: 4055500 - RNA, 13 nt, Staphylococcus aureus subsp. aureus N315
uagagaaagaaua

SEQ ID NO: 4055501 - RNA, 13 nt, Staphylococcus aureus subsp. aureus N315
uagagaacagcag

SEQ ID NO: 4055502 - RNA, 23 nt, Staphylococcus aureus subsp. aureus N315
uagagaacgcuuuauuacuuuaa

SEQ ID NO: 4055503 - RNA, 18 nt, Staphylococcus aureus subsp. aureus N315
uagagauuguaagaauua

SEQ ID NO: 4055504 - RNA, 23 nt, Staphylococcus aureus subsp. aureus N315
uagagcccgagacauaaauuaau

SEQ ID NO: 4055505 - RNA, 14 nt, Staphylococcus aureus subsp. aureus N315
uagagcguuuugcu

SEQ ID NO: 4055506 - RNA, 14 nt, Staphylococcus aureus subsp. aureus N315
uagagguaaaucua

SEQ ID NO: 4055507 - RNA, 15 nt, Staphylococcus aureus subsp. aureus N315
uagauaaaucaagaa

SEQ ID NO: 4055508 - RNA, 19 nt, Staphylococcus aureus subsp. aureus N315
uagauaaaucgauaaaaug

SEQ ID NO: 4055509 - RNA, 23 nt, Staphylococcus aureus subsp. aureus N315
uagauaaucucauucuuuaauau

SEQ ID NO: 4055510 - RNA, 18 nt, Staphylococcus aureus subsp. aureus N315
uagauacauauaagaauu

SEQ ID NO: 4055511 - RNA, 19 nt, Staphylococcus aureus subsp. aureus N315
uagauagaaauugugcuuu

SEQ ID NO: 4055512 - RNA, 21 nt, Staphylococcus aureus subsp. aureus N315
uagauagacuuucuugaugaa

SEQ ID NO: 4055513 - RNA, 13 nt, Staphylococcus aureus subsp. aureus N315
uagauagcggauu

SEQ ID NO: 4055514 - RNA, 17 nt, Staphylococcus aureus subsp. aureus N315
uagauagcggauuuauu

SEQ ID NO: 4055515 - RNA, 18 nt, Staphylococcus aureus subsp. aureus N315
uagauaucuuaaucuaaa

SEQ ID NO: 4055516 - RNA, 14 nt, Staphylococcus aureus subsp. aureus N315
uagauauuauaaaa

SEQ ID NO: 4055517 - RNA, 21 nt, Staphylococcus aureus subsp. aureus N315
uagaucuaucgguauaucuaa

SEQ ID NO: 4055518 - RNA, 18 nt, Staphylococcus aureus subsp. aureus N315
uagaugaaugccuaauuu

SEQ ID NO: 4055519 - RNA, 21 nt, Staphylococcus aureus subsp. aureus N315
uagaugaaugccuaauuuugu

SEQ ID NO: 4055520 - RNA, 14 nt, Staphylococcus aureus subsp. aureus N315
uagaugauacauuc

SEQ ID NO: 4055521 - RNA, 15 nt, Staphylococcus aureus subsp. aureus N315
uagaugcauaaaaaa

SEQ ID NO: 4055522 - RNA, 18 nt, Staphylococcus aureus subsp. aureus N315
uagaugcauaaaaaaaga

SEQ ID NO: 4055523 - RNA, 19 nt, Staphylococcus aureus subsp. aureus N315
uagaugcuaauguaaucug

SEQ ID NO: 4055524 - RNA, 23 nt, Staphylococcus aureus subsp. aureus N315
uagaugcuggcuuaguaguugua

SEQ ID NO: 4055525 - RNA, 18 nt, Staphylococcus aureus subsp. aureus N315
uagaugcuugaccuucag

SEQ ID NO: 4055526 - RNA, 20 nt, Staphylococcus aureus subsp. aureus N315
uagauucacuguauaaauaa

SEQ ID NO: 4055527 - RNA, 20 nt, Staphylococcus aureus subsp. aureus N315
uagauucugauacagaacca

SEQ ID NO: 4055528 - RNA, 17 nt, Staphylococcus aureus subsp. aureus N315
uagauuguauuuaauaa

SEQ ID NO: 4055529 - RNA, 18 nt, Staphylococcus aureus subsp. aureus N315
uagauuguauuuaauaag

SEQ ID NO: 4055530 - RNA, 14 nt, Staphylococcus aureus subsp. aureus N315
uagauuuacgguua

SEQ ID NO: 4055531 - RNA, 14 nt, Staphylococcus aureus subsp. aureus N315
uagauuuguguguc

SEQ ID NO: 4055532 - RNA, 12 nt, Staphylococcus aureus subsp. aureus N315
uagauuuuaaac

SEQ ID NO: 4055533 - RNA, 14 nt, Staphylococcus aureus subsp. aureus N315
uagauuuuaaauca

SEQ ID NO: 4055534 - RNA, 19 nt, Staphylococcus aureus subsp. aureus N315
uagauuuuauauaaaaaga

SEQ ID NO: 4055535 - RNA, 18 nt, Staphylococcus aureus subsp. aureus N315
uagauuuuaugcuuuacu

SEQ ID NO: 4055536 - RNA, 16 nt, Staphylococcus aureus subsp. aureus N315
uagauuuucacuaaua

SEQ ID NO: 4055537 - RNA, 19 nt, Staphylococcus aureus subsp. aureus N315
uagauuuuguauuagcauc

SEQ ID NO: 4055538 - RNA, 14 nt, Staphylococcus aureus subsp. aureus N315
uagcaaaaauacuu

SEQ ID NO: 4055539 - RNA, 21 nt, Staphylococcus aureus subsp. aureus N315
uagcaaaagcuuuuacgccuu

SEQ ID NO: 4055540 - RNA, 21 nt, Staphylococcus aureus subsp. aureus N315
uagcaaaauuauguaaaaaau

SEQ ID NO: 4055541 - RNA, 20 nt, Staphylococcus aureus subsp. aureus N315
uagcaaacaauuuuguacau

SEQ ID NO: 4055542 - RNA, 17 nt, Staphylococcus aureus subsp. aureus N315
uagcaaauauuauuaaa

SEQ ID NO: 4055543 - RNA, 17 nt, Staphylococcus aureus subsp. aureus N315
uagcaaauauuucuggc

SEQ ID NO: 4055544 - RNA, 20 nt, Staphylococcus aureus subsp. aureus N315
uagcaaccauauuuuuagaa

SEQ ID NO: 4055545 - RNA, 20 nt, Staphylococcus aureus subsp. aureus N315
uagcaacgagcuuagcaguu

SEQ ID NO: 4055546 - RNA, 12 nt, Staphylococcus aureus subsp. aureus N315
uagcaauaucau

SEQ ID NO: 4055547 - RNA, 14 nt, Staphylococcus aureus subsp. aureus N315
uagcaauaucauca

SEQ ID NO: 4055548 - RNA, 16 nt, Staphylococcus aureus subsp. aureus N315
uagcaauaucaucauu

SEQ ID NO: 4055549 - RNA, 22 nt, Staphylococcus aureus subsp. aureus N315
uagcaccguaacauauguacua

SEQ ID NO: 4055550 - RNA, 18 nt, Staphylococcus aureus subsp. aureus N315
uagcacuuggauuuuaau

SEQ ID NO: 4055551 - RNA, 20 nt, Staphylococcus aureus subsp. aureus N315
uagcagggugcuaaauuuac

SEQ ID NO: 4055552 - RNA, 18 nt, Staphylococcus aureus subsp. aureus N315
uagcaguaauauguugcu

SEQ ID NO: 4055553 - RNA, 18 nt, Staphylococcus aureus subsp. aureus N315
uagcagucaaacauagau

SEQ ID NO: 4055554 - RNA, 19 nt, Staphylococcus aureus subsp. aureus N315
uagcaguuucugagaagaa

SEQ ID NO: 4055555 - RNA, 15 nt, Staphylococcus aureus subsp. aureus N315
uagcauaaaauuucu

SEQ ID NO: 4055556 - RNA, 14 nt, Staphylococcus aureus subsp. aureus N315
uagcauacauuaag

SEQ ID NO: 4055557 - RNA, 18 nt, Staphylococcus aureus subsp. aureus N315
uagcauaucuuuaucauu

SEQ ID NO: 4055558 - RNA, 19 nt, Staphylococcus aureus subsp. aureus N315
uagcaucaaaaauaaaaau

SEQ ID NO: 4055559 - RNA, 20 nt, Staphylococcus aureus subsp. aureus N315
uagcaucuuuaccauauaau

SEQ ID NO: 4055560 - RNA, 18 nt, Staphylococcus aureus subsp. aureus N315
uagcaugauaaaguaugu

SEQ ID NO: 4055561 - RNA, 19 nt, Staphylococcus aureus subsp. aureus N315
uagcauuacgccaccaguu

SEQ ID NO: 4055562 - RNA, 22 nt, Staphylococcus aureus subsp. aureus N315
uagcauuagcaaauauuauuaa

SEQ ID NO: 4055563 - RNA, 15 nt, Staphylococcus aureus subsp. aureus N315
uagcauuccuaauua

SEQ ID NO: 4055564 - RNA, 19 nt, Staphylococcus aureus subsp. aureus N315
uagcauuccuaauuauauu

SEQ ID NO: 4055565 - RNA, 15 nt, Staphylococcus aureus subsp. aureus N315
uagcauugccccauc

SEQ ID NO: 4055566 - RNA, 20 nt, Staphylococcus aureus subsp. aureus N315
uagcauuucuuuauuagaau

SEQ ID NO: 4055567 - RNA, 16 nt, Staphylococcus aureus subsp. aureus N315
uagccaauaucauauu

SEQ ID NO: 4055568 - RNA, 16 nt, Staphylococcus aureus subsp. aureus N315
uagccuagauaccaaa

SEQ ID NO: 4055569 - RNA, 13 nt, Staphylococcus aureus subsp. aureus N315
uagccuucauuug

SEQ ID NO: 4055570 - RNA, 15 nt, Staphylococcus aureus subsp. aureus N315
uagccuuuucuagcu

SEQ ID NO: 4055571 - RNA, 20 nt, Staphylococcus aureus subsp. aureus N315
uagcgaaaguaucuaugaaa

SEQ ID NO: 4055572 - RNA, 14 nt, Staphylococcus aureus subsp. aureus N315
uagcguagcgaaag

SEQ ID NO: 4055573 - RNA, 15 nt, Staphylococcus aureus subsp. aureus N315
uagcgucaaguuuuc

SEQ ID NO: 4055574 - RNA, 16 nt, Staphylococcus aureus subsp. aureus N315
uagcgugauuuuucau

SEQ ID NO: 4055575 - RNA, 12 nt, Staphylococcus aureus subsp. aureus N315
uagcuaaugcaa

SEQ ID NO: 4055576 - RNA, 22 nt, Staphylococcus aureus subsp. aureus N315
uagcuaaugcauuauuauaaua

SEQ ID NO: 4055577 - RNA, 23 nt, Staphylococcus aureus subsp. aureus N315
uagcuauaacucuaaauauaaua

SEQ ID NO: 4055578 - RNA, 20 nt, Staphylococcus aureus subsp. aureus N315
uagcucaaaacaauuuaaaa

SEQ ID NO: 4055579 - RNA, 12 nt, Staphylococcus aureus subsp. aureus N315
uagcucuucuuu

SEQ ID NO: 4055580 - RNA, 21 nt, Staphylococcus aureus subsp. aureus N315
uagcugcaaucguugaaaaau

SEQ ID NO: 4055581 - RNA, 20 nt, Staphylococcus aureus subsp. aureus N315
uagcuggcuuuuuaauuguu

SEQ ID NO: 4055582 - RNA, 22 nt, Staphylococcus aureus subsp. aureus N315
uagcuuaauaauuaauaagcau

SEQ ID NO: 4055583 - RNA, 20 nt, Staphylococcus aureus subsp. aureus N315
uagcuuagucaauguauauu

SEQ ID NO: 4055584 - RNA, 21 nt, Staphylococcus aureus subsp. aureus N315
uagcuuagucaauguauauuu

SEQ ID NO: 4055585 - RNA, 18 nt, Staphylococcus aureus subsp. aureus N315
uagcuucgucacguaaaa

SEQ ID NO: 4055586 - RNA, 21 nt, Staphylococcus aureus subsp. aureus N315
uagcuucuuaaaucaacauca

SEQ ID NO: 4055587 - RNA, 13 nt, Staphylococcus aureus subsp. aureus N315
uagcuugaauaau

SEQ ID NO: 4055588 - RNA, 18 nt, Staphylococcus aureus subsp. aureus N315
uagcuugaauaauauauu

SEQ ID NO: 4055589 - RNA, 21 nt, Staphylococcus aureus subsp. aureus N315
uagcuugagcaucuuuuacug

SEQ ID NO: 4055590 - RNA, 15 nt, Staphylococcus aureus subsp. aureus N315
uagcuuuaguuacua

SEQ ID NO: 4055591 - RNA, 16 nt, Staphylococcus aureus subsp. aureus N315
uagcuuucguuucuuu

SEQ ID NO: 4055592 - RNA, 18 nt, Staphylococcus aureus subsp. aureus N315
uagcuuucguuucuuuua

SEQ ID NO: 4055593 - RNA, 16 nt, Staphylococcus aureus subsp. aureus N315
uagcuuucuuuuucau

SEQ ID NO: 4055594 - RNA, 23 nt, Staphylococcus aureus subsp. aureus N315
uaggaauuguuaauuucaacauu

SEQ ID NO: 4055595 - RNA, 13 nt, Staphylococcus aureus subsp. aureus N315
uaggacauauaaa

SEQ ID NO: 4055596 - RNA, 16 nt, Staphylococcus aureus subsp. aureus N315
uaggaccuacaauuuu

SEQ ID NO: 4055597 - RNA, 20 nt, Staphylococcus aureus subsp. aureus N315
uaggagagauguauaaaacu

SEQ ID NO: 4055598 - RNA, 20 nt, Staphylococcus aureus subsp. aureus N315
uaggaguaucuguuucuauu

SEQ ID NO: 4055599 - RNA, 16 nt, Staphylococcus aureus subsp. aureus N315
uaggaucuuuuccauu

SEQ ID NO: 4055600 - RNA, 14 nt, Staphylococcus aureus subsp. aureus N315
uaggaugaaaauau

SEQ ID NO: 4055601 - RNA, 14 nt, Staphylococcus aureus subsp. aureus N315
uaggauuuacaccu

SEQ ID NO: 4055602 - RNA, 18 nt, Staphylococcus aureus subsp. aureus N315
uaggauuuacaccuauac

SEQ ID NO: 4055603 - RNA, 17 nt, Staphylococcus aureus subsp. aureus N315
uaggauuugcaccuaua

SEQ ID NO: 4055604 - RNA, 18 nt, Staphylococcus aureus subsp. aureus N315
uaggauuugcaccuauac

SEQ ID NO: 4055605 - RNA, 20 nt, Staphylococcus aureus subsp. aureus N315
uaggcgccauaaucauuagu

SEQ ID NO: 4055606 - RNA, 19 nt, Staphylococcus aureus subsp. aureus N315
uaggcuuuuuuauuaugug

SEQ ID NO: 4055607 - RNA, 16 nt, Staphylococcus aureus subsp. aureus N315
uagggauaauuuuauu

SEQ ID NO: 4055608 - RNA, 17 nt, Staphylococcus aureus subsp. aureus N315
uaggggcuucuuucuaa

SEQ ID NO: 4055609 - RNA, 19 nt, Staphylococcus aureus subsp. aureus N315
uaggggcuuuuaugcaugc

SEQ ID NO: 4055610 - RNA, 12 nt, Staphylococcus aureus subsp. aureus N315
uagguaauaauu

SEQ ID NO: 4055611 - RNA, 18 nt, Staphylococcus aureus subsp. aureus N315
agugcucuugcaauagca

SEQ ID NO: 4055612 - RNA, 21 nt, Staphylococcus aureus subsp. aureus N315
agugcuuauuuguuuauuagu

SEQ ID NO: 4055613 - RNA, 19 nt, Staphylococcus aureus subsp. aureus N315
agugcuuccacuucaucua

SEQ ID NO: 4055614 - RNA, 14 nt, Staphylococcus aureus subsp. aureus N315
aguggaaauuaugu

SEQ ID NO: 4055615 - RNA, 17 nt, Staphylococcus aureus subsp. aureus N315
aguggaagacaaugauu

SEQ ID NO: 4055616 - RNA, 18 nt, Staphylococcus aureus subsp. aureus N315
aguggaucacgauaaugu

SEQ ID NO: 4055617 - RNA, 19 nt, Staphylococcus aureus subsp. aureus N315
aguggauuacagaugaugc

SEQ ID NO: 4055618 - RNA, 13 nt, Staphylococcus aureus subsp. aureus N315
aguggcaaacauu

SEQ ID NO: 4055619 - RNA, 15 nt, Staphylococcus aureus subsp. aureus N315
aguggcaaacauuuc

SEQ ID NO: 4055620 - RNA, 14 nt, Staphylococcus aureus subsp. aureus N315
agugguaaaaauga

SEQ ID NO: 4055621 - RNA, 22 nt, Staphylococcus aureus subsp. aureus N315
agugguuguucccauuuuuaaa

SEQ ID NO: 4055622 - RNA, 21 nt, Staphylococcus aureus subsp. aureus N315
agugguuuucuuuauuuuaaa

SEQ ID NO: 4055623 - RNA, 13 nt, Staphylococcus aureus subsp. aureus N315
aguguaccuuguu

SEQ ID NO: 4055624 - RNA, 16 nt, Staphylococcus aureus subsp. aureus N315
aguguagcacaagauu

SEQ ID NO: 4055625 - RNA, 14 nt, Staphylococcus aureus subsp. aureus N315
aguguaguaaaaau

SEQ ID NO: 4055626 - RNA, 15 nt, Staphylococcus aureus subsp. aureus N315
aguguaguaaaaauc

SEQ ID NO: 4055627 - RNA, 14 nt, Staphylococcus aureus subsp. aureus N315
aguguauucauuuu

SEQ ID NO: 4055628 - RNA, 19 nt, Staphylococcus aureus subsp. aureus N315
aguguauucauuuuaaauu

SEQ ID NO: 4055629 - RNA, 16 nt, Staphylococcus aureus subsp. aureus N315
agugucacaaagaaau

SEQ ID NO: 4055630 - RNA, 21 nt, Staphylococcus aureus subsp. aureus N315
agugucaugcuuaauuuaugu

SEQ ID NO: 4055631 - RNA, 15 nt, Staphylococcus aureus subsp. aureus N315
agugucgagauuuua

SEQ ID NO: 4055632 - RNA, 16 nt, Staphylococcus aureus subsp. aureus N315
agugucgagauuuuau

SEQ ID NO: 4055633 - RNA, 23 nt, Staphylococcus aureus subsp. aureus N315
agugugcaggauaacguucacuu

SEQ ID NO: 4055634 - RNA, 17 nt, Staphylococcus aureus subsp. aureus N315
aguguuauaaauagaga

SEQ ID NO: 4055635 - RNA, 13 nt, Staphylococcus aureus subsp. aureus N315
aguguuauauugu

SEQ ID NO: 4055636 - RNA, 22 nt, Staphylococcus aureus subsp. aureus N315
aguguucucauuauaaugauuu

SEQ ID NO: 4055637 - RNA, 19 nt, Staphylococcus aureus subsp. aureus N315
aguguugaggcguuucaga

SEQ ID NO: 4055638 - RNA, 14 nt, Staphylococcus aureus subsp. aureus N315
aguguuuaaaugcu

SEQ ID NO: 4055639 - RNA, 17 nt, Staphylococcus aureus subsp. aureus N315
aguguuuaugaaagucu

SEQ ID NO: 4055640 - RNA, 19 nt, Staphylococcus aureus subsp. aureus N315
aguguuucauaaucucuuu

SEQ ID NO: 4055641 - RNA, 13 nt, Staphylococcus aureus subsp. aureus N315
aguguuuguaaug

SEQ ID NO: 4055642 - RNA, 17 nt, Staphylococcus aureus subsp. aureus N315
aguguuuuauagauuca

SEQ ID NO: 4055643 - RNA, 18 nt, Staphylococcus aureus subsp. aureus N315
aguuaaaaccuuuucaaa

SEQ ID NO: 4055644 - RNA, 20 nt, Staphylococcus aureus subsp. aureus N315
aguuaaaaccuuuucaaauu

SEQ ID NO: 4055645 - RNA, 23 nt, Staphylococcus aureus subsp. aureus N315
aguuaaaaccuuuucaaauuaua

SEQ ID NO: 4055646 - RNA, 17 nt, Staphylococcus aureus subsp. aureus N315
aguuaaaagugguuuua

SEQ ID NO: 4055647 - RNA, 17 nt, Staphylococcus aureus subsp. aureus N315
aguuaaaauaaccauuu

SEQ ID NO: 4055648 - RNA, 22 nt, Staphylococcus aureus subsp. aureus N315
aguuaaacgaaaaaugccaacu

SEQ ID NO: 4055649 - RNA, 16 nt, Staphylococcus aureus subsp. aureus N315
aguuaaaguacuuaca

SEQ ID NO: 4055650 - RNA, 23 nt, Staphylococcus aureus subsp. aureus N315
aguuaaaguuccaaguuaaugca

SEQ ID NO: 4055651 - RNA, 14 nt, Staphylococcus aureus subsp. aureus N315
aguuaaaucuguau

SEQ ID NO: 4055652 - RNA, 23 nt, Staphylococcus aureus subsp. aureus N315
aguuaaaucuuuaacuucugauu

SEQ ID NO: 4055653 - RNA, 20 nt, Staphylococcus aureus subsp. aureus N315
aguuaacggcguauucaauu

SEQ ID NO: 4055654 - RNA, 21 nt, Staphylococcus aureus subsp. aureus N315
aguuaauaaacgcuucauagu

SEQ ID NO: 4055655 - RNA, 15 nt, Staphylococcus aureus subsp. aureus N315
aguuaauguaaaguu

SEQ ID NO: 4055656 - RNA, 12 nt, Staphylococcus aureus subsp. aureus N315
aguuaauuaugu

SEQ ID NO: 4055657 - RNA, 17 nt, Staphylococcus aureus subsp. aureus N315
aguuaauugaaugaaaa

SEQ ID NO: 4055658 - RNA, 15 nt, Staphylococcus aureus subsp. aureus N315
aguuacaguguaauc

SEQ ID NO: 4055659 - RNA, 17 nt, Staphylococcus aureus subsp. aureus N315
aguuaccuacuacauuc

SEQ ID NO: 4055660 - RNA, 21 nt, Staphylococcus aureus subsp. aureus N315
aguuacgcucaucuaaaauga

SEQ ID NO: 4055661 - RNA, 17 nt, Staphylococcus aureus subsp. aureus N315
aguuacucaauauaaaa

SEQ ID NO: 4055662 - RNA, 23 nt, Staphylococcus aureus subsp. aureus N315
aguuacugcgcuuuuaauuuuuu

SEQ ID NO: 4055663 - RNA, 15 nt, Staphylococcus aureus subsp. aureus N315
aguuagacuaaaaaa

SEQ ID NO: 4055664 - RNA, 20 nt, Staphylococcus aureus subsp. aureus N315
aguuaggcgacuuaacuuaa

SEQ ID NO: 4055665 - RNA, 15 nt, Staphylococcus aureus subsp. aureus N315
aguuauaugugcuuu

SEQ ID NO: 4055666 - RNA, 14 nt, Staphylococcus aureus subsp. aureus N315
aguuauauuuuuag

SEQ ID NO: 4055667 - RNA, 15 nt, Staphylococcus aureus subsp. aureus N315
aguuauauuuuuagg

SEQ ID NO: 4055668 - RNA, 17 nt, Staphylococcus aureus subsp. aureus N315
aguuaugacuaacgaaa

SEQ ID NO: 4055669 - RNA, 21 nt, Staphylococcus aureus subsp. aureus N315
aguuaugaugggaaaaaaugg

SEQ ID NO: 4055670 - RNA, 18 nt, Staphylococcus aureus subsp. aureus N315
aguuaugcugucaaacaa

SEQ ID NO: 4055671 - RNA, 12 nt, Staphylococcus aureus subsp. aureus N315
aguuauuaaauc

SEQ ID NO: 4055672 - RNA, 19 nt, Staphylococcus aureus subsp. aureus N315
aguuauuuauucagcauug

SEQ ID NO: 4055673 - RNA, 15 nt, Staphylococcus aureus subsp. aureus N315
aguucaaaauacuca

SEQ ID NO: 4055674 - RNA, 14 nt, Staphylococcus aureus subsp. aureus N315
aguucaaacagaaa

SEQ ID NO: 4055675 - RNA, 23 nt, Staphylococcus aureus subsp. aureus N315
aguucaaauggacuaacgucauu

SEQ ID NO: 4055676 - RNA, 19 nt, Staphylococcus aureus subsp. aureus N315
aguucaaauugaacuucuu

SEQ ID NO: 4055677 - RNA, 19 nt, Staphylococcus aureus subsp. aureus N315
aguucaacagggguuuuua

SEQ ID NO: 4055678 - RNA, 16 nt, Staphylococcus aureus subsp. aureus N315
aguucaggaucaagug

SEQ ID NO: 4055679 - RNA, 18 nt, Staphylococcus aureus subsp. aureus N315
aguucaggaucaagugca

SEQ ID NO: 4055680 - RNA, 20 nt, Staphylococcus aureus subsp. aureus N315
aguuccguugaauuaacaau

SEQ ID NO: 4055681 - RNA, 18 nt, Staphylococcus aureus subsp. aureus N315
aguucggaugagaaaugu

SEQ ID NO: 4055682 - RNA, 22 nt, Staphylococcus aureus subsp. aureus N315
aguucggaugagaaauguuaac

SEQ ID NO: 4055683 - RNA, 15 nt, Staphylococcus aureus subsp. aureus N315
aguucuauauaauuu

SEQ ID NO: 4055684 - RNA, 14 nt, Staphylococcus aureus subsp. aureus N315
aguugaaaauaauc

SEQ ID NO: 4055685 - RNA, 21 nt, Staphylococcus aureus subsp. aureus N315
aguugaaaauaaucgaacaga

SEQ ID NO: 4055686 - RNA, 14 nt, Staphylococcus aureus subsp. aureus N315
aguugacaauacaa

SEQ ID NO: 4055687 - RNA, 21 nt, Staphylococcus aureus subsp. aureus N315
aguugauugcaugacagcaaa

SEQ ID NO: 4055688 - RNA, 22 nt, Staphylococcus aureus subsp. aureus N315
aguugauuuaagauuuaauaaa

SEQ ID NO: 4055689 - RNA, 21 nt, Staphylococcus aureus subsp. aureus N315
aguugcacauuauaaagcugc

SEQ ID NO: 4055690 - RNA, 24 nt, Staphylococcus aureus subsp. aureus N315
aguugcacuugguucauaaugauc

SEQ ID NO: 4055691 - RNA, 22 nt, Staphylococcus aureus subsp. aureus N315
aguugcauaaucaauuucaccu

SEQ ID NO: 4055692 - RNA, 16 nt, Staphylococcus aureus subsp. aureus N315
aguuggcggggcccca

SEQ ID NO: 4055693 - RNA, 14 nt, Staphylococcus aureus subsp. aureus N315
aguuggcuuacugu

SEQ ID NO: 4055694 - RNA, 18 nt, Staphylococcus aureus subsp. aureus N315
aguuggggaugggcccca

SEQ ID NO: 4055695 - RNA, 16 nt, Staphylococcus aureus subsp. aureus N315
aguuggggugagggcc

SEQ ID NO: 4055696 - RNA, 18 nt, Staphylococcus aureus subsp. aureus N315
aguugguggaugucaugu

SEQ ID NO: 4055697 - RNA, 22 nt, Staphylococcus aureus subsp. aureus N315
aguugguuuuauuaauucugau

SEQ ID NO: 4055698 - RNA, 15 nt, Staphylococcus aureus subsp. aureus N315
aguuguaucauuaau

SEQ ID NO: 4055699 - RNA, 18 nt, Staphylococcus aureus subsp. aureus N315
aguugucaucuaauuaca

SEQ ID NO: 4055700 - RNA, 20 nt, Staphylococcus aureus subsp. aureus N315
aguugugguuguuaauguau

SEQ ID NO: 4055701 - RNA, 15 nt, Staphylococcus aureus subsp. aureus N315
aguuguuaggggcuc

SEQ ID NO: 4055702 - RNA, 21 nt, Staphylococcus aureus subsp. aureus N315
aguuguuauauucuagauuca

SEQ ID NO: 4055703 - RNA, 22 nt, Staphylococcus aureus subsp. aureus N315
aguuguuuuuuguuuucaaaug

SEQ ID NO: 4055704 - RNA, 11 nt, Staphylococcus aureus subsp. aureus N315
aguuuaaaaau

SEQ ID NO: 4055705 - RNA, 15 nt, Staphylococcus aureus subsp. aureus N315
aguuuaacaauacua

SEQ ID NO: 4055706 - RNA, 21 nt, Staphylococcus aureus subsp. aureus N315
aguuuaaucguauuagccaau

SEQ ID NO: 4055707 - RNA, 19 nt, Staphylococcus aureus subsp. aureus N315
aguuuacagguugaauaaa

SEQ ID NO: 4055708 - RNA, 15 nt, Staphylococcus aureus subsp. aureus N315
aguuuacgaucauaa

SEQ ID NO: 4055709 - RNA, 20 nt, Staphylococcus aureus subsp. aureus N315
aguuuacgaucauaaauauu

SEQ ID NO: 4055710 - RNA, 17 nt, Staphylococcus aureus subsp. aureus N315
aguuuagguugauuucu

SEQ ID NO: 4055711 - RNA, 13 nt, Staphylococcus aureus subsp. aureus N315
aguuuaucugagu

SEQ ID NO: 4055712 - RNA, 22 nt, Staphylococcus aureus subsp. aureus N315
aguuucaucaaguauaaauguu

SEQ ID NO: 4055713 - RNA, 21 nt, Staphylococcus aureus subsp. aureus N315
aguuuccauaaauaaaaugcu

SEQ ID NO: 4055714 - RNA, 22 nt, Staphylococcus aureus subsp. aureus N315
aguuuccauaaauaaaaugcua

SEQ ID NO: 4055715 - RNA, 14 nt, Staphylococcus aureus subsp. aureus N315
aguuucggaaaaag

SEQ ID NO: 4055716 - RNA, 14 nt, Staphylococcus aureus subsp. aureus N315
aguuucguuuucaa

SEQ ID NO: 4055717 - RNA, 20 nt, Staphylococcus aureus subsp. aureus N315
aguuucuauagaauuuuuca

SEQ ID NO: 4055718 - RNA, 18 nt, Staphylococcus aureus subsp. aureus N315
aguuucucuacuaauauu

SEQ ID NO: 4055719 - RNA, 22 nt, Staphylococcus aureus subsp. aureus N315
aguuucugacuuuuaaaaaaca

SEQ ID NO: 4055720 - RNA, 18 nt, Staphylococcus aureus subsp. aureus N315
aguuucugagaagaaaua

SEQ ID NO: 4055721 - RNA, 17 nt, Staphylococcus aureus subsp. aureus N315
aguuugaaggugauaau

SEQ ID NO: 4055722 - RNA, 18 nt, Staphylococcus aureus subsp. aureus N315
aguuugauagaugauaca

SEQ ID NO: 4055723 - RNA, 22 nt, Staphylococcus aureus subsp. aureus N315
aguuugauaugcucucuucaaa

SEQ ID NO: 4055724 - RNA, 17 nt, Staphylococcus aureus subsp. aureus N315
aguuugaucauaauuca

SEQ ID NO: 4055725 - RNA, 17 nt, Staphylococcus aureus subsp. aureus N315
aguuuguccuuuaagaa

SEQ ID NO: 4055726 - RNA, 18 nt, Staphylococcus aureus subsp. aureus N315
aguuuguuggucuuucuu

SEQ ID NO: 4055727 - RNA, 14 nt, Staphylococcus aureus subsp. aureus N315
aguuuuaaugaacu

SEQ ID NO: 4055728 - RNA, 15 nt, Staphylococcus aureus subsp. aureus N315
aguuuuauuuauaaa

SEQ ID NO: 4055729 - RNA, 22 nt, Staphylococcus aureus subsp. aureus N315
aguuuuauuuauaaacaauaaa

SEQ ID NO: 4055730 - RNA, 21 nt, Staphylococcus aureus subsp. aureus N315
aguuuucggcuagauuuuaaa

SEQ ID NO: 4055731 - RNA, 19 nt, Staphylococcus aureus subsp. aureus N315
aguuuugaagaauaaaaaa

SEQ ID NO: 4055732 - RNA, 23 nt, Staphylococcus aureus subsp. aureus N315
aguuuugauugcaaaaaaacaaa

SEQ ID NO: 4055733 - RNA, 19 nt, Staphylococcus aureus subsp. aureus N315
aguuuuggucaaguaaaug

SEQ ID NO: 4055734 - RNA, 19 nt, Staphylococcus aureus subsp. aureus N315
aguuuuuaaaauuaucaau

SEQ ID NO: 4055735 - RNA, 22 nt, Staphylococcus aureus subsp. aureus N315
aguuuuugguagcauuuuagau

SEQ ID NO: 4055736 - RNA, 13 nt, Staphylococcus aureus subsp. aureus N315
aguuuuuuaaaau

SEQ ID NO: 4055737 - RNA, 22 nt, Staphylococcus aureus subsp. aureus N315
aguuuuuuaaaauaaugauaua

SEQ ID NO: 4055738 - RNA, 15 nt, Staphylococcus aureus subsp. aureus N315
aguuuuuuuauaagc

SEQ ID NO: 4055739 - RNA, 13 nt, Staphylococcus aureus subsp. aureus N315
auaaaaaaagaga

SEQ ID NO: 4055740 - RNA, 14 nt, Staphylococcus aureus subsp. aureus N315
auaaaaaaagagac

SEQ ID NO: 4055741 - RNA, 14 nt, Staphylococcus aureus subsp. aureus N315
auaaaaaaaucccu

SEQ ID NO: 4055742 - RNA, 12 nt, Staphylococcus aureus subsp. aureus N315
auaaaaaauaac

SEQ ID NO: 4055743 - RNA, 14 nt, Staphylococcus aureus subsp. aureus N315
auaaaaaauaacuc

SEQ ID NO: 4055744 - RNA, 14 nt, Staphylococcus aureus subsp. aureus N315
auaaaaaaugaaug

SEQ ID NO: 4055745 - RNA, 19 nt, Staphylococcus aureus subsp. aureus N315
auaaaaacucuaaaaguug

SEQ ID NO: 4055746 - RNA, 18 nt, Staphylococcus aureus subsp. aureus N315
auaaaaaggagcgacaau

SEQ ID NO: 4055747 - RNA, 21 nt, Staphylococcus aureus subsp. aureus N315
auaaaaaggagcgacaaugga

SEQ ID NO: 4055748 - RNA, 18 nt, Staphylococcus aureus subsp. aureus N315
auaaaaagugaaaguauu

SEQ ID NO: 4055749 - RNA, 12 nt, Staphylococcus aureus subsp. aureus N315
auaaaaauaaaa

SEQ ID NO: 4055750 - RNA, 13 nt, Staphylococcus aureus subsp. aureus N315
auaaaaauuuauu

SEQ ID NO: 4055751 - RNA, 17 nt, Staphylococcus aureus subsp. aureus N315
auaaaaauuuauucaaa

SEQ ID NO: 4055752 - RNA, 14 nt, Staphylococcus aureus subsp. aureus N315
auaaaacaaauuau

SEQ ID NO: 4055753 - RNA, 13 nt, Staphylococcus aureus subsp. aureus N315
auaaaacagaauu

SEQ ID NO: 4055754 - RNA, 15 nt, Staphylococcus aureus subsp. aureus N315
auaaaacaucaucgu

SEQ ID NO: 4055755 - RNA, 16 nt, Staphylococcus aureus subsp. aureus N315
auaaaaccgguacuuu

SEQ ID NO: 4055756 - RNA, 20 nt, Staphylococcus aureus subsp. aureus N315
auaaaacgacucauuauaaa

SEQ ID NO: 4055757 - RNA, 15 nt, Staphylococcus aureus subsp. aureus N315
auaaaacgauaagaa

SEQ ID NO: 4055758 - RNA, 22 nt, Staphylococcus aureus subsp. aureus N315
auaaaacgugcaaauaaaaaag

SEQ ID NO: 4055759 - RNA, 20 nt, Staphylococcus aureus subsp. aureus N315
auaaaacuaaugauaguaca

SEQ ID NO: 4055760 - RNA, 16 nt, Staphylococcus aureus subsp. aureus N315
auaaaacuauguguau

SEQ ID NO: 4055761 - RNA, 13 nt, Staphylococcus aureus subsp. aureus N315
auaaaacuuacau

SEQ ID NO: 4055762 - RNA, 19 nt, Staphylococcus aureus subsp. aureus N315
auaaaacuuauaacugaua

SEQ ID NO: 4055763 - RNA, 14 nt, Staphylococcus aureus subsp. aureus N315
auaaaagcaacaau

SEQ ID NO: 4055764 - RNA, 17 nt, Staphylococcus aureus subsp. aureus N315
auaaaagcccaccuaaa

SEQ ID NO: 4055765 - RNA, 18 nt, Staphylococcus aureus subsp. aureus N315
auaaaagccucuaaugau

SEQ ID NO: 4055766 - RNA, 19 nt, Staphylococcus aureus subsp. aureus N315
auaaaagccucuaaugauu

SEQ ID NO: 4055767 - RNA, 20 nt, Staphylococcus aureus subsp. aureus N315
auaaaaggggaaaucauuug

SEQ ID NO: 4055768 - RNA, 19 nt, Staphylococcus aureus subsp. aureus N315
auaaaagucgauaaauaug

SEQ ID NO: 4055769 - RNA, 20 nt, Staphylococcus aureus subsp. aureus N315
auaaaagucgauaaauauga

SEQ ID NO: 4055770 - RNA, 17 nt, Staphylococcus aureus subsp. aureus N315
auaaaaguguaauguuc

SEQ ID NO: 4055771 - RNA, 16 nt, Staphylococcus aureus subsp. aureus N315
auaaaaguuaggcgac

SEQ ID NO: 4055772 - RNA, 21 nt, Staphylococcus aureus subsp. aureus N315
auaaaaguuaggcgacuuaac

SEQ ID NO: 4055773 - RNA, 12 nt, Staphylococcus aureus subsp. aureus N315
auaaaauaaaau

SEQ ID NO: 4055774 - RNA, 13 nt, Staphylococcus aureus subsp. aureus N315
auaaaauaaaaug

SEQ ID NO: 4055775 - RNA, 12 nt, Staphylococcus aureus subsp. aureus N315
auaaaauaaaua

SEQ ID NO: 4055776 - RNA, 13 nt, Staphylococcus aureus subsp. aureus N315
auaaaauaaauaa

SEQ ID NO: 4055777 - RNA, 22 nt, Staphylococcus aureus subsp. aureus N315
auaaaauaaucgguaauuacuu

SEQ ID NO: 4055778 - RNA, 13 nt, Staphylococcus aureus subsp. aureus N315
auaaaauacauuu

SEQ ID NO: 4055779 - RNA, 17 nt, Staphylococcus aureus subsp. aureus N315
auaaaauauauuuaauu

SEQ ID NO: 4055780 - RNA, 20 nt, Staphylococcus aureus subsp. aureus N315
auaaaaucaucguauuucau

SEQ ID NO: 4055781 - RNA, 16 nt, Staphylococcus aureus subsp. aureus N315
auaaaaucaucuuaac

SEQ ID NO: 4055782 - RNA, 22 nt, Staphylococcus aureus subsp. aureus N315
auaaaauccuaagcaucguaaa

SEQ ID NO: 4055783 - RNA, 15 nt, Staphylococcus aureus subsp. aureus N315
auaaaaugaaauauu

SEQ ID NO: 4055784 - RNA, 22 nt, Staphylococcus aureus subsp. aureus N315
auaaaaugcauagcucuucuuu

SEQ ID NO: 4055785 - RNA, 13 nt, Staphylococcus aureus subsp. aureus N315
auaaaaugcuaca

SEQ ID NO: 4055786 - RNA, 16 nt, Staphylococcus aureus subsp. aureus N315
auaaaaugcuacaauu

SEQ ID NO: 4055787 - RNA, 18 nt, Staphylococcus aureus subsp. aureus N315
auaaaaugcuacaauuuc

SEQ ID NO: 4055788 - RNA, 13 nt, Staphylococcus aureus subsp. aureus N315
auaaaauguuguu

SEQ ID NO: 4055789 - RNA, 13 nt, Staphylococcus aureus subsp. aureus N315
auaaaauuaaaac

SEQ ID NO: 4055790 - RNA, 13 nt, Staphylococcus aureus subsp. aureus N315
auaaaauuuaaaa

SEQ ID NO: 4055791 - RNA, 15 nt, Staphylococcus aureus subsp. aureus N315
auaaaauuuaaaaca

SEQ ID NO: 4055792 - RNA, 18 nt, Staphylococcus aureus subsp. aureus N315
auaaaauuucauauuguu

SEQ ID NO: 4055793 - RNA, 13 nt, Staphylococcus aureus subsp. aureus N315
auaaaauuuugaa

SEQ ID NO: 4055794 - RNA, 15 nt, Staphylococcus aureus subsp. aureus N315
auaaaauuuuuuuca

SEQ ID NO: 4055795 - RNA, 15 nt, Staphylococcus aureus subsp. aureus N315
auaaacaauaaaaaa

SEQ ID NO: 4055796 - RNA, 13 nt, Staphylococcus aureus subsp. aureus N315
auaaacaauaacu

SEQ ID NO: 4055797 - RNA, 14 nt, Staphylococcus aureus subsp. aureus N315
auaaacaauaacug

SEQ ID NO: 4055798 - RNA, 19 nt, Staphylococcus aureus subsp. aureus N315
auaaacaauaacuguucuu

SEQ ID NO: 4055799 - RNA, 23 nt, Staphylococcus aureus subsp. aureus N315
auaaaccaaaucggaauaaaaua

SEQ ID NO: 4055800 - RNA, 14 nt, Staphylococcus aureus subsp. aureus N315
auaaaccacgcaca

SEQ ID NO: 4055801 - RNA, 14 nt, Staphylococcus aureus subsp. aureus N315
auaaaccagcugau

SEQ ID NO: 4055802 - RNA, 19 nt, Staphylococcus aureus subsp. aureus N315
auaaaccuacaauauagaa

SEQ ID NO: 4055803 - RNA, 18 nt, Staphylococcus aureus subsp. aureus N315
auaaacguccaaacacaa

SEQ ID NO: 4055804 - RNA, 12 nt, Staphylococcus aureus subsp. aureus N315
auaaacuaaaaa

SEQ ID NO: 4055805 - RNA, 14 nt, Staphylococcus aureus subsp. aureus N315
auaaacuacacacg

SEQ ID NO: 4055806 - RNA, 16 nt, Staphylococcus aureus subsp. aureus N315
auaaacuuuaugaaau

SEQ ID NO: 4055807 - RNA, 13 nt, Staphylococcus aureus subsp. aureus N315
auaaagaaugauu

SEQ ID NO: 4055808 - RNA, 21 nt, Staphylococcus aureus subsp. aureus N315
auaaagcugauuuuucauuga

SEQ ID NO: 4055809 - RNA, 17 nt, Staphylococcus aureus subsp. aureus N315
auaaagcuuugacauau

SEQ ID NO: 4055810 - RNA, 15 nt, Staphylococcus aureus subsp. aureus N315
auaaaggaauagcua

SEQ ID NO: 4055811 - RNA, 14 nt, Staphylococcus aureus subsp. aureus N315
auaaaggcaacaaa

SEQ ID NO: 4055812 - RNA, 19 nt, Staphylococcus aureus subsp. aureus N315
auaaaguaugagugauaga

SEQ ID NO: 4055813 - RNA, 15 nt, Staphylococcus aureus subsp. aureus N315
auaaagucauauggu

SEQ ID NO: 4055814 - RNA, 16 nt, Staphylococcus aureus subsp. aureus N315
auaaagucauaugguu

SEQ ID NO: 4055815 - RNA, 19 nt, Staphylococcus aureus subsp. aureus N315
auaaaguugacaauacaaa

SEQ ID NO: 4055816 - RNA, 15 nt, Staphylococcus aureus subsp. aureus N315
auaaaguuuauuuau

SEQ ID NO: 4055817 - RNA, 17 nt, Staphylococcus aureus subsp. aureus N315
auaaaguuuguaauauu

SEQ ID NO: 4055818 - RNA, 15 nt, Staphylococcus aureus subsp. aureus N315
auaaauaaaaauaca

SEQ ID NO: 4055819 - RNA, 14 nt, Staphylococcus aureus subsp. aureus N315
auaaauaaaagcca

SEQ ID NO: 4055820 - RNA, 12 nt, Staphylococcus aureus subsp. aureus N315
auaaauaaaaug

SEQ ID NO: 4055821 - RNA, 13 nt, Staphylococcus aureus subsp. aureus N315
auaaauaaaaugc

SEQ ID NO: 4055822 - RNA, 12 nt, Staphylococcus aureus subsp. aureus N315
auaaauaaaauu

SEQ ID NO: 4055823 - RNA, 13 nt, Staphylococcus aureus subsp. aureus N315
auaaauaaaauuu

SEQ ID NO: 4055824 - RNA, 13 nt, Staphylococcus aureus subsp. aureus N315
auaaauaaacuca

SEQ ID NO: 4055825 - RNA, 20 nt, Staphylococcus aureus subsp. aureus N315
auaaauaacacgauuugguu

SEQ ID NO: 4055826 - RNA, 19 nt, Staphylococcus aureus subsp. aureus N315
auaaauaagugauaaauaa

SEQ ID NO: 4055827 - RNA, 14 nt, Staphylococcus aureus subsp. aureus N315
auaaauacaaauau

SEQ ID NO: 4055828 - RNA, 18 nt, Staphylococcus aureus subsp. aureus N315
auaaauacaaauauaucu

SEQ ID NO: 4055829 - RNA, 19 nt, Staphylococcus aureus subsp. aureus N315
auaaauacaauagaaauga

SEQ ID NO: 4055830 - RNA, 21 nt, Staphylococcus aureus subsp. aureus N315
auaaauaccgucuucucuauc

SEQ ID NO: 4055831 - RNA, 13 nt, Staphylococcus aureus subsp. aureus N315
auaaauagauaau

SEQ ID NO: 4055832 - RNA, 17 nt, Staphylococcus aureus subsp. aureus N315
auaaauaucaauaauuc

SEQ ID NO: 4055833 - RNA, 22 nt, Staphylococcus aureus subsp. aureus N315
auaaauaucaauuguugcaaaa

SEQ ID NO: 4055834 - RNA, 17 nt, Staphylococcus aureus subsp. aureus N315
auaaauaugauguuaaa

SEQ ID NO: 4055835 - RNA, 21 nt, Staphylococcus aureus subsp. aureus N315
auaaauaugauguuaaaaaau

SEQ ID NO: 4055836 - RNA, 18 nt, Staphylococcus aureus subsp. aureus N315
auaaauauggauuuugaa

SEQ ID NO: 4055837 - RNA, 12 nt, Staphylococcus aureus subsp. aureus N315
auaaauauuaaa

SEQ ID NO: 4055838 - RNA, 13 nt, Staphylococcus aureus subsp. aureus N315
auaaauauuggaa

SEQ ID NO: 4055839 - RNA, 14 nt, Staphylococcus aureus subsp. aureus N315
auaaauauuguguu

SEQ ID NO: 4055840 - RNA, 13 nt, Staphylococcus aureus subsp. aureus N315
auaaauauuuuua

SEQ ID NO: 4055841 - RNA, 13 nt, Staphylococcus aureus subsp. aureus N315
auaaauauuuuuu

SEQ ID NO: 4055842 - RNA, 20 nt, Staphylococcus aureus subsp. aureus N315
auaaaucaagaaauguuaaa

SEQ ID NO: 4055843 - RNA, 22 nt, Staphylococcus aureus subsp. aureus N315
auaaaucaguaguuuuaaaagu

SEQ ID NO: 4055844 - RNA, 19 nt, Staphylococcus aureus subsp. aureus N315
auaaaucauacgagaaauu

SEQ ID NO: 4055845 - RNA, 22 nt, Staphylococcus aureus subsp. aureus N315
auaaaucauacgagaaauuaga

SEQ ID NO: 4055846 - RNA, 16 nt, Staphylococcus aureus subsp. aureus N315
auaaaucauucuuuau

SEQ ID NO: 4055847 - RNA, 21 nt, Staphylococcus aureus subsp. aureus N315
auaaaucauucuuuauagaaa

SEQ ID NO: 4055848 - RNA, 17 nt, Staphylococcus aureus subsp. aureus N315
auaaaucccuaaaaaaa

SEQ ID NO: 4055849 - RNA, 21 nt, Staphylococcus aureus subsp. aureus N315
auaaauccuaagucuuuuaaa

SEQ ID NO: 4055850 - RNA, 14 nt, Staphylococcus aureus subsp. aureus N315
auaaaucuaauacu

SEQ ID NO: 4055851 - RNA, 19 nt, Staphylococcus aureus subsp. aureus N315
auaaaucuaauacuuucaa

SEQ ID NO: 4055852 - RNA, 17 nt, Staphylococcus aureus subsp. aureus N315
auaaaucuccauuaauc

SEQ ID NO: 4055853 - RNA, 19 nt, Staphylococcus aureus subsp. aureus N315
auaaaugaauuauuuaaaa

SEQ ID NO: 4055854 - RNA, 22 nt, Staphylococcus aureus subsp. aureus N315
auaaaugaauuauuuaaaaugc

SEQ ID NO: 4055855 - RNA, 15 nt, Staphylococcus aureus subsp. aureus N315
auaaaugaauugucu

SEQ ID NO: 4055856 - RNA, 17 nt, Staphylococcus aureus subsp. aureus N315
auaaaugacugaauuaa

SEQ ID NO: 4055857 - RNA, 18 nt, Staphylococcus aureus subsp. aureus N315
auaaaugacuucacauuu

SEQ ID NO: 4055858 - RNA, 19 nt, Staphylococcus aureus subsp. aureus N315
auaaaugcuauauuuagaa

SEQ ID NO: 4055859 - RNA, 22 nt, Staphylococcus aureus subsp. aureus N315
auaaauguccgacuugauaaaa

SEQ ID NO: 4055860 - RNA, 12 nt, Staphylococcus aureus subsp. aureus N315
auaaauguuaaa

SEQ ID NO: 4055861 - RNA, 18 nt, Staphylococcus aureus subsp. aureus N315
auaaauguuauugcuuau

SEQ ID NO: 4055862 - RNA, 19 nt, Staphylococcus aureus subsp. aureus N315
auaaauguuauugcuuauu

SEQ ID NO: 4055863 - RNA, 16 nt, Staphylococcus aureus subsp. aureus N315
auaaauguuuauaucu

SEQ ID NO: 4055864 - RNA, 19 nt, Staphylococcus aureus subsp. aureus N315
auaaauuaaaugcaauaca

SEQ ID NO: 4055865 - RNA, 15 nt, Staphylococcus aureus subsp. aureus N315
auaaauuaaauuuug

SEQ ID NO: 4055866 - RNA, 15 nt, Staphylococcus aureus subsp. aureus N315
auaaauuaauaugaa

SEQ ID NO: 4055867 - RNA, 16 nt, Staphylococcus aureus subsp. aureus N315
auaaauuagaugaaau

SEQ ID NO: 4055868 - RNA, 17 nt, Staphylococcus aureus subsp. aureus N315
auaaauuagaugaaaug

SEQ ID NO: 4055869 - RNA, 22 nt, Staphylococcus aureus subsp. aureus N315
auaaauucuaaucgcauuuuuu

SEQ ID NO: 4055870 - RNA, 22 nt, Staphylococcus aureus subsp. aureus N315
auaaauugaguuuuuuaaaaua

SEQ ID NO: 4055871 - RNA, 23 nt, Staphylococcus aureus subsp. aureus N315
auaaauugaguuuuuuaaaauaa

SEQ ID NO: 4055872 - RNA, 13 nt, Staphylococcus aureus subsp. aureus N315
auaaauugauauu

SEQ ID NO: 4055873 - RNA, 22 nt, Staphylococcus aureus subsp. aureus N315
auaaauuuaacguuauucauuu

SEQ ID NO: 4055874 - RNA, 22 nt, Staphylococcus aureus subsp. aureus N315
auaaauuuagauauuauaaaaa

SEQ ID NO: 4055875 - RNA, 21 nt, Staphylococcus aureus subsp. aureus N315
auaaauuucaagguauacaca

SEQ ID NO: 4055876 - RNA, 22 nt, Staphylococcus aureus subsp. aureus N315
auaaauuucaagguauacacaa

SEQ ID NO: 4055877 - RNA, 23 nt, Staphylococcus aureus subsp. aureus N315
auaaauuuguaccaaauaaauua

SEQ ID NO: 4055878 - RNA, 21 nt, Staphylococcus aureus subsp. aureus N315
auaaauuuucuguuuaauuaa

SEQ ID NO: 4055879 - RNA, 23 nt, Staphylococcus aureus subsp. aureus N315
auaaauuuucuguuuaauuaaaa

SEQ ID NO: 4055880 - RNA, 17 nt, Staphylococcus aureus subsp. aureus N315
auaaauuuugaauuaca

SEQ ID NO: 4055881 - RNA, 19 nt, Staphylococcus aureus subsp. aureus N315
auaaauuuugaauuacaga

SEQ ID NO: 4055882 - RNA, 21 nt, Staphylococcus aureus subsp. aureus N315
auaaauuuugaauuacagauu

SEQ ID NO: 4055883 - RNA, 19 nt, Staphylococcus aureus subsp. aureus N315
auaaauuuugcgaaaauau

SEQ ID NO: 4055884 - RNA, 18 nt, Staphylococcus aureus subsp. aureus N315
auaaauuuuuaguuaaag

SEQ ID NO: 4055885 - RNA, 15 nt, Staphylococcus aureus subsp. aureus N315
auaacaaaaucucaa

SEQ ID NO: 4055886 - RNA, 18 nt, Staphylococcus aureus subsp. aureus N315
auaacaacuacuuaaauu

SEQ ID NO: 4055887 - RNA, 14 nt, Staphylococcus aureus subsp. aureus N315
auaacaagaaguaa

SEQ ID NO: 4055888 - RNA, 22 nt, Staphylococcus aureus subsp. aureus N315
auaacaaugcagcuguauuuaa

SEQ ID NO: 4055889 - RNA, 16 nt, Staphylococcus aureus subsp. aureus N315
auaacaauuuauuaaa

SEQ ID NO: 4055890 - RNA, 13 nt, Staphylococcus aureus subsp. aureus N315
auaacaauuuuaa

SEQ ID NO: 4055891 - RNA, 14 nt, Staphylococcus aureus subsp. aureus N315
auaacaauuuuaaa

SEQ ID NO: 4055892 - RNA, 14 nt, Staphylococcus aureus subsp. aureus N315
auaacaccaauuaa

SEQ ID NO: 4055893 - RNA, 15 nt, Staphylococcus aureus subsp. aureus N315
auaacaccaauuaaa

SEQ ID NO: 4055894 - RNA, 18 nt, Staphylococcus aureus subsp. aureus N315
auaacaccuuucauuugg

SEQ ID NO: 4055895 - RNA, 18 nt, Staphylococcus aureus subsp. aureus N315
auaacagcuacaaauaau

SEQ ID NO: 4055896 - RNA, 22 nt, Staphylococcus aureus subsp. aureus N315
auaacaggugcuuacuuuuaaa

SEQ ID NO: 4055897 - RNA, 18 nt, Staphylococcus aureus subsp. aureus N315
auaacaguuaauuauacc

SEQ ID NO: 4055898 - RNA, 18 nt, Staphylococcus aureus subsp. aureus N315
auaacauagaaaagcagu

SEQ ID NO: 4055899 - RNA, 13 nt, Staphylococcus aureus subsp. aureus N315
auaacaucuaaau

SEQ ID NO: 4055900 - RNA, 15 nt, Staphylococcus aureus subsp. aureus N315
auaacaucuaaauuu

SEQ ID NO: 4055901 - RNA, 17 nt, Staphylococcus aureus subsp. aureus N315
auaacauucuucaaaaa

SEQ ID NO: 4055902 - RNA, 23 nt, Staphylococcus aureus subsp. aureus N315
auaacauucuucaaaaaauaaua

SEQ ID NO: 4055903 - RNA, 23 nt, Staphylococcus aureus subsp. aureus N315
auaacauugaacgauaacaauuu

SEQ ID NO: 4055904 - RNA, 23 nt, Staphylococcus aureus subsp. aureus N315
auaacauuggcaaacgaauauuc

SEQ ID NO: 4055905 - RNA, 15 nt, Staphylococcus aureus subsp. aureus N315
auaacauuuaagaaa

SEQ ID NO: 4055906 - RNA, 17 nt, Staphylococcus aureus subsp. aureus N315
auaaccauaguaauaaa

SEQ ID NO: 4055907 - RNA, 20 nt, Staphylococcus aureus subsp. aureus N315
auaaccauaguaauaaaaug

SEQ ID NO: 4055908 - RNA, 17 nt, Staphylococcus aureus subsp. aureus N315
auaaccauguaaaauua

SEQ ID NO: 4055909 - RNA, 14 nt, Staphylococcus aureus subsp. aureus N315
auaaccgaaauauu

SEQ ID NO: 4055910 - RNA, 20 nt, Staphylococcus aureus subsp. aureus N315
auaaccuaauucgccaucuu

SEQ ID NO: 4055911 - RNA, 15 nt, Staphylococcus aureus subsp. aureus N315
auaaccuagguuaaa

SEQ ID NO: 4055912 - RNA, 23 nt, Staphylococcus aureus subsp. aureus N315
auaaccuuccccuucauauuuug

SEQ ID NO: 4055913 - RNA, 20 nt, Staphylococcus aureus subsp. aureus N315
auaaccuuuaaaacaucauu

SEQ ID NO: 4055914 - RNA, 19 nt, Staphylococcus aureus subsp. aureus N315
auaacgagcaguauauauc

SEQ ID NO: 4055915 - RNA, 20 nt, Staphylococcus aureus subsp. aureus N315
auaacgagcaguauauauca

SEQ ID NO: 4055916 - RNA, 16 nt, Staphylococcus aureus subsp. aureus N315
auaacgucauauguuu

SEQ ID NO: 4055917 - RNA, 19 nt, Staphylococcus aureus subsp. aureus N315
auaacgugcuuuuuuagaa

SEQ ID NO: 4055918 - RNA, 19 nt, Staphylococcus aureus subsp. aureus N315
auaacguuaauauaauuaa

SEQ ID NO: 4055919 - RNA, 22 nt, Staphylococcus aureus subsp. aureus N315
auaacuaagugaauuaucuaua

SEQ ID NO: 4055920 - RNA, 13 nt, Staphylococcus aureus subsp. aureus N315
auaacuacacuua

SEQ ID NO: 4055921 - RNA, 14 nt, Staphylococcus aureus subsp. aureus N315
auaacuagaaugau

SEQ ID NO: 4055922 - RNA, 17 nt, Staphylococcus aureus subsp. aureus N315
auaacuccuccaaagcu

SEQ ID NO: 4055923 - RNA, 21 nt, Staphylococcus aureus subsp. aureus N315
auaacucgcuucguucuaaaa

SEQ ID NO: 4055924 - RNA, 15 nt, Staphylococcus aureus subsp. aureus N315
auaacucuaaauaua

SEQ ID NO: 4055925 - RNA, 16 nt, Staphylococcus aureus subsp. aureus N315
auaacucuaaauauaa

SEQ ID NO: 4055926 - RNA, 15 nt, Staphylococcus aureus subsp. aureus N315
auaacuguaaaacau

SEQ ID NO: 4055927 - RNA, 19 nt, Staphylococcus aureus subsp. aureus N315
auaacuguagcuccuaaag

SEQ ID NO: 4055928 - RNA, 22 nt, Staphylococcus aureus subsp. aureus N315
auaacuguauaccucuuagcac

SEQ ID NO: 4055929 - RNA, 23 nt, Staphylococcus aureus subsp. aureus N315
auaacuguucuuucgucuuguaa

SEQ ID NO: 4055930 - RNA, 12 nt, Staphylococcus aureus subsp. aureus N315
auaacuuuaaaa

SEQ ID NO: 4055931 - RNA, 13 nt, Staphylococcus aureus subsp. aureus N315
auaacuuuaaaaa

SEQ ID NO: 4055932 - RNA, 15 nt, Staphylococcus aureus subsp. aureus N315
auaacuuuauauaua

SEQ ID NO: 4055933 - RNA, 15 nt, Staphylococcus aureus subsp. aureus N315
auaagaaaauaccua

SEQ ID NO: 4055934 - RNA, 11 nt, Staphylococcus aureus subsp. aureus N315
auaagaaucag

SEQ ID NO: 4055935 - RNA, 17 nt, Staphylococcus aureus subsp. aureus N315
auaagaaucaucuaaau

SEQ ID NO: 4055936 - RNA, 20 nt, Staphylococcus aureus subsp. aureus N315
auaagaauuaacaacaaaua

SEQ ID NO: 4055937 - RNA, 15 nt, Staphylococcus aureus subsp. aureus N315
auaagaauuguugau

SEQ ID NO: 4055938 - RNA, 10 nt, Staphylococcus aureus subsp. aureus N315
auaagaauuu

SEQ ID NO: 4055939 - RNA, 13 nt, Staphylococcus aureus subsp. aureus N315
auaagacaauagu

SEQ ID NO: 4055940 - RNA, 15 nt, Staphylococcus aureus subsp. aureus N315
auaagacaauaguau

SEQ ID NO: 4055941 - RNA, 22 nt, Staphylococcus aureus subsp. aureus N315
auaagagaacuuuucaaacaau

SEQ ID NO: 4055942 - RNA, 13 nt, Staphylococcus aureus subsp. aureus N315
auaagaggagaaa

SEQ ID NO: 4055943 - RNA, 17 nt, Staphylococcus aureus subsp. aureus N315
auaagaggagaaagcua

SEQ ID NO: 4055944 - RNA, 13 nt, Staphylococcus aureus subsp. aureus N315
auaagauuuugaa

SEQ ID NO: 4055945 - RNA, 19 nt, Staphylococcus aureus subsp. aureus N315
auaagauuuugaauuuuau

SEQ ID NO: 4055946 - RNA, 18 nt, Staphylococcus aureus subsp. aureus N315
auaagcaaucauaauacu

SEQ ID NO: 4055947 - RNA, 16 nt, Staphylococcus aureus subsp. aureus N315
auaagccuuuucaaac

SEQ ID NO: 4055948 - RNA, 17 nt, Staphylococcus aureus subsp. aureus N315
auaagccuuuucaaaca

SEQ ID NO: 4055949 - RNA, 16 nt, Staphylococcus aureus subsp. aureus N315
auaagcgcaauuaaaa

SEQ ID NO: 4055950 - RNA, 21 nt, Staphylococcus aureus subsp. aureus N315
auaagcgcaauuaaaaguacu

SEQ ID NO: 4055951 - RNA, 23 nt, Staphylococcus aureus subsp. aureus N315
auaagcuuuuucuuucucuaaca

SEQ ID NO: 4055952 - RNA, 14 nt, Staphylococcus aureus subsp. aureus N315
auaaggaaaaggau

SEQ ID NO: 4055953 - RNA, 17 nt, Staphylococcus aureus subsp. aureus N315
auaaggaagcguaugau

SEQ ID NO: 4055954 - RNA, 14 nt, Staphylococcus aureus subsp. aureus N315
auaaggacucuguu

SEQ ID NO: 4055955 - RNA, 16 nt, Staphylococcus aureus subsp. aureus N315
auaagguacauaaaua

SEQ ID NO: 4055956 - RNA, 16 nt, Staphylococcus aureus subsp. aureus N315
auaaguaaauaauagu

SEQ ID NO: 4055957 - RNA, 14 nt, Staphylococcus aureus subsp. aureus N315
auaaguacaaauaa

SEQ ID NO: 4055958 - RNA, 20 nt, Staphylococcus aureus subsp. aureus N315
auaaguacaaauaauacagg

SEQ ID NO: 4055959 - RNA, 19 nt, Staphylococcus aureus subsp. aureus N315
auaaguaguucagcaaguu

SEQ ID NO: 4055960 - RNA, 17 nt, Staphylococcus aureus subsp. aureus N315
auaaguuacuagcauua

SEQ ID NO: 4055961 - RNA, 15 nt, Staphylococcus aureus subsp. aureus N315
auaaguucuagauua

SEQ ID NO: 4055962 - RNA, 21 nt, Staphylococcus aureus subsp. aureus N315
auaaguucuagauuauuuaaa

SEQ ID NO: 4055963 - RNA, 16 nt, Staphylococcus aureus subsp. aureus N315
auaaguugaauauaaa

SEQ ID NO: 4055964 - RNA, 19 nt, Staphylococcus aureus subsp. aureus N315
auaaguuuuugaauaucua

SEQ ID NO: 4055965 - RNA, 20 nt, Staphylococcus aureus subsp. aureus N315
auaauaaaacuugugauaua

SEQ ID NO: 4055966 - RNA, 12 nt, Staphylococcus aureus subsp. aureus N315
auaauaaaauag

SEQ ID NO: 4055967 - RNA, 14 nt, Staphylococcus aureus subsp. aureus N315
auaauaaaccuaaa

SEQ ID NO: 4055968 - RNA, 23 nt, Staphylococcus aureus subsp. aureus N315
auaauaaauagacugccaauaaa

SEQ ID NO: 4055969 - RNA, 13 nt, Staphylococcus aureus subsp. aureus N315
auaauaaaucacg

SEQ ID NO: 4055970 - RNA, 15 nt, Staphylococcus aureus subsp. aureus N315
auaauaaaucgaauu

SEQ ID NO: 4055971 - RNA, 18 nt, Staphylococcus aureus subsp. aureus N315
auaauaacuggcaaauca

SEQ ID NO: 4055972 - RNA, 20 nt, Staphylococcus aureus subsp. aureus N315
auaauaagagguauagcaag

SEQ ID NO: 4055973 - RNA, 21 nt, Staphylococcus aureus subsp. aureus N315
auaauaaguugaauauaaaaa

SEQ ID NO: 4055974 - RNA, 22 nt, Staphylococcus aureus subsp. aureus N315
auaauaaguugaauauaaaaaa

SEQ ID NO: 4055975 - RNA, 19 nt, Staphylococcus aureus subsp. aureus N315
auaauaaucggacugaugg

SEQ ID NO: 4055976 - RNA, 14 nt, Staphylococcus aureus subsp. aureus N315
auaauaccaauugc

SEQ ID NO: 4055977 - RNA, 18 nt, Staphylococcus aureus subsp. aureus N315
auaauacgucguaaugaa

SEQ ID NO: 4055978 - RNA, 16 nt, Staphylococcus aureus subsp. aureus N315
auaauacuguauuuua

SEQ ID NO: 4055979 - RNA, 17 nt, Staphylococcus aureus subsp. aureus N315
auaauacuguuuaaaua

SEQ ID NO: 4055980 - RNA, 17 nt, Staphylococcus aureus subsp. aureus N315
auaauagaaagcgcauu

SEQ ID NO: 4055981 - RNA, 13 nt, Staphylococcus aureus subsp. aureus N315
auaauagaaauaa

SEQ ID NO: 4055982 - RNA, 15 nt, Staphylococcus aureus subsp. aureus N315
auaauagauaauagu

SEQ ID NO: 4055983 - RNA, 15 nt, Staphylococcus aureus subsp. aureus N315
auaauagcaaaauua

SEQ ID NO: 4055984 - RNA, 18 nt, Staphylococcus aureus subsp. aureus N315
auaauagccauucgaugc

SEQ ID NO: 4055985 - RNA, 18 nt, Staphylococcus aureus subsp. aureus N315
auaauagcuugagcaucu

SEQ ID NO: 4055986 - RNA, 22 nt, Staphylococcus aureus subsp. aureus N315
auaauaggauaccacaucgcau

SEQ ID NO: 4055987 - RNA, 17 nt, Staphylococcus aureus subsp. aureus N315
auaauauaaaaacaaaa

SEQ ID NO: 4055988 - RNA, 13 nt, Staphylococcus aureus subsp. aureus N315
auaauauaaauaa

SEQ ID NO: 4055989 - RNA, 14 nt, Staphylococcus aureus subsp. aureus N315
auaauauacacaaa

SEQ ID NO: 4055990 - RNA, 13 nt, Staphylococcus aureus subsp. aureus N315
auaauauauuuag

SEQ ID NO: 4055991 - RNA, 22 nt, Staphylococcus aureus subsp. aureus N315
auaauaucaccuuuuuuaagau

SEQ ID NO: 4055992 - RNA, 17 nt, Staphylococcus aureus subsp. aureus N315
auaauaucgaugacuuu

SEQ ID NO: 4055993 - RNA, 17 nt, Staphylococcus aureus subsp. aureus N315
auaauauugaugaauaa

SEQ ID NO: 4055994 - RNA, 19 nt, Staphylococcus aureus subsp. aureus N315
auaauauugaugaauaaau

SEQ ID NO: 4055995 - RNA, 22 nt, Staphylococcus aureus subsp. aureus N315
auaaucaaaccaccaaaaauca

SEQ ID NO: 4055996 - RNA, 23 nt, Staphylococcus aureus subsp. aureus N315
auaaucaacaaagugcaauuauu

SEQ ID NO: 4055997 - RNA, 14 nt, Staphylococcus aureus subsp. aureus N315
auaaucaacaugug

SEQ ID NO: 4055998 - RNA, 13 nt, Staphylococcus aureus subsp. aureus N315
auaaucacauuaa

SEQ ID NO: 4055999 - RNA, 21 nt, Staphylococcus aureus subsp. aureus N315
auaaucacuuggcgacauuug

SEQ ID NO: 4056000 - RNA, 12 nt, Staphylococcus aureus subsp. aureus N315
auaaucaucauu

SEQ ID NO: 4056001 - RNA, 18 nt, Staphylococcus aureus subsp. aureus N315
auaaucauccauauaugc

SEQ ID NO: 4056002 - RNA, 20 nt, Staphylococcus aureus subsp. aureus N315
auaauccagccacaccaaau

SEQ ID NO: 4056003 - RNA, 19 nt, Staphylococcus aureus subsp. aureus N315
auaauccauucuucuuguu

SEQ ID NO: 4056004 - RNA, 18 nt, Staphylococcus aureus subsp. aureus N315
auaaucccaaccauucua

SEQ ID NO: 4056005 - RNA, 20 nt, Staphylococcus aureus subsp. aureus N315
auaaucccaaccauucuacc

SEQ ID NO: 4056006 - RNA, 21 nt, Staphylococcus aureus subsp. aureus N315
auaauccgagucauacucauc

SEQ ID NO: 4056007 - RNA, 16 nt, Staphylococcus aureus subsp. aureus N315
auaaucgaacauaaau

SEQ ID NO: 4056008 - RNA, 19 nt, Staphylococcus aureus subsp. aureus N315
auaaucgaacauaaauaaa

SEQ ID NO: 4056009 - RNA, 12 nt, Staphylococcus aureus subsp. aureus N315
auaaucgccauc

SEQ ID NO: 4056010 - RNA, 19 nt, Staphylococcus aureus subsp. aureus N315
auaaucgguaauuacuugu

SEQ ID NO: 4056011 - RNA, 21 nt, Staphylococcus aureus subsp. aureus N315
auaaucguuuuuacuguaauc

SEQ ID NO: 4056012 - RNA, 12 nt, Staphylococcus aureus subsp. aureus N315
auaaucuaucuu

SEQ ID NO: 4056013 - RNA, 18 nt, Staphylococcus aureus subsp. aureus N315
auaaucucauucuuuaau

SEQ ID NO: 4056014 - RNA, 12 nt, Staphylococcus aureus subsp. aureus N315
auaaucucuuua

SEQ ID NO: 4056015 - RNA, 16 nt, Staphylococcus aureus subsp. aureus N315
auaaucuuuauuaaua

SEQ ID NO: 4056016 - RNA, 17 nt, Staphylococcus aureus subsp. aureus N315
auaaucuuuuuuacuaa

SEQ ID NO: 4056017 - RNA, 19 nt, Staphylococcus aureus subsp. aureus N315
auaaucuuuuuuacuaaaa

SEQ ID NO: 4056018 - RNA, 21 nt, Staphylococcus aureus subsp. aureus N315
auaaugaaaugaaguuuuuag

SEQ ID NO: 4056019 - RNA, 15 nt, Staphylococcus aureus subsp. aureus N315
auaaugaauaauuaa

SEQ ID NO: 4056020 - RNA, 19 nt, Staphylococcus aureus subsp. aureus N315
auaaugaauaauuaaaaaa

SEQ ID NO: 4056021 - RNA, 14 nt, Staphylococcus aureus subsp. aureus N315
auaaugaauaguaa

SEQ ID NO: 4056022 - RNA, 15 nt, Staphylococcus aureus subsp. aureus N315
auaaugaauaguaau

SEQ ID NO: 4056023 - RNA, 17 nt, Staphylococcus aureus subsp. aureus N315
auaaugacgagaauuaa

SEQ ID NO: 4056024 - RNA, 15 nt, Staphylococcus aureus subsp. aureus N315
auaaugacuauaaca

SEQ ID NO: 4056025 - RNA, 15 nt, Staphylococcus aureus subsp. aureus N315
auaaugacugacacu

SEQ ID NO: 4056026 - RNA, 21 nt, Staphylococcus aureus subsp. aureus N315
auaaugauguauuuuagcuaa

SEQ ID NO: 4056027 - RNA, 13 nt, Staphylococcus aureus subsp. aureus N315
auaaugauugucu

SEQ ID NO: 4056028 - RNA, 20 nt, Staphylococcus aureus subsp. aureus N315
auaaugcacgcgugccaaca

SEQ ID NO: 4056029 - RNA, 14 nt, Staphylococcus aureus subsp. aureus N315
auaaugcuacuauu

SEQ ID NO: 4056030 - RNA, 19 nt, Staphylococcus aureus subsp. aureus N315
auaaugcuacuauuaaaua

SEQ ID NO: 4056031 - RNA, 14 nt, Staphylococcus aureus subsp. aureus N315
auaaugcuauauuu

SEQ ID NO: 4056032 - RNA, 20 nt, Staphylococcus aureus subsp. aureus N315
auaaugguugaauaacacua

SEQ ID NO: 4056033 - RNA, 18 nt, Staphylococcus aureus subsp. aureus N315
auaauguacauguauaaa

SEQ ID NO: 4056034 - RNA, 19 nt, Staphylococcus aureus subsp. aureus N315
auaauguauaaaacagaau

SEQ ID NO: 4056035 - RNA, 16 nt, Staphylococcus aureus subsp. aureus N315
auaaugugaaaaaucu

SEQ ID NO: 4056036 - RNA, 13 nt, Staphylococcus aureus subsp. aureus N315
auaauguuuccau

SEQ ID NO: 4056037 - RNA, 14 nt, Staphylococcus aureus subsp. aureus N315
auaauguuuccauu

SEQ ID NO: 4056038 - RNA, 18 nt, Staphylococcus aureus subsp. aureus N315
auaauguuuucauuggau

SEQ ID NO: 4056039 - RNA, 12 nt, Staphylococcus aureus subsp. aureus N315
auaauuaaacua

SEQ ID NO: 4056040 - RNA, 24 nt, Staphylococcus aureus subsp. aureus N315
auaauuaaacuaauagcauuugua

SEQ ID NO: 4056041 - RNA, 16 nt, Staphylococcus aureus subsp. aureus N315
auaauuaaauaaaaau

SEQ ID NO: 4056042 - RNA, 15 nt, Staphylococcus aureus subsp. aureus N315
auaauuaaauaacuu

SEQ ID NO: 4056043 - RNA, 23 nt, Staphylococcus aureus subsp. aureus N315
auaauuaacugcggcaugcgauu

SEQ ID NO: 4056044 - RNA, 23 nt, Staphylococcus aureus subsp. aureus N315
auaauuaacuuacuuuuguaaaa

SEQ ID NO: 4056045 - RNA, 13 nt, Staphylococcus aureus subsp. aureus N315
auaauuaauaaca

SEQ ID NO: 4056046 - RNA, 19 nt, Staphylococcus aureus subsp. aureus N315
auaauuaauuuuguaauua

SEQ ID NO: 4056047 - RNA, 16 nt, Staphylococcus aureus subsp. aureus N315
auaauuaccuuuccau

SEQ ID NO: 4056048 - RNA, 21 nt, Staphylococcus aureus subsp. aureus N315
auaauuaccuuuccauucgua

SEQ ID NO: 4056049 - RNA, 15 nt, Staphylococcus aureus subsp. aureus N315
auaauuagauuuaaa

SEQ ID NO: 4056050 - RNA, 16 nt, Staphylococcus aureus subsp. aureus N315
auaauuaugaaaagua

SEQ ID NO: 4056051 - RNA, 17 nt, Staphylococcus aureus subsp. aureus N315
auaauuauuaaacuuug

SEQ ID NO: 4056052 - RNA, 14 nt, Staphylococcus aureus subsp. aureus N315
auaauuauuaauuu

SEQ ID NO: 4056053 - RNA, 17 nt, Staphylococcus aureus subsp. aureus N315
auaauucagaugaauaa

SEQ ID NO: 4056054 - RNA, 21 nt, Staphylococcus aureus subsp. aureus N315
auaauucaguguuacuauaca

SEQ ID NO: 4056055 - RNA, 14 nt, Staphylococcus aureus subsp. aureus N315
auaauucauaaaug

SEQ ID NO: 4056056 - RNA, 18 nt, Staphylococcus aureus subsp. aureus N315
auaauucgaaaucaaaua

SEQ ID NO: 4056057 - RNA, 19 nt, Staphylococcus aureus subsp. aureus N315
auaauucgaaaucaaauau

SEQ ID NO: 4056058 - RNA, 20 nt, Staphylococcus aureus subsp. aureus N315
auaauugcauagcuaaauaa

SEQ ID NO: 4056059 - RNA, 13 nt, Staphylococcus aureus subsp. aureus N315
auaauugcauuac

SEQ ID NO: 4056060 - RNA, 18 nt, Staphylococcus aureus subsp. aureus N315
auaauuggaaucaucuuu

SEQ ID NO: 4056061 - RNA, 19 nt, Staphylococcus aureus subsp. aureus N315
auaauuguccaugccuuau

SEQ ID NO: 4056062 - RNA, 14 nt, Staphylococcus aureus subsp. aureus N315
auaauuuaaaagau

SEQ ID NO: 4056063 - RNA, 19 nt, Staphylococcus aureus subsp. aureus N315
auaauuuaaagaacuauuu

SEQ ID NO: 4056064 - RNA, 20 nt, Staphylococcus aureus subsp. aureus N315
auaauuuaucugcaaaaugc

SEQ ID NO: 4056065 - RNA, 12 nt, Staphylococcus aureus subsp. aureus N315
auaauuucaauu

SEQ ID NO: 4056066 - RNA, 17 nt, Staphylococcus aureus subsp. aureus N315
auaauuucaguucuuag

SEQ ID NO: 4056067 - RNA, 21 nt, Staphylococcus aureus subsp. aureus N315
auaauuucaguucuuagauuu

SEQ ID NO: 4056068 - RNA, 15 nt, Staphylococcus aureus subsp. aureus N315
auaauuuccuaaaaa

SEQ ID NO: 4056069 - RNA, 12 nt, Staphylococcus aureus subsp. aureus N315
auaauuucucaa

SEQ ID NO: 4056070 - RNA, 19 nt, Staphylococcus aureus subsp. aureus N315
auaauuugguuaauacguu

SEQ ID NO: 4056071 - RNA, 16 nt, Staphylococcus aureus subsp. aureus N315
auaauuuguaauuccu

SEQ ID NO: 4056072 - RNA, 12 nt, Staphylococcus aureus subsp. aureus N315
auaauuuuaaaa

SEQ ID NO: 4056073 - RNA, 14 nt, Staphylococcus aureus subsp. aureus N315
auaauuuuaaaaau

SEQ ID NO: 4056074 - RNA, 18 nt, Staphylococcus aureus subsp. aureus N315
auaauuuuaaaaauaaaa

SEQ ID NO: 4056075 - RNA, 11 nt, Staphylococcus aureus subsp. aureus N315
auaauuuuaau

SEQ ID NO: 4056076 - RNA, 19 nt, Staphylococcus aureus subsp. aureus N315
auaauuuucaauuagaaaa

SEQ ID NO: 4056077 - RNA, 22 nt, Staphylococcus aureus subsp. aureus N315
auaauuuucaauuagaaaauau

SEQ ID NO: 4056078 - RNA, 22 nt, Staphylococcus aureus subsp. aureus N315
auaauuuuuaacagcgugaaua

SEQ ID NO: 4056079 - RNA, 17 nt, Staphylococcus aureus subsp. aureus N315
auacaaaaauauagcua

SEQ ID NO: 4056080 - RNA, 19 nt, Staphylococcus aureus subsp. aureus N315
auacaaaacaccucgauau

SEQ ID NO: 4056081 - RNA, 13 nt, Staphylococcus aureus subsp. aureus N315
auacaaaguacag

SEQ ID NO: 4056082 - RNA, 23 nt, Staphylococcus aureus subsp. aureus N315
auacaaaucguaaacauaaugac

SEQ ID NO: 4056083 - RNA, 13 nt, Staphylococcus aureus subsp. aureus N315
auacaaauugauu

SEQ ID NO: 4056084 - RNA, 13 nt, Staphylococcus aureus subsp. aureus N315
auacaaauuuuuu

SEQ ID NO: 4056085 - RNA, 17 nt, Staphylococcus aureus subsp. aureus N315
auacaacaguaaucaug

SEQ ID NO: 4056086 - RNA, 17 nt, Staphylococcus aureus subsp. aureus N315
auacaacucguuuuucc

SEQ ID NO: 4056087 - RNA, 16 nt, Staphylococcus aureus subsp. aureus N315
auacaaucauuuaugu

SEQ ID NO: 4056088 - RNA, 21 nt, Staphylococcus aureus subsp. aureus N315
auacaaugaauuucuaauuua

SEQ ID NO: 4056089 - RNA, 20 nt, Staphylococcus aureus subsp. aureus N315
auacaauuauggauaaaauu

SEQ ID NO: 4056090 - RNA, 21 nt, Staphylococcus aureus subsp. aureus N315
auacaauuucuucauuuucau

SEQ ID NO: 4056091 - RNA, 13 nt, Staphylococcus aureus subsp. aureus N315
auacaauuuuacc

SEQ ID NO: 4056092 - RNA, 13 nt, Staphylococcus aureus subsp. aureus N315
auacacaaauuuu

SEQ ID NO: 4056093 - RNA, 15 nt, Staphylococcus aureus subsp. aureus N315
auacacaaauuuuuu

SEQ ID NO: 4056094 - RNA, 17 nt, Staphylococcus aureus subsp. aureus N315
auacacagauuacucug

SEQ ID NO: 4056095 - RNA, 22 nt, Staphylococcus aureus subsp. aureus N315
auacacuaucauuaucaaauaa

SEQ ID NO: 4056096 - RNA, 23 nt, Staphylococcus aureus subsp. aureus N315
auacacuaucauuaucaaauaac

SEQ ID NO: 4056097 - RNA, 17 nt, Staphylococcus aureus subsp. aureus N315
auacacugcacaucaua

SEQ ID NO: 4056098 - RNA, 15 nt, Staphylococcus aureus subsp. aureus N315
auacacuuacaaaua

SEQ ID NO: 4056099 - RNA, 16 nt, Staphylococcus aureus subsp. aureus N315
auacacuuacaaauau

SEQ ID NO: 4056100 - RNA, 19 nt, Staphylococcus aureus subsp. aureus N315
auacagaucucaauccaau

SEQ ID NO: 4056101 - RNA, 21 nt, Staphylococcus aureus subsp. aureus N315
auacagaucucaauccaauua

SEQ ID NO: 4056102 - RNA, 22 nt, Staphylococcus aureus subsp. aureus N315
auacaggcugauuuuuuauuca

SEQ ID NO: 4056103 - RNA, 18 nt, Staphylococcus aureus subsp. aureus N315
auacaguuguuauuuuug

SEQ ID NO: 4056104 - RNA, 19 nt, Staphylococcus aureus subsp. aureus N315
auacaguuguuauuuuugc

SEQ ID NO: 4056105 - RNA, 21 nt, Staphylococcus aureus subsp. aureus N315
auacaguuguuauuuuugcua

SEQ ID NO: 4056106 - RNA, 19 nt, Staphylococcus aureus subsp. aureus N315
auacauaccacacuuuaaa

SEQ ID NO: 4056107 - RNA, 13 nt, Staphylococcus aureus subsp. aureus N315
auacauacugauu

SEQ ID NO: 4056108 - RNA, 14 nt, Staphylococcus aureus subsp. aureus N315
auacauauaagaau

SEQ ID NO: 4056109 - RNA, 20 nt, Staphylococcus aureus subsp. aureus N315
auacauaucggcccauaaua

SEQ ID NO: 4056110 - RNA, 23 nt, Staphylococcus aureus subsp. aureus N315
auacauaucggcccauaauagcu

SEQ ID NO: 4056111 - RNA, 14 nt, Staphylococcus aureus subsp. aureus N315
auacauaucuuuug

SEQ ID NO: 4056112 - RNA, 15 nt, Staphylococcus aureus subsp. aureus N315
auacauaucuuuugc

SEQ ID NO: 4056113 - RNA, 14 nt, Staphylococcus aureus subsp. aureus N315
auacaucaauuucu

SEQ ID NO: 4056114 - RNA, 20 nt, Staphylococcus aureus subsp. aureus N315
auacauccauacuucuauuu

SEQ ID NO: 4056115 - RNA, 22 nt, Staphylococcus aureus subsp. aureus N315
auacaucggaauucaaccaauu

SEQ ID NO: 4056116 - RNA, 18 nt, Staphylococcus aureus subsp. aureus N315
auacauuaucaagaauaa

SEQ ID NO: 4056117 - RNA, 15 nt, Staphylococcus aureus subsp. aureus N315
auacauuauuaaaua

SEQ ID NO: 4056118 - RNA, 17 nt, Staphylococcus aureus subsp. aureus N315
auacauugauaaauuuu

SEQ ID NO: 4056119 - RNA, 13 nt, Staphylococcus aureus subsp. aureus N315
auacauuuugaaa

SEQ ID NO: 4056120 - RNA, 14 nt, Staphylococcus aureus subsp. aureus N315
auaccaaaaacauu

SEQ ID NO: 4056121 - RNA, 16 nt, Staphylococcus aureus subsp. aureus N315
auaccaaaaacauuaa

SEQ ID NO: 4056122 - RNA, 18 nt, Staphylococcus aureus subsp. aureus N315
auaccaaccaaaaccaaa

SEQ ID NO: 4056123 - RNA, 22 nt, Staphylococcus aureus subsp. aureus N315
auaccaaccaaaaccaaaugaa

SEQ ID NO: 4056124 - RNA, 21 nt, Staphylococcus aureus subsp. aureus N315
auaccaacugucgguucaucu

SEQ ID NO: 4056125 - RNA, 22 nt, Staphylococcus aureus subsp. aureus N315
auaccaauugcugauauaauag

SEQ ID NO: 4056126 - RNA, 19 nt, Staphylococcus aureus subsp. aureus N315
auaccacacuuuaaacaag

SEQ ID NO: 4056127 - RNA, 21 nt, Staphylococcus aureus subsp. aureus N315
auaccacaucgcauaauaucu

SEQ ID NO: 4056128 - RNA, 22 nt, Staphylococcus aureus subsp. aureus N315
auaccacuuaaucguucccauu

SEQ ID NO: 4056129 - RNA, 22 nt, Staphylococcus aureus subsp. aureus N315
auaccacuugaauacuuuuuaa

SEQ ID NO: 4056130 - RNA, 19 nt, Staphylococcus aureus subsp. aureus N315
auaccaguggaaauuaugu

SEQ ID NO: 4056131 - RNA, 15 nt, Staphylococcus aureus subsp. aureus N315
auaccauaauuaaau

SEQ ID NO: 4056132 - RNA, 17 nt, Staphylococcus aureus subsp. aureus N315
auaccaucugaaucagu

SEQ ID NO: 4056133 - RNA, 16 nt, Staphylococcus aureus subsp. aureus N315
auaccauuccaaaaau

SEQ ID NO: 4056134 - RNA, 18 nt, Staphylococcus aureus subsp. aureus N315
auaccauuccaaaaauug

SEQ ID NO: 4056135 - RNA, 20 nt, Staphylococcus aureus subsp. aureus N315
auaccauugugaugauaauu

SEQ ID NO: 4056136 - RNA, 18 nt, Staphylococcus aureus subsp. aureus N315
auacccgcgauacugcca

SEQ ID NO: 4056137 - RNA, 13 nt, Staphylococcus aureus subsp. aureus N315
auaccgaauaauu

SEQ ID NO: 4056138 - RNA, 22 nt, Staphylococcus aureus subsp. aureus N315
auaccguacaaagguaauagaa

SEQ ID NO: 4056139 - RNA, 14 nt, Staphylococcus aureus subsp. aureus N315
auaccuaaaauacc

SEQ ID NO: 4056140 - RNA, 22 nt, Staphylococcus aureus subsp. aureus N315
auaccuaaugcgacaucgccaa

SEQ ID NO: 4056141 - RNA, 19 nt, Staphylococcus aureus subsp. aureus N315
auaccuauuccuauuacua

SEQ ID NO: 4056142 - RNA, 15 nt, Staphylococcus aureus subsp. aureus N315
auaccugcauauuca

SEQ ID NO: 4056143 - RNA, 12 nt, Staphylococcus aureus subsp. aureus N315
auaccuuuaaau

SEQ ID NO: 4056144 - RNA, 15 nt, Staphylococcus aureus subsp. aureus N315
auaccuuuaauaucu

SEQ ID NO: 4056145 - RNA, 18 nt, Staphylococcus aureus subsp. aureus N315
auaccuuuaauuguuaaa

SEQ ID NO: 4056146 - RNA, 19 nt, Staphylococcus aureus subsp. aureus N315
auaccuuuacuuucauuac

SEQ ID NO: 4056147 - RNA, 14 nt, Staphylococcus aureus subsp. aureus N315
auaccuuuuucuaa

SEQ ID NO: 4056148 - RNA, 14 nt, Staphylococcus aureus subsp. aureus N315
auacgaauuaaaau

SEQ ID NO: 4056149 - RNA, 13 nt, Staphylococcus aureus subsp. aureus N315
auacgacaaucac

SEQ ID NO: 4056150 - RNA, 24 nt, Staphylococcus aureus subsp. aureus N315
auacgagcuuugcucauagaugac

SEQ ID NO: 4056151 - RNA, 15 nt, Staphylococcus aureus subsp. aureus N315
auacgaguguuuuaa

SEQ ID NO: 4056152 - RNA, 16 nt, Staphylococcus aureus subsp. aureus N315
auacgauugcaauugc

SEQ ID NO: 4056153 - RNA, 18 nt, Staphylococcus aureus subsp. aureus N315
auacgccuaaauauuuac

SEQ ID NO: 4056154 - RNA, 14 nt, Staphylococcus aureus subsp. aureus N315
auacgcuuuuuaaa

SEQ ID NO: 4056155 - RNA, 20 nt, Staphylococcus aureus subsp. aureus N315
auacguaaacacuuuaguau

SEQ ID NO: 4056156 - RNA, 13 nt, Staphylococcus aureus subsp. aureus N315
auacguaaauggu

SEQ ID NO: 4056157 - RNA, 20 nt, Staphylococcus aureus subsp. aureus N315
auacguaucaagaaaaaguu

SEQ ID NO: 4056158 - RNA, 15 nt, Staphylococcus aureus subsp. aureus N315
auacgugcuuuaaag

SEQ ID NO: 4056159 - RNA, 22 nt, Staphylococcus aureus subsp. aureus N315
auacguguguuuucuuuucaaa

SEQ ID NO: 4056160 - RNA, 20 nt, Staphylococcus aureus subsp. aureus N315
auacguuauuucaauaauaa

SEQ ID NO: 4056161 - RNA, 14 nt, Staphylococcus aureus subsp. aureus N315
auacguuauuuuuu

SEQ ID NO: 4056162 - RNA, 14 nt, Staphylococcus aureus subsp. aureus N315
auacguuuauaucu

SEQ ID NO: 4056163 - RNA, 13 nt, Staphylococcus aureus subsp. aureus N315
auacuaaaacaug

SEQ ID NO: 4056164 - RNA, 21 nt, Staphylococcus aureus subsp. aureus N315
auacuaaaaguguuaugaauu

SEQ ID NO: 4056165 - RNA, 13 nt, Staphylococcus aureus subsp. aureus N315
auacuaaagcacc

SEQ ID NO: 4056166 - RNA, 16 nt, Staphylococcus aureus subsp. aureus N315
auacuaaauugagaag

SEQ ID NO: 4056167 - RNA, 17 nt, Staphylococcus aureus subsp. aureus N315
auacuaaauugagaagu

SEQ ID NO: 4056168 - RNA, 13 nt, Staphylococcus aureus subsp. aureus N315
auacuaacaauua

SEQ ID NO: 4056169 - RNA, 13 nt, Staphylococcus aureus subsp. aureus N315
auacuaacuauau

SEQ ID NO: 4056170 - RNA, 21 nt, Staphylococcus aureus subsp. aureus N315
auacuaacugaagacaccuua

SEQ ID NO: 4056171 - RNA, 23 nt, Staphylococcus aureus subsp. aureus N315
auacuaagcgcucauaaacgauu

SEQ ID NO: 4056172 - RNA, 19 nt, Staphylococcus aureus subsp. aureus N315
auacuaauaucuucuuuau

SEQ ID NO: 4056173 - RNA, 19 nt, Staphylococcus aureus subsp. aureus N315
auacuaaucaaagaaaaag

SEQ ID NO: 4056174 - RNA, 23 nt, Staphylococcus aureus subsp. aureus N315
auacuaaucuucaacuucgauau

SEQ ID NO: 4056175 - RNA, 22 nt, Staphylococcus aureus subsp. aureus N315
auacuaauuucuauagaaaaag

SEQ ID NO: 4056176 - RNA, 13 nt, Staphylococcus aureus subsp. aureus N315
auacuacauauaa

SEQ ID NO: 4056177 - RNA, 17 nt, Staphylococcus aureus subsp. aureus N315
auacuacauauaaugcc

SEQ ID NO: 4056178 - RNA, 13 nt, Staphylococcus aureus subsp. aureus N315
auacuauacugau

SEQ ID NO: 4056179 - RNA, 14 nt, Staphylococcus aureus subsp. aureus N315
auacuauacugaug

SEQ ID NO: 4056180 - RNA, 17 nt, Staphylococcus aureus subsp. aureus N315
auacuauaugaaaagag

SEQ ID NO: 4056181 - RNA, 19 nt, Staphylococcus aureus subsp. aureus N315
auacuaucugacauuuaaa

SEQ ID NO: 4056182 - RNA, 21 nt, Staphylococcus aureus subsp. aureus N315
auacuauuccguuucauugau

SEQ ID NO: 4056183 - RNA, 13 nt, Staphylococcus aureus subsp. aureus N315
auacucaauaaaa

SEQ ID NO: 4056184 - RNA, 20 nt, Staphylococcus aureus subsp. aureus N315
auacucaguuuauugaggau

SEQ ID NO: 4056185 - RNA, 19 nt, Staphylococcus aureus subsp. aureus N315
auacucaucuguccgauau

SEQ ID NO: 4056186 - RNA, 20 nt, Staphylococcus aureus subsp. aureus N315
auacuccaguuuauaacugg

SEQ ID NO: 4056187 - RNA, 14 nt, Staphylococcus aureus subsp. aureus N315
auacucuaaaaaag

SEQ ID NO: 4056188 - RNA, 16 nt, Staphylococcus aureus subsp. aureus N315
auacugauauuuagaa

SEQ ID NO: 4056189 - RNA, 16 nt, Staphylococcus aureus subsp. aureus N315
auacugccauauguuu

SEQ ID NO: 4056190 - RNA, 14 nt, Staphylococcus aureus subsp. aureus N315
auacuguauuuaua

SEQ ID NO: 4056191 - RNA, 15 nt, Staphylococcus aureus subsp. aureus N315
auacugucaucuuuc

SEQ ID NO: 4056192 - RNA, 19 nt, Staphylococcus aureus subsp. aureus N315
auacuguuuaaauaaaauu

SEQ ID NO: 4056193 - RNA, 16 nt, Staphylococcus aureus subsp. aureus N315
auacuuaauauaguua

SEQ ID NO: 4056194 - RNA, 15 nt, Staphylococcus aureus subsp. aureus N315
auacuuaauuuaaau

SEQ ID NO: 4056195 - RNA, 15 nt, Staphylococcus aureus subsp. aureus N315
auacuucguauugaa

SEQ ID NO: 4056196 - RNA, 22 nt, Staphylococcus aureus subsp. aureus N315
auacuucguugucacuauugca

SEQ ID NO: 4056197 - RNA, 13 nt, Staphylococcus aureus subsp. aureus N315
auacuucuauuuu

SEQ ID NO: 4056198 - RNA, 19 nt, Staphylococcus aureus subsp. aureus N315
auacuucuauuuuauaaua

SEQ ID NO: 4056199 - RNA, 13 nt, Staphylococcus aureus subsp. aureus N315
auacuucuuguuc

SEQ ID NO: 4056200 - RNA, 12 nt, Staphylococcus aureus subsp. aureus N315
auacuugaagaa

SEQ ID NO: 4056201 - RNA, 15 nt, Staphylococcus aureus subsp. aureus N315
auacuugaagaaaag

SEQ ID NO: 4056202 - RNA, 15 nt, Staphylococcus aureus subsp. aureus N315
auacuugaagaauca

SEQ ID NO: 4056203 - RNA, 17 nt, Staphylococcus aureus subsp. aureus N315
auacuugaagcaucgau

SEQ ID NO: 4056204 - RNA, 23 nt, Staphylococcus aureus subsp. aureus N315
auacuugaagcaucgauuuauua

SEQ ID NO: 4056205 - RNA, 18 nt, Staphylococcus aureus subsp. aureus N315
auacuugaugaaacugau

SEQ ID NO: 4056206 - RNA, 19 nt, Staphylococcus aureus subsp. aureus N315
auacuugccuucaaauucu

SEQ ID NO: 4056207 - RNA, 16 nt, Staphylococcus aureus subsp. aureus N315
auacuuucaaacaaau

SEQ ID NO: 4056208 - RNA, 21 nt, Staphylococcus aureus subsp. aureus N315
auacuuucacuuuuuauauca

SEQ ID NO: 4056209 - RNA, 18 nt, Staphylococcus aureus subsp. aureus N315
auacuuucuaagauacgu

SEQ ID NO: 4056210 - RNA, 14 nt, Staphylococcus aureus subsp. aureus N315
auacuuugaaagaa

SEQ ID NO: 4056211 - RNA, 14 nt, Staphylococcus aureus subsp. aureus N315
auacuuuucucgau

SEQ ID NO: 4056212 - RNA, 17 nt, Staphylococcus aureus subsp. aureus N315
auacuuuugcaucacag

SEQ ID NO: 4056213 - RNA, 22 nt, Staphylococcus aureus subsp. aureus N315
auacuuuuggucuguugaaguc

SEQ ID NO: 4056214 - RNA, 14 nt, Staphylococcus aureus subsp. aureus N315
auacuuuuuauaua

SEQ ID NO: 4056215 - RNA, 16 nt, Staphylococcus aureus subsp. aureus N315
auagaaaaauuucaaa

SEQ ID NO: 4056216 - RNA, 21 nt, Staphylococcus aureus subsp. aureus N315
auagaaaaugaguacaacaua

SEQ ID NO: 4056217 - RNA, 14 nt, Staphylococcus aureus subsp. aureus N315
auagaaaauuaacu

SEQ ID NO: 4056218 - RNA, 19 nt, Staphylococcus aureus subsp. aureus N315
auagaaagaaauuguuccu

SEQ ID NO: 4056219 - RNA, 18 nt, Staphylococcus aureus subsp. aureus N315
auagaaaugacgauaccu

SEQ ID NO: 4056220 - RNA, 19 nt, Staphylococcus aureus subsp. aureus N315
auagaaaugacgauaccuu

SEQ ID NO: 4056221 - RNA, 14 nt, Staphylococcus aureus subsp. aureus N315
auagaacaaaaugu

SEQ ID NO: 4056222 - RNA, 15 nt, Staphylococcus aureus subsp. aureus N315
auagaaguauggaug

SEQ ID NO: 4056223 - RNA, 15 nt, Staphylococcus aureus subsp. aureus N315
auagaaugucgauau

SEQ ID NO: 4056224 - RNA, 13 nt, Staphylococcus aureus subsp. aureus N315
auagaauuuuuca

SEQ ID NO: 4056225 - RNA, 13 nt, Staphylococcus aureus subsp. aureus N315
auagaccuaugaa

SEQ ID NO: 4056226 - RNA, 16 nt, Staphylococcus aureus subsp. aureus N315
auagacugccaauaaa

SEQ ID NO: 4056227 - RNA, 13 nt, Staphylococcus aureus subsp. aureus N315
auagagaaagaau

SEQ ID NO: 4056228 - RNA, 15 nt, Staphylococcus aureus subsp. aureus N315
auagagaaagaauaa

SEQ ID NO: 4056229 - RNA, 19 nt, Staphylococcus aureus subsp. aureus N315
auagagaaagaauaaaugu

SEQ ID NO: 4056230 - RNA, 13 nt, Staphylococcus aureus subsp. aureus N315
auagagaaauacu

SEQ ID NO: 4056231 - RNA, 14 nt, Staphylococcus aureus subsp. aureus N315
auagagacauuuua

SEQ ID NO: 4056232 - RNA, 17 nt, Staphylococcus aureus subsp. aureus N315
auagaggcacaguggau

SEQ ID NO: 4056233 - RNA, 22 nt, Staphylococcus aureus subsp. aureus N315
auagaguaguucggaugagaaa

SEQ ID NO: 4056234 - RNA, 16 nt, Staphylococcus aureus subsp. aureus N315
auagaugaaaauuuaa

SEQ ID NO: 4056235 - RNA, 24 nt, Staphylococcus aureus subsp. aureus N315
auagaugaugugacgauauuuguu

SEQ ID NO: 4056236 - RNA, 14 nt, Staphylococcus aureus subsp. aureus N315
auagaugcauaaaa

SEQ ID NO: 4056237 - RNA, 16 nt, Staphylococcus aureus subsp. aureus N315
auagauuaaaaaauca

SEQ ID NO: 4056238 - RNA, 19 nt, Staphylococcus aureus subsp. aureus N315
auagauuaaaaaaucauuc

SEQ ID NO: 4056239 - RNA, 13 nt, Staphylococcus aureus subsp. aureus N315
auagauugaaaaa

SEQ ID NO: 4056240 - RNA, 19 nt, Staphylococcus aureus subsp. aureus N315
auagcaaaauuauguaaaa

SEQ ID NO: 4056241 - RNA, 21 nt, Staphylococcus aureus subsp. aureus N315
auagcaaccauauuuuuagaa

SEQ ID NO: 4056242 - RNA, 17 nt, Staphylococcus aureus subsp. aureus N315
auagcaaugaauuaaua

SEQ ID NO: 4056243 - RNA, 17 nt, Staphylococcus aureus subsp. aureus N315
auagcaauuuucgauau

SEQ ID NO: 4056244 - RNA, 24 nt, Staphylococcus aureus subsp. aureus N315
auagcagggugcuaaauuuacgaa

SEQ ID NO: 4056245 - RNA, 21 nt, Staphylococcus aureus subsp. aureus N315
auagcauaaaaagagguuuuc

SEQ ID NO: 4056246 - RNA, 22 nt, Staphylococcus aureus subsp. aureus N315
auagcauaaaauuucugcuucu

SEQ ID NO: 4056247 - RNA, 14 nt, Staphylococcus aureus subsp. aureus N315
auagccuucauuug

SEQ ID NO: 4056248 - RNA, 20 nt, Staphylococcus aureus subsp. aureus N315
auagcgcucuggauuuuucu

SEQ ID NO: 4056249 - RNA, 17 nt, Staphylococcus aureus subsp. aureus N315
auagcgguguuuugaga

SEQ ID NO: 4056250 - RNA, 18 nt, Staphylococcus aureus subsp. aureus N315
auagcuaaugcauuauua

SEQ ID NO: 4056251 - RNA, 14 nt, Staphylococcus aureus subsp. aureus N315
auagcuacaauuaa

SEQ ID NO: 4056252 - RNA, 13 nt, Staphylococcus aureus subsp. aureus N315
auagcuauauuua

SEQ ID NO: 4056253 - RNA, 18 nt, Staphylococcus aureus subsp. aureus N315
auagcuauuacuauaaaa

SEQ ID NO: 4056254 - RNA, 16 nt, Staphylococcus aureus subsp. aureus N315
auagcucuauggcuuc

SEQ ID NO: 4056255 - RNA, 16 nt, Staphylococcus aureus subsp. aureus N315
auagcuuucguuucuu

SEQ ID NO: 4056256 - RNA, 16 nt, Staphylococcus aureus subsp. aureus N315
auaggaaacuuaaaua

SEQ ID NO: 4056257 - RNA, 17 nt, Staphylococcus aureus subsp. aureus N315
auaggaaacuuaaauau

SEQ ID NO: 4056258 - RNA, 15 nt, Staphylococcus aureus subsp. aureus N315
auaggaauacaugag

SEQ ID NO: 4056259 - RNA, 18 nt, Staphylococcus aureus subsp. aureus N315
auaggaauacaugaguaa

SEQ ID NO: 4056260 - RNA, 19 nt, Staphylococcus aureus subsp. aureus N315
auaggauauugcaucauuc

SEQ ID NO: 4056261 - RNA, 17 nt, Staphylococcus aureus subsp. aureus N315
auaggauuauuaucaaa

SEQ ID NO: 4056262 - RNA, 16 nt, Staphylococcus aureus subsp. aureus N315
auaggauuuacaccua

SEQ ID NO: 4056263 - RNA, 24 nt, Staphylococcus aureus subsp. aureus N315
auaggauuuacaccuauaccucgu

SEQ ID NO: 4056264 - RNA, 24 nt, Staphylococcus aureus subsp. aureus N315
auaggauuugcaccuauaccucgu

SEQ ID NO: 4056265 - RNA, 14 nt, Staphylococcus aureus subsp. aureus N315
auaggcuugccaau

SEQ ID NO: 4056266 - RNA, 18 nt, Staphylococcus aureus subsp. aureus N315
auaggcuugccaauguga

SEQ ID NO: 4056267 - RNA, 17 nt, Staphylococcus aureus subsp. aureus N315
auaggugauuauauaua

SEQ ID NO: 4056268 - RNA, 17 nt, Staphylococcus aureus subsp. aureus N315
auaguaaagugaaauaa

SEQ ID NO: 4056269 - RNA, 13 nt, Staphylococcus aureus subsp. aureus N315
auaguaagaaaag

SEQ ID NO: 4056270 - RNA, 18 nt, Staphylococcus aureus subsp. aureus N315
auaguaagguuugaacuc

SEQ ID NO: 4056271 - RNA, 13 nt, Staphylococcus aureus subsp. aureus N315
auaguaaucgauu

SEQ ID NO: 4056272 - RNA, 19 nt, Staphylococcus aureus subsp. aureus N315
auaguacauuuauuuucaa

SEQ ID NO: 4056273 - RNA, 19 nt, Staphylococcus aureus subsp. aureus N315
auaguaggguauugaaaua

SEQ ID NO: 4056274 - RNA, 20 nt, Staphylococcus aureus subsp. aureus N315
auagucauaacgauuguugc

SEQ ID NO: 4056275 - RNA, 14 nt, Staphylococcus aureus subsp. aureus N315
auagucaucuguua

SEQ ID NO: 4056276 - RNA, 23 nt, Staphylococcus aureus subsp. aureus N315
auagucaucuguuaauucaggau

SEQ ID NO: 4056277 - RNA, 12 nt, Staphylococcus aureus subsp. aureus N315
auagucaucuua

SEQ ID NO: 4056278 - RNA, 19 nt, Staphylococcus aureus subsp. aureus N315
auaguccgcguguacuuua

SEQ ID NO: 4056279 - RNA, 20 nt, Staphylococcus aureus subsp. aureus N315
auaguccgcguguacuuuac

SEQ ID NO: 4056280 - RNA, 18 nt, Staphylococcus aureus subsp. aureus N315
auaguccggggccccaac

SEQ ID NO: 4056281 - RNA, 16 nt, Staphylococcus aureus subsp. aureus N315
auagucuuaaacauaa

SEQ ID NO: 4056282 - RNA, 12 nt, Staphylococcus aureus subsp. aureus N315
auagugaaauua

SEQ ID NO: 4056283 - RNA, 19 nt, Staphylococcus aureus subsp. aureus N315
auagugcuuguuuauuaca

SEQ ID NO: 4056284 - RNA, 19 nt, Staphylococcus aureus subsp. aureus N315
auaguggaugcucguauag

SEQ ID NO: 4056285 - RNA, 18 nt, Staphylococcus aureus subsp. aureus N315
auaguggugguacuuuuu

SEQ ID NO: 4056286 - RNA, 20 nt, Staphylococcus aureus subsp. aureus N315
auaguuaagauuuuaacuuc

SEQ ID NO: 4056287 - RNA, 22 nt, Staphylococcus aureus subsp. aureus N315
auaguucaaauugaacuucuuu

SEQ ID NO: 4056288 - RNA, 14 nt, Staphylococcus aureus subsp. aureus N315
auaguucuauauaa

SEQ ID NO: 4056289 - RNA, 20 nt, Staphylococcus aureus subsp. aureus N315
auaguucuuuaaauuauaua

SEQ ID NO: 4056290 - RNA, 23 nt, Staphylococcus aureus subsp. aureus N315
auaguugagcguuuaauuagaaa

SEQ ID NO: 4056291 - RNA, 20 nt, Staphylococcus aureus subsp. aureus N315
auaguugucuuuacauucuu

SEQ ID NO: 4056292 - RNA, 14 nt, Staphylococcus aureus subsp. aureus N315
auaguuuauuaaua

SEQ ID NO: 4056293 - RNA, 15 nt, Staphylococcus aureus subsp. aureus N315
auaguuucaaugccu

SEQ ID NO: 4056294 - RNA, 21 nt, Staphylococcus aureus subsp. aureus N315
auaguuuugauugcaaaaaaa

SEQ ID NO: 4056295 - RNA, 17 nt, Staphylococcus aureus subsp. aureus N315
auaguuuuucauauuca

SEQ ID NO: 4056296 - RNA, 21 nt, Staphylococcus aureus subsp. aureus N315
auauaaaaaagaucacugcca

SEQ ID NO: 4056297 - RNA, 16 nt, Staphylococcus aureus subsp. aureus N315
auauaaaaaauuauua

SEQ ID NO: 4056298 - RNA, 18 nt, Staphylococcus aureus subsp. aureus N315
auauaaaaacaaaagaaa

SEQ ID NO: 4056299 - RNA, 23 nt, Staphylococcus aureus subsp. aureus N315
auauaaaaaccccuguugaacuu

SEQ ID NO: 4056300 - RNA, 21 nt, Staphylococcus aureus subsp. aureus N315
auauaaaaagaagaucccuca

SEQ ID NO: 4056301 - RNA, 22 nt, Staphylococcus aureus subsp. aureus N315
auauaaaaagucccgcuuaaaa

SEQ ID NO: 4056302 - RNA, 23 nt, Staphylococcus aureus subsp. aureus N315
auauaaaaagugaagauauuuau

SEQ ID NO: 4056303 - RNA, 19 nt, Staphylococcus aureus subsp. aureus N315
auauaaaacgauaagaauu

SEQ ID NO: 4056304 - RNA, 16 nt, Staphylococcus aureus subsp. aureus N315
auauaaaacugugcau

SEQ ID NO: 4056305 - RNA, 22 nt, Staphylococcus aureus subsp. aureus N315
auauaaagaaauaauuuaaagg

SEQ ID NO: 4056306 - RNA, 14 nt, Staphylococcus aureus subsp. aureus N315
auauaaagcuuuga

SEQ ID NO: 4056307 - RNA, 21 nt, Staphylococcus aureus subsp. aureus N315
auauaaaggaauagcuacaau

SEQ ID NO: 4056308 - RNA, 13 nt, Staphylococcus aureus subsp. aureus N315
auauaaauaggca

SEQ ID NO: 4056309 - RNA, 14 nt, Staphylococcus aureus subsp. aureus N315
auauaaauaggcag

SEQ ID NO: 4056310 - RNA, 19 nt, Staphylococcus aureus subsp. aureus N315
auauaaaucaaauauacuu

SEQ ID NO: 4056311 - RNA, 20 nt, Staphylococcus aureus subsp. aureus N315
auauaaaucaaauauacuuu

SEQ ID NO: 4056312 - RNA, 14 nt, Staphylococcus aureus subsp. aureus N315
auauaaauguugac

SEQ ID NO: 4056313 - RNA, 17 nt, Staphylococcus aureus subsp. aureus N315
auauaaauuaucagaau

SEQ ID NO: 4056314 - RNA, 22 nt, Staphylococcus aureus subsp. aureus N315
auauaaccgugaugaugugcaa

SEQ ID NO: 4056315 - RNA, 16 nt, Staphylococcus aureus subsp. aureus N315
auauaaccuauuucau

SEQ ID NO: 4056316 - RNA, 21 nt, Staphylococcus aureus subsp. aureus N315
auauaacuauggucaucaauu

SEQ ID NO: 4056317 - RNA, 22 nt, Staphylococcus aureus subsp. aureus N315
auauaacuucuauuaagaaaua

SEQ ID NO: 4056318 - RNA, 23 nt, Staphylococcus aureus subsp. aureus N315
auauaacuucuauuaagaaauac

SEQ ID NO: 4056319 - RNA, 18 nt, Staphylococcus aureus subsp. aureus N315
auauaagaaauccaccua

SEQ ID NO: 4056320 - RNA, 19 nt, Staphylococcus aureus subsp. aureus N315
auauaagauucauauuuau

SEQ ID NO: 4056321 - RNA, 15 nt, Staphylococcus aureus subsp. aureus N315
auauaaggaaaagga

SEQ ID NO: 4056322 - RNA, 16 nt, Staphylococcus aureus subsp. aureus N315
auauaaguauaaugau

SEQ ID NO: 4056323 - RNA, 18 nt, Staphylococcus aureus subsp. aureus N315
auauaauaccccaaauag

SEQ ID NO: 4056324 - RNA, 13 nt, Staphylococcus aureus subsp. aureus N315
auauaauagaaau

SEQ ID NO: 4056325 - RNA, 14 nt, Staphylococcus aureus subsp. aureus N315
auauaauagaaaua

SEQ ID NO: 4056326 - RNA, 21 nt, Staphylococcus aureus subsp. aureus N315
auauaaugcugauaauuuuuc

SEQ ID NO: 4056327 - RNA, 22 nt, Staphylococcus aureus subsp. aureus N315
auauaaugcugauaauuuuucu

SEQ ID NO: 4056328 - RNA, 19 nt, Staphylococcus aureus subsp. aureus N315
auauaauggcacugcaauc

SEQ ID NO: 4056329 - RNA, 16 nt, Staphylococcus aureus subsp. aureus N315
auauaauguauaaaac

SEQ ID NO: 4056330 - RNA, 17 nt, Staphylococcus aureus subsp. aureus N315
auauaauuaauuuugua

SEQ ID NO: 4056331 - RNA, 14 nt, Staphylococcus aureus subsp. aureus N315
auauaauuuaaaga

SEQ ID NO: 4056332 - RNA, 18 nt, Staphylococcus aureus subsp. aureus N315
auauaauuuauaaaaaga

SEQ ID NO: 4056333 - RNA, 13 nt, Staphylococcus aureus subsp. aureus N315
auauaauuuauuu

SEQ ID NO: 4056334 - RNA, 13 nt, Staphylococcus aureus subsp. aureus N315
auauaccaaccaa

SEQ ID NO: 4056335 - RNA, 21 nt, Staphylococcus aureus subsp. aureus N315
auauacccagaugaauuuuua

SEQ ID NO: 4056336 - RNA, 16 nt, Staphylococcus aureus subsp. aureus N315
auauacgacaaucaca

SEQ ID NO: 4056337 - RNA, 15 nt, Staphylococcus aureus subsp. aureus N315
auauacgacauuuuu

SEQ ID NO: 4056338 - RNA, 22 nt, Staphylococcus aureus subsp. aureus N315
auauacgauugaguugaaaaua

SEQ ID NO: 4056339 - RNA, 14 nt, Staphylococcus aureus subsp. aureus N315
auauacucuaaaaa

SEQ ID NO: 4056340 - RNA, 18 nt, Staphylococcus aureus subsp. aureus N315
auauacuguauaguaacc

SEQ ID NO: 4056341 - RNA, 12 nt, Staphylococcus aureus subsp. aureus N315
auauacuugaag

SEQ ID NO: 4056342 - RNA, 13 nt, Staphylococcus aureus subsp. aureus N315
auauacuugaaga

SEQ ID NO: 4056343 - RNA, 14 nt, Staphylococcus aureus subsp. aureus N315
auauacuugaagaa

SEQ ID NO: 4056344 - RNA, 15 nt, Staphylococcus aureus subsp. aureus N315
auauacuugaagaaa

SEQ ID NO: 4056345 - RNA, 18 nt, Staphylococcus aureus subsp. aureus N315
auauacuugccuucaaau

SEQ ID NO: 4056346 - RNA, 17 nt, Staphylococcus aureus subsp. aureus N315
auauacuuguucaacaa

SEQ ID NO: 4056347 - RNA, 11 nt, Staphylococcus aureus subsp. aureus N315
auauacuuuuu

SEQ ID NO: 4056348 - RNA, 17 nt, Staphylococcus aureus subsp. aureus N315
auauacuuuuuaaauga

SEQ ID NO: 4056349 - RNA, 11 nt, Staphylococcus aureus subsp. aureus N315
auauagaaaau

SEQ ID NO: 4056350 - RNA, 23 nt, Staphylococcus aureus subsp. aureus N315
auauagaaaaugaguacaacaua

SEQ ID NO: 4056351 - RNA, 20 nt, Staphylococcus aureus subsp. aureus N315
auauagaagauauaacaugu

SEQ ID NO: 4056352 - RNA, 22 nt, Staphylococcus aureus subsp. aureus N315
auauagaagauauaacauguau

SEQ ID NO: 4056353 - RNA, 14 nt, Staphylococcus aureus subsp. aureus N315
auauagaaggggac

SEQ ID NO: 4056354 - RNA, 21 nt, Staphylococcus aureus subsp. aureus N315
auauagagccaugaaaaggaa

SEQ ID NO: 4056355 - RNA, 13 nt, Staphylococcus aureus subsp. aureus N315
auauagauuaaac

SEQ ID NO: 4056356 - RNA, 18 nt, Staphylococcus aureus subsp. aureus N315
auauagcggugucaauau

SEQ ID NO: 4056357 - RNA, 19 nt, Staphylococcus aureus subsp. aureus N315
auauaguaaaauaaauaca

SEQ ID NO: 4056358 - RNA, 14 nt, Staphylococcus aureus subsp. aureus N315
auauaguuggcaau

SEQ ID NO: 4056359 - RNA, 13 nt, Staphylococcus aureus subsp. aureus N315
auauauaaagaaa

SEQ ID NO: 4056360 - RNA, 16 nt, Staphylococcus aureus subsp. aureus N315
auauauaacaaguaca

SEQ ID NO: 4056361 - RNA, 18 nt, Staphylococcus aureus subsp. aureus N315
auauauaaggcgcucucu

SEQ ID NO: 4056362 - RNA, 14 nt, Staphylococcus aureus subsp. aureus N315
auauauauauuaaa

SEQ ID NO: 4056363 - RNA, 11 nt, Staphylococcus aureus subsp. aureus N315
auauauauucg

SEQ ID NO: 4056364 - RNA, 19 nt, Staphylococcus aureus subsp. aureus N315
auauaucuagccugaaaua

SEQ ID NO: 4056365 - RNA, 14 nt, Staphylococcus aureus subsp. aureus N315
auauaugaaauauu

SEQ ID NO: 4056366 - RNA, 15 nt, Staphylococcus aureus subsp. aureus N315
auauaugaaauauuu

SEQ ID NO: 4056367 - RNA, 17 nt, Staphylococcus aureus subsp. aureus N315
auauaugaaauauuuau

SEQ ID NO: 4056368 - RNA, 12 nt, Staphylococcus aureus subsp. aureus N315
auauaugauaaa

SEQ ID NO: 4056369 - RNA, 18 nt, Staphylococcus aureus subsp. aureus N315
auauaugccgauugcucu

SEQ ID NO: 4056370 - RNA, 15 nt, Staphylococcus aureus subsp. aureus N315
auauauguaacauaa

SEQ ID NO: 4056371 - RNA, 16 nt, Staphylococcus aureus subsp. aureus N315
auauauguaacauaaa

SEQ ID NO: 4056372 - RNA, 19 nt, Staphylococcus aureus subsp. aureus N315
auauauguaacauaaagcu

SEQ ID NO: 4056373 - RNA, 20 nt, Staphylococcus aureus subsp. aureus N315
auauauguauaacauuauua

SEQ ID NO: 4056374 - RNA, 21 nt, Staphylococcus aureus subsp. aureus N315
auauauuaaaacaaugaggau

SEQ ID NO: 4056375 - RNA, 15 nt, Staphylococcus aureus subsp. aureus N315
auauauuaaaguaaa

SEQ ID NO: 4056376 - RNA, 22 nt, Staphylococcus aureus subsp. aureus N315
auauauuacuaaccuauuaaaa

SEQ ID NO: 4056377 - RNA, 14 nt, Staphylococcus aureus subsp. aureus N315
auauauuauaaccc

SEQ ID NO: 4056378 - RNA, 20 nt, Staphylococcus aureus subsp. aureus N315
auauauucaauaauuauuaa

SEQ ID NO: 4056379 - RNA, 15 nt, Staphylococcus aureus subsp. aureus N315
auauauucaucucuu

SEQ ID NO: 4056380 - RNA, 13 nt, Staphylococcus aureus subsp. aureus N315
auauauucguuac

SEQ ID NO: 4056381 - RNA, 18 nt, Staphylococcus aureus subsp. aureus N315
auauauucguuacaaaug

SEQ ID NO: 4056382 - RNA, 16 nt, Staphylococcus aureus subsp. aureus N315
auauauuuauuuuuga

SEQ ID NO: 4056383 - RNA, 19 nt, Staphylococcus aureus subsp. aureus N315
auauauuuauuuuugauag

SEQ ID NO: 4056384 - RNA, 12 nt, Staphylococcus aureus subsp. aureus N315
auauauuucuau

SEQ ID NO: 4056385 - RNA, 18 nt, Staphylococcus aureus subsp. aureus N315
auauauuuguauaugcaa

SEQ ID NO: 4056386 - RNA, 12 nt, Staphylococcus aureus subsp. aureus N315
auauauuuuguu

SEQ ID NO: 4056387 - RNA, 14 nt, Staphylococcus aureus subsp. aureus N315
auaucaaauacauu

SEQ ID NO: 4056388 - RNA, 17 nt, Staphylococcus aureus subsp. aureus N315
auaucaacguuaauaua

SEQ ID NO: 4056389 - RNA, 14 nt, Staphylococcus aureus subsp. aureus N315
auaucaagauguuu

SEQ ID NO: 4056390 - RNA, 15 nt, Staphylococcus aureus subsp. aureus N315
auaucaauaaugcug

SEQ ID NO: 4056391 - RNA, 18 nt, Staphylococcus aureus subsp. aureus N315
auaucaauaauucguuga

SEQ ID NO: 4056392 - RNA, 21 nt, Staphylococcus aureus subsp. aureus N315
auaucaauuuauuauuaacug

SEQ ID NO: 4056393 - RNA, 19 nt, Staphylococcus aureus subsp. aureus N315
auaucaauuucaacuuaua

SEQ ID NO: 4056394 - RNA, 21 nt, Staphylococcus aureus subsp. aureus N315
auaucaauuucaacuuauaaa

SEQ ID NO: 4056395 - RNA, 18 nt, Staphylococcus aureus subsp. aureus N315
auaucaauuuuuacuaaa

SEQ ID NO: 4056396 - RNA, 17 nt, Staphylococcus aureus subsp. aureus N315
auaucacgagcuuuuaa

SEQ ID NO: 4056397 - RNA, 16 nt, Staphylococcus aureus subsp. aureus N315
auaucacuuuagauaa

SEQ ID NO: 4056398 - RNA, 22 nt, Staphylococcus aureus subsp. aureus N315
auaucagcuaaguuaaauauca

SEQ ID NO: 4056399 - RNA, 21 nt, Staphylococcus aureus subsp. aureus N315
auaucagcuuguuucagguuu

SEQ ID NO: 4056400 - RNA, 15 nt, Staphylococcus aureus subsp. aureus N315
auaucagcuuuuuca

SEQ ID NO: 4056401 - RNA, 18 nt, Staphylococcus aureus subsp. aureus N315
auaucaguaauaauacgc

SEQ ID NO: 4056402 - RNA, 18 nt, Staphylococcus aureus subsp. aureus N315
auaucauauucaaaauaa

SEQ ID NO: 4056403 - RNA, 12 nt, Staphylococcus aureus subsp. aureus N315
auaucaucaagu

SEQ ID NO: 4056404 - RNA, 18 nt, Staphylococcus aureus subsp. aureus N315
auaucaucaaguuuaucu

SEQ ID NO: 4056405 - RNA, 15 nt, Staphylococcus aureus subsp. aureus N315
auaucaucauuuaaa

SEQ ID NO: 4056406 - RNA, 14 nt, Staphylococcus aureus subsp. aureus N315
auaucaucucuaug

SEQ ID NO: 4056407 - RNA, 21 nt, Staphylococcus aureus subsp. aureus N315
auaucauucuguguaaauaua

SEQ ID NO: 4056408 - RNA, 17 nt, Staphylococcus aureus subsp. aureus N315
auauccacgguuuacca

SEQ ID NO: 4056409 - RNA, 21 nt, Staphylococcus aureus subsp. aureus N315
auauccacgguuuaccacuua

SEQ ID NO: 4056410 - RNA, 17 nt, Staphylococcus aureus subsp. aureus N315
auauccauuaugaugua

SEQ ID NO: 4056411 - RNA, 20 nt, Staphylococcus aureus subsp. aureus N315
auauccauucaauguuuaau

SEQ ID NO: 4056412 - RNA, 18 nt, Staphylococcus aureus subsp. aureus N315
auauccuggaauauuaac

SEQ ID NO: 4056413 - RNA, 15 nt, Staphylococcus aureus subsp. aureus N315
auauccuguuucaua

SEQ ID NO: 4056414 - RNA, 17 nt, Staphylococcus aureus subsp. aureus N315
auauccuucaaagauuu

SEQ ID NO: 4056415 - RNA, 16 nt, Staphylococcus aureus subsp. aureus N315
auaucgacaccauuua

SEQ ID NO: 4056416 - RNA, 14 nt, Staphylococcus aureus subsp. aureus N315
auaucgauaaaugu

SEQ ID NO: 4056417 - RNA, 17 nt, Staphylococcus aureus subsp. aureus N315
auaucgcgcaucaaaaa

SEQ ID NO: 4056418 - RNA, 17 nt, Staphylococcus aureus subsp. aureus N315
auaucgcuuuugaaguu

SEQ ID NO: 4056419 - RNA, 16 nt, Staphylococcus aureus subsp. aureus N315
auaucuaaugcaacuu

SEQ ID NO: 4056420 - RNA, 18 nt, Staphylococcus aureus subsp. aureus N315
auaucuaauucguaauuu

SEQ ID NO: 4056421 - RNA, 17 nt, Staphylococcus aureus subsp. aureus N315
auaucuauuuaucauac

SEQ ID NO: 4056422 - RNA, 14 nt, Staphylococcus aureus subsp. aureus N315
auaucuauuuuucg

SEQ ID NO: 4056423 - RNA, 14 nt, Staphylococcus aureus subsp. aureus N315
auaucucaaagauu

SEQ ID NO: 4056424 - RNA, 15 nt, Staphylococcus aureus subsp. aureus N315
auaucucaagauauc

SEQ ID NO: 4056425 - RNA, 20 nt, Staphylococcus aureus subsp. aureus N315
auaucucaagauauccauua

SEQ ID NO: 4056426 - RNA, 18 nt, Staphylococcus aureus subsp. aureus N315
auaucuuaaguacauaaa

SEQ ID NO: 4056427 - RNA, 23 nt, Staphylococcus aureus subsp. aureus N315
auaucuuaaucuaaaaauagaug

SEQ ID NO: 4056428 - RNA, 12 nt, Staphylococcus aureus subsp. aureus N315
auaucuuauaac

SEQ ID NO: 4056429 - RNA, 17 nt, Staphylococcus aureus subsp. aureus N315
auaucuucauuuaaaag

SEQ ID NO: 4056430 - RNA, 17 nt, Staphylococcus aureus subsp. aureus N315
auaucuugcuuggauaa

SEQ ID NO: 4056431 - RNA, 18 nt, Staphylococcus aureus subsp. aureus N315
auaucuuuaucauuauuc

SEQ ID NO: 4056432 - RNA, 12 nt, Staphylococcus aureus subsp. aureus N315
auaucuuucaau

SEQ ID NO: 4056433 - RNA, 14 nt, Staphylococcus aureus subsp. aureus N315
auaucuuuguugca

SEQ ID NO: 4056434 - RNA, 14 nt, Staphylococcus aureus subsp. aureus N315
auaucuuuuccaaa

SEQ ID NO: 4056435 - RNA, 17 nt, Staphylococcus aureus subsp. aureus N315
auaucuuuuccaaaaca

SEQ ID NO: 4056436 - RNA, 14 nt, Staphylococcus aureus subsp. aureus N315
auaugaaaagagaa

SEQ ID NO: 4056437 - RNA, 11 nt, Staphylococcus aureus subsp. aureus N315
auaugaaaugu

SEQ ID NO: 4056438 - RNA, 13 nt, Staphylococcus aureus subsp. aureus N315
auaugaacaaaaa

SEQ ID NO: 4056439 - RNA, 21 nt, Staphylococcus aureus subsp. aureus N315
auaugaagcguuuuuauuaca

SEQ ID NO: 4056440 - RNA, 17 nt, Staphylococcus aureus subsp. aureus N315
auaugaaucuagaauau

SEQ ID NO: 4056441 - RNA, 20 nt, Staphylococcus aureus subsp. aureus N315
auaugaaucuagaauauaac

SEQ ID NO: 4056442 - RNA, 13 nt, Staphylococcus aureus subsp. aureus N315
auaugaauuggau

SEQ ID NO: 4056443 - RNA, 20 nt, Staphylococcus aureus subsp. aureus N315
auaugaauuuagaugcauaa

SEQ ID NO: 4056444 - RNA, 23 nt, Staphylococcus aureus subsp. aureus N315
auaugaauuuagaugcauaaaaa

SEQ ID NO: 4056445 - RNA, 13 nt, Staphylococcus aureus subsp. aureus N315
auaugaauuuuau

SEQ ID NO: 4056446 - RNA, 16 nt, Staphylococcus aureus subsp. aureus N315
auaugacacauacacc

SEQ ID NO: 4056447 - RNA, 17 nt, Staphylococcus aureus subsp. aureus N315
auaugacgcgugaauua

SEQ ID NO: 4056448 - RNA, 23 nt, Staphylococcus aureus subsp. aureus N315
auaugacgcgugaauuaaaaaau

SEQ ID NO: 4056449 - RNA, 16 nt, Staphylococcus aureus subsp. aureus N315
auaugagguucaguag

SEQ ID NO: 4056450 - RNA, 17 nt, Staphylococcus aureus subsp. aureus N315
auaugaguuacaugguu

SEQ ID NO: 4056451 - RNA, 13 nt, Staphylococcus aureus subsp. aureus N315
auaugauaaauau

SEQ ID NO: 4056452 - RNA, 20 nt, Staphylococcus aureus subsp. aureus N315
auaugauaaccaaaccauaa

SEQ ID NO: 4056453 - RNA, 17 nt, Staphylococcus aureus subsp. aureus N315
auaugauguuaaaaaau

SEQ ID NO: 4056454 - RNA, 16 nt, Staphylococcus aureus subsp. aureus N315
auaugauuaaagcgau

SEQ ID NO: 4056455 - RNA, 20 nt, Staphylococcus aureus subsp. aureus N315
auaugauuacaacuuauucu

SEQ ID NO: 4056456 - RNA, 18 nt, Staphylococcus aureus subsp. aureus N315
auaugauugcaaauuauc

SEQ ID NO: 4056457 - RNA, 13 nt, Staphylococcus aureus subsp. aureus N315
auaugauugguuu

SEQ ID NO: 4056458 - RNA, 17 nt, Staphylococcus aureus subsp. aureus N315
auaugcaacuuauaaua

SEQ ID NO: 4056459 - RNA, 12 nt, Staphylococcus aureus subsp. aureus N315
auaugcauauau

SEQ ID NO: 4056460 - RNA, 16 nt, Staphylococcus aureus subsp. aureus N315
auaugcaucaacagau

SEQ ID NO: 4056461 - RNA, 22 nt, Staphylococcus aureus subsp. aureus N315
auaugccgauugcucuaaucca

SEQ ID NO: 4056462 - RNA, 23 nt, Staphylococcus aureus subsp. aureus N315
auaugcuuguugugaauaaaauu

SEQ ID NO: 4056463 - RNA, 22 nt, Staphylococcus aureus subsp. aureus N315
auaugcuuuaggugaguuucca

SEQ ID NO: 4056464 - RNA, 15 nt, Staphylococcus aureus subsp. aureus N315
auauggaaaauguau

SEQ ID NO: 4056465 - RNA, 14 nt, Staphylococcus aureus subsp. aureus N315
auauggauuuugaa

SEQ ID NO: 4056466 - RNA, 21 nt, Staphylococcus aureus subsp. aureus N315
auaugguuagagaaaaaucug

SEQ ID NO: 4056467 - RNA, 15 nt, Staphylococcus aureus subsp. aureus N315
auauguacuauuauc

SEQ ID NO: 4056468 - RNA, 19 nt, Staphylococcus aureus subsp. aureus N315
auauguauaacauuauuaa

SEQ ID NO: 4056469 - RNA, 22 nt, Staphylococcus aureus subsp. aureus N315
auaugucucucuuucuuauuca

SEQ ID NO: 4056470 - RNA, 16 nt, Staphylococcus aureus subsp. aureus N315
auauguguuaacugau

SEQ ID NO: 4056471 - RNA, 17 nt, Staphylococcus aureus subsp. aureus N315
auauguguuucuagcuu

SEQ ID NO: 4056472 - RNA, 22 nt, Staphylococcus aureus subsp. aureus N315
auauguuuuauaauaaauguca

SEQ ID NO: 4056473 - RNA, 15 nt, Staphylococcus aureus subsp. aureus N315
auauuaaaacaauga

SEQ ID NO: 4056474 - RNA, 16 nt, Staphylococcus aureus subsp. aureus N315
auauuaaaguaaaaua

SEQ ID NO: 4056475 - RNA, 18 nt, Staphylococcus aureus subsp. aureus N315
auauuaaauuauggagcg

SEQ ID NO: 4056476 - RNA, 15 nt, Staphylococcus aureus subsp. aureus N315
auauuaacaccagau

SEQ ID NO: 4056477 - RNA, 15 nt, Staphylococcus aureus subsp. aureus N315
auauuaagauguaua

SEQ ID NO: 4056478 - RNA, 18 nt, Staphylococcus aureus subsp. aureus N315
auauuaauaaucuucugu

SEQ ID NO: 4056479 - RNA, 17 nt, Staphylococcus aureus subsp. aureus N315
auauuaauauaaaauaa

SEQ ID NO: 4056480 - RNA, 17 nt, Staphylococcus aureus subsp. aureus N315
auauuaaucauaaugaa

SEQ ID NO: 4056481 - RNA, 19 nt, Staphylococcus aureus subsp. aureus N315
auauuaaugaauauaggca

SEQ ID NO: 4056482 - RNA, 22 nt, Staphylococcus aureus subsp. aureus N315
auauuaaugaauauaggcacau

SEQ ID NO: 4056483 - RNA, 14 nt, Staphylococcus aureus subsp. aureus N315
auauuaauugaaaa

SEQ ID NO: 4056484 - RNA, 14 nt, Staphylococcus aureus subsp. aureus N315
auauuacaccauug

SEQ ID NO: 4056485 - RNA, 22 nt, Staphylococcus aureus subsp. aureus N315
auauuacuaaccuauuaaaaua

SEQ ID NO: 4056486 - RNA, 23 nt, Staphylococcus aureus subsp. aureus N315
auauuacuaaccuauuaaaauaa

SEQ ID NO: 4056487 - RNA, 21 nt, Staphylococcus aureus subsp. aureus N315
auauuacucaaaauuaaagcu

SEQ ID NO: 4056488 - RNA, 19 nt, Staphylococcus aureus subsp. aureus N315
auauuacuuuggaaauuua

SEQ ID NO: 4056489 - RNA, 21 nt, Staphylococcus aureus subsp. aureus N315
auauuacuuuggaaauuuauu

SEQ ID NO: 4056490 - RNA, 14 nt, Staphylococcus aureus subsp. aureus N315
auauuagaacauuu

SEQ ID NO: 4056491 - RNA, 19 nt, Staphylococcus aureus subsp. aureus N315
auauuagauaucuuaaucu

SEQ ID NO: 4056492 - RNA, 17 nt, Staphylococcus aureus subsp. aureus N315
auauuaggcuuaaauau

SEQ ID NO: 4056493 - RNA, 13 nt, Staphylococcus aureus subsp. aureus N315
auauuagugacau

SEQ ID NO: 4056494 - RNA, 23 nt, Staphylococcus aureus subsp. aureus N315
auauuauaacccucguaggcaua

SEQ ID NO: 4056495 - RNA, 12 nt, Staphylococcus aureus subsp. aureus N315
auauuauauaua

SEQ ID NO: 4056496 - RNA, 15 nt, Staphylococcus aureus subsp. aureus N315
auauuauauauauuc

SEQ ID NO: 4056497 - RNA, 16 nt, Staphylococcus aureus subsp. aureus N315
auauuauauuuugaau

SEQ ID NO: 4056498 - RNA, 18 nt, Staphylococcus aureus subsp. aureus N315
auauuaugccauucauua

SEQ ID NO: 4056499 - RNA, 13 nt, Staphylococcus aureus subsp. aureus N315
auauuauguuagu

SEQ ID NO: 4056500 - RNA, 13 nt, Staphylococcus aureus subsp. aureus N315
auauuauuucaau

SEQ ID NO: 4056501 - RNA, 12 nt, Staphylococcus aureus subsp. aureus N315
auauuauuuuua

SEQ ID NO: 4056502 - RNA, 16 nt, Staphylococcus aureus subsp. aureus N315
auauucaaauuuacca

SEQ ID NO: 4056503 - RNA, 16 nt, Staphylococcus aureus subsp. aureus N315
auauucaauaauuauu

SEQ ID NO: 4056504 - RNA, 17 nt, Staphylococcus aureus subsp. aureus N315
auauucaauaauuauua

SEQ ID NO: 4056505 - RNA, 12 nt, Staphylococcus aureus subsp. aureus N315
auauucaaugaa

SEQ ID NO: 4056506 - RNA, 13 nt, Staphylococcus aureus subsp. aureus N315
auauucaaugaau

SEQ ID NO: 4056507 - RNA, 14 nt, Staphylococcus aureus subsp. aureus N315
auauucaaugaauu

SEQ ID NO: 4056508 - RNA, 21 nt, Staphylococcus aureus subsp. aureus N315
auauucaccuacaacaccaau

SEQ ID NO: 4056509 - RNA, 16 nt, Staphylococcus aureus subsp. aureus N315
auauucaguauaugua

SEQ ID NO: 4056510 - RNA, 22 nt, Staphylococcus aureus subsp. aureus N315
auauucauguucuuguaauccu

SEQ ID NO: 4056511 - RNA, 19 nt, Staphylococcus aureus subsp. aureus N315
auauucauuaguuuuacca

SEQ ID NO: 4056512 - RNA, 20 nt, Staphylococcus aureus subsp. aureus N315
auauuccacgcucacauuaa

SEQ ID NO: 4056513 - RNA, 22 nt, Staphylococcus aureus subsp. aureus N315
auauuccuuacuaaguaaccaa

SEQ ID NO: 4056514 - RNA, 20 nt, Staphylococcus aureus subsp. aureus N315
auauucgauacauaaaacau

SEQ ID NO: 4056515 - RNA, 23 nt, Staphylococcus aureus subsp. aureus N315
auauucgcgaacguuauuuucaa

SEQ ID NO: 4056516 - RNA, 23 nt, Staphylococcus aureus subsp. aureus N315
auauucgcuaauguaccaaucaa

SEQ ID NO: 4056517 - RNA, 15 nt, Staphylococcus aureus subsp. aureus N315
auauucgcuuaaaaa

SEQ ID NO: 4056518 - RNA, 20 nt, Staphylococcus aureus subsp. aureus N315
auauucguagcaugacauua

SEQ ID NO: 4056519 - RNA, 17 nt, Staphylococcus aureus subsp. aureus N315
auauucguuacaaauga

SEQ ID NO: 4056520 - RNA, 13 nt, Staphylococcus aureus subsp. aureus N315
auauucuaaaaaa

SEQ ID NO: 4056521 - RNA, 14 nt, Staphylococcus aureus subsp. aureus N315
auauucuaaaaaau

SEQ ID NO: 4056522 - RNA, 21 nt, Staphylococcus aureus subsp. aureus N315
auauucuaaaaaauuaaaaau

SEQ ID NO: 4056523 - RNA, 18 nt, Staphylococcus aureus subsp. aureus N315
auauucuacaugaaucaa

SEQ ID NO: 4056524 - RNA, 22 nt, Staphylococcus aureus subsp. aureus N315
auauucuccaacucuaacagcu

SEQ ID NO: 4056525 - RNA, 22 nt, Staphylococcus aureus subsp. aureus N315
auauucucugcuucuaaaacau

SEQ ID NO: 4056526 - RNA, 11 nt, Staphylococcus aureus subsp. aureus N315
auauucuuuuu

SEQ ID NO: 4056527 - RNA, 14 nt, Staphylococcus aureus subsp. aureus N315
auauucuuuuuaac

SEQ ID NO: 4056528 - RNA, 14 nt, Staphylococcus aureus subsp. aureus N315
auauugaaaacacg

SEQ ID NO: 4056529 - RNA, 17 nt, Staphylococcus aureus subsp. aureus N315
auauugaaaacacguau

SEQ ID NO: 4056530 - RNA, 22 nt, Staphylococcus aureus subsp. aureus N315
auauugaaaugagcuuaaguua

SEQ ID NO: 4056531 - RNA, 18 nt, Staphylococcus aureus subsp. aureus N315
auauugaacaauucuuca

SEQ ID NO: 4056532 - RNA, 20 nt, Staphylococcus aureus subsp. aureus N315
auauugaauauaaaaaacac

SEQ ID NO: 4056533 - RNA, 21 nt, Staphylococcus aureus subsp. aureus N315
auauugaauauaaaaaacacg

SEQ ID NO: 4056534 - RNA, 16 nt, Staphylococcus aureus subsp. aureus N315
auauugagaauauuaa

SEQ ID NO: 4056535 - RNA, 11 nt, Staphylococcus aureus subsp. aureus N315
auauugauagc

SEQ ID NO: 4056536 - RNA, 16 nt, Staphylococcus aureus subsp. aureus N315
auauugcaaaaauaau

SEQ ID NO: 4056537 - RNA, 22 nt, Staphylococcus aureus subsp. aureus N315
auauugcaaaaauaauaugaau

SEQ ID NO: 4056538 - RNA, 16 nt, Staphylococcus aureus subsp. aureus N315
auauugcgaaaaauaa

SEQ ID NO: 4056539 - RNA, 14 nt, Staphylococcus aureus subsp. aureus N315
auauugcguuuaau

SEQ ID NO: 4056540 - RNA, 18 nt, Staphylococcus aureus subsp. aureus N315
auauugcguuuaauuuac

SEQ ID NO: 4056541 - RNA, 16 nt, Staphylococcus aureus subsp. aureus N315
auauuggacuuugcug

SEQ ID NO: 4056542 - RNA, 22 nt, Staphylococcus aureus subsp. aureus N315
auauuggcaguguuugacugaa

SEQ ID NO: 4056543 - RNA, 12 nt, Staphylococcus aureus subsp. aureus N315
auauugggacuu

SEQ ID NO: 4056544 - RNA, 15 nt, Staphylococcus aureus subsp. aureus N315
auauuguaaucacua

SEQ ID NO: 4056545 - RNA, 19 nt, Staphylococcus aureus subsp. aureus N315
auauuguagggaguauugu

SEQ ID NO: 4056546 - RNA, 17 nt, Staphylococcus aureus subsp. aureus N315
auauugucgacuuuuag

SEQ ID NO: 4056547 - RNA, 13 nt, Staphylococcus aureus subsp. aureus N315
auauuguuaauuc

SEQ ID NO: 4056548 - RNA, 12 nt, Staphylococcus aureus subsp. aureus N315
auauuuaaacua

SEQ ID NO: 4056549 - RNA, 12 nt, Staphylococcus aureus subsp. aureus N315
auauuuaaacuc

SEQ ID NO: 4056550 - RNA, 14 nt, Staphylococcus aureus subsp. aureus N315
auauuuaaaugucu

SEQ ID NO: 4056551 - RNA, 19 nt, Staphylococcus aureus subsp. aureus N315
auauuuaaaugucuuucaa

SEQ ID NO: 4056552 - RNA, 19 nt, Staphylococcus aureus subsp. aureus N315
auauuuaacaucaauuacu

SEQ ID NO: 4056553 - RNA, 12 nt, Staphylococcus aureus subsp. aureus N315
auauuuaacauu

SEQ ID NO: 4056554 - RNA, 13 nt, Staphylococcus aureus subsp. aureus N315
auauuuacacaga

SEQ ID NO: 4056555 - RNA, 21 nt, Staphylococcus aureus subsp. aureus N315
auauuuacacagaaugauaua

SEQ ID NO: 4056556 - RNA, 15 nt, Staphylococcus aureus subsp. aureus N315
auauuuaccacaaau

SEQ ID NO: 4056557 - RNA, 18 nt, Staphylococcus aureus subsp. aureus N315
auauuuagaauaagaaau

SEQ ID NO: 4056558 - RNA, 20 nt, Staphylococcus aureus subsp. aureus N315
auauuuagauuggucaaacu

SEQ ID NO: 4056559 - RNA, 22 nt, Staphylococcus aureus subsp. aureus N315
auauuuauuguuuuuaaaaucu

SEQ ID NO: 4056560 - RNA, 14 nt, Staphylococcus aureus subsp. aureus N315
auauuuauuuuuga

SEQ ID NO: 4056561 - RNA, 20 nt, Staphylococcus aureus subsp. aureus N315
auauuuccaaauugaaauua

SEQ ID NO: 4056562 - RNA, 17 nt, Staphylococcus aureus subsp. aureus N315
auauuucccuaugaaau

SEQ ID NO: 4056563 - RNA, 20 nt, Staphylococcus aureus subsp. aureus N315
auauuucgguauuuuaaauu

SEQ ID NO: 4056564 - RNA, 22 nt, Staphylococcus aureus subsp. aureus N315
auauuucgguuagucuuaaucc

SEQ ID NO: 4056565 - RNA, 21 nt, Staphylococcus aureus subsp. aureus N315
auauuucuauuccuucuaaca

SEQ ID NO: 4056566 - RNA, 21 nt, Staphylococcus aureus subsp. aureus N315
auauuucugggcuuucuuuuu

SEQ ID NO: 4056567 - RNA, 13 nt, Staphylococcus aureus subsp. aureus N315
auauuucuuacca

SEQ ID NO: 4056568 - RNA, 15 nt, Staphylococcus aureus subsp. aureus N315
auauuucuuaccauu

SEQ ID NO: 4056569 - RNA, 16 nt, Staphylococcus aureus subsp. aureus N315
auauuugaaaauuuca

SEQ ID NO: 4056570 - RNA, 18 nt, Staphylococcus aureus subsp. aureus N315
auauuugaaaauuucacc

SEQ ID NO: 4056571 - RNA, 16 nt, Staphylococcus aureus subsp. aureus N315
auauuuguauaugcaa

SEQ ID NO: 4056572 - RNA, 12 nt, Staphylococcus aureus subsp. aureus N315
auauuuuaaaaa

SEQ ID NO: 4056573 - RNA, 12 nt, Staphylococcus aureus subsp. aureus N315
auauuuuaaacg

SEQ ID NO: 4056574 - RNA, 20 nt, Staphylococcus aureus subsp. aureus N315
auauuuuauuagaauauuca

SEQ ID NO: 4056575 - RNA, 14 nt, Staphylococcus aureus subsp. aureus N315
auauuuuauuuaaa

SEQ ID NO: 4056576 - RNA, 18 nt, Staphylococcus aureus subsp. aureus N315
auauuuuauuuaaaaaua

SEQ ID NO: 4056577 - RNA, 22 nt, Staphylococcus aureus subsp. aureus N315
auauuuuauuuaaaaauagccu

SEQ ID NO: 4056578 - RNA, 14 nt, Staphylococcus aureus subsp. aureus N315
auauuuucugcgau

SEQ ID NO: 4056579 - RNA, 23 nt, Staphylococcus aureus subsp. aureus N315
auauuuucugcgauauagcuuug

SEQ ID NO: 4056580 - RNA, 11 nt, Staphylococcus aureus subsp. aureus N315
auauuuucuua

SEQ ID NO: 4056581 - RNA, 11 nt, Staphylococcus aureus subsp. aureus N315
auauuuucuuc

SEQ ID NO: 4056582 - RNA, 13 nt, Staphylococcus aureus subsp. aureus N315
auauuuuguuaau

SEQ ID NO: 4056583 - RNA, 16 nt, Staphylococcus aureus subsp. aureus N315
auauuuuuacauauuu

SEQ ID NO: 4056584 - RNA, 13 nt, Staphylococcus aureus subsp. aureus N315
auauuuuuagaaa

SEQ ID NO: 4056585 - RNA, 17 nt, Staphylococcus aureus subsp. aureus N315
auauuuuuaucaucuuc

SEQ ID NO: 4056586 - RNA, 20 nt, Staphylococcus aureus subsp. aureus N315
auauuuuuguauuuauguuu

SEQ ID NO: 4056587 - RNA, 12 nt, Staphylococcus aureus subsp. aureus N315
auauuuuuuaau

SEQ ID NO: 4056588 - RNA, 14 nt, Staphylococcus aureus subsp. aureus N315
auauuuuuucugug

SEQ ID NO: 4056589 - RNA, 13 nt, Staphylococcus aureus subsp. aureus N315
aucaaaaauaaaa

SEQ ID NO: 4056590 - RNA, 14 nt, Staphylococcus aureus subsp. aureus N315
aucaaaaauaaaaa

SEQ ID NO: 4056591 - RNA, 20 nt, Staphylococcus aureus subsp. aureus N315
aucaaaaccgcuauaaaauu

SEQ ID NO: 4056592 - RNA, 12 nt, Staphylococcus aureus subsp. aureus N315
aucaaaaguuug

SEQ ID NO: 4056593 - RNA, 12 nt, Staphylococcus aureus subsp. aureus N315
aucaaaauauaa

SEQ ID NO: 4056594 - RNA, 15 nt, Staphylococcus aureus subsp. aureus N315
aucaaacaacaucac

SEQ ID NO: 4056595 - RNA, 18 nt, Staphylococcus aureus subsp. aureus N315
aucaaacuuggcaaugaa

SEQ ID NO: 4056596 - RNA, 22 nt, Staphylococcus aureus subsp. aureus N315
aucaaagaaaaagugauaauua

SEQ ID NO: 4056597 - RNA, 23 nt, Staphylococcus aureus subsp. aureus N315
aucaaagaaaaagugauaauuaa

SEQ ID NO: 4056598 - RNA, 14 nt, Staphylococcus aureus subsp. aureus N315
aucaaagaggaaca

SEQ ID NO: 4056599 - RNA, 14 nt, Staphylococcus aureus subsp. aureus N315
aucaaagaggcaca

SEQ ID NO: 4056600 - RNA, 20 nt, Staphylococcus aureus subsp. aureus N315
aucaaagaggcacagcggaa

SEQ ID NO: 4056601 - RNA, 18 nt, Staphylococcus aureus subsp. aureus N315
aucaaagaggcuuuaaaa

SEQ ID NO: 4056602 - RNA, 18 nt, Staphylococcus aureus subsp. aureus N315
aucaaagauuuuguugaa

SEQ ID NO: 4056603 - RNA, 19 nt, Staphylococcus aureus subsp. aureus N315
aucaaaguacuaacguuuu

SEQ ID NO: 4056604 - RNA, 21 nt, Staphylococcus aureus subsp. aureus N315
aucaaaguacuaacguuuuaa

SEQ ID NO: 4056605 - RNA, 14 nt, Staphylococcus aureus subsp. aureus N315
aucaaaguaucagu

SEQ ID NO: 4056606 - RNA, 21 nt, Staphylococcus aureus subsp. aureus N315
aucaaagucuucuucaacaau

SEQ ID NO: 4056607 - RNA, 18 nt, Staphylococcus aureus subsp. aureus N315
aucaaauacauuucaaaa

SEQ ID NO: 4056608 - RNA, 18 nt, Staphylococcus aureus subsp. aureus N315
aucaaauagacaccaaaa

SEQ ID NO: 4056609 - RNA, 14 nt, Staphylococcus aureus subsp. aureus N315
aucaaauauuugga

SEQ ID NO: 4056610 - RNA, 16 nt, Staphylococcus aureus subsp. aureus N315
aucaaauuuaauaaua

SEQ ID NO: 4056611 - RNA, 14 nt, Staphylococcus aureus subsp. aureus N315
aucaacaaauuuaa

SEQ ID NO: 4056612 - RNA, 17 nt, Staphylococcus aureus subsp. aureus N315
aucaacaaauuuaacuu

SEQ ID NO: 4056613 - RNA, 13 nt, Staphylococcus aureus subsp. aureus N315
aucaacaauuuaa

SEQ ID NO: 4056614 - RNA, 12 nt, Staphylococcus aureus subsp. aureus N315
aucaacacacac

SEQ ID NO: 4056615 - RNA, 14 nt, Staphylococcus aureus subsp. aureus N315
aucaacacacacag

SEQ ID NO: 4056616 - RNA, 23 nt, Staphylococcus aureus subsp. aureus N315
aucaacacacacaguuuauaaua

SEQ ID NO: 4056617 - RNA, 17 nt, Staphylococcus aureus subsp. aureus N315
aucaacauaaaauuuaa

SEQ ID NO: 4056618 - RNA, 23 nt, Staphylococcus aureus subsp. aureus N315
aucaacauauuuaucucuuucuu

SEQ ID NO: 4056619 - RNA, 22 nt, Staphylococcus aureus subsp. aureus N315
aucaaccuguucuuuauuuaaa

SEQ ID NO: 4056620 - RNA, 20 nt, Staphylococcus aureus subsp. aureus N315
aucaaccuuugcuaaaucaa

SEQ ID NO: 4056621 - RNA, 20 nt, Staphylococcus aureus subsp. aureus N315
aucaacgagucauaaauaua

SEQ ID NO: 4056622 - RNA, 19 nt, Staphylococcus aureus subsp. aureus N315
aucaacgauugaauuguag

SEQ ID NO: 4056623 - RNA, 17 nt, Staphylococcus aureus subsp. aureus N315
aucaacgccauauuuau

SEQ ID NO: 4056624 - RNA, 21 nt, Staphylococcus aureus subsp. aureus N315
aucaacugaaauuuuuccgau

SEQ ID NO: 4056625 - RNA, 17 nt, Staphylococcus aureus subsp. aureus N315
aucaacugcuucacgau

SEQ ID NO: 4056626 - RNA, 13 nt, Staphylococcus aureus subsp. aureus N315
aucaacuuuucua

SEQ ID NO: 4056627 - RNA, 13 nt, Staphylococcus aureus subsp. aureus N315
aucaagaaauguu

SEQ ID NO: 4056628 - RNA, 14 nt, Staphylococcus aureus subsp. aureus N315
aucaagaaauguua

SEQ ID NO: 4056629 - RNA, 22 nt, Staphylococcus aureus subsp. aureus N315
aucaagacucccuuuuuaaaau

SEQ ID NO: 4056630 - RNA, 23 nt, Staphylococcus aureus subsp. aureus N315
aucaagacucccuuuuuaaaaua

SEQ ID NO: 4056631 - RNA, 16 nt, Staphylococcus aureus subsp. aureus N315
aucaagcuagcaucau

SEQ ID NO: 4056632 - RNA, 18 nt, Staphylococcus aureus subsp. aureus N315
aucaagcugagcuuuaau

SEQ ID NO: 4056633 - RNA, 17 nt, Staphylococcus aureus subsp. aureus N315
aucaaguaguuaucuaa

SEQ ID NO: 4056634 - RNA, 16 nt, Staphylococcus aureus subsp. aureus N315
aucaaguauaaauguu

SEQ ID NO: 4056635 - RNA, 18 nt, Staphylococcus aureus subsp. aureus N315
aucaagucugcauuaauu

SEQ ID NO: 4056636 - RNA, 23 nt, Staphylococcus aureus subsp. aureus N315
aucaagugcagauguugguucau

SEQ ID NO: 4056637 - RNA, 20 nt, Staphylococcus aureus subsp. aureus N315
aucaaguuuacgaucauaaa

SEQ ID NO: 4056638 - RNA, 21 nt, Staphylococcus aureus subsp. aureus N315
aucaauaccauaauuaaauaa

SEQ ID NO: 4056639 - RNA, 20 nt, Staphylococcus aureus subsp. aureus N315
aucaauagaugaaaauuuaa

SEQ ID NO: 4056640 - RNA, 14 nt, Staphylococcus aureus subsp. aureus N315
aucaauaguuuaua

SEQ ID NO: 4056641 - RNA, 21 nt, Staphylococcus aureus subsp. aureus N315
aucaauaguuuauaaauuaau

SEQ ID NO: 4056642 - RNA, 13 nt, Staphylococcus aureus subsp. aureus N315
aucaauauaaccg

SEQ ID NO: 4056643 - RNA, 15 nt, Staphylococcus aureus subsp. aureus N315
aucaauauaauuugg

SEQ ID NO: 4056644 - RNA, 19 nt, Staphylococcus aureus subsp. aureus N315
aucaauaugaccuuuaugu

SEQ ID NO: 4056645 - RNA, 12 nt, Staphylococcus aureus subsp. aureus N315
aucaauccauca

SEQ ID NO: 4056646 - RNA, 17 nt, Staphylococcus aureus subsp. aureus N315
aucaaucgcuuuagcaa

SEQ ID NO: 4056647 - RNA, 22 nt, Staphylococcus aureus subsp. aureus N315
aucaaucgcuuuagcaauugaa

SEQ ID NO: 4056648 - RNA, 20 nt, Staphylococcus aureus subsp. aureus N315
aucaaucguuaauuuccaau

SEQ ID NO: 4056649 - RNA, 17 nt, Staphylococcus aureus subsp. aureus N315
aucaaugacuguugguu

SEQ ID NO: 4056650 - RNA, 15 nt, Staphylococcus aureus subsp. aureus N315
aucaaugguugaugu

SEQ ID NO: 4056651 - RNA, 12 nt, Staphylococcus aureus subsp. aureus N315
aucaauuaaacu

SEQ ID NO: 4056652 - RNA, 19 nt, Staphylococcus aureus subsp. aureus N315
aucaauuacucuuuuucuu

SEQ ID NO: 4056653 - RNA, 13 nt, Staphylococcus aureus subsp. aureus N315
aucaauuagccaa

SEQ ID NO: 4056654 - RNA, 22 nt, Staphylococcus aureus subsp. aureus N315
aucaauucgcgucauuuguuca

SEQ ID NO: 4056655 - RNA, 16 nt, Staphylococcus aureus subsp. aureus N315
aucaauuuauuauuaa

SEQ ID NO: 4056656 - RNA, 22 nt, Staphylococcus aureus subsp. aureus N315
aucacacgacauguagguaauu

SEQ ID NO: 4056657 - RNA, 20 nt, Staphylococcus aureus subsp. aureus N315
aucacacgcauacaggaaau

SEQ ID NO: 4056658 - RNA, 17 nt, Staphylococcus aureus subsp. aureus N315
aucacagcaauaauaau

SEQ ID NO: 4056659 - RNA, 18 nt, Staphylococcus aureus subsp. aureus N315
aucacaguacacuaaguu

SEQ ID NO: 4056660 - RNA, 16 nt, Staphylococcus aureus subsp. aureus N315
aucacauaaaauacau

SEQ ID NO: 4056661 - RNA, 23 nt, Staphylococcus aureus subsp. aureus N315
aucaccaauggcagaugauuaug

SEQ ID NO: 4056662 - RNA, 22 nt, Staphylococcus aureus subsp. aureus N315
aucaccuuauugaugaaaacaa

SEQ ID NO: 4056663 - RNA, 17 nt, Staphylococcus aureus subsp. aureus N315
aucaccuuuuuuaacuu

SEQ ID NO: 4056664 - RNA, 14 nt, Staphylococcus aureus subsp. aureus N315
aucacgauauguug

SEQ ID NO: 4056665 - RNA, 13 nt, Staphylococcus aureus subsp. aureus N315
aucacuaaaguaa

SEQ ID NO: 4056666 - RNA, 16 nt, Staphylococcus aureus subsp. aureus N315
aucacucaacauauua

SEQ ID NO: 4056667 - RNA, 14 nt, Staphylococcus aureus subsp. aureus N315
aucacuccucuauu

SEQ ID NO: 4056668 - RNA, 21 nt, Staphylococcus aureus subsp. aureus N315
aucacugaaugcuaauacuaa

SEQ ID NO: 4056669 - RNA, 21 nt, Staphylococcus aureus subsp. aureus N315
aucacugcauauaaagucaua

SEQ ID NO: 4056670 - RNA, 22 nt, Staphylococcus aureus subsp. aureus N315
aucacuugcuguugcaauaaaa

SEQ ID NO: 4056671 - RNA, 17 nt, Staphylococcus aureus subsp. aureus N315
aucacuugguaaaacau

SEQ ID NO: 4056672 - RNA, 21 nt, Staphylococcus aureus subsp. aureus N315
aucacuuuaggguucauugcu

SEQ ID NO: 4056673 - RNA, 12 nt, Staphylococcus aureus subsp. aureus N315
aucagacuaaaa

SEQ ID NO: 4056674 - RNA, 22 nt, Staphylococcus aureus subsp. aureus N315
aucagcauuaaucguauuuuua

SEQ ID NO: 4056675 - RNA, 16 nt, Staphylococcus aureus subsp. aureus N315
aucagcuauaaaagua

SEQ ID NO: 4056676 - RNA, 17 nt, Staphylococcus aureus subsp. aureus N315
aucagcuauaaaaguac

SEQ ID NO: 4056677 - RNA, 14 nt, Staphylococcus aureus subsp. aureus N315
aucagcucuuaaau

SEQ ID NO: 4056678 - RNA, 15 nt, Staphylococcus aureus subsp. aureus N315
aucaggaccaaauag

SEQ ID NO: 4056679 - RNA, 15 nt, Staphylococcus aureus subsp. aureus N315
aucagggaaaucauc

SEQ ID NO: 4056680 - RNA, 17 nt, Staphylococcus aureus subsp. aureus N315
aucagguccaauucucu

SEQ ID NO: 4056681 - RNA, 13 nt, Staphylococcus aureus subsp. aureus N315
aucaguaauaaua

SEQ ID NO: 4056682 - RNA, 16 nt, Staphylococcus aureus subsp. aureus N315
aucaguaccaaagaaa

SEQ ID NO: 4056683 - RNA, 23 nt, Staphylococcus aureus subsp. aureus N315
aucaguaccaaagaaaucaccag

SEQ ID NO: 4056684 - RNA, 20 nt, Staphylococcus aureus subsp. aureus N315
aucaguauaaucagcaaugu

SEQ ID NO: 4056685 - RNA, 17 nt, Staphylococcus aureus subsp. aureus N315
aucaguauuuacuuuuc

SEQ ID NO: 4056686 - RNA, 18 nt, Staphylococcus aureus subsp. aureus N315
aucagucauucacauaca

SEQ ID NO: 4056687 - RNA, 17 nt, Staphylococcus aureus subsp. aureus N315
aucagugugauuuugga

SEQ ID NO: 4056688 - RNA, 19 nt, Staphylococcus aureus subsp. aureus N315
aucagugugauuuuggaac

SEQ ID NO: 4056689 - RNA, 21 nt, Staphylococcus aureus subsp. aureus N315
aucaguuacugcgcuuuuaau

SEQ ID NO: 4056690 - RNA, 12 nt, Staphylococcus aureus subsp. aureus N315
aucaguuauuuu

SEQ ID NO: 4056691 - RNA, 20 nt, Staphylococcus aureus subsp. aureus N315
aucaguugagugauuuuaau

SEQ ID NO: 4056692 - RNA, 21 nt, Staphylococcus aureus subsp. aureus N315
aucaguuucaucaaguauaaa

SEQ ID NO: 4056693 - RNA, 13 nt, Staphylococcus aureus subsp. aureus N315
aucaguuuuuaaa

SEQ ID NO: 4056694 - RNA, 14 nt, Staphylococcus aureus subsp. aureus N315
aucaguuuuugaau

SEQ ID NO: 4056695 - RNA, 17 nt, Staphylococcus aureus subsp. aureus N315
aucaguuuuugaauauu

SEQ ID NO: 4056696 - RNA, 19 nt, Staphylococcus aureus subsp. aureus N315
aucaguuuuugaauauuug

SEQ ID NO: 4056697 - RNA, 17 nt, Staphylococcus aureus subsp. aureus N315
aucauaaauauuuucug

SEQ ID NO: 4056698 - RNA, 24 nt, Staphylococcus aureus subsp. aureus N315
aucauaaauauuuucugcgauaua

SEQ ID NO: 4056699 - RNA, 13 nt, Staphylococcus aureus subsp. aureus N315
aucauaauauuga

SEQ ID NO: 4056700 - RNA, 17 nt, Staphylococcus aureus subsp. aureus N315
aucauaaucauaaaaau

SEQ ID NO: 4056701 - RNA, 15 nt, Staphylococcus aureus subsp. aureus N315
aucauacuucaauaa

SEQ ID NO: 4056702 - RNA, 16 nt, Staphylococcus aureus subsp. aureus N315
aucauagcauuaagau

SEQ ID NO: 4056703 - RNA, 17 nt, Staphylococcus aureus subsp. aureus N315
aucauauaaaucaaaua

SEQ ID NO: 4056704 - RNA, 23 nt, Staphylococcus aureus subsp. aureus N315
aucauauaaugguugaauaacac

SEQ ID NO: 4056705 - RNA, 12 nt, Staphylococcus aureus subsp. aureus N315
aucauauauuuc

SEQ ID NO: 4056706 - RNA, 14 nt, Staphylococcus aureus subsp. aureus N315
aucauaucauacca

SEQ ID NO: 4056707 - RNA, 15 nt, Staphylococcus aureus subsp. aureus N315
aucauauucaaaaua

SEQ ID NO: 4056708 - RNA, 13 nt, Staphylococcus aureus subsp. aureus N315
aucaucacacaua

SEQ ID NO: 4056709 - RNA, 17 nt, Staphylococcus aureus subsp. aureus N315
aucaucacacucucccc

SEQ ID NO: 4056710 - RNA, 13 nt, Staphylococcus aureus subsp. aureus N315
aucaucacucuua

SEQ ID NO: 4056711 - RNA, 21 nt, Staphylococcus aureus subsp. aureus N315
aucaucacuguagauucaaau

SEQ ID NO: 4056712 - RNA, 13 nt, Staphylococcus aureus subsp. aureus N315
aucauccacaauc

SEQ ID NO: 4056713 - RNA, 15 nt, Staphylococcus aureus subsp. aureus N315
aucauccauaaaaau

SEQ ID NO: 4056714 - RNA, 16 nt, Staphylococcus aureus subsp. aureus N315
aucauccauaaaaaua

SEQ ID NO: 4056715 - RNA, 18 nt, Staphylococcus aureus subsp. aureus N315
aucauccauaaaaauacg

SEQ ID NO: 4056716 - RNA, 17 nt, Staphylococcus aureus subsp. aureus N315
aucaucgcaaauacaua

SEQ ID NO: 4056717 - RNA, 14 nt, Staphylococcus aureus subsp. aureus N315
aucaucgccagcau

SEQ ID NO: 4056718 - RNA, 20 nt, Staphylococcus aureus subsp. aureus N315
aucaucgccaucccauucac

SEQ ID NO: 4056719 - RNA, 19 nt, Staphylococcus aureus subsp. aureus N315
aucaucguauuucauauau

SEQ ID NO: 4056720 - RNA, 16 nt, Staphylococcus aureus subsp. aureus N315
aucaucuauauuuaau

SEQ ID NO: 4056721 - RNA, 11 nt, Staphylococcus aureus subsp. aureus N315
aucaucuauuc

SEQ ID NO: 4056722 - RNA, 14 nt, Staphylococcus aureus subsp. aureus N315
aucaucuauucaac

SEQ ID NO: 4056723 - RNA, 23 nt, Staphylococcus aureus subsp. aureus N315
aucaucuccuugguuauuaaaau

SEQ ID NO: 4056724 - RNA, 18 nt, Staphylococcus aureus subsp. aureus N315
aucaucucugcuuuaaua

SEQ ID NO: 4056725 - RNA, 19 nt, Staphylococcus aureus subsp. aureus N315
aucaucuuuaauuuucuug

SEQ ID NO: 4056726 - RNA, 20 nt, Staphylococcus aureus subsp. aureus N315
aucaucuuuuugaaauuucg

SEQ ID NO: 4056727 - RNA, 14 nt, Staphylococcus aureus subsp. aureus N315
aucaugaaauaaaa

SEQ ID NO: 4056728 - RNA, 16 nt, Staphylococcus aureus subsp. aureus N315
aucaugacauaaaacu

SEQ ID NO: 4056729 - RNA, 15 nt, Staphylococcus aureus subsp. aureus N315
aucaugcaaaacuaa

SEQ ID NO: 4056730 - RNA, 14 nt, Staphylococcus aureus subsp. aureus N315
aucaugcacaauau

SEQ ID NO: 4056731 - RNA, 16 nt, Staphylococcus aureus subsp. aureus N315
aucaugccuucaugaa

SEQ ID NO: 4056732 - RNA, 16 nt, Staphylococcus aureus subsp. aureus N315
aucaugcucauuugau

SEQ ID NO: 4056733 - RNA, 17 nt, Staphylococcus aureus subsp. aureus N315
aucaugcucguuuuuau

SEQ ID NO: 4056734 - RNA, 19 nt, Staphylococcus aureus subsp. aureus N315
aucaugcuuaucuguaaau

SEQ ID NO: 4056735 - RNA, 20 nt, Staphylococcus aureus subsp. aureus N315
aucaugcuuaucuguaaaua

SEQ ID NO: 4056736 - RNA, 14 nt, Staphylococcus aureus subsp. aureus N315
aucaugcuuuuaau

SEQ ID NO: 4056737 - RNA, 18 nt, Staphylococcus aureus subsp. aureus N315
aucaugcuuuuaauauua

SEQ ID NO: 4056738 - RNA, 20 nt, Staphylococcus aureus subsp. aureus N315
aucaugcuuuuaauauuaua

SEQ ID NO: 4056739 - RNA, 22 nt, Staphylococcus aureus subsp. aureus N315
aucauggcuuauacacuuacaa

SEQ ID NO: 4056740 - RNA, 22 nt, Staphylococcus aureus subsp. aureus N315
aucauggucaacuuuuuuaacu

SEQ ID NO: 4056741 - RNA, 23 nt, Staphylococcus aureus subsp. aureus N315
aucauguaaugcuuaaaaacaau

SEQ ID NO: 4056742 - RNA, 19 nt, Staphylococcus aureus subsp. aureus N315
aucauguacaguuacuuuc

SEQ ID NO: 4056743 - RNA, 22 nt, Staphylococcus aureus subsp. aureus N315
aucauguauauggcaucaucac

SEQ ID NO: 4056744 - RNA, 23 nt, Staphylococcus aureus subsp. aureus N315
aucaugugucuuccaaucaacuu

SEQ ID NO: 4056745 - RNA, 16 nt, Staphylococcus aureus subsp. aureus N315
aucauguucuuauaaa

SEQ ID NO: 4056746 - RNA, 19 nt, Staphylococcus aureus subsp. aureus N315
aucauguucuuauaaaaaa

SEQ ID NO: 4056747 - RNA, 22 nt, Staphylococcus aureus subsp. aureus N315
aucauguucuuauaaaaaacaa

SEQ ID NO: 4056748 - RNA, 22 nt, Staphylococcus aureus subsp. aureus N315
aucauuaaaucugauucauuaa

SEQ ID NO: 4056749 - RNA, 19 nt, Staphylococcus aureus subsp. aureus N315
aucauuaguguagaaaaua

SEQ ID NO: 4056750 - RNA, 20 nt, Staphylococcus aureus subsp. aureus N315
aucauuaguguagaaaauag

SEQ ID NO: 4056751 - RNA, 16 nt, Staphylococcus aureus subsp. aureus N315
aucauuaguuuuuaaa

SEQ ID NO: 4056752 - RNA, 20 nt, Staphylococcus aureus subsp. aureus N315
aucauuaguuuuuaaaauua

SEQ ID NO: 4056753 - RNA, 14 nt, Staphylococcus aureus subsp. aureus N315
aucauuauaaaaug

SEQ ID NO: 4056754 - RNA, 15 nt, Staphylococcus aureus subsp. aureus N315
aucauuauaaaaugg

SEQ ID NO: 4056755 - RNA, 19 nt, Staphylococcus aureus subsp. aureus N315
aucauuauacgugcuuuaa

SEQ ID NO: 4056756 - RNA, 19 nt, Staphylococcus aureus subsp. aureus N315
aucauuauucgcaucucca

SEQ ID NO: 4056757 - RNA, 19 nt, Staphylococcus aureus subsp. aureus N315
aucauuauuugauaaauaa

SEQ ID NO: 4056758 - RNA, 22 nt, Staphylococcus aureus subsp. aureus N315
aucauucaaguguaguaaaaau

SEQ ID NO: 4056759 - RNA, 23 nt, Staphylococcus aureus subsp. aureus N315
aucauucaaguguaguaaaaauc

SEQ ID NO: 4056760 - RNA, 18 nt, Staphylococcus aureus subsp. aureus N315
aucauucaccuaaaaaga

SEQ ID NO: 4056761 - RNA, 16 nt, Staphylococcus aureus subsp. aureus N315
aucauucauuugcaaa

SEQ ID NO: 4056762 - RNA, 19 nt, Staphylococcus aureus subsp. aureus N315
aucauucuguguaaauaua

SEQ ID NO: 4056763 - RNA, 22 nt, Staphylococcus aureus subsp. aureus N315
aucauucuuuauagaaaccaaa

SEQ ID NO: 4056764 - RNA, 13 nt, Staphylococcus aureus subsp. aureus N315
aucauuguggcuu

SEQ ID NO: 4056765 - RNA, 20 nt, Staphylococcus aureus subsp. aureus N315
aucauuguggcuuuuuuuau

SEQ ID NO: 4056766 - RNA, 23 nt, Staphylococcus aureus subsp. aureus N315
aucauuguguccauaaauauuaa

SEQ ID NO: 4056767 - RNA, 19 nt, Staphylococcus aureus subsp. aureus N315
aucauuuaaauuaguuaua

SEQ ID NO: 4056768 - RNA, 16 nt, Staphylococcus aureus subsp. aureus N315
aucauuuaauugaugu

SEQ ID NO: 4056769 - RNA, 18 nt, Staphylococcus aureus subsp. aureus N315
aucauuucagaaauacau

SEQ ID NO: 4056770 - RNA, 18 nt, Staphylococcus aureus subsp. aureus N315
aucauuugacauaaucca

SEQ ID NO: 4056771 - RNA, 16 nt, Staphylococcus aureus subsp. aureus N315
aucauuuguguauaaa

SEQ ID NO: 4056772 - RNA, 18 nt, Staphylococcus aureus subsp. aureus N315
aucauuuguguuuuuaau

SEQ ID NO: 4056773 - RNA, 22 nt, Staphylococcus aureus subsp. aureus N315
aucauuuguguuuuuaauguuu

SEQ ID NO: 4056774 - RNA, 22 nt, Staphylococcus aureus subsp. aureus N315
aucauuuucaacauaauauuuc

SEQ ID NO: 4056775 - RNA, 15 nt, Staphylococcus aureus subsp. aureus N315
aucauuuucaauacu

SEQ ID NO: 4056776 - RNA, 14 nt, Staphylococcus aureus subsp. aureus N315
auccaaaacauuuu

SEQ ID NO: 4056777 - RNA, 16 nt, Staphylococcus aureus subsp. aureus N315
auccaaagacauacag

SEQ ID NO: 4056778 - RNA, 16 nt, Staphylococcus aureus subsp. aureus N315
auccaaauauuaaaaa

SEQ ID NO: 4056779 - RNA, 14 nt, Staphylococcus aureus subsp. aureus N315
auccaacuaaaugu

SEQ ID NO: 4056780 - RNA, 24 nt, Staphylococcus aureus subsp. aureus N315
auccaagcgcuucaggcauaacug

SEQ ID NO: 4056781 - RNA, 13 nt, Staphylococcus aureus subsp. aureus N315
auccaauguauaa

SEQ ID NO: 4056782 - RNA, 22 nt, Staphylococcus aureus subsp. aureus N315
auccaauuuaauagcuuguaca

SEQ ID NO: 4056783 - RNA, 20 nt, Staphylococcus aureus subsp. aureus N315
auccacuuuauaauuuuuga

SEQ ID NO: 4056784 - RNA, 13 nt, Staphylococcus aureus subsp. aureus N315
auccauaaaaaua

SEQ ID NO: 4056785 - RNA, 15 nt, Staphylococcus aureus subsp. aureus N315
auccaucaauaccau

SEQ ID NO: 4056786 - RNA, 12 nt, Staphylococcus aureus subsp. aureus N315
auccaucuacac

SEQ ID NO: 4056787 - RNA, 14 nt, Staphylococcus aureus subsp. aureus N315
auccaucuacaccc

SEQ ID NO: 4056788 - RNA, 16 nt, Staphylococcus aureus subsp. aureus N315
auccaugcugguuuug

SEQ ID NO: 4056789 - RNA, 13 nt, Staphylococcus aureus subsp. aureus N315
auccauucaaugu

SEQ ID NO: 4056790 - RNA, 15 nt, Staphylococcus aureus subsp. aureus N315
auccauucaauguuu

SEQ ID NO: 4056791 - RNA, 21 nt, Staphylococcus aureus subsp. aureus N315
auccauucuaacgguaaauaa

SEQ ID NO: 4056792 - RNA, 18 nt, Staphylococcus aureus subsp. aureus N315
aucccaucgcuuuuucca

SEQ ID NO: 4056793 - RNA, 15 nt, Staphylococcus aureus subsp. aureus N315
aucccauucaccaau

SEQ ID NO: 4056794 - RNA, 19 nt, Staphylococcus aureus subsp. aureus N315
aucccauucaccaauauua

SEQ ID NO: 4056795 - RNA, 14 nt, Staphylococcus aureus subsp. aureus N315
aucccauuuuaaag

SEQ ID NO: 4056796 - RNA, 19 nt, Staphylococcus aureus subsp. aureus N315
auccccagccauuuguugu

SEQ ID NO: 4056797 - RNA, 17 nt, Staphylococcus aureus subsp. aureus N315
auccccgagcaauucuu

SEQ ID NO: 4056798 - RNA, 18 nt, Staphylococcus aureus subsp. aureus N315
aucccgaaaguuagacua

SEQ ID NO: 4056799 - RNA, 16 nt, Staphylococcus aureus subsp. aureus N315
aucccuguaaaaccau

SEQ ID NO: 4056800 - RNA, 22 nt, Staphylococcus aureus subsp. aureus N315
auccgauuuugauauaaaaagu

SEQ ID NO: 4056801 - RNA, 17 nt, Staphylococcus aureus subsp. aureus N315
auccuaaauuauaaaua

SEQ ID NO: 4056802 - RNA, 17 nt, Staphylococcus aureus subsp. aureus N315
auccuaagcauaauuca

SEQ ID NO: 4056803 - RNA, 14 nt, Staphylococcus aureus subsp. aureus N315
auccuaauuuuucu

SEQ ID NO: 4056804 - RNA, 17 nt, Staphylococcus aureus subsp. aureus N315
auccuaauuuuucucca

SEQ ID NO: 4056805 - RNA, 22 nt, Staphylococcus aureus subsp. aureus N315
auccuacgacacguguaaaaau

SEQ ID NO: 4056806 - RNA, 17 nt, Staphylococcus aureus subsp. aureus N315
auccuaugccaaauaac

SEQ ID NO: 4056807 - RNA, 20 nt, Staphylococcus aureus subsp. aureus N315
auccucacuaacucaauaug

SEQ ID NO: 4056808 - RNA, 16 nt, Staphylococcus aureus subsp. aureus N315
auccucaguuauacca

SEQ ID NO: 4056809 - RNA, 13 nt, Staphylococcus aureus subsp. aureus N315
auccucauaauua

SEQ ID NO: 4056810 - RNA, 21 nt, Staphylococcus aureus subsp. aureus N315
auccucgguauuuaauguuuu

SEQ ID NO: 4056811 - RNA, 24 nt, Staphylococcus aureus subsp. aureus N315
auccugauuuaauguuaaacaaua

SEQ ID NO: 4056812 - RNA, 15 nt, Staphylococcus aureus subsp. aureus N315
auccugccaauauau

SEQ ID NO: 4056813 - RNA, 16 nt, Staphylococcus aureus subsp. aureus N315
auccugccaauauauu

SEQ ID NO: 4056814 - RNA, 14 nt, Staphylococcus aureus subsp. aureus N315
auccuggaauauua

SEQ ID NO: 4056815 - RNA, 15 nt, Staphylococcus aureus subsp. aureus N315
auccuggaauauuaa

SEQ ID NO: 4056816 - RNA, 16 nt, Staphylococcus aureus subsp. aureus N315
auccuggaauauuaac

SEQ ID NO: 4056817 - RNA, 21 nt, Staphylococcus aureus subsp. aureus N315
auccuguguaaaauaaaucau

SEQ ID NO: 4056818 - RNA, 11 nt, Staphylococcus aureus subsp. aureus N315
auccuuaaaug

SEQ ID NO: 4056819 - RNA, 15 nt, Staphylococcus aureus subsp. aureus N315
auccuucaaaaguuu

SEQ ID NO: 4056820 - RNA, 20 nt, Staphylococcus aureus subsp. aureus N315
auccuucaaagauuuuaccu

SEQ ID NO: 4056821 - RNA, 17 nt, Staphylococcus aureus subsp. aureus N315
auccuugcuaucaaacu

SEQ ID NO: 4056822 - RNA, 15 nt, Staphylococcus aureus subsp. aureus N315
auccuuuaaaucauu

SEQ ID NO: 4056823 - RNA, 16 nt, Staphylococcus aureus subsp. aureus N315
auccuuugcucaccuu

SEQ ID NO: 4056824 - RNA, 15 nt, Staphylococcus aureus subsp. aureus N315
aucgaaaauuucagg

SEQ ID NO: 4056825 - RNA, 18 nt, Staphylococcus aureus subsp. aureus N315
aucgaacaaaugaaaaag

SEQ ID NO: 4056826 - RNA, 17 nt, Staphylococcus aureus subsp. aureus N315
aucgaacauaaauaaac

SEQ ID NO: 4056827 - RNA, 18 nt, Staphylococcus aureus subsp. aureus N315
aucgaauugguaaaaauc

SEQ ID NO: 4056828 - RNA, 22 nt, Staphylococcus aureus subsp. aureus N315
aucgaauuuucaaagacguaca

SEQ ID NO: 4056829 - RNA, 21 nt, Staphylococcus aureus subsp. aureus N315
aucgagaggguacacuucaac

SEQ ID NO: 4056830 - RNA, 20 nt, Staphylococcus aureus subsp. aureus N315
aucgaguuugaaauaaucua

SEQ ID NO: 4056831 - RNA, 13 nt, Staphylococcus aureus subsp. aureus N315
aucgauaaaaugu

SEQ ID NO: 4056832 - RNA, 16 nt, Staphylococcus aureus subsp. aureus N315
aucgauacuaauaucu

SEQ ID NO: 4056833 - RNA, 23 nt, Staphylococcus aureus subsp. aureus N315
aucgaucgguauuuucauuuuag

SEQ ID NO: 4056834 - RNA, 19 nt, Staphylococcus aureus subsp. aureus N315
aucgaugacuuugucuuua

SEQ ID NO: 4056835 - RNA, 18 nt, Staphylococcus aureus subsp. aureus N315
aucgauuaguuuuugguu

SEQ ID NO: 4056836 - RNA, 22 nt, Staphylococcus aureus subsp. aureus N315
aucgauuuuaucgaaauauuua

SEQ ID NO: 4056837 - RNA, 16 nt, Staphylococcus aureus subsp. aureus N315
aucgcaaauacauaau

SEQ ID NO: 4056838 - RNA, 16 nt, Staphylococcus aureus subsp. aureus N315
aucgcauuuaaauaua

SEQ ID NO: 4056839 - RNA, 15 nt, Staphylococcus aureus subsp. aureus N315
aucgccaaucuauug

SEQ ID NO: 4056840 - RNA, 15 nt, Staphylococcus aureus subsp. aureus N315
aucgccaucccauuc

SEQ ID NO: 4056841 - RNA, 13 nt, Staphylococcus aureus subsp. aureus N315
aucgccuaaaaau

SEQ ID NO: 4056842 - RNA, 14 nt, Staphylococcus aureus subsp. aureus N315
aucgccuaaaaaua

SEQ ID NO: 4056843 - RNA, 15 nt, Staphylococcus aureus subsp. aureus N315
aucgccuaaaaauaa

SEQ ID NO: 4056844 - RNA, 17 nt, Staphylococcus aureus subsp. aureus N315
aucggaauaaaauaaau

SEQ ID NO: 4056845 - RNA, 13 nt, Staphylococcus aureus subsp. aureus N315
aucggcuuugacg

SEQ ID NO: 4056846 - RNA, 15 nt, Staphylococcus aureus subsp. aureus N315
aucgguaauuacuug

SEQ ID NO: 4056847 - RNA, 18 nt, Staphylococcus aureus subsp. aureus N315
aucguaacauaucagcuu

SEQ ID NO: 4056848 - RNA, 14 nt, Staphylococcus aureus subsp. aureus N315
aucguauagauuaa

SEQ ID NO: 4056849 - RNA, 22 nt, Staphylococcus aureus subsp. aureus N315
aucguauagauuaaaaaaucau

SEQ ID NO: 4056850 - RNA, 16 nt, Staphylococcus aureus subsp. aureus N315
aucguauucuuuuaau

SEQ ID NO: 4056851 - RNA, 20 nt, Staphylococcus aureus subsp. aureus N315
aucgucaauuuuaaugagua

SEQ ID NO: 4056852 - RNA, 18 nt, Staphylococcus aureus subsp. aureus N315
aucgugaagaaaaaauga

SEQ ID NO: 4056853 - RNA, 17 nt, Staphylococcus aureus subsp. aureus N315
aucgugcccauaugauu

SEQ ID NO: 4056854 - RNA, 20 nt, Staphylococcus aureus subsp. aureus N315
aucguguauuauugaaacua

SEQ ID NO: 4056855 - RNA, 21 nt, Staphylococcus aureus subsp. aureus N315
aucguuaaaacacccugcuua

SEQ ID NO: 4056856 - RNA, 14 nt, Staphylococcus aureus subsp. aureus N315
aucguuaaggaaag

SEQ ID NO: 4056857 - RNA, 17 nt, Staphylococcus aureus subsp. aureus N315
aucguuaaggaaagcuu

SEQ ID NO: 4056858 - RNA, 21 nt, Staphylococcus aureus subsp. aureus N315
aucguuaauaaaccuacaaua

SEQ ID NO: 4056859 - RNA, 19 nt, Staphylococcus aureus subsp. aureus N315
aucguuauaaguacaaaua

SEQ ID NO: 4056860 - RNA, 17 nt, Staphylococcus aureus subsp. aureus N315
aucguuguaccacccca

SEQ ID NO: 4056861 - RNA, 22 nt, Staphylococcus aureus subsp. aureus N315
aucuaaaaugaguuguucagau

SEQ ID NO: 4056862 - RNA, 15 nt, Staphylococcus aureus subsp. aureus N315
aucuaaacuauaaua

SEQ ID NO: 4056863 - RNA, 17 nt, Staphylococcus aureus subsp. aureus N315
aucuaaacuauaauaau

SEQ ID NO: 4056864 - RNA, 17 nt, Staphylococcus aureus subsp. aureus N315
aucuaaagcuauaaaaa

SEQ ID NO: 4056865 - RNA, 20 nt, Staphylococcus aureus subsp. aureus N315
aucuaaaucuucaucaucgc

SEQ ID NO: 4056866 - RNA, 13 nt, Staphylococcus aureus subsp. aureus N315
aucuaaaugauca

SEQ ID NO: 4056867 - RNA, 21 nt, Staphylococcus aureus subsp. aureus N315
aucuaaaugaucuuuguagcc

SEQ ID NO: 4056868 - RNA, 21 nt, Staphylococcus aureus subsp. aureus N315
aucuaaaugcacgagcaacau

SEQ ID NO: 4056869 - RNA, 22 nt, Staphylococcus aureus subsp. aureus N315
aucuaacaaucguuuuaaugcc

SEQ ID NO: 4056870 - RNA, 17 nt, Staphylococcus aureus subsp. aureus N315
aucuaaucuuaauuguc

SEQ ID NO: 4056871 - RNA, 20 nt, Staphylococcus aureus subsp. aureus N315
aucuaaugggucaaugacug

SEQ ID NO: 4056872 - RNA, 19 nt, Staphylococcus aureus subsp. aureus N315
aucuaauuauucaugaauc

SEQ ID NO: 4056873 - RNA, 22 nt, Staphylococcus aureus subsp. aureus N315
aucuaauucuguuucaaagcug

SEQ ID NO: 4056874 - RNA, 14 nt, Staphylococcus aureus subsp. aureus N315
aucuacaauauuaa

SEQ ID NO: 4056875 - RNA, 18 nt, Staphylococcus aureus subsp. aureus N315
aucuacagagaaucaauu

SEQ ID NO: 4056876 - RNA, 20 nt, Staphylococcus aureus subsp. aureus N315
aucuacauaauuugaauuag

SEQ ID NO: 4056877 - RNA, 19 nt, Staphylococcus aureus subsp. aureus N315
aucuacaucaaauuuuucg

SEQ ID NO: 4056878 - RNA, 13 nt, Staphylococcus aureus subsp. aureus N315
aucuaccauguuu

SEQ ID NO: 4056879 - RNA, 18 nt, Staphylococcus aureus subsp. aureus N315
aucuacuauuuguuuuag

SEQ ID NO: 4056880 - RNA, 23 nt, Staphylococcus aureus subsp. aureus N315
aucuacuuccuuacagacaaaca

SEQ ID NO: 4056881 - RNA, 21 nt, Staphylococcus aureus subsp. aureus N315
aucuacuuuguucugcuuuuu

SEQ ID NO: 4056882 - RNA, 15 nt, Staphylococcus aureus subsp. aureus N315
aucuagaugaaauug

SEQ ID NO: 4056883 - RNA, 19 nt, Staphylococcus aureus subsp. aureus N315
aucuagccugaaauagaaa

SEQ ID NO: 4056884 - RNA, 16 nt, Staphylococcus aureus subsp. aureus N315
aucuagcugcuucugc

SEQ ID NO: 4056885 - RNA, 14 nt, Staphylococcus aureus subsp. aureus N315
aucuaguacaccuc

SEQ ID NO: 4056886 - RNA, 13 nt, Staphylococcus aureus subsp. aureus N315
aucuauaaauacu

SEQ ID NO: 4056887 - RNA, 21 nt, Staphylococcus aureus subsp. aureus N315
aucuauaacaaaaucucaaca

SEQ ID NO: 4056888 - RNA, 14 nt, Staphylococcus aureus subsp. aureus N315
aucuauauaaaaac

SEQ ID NO: 4056889 - RNA, 14 nt, Staphylococcus aureus subsp. aureus N315
aucuauauuuaauu

SEQ ID NO: 4056890 - RNA, 13 nt, Staphylococcus aureus subsp. aureus N315
aucuaucuugugc

SEQ ID NO: 4056891 - RNA, 21 nt, Staphylococcus aureus subsp. aureus N315
aucuauggaaaauguuaucaa

SEQ ID NO: 4056892 - RNA, 21 nt, Staphylococcus aureus subsp. aureus N315
aucuauuauuauguuauaaau

SEQ ID NO: 4056893 - RNA, 15 nt, Staphylococcus aureus subsp. aureus N315
aucuauucaacugau

SEQ ID NO: 4056894 - RNA, 18 nt, Staphylococcus aureus subsp. aureus N315
aucuauugugauauauga

SEQ ID NO: 4056895 - RNA, 18 nt, Staphylococcus aureus subsp. aureus N315
aucuauuuaauaauguau

SEQ ID NO: 4056896 - RNA, 16 nt, Staphylococcus aureus subsp. aureus N315
aucuauuuaucauacu

SEQ ID NO: 4056897 - RNA, 20 nt, Staphylococcus aureus subsp. aureus N315
aucuauuuaucauacuucaa

SEQ ID NO: 4056898 - RNA, 18 nt, Staphylococcus aureus subsp. aureus N315
aucuauuuuaaacucauc

SEQ ID NO: 4056899 - RNA, 15 nt, Staphylococcus aureus subsp. aureus N315
aucuauuuuucgauu

SEQ ID NO: 4056900 - RNA, 12 nt, Staphylococcus aureus subsp. aureus N315
aucucaaaauuu

SEQ ID NO: 4056901 - RNA, 14 nt, Staphylococcus aureus subsp. aureus N315
aucucaacagcaaa

SEQ ID NO: 4056902 - RNA, 21 nt, Staphylococcus aureus subsp. aureus N315
aucucaauccaauuaaauauu

SEQ ID NO: 4056903 - RNA, 14 nt, Staphylococcus aureus subsp. aureus N315
aucucauaauaauu

SEQ ID NO: 4056904 - RNA, 13 nt, Staphylococcus aureus subsp. aureus N315
aucucauucuuua

SEQ ID NO: 4056905 - RNA, 16 nt, Staphylococcus aureus subsp. aureus N315
aucuccauuaaucauu

SEQ ID NO: 4056906 - RNA, 18 nt, Staphylococcus aureus subsp. aureus N315
aucuccauuaaucauuua

SEQ ID NO: 4056907 - RNA, 19 nt, Staphylococcus aureus subsp. aureus N315
aucuccgcuacaauuauau

SEQ ID NO: 4056908 - RNA, 23 nt, Staphylococcus aureus subsp. aureus N315
aucucgucacauauaaauauuuu

SEQ ID NO: 4056909 - RNA, 18 nt, Staphylococcus aureus subsp. aureus N315
aucucuauuuuuuauguu

SEQ ID NO: 4056910 - RNA, 11 nt, Staphylococcus aureus subsp. aureus N315
aucucugaaaa

SEQ ID NO: 4056911 - RNA, 21 nt, Staphylococcus aureus subsp. aureus N315
aucucuuacguccuaauccca

SEQ ID NO: 4056912 - RNA, 20 nt, Staphylococcus aureus subsp. aureus N315
aucucuucugucuaaaaaca

SEQ ID NO: 4056913 - RNA, 17 nt, Staphylococcus aureus subsp. aureus N315
aucugauaccguuagua

SEQ ID NO: 4056914 - RNA, 16 nt, Staphylococcus aureus subsp. aureus N315
aucugcaaaaugcauu

SEQ ID NO: 4056915 - RNA, 19 nt, Staphylococcus aureus subsp. aureus N315
aucugcaaaugccucuuuc

SEQ ID NO: 4056916 - RNA, 14 nt, Staphylococcus aureus subsp. aureus N315
aucugcuuuucuau

SEQ ID NO: 4056917 - RNA, 16 nt, Staphylococcus aureus subsp. aureus N315
aucuggcaaauugccu

SEQ ID NO: 4056918 - RNA, 21 nt, Staphylococcus aureus subsp. aureus N315
aucuguaaauaacuuauggua

SEQ ID NO: 4056919 - RNA, 18 nt, Staphylococcus aureus subsp. aureus N315
aucuguaacauaaacaau

SEQ ID NO: 4056920 - RNA, 16 nt, Staphylococcus aureus subsp. aureus N315
aucuguagaaacacuu

SEQ ID NO: 4056921 - RNA, 13 nt, Staphylococcus aureus subsp. aureus N315
aucuguaucaaaa

SEQ ID NO: 4056922 - RNA, 20 nt, Staphylococcus aureus subsp. aureus N315
aucuguccgacuuaauauug

SEQ ID NO: 4056923 - RNA, 23 nt, Staphylococcus aureus subsp. aureus N315
aucuguuacagguuuuaaaauua

SEQ ID NO: 4056924 - RNA, 15 nt, Staphylococcus aureus subsp. aureus N315
aucuguuguuauaua

SEQ ID NO: 4056925 - RNA, 22 nt, Staphylococcus aureus subsp. aureus N315
aucuguuuuagguuuguugcuu

SEQ ID NO: 4056926 - RNA, 13 nt, Staphylococcus aureus subsp. aureus N315
aucuuaaaacaac

SEQ ID NO: 4056927 - RNA, 22 nt, Staphylococcus aureus subsp. aureus N315
aucuuaaagcauaucucaagau

SEQ ID NO: 4056928 - RNA, 22 nt, Staphylococcus aureus subsp. aureus N315
aucuuaaauuacuuaauaguaa

SEQ ID NO: 4056929 - RNA, 16 nt, Staphylococcus aureus subsp. aureus N315
aucuuaacaacuuuaa

SEQ ID NO: 4056930 - RNA, 18 nt, Staphylococcus aureus subsp. aureus N315
aucuuaacaacuuuaauu

SEQ ID NO: 4056931 - RNA, 23 nt, Staphylococcus aureus subsp. aureus N315
aucuuaacaacuuuaauuuuuca

SEQ ID NO: 4056932 - RNA, 21 nt, Staphylococcus aureus subsp. aureus N315
aucuuaaguacauaaaugcua

SEQ ID NO: 4056933 - RNA, 22 nt, Staphylococcus aureus subsp. aureus N315
aucuuaaguacauaaaugcuaa

SEQ ID NO: 4056934 - RNA, 22 nt, Staphylococcus aureus subsp. aureus N315
aucuuaauauugauuaaucuau

SEQ ID NO: 4056935 - RNA, 15 nt, Staphylococcus aureus subsp. aureus N315
aucuuaaucuaaaaa

SEQ ID NO: 4056936 - RNA, 16 nt, Staphylococcus aureus subsp. aureus N315
aucuuacuacuuaauu

SEQ ID NO: 4056937 - RNA, 20 nt, Staphylococcus aureus subsp. aureus N315
aucuuacugcuguucucuau

SEQ ID NO: 4056938 - RNA, 20 nt, Staphylococcus aureus subsp. aureus N315
aucuuacugcuguuuuuuau

SEQ ID NO: 4056939 - RNA, 15 nt, Staphylococcus aureus subsp. aureus N315
aucuuacugcuuuuu

SEQ ID NO: 4056940 - RNA, 21 nt, Staphylococcus aureus subsp. aureus N315
aucuuacugcuuuuuuaaauu

SEQ ID NO: 4056941 - RNA, 21 nt, Staphylococcus aureus subsp. aureus N315
aucuuagacgcuguuuuaaau

SEQ ID NO: 4056942 - RNA, 20 nt, Staphylococcus aureus subsp. aureus N315
aucuuaggugucaucgcuuu

SEQ ID NO: 4056943 - RNA, 22 nt, Staphylococcus aureus subsp. aureus N315
aucuuauaacaaaaauugcuau

SEQ ID NO: 4056944 - RNA, 20 nt, Staphylococcus aureus subsp. aureus N315
aucuuaugacugcuuuuuau

SEQ ID NO: 4056945 - RNA, 20 nt, Staphylococcus aureus subsp. aureus N315
aucuuaugauacuuugaaag

SEQ ID NO: 4056946 - RNA, 22 nt, Staphylococcus aureus subsp. aureus N315
aucuuaugauacuuugaaagaa

SEQ ID NO: 4056947 - RNA, 22 nt, Staphylococcus aureus subsp. aureus N315
aucuucaacauaacucaaauau

SEQ ID NO: 4056948 - RNA, 18 nt, Staphylococcus aureus subsp. aureus N315
aucuucaauauuuaaauu

SEQ ID NO: 4056949 - RNA, 18 nt, Staphylococcus aureus subsp. aureus N315
aucuucacgcuuauucga

SEQ ID NO: 4056950 - RNA, 16 nt, Staphylococcus aureus subsp. aureus N315
aucuucccaucuuuua

SEQ ID NO: 4056951 - RNA, 18 nt, Staphylococcus aureus subsp. aureus N315
aucuucuaaaucaauaua

SEQ ID NO: 4056952 - RNA, 17 nt, Staphylococcus aureus subsp. aureus N315
aucuucuaguaauucuu

SEQ ID NO: 4056953 - RNA, 20 nt, Staphylococcus aureus subsp. aureus N315
aucuucuaguaauucuucau

SEQ ID NO: 4056954 - RNA, 21 nt, Staphylococcus aureus subsp. aureus N315
aucuucuggauagguaucacu

SEQ ID NO: 4056955 - RNA, 15 nt, Staphylococcus aureus subsp. aureus N315
aucuucuuguuuuaa

SEQ ID NO: 4056956 - RNA, 17 nt, Staphylococcus aureus subsp. aureus N315
aucuucuuguuuuaaau

SEQ ID NO: 4056957 - RNA, 15 nt, Staphylococcus aureus subsp. aureus N315
aucuucuuuuucuac

SEQ ID NO: 4056958 - RNA, 15 nt, Staphylococcus aureus subsp. aureus N315
aucuugagauuuuca

SEQ ID NO: 4056959 - RNA, 20 nt, Staphylococcus aureus subsp. aureus N315
aucuugauuuaaaccaucaa

SEQ ID NO: 4056960 - RNA, 20 nt, Staphylococcus aureus subsp. aureus N315
aucuugcuuauugauauaag

SEQ ID NO: 4056961 - RNA, 22 nt, Staphylococcus aureus subsp. aureus N315
aucuugcuuggauaauugcauu

SEQ ID NO: 4056962 - RNA, 15 nt, Staphylococcus aureus subsp. aureus N315
aucuugguucagcuu

SEQ ID NO: 4056963 - RNA, 21 nt, Staphylococcus aureus subsp. aureus N315
aucuugucuaguucgauuuuu

SEQ ID NO: 4056964 - RNA, 17 nt, Staphylococcus aureus subsp. aureus N315
aucuuguucuaauuguu

SEQ ID NO: 4056965 - RNA, 23 nt, Staphylococcus aureus subsp. aureus N315
aucuuguucuucgucaaauucaa

SEQ ID NO: 4056966 - RNA, 19 nt, Staphylococcus aureus subsp. aureus N315
aucuuguuuucauuuaaaa

SEQ ID NO: 4056967 - RNA, 17 nt, Staphylococcus aureus subsp. aureus N315
aucuuuaaagaaaauuu

SEQ ID NO: 4056968 - RNA, 16 nt, Staphylococcus aureus subsp. aureus N315
aucuuuaaagucaaca

SEQ ID NO: 4056969 - RNA, 20 nt, Staphylococcus aureus subsp. aureus N315
aucuuuaacauuuauucuuu

SEQ ID NO: 4056970 - RNA, 14 nt, Staphylococcus aureus subsp. aureus N315
aucuuuaaucaaag

SEQ ID NO: 4056971 - RNA, 15 nt, Staphylococcus aureus subsp. aureus N315
aucuuuaauuucauu

SEQ ID NO: 4056972 - RNA, 21 nt, Staphylococcus aureus subsp. aureus N315
aucuuuaauuuucuugccauc

SEQ ID NO: 4056973 - RNA, 18 nt, Staphylococcus aureus subsp. aureus N315
aucuuuacgauaaacuaa

SEQ ID NO: 4056974 - RNA, 22 nt, Staphylococcus aureus subsp. aureus N315
aucuuuacgauaaacuaaaaag

SEQ ID NO: 4056975 - RNA, 11 nt, Staphylococcus aureus subsp. aureus N315
aucuuuaucag

SEQ ID NO: 4056976 - RNA, 21 nt, Staphylococcus aureus subsp. aureus N315
aucuuuaucauuauucgcauc

SEQ ID NO: 4056977 - RNA, 11 nt, Staphylococcus aureus subsp. aureus N315
aucuuucaaag

SEQ ID NO: 4056978 - RNA, 15 nt, Staphylococcus aureus subsp. aureus N315
aucuuucaaaugcuu

SEQ ID NO: 4056979 - RNA, 13 nt, Staphylococcus aureus subsp. aureus N315
aucuuucacaauu

SEQ ID NO: 4056980 - RNA, 18 nt, Staphylococcus aureus subsp. aureus N315
aucuuugacauguguuaa

SEQ ID NO: 4056981 - RNA, 19 nt, Staphylococcus aureus subsp. aureus N315
aucuuuguaaauuuuuaag

SEQ ID NO: 4056982 - RNA, 23 nt, Staphylococcus aureus subsp. aureus N315
aucuuuguaugcaucaguuaaua

SEQ ID NO: 4056983 - RNA, 14 nt, Staphylococcus aureus subsp. aureus N315
aucuuuuaauucuu

SEQ ID NO: 4056984 - RNA, 17 nt, Staphylococcus aureus subsp. aureus N315
aucuuuuaauucuuaau

SEQ ID NO: 4056985 - RNA, 18 nt, Staphylococcus aureus subsp. aureus N315
aucuuuuacuaaaugaau

SEQ ID NO: 4056986 - RNA, 16 nt, Staphylococcus aureus subsp. aureus N315
aucuuuuauaaugaac

SEQ ID NO: 4056987 - RNA, 21 nt, Staphylococcus aureus subsp. aureus N315
aucuuuuauccaauguauaaa

SEQ ID NO: 4056988 - RNA, 18 nt, Staphylococcus aureus subsp. aureus N315
aucuuuuccauucauaaa

SEQ ID NO: 4056989 - RNA, 23 nt, Staphylococcus aureus subsp. aureus N315
aucuuuugcguccucaugacauu

SEQ ID NO: 4056990 - RNA, 13 nt, Staphylococcus aureus subsp. aureus N315
aucuuuugcuucg

SEQ ID NO: 4056991 - RNA, 19 nt, Staphylococcus aureus subsp. aureus N315
aucuuuugguuuaucuguu

SEQ ID NO: 4056992 - RNA, 21 nt, Staphylococcus aureus subsp. aureus N315
aucuuuugguuuaucuguugu

SEQ ID NO: 4056993 - RNA, 13 nt, Staphylococcus aureus subsp. aureus N315
aucuuuuguuguu

SEQ ID NO: 4056994 - RNA, 15 nt, Staphylococcus aureus subsp. aureus N315
aucuuuuugaaauuu

SEQ ID NO: 4056995 - RNA, 23 nt, Staphylococcus aureus subsp. aureus N315
augaaaaagauucggaaaauaug

SEQ ID NO: 4056996 - RNA, 16 nt, Staphylococcus aureus subsp. aureus N315
augaaaacagguggaa

SEQ ID NO: 4056997 - RNA, 18 nt, Staphylococcus aureus subsp. aureus N315
augaaaacuuaaaaauga

SEQ ID NO: 4056998 - RNA, 17 nt, Staphylococcus aureus subsp. aureus N315
augaaaauaagcuugua

SEQ ID NO: 4056999 - RNA, 18 nt, Staphylococcus aureus subsp. aureus N315
augaaaauaccucuacau

SEQ ID NO: 4057000 - RNA, 22 nt, Staphylococcus aureus subsp. aureus N315
augaaaauaccucuacauuaua

SEQ ID NO: 4057001 - RNA, 15 nt, Staphylococcus aureus subsp. aureus N315
augaaaccguauuau

SEQ ID NO: 4057002 - RNA, 16 nt, Staphylococcus aureus subsp. aureus N315
augaaagcaucuugca

SEQ ID NO: 4057003 - RNA, 11 nt, Staphylococcus aureus subsp. aureus N315
augaaaugaag

SEQ ID NO: 4057004 - RNA, 16 nt, Staphylococcus aureus subsp. aureus N315
augaaauuguguugaa

SEQ ID NO: 4057005 - RNA, 14 nt, Staphylococcus aureus subsp. aureus N315
augaacaaaauaac

SEQ ID NO: 4057006 - RNA, 15 nt, Staphylococcus aureus subsp. aureus N315
augaacaacaaauug

SEQ ID NO: 4057007 - RNA, 14 nt, Staphylococcus aureus subsp. aureus N315
augaacauaccugc

SEQ ID NO: 4057008 - RNA, 21 nt, Staphylococcus aureus subsp. aureus N315
augaaccagcuaaccaaauaa

SEQ ID NO: 4057009 - RNA, 22 nt, Staphylococcus aureus subsp. aureus N315
augaaccagcuaaccaaauaau

SEQ ID NO: 4057010 - RNA, 15 nt, Staphylococcus aureus subsp. aureus N315
augaacuuaaugcuu

SEQ ID NO: 4057011 - RNA, 16 nt, Staphylococcus aureus subsp. aureus N315
augaacuuaaugcuuc

SEQ ID NO: 4057012 - RNA, 19 nt, Staphylococcus aureus subsp. aureus N315
augaaggcuuuuuguuuug

SEQ ID NO: 4057013 - RNA, 16 nt, Staphylococcus aureus subsp. aureus N315
augaauaacaagaaaa

SEQ ID NO: 4057014 - RNA, 18 nt, Staphylococcus aureus subsp. aureus N315
augaauaaucaaaguucg

SEQ ID NO: 4057015 - RNA, 15 nt, Staphylococcus aureus subsp. aureus N315
augaauaaugcaauu

SEQ ID NO: 4057016 - RNA, 21 nt, Staphylococcus aureus subsp. aureus N315
augaauaaugcaauugaccaa

SEQ ID NO: 4057017 - RNA, 15 nt, Staphylococcus aureus subsp. aureus N315
augaauaauuaaaaa

SEQ ID NO: 4057018 - RNA, 17 nt, Staphylococcus aureus subsp. aureus N315
augaauaauuaaaaaac

SEQ ID NO: 4057019 - RNA, 13 nt, Staphylococcus aureus subsp. aureus N315
augaauagaugau

SEQ ID NO: 4057020 - RNA, 15 nt, Staphylococcus aureus subsp. aureus N315
augaaucaacaauuu

SEQ ID NO: 4057021 - RNA, 13 nt, Staphylococcus aureus subsp. aureus N315
augaaucaauugc

SEQ ID NO: 4057022 - RNA, 14 nt, Staphylococcus aureus subsp. aureus N315
augaaucagaugau

SEQ ID NO: 4057023 - RNA, 22 nt, Staphylococcus aureus subsp. aureus N315
augaaucagaugauuuaauucu

SEQ ID NO: 4057024 - RNA, 19 nt, Staphylococcus aureus subsp. aureus N315
augaaucccauaaugacua

SEQ ID NO: 4057025 - RNA, 15 nt, Staphylococcus aureus subsp. aureus N315
augaaucgauauaau

SEQ ID NO: 4057026 - RNA, 17 nt, Staphylococcus aureus subsp. aureus N315
augaaucgcauuuaaau

SEQ ID NO: 4057027 - RNA, 21 nt, Staphylococcus aureus subsp. aureus N315
augaaucgcauuuaaauauaa

SEQ ID NO: 4057028 - RNA, 17 nt, Staphylococcus aureus subsp. aureus N315
augaaucuagaauauaa

SEQ ID NO: 4057029 - RNA, 18 nt, Staphylococcus aureus subsp. aureus N315
augaaucuagaauauaac

SEQ ID NO: 4057030 - RNA, 13 nt, Staphylococcus aureus subsp. aureus N315
augaaugauauug

SEQ ID NO: 4057031 - RNA, 15 nt, Staphylococcus aureus subsp. aureus N315
augaaugccuaauuu

SEQ ID NO: 4057032 - RNA, 21 nt, Staphylococcus aureus subsp. aureus N315
augaaugccuaauuuugugaa

SEQ ID NO: 4057033 - RNA, 16 nt, Staphylococcus aureus subsp. aureus N315
augaauguuaagacau

SEQ ID NO: 4057034 - RNA, 14 nt, Staphylococcus aureus subsp. aureus N315
augaauuaauagcu

SEQ ID NO: 4057035 - RNA, 18 nt, Staphylococcus aureus subsp. aureus N315
augaauuauuuaaaaugc

SEQ ID NO: 4057036 - RNA, 19 nt, Staphylococcus aureus subsp. aureus N315
augaauuauuuaaaaugcu

SEQ ID NO: 4057037 - RNA, 16 nt, Staphylococcus aureus subsp. aureus N315
augaauugaguauuaa

SEQ ID NO: 4057038 - RNA, 23 nt, Staphylococcus aureus subsp. aureus N315
augaauugaguauuaaauuugaa

SEQ ID NO: 4057039 - RNA, 19 nt, Staphylococcus aureus subsp. aureus N315
augaauugcuuguuuuaaa

SEQ ID NO: 4057040 - RNA, 20 nt, Staphylococcus aureus subsp. aureus N315
augaauugcuuguuuuaaau

SEQ ID NO: 4057041 - RNA, 20 nt, Staphylococcus aureus subsp. aureus N315
augaauugucuuaauaugca

SEQ ID NO: 4057042 - RNA, 15 nt, Staphylococcus aureus subsp. aureus N315
augaauuguuaguuu

SEQ ID NO: 4057043 - RNA, 18 nt, Staphylococcus aureus subsp. aureus N315
augaauuguuguacaugu

SEQ ID NO: 4057044 - RNA, 19 nt, Staphylococcus aureus subsp. aureus N315
augaauuuagcaucaaaaa

SEQ ID NO: 4057045 - RNA, 19 nt, Staphylococcus aureus subsp. aureus N315
augaauuucuaauuuagua

SEQ ID NO: 4057046 - RNA, 16 nt, Staphylococcus aureus subsp. aureus N315
augaauuuuaauauau

SEQ ID NO: 4057047 - RNA, 13 nt, Staphylococcus aureus subsp. aureus N315
augaauuuuauaa

SEQ ID NO: 4057048 - RNA, 14 nt, Staphylococcus aureus subsp. aureus N315
augaauuuuauaaa

SEQ ID NO: 4057049 - RNA, 18 nt, Staphylococcus aureus subsp. aureus N315
augaauuuuauaaauuaa

SEQ ID NO: 4057050 - RNA, 15 nt, Staphylococcus aureus subsp. aureus N315
augaauuuuuauuuu

SEQ ID NO: 4057051 - RNA, 14 nt, Staphylococcus aureus subsp. aureus N315
augacacauacacc

SEQ ID NO: 4057052 - RNA, 16 nt, Staphylococcus aureus subsp. aureus N315
augacaccuaauacca

SEQ ID NO: 4057053 - RNA, 15 nt, Staphylococcus aureus subsp. aureus N315
augacaguaaucaaa

SEQ ID NO: 4057054 - RNA, 13 nt, Staphylococcus aureus subsp. aureus N315
augacaucaauau

SEQ ID NO: 4057055 - RNA, 14 nt, Staphylococcus aureus subsp. aureus N315
augacaucaauauc

SEQ ID NO: 4057056 - RNA, 15 nt, Staphylococcus aureus subsp. aureus N315
augacaucaauaucu

SEQ ID NO: 4057057 - RNA, 15 nt, Staphylococcus aureus subsp. aureus N315
augacauccauacaa

SEQ ID NO: 4057058 - RNA, 19 nt, Staphylococcus aureus subsp. aureus N315
augacauugugaaaguuuu

SEQ ID NO: 4057059 - RNA, 18 nt, Staphylococcus aureus subsp. aureus N315
augacauuuaauacuuuu

SEQ ID NO: 4057060 - RNA, 23 nt, Staphylococcus aureus subsp. aureus N315
augacauuuuaaaucuaauuauu

SEQ ID NO: 4057061 - RNA, 13 nt, Staphylococcus aureus subsp. aureus N315
augaccaauauuc

SEQ ID NO: 4057062 - RNA, 19 nt, Staphylococcus aureus subsp. aureus N315
augaccaugauauauaaca

SEQ ID NO: 4057063 - RNA, 16 nt, Staphylococcus aureus subsp. aureus N315
augaccuaauauauua

SEQ ID NO: 4057064 - RNA, 16 nt, Staphylococcus aureus subsp. aureus N315
augaccuggaauauug

SEQ ID NO: 4057065 - RNA, 16 nt, Staphylococcus aureus subsp. aureus N315
augacgaacgauagau

SEQ ID NO: 4057066 - RNA, 23 nt, Staphylococcus aureus subsp. aureus N315
augacggugaaaguucauuacaa

SEQ ID NO: 4057067 - RNA, 21 nt, Staphylococcus aureus subsp. aureus N315
augacgugcuuuuaaauguau

SEQ ID NO: 4057068 - RNA, 14 nt, Staphylococcus aureus subsp. aureus N315
augacuaacgaaaa

SEQ ID NO: 4057069 - RNA, 23 nt, Staphylococcus aureus subsp. aureus N315
augacuaugcaaaugaaauucuu

SEQ ID NO: 4057070 - RNA, 20 nt, Staphylococcus aureus subsp. aureus N315
augacugagaaaaauauuuc

SEQ ID NO: 4057071 - RNA, 22 nt, Staphylococcus aureus subsp. aureus N315
augacugagaaaaauauuucua

SEQ ID NO: 4057072 - RNA, 23 nt, Staphylococcus aureus subsp. aureus N315
augacugagaaaaauauuucuaa

SEQ ID NO: 4057073 - RNA, 13 nt, Staphylococcus aureus subsp. aureus N315
augacuguagaaa

SEQ ID NO: 4057074 - RNA, 15 nt, Staphylococcus aureus subsp. aureus N315
augacuuauuuuuca

SEQ ID NO: 4057075 - RNA, 18 nt, Staphylococcus aureus subsp. aureus N315
augacuuauuuuucauca

SEQ ID NO: 4057076 - RNA, 16 nt, Staphylococcus aureus subsp. aureus N315
augacuuuuuauuagu

SEQ ID NO: 4057077 - RNA, 12 nt, Staphylococcus aureus subsp. aureus N315
augagaaauguu

SEQ ID NO: 4057078 - RNA, 15 nt, Staphylococcus aureus subsp. aureus N315
augagaagcugucuu

SEQ ID NO: 4057079 - RNA, 22 nt, Staphylococcus aureus subsp. aureus N315
augagaagcugucuuacugcug

SEQ ID NO: 4057080 - RNA, 21 nt, Staphylococcus aureus subsp. aureus N315
augagaguaauguuccauaua

SEQ ID NO: 4057081 - RNA, 14 nt, Staphylococcus aureus subsp. aureus N315
augagauuauucug

SEQ ID NO: 4057082 - RNA, 15 nt, Staphylococcus aureus subsp. aureus N315
augagcgcauaaauu

SEQ ID NO: 4057083 - RNA, 19 nt, Staphylococcus aureus subsp. aureus N315
augagcuucuuuaaauaca

SEQ ID NO: 4057084 - RNA, 18 nt, Staphylococcus aureus subsp. aureus N315
augaggaucaacugaaau

SEQ ID NO: 4057085 - RNA, 17 nt, Staphylococcus aureus subsp. aureus N315
augagguucaguagaau

SEQ ID NO: 4057086 - RNA, 19 nt, Staphylococcus aureus subsp. aureus N315
augagguucaguagaauug

SEQ ID NO: 4057087 - RNA, 16 nt, Staphylococcus aureus subsp. aureus N315
augaguaugacgaaau

SEQ ID NO: 4057088 - RNA, 17 nt, Staphylococcus aureus subsp. aureus N315
augaguugaagcuaauu

SEQ ID NO: 4057089 - RNA, 20 nt, Staphylococcus aureus subsp. aureus N315
augaguuguucagauuugua

SEQ ID NO: 4057090 - RNA, 19 nt, Staphylococcus aureus subsp. aureus N315
augauaaaaauaaaaccga

SEQ ID NO: 4057091 - RNA, 22 nt, Staphylococcus aureus subsp. aureus N315
augauaaagagccacuaaugau

SEQ ID NO: 4057092 - RNA, 20 nt, Staphylococcus aureus subsp. aureus N315
augauaaccaaucaucgcaa

SEQ ID NO: 4057093 - RNA, 19 nt, Staphylococcus aureus subsp. aureus N315
augauaaccauuaugauua

SEQ ID NO: 4057094 - RNA, 22 nt, Staphylococcus aureus subsp. aureus N315
augauaaucguuuuuacuguaa

SEQ ID NO: 4057095 - RNA, 15 nt, Staphylococcus aureus subsp. aureus N315
augauaauuaaugcc

SEQ ID NO: 4057096 - RNA, 18 nt, Staphylococcus aureus subsp. aureus N315
augauaauuaaugccauu

SEQ ID NO: 4057097 - RNA, 16 nt, Staphylococcus aureus subsp. aureus N315
augauaauuaauuaaa

SEQ ID NO: 4057098 - RNA, 18 nt, Staphylococcus aureus subsp. aureus N315
augauacgccuaaauauu

SEQ ID NO: 4057099 - RNA, 19 nt, Staphylococcus aureus subsp. aureus N315
augauacgcuuuuuaaaaa

SEQ ID NO: 4057100 - RNA, 19 nt, Staphylococcus aureus subsp. aureus N315
augauacguacguugaugu

SEQ ID NO: 4057101 - RNA, 18 nt, Staphylococcus aureus subsp. aureus N315
augauacgugguuuuauu

SEQ ID NO: 4057102 - RNA, 16 nt, Staphylococcus aureus subsp. aureus N315
augauacucaauaaaa

SEQ ID NO: 4057103 - RNA, 17 nt, Staphylococcus aureus subsp. aureus N315
augauacugauauuuag

SEQ ID NO: 4057104 - RNA, 19 nt, Staphylococcus aureus subsp. aureus N315
augauagcaaugaauuaau

SEQ ID NO: 4057105 - RNA, 20 nt, Staphylococcus aureus subsp. aureus N315
augauagccgcuucauugau

SEQ ID NO: 4057106 - RNA, 19 nt, Staphylococcus aureus subsp. aureus N315
augauagcgugauuuuuca

SEQ ID NO: 4057107 - RNA, 16 nt, Staphylococcus aureus subsp. aureus N315
augauagcuaaacauu

SEQ ID NO: 4057108 - RNA, 20 nt, Staphylococcus aureus subsp. aureus N315
augauauacuugaagaaaag

SEQ ID NO: 4057109 - RNA, 13 nt, Staphylococcus aureus subsp. aureus N315
augauauauguaa

SEQ ID NO: 4057110 - RNA, 16 nt, Staphylococcus aureus subsp. aureus N315
augauauccaaagcuu

SEQ ID NO: 4057111 - RNA, 15 nt, Staphylococcus aureus subsp. aureus N315
augauauguucgcuu

SEQ ID NO: 4057112 - RNA, 13 nt, Staphylococcus aureus subsp. aureus N315
augauauucaacu

SEQ ID NO: 4057113 - RNA, 14 nt, Staphylococcus aureus subsp. aureus N315
augauauucaacuu

SEQ ID NO: 4057114 - RNA, 22 nt, Staphylococcus aureus subsp. aureus N315
augauauugaaaguguaugcau

SEQ ID NO: 4057115 - RNA, 23 nt, Staphylococcus aureus subsp. aureus N315
augauauugauuugauucauuac

SEQ ID NO: 4057116 - RNA, 15 nt, Staphylococcus aureus subsp. aureus N315
augauauuuaacaaa

SEQ ID NO: 4057117 - RNA, 16 nt, Staphylococcus aureus subsp. aureus N315
augauauuuaacaaaa

SEQ ID NO: 4057118 - RNA, 18 nt, Staphylococcus aureus subsp. aureus N315
augauauuuaacaaaauu

SEQ ID NO: 4057119 - RNA, 18 nt, Staphylococcus aureus subsp. aureus N315
augaucagggaaaucauc

SEQ ID NO: 4057120 - RNA, 20 nt, Staphylococcus aureus subsp. aureus N315
augaucccaaaaucgcaaau

SEQ ID NO: 4057121 - RNA, 14 nt, Staphylococcus aureus subsp. aureus N315
augaugaauuguug

SEQ ID NO: 4057122 - RNA, 21 nt, Staphylococcus aureus subsp. aureus N315
augaugaauuguuguacaugu

SEQ ID NO: 4057123 - RNA, 15 nt, Staphylococcus aureus subsp. aureus N315
augaugacaucaaua

SEQ ID NO: 4057124 - RNA, 16 nt, Staphylococcus aureus subsp. aureus N315
augaugagauaaaauc

SEQ ID NO: 4057125 - RNA, 19 nt, Staphylococcus aureus subsp. aureus N315
augaugagauaaaaucaua

SEQ ID NO: 4057126 - RNA, 15 nt, Staphylococcus aureus subsp. aureus N315
augaugauaaauuga

SEQ ID NO: 4057127 - RNA, 21 nt, Staphylococcus aureus subsp. aureus N315
augaugcuucuaacugaauua

SEQ ID NO: 4057128 - RNA, 14 nt, Staphylococcus aureus subsp. aureus N315
augaugucauguau

SEQ ID NO: 4057129 - RNA, 16 nt, Staphylococcus aureus subsp. aureus N315
augaugucauguauug

SEQ ID NO: 4057130 - RNA, 21 nt, Staphylococcus aureus subsp. aureus N315
augaugugcaaacgauauguu

SEQ ID NO: 4057131 - RNA, 15 nt, Staphylococcus aureus subsp. aureus N315
augauguuaaaaaau

SEQ ID NO: 4057132 - RNA, 17 nt, Staphylococcus aureus subsp. aureus N315
augauuaaaaaucaaag

SEQ ID NO: 4057133 - RNA, 14 nt, Staphylococcus aureus subsp. aureus N315
augauuaauuaaag

SEQ ID NO: 4057134 - RNA, 16 nt, Staphylococcus aureus subsp. aureus N315
augauuaauuaaagau

SEQ ID NO: 4057135 - RNA, 22 nt, Staphylococcus aureus subsp. aureus N315
augauuaauuaaagauuaaaau

SEQ ID NO: 4057136 - RNA, 16 nt, Staphylococcus aureus subsp. aureus N315
augauuacuuuaagau

SEQ ID NO: 4057137 - RNA, 20 nt, Staphylococcus aureus subsp. aureus N315
augauuacuuuaagauuauu

SEQ ID NO: 4057138 - RNA, 22 nt, Staphylococcus aureus subsp. aureus N315
augauuacuuuaagauuauuug

SEQ ID NO: 4057139 - RNA, 14 nt, Staphylococcus aureus subsp. aureus N315
augauuaguaauga

SEQ ID NO: 4057140 - RNA, 23 nt, Staphylococcus aureus subsp. aureus N315
augauucguauucaaaguuuuca

SEQ ID NO: 4057141 - RNA, 19 nt, Staphylococcus aureus subsp. aureus N315
augauucuuuauaagcuuu

SEQ ID NO: 4057142 - RNA, 15 nt, Staphylococcus aureus subsp. aureus N315
augauugaaauccuu

SEQ ID NO: 4057143 - RNA, 17 nt, Staphylococcus aureus subsp. aureus N315
augauugcaaauuauca

SEQ ID NO: 4057144 - RNA, 16 nt, Staphylococcus aureus subsp. aureus N315
augauugcauugauuu

SEQ ID NO: 4057145 - RNA, 16 nt, Staphylococcus aureus subsp. aureus N315
augauuguuaauacaa

SEQ ID NO: 4057146 - RNA, 23 nt, Staphylococcus aureus subsp. aureus N315
augauuuagauguguugugauua

SEQ ID NO: 4057147 - RNA, 21 nt, Staphylococcus aureus subsp. aureus N315
augauuucacuucauaaagcg

SEQ ID NO: 4057148 - RNA, 12 nt, Staphylococcus aureus subsp. aureus N315
augauuugauuu

SEQ ID NO: 4057149 - RNA, 18 nt, Staphylococcus aureus subsp. aureus N315
augauuugugguaaucau

SEQ ID NO: 4057150 - RNA, 13 nt, Staphylococcus aureus subsp. aureus N315
augauuuugcuuu

SEQ ID NO: 4057151 - RNA, 18 nt, Staphylococcus aureus subsp. aureus N315
augauuuuuaaaaauaca

SEQ ID NO: 4057152 - RNA, 17 nt, Staphylococcus aureus subsp. aureus N315
augcaacuaaaacuauc

SEQ ID NO: 4057153 - RNA, 19 nt, Staphylococcus aureus subsp. aureus N315
augcaacuuauaauauuaa

SEQ ID NO: 4057154 - RNA, 20 nt, Staphylococcus aureus subsp. aureus N315
augcaaguuggcggggcccc

SEQ ID NO: 4057155 - RNA, 12 nt, Staphylococcus aureus subsp. aureus N315
augcaauacauu

SEQ ID NO: 4057156 - RNA, 14 nt, Staphylococcus aureus subsp. aureus N315
augcaauacauuaa

SEQ ID NO: 4057157 - RNA, 19 nt, Staphylococcus aureus subsp. aureus N315
augcaauacauuaauauaa

SEQ ID NO: 4057158 - RNA, 21 nt, Staphylococcus aureus subsp. aureus N315
augcacgcgugccaacaucuu

SEQ ID NO: 4057159 - RNA, 17 nt, Staphylococcus aureus subsp. aureus N315
augcacuuuaacauaac

SEQ ID NO: 4057160 - RNA, 14 nt, Staphylococcus aureus subsp. aureus N315
augcacuuuauuaa

SEQ ID NO: 4057161 - RNA, 21 nt, Staphylococcus aureus subsp. aureus N315
augcacuuuauuaaaaauccu

SEQ ID NO: 4057162 - RNA, 14 nt, Staphylococcus aureus subsp. aureus N315
augcagauucuuca

SEQ ID NO: 4057163 - RNA, 13 nt, Staphylococcus aureus subsp. aureus N315
augcagcuguauu

SEQ ID NO: 4057164 - RNA, 15 nt, Staphylococcus aureus subsp. aureus N315
augcaguaaaaccaa

SEQ ID NO: 4057165 - RNA, 14 nt, Staphylococcus aureus subsp. aureus N315
augcauaauaccaa

SEQ ID NO: 4057166 - RNA, 20 nt, Staphylococcus aureus subsp. aureus N315
augcauaauaccaauugcuu

SEQ ID NO: 4057167 - RNA, 21 nt, Staphylococcus aureus subsp. aureus N315
augcauaauuaggauuaacau

SEQ ID NO: 4057168 - RNA, 15 nt, Staphylococcus aureus subsp. aureus N315
augcauauauauaua

SEQ ID NO: 4057169 - RNA, 21 nt, Staphylococcus aureus subsp. aureus N315
augcaugccagaugcaaugau

SEQ ID NO: 4057170 - RNA, 20 nt, Staphylococcus aureus subsp. aureus N315
augcaugcuucucaauuugu

SEQ ID NO: 4057171 - RNA, 22 nt, Staphylococcus aureus subsp. aureus N315
augccaacacguuuuaagccag

SEQ ID NO: 4057172 - RNA, 19 nt, Staphylococcus aureus subsp. aureus N315
augccagcuucuaacaaau

SEQ ID NO: 4057173 - RNA, 19 nt, Staphylococcus aureus subsp. aureus N315
augcccaaccacgauaucu

SEQ ID NO: 4057174 - RNA, 23 nt, Staphylococcus aureus subsp. aureus N315
augcccgauaaaaccaccuacca

SEQ ID NO: 4057175 - RNA, 15 nt, Staphylococcus aureus subsp. aureus N315
augcccuuaaagcac

SEQ ID NO: 4057176 - RNA, 14 nt, Staphylococcus aureus subsp. aureus N315
augccgagauuauu

SEQ ID NO: 4057177 - RNA, 17 nt, Staphylococcus aureus subsp. aureus N315
augccgccuaauaauaa

SEQ ID NO: 4057178 - RNA, 15 nt, Staphylococcus aureus subsp. aureus N315
augccggucauaaca

SEQ ID NO: 4057179 - RNA, 16 nt, Staphylococcus aureus subsp. aureus N315
augccguaguuuucuc

SEQ ID NO: 4057180 - RNA, 18 nt, Staphylococcus aureus subsp. aureus N315
augccucaguuagaagau

SEQ ID NO: 4057181 - RNA, 23 nt, Staphylococcus aureus subsp. aureus N315
augccugcccuuuagucauguuu

SEQ ID NO: 4057182 - RNA, 20 nt, Staphylococcus aureus subsp. aureus N315
augccuuaugucauauacua

SEQ ID NO: 4057183 - RNA, 17 nt, Staphylococcus aureus subsp. aureus N315
augccuuugauuuuacu

SEQ ID NO: 4057184 - RNA, 14 nt, Staphylococcus aureus subsp. aureus N315
augcgaaaccuuuc

SEQ ID NO: 4057185 - RNA, 16 nt, Staphylococcus aureus subsp. aureus N315
augcgauucucauuua

SEQ ID NO: 4057186 - RNA, 22 nt, Staphylococcus aureus subsp. aureus N315
augcgauucucauuuacuugau

SEQ ID NO: 4057187 - RNA, 15 nt, Staphylococcus aureus subsp. aureus N315
augcgcaaugaaaac

SEQ ID NO: 4057188 - RNA, 17 nt, Staphylococcus aureus subsp. aureus N315
augcuaaaaauauugaa

SEQ ID NO: 4057189 - RNA, 16 nt, Staphylococcus aureus subsp. aureus N315
augcuaauuuaacugc

SEQ ID NO: 4057190 - RNA, 18 nt, Staphylococcus aureus subsp. aureus N315
augcuagaaaguaaugcu

SEQ ID NO: 4057191 - RNA, 19 nt, Staphylococcus aureus subsp. aureus N315
augcuagcuuucuuuuuca

SEQ ID NO: 4057192 - RNA, 21 nt, Staphylococcus aureus subsp. aureus N315
augcucccuucaaaguuuuca

SEQ ID NO: 4057193 - RNA, 19 nt, Staphylococcus aureus subsp. aureus N315
augcucuauauauccauuc

SEQ ID NO: 4057194 - RNA, 20 nt, Staphylococcus aureus subsp. aureus N315
augcucuauauauccauuca

SEQ ID NO: 4057195 - RNA, 21 nt, Staphylococcus aureus subsp. aureus N315
augcucuauauauccauucaa

SEQ ID NO: 4057196 - RNA, 16 nt, Staphylococcus aureus subsp. aureus N315
augcucuuuagguaaa

SEQ ID NO: 4057197 - RNA, 19 nt, Staphylococcus aureus subsp. aureus N315
augcugaaauguagacaau

SEQ ID NO: 4057198 - RNA, 17 nt, Staphylococcus aureus subsp. aureus N315
augcugaauaaauaacu

SEQ ID NO: 4057199 - RNA, 17 nt, Staphylococcus aureus subsp. aureus N315
augcugauaauuuuucu

SEQ ID NO: 4057200 - RNA, 16 nt, Staphylococcus aureus subsp. aureus N315
augcugcacauuccau

SEQ ID NO: 4057201 - RNA, 21 nt, Staphylococcus aureus subsp. aureus N315
augcugcuucuucagguguuu

SEQ ID NO: 4057202 - RNA, 13 nt, Staphylococcus aureus subsp. aureus N315
augcuguacuaua

SEQ ID NO: 4057203 - RNA, 22 nt, Staphylococcus aureus subsp. aureus N315
augcuguacuauauucaaugau

SEQ ID NO: 4057204 - RNA, 20 nt, Staphylococcus aureus subsp. aureus N315
augcuguguaucaucauaau

SEQ ID NO: 4057205 - RNA, 12 nt, Staphylococcus aureus subsp. aureus N315
augcuguuuuau

SEQ ID NO: 4057206 - RNA, 18 nt, Staphylococcus aureus subsp. aureus N315
augcuuaaaaacaauauu

SEQ ID NO: 4057207 - RNA, 14 nt, Staphylococcus aureus subsp. aureus N315
augcuucaaaaauu

SEQ ID NO: 4057208 - RNA, 19 nt, Staphylococcus aureus subsp. aureus N315
augcuucaaaaauuaauca

SEQ ID NO: 4057209 - RNA, 15 nt, Staphylococcus aureus subsp. aureus N315
augcuucaaagucaa

SEQ ID NO: 4057210 - RNA, 17 nt, Staphylococcus aureus subsp. aureus N315
augcuucgaauuuaaca

SEQ ID NO: 4057211 - RNA, 19 nt, Staphylococcus aureus subsp. aureus N315
augcuucgcacaacugcau

SEQ ID NO: 4057212 - RNA, 19 nt, Staphylococcus aureus subsp. aureus N315
augcuucgcaucacugcau

SEQ ID NO: 4057213 - RNA, 16 nt, Staphylococcus aureus subsp. aureus N315
augcuucugguucuuc

SEQ ID NO: 4057214 - RNA, 21 nt, Staphylococcus aureus subsp. aureus N315
augcuucugguucuucaauau

SEQ ID NO: 4057215 - RNA, 15 nt, Staphylococcus aureus subsp. aureus N315
augcuugaauguuug

SEQ ID NO: 4057216 - RNA, 17 nt, Staphylococcus aureus subsp. aureus N315
augcuuggacauauacu

SEQ ID NO: 4057217 - RNA, 17 nt, Staphylococcus aureus subsp. aureus N315
augcuuguacaaaaaau

SEQ ID NO: 4057218 - RNA, 14 nt, Staphylococcus aureus subsp. aureus N315
augcuuuaaaucga

SEQ ID NO: 4057219 - RNA, 19 nt, Staphylococcus aureus subsp. aureus N315
augcuuuaugugcagcuug

SEQ ID NO: 4057220 - RNA, 15 nt, Staphylococcus aureus subsp. aureus N315
augcuuuuaauauua

SEQ ID NO: 4057221 - RNA, 23 nt, Staphylococcus aureus subsp. aureus N315
augcuuuuuuuacaauaugauua

SEQ ID NO: 4057222 - RNA, 16 nt, Staphylococcus aureus subsp. aureus N315
auggaaaaguuuuuua

SEQ ID NO: 4057223 - RNA, 17 nt, Staphylococcus aureus subsp. aureus N315
auggaaaggcguuuuuu

SEQ ID NO: 4057224 - RNA, 17 nt, Staphylococcus aureus subsp. aureus N315
auggacuaagauauaag

SEQ ID NO: 4057225 - RNA, 13 nt, Staphylococcus aureus subsp. aureus N315
auggagcaugauu

SEQ ID NO: 4057226 - RNA, 16 nt, Staphylococcus aureus subsp. aureus N315
auggagcggaagauag

SEQ ID NO: 4057227 - RNA, 16 nt, Staphylococcus aureus subsp. aureus N315
auggauacuuaaagau

SEQ ID NO: 4057228 - RNA, 21 nt, Staphylococcus aureus subsp. aureus N315
auggaucauaaucauaaaaau

SEQ ID NO: 4057229 - RNA, 16 nt, Staphylococcus aureus subsp. aureus N315
auggaugaauauauug

SEQ ID NO: 4057230 - RNA, 22 nt, Staphylococcus aureus subsp. aureus N315
auggauuacagcguacuaaaga

SEQ ID NO: 4057231 - RNA, 17 nt, Staphylococcus aureus subsp. aureus N315
auggcaaucuauauaaa

SEQ ID NO: 4057232 - RNA, 14 nt, Staphylococcus aureus subsp. aureus N315
auggcauuauugcc

SEQ ID NO: 4057233 - RNA, 19 nt, Staphylococcus aureus subsp. aureus N315
auggcuaauacaaaacaaa

SEQ ID NO: 4057234 - RNA, 19 nt, Staphylococcus aureus subsp. aureus N315
auggcugcaucaauaugac

SEQ ID NO: 4057235 - RNA, 20 nt, Staphylococcus aureus subsp. aureus N315
auggcugcaucaauaugacc

SEQ ID NO: 4057236 - RNA, 18 nt, Staphylococcus aureus subsp. aureus N315
auggcuugguuauuuuca

SEQ ID NO: 4057237 - RNA, 12 nt, Staphylococcus aureus subsp. aureus N315
augggccccaac

SEQ ID NO: 4057238 - RNA, 20 nt, Staphylococcus aureus subsp. aureus N315
augggccccaacaaagagaa

SEQ ID NO: 4057239 - RNA, 21 nt, Staphylococcus aureus subsp. aureus N315
auggguauccuucucaucauu

SEQ ID NO: 4057240 - RNA, 23 nt, Staphylococcus aureus subsp. aureus N315
augggucaaugacugagaaaaau

SEQ ID NO: 4057241 - RNA, 18 nt, Staphylococcus aureus subsp. aureus N315
augguaaguauaauuaaa

SEQ ID NO: 4057242 - RNA, 16 nt, Staphylococcus aureus subsp. aureus N315
auggucauguguugca

SEQ ID NO: 4057243 - RNA, 15 nt, Staphylococcus aureus subsp. aureus N315
auggugaacuaaauu

SEQ ID NO: 4057244 - RNA, 18 nt, Staphylococcus aureus subsp. aureus N315
auggugaacuguuaaacu

SEQ ID NO: 4057245 - RNA, 22 nt, Staphylococcus aureus subsp. aureus N315
auggugaacuguuaaacucaua

SEQ ID NO: 4057246 - RNA, 20 nt, Staphylococcus aureus subsp. aureus N315
auggugaccaagauuccauc

SEQ ID NO: 4057247 - RNA, 21 nt, Staphylococcus aureus subsp. aureus N315
augguuaucacuuauuauuuu

SEQ ID NO: 4057248 - RNA, 17 nt, Staphylococcus aureus subsp. aureus N315
augguuccaaguauuuu

SEQ ID NO: 4057249 - RNA, 19 nt, Staphylococcus aureus subsp. aureus N315
augguuccaaguauuuucu

SEQ ID NO: 4057250 - RNA, 15 nt, Staphylococcus aureus subsp. aureus N315
augguugaucgaaua

SEQ ID NO: 4057251 - RNA, 20 nt, Staphylococcus aureus subsp. aureus N315
augguugauuacaauuguuc

SEQ ID NO: 4057252 - RNA, 14 nt, Staphylococcus aureus subsp. aureus N315
augguuugaguaaa

SEQ ID NO: 4057253 - RNA, 21 nt, Staphylococcus aureus subsp. aureus N315
augguuuucuuuuuaucauga

SEQ ID NO: 4057254 - RNA, 20 nt, Staphylococcus aureus subsp. aureus N315
augguuuucuuuuucuauac

SEQ ID NO: 4057255 - RNA, 22 nt, Staphylococcus aureus subsp. aureus N315
augguuuuguuuugcucuuuaa

SEQ ID NO: 4057256 - RNA, 15 nt, Staphylococcus aureus subsp. aureus N315
auguaaaauuagcaa

SEQ ID NO: 4057257 - RNA, 13 nt, Staphylococcus aureus subsp. aureus N315
auguaaaauuauu

SEQ ID NO: 4057258 - RNA, 19 nt, Staphylococcus aureus subsp. aureus N315
auguaaauaaaaauuauau

SEQ ID NO: 4057259 - RNA, 18 nt, Staphylococcus aureus subsp. aureus N315
auguaaaugaaauaggcg

SEQ ID NO: 4057260 - RNA, 16 nt, Staphylococcus aureus subsp. aureus N315
auguaacaauuuagca

SEQ ID NO: 4057261 - RNA, 13 nt, Staphylococcus aureus subsp. aureus N315
auguaacauaaag

SEQ ID NO: 4057262 - RNA, 19 nt, Staphylococcus aureus subsp. aureus N315
auguaacauuaaaaauaaa

SEQ ID NO: 4057263 - RNA, 17 nt, Staphylococcus aureus subsp. aureus N315
auguaagcuaucguaaa

SEQ ID NO: 4057264 - RNA, 15 nt, Staphylococcus aureus subsp. aureus N315
auguaaucagguuua

SEQ ID NO: 4057265 - RNA, 17 nt, Staphylococcus aureus subsp. aureus N315
auguaaucauuauagca

SEQ ID NO: 4057266 - RNA, 21 nt, Staphylococcus aureus subsp. aureus N315
auguaaugauacaaacccaua

SEQ ID NO: 4057267 - RNA, 12 nt, Staphylococcus aureus subsp. aureus N315
auguaauuauuu

SEQ ID NO: 4057268 - RNA, 15 nt, Staphylococcus aureus subsp. aureus N315
auguaauuguuuuuu

SEQ ID NO: 4057269 - RNA, 23 nt, Staphylococcus aureus subsp. aureus N315
auguacacuuuugauuguuuaaa

SEQ ID NO: 4057270 - RNA, 23 nt, Staphylococcus aureus subsp. aureus N315
auguaccgaauccuucaucaaua

SEQ ID NO: 4057271 - RNA, 17 nt, Staphylococcus aureus subsp. aureus N315
auguacgaaaauuuugu

SEQ ID NO: 4057272 - RNA, 18 nt, Staphylococcus aureus subsp. aureus N315
auguacguuuuuuuaaau

SEQ ID NO: 4057273 - RNA, 12 nt, Staphylococcus aureus subsp. aureus N315
auguacuauaaa

SEQ ID NO: 4057274 - RNA, 16 nt, Staphylococcus aureus subsp. aureus N315
auguacuauaaauccu

SEQ ID NO: 4057275 - RNA, 22 nt, Staphylococcus aureus subsp. aureus N315
auguacuuuucugucuguaaau

SEQ ID NO: 4057276 - RNA, 14 nt, Staphylococcus aureus subsp. aureus N315
auguagaauuucuu

SEQ ID NO: 4057277 - RNA, 21 nt, Staphylococcus aureus subsp. aureus N315
auguagacgauucacagacaa

SEQ ID NO: 4057278 - RNA, 22 nt, Staphylococcus aureus subsp. aureus N315
auguagugaaagucguuguuga

SEQ ID NO: 4057279 - RNA, 20 nt, Staphylococcus aureus subsp. aureus N315
auguauaaaaccuucaauca

SEQ ID NO: 4057280 - RNA, 19 nt, Staphylococcus aureus subsp. aureus N315
auguauaucgacaccauuu

SEQ ID NO: 4057281 - RNA, 15 nt, Staphylococcus aureus subsp. aureus N315
auguauaucuuuauu

SEQ ID NO: 4057282 - RNA, 17 nt, Staphylococcus aureus subsp. aureus N315
auguaucaagaucaaca

SEQ ID NO: 4057283 - RNA, 14 nt, Staphylococcus aureus subsp. aureus N315
auguaucuauacaa

SEQ ID NO: 4057284 - RNA, 20 nt, Staphylococcus aureus subsp. aureus N315
auguauguuuuaucaauauu

SEQ ID NO: 4057285 - RNA, 23 nt, Staphylococcus aureus subsp. aureus N315
auguauuaauugaauugauuaua

SEQ ID NO: 4057286 - RNA, 17 nt, Staphylococcus aureus subsp. aureus N315
auguauucuuagauauu

SEQ ID NO: 4057287 - RNA, 13 nt, Staphylococcus aureus subsp. aureus N315
auguauugcuaua

SEQ ID NO: 4057288 - RNA, 14 nt, Staphylococcus aureus subsp. aureus N315
auguauuuauuacu

SEQ ID NO: 4057289 - RNA, 20 nt, Staphylococcus aureus subsp. aureus N315
augucaaaucggcuauacau

SEQ ID NO: 4057290 - RNA, 19 nt, Staphylococcus aureus subsp. aureus N315
augucaauagcgguuuaaa

SEQ ID NO: 4057291 - RNA, 14 nt, Staphylococcus aureus subsp. aureus N315
augucacauaugac

SEQ ID NO: 4057292 - RNA, 15 nt, Staphylococcus aureus subsp. aureus N315
augucacauaugacu

SEQ ID NO: 4057293 - RNA, 16 nt, Staphylococcus aureus subsp. aureus N315
augucacauaugacuu

SEQ ID NO: 4057294 - RNA, 16 nt, Staphylococcus aureus subsp. aureus N315
augucauagccuauuu

SEQ ID NO: 4057295 - RNA, 23 nt, Staphylococcus aureus subsp. aureus N315
augucauaucuuuauuugauucu

SEQ ID NO: 4057296 - RNA, 15 nt, Staphylococcus aureus subsp. aureus N315
augucaugaaaauaa

SEQ ID NO: 4057297 - RNA, 20 nt, Staphylococcus aureus subsp. aureus N315
augucaugucuagauuuuaa

SEQ ID NO: 4057298 - RNA, 23 nt, Staphylococcus aureus subsp. aureus N315
auguccaucuuuuauuaaagaaa

SEQ ID NO: 4057299 - RNA, 16 nt, Staphylococcus aureus subsp. aureus N315
augucgaaaauagcua

SEQ ID NO: 4057300 - RNA, 16 nt, Staphylococcus aureus subsp. aureus N315
augucgauauuucuag

SEQ ID NO: 4057301 - RNA, 22 nt, Staphylococcus aureus subsp. aureus N315
augucguucaagaacaaucaau

SEQ ID NO: 4057302 - RNA, 16 nt, Staphylococcus aureus subsp. aureus N315
augucuagauuuuaaa

SEQ ID NO: 4057303 - RNA, 13 nt, Staphylococcus aureus subsp. aureus N315
augucuuaaaauu

SEQ ID NO: 4057304 - RNA, 23 nt, Staphylococcus aureus subsp. aureus N315
augucuuaaaauugaauaucacu

SEQ ID NO: 4057305 - RNA, 15 nt, Staphylococcus aureus subsp. aureus N315
augucuuuaauuguc

SEQ ID NO: 4057306 - RNA, 18 nt, Staphylococcus aureus subsp. aureus N315
augucuuucaaauacaca

SEQ ID NO: 4057307 - RNA, 14 nt, Staphylococcus aureus subsp. aureus N315
augucuuugaaaaa

SEQ ID NO: 4057308 - RNA, 15 nt, Staphylococcus aureus subsp. aureus N315
augucuuugaaaaac

SEQ ID NO: 4057309 - RNA, 21 nt, Staphylococcus aureus subsp. aureus N315
augucuuuuuuuaccuaauug

SEQ ID NO: 4057310 - RNA, 17 nt, Staphylococcus aureus subsp. aureus N315
augugaaaaagcuaauu

SEQ ID NO: 4057311 - RNA, 20 nt, Staphylococcus aureus subsp. aureus N315
augugaaaaagcuaauucuu

SEQ ID NO: 4057312 - RNA, 22 nt, Staphylococcus aureus subsp. aureus N315
augugaaauaaucccaaccauu

SEQ ID NO: 4057313 - RNA, 22 nt, Staphylococcus aureus subsp. aureus N315
augugaacaucuaguuauuuca

SEQ ID NO: 4057314 - RNA, 23 nt, Staphylococcus aureus subsp. aureus N315
augugaagugcgggggauuauuu

SEQ ID NO: 4057315 - RNA, 15 nt, Staphylococcus aureus subsp. aureus N315
augugacauaccagu

SEQ ID NO: 4057316 - RNA, 20 nt, Staphylococcus aureus subsp. aureus N315
augugcaacgguuugaaaaa

SEQ ID NO: 4057317 - RNA, 21 nt, Staphylococcus aureus subsp. aureus N315
augugcaagugguaaaaauga

SEQ ID NO: 4057318 - RNA, 21 nt, Staphylococcus aureus subsp. aureus N315
augugcaucauuuauaugaug

SEQ ID NO: 4057319 - RNA, 15 nt, Staphylococcus aureus subsp. aureus N315
augugccuuugcuuu

SEQ ID NO: 4057320 - RNA, 17 nt, Staphylococcus aureus subsp. aureus N315
augugcgucacucacuu

SEQ ID NO: 4057321 - RNA, 15 nt, Staphylococcus aureus subsp. aureus N315
augugcuaccuacuu

SEQ ID NO: 4057322 - RNA, 21 nt, Staphylococcus aureus subsp. aureus N315
augugcuuguaacaagcuuuu

SEQ ID NO: 4057323 - RNA, 15 nt, Staphylococcus aureus subsp. aureus N315
augugcuuuaucaac

SEQ ID NO: 4057324 - RNA, 14 nt, Staphylococcus aureus subsp. aureus N315
auguggcacucaua

SEQ ID NO: 4057325 - RNA, 17 nt, Staphylococcus aureus subsp. aureus N315
auguguaugaucaagcu

SEQ ID NO: 4057326 - RNA, 18 nt, Staphylococcus aureus subsp. aureus N315
augugucauaauccauuc

SEQ ID NO: 4057327 - RNA, 22 nt, Staphylococcus aureus subsp. aureus N315
auguguuaaucaacguauauaa

SEQ ID NO: 4057328 - RNA, 13 nt, Staphylococcus aureus subsp. aureus N315
auguguugcauua

SEQ ID NO: 4057329 - RNA, 14 nt, Staphylococcus aureus subsp. aureus N315
auguuaaacaauac

SEQ ID NO: 4057330 - RNA, 17 nt, Staphylococcus aureus subsp. aureus N315
auguuaaugucuuaaaa

SEQ ID NO: 4057331 - RNA, 15 nt, Staphylococcus aureus subsp. aureus N315
auguuacccuaauga

SEQ ID NO: 4057332 - RNA, 13 nt, Staphylococcus aureus subsp. aureus N315
auguuacugauga

SEQ ID NO: 4057333 - RNA, 16 nt, Staphylococcus aureus subsp. aureus N315
auguuacuuauauauu

SEQ ID NO: 4057334 - RNA, 17 nt, Staphylococcus aureus subsp. aureus N315
auguuacuuauauauuc

SEQ ID NO: 4057335 - RNA, 18 nt, Staphylococcus aureus subsp. aureus N315
auguuagugacaagguau

SEQ ID NO: 4057336 - RNA, 15 nt, Staphylococcus aureus subsp. aureus N315
auguuauaaaaugaa

SEQ ID NO: 4057337 - RNA, 13 nt, Staphylococcus aureus subsp. aureus N315
auguuaucgauau

SEQ ID NO: 4057338 - RNA, 20 nt, Staphylococcus aureus subsp. aureus N315
auguuaucgauauagcauaa

SEQ ID NO: 4057339 - RNA, 22 nt, Staphylococcus aureus subsp. aureus N315
auguuaucgauauagcauaaaa

SEQ ID NO: 4057340 - RNA, 18 nt, Staphylococcus aureus subsp. aureus N315
auguuauuaaccaucaug

SEQ ID NO: 4057341 - RNA, 15 nt, Staphylococcus aureus subsp. aureus N315
auguucagaaauuua

SEQ ID NO: 4057342 - RNA, 18 nt, Staphylococcus aureus subsp. aureus N315
auguucagaacuacaauu

SEQ ID NO: 4057343 - RNA, 18 nt, Staphylococcus aureus subsp. aureus N315
auguucagguucaaaauu

SEQ ID NO: 4057344 - RNA, 18 nt, Staphylococcus aureus subsp. aureus N315
auguucaucaacaugaua

SEQ ID NO: 4057345 - RNA, 16 nt, Staphylococcus aureus subsp. aureus N315
auguuccauauaaccu

SEQ ID NO: 4057346 - RNA, 17 nt, Staphylococcus aureus subsp. aureus N315
auguucccuuaccauuu

SEQ ID NO: 4057347 - RNA, 18 nt, Staphylococcus aureus subsp. aureus N315
auguuccgcuacaaaaca

SEQ ID NO: 4057348 - RNA, 20 nt, Staphylococcus aureus subsp. aureus N315
auguuccuuguuuuaaacuu

SEQ ID NO: 4057349 - RNA, 20 nt, Staphylococcus aureus subsp. aureus N315
auguucuuauaaaaaacaau

SEQ ID NO: 4057350 - RNA, 22 nt, Staphylococcus aureus subsp. aureus N315
auguugaagggaguauuuuuua

SEQ ID NO: 4057351 - RNA, 22 nt, Staphylococcus aureus subsp. aureus N315
auguugacauaccacuaaguga

SEQ ID NO: 4057352 - RNA, 19 nt, Staphylococcus aureus subsp. aureus N315
auguugacucguuauucaa

SEQ ID NO: 4057353 - RNA, 14 nt, Staphylococcus aureus subsp. aureus N315
auguugauaaaaag

SEQ ID NO: 4057354 - RNA, 20 nt, Staphylococcus aureus subsp. aureus N315
auguuggaaaaggucaaaaa

SEQ ID NO: 4057355 - RNA, 18 nt, Staphylococcus aureus subsp. aureus N315
auguugucacuuggauuc

SEQ ID NO: 4057356 - RNA, 13 nt, Staphylococcus aureus subsp. aureus N315
auguuuaaaaaac

SEQ ID NO: 4057357 - RNA, 14 nt, Staphylococcus aureus subsp. aureus N315
auguuuaaaaaacu

SEQ ID NO: 4057358 - RNA, 13 nt, Staphylococcus aureus subsp. aureus N315
auguuuaaacauu

SEQ ID NO: 4057359 - RNA, 20 nt, Staphylococcus aureus subsp. aureus N315
auguuuaauuugauuaaauu

SEQ ID NO: 4057360 - RNA, 14 nt, Staphylococcus aureus subsp. aureus N315
auguuuaauuuucu

SEQ ID NO: 4057361 - RNA, 14 nt, Staphylococcus aureus subsp. aureus N315
auguuuaugacaaa

SEQ ID NO: 4057362 - RNA, 15 nt, Staphylococcus aureus subsp. aureus N315
auguuugauucuaaa

SEQ ID NO: 4057363 - RNA, 21 nt, Staphylococcus aureus subsp. aureus N315
auguuugcauaccuauaaaca

SEQ ID NO: 4057364 - RNA, 16 nt, Staphylococcus aureus subsp. aureus N315
auguuugccagguaaa

SEQ ID NO: 4057365 - RNA, 17 nt, Staphylococcus aureus subsp. aureus N315
auguuuggaugaacaaa

SEQ ID NO: 4057366 - RNA, 22 nt, Staphylococcus aureus subsp. aureus N315
auguuugggauauagaaaaggg

SEQ ID NO: 4057367 - RNA, 23 nt, Staphylococcus aureus subsp. aureus N315
auguuugggauauagaaaaggga

SEQ ID NO: 4057368 - RNA, 21 nt, Staphylococcus aureus subsp. aureus N315
auguuuuagugacaaacauuu

SEQ ID NO: 4057369 - RNA, 14 nt, Staphylococcus aureus subsp. aureus N315
auguuuuauacauu

SEQ ID NO: 4057370 - RNA, 17 nt, Staphylococcus aureus subsp. aureus N315
auguuuucuaguuuaac

SEQ ID NO: 4057371 - RNA, 21 nt, Staphylococcus aureus subsp. aureus N315
auguuuuuaacagcuuuuucu

SEQ ID NO: 4057372 - RNA, 15 nt, Staphylococcus aureus subsp. aureus N315
auguuuuuuaaguac

SEQ ID NO: 4057373 - RNA, 14 nt, Staphylococcus aureus subsp. aureus N315
auuaaaaaaucauu

SEQ ID NO: 4057374 - RNA, 13 nt, Staphylococcus aureus subsp. aureus N315
auuaaaaaucaaa

SEQ ID NO: 4057375 - RNA, 14 nt, Staphylococcus aureus subsp. aureus N315
auuaaaaauuucaa

SEQ ID NO: 4057376 - RNA, 18 nt, Staphylococcus aureus subsp. aureus N315
auuaaaacagcaaauaaa

SEQ ID NO: 4057377 - RNA, 20 nt, Staphylococcus aureus subsp. aureus N315
auuaaaaguguugacuuuau

SEQ ID NO: 4057378 - RNA, 15 nt, Staphylococcus aureus subsp. aureus N315
auuaaaauaauuaaa

SEQ ID NO: 4057379 - RNA, 14 nt, Staphylococcus aureus subsp. aureus N315
auuaaaaucugcuu

SEQ ID NO: 4057380 - RNA, 12 nt, Staphylococcus aureus subsp. aureus N315
auuaaaaugaua

SEQ ID NO: 4057381 - RNA, 12 nt, Staphylococcus aureus subsp. aureus N315
auuaaaauguua

SEQ ID NO: 4057382 - RNA, 18 nt, Staphylococcus aureus subsp. aureus N315
auuaaaauuaaauaauga

SEQ ID NO: 4057383 - RNA, 21 nt, Staphylococcus aureus subsp. aureus N315
auuaaaauuacgguuugcuuu

SEQ ID NO: 4057384 - RNA, 20 nt, Staphylococcus aureus subsp. aureus N315
auuaaacauuuagauuucau

SEQ ID NO: 4057385 - RNA, 21 nt, Staphylococcus aureus subsp. aureus N315
auuaaacauuuagauuucaug

SEQ ID NO: 4057386 - RNA, 17 nt, Staphylococcus aureus subsp. aureus N315
auuaaacgcaauuaacc

SEQ ID NO: 4057387 - RNA, 19 nt, Staphylococcus aureus subsp. aureus N315
auuaaacucaaaaagccaa

SEQ ID NO: 4057388 - RNA, 19 nt, Staphylococcus aureus subsp. aureus N315
auuaaacuuauaacuuuau

SEQ ID NO: 4057389 - RNA, 16 nt, Staphylococcus aureus subsp. aureus N315
auuaaagcaaauuaua

SEQ ID NO: 4057390 - RNA, 18 nt, Staphylococcus aureus subsp. aureus N315
auuaaagcaucgaacaau

SEQ ID NO: 4057391 - RNA, 20 nt, Staphylococcus aureus subsp. aureus N315
auuaaagcaucuucaauauu

SEQ ID NO: 4057392 - RNA, 20 nt, Staphylococcus aureus subsp. aureus N315
auuaaagcuagaaacaaugc

SEQ ID NO: 4057393 - RNA, 20 nt, Staphylococcus aureus subsp. aureus N315
auuaaagcuaucuucagauu

SEQ ID NO: 4057394 - RNA, 16 nt, Staphylococcus aureus subsp. aureus N315
auuaaaggaaaucaau

SEQ ID NO: 4057395 - RNA, 21 nt, Staphylococcus aureus subsp. aureus N315
auuaaaggaaaucaauccauc

SEQ ID NO: 4057396 - RNA, 13 nt, Staphylococcus aureus subsp. aureus N315
auuaaaguagcag

SEQ ID NO: 4057397 - RNA, 15 nt, Staphylococcus aureus subsp. aureus N315
auuaaagugaauauu

SEQ ID NO: 4057398 - RNA, 17 nt, Staphylococcus aureus subsp. aureus N315
auuaaaguguuucaaca

SEQ ID NO: 4057399 - RNA, 16 nt, Staphylococcus aureus subsp. aureus N315
auuaaaguuaaagacu

SEQ ID NO: 4057400 - RNA, 22 nt, Staphylococcus aureus subsp. aureus N315
auuaaauauuuaaccuuuaaaa

SEQ ID NO: 4057401 - RNA, 15 nt, Staphylococcus aureus subsp. aureus N315
auuaaaucaacaaga

SEQ ID NO: 4057402 - RNA, 22 nt, Staphylococcus aureus subsp. aureus N315
auuaaauccgcuuguucaacua

SEQ ID NO: 4057403 - RNA, 16 nt, Staphylococcus aureus subsp. aureus N315
auuaaaucgauuaaga

SEQ ID NO: 4057404 - RNA, 13 nt, Staphylococcus aureus subsp. aureus N315
auuaaaucugcuu

SEQ ID NO: 4057405 - RNA, 12 nt, Staphylococcus aureus subsp. aureus N315
auuaaaugcaau

SEQ ID NO: 4057406 - RNA, 17 nt, Staphylococcus aureus subsp. aureus N315
auuaaaugcaauacauu

SEQ ID NO: 4057407 - RNA, 20 nt, Staphylococcus aureus subsp. aureus N315
auuaaauguuuacgaaguuc

SEQ ID NO: 4057408 - RNA, 16 nt, Staphylococcus aureus subsp. aureus N315
auuaaauucaaaucug

SEQ ID NO: 4057409 - RNA, 22 nt, Staphylococcus aureus subsp. aureus N315
auuaaauucuuuucaagaaauu

SEQ ID NO: 4057410 - RNA, 23 nt, Staphylococcus aureus subsp. aureus N315
auuaaauucuuuucaagaaauuc

SEQ ID NO: 4057411 - RNA, 18 nt, Staphylococcus aureus subsp. aureus N315
auuaaauuugaaaguaaa

SEQ ID NO: 4057412 - RNA, 19 nt, Staphylococcus aureus subsp. aureus N315
auuaaauuuuguauaaccu

SEQ ID NO: 4057413 - RNA, 20 nt, Staphylococcus aureus subsp. aureus N315
auuaaauuuuguauaaccuu

SEQ ID NO: 4057414 - RNA, 19 nt, Staphylococcus aureus subsp. aureus N315
auuaaauuuuguuaggaga

SEQ ID NO: 4057415 - RNA, 16 nt, Staphylococcus aureus subsp. aureus N315
auuaacaacaaauaua

SEQ ID NO: 4057416 - RNA, 17 nt, Staphylococcus aureus subsp. aureus N315
auuaacaauauuaaauu

SEQ ID NO: 4057417 - RNA, 22 nt, Staphylococcus aureus subsp. aureus N315
auuaacacgaacugcauaggua

SEQ ID NO: 4057418 - RNA, 14 nt, Staphylococcus aureus subsp. aureus N315
auuaacauuaucca

SEQ ID NO: 4057419 - RNA, 22 nt, Staphylococcus aureus subsp. aureus N315
auuaacauuuugaaucauacga

SEQ ID NO: 4057420 - RNA, 23 nt, Staphylococcus aureus subsp. aureus N315
auuaacauuuugaaucauacgaa

SEQ ID NO: 4057421 - RNA, 15 nt, Staphylococcus aureus subsp. aureus N315
auuaaccaucaugac

SEQ ID NO: 4057422 - RNA, 19 nt, Staphylococcus aureus subsp. aureus N315
auuaaccuugauuuaauuu

SEQ ID NO: 4057423 - RNA, 16 nt, Staphylococcus aureus subsp. aureus N315
auuaacgucaacagca

SEQ ID NO: 4057424 - RNA, 22 nt, Staphylococcus aureus subsp. aureus N315
auuaacuguuagacuugguuac

SEQ ID NO: 4057425 - RNA, 18 nt, Staphylococcus aureus subsp. aureus N315
auuaacuuaaaauuuaaa

SEQ ID NO: 4057426 - RNA, 20 nt, Staphylococcus aureus subsp. aureus N315
auuaacuuaaaauuuaaaua

SEQ ID NO: 4057427 - RNA, 22 nt, Staphylococcus aureus subsp. aureus N315
auuaacuuaaaauuuaaauauu

SEQ ID NO: 4057428 - RNA, 21 nt, Staphylococcus aureus subsp. aureus N315
auuaacuuacuuuuguaaaaa

SEQ ID NO: 4057429 - RNA, 16 nt, Staphylococcus aureus subsp. aureus N315
auuaacuugauaucau

SEQ ID NO: 4057430 - RNA, 15 nt, Staphylococcus aureus subsp. aureus N315
auuaagaaaaucauu

SEQ ID NO: 4057431 - RNA, 22 nt, Staphylococcus aureus subsp. aureus N315
auuaagaaugcaccaacaauag

SEQ ID NO: 4057432 - RNA, 17 nt, Staphylococcus aureus subsp. aureus N315
auuaagacugauuaauu

SEQ ID NO: 4057433 - RNA, 21 nt, Staphylococcus aureus subsp. aureus N315
auuaagccaucccaacuuaau

SEQ ID NO: 4057434 - RNA, 19 nt, Staphylococcus aureus subsp. aureus N315
auuaagcuugaaacaaggu

SEQ ID NO: 4057435 - RNA, 14 nt, Staphylococcus aureus subsp. aureus N315
auuaagcuuuguuu

SEQ ID NO: 4057436 - RNA, 15 nt, Staphylococcus aureus subsp. aureus N315
auuaaguauaucuuu

SEQ ID NO: 4057437 - RNA, 16 nt, Staphylococcus aureus subsp. aureus N315
auuaagugcaauaaca

SEQ ID NO: 4057438 - RNA, 18 nt, Staphylococcus aureus subsp. aureus N315
auuaauaacauccccaaa

SEQ ID NO: 4057439 - RNA, 18 nt, Staphylococcus aureus subsp. aureus N315
auuaauaagcauuaaugu

SEQ ID NO: 4057440 - RNA, 15 nt, Staphylococcus aureus subsp. aureus N315
auuaauacaucaaua

SEQ ID NO: 4057441 - RNA, 14 nt, Staphylococcus aureus subsp. aureus N315
auuaauagaaagug

SEQ ID NO: 4057442 - RNA, 15 nt, Staphylococcus aureus subsp. aureus N315
auuaauagaaagugc

SEQ ID NO: 4057443 - RNA, 12 nt, Staphylococcus aureus subsp. aureus N315
auuaauagagac

SEQ ID NO: 4057444 - RNA, 20 nt, Staphylococcus aureus subsp. aureus N315
auuaauaggauuauuaucaa

SEQ ID NO: 4057445 - RNA, 18 nt, Staphylococcus aureus subsp. aureus N315
auuaaucauaaugaauaa

SEQ ID NO: 4057446 - RNA, 12 nt, Staphylococcus aureus subsp. aureus N315
auuaaucauuua

SEQ ID NO: 4057447 - RNA, 18 nt, Staphylococcus aureus subsp. aureus N315
auuaaucccuucaaaauu

SEQ ID NO: 4057448 - RNA, 20 nt, Staphylococcus aureus subsp. aureus N315
auuaaugcucuauauaucca

SEQ ID NO: 4057449 - RNA, 17 nt, Staphylococcus aureus subsp. aureus N315
auuaauggcaacuaaga

SEQ ID NO: 4057450 - RNA, 18 nt, Staphylococcus aureus subsp. aureus N315
auuaauggcaacuaagau

SEQ ID NO: 4057451 - RNA, 14 nt, Staphylococcus aureus subsp. aureus N315
auuaauuaaagauu

SEQ ID NO: 4057452 - RNA, 12 nt, Staphylococcus aureus subsp. aureus N315
auuaauuaacaa

SEQ ID NO: 4057453 - RNA, 21 nt, Staphylococcus aureus subsp. aureus N315
auuaauuacaggaauugcuuu

SEQ ID NO: 4057454 - RNA, 18 nt, Staphylococcus aureus subsp. aureus N315
auuaauuacagguuuaau

SEQ ID NO: 4057455 - RNA, 15 nt, Staphylococcus aureus subsp. aureus N315
auuaauuaucauaaa

SEQ ID NO: 4057456 - RNA, 21 nt, Staphylococcus aureus subsp. aureus N315
auuaauuauugagaauauuua

SEQ ID NO: 4057457 - RNA, 15 nt, Staphylococcus aureus subsp. aureus N315
auuaauucugauuau

SEQ ID NO: 4057458 - RNA, 13 nt, Staphylococcus aureus subsp. aureus N315
auuaauugaaaaa

SEQ ID NO: 4057459 - RNA, 17 nt, Staphylococcus aureus subsp. aureus N315
auuaauugaaaaaccaa

SEQ ID NO: 4057460 - RNA, 15 nt, Staphylococcus aureus subsp. aureus N315
auuaauuggauuuuu

SEQ ID NO: 4057461 - RNA, 20 nt, Staphylococcus aureus subsp. aureus N315
auuaauuuacucaaaccauc

SEQ ID NO: 4057462 - RNA, 21 nt, Staphylococcus aureus subsp. aureus N315
auuaauuuacucaaaccaucu

SEQ ID NO: 4057463 - RNA, 15 nt, Staphylococcus aureus subsp. aureus N315
auuaauuugaaugcc

SEQ ID NO: 4057464 - RNA, 13 nt, Staphylococcus aureus subsp. aureus N315
auuaauuugauaa

SEQ ID NO: 4057465 - RNA, 23 nt, Staphylococcus aureus subsp. aureus N315
auuaauuuguccauccauuuuag

SEQ ID NO: 4057466 - RNA, 19 nt, Staphylococcus aureus subsp. aureus N315
auuaauuuucuuuuuuaau

SEQ ID NO: 4057467 - RNA, 12 nt, Staphylococcus aureus subsp. aureus N315
auuacaauaagg

SEQ ID NO: 4057468 - RNA, 14 nt, Staphylococcus aureus subsp. aureus N315
auuacaauaaggac

SEQ ID NO: 4057469 - RNA, 15 nt, Staphylococcus aureus subsp. aureus N315
auuacaaugaaaaaa

SEQ ID NO: 4057470 - RNA, 18 nt, Staphylococcus aureus subsp. aureus N315
auuacaaugaaaaaacga

SEQ ID NO: 4057471 - RNA, 12 nt, Staphylococcus aureus subsp. aureus N315
auuacagaugau

SEQ ID NO: 4057472 - RNA, 20 nt, Staphylococcus aureus subsp. aureus N315
auuacagcguacuaaagaau

SEQ ID NO: 4057473 - RNA, 19 nt, Staphylococcus aureus subsp. aureus N315
auuacagguuuaaacaucu

SEQ ID NO: 4057474 - RNA, 18 nt, Staphylococcus aureus subsp. aureus N315
auuacagguuuaauugac

SEQ ID NO: 4057475 - RNA, 20 nt, Staphylococcus aureus subsp. aureus N315
auuacagguuuaauugacac

SEQ ID NO: 4057476 - RNA, 14 nt, Staphylococcus aureus subsp. aureus N315
auuacauaauuuau

SEQ ID NO: 4057477 - RNA, 14 nt, Staphylococcus aureus subsp. aureus N315
auuacauuuuaugu

SEQ ID NO: 4057478 - RNA, 17 nt, Staphylococcus aureus subsp. aureus N315
auuacauuuuaugucca

SEQ ID NO: 4057479 - RNA, 13 nt, Staphylococcus aureus subsp. aureus N315
auuaccagcaauu

SEQ ID NO: 4057480 - RNA, 16 nt, Staphylococcus aureus subsp. aureus N315
auuaccauaacuuuau

SEQ ID NO: 4057481 - RNA, 13 nt, Staphylococcus aureus subsp. aureus N315
auuaccauauaaa

SEQ ID NO: 4057482 - RNA, 15 nt, Staphylococcus aureus subsp. aureus N315
auuaccauauaaagc

SEQ ID NO: 4057483 - RNA, 16 nt, Staphylococcus aureus subsp. aureus N315
auuacccuuuaaacuc

SEQ ID NO: 4057484 - RNA, 20 nt, Staphylococcus aureus subsp. aureus N315
auuaccuggguauacagguu

SEQ ID NO: 4057485 - RNA, 17 nt, Staphylococcus aureus subsp. aureus N315
auuacgcucauaugucu

SEQ ID NO: 4057486 - RNA, 16 nt, Staphylococcus aureus subsp. aureus N315
auuacguuuacuagaa

SEQ ID NO: 4057487 - RNA, 20 nt, Staphylococcus aureus subsp. aureus N315
auuacuacuuuauaaauauc

SEQ ID NO: 4057488 - RNA, 23 nt, Staphylococcus aureus subsp. aureus N315
auuacuacuuuauaaauaucuuu

SEQ ID NO: 4057489 - RNA, 14 nt, Staphylococcus aureus subsp. aureus N315
auuacuauaaaaaa

SEQ ID NO: 4057490 - RNA, 17 nt, Staphylococcus aureus subsp. aureus N315
auuacuauauuuaaauu

SEQ ID NO: 4057491 - RNA, 17 nt, Staphylococcus aureus subsp. aureus N315
auuacuaucuucaucau

SEQ ID NO: 4057492 - RNA, 22 nt, Staphylococcus aureus subsp. aureus N315
auuacucaaaauuaaagcuuaa

SEQ ID NO: 4057493 - RNA, 20 nt, Staphylococcus aureus subsp. aureus N315
auuacuccaauuaccaauga

SEQ ID NO: 4057494 - RNA, 22 nt, Staphylococcus aureus subsp. aureus N315
auuacucuggucugugauauuc

SEQ ID NO: 4057495 - RNA, 15 nt, Staphylococcus aureus subsp. aureus N315
auuacucuuuuucuu

SEQ ID NO: 4057496 - RNA, 15 nt, Staphylococcus aureus subsp. aureus N315
auuacugauuguuaa

SEQ ID NO: 4057497 - RNA, 19 nt, Staphylococcus aureus subsp. aureus N315
auuacugcagcaucauaau

SEQ ID NO: 4057498 - RNA, 15 nt, Staphylococcus aureus subsp. aureus N315
auuacuguuugcuuu

SEQ ID NO: 4057499 - RNA, 21 nt, Staphylococcus aureus subsp. aureus N315
auuacuguuugcuuuaucaau

SEQ ID NO: 4057500 - RNA, 15 nt, Staphylococcus aureus subsp. aureus N315
auuacuuaauaguaa

SEQ ID NO: 4057501 - RNA, 22 nt, Staphylococcus aureus subsp. aureus N315
auuacuuagcaaacaauuuugu

SEQ ID NO: 4057502 - RNA, 17 nt, Staphylococcus aureus subsp. aureus N315
auuacuugcacaccagu

SEQ ID NO: 4057503 - RNA, 17 nt, Staphylococcus aureus subsp. aureus N315
auuacuuucauuguaaa

SEQ ID NO: 4057504 - RNA, 15 nt, Staphylococcus aureus subsp. aureus N315
auuacuuuggaaauu

SEQ ID NO: 4057505 - RNA, 16 nt, Staphylococcus aureus subsp. aureus N315
auuagaaaauuucuca

SEQ ID NO: 4057506 - RNA, 14 nt, Staphylococcus aureus subsp. aureus N315
auuagaaccaucau

SEQ ID NO: 4057507 - RNA, 14 nt, Staphylococcus aureus subsp. aureus N315
auuagaauauaugu

SEQ ID NO: 4057508 - RNA, 21 nt, Staphylococcus aureus subsp. aureus N315
auuagagagcacgagaaaugu

SEQ ID NO: 4057509 - RNA, 23 nt, Staphylococcus aureus subsp. aureus N315
auuagagagcacgagaaauguca

SEQ ID NO: 4057510 - RNA, 21 nt, Staphylococcus aureus subsp. aureus N315
auuagagccuacucauauuca

SEQ ID NO: 4057511 - RNA, 14 nt, Staphylococcus aureus subsp. aureus N315
auuagauacuucuu

SEQ ID NO: 4057512 - RNA, 22 nt, Staphylococcus aureus subsp. aureus N315
auuagauaucuuaaucuaaaaa

SEQ ID NO: 4057513 - RNA, 13 nt, Staphylococcus aureus subsp. aureus N315
auuagauuuuaug

SEQ ID NO: 4057514 - RNA, 17 nt, Staphylococcus aureus subsp. aureus N315
auuagcaauuuggucau

SEQ ID NO: 4057515 - RNA, 20 nt, Staphylococcus aureus subsp. aureus N315
auuagcgaaaacuaaaggga

SEQ ID NO: 4057516 - RNA, 21 nt, Staphylococcus aureus subsp. aureus N315
auuagcgcaccaauuaucaac

SEQ ID NO: 4057517 - RNA, 14 nt, Staphylococcus aureus subsp. aureus N315
auuaggauguucag

SEQ ID NO: 4057518 - RNA, 23 nt, Staphylococcus aureus subsp. aureus N315
auuaggauuaacauaacuagcaa

SEQ ID NO: 4057519 - RNA, 19 nt, Staphylococcus aureus subsp. aureus N315
auuaggauuagcguuagau

SEQ ID NO: 4057520 - RNA, 16 nt, Staphylococcus aureus subsp. aureus N315
auuaggauucaauaau

SEQ ID NO: 4057521 - RNA, 23 nt, Staphylococcus aureus subsp. aureus N315
auuaggcuuaaauauaaugaucc

SEQ ID NO: 4057522 - RNA, 14 nt, Staphylococcus aureus subsp. aureus N315
auuagguaauacuu

SEQ ID NO: 4057523 - RNA, 20 nt, Staphylococcus aureus subsp. aureus N315
auuaggucuacgaucaaaau

SEQ ID NO: 4057524 - RNA, 19 nt, Staphylococcus aureus subsp. aureus N315
auuagguuucgauucauuu

SEQ ID NO: 4057525 - RNA, 12 nt, Staphylococcus aureus subsp. aureus N315
auuaguaaauau

SEQ ID NO: 4057526 - RNA, 20 nt, Staphylococcus aureus subsp. aureus N315
auuaguacuaaaccgauuaa

SEQ ID NO: 4057527 - RNA, 15 nt, Staphylococcus aureus subsp. aureus N315
auuaguauaauuuau

SEQ ID NO: 4057528 - RNA, 19 nt, Staphylococcus aureus subsp. aureus N315
auuaguaugacuuaccuaa

SEQ ID NO: 4057529 - RNA, 15 nt, Staphylococcus aureus subsp. aureus N315
auuagucaucaaccu

SEQ ID NO: 4057530 - RNA, 23 nt, Staphylococcus aureus subsp. aureus N315
auuagucauccaaagaaacggaa

SEQ ID NO: 4057531 - RNA, 13 nt, Staphylococcus aureus subsp. aureus N315
auuaguuauacua

SEQ ID NO: 4057532 - RNA, 12 nt, Staphylococcus aureus subsp. aureus N315
auuauaaaauaa

SEQ ID NO: 4057533 - RNA, 13 nt, Staphylococcus aureus subsp. aureus N315
auuauaaaauaaa

SEQ ID NO: 4057534 - RNA, 18 nt, Staphylococcus aureus subsp. aureus N315
auuauaaauauuuuuugg

SEQ ID NO: 4057535 - RNA, 18 nt, Staphylococcus aureus subsp. aureus N315
auuauaaaugaaucgcuu

SEQ ID NO: 4057536 - RNA, 22 nt, Staphylococcus aureus subsp. aureus N315
auuauaaccacaccaugcugca

SEQ ID NO: 4057537 - RNA, 16 nt, Staphylococcus aureus subsp. aureus N315
auuauaaccgcuacaa

SEQ ID NO: 4057538 - RNA, 21 nt, Staphylococcus aureus subsp. aureus N315
auuauaaguugcauauaaaaa

SEQ ID NO: 4057539 - RNA, 14 nt, Staphylococcus aureus subsp. aureus N315
auuauaauaaauag

SEQ ID NO: 4057540 - RNA, 16 nt, Staphylococcus aureus subsp. aureus N315
auuauaaugauuuuua

SEQ ID NO: 4057541 - RNA, 23 nt, Staphylococcus aureus subsp. aureus N315
auuauaauuuuguuucacuacgu

SEQ ID NO: 4057542 - RNA, 21 nt, Staphylococcus aureus subsp. aureus N315
auuauacgugcuuuaaaguug

SEQ ID NO: 4057543 - RNA, 23 nt, Staphylococcus aureus subsp. aureus N315
auuauagcagguggcauccauau

SEQ ID NO: 4057544 - RNA, 19 nt, Staphylococcus aureus subsp. aureus N315
auuauagggcuguuuuuuu

SEQ ID NO: 4057545 - RNA, 16 nt, Staphylococcus aureus subsp. aureus N315
auuauagguauaagaa

SEQ ID NO: 4057546 - RNA, 20 nt, Staphylococcus aureus subsp. aureus N315
auuauagucuuaaacauaac

SEQ ID NO: 4057547 - RNA, 23 nt, Staphylococcus aureus subsp. aureus N315
auuauaguuucgucuacuauuuu

SEQ ID NO: 4057548 - RNA, 16 nt, Staphylococcus aureus subsp. aureus N315
auuauauaauucuuca

SEQ ID NO: 4057549 - RNA, 17 nt, Staphylococcus aureus subsp. aureus N315
auuauauagaaaacuag

SEQ ID NO: 4057550 - RNA, 13 nt, Staphylococcus aureus subsp. aureus N315
auuauauauauua

SEQ ID NO: 4057551 - RNA, 15 nt, Staphylococcus aureus subsp. aureus N315
auuauauauauuaaa

SEQ ID NO: 4057552 - RNA, 21 nt, Staphylococcus aureus subsp. aureus N315
auuauauggagcuacccuauu

SEQ ID NO: 4057553 - RNA, 21 nt, Staphylococcus aureus subsp. aureus N315
auuauaugguucguccauuca

SEQ ID NO: 4057554 - RNA, 14 nt, Staphylococcus aureus subsp. aureus N315
auuauauuuucuca

SEQ ID NO: 4057555 - RNA, 13 nt, Staphylococcus aureus subsp. aureus N315
auuauauuuuucu

SEQ ID NO: 4057556 - RNA, 21 nt, Staphylococcus aureus subsp. aureus N315
auuauauuuuucuucaguuaa

SEQ ID NO: 4057557 - RNA, 22 nt, Staphylococcus aureus subsp. aureus N315
auuauauuuuucuucaguuaaa

SEQ ID NO: 4057558 - RNA, 13 nt, Staphylococcus aureus subsp. aureus N315
auuaucaaagaaa

SEQ ID NO: 4057559 - RNA, 14 nt, Staphylococcus aureus subsp. aureus N315
auuaucaacauaau

SEQ ID NO: 4057560 - RNA, 18 nt, Staphylococcus aureus subsp. aureus N315
auuaucaccuucaaacuu

SEQ ID NO: 4057561 - RNA, 15 nt, Staphylococcus aureus subsp. aureus N315
auuaucauaaagaua

SEQ ID NO: 4057562 - RNA, 19 nt, Staphylococcus aureus subsp. aureus N315
auuaucauauaaaucaaau

SEQ ID NO: 4057563 - RNA, 20 nt, Staphylococcus aureus subsp. aureus N315
auuaucauauaaaucaaaua

SEQ ID NO: 4057564 - RNA, 18 nt, Staphylococcus aureus subsp. aureus N315
auuaucauaugaacaaua

SEQ ID NO: 4057565 - RNA, 14 nt, Staphylococcus aureus subsp. aureus N315
auuaucauuaaauu

SEQ ID NO: 4057566 - RNA, 13 nt, Staphylococcus aureus subsp. aureus N315
auuaucauuaacc

SEQ ID NO: 4057567 - RNA, 14 nt, Staphylococcus aureus subsp. aureus N315
auuauccuacugcu

SEQ ID NO: 4057568 - RNA, 20 nt, Staphylococcus aureus subsp. aureus N315
auuaucgaagaaacauuaua

SEQ ID NO: 4057569 - RNA, 21 nt, Staphylococcus aureus subsp. aureus N315
auuaucgaagaaacauuauau

SEQ ID NO: 4057570 - RNA, 15 nt, Staphylococcus aureus subsp. aureus N315
auuaucguaaaaaaa

SEQ ID NO: 4057571 - RNA, 20 nt, Staphylococcus aureus subsp. aureus N315
auuaucguaauuguuaaacc

SEQ ID NO: 4057572 - RNA, 15 nt, Staphylococcus aureus subsp. aureus N315
auuaucuaaagaaau

SEQ ID NO: 4057573 - RNA, 13 nt, Staphylococcus aureus subsp. aureus N315
auuaucuaacuca

SEQ ID NO: 4057574 - RNA, 15 nt, Staphylococcus aureus subsp. aureus N315
auuaucuaacucaua

SEQ ID NO: 4057575 - RNA, 21 nt, Staphylococcus aureus subsp. aureus N315
auuaucuaacucauaaucaac

SEQ ID NO: 4057576 - RNA, 15 nt, Staphylococcus aureus subsp. aureus N315
auuaucuauccauuu

SEQ ID NO: 4057577 - RNA, 20 nt, Staphylococcus aureus subsp. aureus N315
auuaucuauccauuugguuu

SEQ ID NO: 4057578 - RNA, 22 nt, Staphylococcus aureus subsp. aureus N315
auuaucuauccauuugguuuaa

SEQ ID NO: 4057579 - RNA, 22 nt, Staphylococcus aureus subsp. aureus N315
auuaucuguaauuaauccaucu

SEQ ID NO: 4057580 - RNA, 20 nt, Staphylococcus aureus subsp. aureus N315
auuaucuuaagucaucaauc

SEQ ID NO: 4057581 - RNA, 22 nt, Staphylococcus aureus subsp. aureus N315
auuaucuuuacgauaaacuaaa

SEQ ID NO: 4057582 - RNA, 22 nt, Staphylococcus aureus subsp. aureus N315
auuaucuuuaguauuucaucau

SEQ ID NO: 4057583 - RNA, 18 nt, Staphylococcus aureus subsp. aureus N315
auuaucuuuguaaauuuu

SEQ ID NO: 4057584 - RNA, 14 nt, Staphylococcus aureus subsp. aureus N315
auuaugaaaaguaa

SEQ ID NO: 4057585 - RNA, 13 nt, Staphylococcus aureus subsp. aureus N315
auuaugacaacau

SEQ ID NO: 4057586 - RNA, 15 nt, Staphylococcus aureus subsp. aureus N315
auuaugacuaacauu

SEQ ID NO: 4057587 - RNA, 21 nt, Staphylococcus aureus subsp. aureus N315
auuaugaggcugaguauacca

SEQ ID NO: 4057588 - RNA, 20 nt, Staphylococcus aureus subsp. aureus N315
auuaugauacgcuuuuuaaa

SEQ ID NO: 4057589 - RNA, 22 nt, Staphylococcus aureus subsp. aureus N315
auuaugauacgcuuuuuaaaaa

SEQ ID NO: 4057590 - RNA, 19 nt, Staphylococcus aureus subsp. aureus N315
auuaugauugcuuauuuau

SEQ ID NO: 4057591 - RNA, 14 nt, Staphylococcus aureus subsp. aureus N315
auuaugcccaacca

SEQ ID NO: 4057592 - RNA, 23 nt, Staphylococcus aureus subsp. aureus N315
auuaugcccgauaauucuaacuu

SEQ ID NO: 4057593 - RNA, 19 nt, Staphylococcus aureus subsp. aureus N315
auuaugccuuugauuuuac

SEQ ID NO: 4057594 - RNA, 11 nt, Staphylococcus aureus subsp. aureus N315
auuauggagcg

SEQ ID NO: 4057595 - RNA, 15 nt, Staphylococcus aureus subsp. aureus N315
auuauggagcggaag

SEQ ID NO: 4057596 - RNA, 17 nt, Staphylococcus aureus subsp. aureus N315
auuauggagcggaagau

SEQ ID NO: 4057597 - RNA, 14 nt, Staphylococcus aureus subsp. aureus N315
auuauguaaaaaau

SEQ ID NO: 4057598 - RNA, 18 nt, Staphylococcus aureus subsp. aureus N315
auuauguaaaaaauaucu

SEQ ID NO: 4057599 - RNA, 22 nt, Staphylococcus aureus subsp. aureus N315
auuauguaaaaaauaucuuguc

SEQ ID NO: 4057600 - RNA, 14 nt, Staphylococcus aureus subsp. aureus N315
auuauguagcuuug

SEQ ID NO: 4057601 - RNA, 21 nt, Staphylococcus aureus subsp. aureus N315
auuaugucgagguguuuuuuu

SEQ ID NO: 4057602 - RNA, 13 nt, Staphylococcus aureus subsp. aureus N315
auuaugugacaua

SEQ ID NO: 4057603 - RNA, 17 nt, Staphylococcus aureus subsp. aureus N315
auuauguuauaaauucu

SEQ ID NO: 4057604 - RNA, 13 nt, Staphylococcus aureus subsp. aureus N315
auuauuaaaucaa

SEQ ID NO: 4057605 - RNA, 19 nt, Staphylococcus aureus subsp. aureus N315
auuauuaaauuauggagcg

SEQ ID NO: 4057606 - RNA, 14 nt, Staphylococcus aureus subsp. aureus N315
auuauuaacuguac

SEQ ID NO: 4057607 - RNA, 19 nt, Staphylococcus aureus subsp. aureus N315
auuauuaagugaguuuuau

SEQ ID NO: 4057608 - RNA, 15 nt, Staphylococcus aureus subsp. aureus N315
auuauuacaaugaaa

SEQ ID NO: 4057609 - RNA, 16 nt, Staphylococcus aureus subsp. aureus N315
auuauuacaaugaaaa

SEQ ID NO: 4057610 - RNA, 14 nt, Staphylococcus aureus subsp. aureus N315
auuauuaccauaac

SEQ ID NO: 4057611 - RNA, 13 nt, Staphylococcus aureus subsp. aureus N315
auuauuaccauau

SEQ ID NO: 4057612 - RNA, 22 nt, Staphylococcus aureus subsp. aureus N315
auuauuaggcggccaguccauu

SEQ ID NO: 4057613 - RNA, 16 nt, Staphylococcus aureus subsp. aureus N315
auuauuauaauaaaua

SEQ ID NO: 4057614 - RNA, 19 nt, Staphylococcus aureus subsp. aureus N315
auuauuaugccuuugauuu

SEQ ID NO: 4057615 - RNA, 15 nt, Staphylococcus aureus subsp. aureus N315
auuauuauuuaaauu

SEQ ID NO: 4057616 - RNA, 14 nt, Staphylococcus aureus subsp. aureus N315
auuauuauuuuaau

SEQ ID NO: 4057617 - RNA, 21 nt, Staphylococcus aureus subsp. aureus N315
auuauucucucauuuguauag

SEQ ID NO: 4057618 - RNA, 14 nt, Staphylococcus aureus subsp. aureus N315
auuauucucuuuau

SEQ ID NO: 4057619 - RNA, 22 nt, Staphylococcus aureus subsp. aureus N315
auuauucugagauugagaauuc

SEQ ID NO: 4057620 - RNA, 17 nt, Staphylococcus aureus subsp. aureus N315
auuauucuucauuuaua

SEQ ID NO: 4057621 - RNA, 16 nt, Staphylococcus aureus subsp. aureus N315
auuauucuuuauauuu

SEQ ID NO: 4057622 - RNA, 14 nt, Staphylococcus aureus subsp. aureus N315
auuauucuuugauu

SEQ ID NO: 4057623 - RNA, 16 nt, Staphylococcus aureus subsp. aureus N315
auuauugaaaacaaaa

SEQ ID NO: 4057624 - RNA, 12 nt, Staphylococcus aureus subsp. aureus N315
auuauugaaacu

SEQ ID NO: 4057625 - RNA, 20 nt, Staphylococcus aureus subsp. aureus N315
auuauugaaaucgauacuaa

SEQ ID NO: 4057626 - RNA, 12 nt, Staphylococcus aureus subsp. aureus N315
auuauugaaauu

SEQ ID NO: 4057627 - RNA, 18 nt, Staphylococcus aureus subsp. aureus N315
auuauugagaauauuuau

SEQ ID NO: 4057628 - RNA, 17 nt, Staphylococcus aureus subsp. aureus N315
auuauugguugaaauua

SEQ ID NO: 4057629 - RNA, 14 nt, Staphylococcus aureus subsp. aureus N315
auuauuuaaaacuu

SEQ ID NO: 4057630 - RNA, 16 nt, Staphylococcus aureus subsp. aureus N315
auuauuuaaauuuuca

SEQ ID NO: 4057631 - RNA, 16 nt, Staphylococcus aureus subsp. aureus N315
auuauuuaauuuuucu

SEQ ID NO: 4057632 - RNA, 19 nt, Staphylococcus aureus subsp. aureus N315
auuauuuaauuuuucuaaa

SEQ ID NO: 4057633 - RNA, 14 nt, Staphylococcus aureus subsp. aureus N315
auuauuuagaauuc

SEQ ID NO: 4057634 - RNA, 23 nt, Staphylococcus aureus subsp. aureus N315
auuauuuagaauucuaaaagaau

SEQ ID NO: 4057635 - RNA, 17 nt, Staphylococcus aureus subsp. aureus N315
auuauuuagauaaaaau

SEQ ID NO: 4057636 - RNA, 21 nt, Staphylococcus aureus subsp. aureus N315
auuauuuagauaaaaauuacu

SEQ ID NO: 4057637 - RNA, 13 nt, Staphylococcus aureus subsp. aureus N315
auuauuuauauuu

SEQ ID NO: 4057638 - RNA, 16 nt, Staphylococcus aureus subsp. aureus N315
auuauuuauauuuuau

SEQ ID NO: 4057639 - RNA, 16 nt, Staphylococcus aureus subsp. aureus N315
auuauuuauucauuau

SEQ ID NO: 4057640 - RNA, 22 nt, Staphylococcus aureus subsp. aureus N315
auuauuucccuggaaaaugauu

SEQ ID NO: 4057641 - RNA, 17 nt, Staphylococcus aureus subsp. aureus N315
auuauuuccuguuacuu

SEQ ID NO: 4057642 - RNA, 13 nt, Staphylococcus aureus subsp. aureus N315
auuauuugauaaa

SEQ ID NO: 4057643 - RNA, 16 nt, Staphylococcus aureus subsp. aureus N315
auuauuugauaaauaa

SEQ ID NO: 4057644 - RNA, 17 nt, Staphylococcus aureus subsp. aureus N315
auuauuugcgauaucag

SEQ ID NO: 4057645 - RNA, 15 nt, Staphylococcus aureus subsp. aureus N315
auuauuuuguauuuu

SEQ ID NO: 4057646 - RNA, 21 nt, Staphylococcus aureus subsp. aureus N315
auuauuuuguauuuuucaaau

SEQ ID NO: 4057647 - RNA, 14 nt, Staphylococcus aureus subsp. aureus N315
auucaaaauaacuu

SEQ ID NO: 4057648 - RNA, 19 nt, Staphylococcus aureus subsp. aureus N315
auucaaaauucaauauuaa

SEQ ID NO: 4057649 - RNA, 17 nt, Staphylococcus aureus subsp. aureus N315
auucaaauaaaucaaac

SEQ ID NO: 4057650 - RNA, 21 nt, Staphylococcus aureus subsp. aureus N315
auucaaauaaaucaaacuuuu

SEQ ID NO: 4057651 - RNA, 23 nt, Staphylococcus aureus subsp. aureus N315
auucaaauaaaucaaacuuuuca

SEQ ID NO: 4057652 - RNA, 13 nt, Staphylococcus aureus subsp. aureus N315
auucaaaucauaa

SEQ ID NO: 4057653 - RNA, 17 nt, Staphylococcus aureus subsp. aureus N315
auucaaccuuaauagga

SEQ ID NO: 4057654 - RNA, 22 nt, Staphylococcus aureus subsp. aureus N315
auucaacguauaagugauauca

SEQ ID NO: 4057655 - RNA, 18 nt, Staphylococcus aureus subsp. aureus N315
auucaacgucaucaaaac

SEQ ID NO: 4057656 - RNA, 15 nt, Staphylococcus aureus subsp. aureus N315
auucaacuaauuuaa

SEQ ID NO: 4057657 - RNA, 12 nt, Staphylococcus aureus subsp. aureus N315
auucaacuuaaa

SEQ ID NO: 4057658 - RNA, 15 nt, Staphylococcus aureus subsp. aureus N315
auucaacuugauuaa

SEQ ID NO: 4057659 - RNA, 19 nt, Staphylococcus aureus subsp. aureus N315
auucaacuuuaaucaaaaa

SEQ ID NO: 4057660 - RNA, 16 nt, Staphylococcus aureus subsp. aureus N315
auucaagcaucauuuu

SEQ ID NO: 4057661 - RNA, 18 nt, Staphylococcus aureus subsp. aureus N315
auucaagcaucauuuuuc

SEQ ID NO: 4057662 - RNA, 19 nt, Staphylococcus aureus subsp. aureus N315
auucaaguguaguaaaaau

SEQ ID NO: 4057663 - RNA, 21 nt, Staphylococcus aureus subsp. aureus N315
auucaaguguaguaaaaauca

SEQ ID NO: 4057664 - RNA, 17 nt, Staphylococcus aureus subsp. aureus N315
auucaauaauuauuaau

SEQ ID NO: 4057665 - RNA, 22 nt, Staphylococcus aureus subsp. aureus N315
auucaauaauuauuaauuuaau

SEQ ID NO: 4057666 - RNA, 23 nt, Staphylococcus aureus subsp. aureus N315
auucaaugauuaguaaugauuaa

SEQ ID NO: 4057667 - RNA, 16 nt, Staphylococcus aureus subsp. aureus N315
auucaaugauuuuuaa

SEQ ID NO: 4057668 - RNA, 18 nt, Staphylococcus aureus subsp. aureus N315
auucaaugauuuuuaaaa

SEQ ID NO: 4057669 - RNA, 17 nt, Staphylococcus aureus subsp. aureus N315
auucaauguaauuuuca

SEQ ID NO: 4057670 - RNA, 14 nt, Staphylococcus aureus subsp. aureus N315
auucaauguuuaau

SEQ ID NO: 4057671 - RNA, 14 nt, Staphylococcus aureus subsp. aureus N315
auucaauucuguga

SEQ ID NO: 4057672 - RNA, 18 nt, Staphylococcus aureus subsp. aureus N315
auucaauugauuacacca

SEQ ID NO: 4057673 - RNA, 13 nt, Staphylococcus aureus subsp. aureus N315
auucaauuuaguu

SEQ ID NO: 4057674 - RNA, 15 nt, Staphylococcus aureus subsp. aureus N315
auucacauacauuuu

SEQ ID NO: 4057675 - RNA, 14 nt, Staphylococcus aureus subsp. aureus N315
auucaccuaaaaag

SEQ ID NO: 4057676 - RNA, 18 nt, Staphylococcus aureus subsp. aureus N315
auucaccuaucaacgauu

SEQ ID NO: 4057677 - RNA, 14 nt, Staphylococcus aureus subsp. aureus N315
auucacgauauaac

SEQ ID NO: 4057678 - RNA, 19 nt, Staphylococcus aureus subsp. aureus N315
auucacuacuuuuucaacu

SEQ ID NO: 4057679 - RNA, 22 nt, Staphylococcus aureus subsp. aureus N315
auucacucuguaauaaagaaua

SEQ ID NO: 4057680 - RNA, 13 nt, Staphylococcus aureus subsp. aureus N315
auucacuguauaa

SEQ ID NO: 4057681 - RNA, 16 nt, Staphylococcus aureus subsp. aureus N315
auucagaugaauaaug

SEQ ID NO: 4057682 - RNA, 12 nt, Staphylococcus aureus subsp. aureus N315
auucagauuuuc

SEQ ID NO: 4057683 - RNA, 17 nt, Staphylococcus aureus subsp. aureus N315
auucagauuuucgagug

SEQ ID NO: 4057684 - RNA, 15 nt, Staphylococcus aureus subsp. aureus N315
auucaguauauguau

SEQ ID NO: 4057685 - RNA, 13 nt, Staphylococcus aureus subsp. aureus N315
auucagucaacua

SEQ ID NO: 4057686 - RNA, 17 nt, Staphylococcus aureus subsp. aureus N315
auucagucaguaaaaau

SEQ ID NO: 4057687 - RNA, 21 nt, Staphylococcus aureus subsp. aureus N315
auucagucaguaaaaauacau

SEQ ID NO: 4057688 - RNA, 15 nt, Staphylococcus aureus subsp. aureus N315
auucauaaaauuuaa

SEQ ID NO: 4057689 - RNA, 20 nt, Staphylococcus aureus subsp. aureus N315
auucauaaaugacugaauua

SEQ ID NO: 4057690 - RNA, 19 nt, Staphylococcus aureus subsp. aureus N315
auucauaacguguuugcuc

SEQ ID NO: 4057691 - RNA, 12 nt, Staphylococcus aureus subsp. aureus N315
auucauaauauc

SEQ ID NO: 4057692 - RNA, 19 nt, Staphylococcus aureus subsp. aureus N315
auucauacacugcacauca

SEQ ID NO: 4057693 - RNA, 23 nt, Staphylococcus aureus subsp. aureus N315
auucauacacugcacaucauaau

SEQ ID NO: 4057694 - RNA, 17 nt, Staphylococcus aureus subsp. aureus N315
auucauauauacugccc

SEQ ID NO: 4057695 - RNA, 19 nt, Staphylococcus aureus subsp. aureus N315
auucauaucuuucaauuaa

SEQ ID NO: 4057696 - RNA, 19 nt, Staphylococcus aureus subsp. aureus N315
auucaucgucucacuuaau

SEQ ID NO: 4057697 - RNA, 21 nt, Staphylococcus aureus subsp. aureus N315
auucaucuaaccuuuucauca

SEQ ID NO: 4057698 - RNA, 12 nt, Staphylococcus aureus subsp. aureus N315
auucaugaauaa

SEQ ID NO: 4057699 - RNA, 15 nt, Staphylococcus aureus subsp. aureus N315
auucaugauauguuc

SEQ ID NO: 4057700 - RNA, 13 nt, Staphylococcus aureus subsp. aureus N315
auucauuaagcuu

SEQ ID NO: 4057701 - RNA, 20 nt, Staphylococcus aureus subsp. aureus N315
auucauuaagcuuuguuuga

SEQ ID NO: 4057702 - RNA, 13 nt, Staphylococcus aureus subsp. aureus N315
auucauucaauac

SEQ ID NO: 4057703 - RNA, 21 nt, Staphylococcus aureus subsp. aureus N315
auucauuccuaagaauguaau

SEQ ID NO: 4057704 - RNA, 22 nt, Staphylococcus aureus subsp. aureus N315
auucauucguacuuccaauacu

SEQ ID NO: 4057705 - RNA, 15 nt, Staphylococcus aureus subsp. aureus N315
auucauuguuauuua

SEQ ID NO: 4057706 - RNA, 16 nt, Staphylococcus aureus subsp. aureus N315
auucauuuaaaaauca

SEQ ID NO: 4057707 - RNA, 16 nt, Staphylococcus aureus subsp. aureus N315
auucauuuauuuucuu

SEQ ID NO: 4057708 - RNA, 13 nt, Staphylococcus aureus subsp. aureus N315
auucauuuuaaau

SEQ ID NO: 4057709 - RNA, 20 nt, Staphylococcus aureus subsp. aureus N315
auucauuuuaaauuuaacua

SEQ ID NO: 4057710 - RNA, 14 nt, Staphylococcus aureus subsp. aureus N315
auucauuuuauaaa

SEQ ID NO: 4057711 - RNA, 22 nt, Staphylococcus aureus subsp. aureus N315
auucauuuucuuuuucuugaag

SEQ ID NO: 4057712 - RNA, 15 nt, Staphylococcus aureus subsp. aureus N315
auuccaaaaauugua

SEQ ID NO: 4057713 - RNA, 15 nt, Staphylococcus aureus subsp. aureus N315
auuccaaauuugaaa

SEQ ID NO: 4057714 - RNA, 19 nt, Staphylococcus aureus subsp. aureus N315
auuccaaucuauuuuaaac

SEQ ID NO: 4057715 - RNA, 14 nt, Staphylococcus aureus subsp. aureus N315
auuccacuacaauc

SEQ ID NO: 4057716 - RNA, 16 nt, Staphylococcus aureus subsp. aureus N315
auuccacuacaaucau

SEQ ID NO: 4057717 - RNA, 18 nt, Staphylococcus aureus subsp. aureus N315
auuccacuacaaucauac

SEQ ID NO: 4057718 - RNA, 20 nt, Staphylococcus aureus subsp. aureus N315
auuccauacgaucuuuuuca

SEQ ID NO: 4057719 - RNA, 24 nt, Staphylococcus aureus subsp. aureus N315
auuccaucacgauauguugugcug

SEQ ID NO: 4057720 - RNA, 15 nt, Staphylococcus aureus subsp. aureus N315
auuccaucuuaaaac

SEQ ID NO: 4057721 - RNA, 17 nt, Staphylococcus aureus subsp. aureus N315
auuccaucuuaaaacaa

SEQ ID NO: 4057722 - RNA, 17 nt, Staphylococcus aureus subsp. aureus N315
auuccaugucaauuuuu

SEQ ID NO: 4057723 - RNA, 15 nt, Staphylococcus aureus subsp. aureus N315
auucccaaagcgaau

SEQ ID NO: 4057724 - RNA, 17 nt, Staphylococcus aureus subsp. aureus N315
auucccguuaauaucau

SEQ ID NO: 4057725 - RNA, 15 nt, Staphylococcus aureus subsp. aureus N315
auuccguuucauuga

SEQ ID NO: 4057726 - RNA, 15 nt, Staphylococcus aureus subsp. aureus N315
auuccuagcuuuuau

SEQ ID NO: 4057727 - RNA, 17 nt, Staphylococcus aureus subsp. aureus N315
auuccuagcuuuuaugu

SEQ ID NO: 4057728 - RNA, 13 nt, Staphylococcus aureus subsp. aureus N315
auuccuuaaaccg

SEQ ID NO: 4057729 - RNA, 15 nt, Staphylococcus aureus subsp. aureus N315
auucgaaaagaaauu

SEQ ID NO: 4057730 - RNA, 22 nt, Staphylococcus aureus subsp. aureus N315
auucgaaaagaaauucuacagg

SEQ ID NO: 4057731 - RNA, 15 nt, Staphylococcus aureus subsp. aureus N315
auucgauaauauaac

SEQ ID NO: 4057732 - RNA, 22 nt, Staphylococcus aureus subsp. aureus N315
auucgaucguaguuguccauuu

SEQ ID NO: 4057733 - RNA, 18 nt, Staphylococcus aureus subsp. aureus N315
auucgaugacuuuuuaau

SEQ ID NO: 4057734 - RNA, 16 nt, Staphylococcus aureus subsp. aureus N315
auucgcaccacuggcc

SEQ ID NO: 4057735 - RNA, 15 nt, Staphylococcus aureus subsp. aureus N315
auucgccuaaauggu

SEQ ID NO: 4057736 - RNA, 22 nt, Staphylococcus aureus subsp. aureus N315
auucgcuaauguaccaaucaau

SEQ ID NO: 4057737 - RNA, 15 nt, Staphylococcus aureus subsp. aureus N315
auucguaauuuauga

SEQ ID NO: 4057738 - RNA, 23 nt, Staphylococcus aureus subsp. aureus N315
auucguaccaacucgcuauaugu

SEQ ID NO: 4057739 - RNA, 17 nt, Staphylococcus aureus subsp. aureus N315
auucgugauuacauucu

SEQ ID NO: 4057740 - RNA, 13 nt, Staphylococcus aureus subsp. aureus N315
auucguuaacaau

SEQ ID NO: 4057741 - RNA, 17 nt, Staphylococcus aureus subsp. aureus N315
auucguuugaauuauuu

SEQ ID NO: 4057742 - RNA, 21 nt, Staphylococcus aureus subsp. aureus N315
auucuaaaaaauuaaaaauuu

SEQ ID NO: 4057743 - RNA, 14 nt, Staphylococcus aureus subsp. aureus N315
auucuaaaacggaa

SEQ ID NO: 4057744 - RNA, 18 nt, Staphylococcus aureus subsp. aureus N315
auucuaaauauauuuuau

SEQ ID NO: 4057745 - RNA, 14 nt, Staphylococcus aureus subsp. aureus N315
auucuaacugcaaa

SEQ ID NO: 4057746 - RNA, 14 nt, Staphylococcus aureus subsp. aureus N315
auucuaaguuaaaa

SEQ ID NO: 4057747 - RNA, 17 nt, Staphylococcus aureus subsp. aureus N315
auucuaaguuaaaaccu

SEQ ID NO: 4057748 - RNA, 13 nt, Staphylococcus aureus subsp. aureus N315
auucuacaaacaa

SEQ ID NO: 4057749 - RNA, 21 nt, Staphylococcus aureus subsp. aureus N315
auucuacaaacaaugcaaguu

SEQ ID NO: 4057750 - RNA, 12 nt, Staphylococcus aureus subsp. aureus N315
auucuacaggca

SEQ ID NO: 4057751 - RNA, 18 nt, Staphylococcus aureus subsp. aureus N315
auucuacaggcaaugcaa

SEQ ID NO: 4057752 - RNA, 21 nt, Staphylococcus aureus subsp. aureus N315
auucuacaggcaaugcaaguu

SEQ ID NO: 4057753 - RNA, 21 nt, Staphylococcus aureus subsp. aureus N315
auucuacagguaaugcaaguu

SEQ ID NO: 4057754 - RNA, 13 nt, Staphylococcus aureus subsp. aureus N315
auucuacuaaaaa

SEQ ID NO: 4057755 - RNA, 23 nt, Staphylococcus aureus subsp. aureus N315
auucuacuaaaaaugcuuuaacu

SEQ ID NO: 4057756 - RNA, 19 nt, Staphylococcus aureus subsp. aureus N315
auucuagagauaacuagaa

SEQ ID NO: 4057757 - RNA, 19 nt, Staphylococcus aureus subsp. aureus N315
auucuagauucauauuuau

SEQ ID NO: 4057758 - RNA, 19 nt, Staphylococcus aureus subsp. aureus N315
auucuagcaucgauguuau

SEQ ID NO: 4057759 - RNA, 22 nt, Staphylococcus aureus subsp. aureus N315
auucuauaaauagaauuuuuga

SEQ ID NO: 4057760 - RNA, 14 nt, Staphylococcus aureus subsp. aureus N315
auucuauacuuuua

SEQ ID NO: 4057761 - RNA, 16 nt, Staphylococcus aureus subsp. aureus N315
auucuauacuuuuaau

SEQ ID NO: 4057762 - RNA, 13 nt, Staphylococcus aureus subsp. aureus N315
auucuauuuuuca

SEQ ID NO: 4057763 - RNA, 20 nt, Staphylococcus aureus subsp. aureus N315
auucucagucucuuugaagg

SEQ ID NO: 4057764 - RNA, 14 nt, Staphylococcus aureus subsp. aureus N315
auucucgauuuuuu

SEQ ID NO: 4057765 - RNA, 14 nt, Staphylococcus aureus subsp. aureus N315
auucucgguuuuuu

SEQ ID NO: 4057766 - RNA, 17 nt, Staphylococcus aureus subsp. aureus N315
auucucuaacuuuacca

SEQ ID NO: 4057767 - RNA, 22 nt, Staphylococcus aureus subsp. aureus N315
auucucuauucacgaaauuacu

SEQ ID NO: 4057768 - RNA, 20 nt, Staphylococcus aureus subsp. aureus N315
auucucuuaucuugauuuaa

SEQ ID NO: 4057769 - RNA, 22 nt, Staphylococcus aureus subsp. aureus N315
auucucuuuauugggagcaauc

SEQ ID NO: 4057770 - RNA, 20 nt, Staphylococcus aureus subsp. aureus N315
auucucuuuguuggggccca

SEQ ID NO: 4057771 - RNA, 12 nt, Staphylococcus aureus subsp. aureus N315
auucucuuuuaa

SEQ ID NO: 4057772 - RNA, 17 nt, Staphylococcus aureus subsp. aureus N315
auucugagauugagaau

SEQ ID NO: 4057773 - RNA, 19 nt, Staphylococcus aureus subsp. aureus N315
auucugugagguaaaacua

SEQ ID NO: 4057774 - RNA, 17 nt, Staphylococcus aureus subsp. aureus N315
auucuguguaaauauaa

SEQ ID NO: 4057775 - RNA, 23 nt, Staphylococcus aureus subsp. aureus N315
auucuguuugguguuaccgauuu

SEQ ID NO: 4057776 - RNA, 15 nt, Staphylococcus aureus subsp. aureus N315
auucuuaauuuaagu

SEQ ID NO: 4057777 - RNA, 15 nt, Staphylococcus aureus subsp. aureus N315
auucuuagauauuau

SEQ ID NO: 4057778 - RNA, 14 nt, Staphylococcus aureus subsp. aureus N315
auucuuauaaaaua

SEQ ID NO: 4057779 - RNA, 17 nt, Staphylococcus aureus subsp. aureus N315
auucuuauauguuuuau

SEQ ID NO: 4057780 - RNA, 19 nt, Staphylococcus aureus subsp. aureus N315
auucuuaucauucauuacu

SEQ ID NO: 4057781 - RNA, 15 nt, Staphylococcus aureus subsp. aureus N315
auucuuaucuuuaau

SEQ ID NO: 4057782 - RNA, 22 nt, Staphylococcus aureus subsp. aureus N315
auucuuaugcggucuaaaugcu

SEQ ID NO: 4057783 - RNA, 14 nt, Staphylococcus aureus subsp. aureus N315
auucuucaaaaaau

SEQ ID NO: 4057784 - RNA, 18 nt, Staphylococcus aureus subsp. aureus N315
auucuucaaaaaauaaua

SEQ ID NO: 4057785 - RNA, 14 nt, Staphylococcus aureus subsp. aureus N315
auucuucaccaacu

SEQ ID NO: 4057786 - RNA, 18 nt, Staphylococcus aureus subsp. aureus N315
auucuucaccaguuugug

SEQ ID NO: 4057787 - RNA, 16 nt, Staphylococcus aureus subsp. aureus N315
auucuucacuaaaaau

SEQ ID NO: 4057788 - RNA, 22 nt, Staphylococcus aureus subsp. aureus N315
auucuucaucaauaacuauaau

SEQ ID NO: 4057789 - RNA, 20 nt, Staphylococcus aureus subsp. aureus N315
auucuucaucaugacuauuu

SEQ ID NO: 4057790 - RNA, 17 nt, Staphylococcus aureus subsp. aureus N315
auucuucauuuauaaca

SEQ ID NO: 4057791 - RNA, 15 nt, Staphylococcus aureus subsp. aureus N315
auucuugaaaaguuu

SEQ ID NO: 4057792 - RNA, 22 nt, Staphylococcus aureus subsp. aureus N315
auucuugagcaaugucuuuaau

SEQ ID NO: 4057793 - RNA, 16 nt, Staphylococcus aureus subsp. aureus N315
auucuuggcguauuuu

SEQ ID NO: 4057794 - RNA, 18 nt, Staphylococcus aureus subsp. aureus N315
auucuuguuugauuuuag

SEQ ID NO: 4057795 - RNA, 23 nt, Staphylococcus aureus subsp. aureus N315
auucuuuaccuuuaccaguauca

SEQ ID NO: 4057796 - RNA, 20 nt, Staphylococcus aureus subsp. aureus N315
auucuuuauaagcuuuuucu

SEQ ID NO: 4057797 - RNA, 23 nt, Staphylococcus aureus subsp. aureus N315
auucuuuauagaaaccaaaaaau

SEQ ID NO: 4057798 - RNA, 13 nt, Staphylococcus aureus subsp. aureus N315
auucuuucucuau

SEQ ID NO: 4057799 - RNA, 21 nt, Staphylococcus aureus subsp. aureus N315
auucuuuuaauagaucuuugu

SEQ ID NO: 4057800 - RNA, 14 nt, Staphylococcus aureus subsp. aureus N315
auucuuuucaagaa

SEQ ID NO: 4057801 - RNA, 16 nt, Staphylococcus aureus subsp. aureus N315
auugaaaaaauaacug

SEQ ID NO: 4057802 - RNA, 21 nt, Staphylococcus aureus subsp. aureus N315
auugaaaaauuaaaaaacaaa

SEQ ID NO: 4057803 - RNA, 14 nt, Staphylococcus aureus subsp. aureus N315
auugaaacuaauaa

SEQ ID NO: 4057804 - RNA, 15 nt, Staphylococcus aureus subsp. aureus N315
auugaaaugauagau

SEQ ID NO: 4057805 - RNA, 21 nt, Staphylococcus aureus subsp. aureus N315
auugaaauuauccuacugcug

SEQ ID NO: 4057806 - RNA, 13 nt, Staphylococcus aureus subsp. aureus N315
auugaaauuuuua

SEQ ID NO: 4057807 - RNA, 20 nt, Staphylococcus aureus subsp. aureus N315
auugaacaauucuucaucau

SEQ ID NO: 4057808 - RNA, 13 nt, Staphylococcus aureus subsp. aureus N315
auugaacuucuuu

SEQ ID NO: 4057809 - RNA, 14 nt, Staphylococcus aureus subsp. aureus N315
auugaauauaaaaa

SEQ ID NO: 4057810 - RNA, 21 nt, Staphylococcus aureus subsp. aureus N315
auugaaucuuuguuauauuuu

SEQ ID NO: 4057811 - RNA, 18 nt, Staphylococcus aureus subsp. aureus N315
auugacauuuacauccaa

SEQ ID NO: 4057812 - RNA, 21 nt, Staphylococcus aureus subsp. aureus N315
auugaccaacguucgauaacg

SEQ ID NO: 4057813 - RNA, 23 nt, Staphylococcus aureus subsp. aureus N315
auugaggauaauuauuaggggag

SEQ ID NO: 4057814 - RNA, 16 nt, Staphylococcus aureus subsp. aureus N315
auugagggauuuuuau

SEQ ID NO: 4057815 - RNA, 14 nt, Staphylococcus aureus subsp. aureus N315
auugaguuguugca

SEQ ID NO: 4057816 - RNA, 15 nt, Staphylococcus aureus subsp. aureus N315
auugaguuuuuuaaa

SEQ ID NO: 4057817 - RNA, 23 nt, Staphylococcus aureus subsp. aureus N315
auugauagcaccguaacauaugu

SEQ ID NO: 4057818 - RNA, 16 nt, Staphylococcus aureus subsp. aureus N315
auugauauucuaaaaa

SEQ ID NO: 4057819 - RNA, 12 nt, Staphylococcus aureus subsp. aureus N315
auugaucugauu

SEQ ID NO: 4057820 - RNA, 20 nt, Staphylococcus aureus subsp. aureus N315
auugaugaaagacugacuaa

SEQ ID NO: 4057821 - RNA, 14 nt, Staphylococcus aureus subsp. aureus N315
auugaugaauaaau

SEQ ID NO: 4057822 - RNA, 21 nt, Staphylococcus aureus subsp. aureus N315
auugaugaauaaauagauaau

SEQ ID NO: 4057823 - RNA, 16 nt, Staphylococcus aureus subsp. aureus N315
auugaugucaauuuca

SEQ ID NO: 4057824 - RNA, 20 nt, Staphylococcus aureus subsp. aureus N315
auugaugucaauuucacgcu

SEQ ID NO: 4057825 - RNA, 21 nt, Staphylococcus aureus subsp. aureus N315
auugauuacaccacuuaggau

SEQ ID NO: 4057826 - RNA, 15 nt, Staphylococcus aureus subsp. aureus N315
auugauuaucauaug

SEQ ID NO: 4057827 - RNA, 22 nt, Staphylococcus aureus subsp. aureus N315
auugauucuacagcaucaccua

SEQ ID NO: 4057828 - RNA, 19 nt, Staphylococcus aureus subsp. aureus N315
auugauugcucuaagcauu

SEQ ID NO: 4057829 - RNA, 21 nt, Staphylococcus aureus subsp. aureus N315
auugauuguaccaguaacaau

SEQ ID NO: 4057830 - RNA, 17 nt, Staphylococcus aureus subsp. aureus N315
auugauuucagcaccga

SEQ ID NO: 4057831 - RNA, 22 nt, Staphylococcus aureus subsp. aureus N315
auugcaaaaaaacaaauauuag

SEQ ID NO: 4057832 - RNA, 21 nt, Staphylococcus aureus subsp. aureus N315
auugcaacgcaucacaaaauu

SEQ ID NO: 4057833 - RNA, 23 nt, Staphylococcus aureus subsp. aureus N315
auugcaagacuuggugcccaagu

SEQ ID NO: 4057834 - RNA, 21 nt, Staphylococcus aureus subsp. aureus N315
auugcacuaugcauaauacca

SEQ ID NO: 4057835 - RNA, 23 nt, Staphylococcus aureus subsp. aureus N315
auugcacuaugcauaauaccaau

SEQ ID NO: 4057836 - RNA, 21 nt, Staphylococcus aureus subsp. aureus N315
auugccaguaucucuuuucua

SEQ ID NO: 4057837 - RNA, 16 nt, Staphylococcus aureus subsp. aureus N315
auugccuaaccuguuu

SEQ ID NO: 4057838 - RNA, 16 nt, Staphylococcus aureus subsp. aureus N315
auugccuguagaauuu

SEQ ID NO: 4057839 - RNA, 21 nt, Staphylococcus aureus subsp. aureus N315
auugcgaaagaaagaaacaua

SEQ ID NO: 4057840 - RNA, 15 nt, Staphylococcus aureus subsp. aureus N315
auugcgguuggcucu

SEQ ID NO: 4057841 - RNA, 13 nt, Staphylococcus aureus subsp. aureus N315
auugcuaaaaaaa

SEQ ID NO: 4057842 - RNA, 14 nt, Staphylococcus aureus subsp. aureus N315
auugcuaauccaua

SEQ ID NO: 4057843 - RNA, 16 nt, Staphylococcus aureus subsp. aureus N315
auugcucuuuaacaau

SEQ ID NO: 4057844 - RNA, 17 nt, Staphylococcus aureus subsp. aureus N315
auugcugacaccuauau

SEQ ID NO: 4057845 - RNA, 21 nt, Staphylococcus aureus subsp. aureus N315
auugcugacaccuauauuuuu

SEQ ID NO: 4057846 - RNA, 20 nt, Staphylococcus aureus subsp. aureus N315
auugcugggcuaccgauugu

SEQ ID NO: 4057847 - RNA, 15 nt, Staphylococcus aureus subsp. aureus N315
auugcuuauuuuugu

SEQ ID NO: 4057848 - RNA, 17 nt, Staphylococcus aureus subsp. aureus N315
auugcuuguucuuucuu

SEQ ID NO: 4057849 - RNA, 16 nt, Staphylococcus aureus subsp. aureus N315
auugcuuuagaaaguc

SEQ ID NO: 4057850 - RNA, 15 nt, Staphylococcus aureus subsp. aureus N315
auuggaaaaauaaau

SEQ ID NO: 4057851 - RNA, 19 nt, Staphylococcus aureus subsp. aureus N315
auuggaaucaucuuuuuga

SEQ ID NO: 4057852 - RNA, 12 nt, Staphylococcus aureus subsp. aureus N315
auuggcagauag

SEQ ID NO: 4057853 - RNA, 16 nt, Staphylococcus aureus subsp. aureus N315
auuggcauccaggcaa

SEQ ID NO: 4057854 - RNA, 17 nt, Staphylococcus aureus subsp. aureus N315
auuggcauccaggcaac

SEQ ID NO: 4057855 - RNA, 20 nt, Staphylococcus aureus subsp. aureus N315
auugguaaauuuaucauuuu

SEQ ID NO: 4057856 - RNA, 18 nt, Staphylococcus aureus subsp. aureus N315
auugguuuucauguguca

SEQ ID NO: 4057857 - RNA, 21 nt, Staphylococcus aureus subsp. aureus N315
auugguuuuuacuauaauaau

SEQ ID NO: 4057858 - RNA, 18 nt, Staphylococcus aureus subsp. aureus N315
auuguaaaaauacauaau

SEQ ID NO: 4057859 - RNA, 13 nt, Staphylococcus aureus subsp. aureus N315
auuguaaaaugua

SEQ ID NO: 4057860 - RNA, 21 nt, Staphylococcus aureus subsp. aureus N315
auuguaaagcaugaauagcuu

SEQ ID NO: 4057861 - RNA, 14 nt, Staphylococcus aureus subsp. aureus N315
auuguaaauauagu

SEQ ID NO: 4057862 - RNA, 18 nt, Staphylococcus aureus subsp. aureus N315
auuguaaauauaguaaua

SEQ ID NO: 4057863 - RNA, 18 nt, Staphylococcus aureus subsp. aureus N315
auuguaaaucuuguugga

SEQ ID NO: 4057864 - RNA, 21 nt, Staphylococcus aureus subsp. aureus N315
auuguaagauaacgagugaaa

SEQ ID NO: 4057865 - RNA, 23 nt, Staphylococcus aureus subsp. aureus N315
auuguaauaauaaucuuuaacau

SEQ ID NO: 4057866 - RNA, 13 nt, Staphylococcus aureus subsp. aureus N315
auuguaaucuauu

SEQ ID NO: 4057867 - RNA, 15 nt, Staphylococcus aureus subsp. aureus N315
auuguaccaguaaca

SEQ ID NO: 4057868 - RNA, 18 nt, Staphylococcus aureus subsp. aureus N315
auuguauagaauguguau

SEQ ID NO: 4057869 - RNA, 15 nt, Staphylococcus aureus subsp. aureus N315
auuguaugaauaaua

SEQ ID NO: 4057870 - RNA, 18 nt, Staphylococcus aureus subsp. aureus N315
auuguauguugaaaguga

SEQ ID NO: 4057871 - RNA, 20 nt, Staphylococcus aureus subsp. aureus N315
auuguauuguuuucaucaug

SEQ ID NO: 4057872 - RNA, 13 nt, Staphylococcus aureus subsp. aureus N315
auuguauuuuaau

SEQ ID NO: 4057873 - RNA, 12 nt, Staphylococcus aureus subsp. aureus N315
auugucaucaug

SEQ ID NO: 4057874 - RNA, 21 nt, Staphylococcus aureus subsp. aureus N315
auugucgacuuuuagauuauc

SEQ ID NO: 4057875 - RNA, 21 nt, Staphylococcus aureus subsp. aureus N315
auugucguuguacaucauuaa

SEQ ID NO: 4057876 - RNA, 20 nt, Staphylococcus aureus subsp. aureus N315
auugucuagguuagaauuau

SEQ ID NO: 4057877 - RNA, 18 nt, Staphylococcus aureus subsp. aureus N315
auugucucaucauuuaaa

SEQ ID NO: 4057878 - RNA, 19 nt, Staphylococcus aureus subsp. aureus N315
auugucucaucauuuaaaa

SEQ ID NO: 4057879 - RNA, 21 nt, Staphylococcus aureus subsp. aureus N315
auugucucaucauuuaaaauu

SEQ ID NO: 4057880 - RNA, 14 nt, Staphylococcus aureus subsp. aureus N315
auugucuuauaaga

SEQ ID NO: 4057881 - RNA, 15 nt, Staphylococcus aureus subsp. aureus N315
auugugaaaucuauu

SEQ ID NO: 4057882 - RNA, 15 nt, Staphylococcus aureus subsp. aureus N315
auugugguauuaauu

SEQ ID NO: 4057883 - RNA, 18 nt, Staphylococcus aureus subsp. aureus N315
auuguguccauaaauauu

SEQ ID NO: 4057884 - RNA, 17 nt, Staphylococcus aureus subsp. aureus N315
auuguguugaaucaaca

SEQ ID NO: 4057885 - RNA, 11 nt, Staphylococcus aureus subsp. aureus N315
auuguguuucu

SEQ ID NO: 4057886 - RNA, 13 nt, Staphylococcus aureus subsp. aureus N315
auuguuaaacauu

SEQ ID NO: 4057887 - RNA, 22 nt, Staphylococcus aureus subsp. aureus N315
auuguuaaacuagaaaacauaa

SEQ ID NO: 4057888 - RNA, 15 nt, Staphylococcus aureus subsp. aureus N315
auuguuacuuuaacu

SEQ ID NO: 4057889 - RNA, 16 nt, Staphylococcus aureus subsp. aureus N315
auuguuacuuuaacuu

SEQ ID NO: 4057890 - RNA, 19 nt, Staphylococcus aureus subsp. aureus N315
auuguuagauaaucucauu

SEQ ID NO: 4057891 - RNA, 22 nt, Staphylococcus aureus subsp. aureus N315
auuguuauagcguuuaagaaau

SEQ ID NO: 4057892 - RNA, 18 nt, Staphylococcus aureus subsp. aureus N315
auuguuauccaaaacauu

SEQ ID NO: 4057893 - RNA, 17 nt, Staphylococcus aureus subsp. aureus N315
auuguuccuucgauagu

SEQ ID NO: 4057894 - RNA, 20 nt, Staphylococcus aureus subsp. aureus N315
auuguugcaaaauacgauuu

SEQ ID NO: 4057895 - RNA, 19 nt, Staphylococcus aureus subsp. aureus N315
auuguuugaaaauuaacua

SEQ ID NO: 4057896 - RNA, 16 nt, Staphylococcus aureus subsp. aureus N315
auuguuuguagaaauu

SEQ ID NO: 4057897 - RNA, 21 nt, Staphylococcus aureus subsp. aureus N315
auuguuuguagaaauuaggaa

SEQ ID NO: 4057898 - RNA, 20 nt, Staphylococcus aureus subsp. aureus N315
auuguuuuagcaauuugcug

SEQ ID NO: 4057899 - RNA, 19 nt, Staphylococcus aureus subsp. aureus N315
auuguuuuggcuuugagug

SEQ ID NO: 4057900 - RNA, 16 nt, Staphylococcus aureus subsp. aureus N315
auuguuuuuaaaaucu

SEQ ID NO: 4057901 - RNA, 21 nt, Staphylococcus aureus subsp. aureus N315
auuuaaaacaaugauuaaaau

SEQ ID NO: 4057902 - RNA, 12 nt, Staphylococcus aureus subsp. aureus N315
auuuaaaagaaa

SEQ ID NO: 4057903 - RNA, 13 nt, Staphylococcus aureus subsp. aureus N315
auuuaaaagacaa

SEQ ID NO: 4057904 - RNA, 14 nt, Staphylococcus aureus subsp. aureus N315
auuuaaaagagaau

SEQ ID NO: 4057905 - RNA, 21 nt, Staphylococcus aureus subsp. aureus N315
auuuaaaauaguucuuuaaau

SEQ ID NO: 4057906 - RNA, 12 nt, Staphylococcus aureus subsp. aureus N315
auuuaaaauaua

SEQ ID NO: 4057907 - RNA, 16 nt, Staphylococcus aureus subsp. aureus N315
auuuaaaauauaaauu

SEQ ID NO: 4057908 - RNA, 17 nt, Staphylococcus aureus subsp. aureus N315
auuuaaaauauuauuuu

SEQ ID NO: 4057909 - RNA, 19 nt, Staphylococcus aureus subsp. aureus N315
auuuaaaauauuauuuuua

SEQ ID NO: 4057910 - RNA, 15 nt, Staphylococcus aureus subsp. aureus N315
auuuaaaaugauucu

SEQ ID NO: 4057911 - RNA, 16 nt, Staphylococcus aureus subsp. aureus N315
auuuaaaccaucaauu

SEQ ID NO: 4057912 - RNA, 13 nt, Staphylococcus aureus subsp. aureus N315
auuuaaacuagua

SEQ ID NO: 4057913 - RNA, 14 nt, Staphylococcus aureus subsp. aureus N315
auuuaaacuaguaa

SEQ ID NO: 4057914 - RNA, 14 nt, Staphylococcus aureus subsp. aureus N315
auuuaaagcaucau

SEQ ID NO: 4057915 - RNA, 18 nt, Staphylococcus aureus subsp. aureus N315
auuuaaaggcauaauaac

SEQ ID NO: 4057916 - RNA, 15 nt, Staphylococcus aureus subsp. aureus N315
auuuaaauaacaagu

SEQ ID NO: 4057917 - RNA, 13 nt, Staphylococcus aureus subsp. aureus N315
auuuaaaugucuu

SEQ ID NO: 4057918 - RNA, 18 nt, Staphylococcus aureus subsp. aureus N315
auuuaaauugacuuuaau

SEQ ID NO: 4057919 - RNA, 13 nt, Staphylococcus aureus subsp. aureus N315
auuuaaauuuuca

SEQ ID NO: 4057920 - RNA, 17 nt, Staphylococcus aureus subsp. aureus N315
auuuaacaucaauuacu

SEQ ID NO: 4057921 - RNA, 15 nt, Staphylococcus aureus subsp. aureus N315
auuuaaccuuuaaaa

SEQ ID NO: 4057922 - RNA, 16 nt, Staphylococcus aureus subsp. aureus N315
auuuaacggaaauaca

SEQ ID NO: 4057923 - RNA, 20 nt, Staphylococcus aureus subsp. aureus N315
auuuaacggaaauacaauga

SEQ ID NO: 4057924 - RNA, 21 nt, Staphylococcus aureus subsp. aureus N315
auuuaacgucuaccucuagga

SEQ ID NO: 4057925 - RNA, 17 nt, Staphylococcus aureus subsp. aureus N315
auuuaacuaugaaauug

SEQ ID NO: 4057926 - RNA, 16 nt, Staphylococcus aureus subsp. aureus N315
auuuaagaaacgucuu

SEQ ID NO: 4057927 - RNA, 18 nt, Staphylococcus aureus subsp. aureus N315
auuuaagggucacaccca

SEQ ID NO: 4057928 - RNA, 23 nt, Staphylococcus aureus subsp. aureus N315
auuuaagggucacacccauacuc

SEQ ID NO: 4057929 - RNA, 21 nt, Staphylococcus aureus subsp. aureus N315
auuuaauaaaaaccaauauuu

SEQ ID NO: 4057930 - RNA, 14 nt, Staphylococcus aureus subsp. aureus N315
auuuaauaaaccag

SEQ ID NO: 4057931 - RNA, 18 nt, Staphylococcus aureus subsp. aureus N315
auuuaauaaaccagugcg

SEQ ID NO: 4057932 - RNA, 20 nt, Staphylococcus aureus subsp. aureus N315
auuuaauaacguacauuuau

SEQ ID NO: 4057933 - RNA, 20 nt, Staphylococcus aureus subsp. aureus N315
auuuaauaaguuaauguaau

SEQ ID NO: 4057934 - RNA, 14 nt, Staphylococcus aureus subsp. aureus N315
auuuaauaauacca

SEQ ID NO: 4057935 - RNA, 21 nt, Staphylococcus aureus subsp. aureus N315
auuuaauaauaccaucugaau

SEQ ID NO: 4057936 - RNA, 13 nt, Staphylococcus aureus subsp. aureus N315
auuuaauaaugcu

SEQ ID NO: 4057937 - RNA, 12 nt, Staphylococcus aureus subsp. aureus N315
auuuaauaaugu

SEQ ID NO: 4057938 - RNA, 21 nt, Staphylococcus aureus subsp. aureus N315
auuuaauacuauaguaagaaa

SEQ ID NO: 4057939 - RNA, 20 nt, Staphylococcus aureus subsp. aureus N315
auuuaauacuuuucucgauu

SEQ ID NO: 4057940 - RNA, 16 nt, Staphylococcus aureus subsp. aureus N315
auuuaauagacauuaa

SEQ ID NO: 4057941 - RNA, 23 nt, Staphylococcus aureus subsp. aureus N315
auuuaauaggcuauguaaaucgu

SEQ ID NO: 4057942 - RNA, 19 nt, Staphylococcus aureus subsp. aureus N315
auuuaauaucacgaucuuu

SEQ ID NO: 4057943 - RNA, 23 nt, Staphylococcus aureus subsp. aureus N315
auuuaauaucacgaucuuuaaag

SEQ ID NO: 4057944 - RNA, 14 nt, Staphylococcus aureus subsp. aureus N315
auuuaauccuucuc

SEQ ID NO: 4057945 - RNA, 16 nt, Staphylococcus aureus subsp. aureus N315
auuuaauguuaaacaa

SEQ ID NO: 4057946 - RNA, 12 nt, Staphylococcus aureus subsp. aureus N315
auuuaauguuuu

SEQ ID NO: 4057947 - RNA, 21 nt, Staphylococcus aureus subsp. aureus N315
auuuaauguuuuagugacaaa

SEQ ID NO: 4057948 - RNA, 18 nt, Staphylococcus aureus subsp. aureus N315
auuuaauuacagguuuaa

SEQ ID NO: 4057949 - RNA, 21 nt, Staphylococcus aureus subsp. aureus N315
auuuaauuacagguuuaaaca

SEQ ID NO: 4057950 - RNA, 16 nt, Staphylococcus aureus subsp. aureus N315
auuuaauuauuucucu

SEQ ID NO: 4057951 - RNA, 18 nt, Staphylococcus aureus subsp. aureus N315
auuuaauucugguuuaau

SEQ ID NO: 4057952 - RNA, 12 nt, Staphylococcus aureus subsp. aureus N315
auuuaauuuuuc

SEQ ID NO: 4057953 - RNA, 13 nt, Staphylococcus aureus subsp. aureus N315
auuuaauuuuucu

SEQ ID NO: 4057954 - RNA, 19 nt, Staphylococcus aureus subsp. aureus N315
auuuaauuuuucuaaauga

SEQ ID NO: 4057955 - RNA, 20 nt, Staphylococcus aureus subsp. aureus N315
auuuaauuuuucuaaaugau

SEQ ID NO: 4057956 - RNA, 21 nt, Staphylococcus aureus subsp. aureus N315
auuuaauuuuucuaaaugauu

SEQ ID NO: 4057957 - RNA, 23 nt, Staphylococcus aureus subsp. aureus N315
auuuacaauuaauuacuguaaau

SEQ ID NO: 4057958 - RNA, 15 nt, Staphylococcus aureus subsp. aureus N315
auuuacaccuauacc

SEQ ID NO: 4057959 - RNA, 18 nt, Staphylococcus aureus subsp. aureus N315
auuuacaccuauaccuca

SEQ ID NO: 4057960 - RNA, 18 nt, Staphylococcus aureus subsp. aureus N315
auuuacaccuauaccucg

SEQ ID NO: 4057961 - RNA, 21 nt, Staphylococcus aureus subsp. aureus N315
auuuacauccaacuaaaugua

SEQ ID NO: 4057962 - RNA, 20 nt, Staphylococcus aureus subsp. aureus N315
auuuaccucuugauaaaaua

SEQ ID NO: 4057963 - RNA, 21 nt, Staphylococcus aureus subsp. aureus N315
auuuaccucuugauaaaauaa

SEQ ID NO: 4057964 - RNA, 22 nt, Staphylococcus aureus subsp. aureus N315
auuuaccucuugauaaaauaaa

SEQ ID NO: 4057965 - RNA, 21 nt, Staphylococcus aureus subsp. aureus N315
auuuaccuuugucuuuuuuau

SEQ ID NO: 4057966 - RNA, 20 nt, Staphylococcus aureus subsp. aureus N315
auuuacggcauaauuuuuua

SEQ ID NO: 4057967 - RNA, 18 nt, Staphylococcus aureus subsp. aureus N315
auuuacuccuuacaauaa

SEQ ID NO: 4057968 - RNA, 21 nt, Staphylococcus aureus subsp. aureus N315
auuuacuucuucuucagacca

SEQ ID NO: 4057969 - RNA, 22 nt, Staphylococcus aureus subsp. aureus N315
auuuacuuuuccuugauucuua

SEQ ID NO: 4057970 - RNA, 18 nt, Staphylococcus aureus subsp. aureus N315
auuuagaauaaacuuuau

SEQ ID NO: 4057971 - RNA, 19 nt, Staphylococcus aureus subsp. aureus N315
auuuagaauucuaaaagaa

SEQ ID NO: 4057972 - RNA, 20 nt, Staphylococcus aureus subsp. aureus N315
auuuagaauucuaaaagaau

SEQ ID NO: 4057973 - RNA, 23 nt, Staphylococcus aureus subsp. aureus N315
auuuagacucuccuuuuuuaaag

SEQ ID NO: 4057974 - RNA, 20 nt, Staphylococcus aureus subsp. aureus N315
auuuagacuuggauaaaaau

SEQ ID NO: 4057975 - RNA, 20 nt, Staphylococcus aureus subsp. aureus N315
auuuagauagcggauuuauu

SEQ ID NO: 4057976 - RNA, 22 nt, Staphylococcus aureus subsp. aureus N315
auuuagaugcauaaaaaaagaa

SEQ ID NO: 4057977 - RNA, 17 nt, Staphylococcus aureus subsp. aureus N315
auuuagauuuauaacga

SEQ ID NO: 4057978 - RNA, 18 nt, Staphylococcus aureus subsp. aureus N315
auuuagcaaauauuucug

SEQ ID NO: 4057979 - RNA, 15 nt, Staphylococcus aureus subsp. aureus N315
auuuagcaucaaaaa

SEQ ID NO: 4057980 - RNA, 19 nt, Staphylococcus aureus subsp. aureus N315
auuuagcaucaaaaauaaa

SEQ ID NO: 4057981 - RNA, 19 nt, Staphylococcus aureus subsp. aureus N315
auuuaggaguauccugauu

SEQ ID NO: 4057982 - RNA, 23 nt, Staphylococcus aureus subsp. aureus N315
auuuaggaguauccugauuuaau

SEQ ID NO: 4057983 - RNA, 18 nt, Staphylococcus aureus subsp. aureus N315
auuuaggcaugucaaauc

SEQ ID NO: 4057984 - RNA, 18 nt, Staphylococcus aureus subsp. aureus N315
auuuagggauuauaacca

SEQ ID NO: 4057985 - RNA, 18 nt, Staphylococcus aureus subsp. aureus N315
auuuaguacucaauguua

SEQ ID NO: 4057986 - RNA, 14 nt, Staphylococcus aureus subsp. aureus N315
auuuaguauaaaua

SEQ ID NO: 4057987 - RNA, 16 nt, Staphylococcus aureus subsp. aureus N315
auuuaguauaaauaaa

SEQ ID NO: 4057988 - RNA, 22 nt, Staphylococcus aureus subsp. aureus N315
auuuaguauaaauaaaaauaca

SEQ ID NO: 4057989 - RNA, 15 nt, Staphylococcus aureus subsp. aureus N315
auuuaguaucaugau

SEQ ID NO: 4057990 - RNA, 16 nt, Staphylococcus aureus subsp. aureus N315
auuuaguaucuauaca

SEQ ID NO: 4057991 - RNA, 15 nt, Staphylococcus aureus subsp. aureus N315
auuuaguuaaauaca

SEQ ID NO: 4057992 - RNA, 16 nt, Staphylococcus aureus subsp. aureus N315
auuuaguuaaguauuu

SEQ ID NO: 4057993 - RNA, 17 nt, Staphylococcus aureus subsp. aureus N315
auuuaguuagcccuauu

SEQ ID NO: 4057994 - RNA, 13 nt, Staphylococcus aureus subsp. aureus N315
auuuaguuuuuuu

SEQ ID NO: 4057995 - RNA, 16 nt, Staphylococcus aureus subsp. aureus N315
auuuaguuuuuuuaaa

SEQ ID NO: 4057996 - RNA, 20 nt, Staphylococcus aureus subsp. aureus N315
auuuaguuuuuuuaaaguuu

SEQ ID NO: 4057997 - RNA, 21 nt, Staphylococcus aureus subsp. aureus N315
auuuaguuuuuuuaaaguuua

SEQ ID NO: 4057998 - RNA, 22 nt, Staphylococcus aureus subsp. aureus N315
auuuauaaaaacuuauuugcca

SEQ ID NO: 4057999 - RNA, 16 nt, Staphylococcus aureus subsp. aureus N315
auuuauaaauguuuca

SEQ ID NO: 4058000 - RNA, 21 nt, Staphylococcus aureus subsp. aureus N315
auuuauaacgacguaauccuu

SEQ ID NO: 4058001 - RNA, 19 nt, Staphylococcus aureus subsp. aureus N315
auuuauaagaggagaaagc

SEQ ID NO: 4058002 - RNA, 15 nt, Staphylococcus aureus subsp. aureus N315
auuuauacagugaau

SEQ ID NO: 4058003 - RNA, 16 nt, Staphylococcus aureus subsp. aureus N315
auuuauacuaaagcac

SEQ ID NO: 4058004 - RNA, 15 nt, Staphylococcus aureus subsp. aureus N315
auuuauacuauaaau

SEQ ID NO: 4058005 - RNA, 19 nt, Staphylococcus aureus subsp. aureus N315
auuuauacuauaaauacaa

SEQ ID NO: 4058006 - RNA, 18 nt, Staphylococcus aureus subsp. aureus N315
auuuauacugaucaaaug

SEQ ID NO: 4058007 - RNA, 21 nt, Staphylococcus aureus subsp. aureus N315
auuuauacuugaugaaacuga

SEQ ID NO: 4058008 - RNA, 19 nt, Staphylococcus aureus subsp. aureus N315
auuuauauagucuaugaau

SEQ ID NO: 4058009 - RNA, 17 nt, Staphylococcus aureus subsp. aureus N315
auuuauaugauguucaa

SEQ ID NO: 4058010 - RNA, 21 nt, Staphylococcus aureus subsp. aureus N315
auuuauaugauguucaauauu

SEQ ID NO: 4058011 - RNA, 14 nt, Staphylococcus aureus subsp. aureus N315
auuuauaugauuaa

SEQ ID NO: 4058012 - RNA, 19 nt, Staphylococcus aureus subsp. aureus N315
auuuauauuuacacagaau

SEQ ID NO: 4058013 - RNA, 13 nt, Staphylococcus aureus subsp. aureus N315
auuuauauuuuau

SEQ ID NO: 4058014 - RNA, 14 nt, Staphylococcus aureus subsp. aureus N315
auuuaucaauaaau

SEQ ID NO: 4058015 - RNA, 17 nt, Staphylococcus aureus subsp. aureus N315
auuuaucaauuucuauu

SEQ ID NO: 4058016 - RNA, 18 nt, Staphylococcus aureus subsp. aureus N315
auuuaucaauuucuauuu

SEQ ID NO: 4058017 - RNA, 22 nt, Staphylococcus aureus subsp. aureus N315
auuuaucgcgauuauuaccaua

SEQ ID NO: 4058018 - RNA, 14 nt, Staphylococcus aureus subsp. aureus N315
auuuaucgugaaga

SEQ ID NO: 4058019 - RNA, 15 nt, Staphylococcus aureus subsp. aureus N315
auuuaucgugaagaa

SEQ ID NO: 4058020 - RNA, 21 nt, Staphylococcus aureus subsp. aureus N315
auuuaucuagacucaaggaaa

SEQ ID NO: 4058021 - RNA, 22 nt, Staphylococcus aureus subsp. aureus N315
auuuaucuagacucaaggaaau

SEQ ID NO: 4058022 - RNA, 18 nt, Staphylococcus aureus subsp. aureus N315
auuuauguaacuacuauu

SEQ ID NO: 4058023 - RNA, 17 nt, Staphylococcus aureus subsp. aureus N315
auuuauguagauuuuaa

SEQ ID NO: 4058024 - RNA, 17 nt, Staphylococcus aureus subsp. aureus N315
auuuauguguuggcuuu

SEQ ID NO: 4058025 - RNA, 21 nt, Staphylococcus aureus subsp. aureus N315
auuuauguguugugauauaua

SEQ ID NO: 4058026 - RNA, 15 nt, Staphylococcus aureus subsp. aureus N315
auuuauguuuucuag

SEQ ID NO: 4058027 - RNA, 12 nt, Staphylococcus aureus subsp. aureus N315
auuuauuaaaua

SEQ ID NO: 4058028 - RNA, 14 nt, Staphylococcus aureus subsp. aureus N315
auuuauuaauccau

SEQ ID NO: 4058029 - RNA, 22 nt, Staphylococcus aureus subsp. aureus N315
auuuauuaguugugguuguuaa

SEQ ID NO: 4058030 - RNA, 14 nt, Staphylococcus aureus subsp. aureus N315
auuuauuaguuuuu

SEQ ID NO: 4058031 - RNA, 15 nt, Staphylococcus aureus subsp. aureus N315
auuuauuauaaaaua

SEQ ID NO: 4058032 - RNA, 18 nt, Staphylococcus aureus subsp. aureus N315
auuuauuauaauuguuca

SEQ ID NO: 4058033 - RNA, 14 nt, Staphylococcus aureus subsp. aureus N315
auuuauuauuacca

SEQ ID NO: 4058034 - RNA, 13 nt, Staphylococcus aureus subsp. aureus N315
auuuauucaaaau

SEQ ID NO: 4058035 - RNA, 20 nt, Staphylococcus aureus subsp. aureus N315
auuuauucuaaauauauuuu

SEQ ID NO: 4058036 - RNA, 20 nt, Staphylococcus aureus subsp. aureus N315
auuuauuuauaaaauaaaau

SEQ ID NO: 4058037 - RNA, 23 nt, Staphylococcus aureus subsp. aureus N315
auuuauuucuuuuugucauuaau

SEQ ID NO: 4058038 - RNA, 17 nt, Staphylococcus aureus subsp. aureus N315
auuuauuuuauaauaac

SEQ ID NO: 4058039 - RNA, 18 nt, Staphylococcus aureus subsp. aureus N315
auuuauuuucaauaaaua

SEQ ID NO: 4058040 - RNA, 19 nt, Staphylococcus aureus subsp. aureus N315
auuuauuuucaauaaauaa

SEQ ID NO: 4058041 - RNA, 15 nt, Staphylococcus aureus subsp. aureus N315
auuuauuuucuuugg

SEQ ID NO: 4058042 - RNA, 17 nt, Staphylococcus aureus subsp. aureus N315
auuuauuuucuuuggug

SEQ ID NO: 4058043 - RNA, 14 nt, Staphylococcus aureus subsp. aureus N315
auuuauuuugauua

SEQ ID NO: 4058044 - RNA, 17 nt, Staphylococcus aureus subsp. aureus N315
auuuauuuuugauagug

SEQ ID NO: 4058045 - RNA, 15 nt, Staphylococcus aureus subsp. aureus N315
auuucaacaaacaua

SEQ ID NO: 4058046 - RNA, 16 nt, Staphylococcus aureus subsp. aureus N315
auuucaacaaacauaa

SEQ ID NO: 4058047 - RNA, 20 nt, Staphylococcus aureus subsp. aureus N315
auuucaacuuuuuaauaaua

SEQ ID NO: 4058048 - RNA, 17 nt, Staphylococcus aureus subsp. aureus N315
auuucaagguauacaca

SEQ ID NO: 4058049 - RNA, 20 nt, Staphylococcus aureus subsp. aureus N315
auuucaaugagaagcugucu

SEQ ID NO: 4058050 - RNA, 13 nt, Staphylococcus aureus subsp. aureus N315
auuucaauuugga

SEQ ID NO: 4058051 - RNA, 14 nt, Staphylococcus aureus subsp. aureus N315
auuucaauuuggaa

SEQ ID NO: 4058052 - RNA, 22 nt, Staphylococcus aureus subsp. aureus N315
auuucaccaguagucacuguuu

SEQ ID NO: 4058053 - RNA, 15 nt, Staphylococcus aureus subsp. aureus N315
auuucaccgcuuuca

SEQ ID NO: 4058054 - RNA, 16 nt, Staphylococcus aureus subsp. aureus N315
auuucacucuacaauc

SEQ ID NO: 4058055 - RNA, 11 nt, Staphylococcus aureus subsp. aureus N315
auuucacuuua

SEQ ID NO: 4058056 - RNA, 13 nt, Staphylococcus aureus subsp. aureus N315
auuucacuuuaac

SEQ ID NO: 4058057 - RNA, 14 nt, Staphylococcus aureus subsp. aureus N315
auuucagaaauaca

SEQ ID NO: 4058058 - RNA, 19 nt, Staphylococcus aureus subsp. aureus N315
auuucagaaauacauccau

SEQ ID NO: 4058059 - RNA, 21 nt, Staphylococcus aureus subsp. aureus N315
auuucagcaccgacaauuaua

SEQ ID NO: 4058060 - RNA, 15 nt, Staphylococcus aureus subsp. aureus N315
auuucagcauuugcu

SEQ ID NO: 4058061 - RNA, 15 nt, Staphylococcus aureus subsp. aureus N315
auuucagcgauaacg

SEQ ID NO: 4058062 - RNA, 20 nt, Staphylococcus aureus subsp. aureus N315
auuucaggcguuaauacaua

SEQ ID NO: 4058063 - RNA, 19 nt, Staphylococcus aureus subsp. aureus N315
auuucaguaccauguuuuu

SEQ ID NO: 4058064 - RNA, 20 nt, Staphylococcus aureus subsp. aureus N315
auuucaguucuuagauuuuc

SEQ ID NO: 4058065 - RNA, 17 nt, Staphylococcus aureus subsp. aureus N315
auuucauaguguuugua

SEQ ID NO: 4058066 - RNA, 16 nt, Staphylococcus aureus subsp. aureus N315
auuucauauuguuuag

SEQ ID NO: 4058067 - RNA, 13 nt, Staphylococcus aureus subsp. aureus N315
auuucaucaauaa

SEQ ID NO: 4058068 - RNA, 18 nt, Staphylococcus aureus subsp. aureus N315
auuucaugugcaagcuuu

SEQ ID NO: 4058069 - RNA, 21 nt, Staphylococcus aureus subsp. aureus N315
auuucaugugcaagcuuuuua

SEQ ID NO: 4058070 - RNA, 15 nt, Staphylococcus aureus subsp. aureus N315
auuucaugugucaca

SEQ ID NO: 4058071 - RNA, 19 nt, Staphylococcus aureus subsp. aureus N315
auuucaugugucacaauga

SEQ ID NO: 4058072 - RNA, 13 nt, Staphylococcus aureus subsp. aureus N315
auuucauuuaugc

SEQ ID NO: 4058073 - RNA, 21 nt, Staphylococcus aureus subsp. aureus N315
auuucauuugaaauaguuaaa

SEQ ID NO: 4058074 - RNA, 18 nt, Staphylococcus aureus subsp. aureus N315
auuucccacgugccucau

SEQ ID NO: 4058075 - RNA, 18 nt, Staphylococcus aureus subsp. aureus N315
auuuccuaaaaacuguga

SEQ ID NO: 4058076 - RNA, 18 nt, Staphylococcus aureus subsp. aureus N315
auuuccuuuagcaaaaau

SEQ ID NO: 4058077 - RNA, 16 nt, Staphylococcus aureus subsp. aureus N315
auuucgaaaagaaauu

SEQ ID NO: 4058078 - RNA, 18 nt, Staphylococcus aureus subsp. aureus N315
auuucgaaaagaaauucu

SEQ ID NO: 4058079 - RNA, 20 nt, Staphylococcus aureus subsp. aureus N315
auuucgacaucuagaugaaa

SEQ ID NO: 4058080 - RNA, 18 nt, Staphylococcus aureus subsp. aureus N315
auuucgagauucaauauu

SEQ ID NO: 4058081 - RNA, 20 nt, Staphylococcus aureus subsp. aureus N315
auuucgauaccuaaaauacc

SEQ ID NO: 4058082 - RNA, 13 nt, Staphylococcus aureus subsp. aureus N315
auuucgauuuuca

SEQ ID NO: 4058083 - RNA, 15 nt, Staphylococcus aureus subsp. aureus N315
auuucgccucaucua

SEQ ID NO: 4058084 - RNA, 18 nt, Staphylococcus aureus subsp. aureus N315
auuucgccucaucuaauu

SEQ ID NO: 4058085 - RNA, 20 nt, Staphylococcus aureus subsp. aureus N315
auuucggggacguucaugga

SEQ ID NO: 4058086 - RNA, 21 nt, Staphylococcus aureus subsp. aureus N315
auuucgguauuuuaaauuuau

SEQ ID NO: 4058087 - RNA, 13 nt, Staphylococcus aureus subsp. aureus N315
auuucuaaauuau

SEQ ID NO: 4058088 - RNA, 17 nt, Staphylococcus aureus subsp. aureus N315
auuucuaauacauacug

SEQ ID NO: 4058089 - RNA, 13 nt, Staphylococcus aureus subsp. aureus N315
auuucuaauuuag

SEQ ID NO: 4058090 - RNA, 14 nt, Staphylococcus aureus subsp. aureus N315
auuucuacucgaaa

SEQ ID NO: 4058091 - RNA, 18 nt, Staphylococcus aureus subsp. aureus N315
auuucuauacaaucauuu

SEQ ID NO: 4058092 - RNA, 20 nt, Staphylococcus aureus subsp. aureus N315
auuucuauaucuauuuauca

SEQ ID NO: 4058093 - RNA, 14 nt, Staphylococcus aureus subsp. aureus N315
auuucuaucaaaua

SEQ ID NO: 4058094 - RNA, 16 nt, Staphylococcus aureus subsp. aureus N315
auuucuaucaaauaau

SEQ ID NO: 4058095 - RNA, 20 nt, Staphylococcus aureus subsp. aureus N315
auuucuaucaaauaaugaau

SEQ ID NO: 4058096 - RNA, 16 nt, Staphylococcus aureus subsp. aureus N315
auuucuaugaaaaaaa

SEQ ID NO: 4058097 - RNA, 21 nt, Staphylococcus aureus subsp. aureus N315
auuucuauuuauugagauaga

SEQ ID NO: 4058098 - RNA, 20 nt, Staphylococcus aureus subsp. aureus N315
auuucucguuucgucagauu

SEQ ID NO: 4058099 - RNA, 13 nt, Staphylococcus aureus subsp. aureus N315
auuucugucccac

SEQ ID NO: 4058100 - RNA, 18 nt, Staphylococcus aureus subsp. aureus N315
auuucuucauuaucaaua

SEQ ID NO: 4058101 - RNA, 19 nt, Staphylococcus aureus subsp. aureus N315
auuucuucuccuucaaugu

SEQ ID NO: 4058102 - RNA, 13 nt, Staphylococcus aureus subsp. aureus N315
auuucuucugcua

SEQ ID NO: 4058103 - RNA, 19 nt, Staphylococcus aureus subsp. aureus N315
auuucuugauggauauuca

SEQ ID NO: 4058104 - RNA, 22 nt, Staphylococcus aureus subsp. aureus N315
auuucuugugcgguaaccauuu

SEQ ID NO: 4058105 - RNA, 21 nt, Staphylococcus aureus subsp. aureus N315
auuucuuuucauuaucauuaa

SEQ ID NO: 4058106 - RNA, 13 nt, Staphylococcus aureus subsp. aureus N315
auuucuuuuuaaa

SEQ ID NO: 4058107 - RNA, 15 nt, Staphylococcus aureus subsp. aureus N315
auuucuuuuuaaaau

SEQ ID NO: 4058108 - RNA, 19 nt, Staphylococcus aureus subsp. aureus N315
auuucuuuuuaaaaucguu

SEQ ID NO: 4058109 - RNA, 16 nt, Staphylococcus aureus subsp. aureus N315
auuugaaagacauuua

SEQ ID NO: 4058110 - RNA, 15 nt, Staphylococcus aureus subsp. aureus N315
auuugaaauauacca

SEQ ID NO: 4058111 - RNA, 16 nt, Staphylococcus aureus subsp. aureus N315
auuugaacaucauuua

SEQ ID NO: 4058112 - RNA, 15 nt, Staphylococcus aureus subsp. aureus N315
auuugaagauuuugu

SEQ ID NO: 4058113 - RNA, 12 nt, Staphylococcus aureus subsp. aureus N315
auuugaauacuu

SEQ ID NO: 4058114 - RNA, 19 nt, Staphylococcus aureus subsp. aureus N315
auuugaauugacuuacauu

SEQ ID NO: 4058115 - RNA, 22 nt, Staphylococcus aureus subsp. aureus N315
auuugaauugacuuacauuuua

SEQ ID NO: 4058116 - RNA, 15 nt, Staphylococcus aureus subsp. aureus N315
auuugacacauuauu

SEQ ID NO: 4058117 - RNA, 21 nt, Staphylococcus aureus subsp. aureus N315
auuugacauaauccagccaca

SEQ ID NO: 4058118 - RNA, 13 nt, Staphylococcus aureus subsp. aureus N315
auuugauacaacu

SEQ ID NO: 4058119 - RNA, 22 nt, Staphylococcus aureus subsp. aureus N315
auuugauacaacuauauguguc

SEQ ID NO: 4058120 - RNA, 19 nt, Staphylococcus aureus subsp. aureus N315
auuugauauaguuauaugu

SEQ ID NO: 4058121 - RNA, 12 nt, Staphylococcus aureus subsp. aureus N315
auuugaucaacc

SEQ ID NO: 4058122 - RNA, 21 nt, Staphylococcus aureus subsp. aureus N315
auuugaucaaccuguucuuua

SEQ ID NO: 4058123 - RNA, 16 nt, Staphylococcus aureus subsp. aureus N315
auuugauguucuugaa

SEQ ID NO: 4058124 - RNA, 16 nt, Staphylococcus aureus subsp. aureus N315
auuugauuauucuuca

SEQ ID NO: 4058125 - RNA, 15 nt, Staphylococcus aureus subsp. aureus N315
auuugauucuauuuc

SEQ ID NO: 4058126 - RNA, 23 nt, Staphylococcus aureus subsp. aureus N315
auuugauucuauuucuucauuug

SEQ ID NO: 4058127 - RNA, 21 nt, Staphylococcus aureus subsp. aureus N315
auuugauuuggguaauguuuu

SEQ ID NO: 4058128 - RNA, 15 nt, Staphylococcus aureus subsp. aureus N315
auuugcaaaaucaac

SEQ ID NO: 4058129 - RNA, 19 nt, Staphylococcus aureus subsp. aureus N315
auuugcacaaagauauguu

SEQ ID NO: 4058130 - RNA, 15 nt, Staphylococcus aureus subsp. aureus N315
auuugccauauacac

SEQ ID NO: 4058131 - RNA, 23 nt, Staphylococcus aureus subsp. aureus N315
auuugccauauacacacuaagga

SEQ ID NO: 4058132 - RNA, 21 nt, Staphylococcus aureus subsp. aureus N315
auuugccccgccauucauaaa

SEQ ID NO: 4058133 - RNA, 23 nt, Staphylococcus aureus subsp. aureus N315
auuugccccgccauucauaaaug

SEQ ID NO: 4058134 - RNA, 17 nt, Staphylococcus aureus subsp. aureus N315
auuugcgauuucuucug

SEQ ID NO: 4058135 - RNA, 21 nt, Staphylococcus aureus subsp. aureus N315
auuugcuguuaauaaaucauu

SEQ ID NO: 4058136 - RNA, 15 nt, Staphylococcus aureus subsp. aureus N315
auuuggaaguuuuca

SEQ ID NO: 4058137 - RNA, 17 nt, Staphylococcus aureus subsp. aureus N315
auuuggaggugaugaga

SEQ ID NO: 4058138 - RNA, 15 nt, Staphylococcus aureus subsp. aureus N315
auuuggcguaaugau

SEQ ID NO: 4058139 - RNA, 13 nt, Staphylococcus aureus subsp. aureus N315
auuuggucaaguu

SEQ ID NO: 4058140 - RNA, 19 nt, Staphylococcus aureus subsp. aureus N315
auuuggucauagaaauuuu

SEQ ID NO: 4058141 - RNA, 20 nt, Staphylococcus aureus subsp. aureus N315
auuuggucauagaaauuuua

SEQ ID NO: 4058142 - RNA, 23 nt, Staphylococcus aureus subsp. aureus N315
auuugguggagaaccuuuaaaag

SEQ ID NO: 4058143 - RNA, 19 nt, Staphylococcus aureus subsp. aureus N315
auuuguaaagacaccauca

SEQ ID NO: 4058144 - RNA, 18 nt, Staphylococcus aureus subsp. aureus N315
auuuguaaauauuuuuua

SEQ ID NO: 4058145 - RNA, 17 nt, Staphylococcus aureus subsp. aureus N315
auuuguaacuauugaaa

SEQ ID NO: 4058146 - RNA, 20 nt, Staphylococcus aureus subsp. aureus N315
auuuguaacuauugaaaaua

SEQ ID NO: 4058147 - RNA, 14 nt, Staphylococcus aureus subsp. aureus N315
auuuguaauacaag

SEQ ID NO: 4058148 - RNA, 16 nt, Staphylococcus aureus subsp. aureus N315
auuuguaaucccauuu

SEQ ID NO: 4058149 - RNA, 15 nt, Staphylococcus aureus subsp. aureus N315
auuuguaguaaguag

SEQ ID NO: 4058150 - RNA, 19 nt, Staphylococcus aureus subsp. aureus N315
auuugucaucguauuucua

SEQ ID NO: 4058151 - RNA, 17 nt, Staphylococcus aureus subsp. aureus N315
auuuguccauccauuuu

SEQ ID NO: 4058152 - RNA, 19 nt, Staphylococcus aureus subsp. aureus N315
auuugugcauucaucaaug

SEQ ID NO: 4058153 - RNA, 16 nt, Staphylococcus aureus subsp. aureus N315
auuuguguauaaaugu

SEQ ID NO: 4058154 - RNA, 21 nt, Staphylococcus aureus subsp. aureus N315
auuugugugcgauaagcaaaa

SEQ ID NO: 4058155 - RNA, 18 nt, Staphylococcus aureus subsp. aureus N315
auuuguuaauuuaauaau

SEQ ID NO: 4058156 - RNA, 13 nt, Staphylococcus aureus subsp. aureus N315
auuuguugauagu

SEQ ID NO: 4058157 - RNA, 17 nt, Staphylococcus aureus subsp. aureus N315
auuuguuguuauuauaa

SEQ ID NO: 4058158 - RNA, 13 nt, Staphylococcus aureus subsp. aureus N315
auuuguuuuaaau

SEQ ID NO: 4058159 - RNA, 15 nt, Staphylococcus aureus subsp. aureus N315
auuuuaaaaaugcug

SEQ ID NO: 4058160 - RNA, 22 nt, Staphylococcus aureus subsp. aureus N315
auuuuaaacaugaacaaucaga

SEQ ID NO: 4058161 - RNA, 20 nt, Staphylococcus aureus subsp. aureus N315
auuuuaaaccguuauauauu

SEQ ID NO: 4058162 - RNA, 21 nt, Staphylococcus aureus subsp. aureus N315
auuuuaaacguaucauuuaaa

SEQ ID NO: 4058163 - RNA, 17 nt, Staphylococcus aureus subsp. aureus N315
auuuuaaauaaaaugca

SEQ ID NO: 4058164 - RNA, 21 nt, Staphylococcus aureus subsp. aureus N315
auuuuaaauauugauauaaaa

SEQ ID NO: 4058165 - RNA, 12 nt, Staphylococcus aureus subsp. aureus N315
auuuuaaaucuu

SEQ ID NO: 4058166 - RNA, 15 nt, Staphylococcus aureus subsp. aureus N315
auuuuaaauuuauaa

SEQ ID NO: 4058167 - RNA, 15 nt, Staphylococcus aureus subsp. aureus N315
auuuuaacuuauaua

SEQ ID NO: 4058168 - RNA, 18 nt, Staphylococcus aureus subsp. aureus N315
auuuuaauaaaaucaucu

SEQ ID NO: 4058169 - RNA, 14 nt, Staphylococcus aureus subsp. aureus N315
auuuuaauauauuu

SEQ ID NO: 4058170 - RNA, 15 nt, Staphylococcus aureus subsp. aureus N315
auuuuaauauuaugu

SEQ ID NO: 4058171 - RNA, 21 nt, Staphylococcus aureus subsp. aureus N315
auuuuaauauugaaaugagcu

SEQ ID NO: 4058172 - RNA, 20 nt, Staphylococcus aureus subsp. aureus N315
auuuuaauauugacauuuac

SEQ ID NO: 4058173 - RNA, 15 nt, Staphylococcus aureus subsp. aureus N315
auuuuaauauuuucu

SEQ ID NO: 4058174 - RNA, 17 nt, Staphylococcus aureus subsp. aureus N315
auuuuaaugauuuuuca

SEQ ID NO: 4058175 - RNA, 13 nt, Staphylococcus aureus subsp. aureus N315
auuuuaauuuuca

SEQ ID NO: 4058176 - RNA, 18 nt, Staphylococcus aureus subsp. aureus N315
auuuuacaaaauauggaa

SEQ ID NO: 4058177 - RNA, 14 nt, Staphylococcus aureus subsp. aureus N315
auuuuaccaucaau

SEQ ID NO: 4058178 - RNA, 16 nt, Staphylococcus aureus subsp. aureus N315
auuuuaccuaguaacu

SEQ ID NO: 4058179 - RNA, 17 nt, Staphylococcus aureus subsp. aureus N315
auuuuaccuguuucuau

SEQ ID NO: 4058180 - RNA, 21 nt, Staphylococcus aureus subsp. aureus N315
auuuuaccuguuucuauauua

SEQ ID NO: 4058181 - RNA, 21 nt, Staphylococcus aureus subsp. aureus N315
auuuuaccuguuucuuuacuu

SEQ ID NO: 4058182 - RNA, 21 nt, Staphylococcus aureus subsp. aureus N315
auuuuaccuucgcauacuuuu

SEQ ID NO: 4058183 - RNA, 21 nt, Staphylococcus aureus subsp. aureus N315
auuuuacuugaauauagcugu

SEQ ID NO: 4058184 - RNA, 18 nt, Staphylococcus aureus subsp. aureus N315
auuuuagauuuaguuuuu

SEQ ID NO: 4058185 - RNA, 16 nt, Staphylococcus aureus subsp. aureus N315
auuuuagcaaaagcuu

SEQ ID NO: 4058186 - RNA, 17 nt, Staphylococcus aureus subsp. aureus N315
auuuuaggcaauguaau

SEQ ID NO: 4058187 - RNA, 19 nt, Staphylococcus aureus subsp. aureus N315
auuuuagguggcauuuuau

SEQ ID NO: 4058188 - RNA, 22 nt, Staphylococcus aureus subsp. aureus N315
auuuuaguucacaugaauuuua

SEQ ID NO: 4058189 - RNA, 12 nt, Staphylococcus aureus subsp. aureus N315
auuuuauaaaau

SEQ ID NO: 4058190 - RNA, 14 nt, Staphylococcus aureus subsp. aureus N315
auuuuauaaaguuu

SEQ ID NO: 4058191 - RNA, 14 nt, Staphylococcus aureus subsp. aureus N315
auuuuauaagaauu

SEQ ID NO: 4058192 - RNA, 18 nt, Staphylococcus aureus subsp. aureus N315
auuuuauaagaauuuaaa

SEQ ID NO: 4058193 - RNA, 13 nt, Staphylococcus aureus subsp. aureus N315
auuuuauacauaa

SEQ ID NO: 4058194 - RNA, 18 nt, Staphylococcus aureus subsp. aureus N315
auuuuauacauaaauauu

SEQ ID NO: 4058195 - RNA, 18 nt, Staphylococcus aureus subsp. aureus N315
auuuuauauaaaaagaag

SEQ ID NO: 4058196 - RNA, 12 nt, Staphylococcus aureus subsp. aureus N315
auuuuauauauc

SEQ ID NO: 4058197 - RNA, 23 nt, Staphylococcus aureus subsp. aureus N315
auuuuauauauccuguuucauau

SEQ ID NO: 4058198 - RNA, 14 nt, Staphylococcus aureus subsp. aureus N315
auuuuauauuuuag

SEQ ID NO: 4058199 - RNA, 14 nt, Staphylococcus aureus subsp. aureus N315
auuuuaucaucuau

SEQ ID NO: 4058200 - RNA, 23 nt, Staphylococcus aureus subsp. aureus N315
auuuuauccaaaccaauuuuaac

SEQ ID NO: 4058201 - RNA, 16 nt, Staphylococcus aureus subsp. aureus N315
auuuuaucuaaacauu

SEQ ID NO: 4058202 - RNA, 20 nt, Staphylococcus aureus subsp. aureus N315
auuuuaucuaaagcuauaaa

SEQ ID NO: 4058203 - RNA, 23 nt, Staphylococcus aureus subsp. aureus N315
auuuuaucuaaagcuauaaaaaa

SEQ ID NO: 4058204 - RNA, 16 nt, Staphylococcus aureus subsp. aureus N315
auuuuaucugaaaaua

SEQ ID NO: 4058205 - RNA, 12 nt, Staphylococcus aureus subsp. aureus N315
auuuuaugauuu

SEQ ID NO: 4058206 - RNA, 16 nt, Staphylococcus aureus subsp. aureus N315
auuuuaugauuugauu

SEQ ID NO: 4058207 - RNA, 20 nt, Staphylococcus aureus subsp. aureus N315
auuuuauugaguaucaugcu

SEQ ID NO: 4058208 - RNA, 11 nt, Staphylococcus aureus subsp. aureus N315
auuuucaaaac

SEQ ID NO: 4058209 - RNA, 19 nt, Staphylococcus aureus subsp. aureus N315
auuuucaaaaccaauuaau

SEQ ID NO: 4058210 - RNA, 15 nt, Staphylococcus aureus subsp. aureus N315
auuuucaaaacugcc

SEQ ID NO: 4058211 - RNA, 18 nt, Staphylococcus aureus subsp. aureus N315
auuuucaaaacugccaaa

SEQ ID NO: 4058212 - RNA, 19 nt, Staphylococcus aureus subsp. aureus N315
auuuucaaaacugccaaaa

SEQ ID NO: 4058213 - RNA, 22 nt, Staphylococcus aureus subsp. aureus N315
auuuucaaagacguacaugcuu

SEQ ID NO: 4058214 - RNA, 14 nt, Staphylococcus aureus subsp. aureus N315
auuuucaaauuucu

SEQ ID NO: 4058215 - RNA, 19 nt, Staphylococcus aureus subsp. aureus N315
auuuucaaauuucuaacuu

SEQ ID NO: 4058216 - RNA, 23 nt, Staphylococcus aureus subsp. aureus N315
auuuucaagaccaaauauuuuau

SEQ ID NO: 4058217 - RNA, 16 nt, Staphylococcus aureus subsp. aureus N315
auuuucaauaaaaaug

SEQ ID NO: 4058218 - RNA, 16 nt, Staphylococcus aureus subsp. aureus N315
auuuucaauaaauuuu

SEQ ID NO: 4058219 - RNA, 18 nt, Staphylococcus aureus subsp. aureus N315
auuuucaauaaauuuuau

SEQ ID NO: 4058220 - RNA, 21 nt, Staphylococcus aureus subsp. aureus N315
auuuucaauaaauuuuauaua

SEQ ID NO: 4058221 - RNA, 22 nt, Staphylococcus aureus subsp. aureus N315
auuuucaauacuugaaagauuu

SEQ ID NO: 4058222 - RNA, 22 nt, Staphylococcus aureus subsp. aureus N315
auuuucaaugauuaaaucuucu

SEQ ID NO: 4058223 - RNA, 16 nt, Staphylococcus aureus subsp. aureus N315
auuuucaauuagaaaa

SEQ ID NO: 4058224 - RNA, 18 nt, Staphylococcus aureus subsp. aureus N315
auuuucaauuagaaaaua

SEQ ID NO: 4058225 - RNA, 21 nt, Staphylococcus aureus subsp. aureus N315
auuuucaauuagaaaauaucu

SEQ ID NO: 4058226 - RNA, 22 nt, Staphylococcus aureus subsp. aureus N315
auuuucaauuagaaaauuucuc

SEQ ID NO: 4058227 - RNA, 17 nt, Staphylococcus aureus subsp. aureus N315
auuuucacuaauauuuc

SEQ ID NO: 4058228 - RNA, 16 nt, Staphylococcus aureus subsp. aureus N315
auuuucaguuaaaaua

SEQ ID NO: 4058229 - RNA, 15 nt, Staphylococcus aureus subsp. aureus N315
auuuucauauaaaua

SEQ ID NO: 4058230 - RNA, 14 nt, Staphylococcus aureus subsp. aureus N315
auuuucaucauuaa

SEQ ID NO: 4058231 - RNA, 19 nt, Staphylococcus aureus subsp. aureus N315
auuuucauuguauguugaa

SEQ ID NO: 4058232 - RNA, 19 nt, Staphylococcus aureus subsp. aureus N315
auuuucauuuaauccuucu

SEQ ID NO: 4058233 - RNA, 11 nt, Staphylococcus aureus subsp. aureus N315
auuuucauuuu

SEQ ID NO: 4058234 - RNA, 15 nt, Staphylococcus aureus subsp. aureus N315
auuuuccguguuuau

SEQ ID NO: 4058235 - RNA, 14 nt, Staphylococcus aureus subsp. aureus N315
auuuucuaaauaua

SEQ ID NO: 4058236 - RNA, 17 nt, Staphylococcus aureus subsp. aureus N315
auuuucuggccacuaau

SEQ ID NO: 4058237 - RNA, 14 nt, Staphylococcus aureus subsp. aureus N315
auuuucuguccaaa

SEQ ID NO: 4058238 - RNA, 17 nt, Staphylococcus aureus subsp. aureus N315
auuuucuguccaaaaag

SEQ ID NO: 4058239 - RNA, 20 nt, Staphylococcus aureus subsp. aureus N315
auuuucuuagaaaaucaagu

SEQ ID NO: 4058240 - RNA, 17 nt, Staphylococcus aureus subsp. aureus N315
auuuucuugccaucaau

SEQ ID NO: 4058241 - RNA, 20 nt, Staphylococcus aureus subsp. aureus N315
auuuucuugccaucaauuuc

SEQ ID NO: 4058242 - RNA, 23 nt, Staphylococcus aureus subsp. aureus N315
auuuucuugccaucaauuucugu

SEQ ID NO: 4058243 - RNA, 17 nt, Staphylococcus aureus subsp. aureus N315
auuuucuuuaauaacua

SEQ ID NO: 4058244 - RNA, 15 nt, Staphylococcus aureus subsp. aureus N315
auuuucuuuuucuaa

SEQ ID NO: 4058245 - RNA, 21 nt, Staphylococcus aureus subsp. aureus N315
auuuucuuuuucuaaauaaac

SEQ ID NO: 4058246 - RNA, 16 nt, Staphylococcus aureus subsp. aureus N315
auuuucuuuuuuaauu

SEQ ID NO: 4058247 - RNA, 16 nt, Staphylococcus aureus subsp. aureus N315
auuuugaauaaaaaaa

SEQ ID NO: 4058248 - RNA, 21 nt, Staphylococcus aureus subsp. aureus N315
auuuugacgccagaauaaauc

SEQ ID NO: 4058249 - RNA, 19 nt, Staphylococcus aureus subsp. aureus N315
auuuugagucguagauacu

SEQ ID NO: 4058250 - RNA, 22 nt, Staphylococcus aureus subsp. aureus N315
auuuugagucguagauacuacc

SEQ ID NO: 4058251 - RNA, 22 nt, Staphylococcus aureus subsp. aureus N315
auuuugcgaaaauaucauuucu

SEQ ID NO: 4058252 - RNA, 21 nt, Staphylococcus aureus subsp. aureus N315
auuuugcugccaaaaaguauu

SEQ ID NO: 4058253 - RNA, 17 nt, Staphylococcus aureus subsp. aureus N315
auuuugcuuuauuuucu

SEQ ID NO: 4058254 - RNA, 13 nt, Staphylococcus aureus subsp. aureus N315
auuuuggauuuuu

SEQ ID NO: 4058255 - RNA, 15 nt, Staphylococcus aureus subsp. aureus N315
auuuuguauaaccuu

SEQ ID NO: 4058256 - RNA, 17 nt, Staphylococcus aureus subsp. aureus N315
auuuuguauuuuucaaa

SEQ ID NO: 4058257 - RNA, 14 nt, Staphylococcus aureus subsp. aureus N315
auuuugugaauuua

SEQ ID NO: 4058258 - RNA, 15 nt, Staphylococcus aureus subsp. aureus N315
auuuugugaauuuau

SEQ ID NO: 4058259 - RNA, 18 nt, Staphylococcus aureus subsp. aureus N315
auuuuguuucaacauuuc

SEQ ID NO: 4058260 - RNA, 14 nt, Staphylococcus aureus subsp. aureus N315
auuuuguuucacua

SEQ ID NO: 4058261 - RNA, 18 nt, Staphylococcus aureus subsp. aureus N315
auuuuuaaaugauucuuu

SEQ ID NO: 4058262 - RNA, 17 nt, Staphylococcus aureus subsp. aureus N315
auuuuuaaauuacuaua

SEQ ID NO: 4058263 - RNA, 23 nt, Staphylococcus aureus subsp. aureus N315
auuuuuaacagcgugaauauaag

SEQ ID NO: 4058264 - RNA, 12 nt, Staphylococcus aureus subsp. aureus N315
auuuuuaauaua

SEQ ID NO: 4058265 - RNA, 17 nt, Staphylococcus aureus subsp. aureus N315
auuuuuaauuucuggua

SEQ ID NO: 4058266 - RNA, 21 nt, Staphylococcus aureus subsp. aureus N315
auuuuuacaaagugauuuaaa

SEQ ID NO: 4058267 - RNA, 17 nt, Staphylococcus aureus subsp. aureus N315
auuuuuacuaaaucauu

SEQ ID NO: 4058268 - RNA, 19 nt, Staphylococcus aureus subsp. aureus N315
auuuuuagacauuaaaaaa

SEQ ID NO: 4058269 - RNA, 13 nt, Staphylococcus aureus subsp. aureus N315
auuuuuaguuaaa

SEQ ID NO: 4058270 - RNA, 18 nt, Staphylococcus aureus subsp. aureus N315
auuuuuaguuagaaagua

SEQ ID NO: 4058271 - RNA, 13 nt, Staphylococcus aureus subsp. aureus N315
auuuuuauauaaa

SEQ ID NO: 4058272 - RNA, 22 nt, Staphylococcus aureus subsp. aureus N315
auuuuuauauaaaauuucauau

SEQ ID NO: 4058273 - RNA, 14 nt, Staphylococcus aureus subsp. aureus N315
auuuuuaucaucau

SEQ ID NO: 4058274 - RNA, 13 nt, Staphylococcus aureus subsp. aureus N315
auuuuuaucaucu

SEQ ID NO: 4058275 - RNA, 20 nt, Staphylococcus aureus subsp. aureus N315
auuuuuaucccacuccuuau

SEQ ID NO: 4058276 - RNA, 14 nt, Staphylococcus aureus subsp. aureus N315
auuuuucaaauguu

SEQ ID NO: 4058277 - RNA, 16 nt, Staphylococcus aureus subsp. aureus N315
auuuuucaauuaaaug

SEQ ID NO: 4058278 - RNA, 16 nt, Staphylococcus aureus subsp. aureus N315
auuuuucuaaaugauu

SEQ ID NO: 4058279 - RNA, 14 nt, Staphylococcus aureus subsp. aureus N315
auuuuucuuauaaa

SEQ ID NO: 4058280 - RNA, 16 nt, Staphylococcus aureus subsp. aureus N315
auuuuucuuauaaaaa

SEQ ID NO: 4058281 - RNA, 20 nt, Staphylococcus aureus subsp. aureus N315
auuuuucuuauaaaaaucuu

SEQ ID NO: 4058282 - RNA, 15 nt, Staphylococcus aureus subsp. aureus N315
auuuuucuucuuuuu

SEQ ID NO: 4058283 - RNA, 16 nt, Staphylococcus aureus subsp. aureus N315
auuuuugacuguuaaa

SEQ ID NO: 4058284 - RNA, 19 nt, Staphylococcus aureus subsp. aureus N315
auuuuugacuguuaaacaa

SEQ ID NO: 4058285 - RNA, 14 nt, Staphylococcus aureus subsp. aureus N315
auuuuugauuuaau

SEQ ID NO: 4058286 - RNA, 17 nt, Staphylococcus aureus subsp. aureus N315
auuuuugauuuaauaau

SEQ ID NO: 4058287 - RNA, 16 nt, Staphylococcus aureus subsp. aureus N315
auuuuuguauuuaugu

SEQ ID NO: 4058288 - RNA, 23 nt, Staphylococcus aureus subsp. aureus N315
auuuuuuaaaugcguaguauaaa

SEQ ID NO: 4058289 - RNA, 15 nt, Staphylococcus aureus subsp. aureus N315
auuuuuuaauaauca

SEQ ID NO: 4058290 - RNA, 17 nt, Staphylococcus aureus subsp. aureus N315
auuuuuuaaugucuaaa

SEQ ID NO: 4058291 - RNA, 18 nt, Staphylococcus aureus subsp. aureus N315
auuuuuuagacaaauguu

SEQ ID NO: 4058292 - RNA, 20 nt, Staphylococcus aureus subsp. aureus N315
auuuuuuauuccgaacaugu

SEQ ID NO: 4058293 - RNA, 18 nt, Staphylococcus aureus subsp. aureus N315
auuuuuucaugauuuacu

SEQ ID NO: 4058294 - RNA, 18 nt, Staphylococcus aureus subsp. aureus N315
auuuuuugugccuuucuc

SEQ ID NO: 4058295 - RNA, 12 nt, Staphylococcus aureus subsp. aureus N315
auuuuuuuaaag

SEQ ID NO: 4058296 - RNA, 11 nt, Staphylococcus aureus subsp. aureus N315
auuuuuuuagg

SEQ ID NO: 4058297 - RNA, 15 nt, Staphylococcus aureus subsp. aureus N315
auuuuuuuauauuuu

SEQ ID NO: 4058298 - RNA, 18 nt, Staphylococcus aureus subsp. aureus N315
auuuuuuucacuaauuuc

SEQ ID NO: 4058299 - RNA, 18 nt, Staphylococcus aureus subsp. aureus N315
auuuuuuuccaagcauca

SEQ ID NO: 4058300 - RNA, 22 nt, Staphylococcus aureus subsp. aureus N315
auuuuuuucguaacauuuaaaa

SEQ ID NO: 4058301 - RNA, 23 nt, Staphylococcus aureus subsp. aureus N315
auuuuuuucguaacauuuaaaaa

SEQ ID NO: 4058302 - RNA, 19 nt, Staphylococcus aureus subsp. aureus N315
auuuuuuugacaguuuuaa

SEQ ID NO: 4058303 - RNA, 12 nt, Staphylococcus aureus subsp. aureus N315
caaaaaaacaaa

SEQ ID NO: 4058304 - RNA, 21 nt, Staphylococcus aureus subsp. aureus N315
caaaaaaaccgaacaucugaa

SEQ ID NO: 4058305 - RNA, 20 nt, Staphylococcus aureus subsp. aureus N315
caaaaaaagacacaucacua

SEQ ID NO: 4058306 - RNA, 15 nt, Staphylococcus aureus subsp. aureus N315
caaaaaaagcugauu

SEQ ID NO: 4058307 - RNA, 15 nt, Staphylococcus aureus subsp. aureus N315
caaaaaauaaaaacu

SEQ ID NO: 4058308 - RNA, 21 nt, Staphylococcus aureus subsp. aureus N315
caaaaaauaauagcaaaauua

SEQ ID NO: 4058309 - RNA, 20 nt, Staphylococcus aureus subsp. aureus N315
caaaaaaucgaacaaaugaa

SEQ ID NO: 4058310 - RNA, 15 nt, Staphylococcus aureus subsp. aureus N315
caaaaaauuguauaa

SEQ ID NO: 4058311 - RNA, 17 nt, Staphylococcus aureus subsp. aureus N315
caaaaacaguuacaacu

SEQ ID NO: 4058312 - RNA, 19 nt, Staphylococcus aureus subsp. aureus N315
caaaaacaguuacaacuga

SEQ ID NO: 4058313 - RNA, 22 nt, Staphylococcus aureus subsp. aureus N315
caaaaagcccuauuguuuuuua

SEQ ID NO: 4058314 - RNA, 18 nt, Staphylococcus aureus subsp. aureus N315
caaaaauaauuaaauccg

SEQ ID NO: 4058315 - RNA, 21 nt, Staphylococcus aureus subsp. aureus N315
caaaaauaauuaugaaaagua

SEQ ID NO: 4058316 - RNA, 17 nt, Staphylococcus aureus subsp. aureus N315
caaaaauagauugaaaa

SEQ ID NO: 4058317 - RNA, 17 nt, Staphylococcus aureus subsp. aureus N315
caaaaauaguaaaaccu

SEQ ID NO: 4058318 - RNA, 22 nt, Staphylococcus aureus subsp. aureus N315
caaaaauaguaaaaccuguauc

SEQ ID NO: 4058319 - RNA, 17 nt, Staphylococcus aureus subsp. aureus N315
caaaaauuguaaaaccu

SEQ ID NO: 4058320 - RNA, 22 nt, Staphylococcus aureus subsp. aureus N315
caaaacaaaaaauaucuuuuug

SEQ ID NO: 4058321 - RNA, 23 nt, Staphylococcus aureus subsp. aureus N315
caaaacaaaaaauaucuuuuugu

SEQ ID NO: 4058322 - RNA, 11 nt, Staphylococcus aureus subsp. aureus N315
caaaacaaauc

SEQ ID NO: 4058323 - RNA, 19 nt, Staphylococcus aureus subsp. aureus N315
caaaacaaauccauuaaau

SEQ ID NO: 4058324 - RNA, 22 nt, Staphylococcus aureus subsp. aureus N315
caaaacaauauacccagaugaa

SEQ ID NO: 4058325 - RNA, 21 nt, Staphylococcus aureus subsp. aureus N315
caaaacaauuuaaaaagcagu

SEQ ID NO: 4058326 - RNA, 18 nt, Staphylococcus aureus subsp. aureus N315
caaaacauuuugugacuu

SEQ ID NO: 4058327 - RNA, 14 nt, Staphylococcus aureus subsp. aureus N315
caaaaccaaaugaa

SEQ ID NO: 4058328 - RNA, 22 nt, Staphylococcus aureus subsp. aureus N315
caaaaccgcuauaaaauuuuga

SEQ ID NO: 4058329 - RNA, 17 nt, Staphylococcus aureus subsp. aureus N315
caaaacgcauuucaugu

SEQ ID NO: 4058330 - RNA, 20 nt, Staphylococcus aureus subsp. aureus N315
caaaacgcauuucauguguc

SEQ ID NO: 4058331 - RNA, 22 nt, Staphylococcus aureus subsp. aureus N315
caaaacuagcaguaauauguug

SEQ ID NO: 4058332 - RNA, 19 nt, Staphylococcus aureus subsp. aureus N315
caaaacuuuuacuuucuca

SEQ ID NO: 4058333 - RNA, 20 nt, Staphylococcus aureus subsp. aureus N315
caaaagaaaguuaauuaugu

SEQ ID NO: 4058334 - RNA, 12 nt, Staphylococcus aureus subsp. aureus N315
caaaagaugaaa

SEQ ID NO: 4058335 - RNA, 15 nt, Staphylococcus aureus subsp. aureus N315
caaaagaugaaaauc

SEQ ID NO: 4058336 - RNA, 20 nt, Staphylococcus aureus subsp. aureus N315
caaaagauguuucaaaauaa

SEQ ID NO: 4058337 - RNA, 21 nt, Staphylococcus aureus subsp. aureus N315
caaaagauguuucaaaauaau

SEQ ID NO: 4058338 - RNA, 23 nt, Staphylococcus aureus subsp. aureus N315
caaaagauguuucaaaauaauuu

SEQ ID NO: 4058339 - RNA, 15 nt, Staphylococcus aureus subsp. aureus N315
caaaagcgcaggcga

SEQ ID NO: 4058340 - RNA, 20 nt, Staphylococcus aureus subsp. aureus N315
caaaaggauaagaacgagaa

SEQ ID NO: 4058341 - RNA, 13 nt, Staphylococcus aureus subsp. aureus N315
caaaaguaugauu

SEQ ID NO: 4058342 - RNA, 14 nt, Staphylococcus aureus subsp. aureus N315
caaaaguaugauuu

SEQ ID NO: 4058343 - RNA, 19 nt, Staphylococcus aureus subsp. aureus N315
caaaaguuauauaaauuug

SEQ ID NO: 4058344 - RNA, 21 nt, Staphylococcus aureus subsp. aureus N315
caaaaguuauauaaauuugua

SEQ ID NO: 4058345 - RNA, 13 nt, Staphylococcus aureus subsp. aureus N315
caaaauaguaaag

SEQ ID NO: 4058346 - RNA, 16 nt, Staphylococcus aureus subsp. aureus N315
caaaauauaaaauccu

SEQ ID NO: 4058347 - RNA, 21 nt, Staphylococcus aureus subsp. aureus N315
caaaaucaccuuuuuuaacuu

SEQ ID NO: 4058348 - RNA, 17 nt, Staphylococcus aureus subsp. aureus N315
caaaaucucaacagcaa

SEQ ID NO: 4058349 - RNA, 19 nt, Staphylococcus aureus subsp. aureus N315
caaaaucucaacagcaaaa

SEQ ID NO: 4058350 - RNA, 22 nt, Staphylococcus aureus subsp. aureus N315
caaaaucucaacagcaaaaaau

SEQ ID NO: 4058351 - RNA, 15 nt, Staphylococcus aureus subsp. aureus N315
caaaaucuuuacuug

SEQ ID NO: 4058352 - RNA, 23 nt, Staphylococcus aureus subsp. aureus N315
caaaaugccaagaagacauugga

SEQ ID NO: 4058353 - RNA, 22 nt, Staphylococcus aureus subsp. aureus N315
caaaaugguuaaaaucgcagca

SEQ ID NO: 4058354 - RNA, 18 nt, Staphylococcus aureus subsp. aureus N315
caaaauguuuaacaauaa

SEQ ID NO: 4058355 - RNA, 19 nt, Staphylococcus aureus subsp. aureus N315
caaaauuauguaaaaaaua

SEQ ID NO: 4058356 - RNA, 18 nt, Staphylococcus aureus subsp. aureus N315
caaaauugcugacaccua

SEQ ID NO: 4058357 - RNA, 12 nt, Staphylococcus aureus subsp. aureus N315
caaaauuuucua

SEQ ID NO: 4058358 - RNA, 18 nt, Staphylococcus aureus subsp. aureus N315
caaacaaagcucaauaaa

SEQ ID NO: 4058359 - RNA, 22 nt, Staphylococcus aureus subsp. aureus N315
caaacaacaucacuuuaggguu

SEQ ID NO: 4058360 - RNA, 21 nt, Staphylococcus aureus subsp. aureus N315
caaacaaccugugauaaaaau

SEQ ID NO: 4058361 - RNA, 12 nt, Staphylococcus aureus subsp. aureus N315
caaacaauacag

SEQ ID NO: 4058362 - RNA, 15 nt, Staphylococcus aureus subsp. aureus N315
caaacaauacauaau

SEQ ID NO: 4058363 - RNA, 16 nt, Staphylococcus aureus subsp. aureus N315
caaacaauuuuguaca

SEQ ID NO: 4058364 - RNA, 21 nt, Staphylococcus aureus subsp. aureus N315
caaacaauuuuguacauuucu

SEQ ID NO: 4058365 - RNA, 20 nt, Staphylococcus aureus subsp. aureus N315
caaacauagauacaaaguac

SEQ ID NO: 4058366 - RNA, 21 nt, Staphylococcus aureus subsp. aureus N315
caaacauuaaucuauauaaaa

SEQ ID NO: 4058367 - RNA, 19 nt, Staphylococcus aureus subsp. aureus N315
caaacauuccucuauugua

SEQ ID NO: 4058368 - RNA, 23 nt, Staphylococcus aureus subsp. aureus N315
caaacauuucgguaugauauuuc

SEQ ID NO: 4058369 - RNA, 12 nt, Staphylococcus aureus subsp. aureus N315
caaacauuuguu

SEQ ID NO: 4058370 - RNA, 14 nt, Staphylococcus aureus subsp. aureus N315
caaaccaccaaaaa

SEQ ID NO: 4058371 - RNA, 18 nt, Staphylococcus aureus subsp. aureus N315
caaaccauaaguaaaacu

SEQ ID NO: 4058372 - RNA, 16 nt, Staphylococcus aureus subsp. aureus N315
caaaccuuuauauaaa

SEQ ID NO: 4058373 - RNA, 20 nt, Staphylococcus aureus subsp. aureus N315
caaacuaaaaggucaucuga

SEQ ID NO: 4058374 - RNA, 13 nt, Staphylococcus aureus subsp. aureus N315
caaacuauuaaug

SEQ ID NO: 4058375 - RNA, 19 nt, Staphylococcus aureus subsp. aureus N315
caaacucauuuauaaacau

SEQ ID NO: 4058376 - RNA, 22 nt, Staphylococcus aureus subsp. aureus N315
caaagaaauguaugauauaaac

SEQ ID NO: 4058377 - RNA, 20 nt, Staphylococcus aureus subsp. aureus N315
caaagaaccacgcaucaugu

SEQ ID NO: 4058378 - RNA, 16 nt, Staphylococcus aureus subsp. aureus N315
caaagaauuucgaaaa

SEQ ID NO: 4058379 - RNA, 20 nt, Staphylococcus aureus subsp. aureus N315
caaagaauuucgaaaagaaa

SEQ ID NO: 4058380 - RNA, 23 nt, Staphylococcus aureus subsp. aureus N315
caaagaauuucgaaaagaaauuc

SEQ ID NO: 4058381 - RNA, 20 nt, Staphylococcus aureus subsp. aureus N315
caaagacacggccugcaagu

SEQ ID NO: 4058382 - RNA, 15 nt, Staphylococcus aureus subsp. aureus N315
caaagacauacaguc

SEQ ID NO: 4058383 - RNA, 22 nt, Staphylococcus aureus subsp. aureus N315
caaagacauacagucaauacaa

SEQ ID NO: 4058384 - RNA, 17 nt, Staphylococcus aureus subsp. aureus N315
caaagacuaaaaagaag

SEQ ID NO: 4058385 - RNA, 16 nt, Staphylococcus aureus subsp. aureus N315
caaagacucaauuuca

SEQ ID NO: 4058386 - RNA, 21 nt, Staphylococcus aureus subsp. aureus N315
caaagacucaauuucauuuga

SEQ ID NO: 4058387 - RNA, 17 nt, Staphylococcus aureus subsp. aureus N315
caaagaggcuuuaaaau

SEQ ID NO: 4058388 - RNA, 16 nt, Staphylococcus aureus subsp. aureus N315
caaagauauguuuaua

SEQ ID NO: 4058389 - RNA, 20 nt, Staphylococcus aureus subsp. aureus N315
caaagccuucuaucucuuua

SEQ ID NO: 4058390 - RNA, 22 nt, Staphylococcus aureus subsp. aureus N315
caaagcgauaaaguaugaguga

SEQ ID NO: 4058391 - RNA, 18 nt, Staphylococcus aureus subsp. aureus N315
caaagcuuccaaauguuc

SEQ ID NO: 4058392 - RNA, 16 nt, Staphylococcus aureus subsp. aureus N315
caaaggauauugaaaa

SEQ ID NO: 4058393 - RNA, 23 nt, Staphylococcus aureus subsp. aureus N315
caaaggcgcaccaugugccuuug

SEQ ID NO: 4058394 - RNA, 23 nt, Staphylococcus aureus subsp. aureus N315
caaagguuuacuauuaaaggaaa

SEQ ID NO: 4058395 - RNA, 19 nt, Staphylococcus aureus subsp. aureus N315
caaaguaacaugugcaagu

SEQ ID NO: 4058396 - RNA, 17 nt, Staphylococcus aureus subsp. aureus N315
caaaguacaguuagugg

SEQ ID NO: 4058397 - RNA, 20 nt, Staphylococcus aureus subsp. aureus N315
caaaguaccaucucuauuuu

SEQ ID NO: 4058398 - RNA, 23 nt, Staphylococcus aureus subsp. aureus N315
caaaguacucaaguaaucaagca

SEQ ID NO: 4058399 - RNA, 13 nt, Staphylococcus aureus subsp. aureus N315
caaaguagacauu

SEQ ID NO: 4058400 - RNA, 17 nt, Staphylococcus aureus subsp. aureus N315
caaaguagacauugaau

SEQ ID NO: 4058401 - RNA, 13 nt, Staphylococcus aureus subsp. aureus N315
caaaguuaaccau

SEQ ID NO: 4058402 - RNA, 12 nt, Staphylococcus aureus subsp. aureus N315
caaauaaaaaag

SEQ ID NO: 4058403 - RNA, 19 nt, Staphylococcus aureus subsp. aureus N315
caaauaaaacgcuucauau

SEQ ID NO: 4058404 - RNA, 17 nt, Staphylococcus aureus subsp. aureus N315
caaauaaacacaucuau

SEQ ID NO: 4058405 - RNA, 19 nt, Staphylococcus aureus subsp. aureus N315
caaauaaacacaucuaugu

SEQ ID NO: 4058406 - RNA, 19 nt, Staphylococcus aureus subsp. aureus N315
caaauaaauaagugauaaa

SEQ ID NO: 4058407 - RNA, 14 nt, Staphylococcus aureus subsp. aureus N315
caaauaaauauaaa

SEQ ID NO: 4058408 - RNA, 14 nt, Staphylococcus aureus subsp. aureus N315
caaauaaaucaaac

SEQ ID NO: 4058409 - RNA, 12 nt, Staphylococcus aureus subsp. aureus N315
caaauaaauguc

SEQ ID NO: 4058410 - RNA, 13 nt, Staphylococcus aureus subsp. aureus N315
caaauaauauaaa

SEQ ID NO: 4058411 - RNA, 13 nt, Staphylococcus aureus subsp. aureus N315
caaauaaugaaua

SEQ ID NO: 4058412 - RNA, 14 nt, Staphylococcus aureus subsp. aureus N315
caaauacaguugua

SEQ ID NO: 4058413 - RNA, 16 nt, Staphylococcus aureus subsp. aureus N315
caaauacauaaucauu

SEQ ID NO: 4058414 - RNA, 21 nt, Staphylococcus aureus subsp. aureus N315
caaauacauaaucauugugua

SEQ ID NO: 4058415 - RNA, 15 nt, Staphylococcus aureus subsp. aureus N315
caaauacaucaauuu

SEQ ID NO: 4058416 - RNA, 17 nt, Staphylococcus aureus subsp. aureus N315
caaauacaucaauuucu

SEQ ID NO: 4058417 - RNA, 14 nt, Staphylococcus aureus subsp. aureus N315
caaauagagaaaua

SEQ ID NO: 4058418 - RNA, 14 nt, Staphylococcus aureus subsp. aureus N315
caaauaguucaaau

SEQ ID NO: 4058419 - RNA, 17 nt, Staphylococcus aureus subsp. aureus N315
caaauauaauguauaaa

SEQ ID NO: 4058420 - RNA, 14 nt, Staphylococcus aureus subsp. aureus N315
caaauauaauuuca

SEQ ID NO: 4058421 - RNA, 15 nt, Staphylococcus aureus subsp. aureus N315
caaauauaauuucaa

SEQ ID NO: 4058422 - RNA, 16 nt, Staphylococcus aureus subsp. aureus N315
caaauauaauuucaau

SEQ ID NO: 4058423 - RNA, 13 nt, Staphylococcus aureus subsp. aureus N315
caaauauacuuuu

SEQ ID NO: 4058424 - RNA, 17 nt, Staphylococcus aureus subsp. aureus N315
caaauauacuuuuacca

SEQ ID NO: 4058425 - RNA, 20 nt, Staphylococcus aureus subsp. aureus N315
caaauauaucuagccugaaa

SEQ ID NO: 4058426 - RNA, 14 nt, Staphylococcus aureus subsp. aureus N315
caaauauauuugua

SEQ ID NO: 4058427 - RNA, 15 nt, Staphylococcus aureus subsp. aureus N315
caaauaucaguaaua

SEQ ID NO: 4058428 - RNA, 18 nt, Staphylococcus aureus subsp. aureus N315
caaauauuauuaaaucaa

SEQ ID NO: 4058429 - RNA, 15 nt, Staphylococcus aureus subsp. aureus N315
caaauauuucuaaac

SEQ ID NO: 4058430 - RNA, 16 nt, Staphylococcus aureus subsp. aureus N315
caaaucggaauaaaau

SEQ ID NO: 4058431 - RNA, 19 nt, Staphylococcus aureus subsp. aureus N315
caaaucggaauaaaauaaa

SEQ ID NO: 4058432 - RNA, 19 nt, Staphylococcus aureus subsp. aureus N315
caaaucguuucaugcacuu

SEQ ID NO: 4058433 - RNA, 21 nt, Staphylococcus aureus subsp. aureus N315
caaaucguuucaugcacuuua

SEQ ID NO: 4058434 - RNA, 22 nt, Staphylococcus aureus subsp. aureus N315
caaaucucgucacauauaaaua

SEQ ID NO: 4058435 - RNA, 15 nt, Staphylococcus aureus subsp. aureus N315
caaaucuuuuaaauu

SEQ ID NO: 4058436 - RNA, 18 nt, Staphylococcus aureus subsp. aureus N315
caaaugaaaaaguaaaau

SEQ ID NO: 4058437 - RNA, 15 nt, Staphylococcus aureus subsp. aureus N315
caaaugaauggagca

SEQ ID NO: 4058438 - RNA, 17 nt, Staphylococcus aureus subsp. aureus N315
caaaugagcguuccauu

SEQ ID NO: 4058439 - RNA, 15 nt, Staphylococcus aureus subsp. aureus N315
caaaugcaauaggau

SEQ ID NO: 4058440 - RNA, 18 nt, Staphylococcus aureus subsp. aureus N315
caaaugcuuaauaaaauc

SEQ ID NO: 4058441 - RNA, 13 nt, Staphylococcus aureus subsp. aureus N315
caaauuaaaucac

SEQ ID NO: 4058442 - RNA, 18 nt, Staphylococcus aureus subsp. aureus N315
caaauuaauuaaaccaau

SEQ ID NO: 4058443 - RNA, 15 nt, Staphylococcus aureus subsp. aureus N315
caaauuacaaauuau

SEQ ID NO: 4058444 - RNA, 14 nt, Staphylococcus aureus subsp. aureus N315
caaauuaguaugac

SEQ ID NO: 4058445 - RNA, 21 nt, Staphylococcus aureus subsp. aureus N315
caaauuagucauccaaagaaa

SEQ ID NO: 4058446 - RNA, 15 nt, Staphylococcus aureus subsp. aureus N315
caaauuauuaacgca

SEQ ID NO: 4058447 - RNA, 16 nt, Staphylococcus aureus subsp. aureus N315
caaauucaacuuuaau

SEQ ID NO: 4058448 - RNA, 19 nt, Staphylococcus aureus subsp. aureus N315
caaauucaacuuuucaaag

SEQ ID NO: 4058449 - RNA, 17 nt, Staphylococcus aureus subsp. aureus N315
caaauucauauuaacug

SEQ ID NO: 4058450 - RNA, 14 nt, Staphylococcus aureus subsp. aureus N315
caaauucauuugua

SEQ ID NO: 4058451 - RNA, 17 nt, Staphylococcus aureus subsp. aureus N315
caaauugacgcauuaau

SEQ ID NO: 4058452 - RNA, 21 nt, Staphylococcus aureus subsp. aureus N315
caaauugagcaguauuuuuug

SEQ ID NO: 4058453 - RNA, 13 nt, Staphylococcus aureus subsp. aureus N315
caaauugcaaugg

SEQ ID NO: 4058454 - RNA, 16 nt, Staphylococcus aureus subsp. aureus N315
caaauugccuuucauu

SEQ ID NO: 4058455 - RNA, 19 nt, Staphylococcus aureus subsp. aureus N315
caaauuggaaaaauaaaua

SEQ ID NO: 4058456 - RNA, 23 nt, Staphylococcus aureus subsp. aureus N315
caaauuggauaauuucuucuucu

SEQ ID NO: 4058457 - RNA, 15 nt, Staphylococcus aureus subsp. aureus N315
caaauuugaaacaau

SEQ ID NO: 4058458 - RNA, 15 nt, Staphylococcus aureus subsp. aureus N315
caaauuuuuuguaaa

SEQ ID NO: 4058459 - RNA, 17 nt, Staphylococcus aureus subsp. aureus N315
caacaaagcuuccaaau

SEQ ID NO: 4058460 - RNA, 19 nt, Staphylococcus aureus subsp. aureus N315
caacaaagugcaauuauuu

SEQ ID NO: 4058461 - RNA, 19 nt, Staphylococcus aureus subsp. aureus N315
caacaacuaagauauauug

SEQ ID NO: 4058462 - RNA, 11 nt, Staphylococcus aureus subsp. aureus N315
caacaacuuuu

SEQ ID NO: 4058463 - RNA, 16 nt, Staphylococcus aureus subsp. aureus N315
caacaacuuuucauau

SEQ ID NO: 4058464 - RNA, 12 nt, Staphylococcus aureus subsp. aureus N315
caacaauucgau

SEQ ID NO: 4058465 - RNA, 13 nt, Staphylococcus aureus subsp. aureus N315
caacaauugcuaa

SEQ ID NO: 4058466 - RNA, 20 nt, Staphylococcus aureus subsp. aureus N315
caacaauugcuaauccauac

SEQ ID NO: 4058467 - RNA, 12 nt, Staphylococcus aureus subsp. aureus N315
caacaauuuuau

SEQ ID NO: 4058468 - RNA, 12 nt, Staphylococcus aureus subsp. aureus N315
caacacagagaa

SEQ ID NO: 4058469 - RNA, 16 nt, Staphylococcus aureus subsp. aureus N315
caacacagagaaauuc

SEQ ID NO: 4058470 - RNA, 22 nt, Staphylococcus aureus subsp. aureus N315
caacacagaggcugguggaaag

SEQ ID NO: 4058471 - RNA, 15 nt, Staphylococcus aureus subsp. aureus N315
caacacccauauaau

SEQ ID NO: 4058472 - RNA, 16 nt, Staphylococcus aureus subsp. aureus N315
caacacccauauaauu

SEQ ID NO: 4058473 - RNA, 15 nt, Staphylococcus aureus subsp. aureus N315
caacaccuaauauuu

SEQ ID NO: 4058474 - RNA, 22 nt, Staphylococcus aureus subsp. aureus N315
caacacguuguuguugaccacc

SEQ ID NO: 4058475 - RNA, 22 nt, Staphylococcus aureus subsp. aureus N315
caacacugagaauuucuaauua

SEQ ID NO: 4058476 - RNA, 16 nt, Staphylococcus aureus subsp. aureus N315
caacagggguaaaacu

SEQ ID NO: 4058477 - RNA, 23 nt, Staphylococcus aureus subsp. aureus N315
caacaguuucuuggucugcugua

SEQ ID NO: 4058478 - RNA, 21 nt, Staphylococcus aureus subsp. aureus N315
caacaguuuuauuaucuuugu

SEQ ID NO: 4058479 - RNA, 14 nt, Staphylococcus aureus subsp. aureus N315
caacauauuauaua

SEQ ID NO: 4058480 - RNA, 17 nt, Staphylococcus aureus subsp. aureus N315
caacauauuauauauau

SEQ ID NO: 4058481 - RNA, 22 nt, Staphylococcus aureus subsp. aureus N315
caacaucgauuuaucauuauuu

SEQ ID NO: 4058482 - RNA, 13 nt, Staphylococcus aureus subsp. aureus N315
caacaucuucaac

SEQ ID NO: 4058483 - RNA, 21 nt, Staphylococcus aureus subsp. aureus N315
caacauguuuggaugaacaaa

SEQ ID NO: 4058484 - RNA, 16 nt, Staphylococcus aureus subsp. aureus N315
caacauuaauaaauaa

SEQ ID NO: 4058485 - RNA, 17 nt, Staphylococcus aureus subsp. aureus N315
caacauuaauaaauaau

SEQ ID NO: 4058486 - RNA, 19 nt, Staphylococcus aureus subsp. aureus N315
caacauuaauaaauaauaa

SEQ ID NO: 4058487 - RNA, 15 nt, Staphylococcus aureus subsp. aureus N315
caacauuacaugcac

SEQ ID NO: 4058488 - RNA, 15 nt, Staphylococcus aureus subsp. aureus N315
caacauuauuuuugu

SEQ ID NO: 4058489 - RNA, 20 nt, Staphylococcus aureus subsp. aureus N315
caacauugagauuaucuuua

SEQ ID NO: 4058490 - RNA, 23 nt, Staphylococcus aureus subsp. aureus N315
caacauuuugauacguaaacacu

SEQ ID NO: 4058491 - RNA, 18 nt, Staphylococcus aureus subsp. aureus N315
caaccaaaaccaaaugaa

SEQ ID NO: 4058492 - RNA, 13 nt, Staphylococcus aureus subsp. aureus N315
caaccaauuauua

SEQ ID NO: 4058493 - RNA, 16 nt, Staphylococcus aureus subsp. aureus N315
caaccaccauaugcua

SEQ ID NO: 4058494 - RNA, 15 nt, Staphylococcus aureus subsp. aureus N315
caaccgauauaauua

SEQ ID NO: 4058495 - RNA, 22 nt, Staphylococcus aureus subsp. aureus N315
caaccgcuugggcugacauuuu

SEQ ID NO: 4058496 - RNA, 14 nt, Staphylococcus aureus subsp. aureus N315
caaccucugaugug

SEQ ID NO: 4058497 - RNA, 18 nt, Staphylococcus aureus subsp. aureus N315
caaccucugauguguuau

SEQ ID NO: 4058498 - RNA, 17 nt, Staphylococcus aureus subsp. aureus N315
caaccugugauaaaaau

SEQ ID NO: 4058499 - RNA, 22 nt, Staphylococcus aureus subsp. aureus N315
caaccuguucuuuauuuaaagg

SEQ ID NO: 4058500 - RNA, 22 nt, Staphylococcus aureus subsp. aureus N315
caaccuuugguuguuaggggcu

SEQ ID NO: 4058501 - RNA, 14 nt, Staphylococcus aureus subsp. aureus N315
caacgauaccaaau

SEQ ID NO: 4058502 - RNA, 17 nt, Staphylococcus aureus subsp. aureus N315
caacgccauauuuauuu

SEQ ID NO: 4058503 - RNA, 21 nt, Staphylococcus aureus subsp. aureus N315
caacguauaagugauaucagu

SEQ ID NO: 4058504 - RNA, 18 nt, Staphylococcus aureus subsp. aureus N315
caacgucaucugcuugua

SEQ ID NO: 4058505 - RNA, 20 nt, Staphylococcus aureus subsp. aureus N315
caacguuauucguuaacaau

SEQ ID NO: 4058506 - RNA, 18 nt, Staphylococcus aureus subsp. aureus N315
caacuaaaggucccauua

SEQ ID NO: 4058507 - RNA, 22 nt, Staphylococcus aureus subsp. aureus N315
caacuaaaggucccauuaaaau

SEQ ID NO: 4058508 - RNA, 16 nt, Staphylococcus aureus subsp. aureus N315
caacuaagaugacuga

SEQ ID NO: 4058509 - RNA, 16 nt, Staphylococcus aureus subsp. aureus N315
caacuaauaacaaaua

SEQ ID NO: 4058510 - RNA, 17 nt, Staphylococcus aureus subsp. aureus N315
caacuaauaacaaauag

SEQ ID NO: 4058511 - RNA, 20 nt, Staphylococcus aureus subsp. aureus N315
caacuaauuuaaagcaucau

SEQ ID NO: 4058512 - RNA, 19 nt, Staphylococcus aureus subsp. aureus N315
caacuauauauaguugauc

SEQ ID NO: 4058513 - RNA, 14 nt, Staphylococcus aureus subsp. aureus N315
caacucguuuuucc

SEQ ID NO: 4058514 - RNA, 13 nt, Staphylococcus aureus subsp. aureus N315
caacugaaauuuu

SEQ ID NO: 4058515 - RNA, 12 nt, Staphylococcus aureus subsp. aureus N315
caacugagaaau

SEQ ID NO: 4058516 - RNA, 13 nt, Staphylococcus aureus subsp. aureus N315
caacugagaaauc

SEQ ID NO: 4058517 - RNA, 17 nt, Staphylococcus aureus subsp. aureus N315
caacugaucauuuucau

SEQ ID NO: 4058518 - RNA, 18 nt, Staphylococcus aureus subsp. aureus N315
caacugcugcuaaaauaa

SEQ ID NO: 4058519 - RNA, 14 nt, Staphylococcus aureus subsp. aureus N315
caacugcuuuuuau

SEQ ID NO: 4058520 - RNA, 16 nt, Staphylococcus aureus subsp. aureus N315
caacugcuuuuuauua

SEQ ID NO: 4058521 - RNA, 11 nt, Staphylococcus aureus subsp. aureus N315
caacuuaauac

SEQ ID NO: 4058522 - RNA, 13 nt, Staphylococcus aureus subsp. aureus N315
caacuuaauagaa

SEQ ID NO: 4058523 - RNA, 17 nt, Staphylococcus aureus subsp. aureus N315
caacuuagaauuuacaa

SEQ ID NO: 4058524 - RNA, 13 nt, Staphylococcus aureus subsp. aureus N315
caacuuagcuuag

SEQ ID NO: 4058525 - RNA, 15 nt, Staphylococcus aureus subsp. aureus N315
caacuuauaaaauga

SEQ ID NO: 4058526 - RNA, 14 nt, Staphylococcus aureus subsp. aureus N315
caacuucauuaguu

SEQ ID NO: 4058527 - RNA, 19 nt, Staphylococcus aureus subsp. aureus N315
caacuugaucauuauaaaa

SEQ ID NO: 4058528 - RNA, 12 nt, Staphylococcus aureus subsp. aureus N315
caacuuguauug

SEQ ID NO: 4058529 - RNA, 22 nt, Staphylococcus aureus subsp. aureus N315
caacuugugguuggaagucugc

SEQ ID NO: 4058530 - RNA, 23 nt, Staphylococcus aureus subsp. aureus N315
caacuugugguuggaagucugcu

SEQ ID NO: 4058531 - RNA, 23 nt, Staphylococcus aureus subsp. aureus N315
caacuuuaaucaaaaaagacuca

SEQ ID NO: 4058532 - RNA, 21 nt, Staphylococcus aureus subsp. aureus N315
caacuuuaauuuuucauuaau

SEQ ID NO: 4058533 - RNA, 17 nt, Staphylococcus aureus subsp. aureus N315
caacuuuacgauaaaua

SEQ ID NO: 4058534 - RNA, 21 nt, Staphylococcus aureus subsp. aureus N315
caacuuuagcauauucgcuua

SEQ ID NO: 4058535 - RNA, 20 nt, Staphylococcus aureus subsp. aureus N315
caacuuuguuuucaguaacu

SEQ ID NO: 4058536 - RNA, 22 nt, Staphylococcus aureus subsp. aureus N315
caacuuuuuaauaauacuucua

SEQ ID NO: 4058537 - RNA, 12 nt, Staphylococcus aureus subsp. aureus N315
caagaaaaaguu

SEQ ID NO: 4058538 - RNA, 14 nt, Staphylococcus aureus subsp. aureus N315
caagaacuuuaaaa

SEQ ID NO: 4058539 - RNA, 17 nt, Staphylococcus aureus subsp. aureus N315
caagaaguaauguuaaa

SEQ ID NO: 4058540 - RNA, 16 nt, Staphylococcus aureus subsp. aureus N315
caagaauuaaugaaau

SEQ ID NO: 4058541 - RNA, 18 nt, Staphylococcus aureus subsp. aureus N315
caagagaauuaauaauuu

SEQ ID NO: 4058542 - RNA, 14 nt, Staphylococcus aureus subsp. aureus N315
caagagauaagaaa

SEQ ID NO: 4058543 - RNA, 23 nt, Staphylococcus aureus subsp. aureus N315
caagagauaagaaaauaccuaau

SEQ ID NO: 4058544 - RNA, 15 nt, Staphylococcus aureus subsp. aureus N315
caagagguuuuauuu

SEQ ID NO: 4058545 - RNA, 13 nt, Staphylococcus aureus subsp. aureus N315
caagauaaaucau

SEQ ID NO: 4058546 - RNA, 18 nt, Staphylococcus aureus subsp. aureus N315
caagauuaugacaacaua

SEQ ID NO: 4058547 - RNA, 23 nt, Staphylococcus aureus subsp. aureus N315
caagauuaugacaacauaacaaa

SEQ ID NO: 4058548 - RNA, 14 nt, Staphylococcus aureus subsp. aureus N315
caagauuccaucac

SEQ ID NO: 4058549 - RNA, 21 nt, Staphylococcus aureus subsp. aureus N315
caagauuggcugugcuauaau

SEQ ID NO: 4058550 - RNA, 14 nt, Staphylococcus aureus subsp. aureus N315
caagcaucaugaaa

SEQ ID NO: 4058551 - RNA, 15 nt, Staphylococcus aureus subsp. aureus N315
caagccguugguugu

SEQ ID NO: 4058552 - RNA, 18 nt, Staphylococcus aureus subsp. aureus N315
caagcguuucuugaucua

SEQ ID NO: 4058553 - RNA, 18 nt, Staphylococcus aureus subsp. aureus N315
caagcuuuucauuuuuau

SEQ ID NO: 4058554 - RNA, 17 nt, Staphylococcus aureus subsp. aureus N315
caagcuuuuuaggaaug

SEQ ID NO: 4058555 - RNA, 18 nt, Staphylococcus aureus subsp. aureus N315
caaggaaaucauauauuu

SEQ ID NO: 4058556 - RNA, 20 nt, Staphylococcus aureus subsp. aureus N315
caaggaaaucauauauuucu

SEQ ID NO: 4058557 - RNA, 20 nt, Staphylococcus aureus subsp. aureus N315
caaggauguuauaaaaugaa

SEQ ID NO: 4058558 - RNA, 22 nt, Staphylococcus aureus subsp. aureus N315
caaggauguuauaaaaugaaua

SEQ ID NO: 4058559 - RNA, 13 nt, Staphylococcus aureus subsp. aureus N315
caaggauugaaaa

SEQ ID NO: 4058560 - RNA, 15 nt, Staphylococcus aureus subsp. aureus N315
caaggauugaaaaaa

SEQ ID NO: 4058561 - RNA, 19 nt, Staphylococcus aureus subsp. aureus N315
caagguaguuggcugauag

SEQ ID NO: 4058562 - RNA, 21 nt, Staphylococcus aureus subsp. aureus N315
caagguuuucgccaauaaaac

SEQ ID NO: 4058563 - RNA, 17 nt, Staphylococcus aureus subsp. aureus N315
caaguaaauguuuuaug

SEQ ID NO: 4058564 - RNA, 18 nt, Staphylococcus aureus subsp. aureus N315
caaguaacucaagugauu

SEQ ID NO: 4058565 - RNA, 20 nt, Staphylococcus aureus subsp. aureus N315
caagucguucucuuaaauau

SEQ ID NO: 4058566 - RNA, 22 nt, Staphylococcus aureus subsp. aureus N315
caagucguucucuuaaauauga

SEQ ID NO: 4058567 - RNA, 15 nt, Staphylococcus aureus subsp. aureus N315
caagucuaacaguua

SEQ ID NO: 4058568 - RNA, 23 nt, Staphylococcus aureus subsp. aureus N315
caagucuaguucgaacacacacu

SEQ ID NO: 4058569 - RNA, 22 nt, Staphylococcus aureus subsp. aureus N315
caagucucauaucuauuuuucg

SEQ ID NO: 4058570 - RNA, 20 nt, Staphylococcus aureus subsp. aureus N315
caagugcuugguuaaaguua

SEQ ID NO: 4058571 - RNA, 17 nt, Staphylococcus aureus subsp. aureus N315
caagugguaaaaaugaa

SEQ ID NO: 4058572 - RNA, 19 nt, Staphylococcus aureus subsp. aureus N315
caaguuaugcugucaaaca

SEQ ID NO: 4058573 - RNA, 20 nt, Staphylococcus aureus subsp. aureus N315
caaguucaccguaaucuuuu

SEQ ID NO: 4058574 - RNA, 13 nt, Staphylococcus aureus subsp. aureus N315
caaguugaucaaa

SEQ ID NO: 4058575 - RNA, 16 nt, Staphylococcus aureus subsp. aureus N315
caaguuggcggggccc

SEQ ID NO: 4058576 - RNA, 23 nt, Staphylococcus aureus subsp. aureus N315
caaguuggcggggccccaacaca

SEQ ID NO: 4058577 - RNA, 23 nt, Staphylococcus aureus subsp. aureus N315
caaguuggcuggcccccaacacu

SEQ ID NO: 4058578 - RNA, 22 nt, Staphylococcus aureus subsp. aureus N315
caaguuggggaaggacaggaau

SEQ ID NO: 4058579 - RNA, 22 nt, Staphylococcus aureus subsp. aureus N315
caaguuggggaugggccccaac

SEQ ID NO: 4058580 - RNA, 14 nt, Staphylococcus aureus subsp. aureus N315
caaguuguuuuuug

SEQ ID NO: 4058581 - RNA, 13 nt, Staphylococcus aureus subsp. aureus N315
caaguuuaaaaua

SEQ ID NO: 4058582 - RNA, 15 nt, Staphylococcus aureus subsp. aureus N315
caaguuuaaaauacg

SEQ ID NO: 4058583 - RNA, 24 nt, Staphylococcus aureus subsp. aureus N315
caaguuuaguaucuccaucaaagu

SEQ ID NO: 4058584 - RNA, 22 nt, Staphylococcus aureus subsp. aureus N315
caaguuucauggggcuuaugca

SEQ ID NO: 4058585 - RNA, 19 nt, Staphylococcus aureus subsp. aureus N315
caauaaaaaaccaagugca

SEQ ID NO: 4058586 - RNA, 20 nt, Staphylococcus aureus subsp. aureus N315
caauaaaaugcaauuuuuca

SEQ ID NO: 4058587 - RNA, 21 nt, Staphylococcus aureus subsp. aureus N315
caauaaaauuggaacacgaaa

SEQ ID NO: 4058588 - RNA, 16 nt, Staphylococcus aureus subsp. aureus N315
caauaaauaaacaacu

SEQ ID NO: 4058589 - RNA, 18 nt, Staphylococcus aureus subsp. aureus N315
caauaaauauugauucua

SEQ ID NO: 4058590 - RNA, 12 nt, Staphylococcus aureus subsp. aureus N315
caauaaaucuuu

SEQ ID NO: 4058591 - RNA, 15 nt, Staphylococcus aureus subsp. aureus N315
caauaaauuaugaaa

SEQ ID NO: 4058592 - RNA, 23 nt, Staphylococcus aureus subsp. aureus N315
caauaaauuucaagguauacaca

SEQ ID NO: 4058593 - RNA, 15 nt, Staphylococcus aureus subsp. aureus N315
caauaaauuuuauau

SEQ ID NO: 4058594 - RNA, 16 nt, Staphylococcus aureus subsp. aureus N315
caauaacaccaauuga

SEQ ID NO: 4058595 - RNA, 17 nt, Staphylococcus aureus subsp. aureus N315
caauaacaccaauugaa

SEQ ID NO: 4058596 - RNA, 16 nt, Staphylococcus aureus subsp. aureus N315
caauaacaggugcuua

SEQ ID NO: 4058597 - RNA, 21 nt, Staphylococcus aureus subsp. aureus N315
caauaacaggugcuuacuuuu

SEQ ID NO: 4058598 - RNA, 23 nt, Staphylococcus aureus subsp. aureus N315
caauaacaggugcuuacuuuuaa

SEQ ID NO: 4058599 - RNA, 17 nt, Staphylococcus aureus subsp. aureus N315
caauaaccccugucacu

SEQ ID NO: 4058600 - RNA, 22 nt, Staphylococcus aureus subsp. aureus N315
caauaauaaaccuaaagauaua

SEQ ID NO: 4058601 - RNA, 14 nt, Staphylococcus aureus subsp. aureus N315
caauaauaugccau

SEQ ID NO: 4058602 - RNA, 12 nt, Staphylococcus aureus subsp. aureus N315
caauaaugugca

SEQ ID NO: 4058603 - RNA, 19 nt, Staphylococcus aureus subsp. aureus N315
caauaaugugcaaguuggg

SEQ ID NO: 4058604 - RNA, 16 nt, Staphylococcus aureus subsp. aureus N315
caauaaugugucaaau

SEQ ID NO: 4058605 - RNA, 18 nt, Staphylococcus aureus subsp. aureus N315
caauaaugugucaaauag

SEQ ID NO: 4058606 - RNA, 15 nt, Staphylococcus aureus subsp. aureus N315
caauaauugaugaaa

SEQ ID NO: 4058607 - RNA, 24 nt, Staphylococcus aureus subsp. aureus N315
caauaauugaugaaagacugacua

SEQ ID NO: 4058608 - RNA, 14 nt, Staphylococcus aureus subsp. aureus N315
caauaauuuuaucu

SEQ ID NO: 4058609 - RNA, 14 nt, Staphylococcus aureus subsp. aureus N315
caauacaaaucgau

SEQ ID NO: 4058610 - RNA, 19 nt, Staphylococcus aureus subsp. aureus N315
caauacagaacuuuaauaa

SEQ ID NO: 4058611 - RNA, 16 nt, Staphylococcus aureus subsp. aureus N315
caauaccgaauaauuu

SEQ ID NO: 4058612 - RNA, 18 nt, Staphylococcus aureus subsp. aureus N315
caauaccuguccaaauaa

SEQ ID NO: 4058613 - RNA, 23 nt, Staphylococcus aureus subsp. aureus N315
caauacgaugaugauuuauaaaa

SEQ ID NO: 4058614 - RNA, 17 nt, Staphylococcus aureus subsp. aureus N315
caauacgauugcaauug

SEQ ID NO: 4058615 - RNA, 14 nt, Staphylococcus aureus subsp. aureus N315
caauacuacuuaau

SEQ ID NO: 4058616 - RNA, 18 nt, Staphylococcus aureus subsp. aureus N315
caauacuuucacuuugaa

SEQ ID NO: 4058617 - RNA, 13 nt, Staphylococcus aureus subsp. aureus N315
caauacuuuuuau

SEQ ID NO: 4058618 - RNA, 15 nt, Staphylococcus aureus subsp. aureus N315
caauacuuuuuauau

SEQ ID NO: 4058619 - RNA, 14 nt, Staphylococcus aureus subsp. aureus N315
caauagaugaaaau

SEQ ID NO: 4058620 - RNA, 16 nt, Staphylococcus aureus subsp. aureus N315
caauagcaauugaaua

SEQ ID NO: 4058621 - RNA, 22 nt, Staphylococcus aureus subsp. aureus N315
caauagguucauuauuuaaaua

SEQ ID NO: 4058622 - RNA, 19 nt, Staphylococcus aureus subsp. aureus N315
caauagugugcaaguuggc

SEQ ID NO: 4058623 - RNA, 15 nt, Staphylococcus aureus subsp. aureus N315
caauauaacaucaaa

SEQ ID NO: 4058624 - RNA, 15 nt, Staphylococcus aureus subsp. aureus N315
caauauaacauugca

SEQ ID NO: 4058625 - RNA, 12 nt, Staphylococcus aureus subsp. aureus N315
caauauacuuuu

SEQ ID NO: 4058626 - RNA, 22 nt, Staphylococcus aureus subsp. aureus N315
caauauauaaugguucuauaau

SEQ ID NO: 4058627 - RNA, 20 nt, Staphylococcus aureus subsp. aureus N315
caauauauucaccuacaaca

SEQ ID NO: 4058628 - RNA, 14 nt, Staphylococcus aureus subsp. aureus N315
caauaucauauuug

SEQ ID NO: 4058629 - RNA, 21 nt, Staphylococcus aureus subsp. aureus N315
caauaucuucuaauuccauca

SEQ ID NO: 4058630 - RNA, 13 nt, Staphylococcus aureus subsp. aureus N315
caauaucuuuaau

SEQ ID NO: 4058631 - RNA, 21 nt, Staphylococcus aureus subsp. aureus N315
caauaugaccuuuaugugcau

SEQ ID NO: 4058632 - RNA, 13 nt, Staphylococcus aureus subsp. aureus N315
caauauuaaaaua

SEQ ID NO: 4058633 - RNA, 13 nt, Staphylococcus aureus subsp. aureus N315
caauauuaaaauu

SEQ ID NO: 4058634 - RNA, 16 nt, Staphylococcus aureus subsp. aureus N315
caauauuaaugaauau

SEQ ID NO: 4058635 - RNA, 17 nt, Staphylococcus aureus subsp. aureus N315
caauauuaaugaauaua

SEQ ID NO: 4058636 - RNA, 12 nt, Staphylococcus aureus subsp. aureus N315
caauauuacuuu

SEQ ID NO: 4058637 - RNA, 12 nt, Staphylococcus aureus subsp. aureus N315
caauauucguaa

SEQ ID NO: 4058638 - RNA, 15 nt, Staphylococcus aureus subsp. aureus N315
caauauugauaucga

SEQ ID NO: 4058639 - RNA, 20 nt, Staphylococcus aureus subsp. aureus N315
caauauuuaccacaaauauc

SEQ ID NO: 4058640 - RNA, 23 nt, Staphylococcus aureus subsp. aureus N315
caaucaacgagucauaaauauaa

SEQ ID NO: 4058641 - RNA, 13 nt, Staphylococcus aureus subsp. aureus N315
caaucacaauaua

SEQ ID NO: 4058642 - RNA, 13 nt, Staphylococcus aureus subsp. aureus N315
caaucacuauauu

SEQ ID NO: 4058643 - RNA, 16 nt, Staphylococcus aureus subsp. aureus N315
caaucacuauauuuca

SEQ ID NO: 4058644 - RNA, 20 nt, Staphylococcus aureus subsp. aureus N315
caaucacuccucuauuuuau

SEQ ID NO: 4058645 - RNA, 12 nt, Staphylococcus aureus subsp. aureus N315
caaucauaauac

SEQ ID NO: 4058646 - RNA, 23 nt, Staphylococcus aureus subsp. aureus N315
caaucauaccggcaaauaacaau

SEQ ID NO: 4058647 - RNA, 18 nt, Staphylococcus aureus subsp. aureus N315
caaucaucacacauaaau

SEQ ID NO: 4058648 - RNA, 23 nt, Staphylococcus aureus subsp. aureus N315
caaucauuguaaaugaucaucgu

SEQ ID NO: 4058649 - RNA, 21 nt, Staphylococcus aureus subsp. aureus N315
caauccaauauacaaugcuga

SEQ ID NO: 4058650 - RNA, 19 nt, Staphylococcus aureus subsp. aureus N315
caaucgcauuuuguuucaa

SEQ ID NO: 4058651 - RNA, 17 nt, Staphylococcus aureus subsp. aureus N315
caaucguaacuaacaug

SEQ ID NO: 4058652 - RNA, 18 nt, Staphylococcus aureus subsp. aureus N315
caaucgucacaucacguu

SEQ ID NO: 4058653 - RNA, 13 nt, Staphylococcus aureus subsp. aureus N315
caaucguuaauuu

SEQ ID NO: 4058654 - RNA, 23 nt, Staphylococcus aureus subsp. aureus N315
caaucguuucuuccgcacugccu

SEQ ID NO: 4058655 - RNA, 14 nt, Staphylococcus aureus subsp. aureus N315
caaucuauauaaau

SEQ ID NO: 4058656 - RNA, 15 nt, Staphylococcus aureus subsp. aureus N315
caaucuauuuuaaac

SEQ ID NO: 4058657 - RNA, 20 nt, Staphylococcus aureus subsp. aureus N315
caaugaaaacagguggaagu

SEQ ID NO: 4058658 - RNA, 18 nt, Staphylococcus aureus subsp. aureus N315
caaugaauaacaagaaaa

SEQ ID NO: 4058659 - RNA, 19 nt, Staphylococcus aureus subsp. aureus N315
caaugaauaacaagaaaaa

SEQ ID NO: 4058660 - RNA, 14 nt, Staphylococcus aureus subsp. aureus N315
caaugaauuuacuc

SEQ ID NO: 4058661 - RNA, 22 nt, Staphylococcus aureus subsp. aureus N315
caaugaauuucuaauuuaguau

SEQ ID NO: 4058662 - RNA, 17 nt, Staphylococcus aureus subsp. aureus N315
caaugacagcagacuuc

SEQ ID NO: 4058663 - RNA, 17 nt, Staphylococcus aureus subsp. aureus N315
caaugacauccauacaa

SEQ ID NO: 4058664 - RNA, 19 nt, Staphylococcus aureus subsp. aureus N315
caaugacugagaaaaauau

SEQ ID NO: 4058665 - RNA, 22 nt, Staphylococcus aureus subsp. aureus N315
caaugagcaucuugucuaguuc

SEQ ID NO: 4058666 - RNA, 11 nt, Staphylococcus aureus subsp. aureus N315
caaugauuaau

SEQ ID NO: 4058667 - RNA, 16 nt, Staphylococcus aureus subsp. aureus N315
caaugcauccaaauau

SEQ ID NO: 4058668 - RNA, 16 nt, Staphylococcus aureus subsp. aureus N315
caaugcgcaaugaaaa

SEQ ID NO: 4058669 - RNA, 19 nt, Staphylococcus aureus subsp. aureus N315
caaugcgguaaaaacucuu

SEQ ID NO: 4058670 - RNA, 19 nt, Staphylococcus aureus subsp. aureus N315
caaugcuuccaucacauca

SEQ ID NO: 4058671 - RNA, 14 nt, Staphylococcus aureus subsp. aureus N315
caauggccauuuga

SEQ ID NO: 4058672 - RNA, 15 nt, Staphylococcus aureus subsp. aureus N315
caaugucuuuaauug

SEQ ID NO: 4058673 - RNA, 16 nt, Staphylococcus aureus subsp. aureus N315
caaugugagauauaaa

SEQ ID NO: 4058674 - RNA, 16 nt, Staphylococcus aureus subsp. aureus N315
caauguuaucuugcuu

SEQ ID NO: 4058675 - RNA, 14 nt, Staphylococcus aureus subsp. aureus N315
caauguucaauuca

SEQ ID NO: 4058676 - RNA, 13 nt, Staphylococcus aureus subsp. aureus N315
caauguugcuugu

SEQ ID NO: 4058677 - RNA, 16 nt, Staphylococcus aureus subsp. aureus N315
caauguuuaauuuucu

SEQ ID NO: 4058678 - RNA, 17 nt, Staphylococcus aureus subsp. aureus N315
caauguuuaauuuucua

SEQ ID NO: 4058679 - RNA, 13 nt, Staphylococcus aureus subsp. aureus N315
caauuaaaaguac

SEQ ID NO: 4058680 - RNA, 13 nt, Staphylococcus aureus subsp. aureus N315
caauuaaauguuu

SEQ ID NO: 4058681 - RNA, 20 nt, Staphylococcus aureus subsp. aureus N315
caauuaaucggaucauuauu

SEQ ID NO: 4058682 - RNA, 22 nt, Staphylococcus aureus subsp. aureus N315
caauuaaucggaucauuauuua

SEQ ID NO: 4058683 - RNA, 17 nt, Staphylococcus aureus subsp. aureus N315
caauuaaugauaaaccg

SEQ ID NO: 4058684 - RNA, 15 nt, Staphylococcus aureus subsp. aureus N315
caauuaauguaauga

SEQ ID NO: 4058685 - RNA, 18 nt, Staphylococcus aureus subsp. aureus N315
caauuaauguaaugauac

SEQ ID NO: 4058686 - RNA, 14 nt, Staphylococcus aureus subsp. aureus N315
caauuaauuguaaa

SEQ ID NO: 4058687 - RNA, 20 nt, Staphylococcus aureus subsp. aureus N315
caauuaauuuagucauuaca

SEQ ID NO: 4058688 - RNA, 21 nt, Staphylococcus aureus subsp. aureus N315
caauuaauuuagucauuacaa

SEQ ID NO: 4058689 - RNA, 22 nt, Staphylococcus aureus subsp. aureus N315
caauuaauuuagucauuacaaa

SEQ ID NO: 4058690 - RNA, 23 nt, Staphylococcus aureus subsp. aureus N315
caauuaauuuagucauuacaaau

SEQ ID NO: 4058691 - RNA, 15 nt, Staphylococcus aureus subsp. aureus N315
caauuacucuuuuuc

SEQ ID NO: 4058692 - RNA, 16 nt, Staphylococcus aureus subsp. aureus N315
caauuacucuuuuucu

SEQ ID NO: 4058693 - RNA, 24 nt, Staphylococcus aureus subsp. aureus N315
caauuacucuuuuucuuucauaau

SEQ ID NO: 4058694 - RNA, 19 nt, Staphylococcus aureus subsp. aureus N315
caauuagaaaauuucucac

SEQ ID NO: 4058695 - RNA, 17 nt, Staphylococcus aureus subsp. aureus N315
caauuauaaaugauuaa

SEQ ID NO: 4058696 - RNA, 17 nt, Staphylococcus aureus subsp. aureus N315
caauuaucaacauaaua

SEQ ID NO: 4058697 - RNA, 12 nt, Staphylococcus aureus subsp. aureus N315
caauuauggaua

SEQ ID NO: 4058698 - RNA, 15 nt, Staphylococcus aureus subsp. aureus N315
caauuauggauaaaa

SEQ ID NO: 4058699 - RNA, 16 nt, Staphylococcus aureus subsp. aureus N315
caauuauuuuucaaau

SEQ ID NO: 4058700 - RNA, 17 nt, Staphylococcus aureus subsp. aureus N315
caauuauuuuucaaaua

SEQ ID NO: 4058701 - RNA, 11 nt, Staphylococcus aureus subsp. aureus N315
caauucaaacu

SEQ ID NO: 4058702 - RNA, 19 nt, Staphylococcus aureus subsp. aureus N315
caauucaagaccaugcaaa

SEQ ID NO: 4058703 - RNA, 12 nt, Staphylococcus aureus subsp. aureus N315
caauucaaugua

SEQ ID NO: 4058704 - RNA, 23 nt, Staphylococcus aureus subsp. aureus N315
caauucaauguaucaccuaauug

SEQ ID NO: 4058705 - RNA, 15 nt, Staphylococcus aureus subsp. aureus N315
caauucauaagaaaa

SEQ ID NO: 4058706 - RNA, 22 nt, Staphylococcus aureus subsp. aureus N315
caauucauuaauaggauuauua

SEQ ID NO: 4058707 - RNA, 20 nt, Staphylococcus aureus subsp. aureus N315
caauucauuuuauaaaucaa

SEQ ID NO: 4058708 - RNA, 21 nt, Staphylococcus aureus subsp. aureus N315
caauucgcucacaugugaaau

SEQ ID NO: 4058709 - RNA, 22 nt, Staphylococcus aureus subsp. aureus N315
caauucucuuaucuugauuuaa

SEQ ID NO: 4058710 - RNA, 21 nt, Staphylococcus aureus subsp. aureus N315
caauucugugagguaaaacua

SEQ ID NO: 4058711 - RNA, 17 nt, Staphylococcus aureus subsp. aureus N315
caauucuuacaccugca

SEQ ID NO: 4058712 - RNA, 22 nt, Staphylococcus aureus subsp. aureus N315
caauugaagugaaauugcgugc

SEQ ID NO: 4058713 - RNA, 18 nt, Staphylococcus aureus subsp. aureus N315
caauugaaucaaauacau

SEQ ID NO: 4058714 - RNA, 22 nt, Staphylococcus aureus subsp. aureus N315
caauugaaugaaguaauauaua

SEQ ID NO: 4058715 - RNA, 20 nt, Staphylococcus aureus subsp. aureus N315
caauugauuacaccacuuag

SEQ ID NO: 4058716 - RNA, 24 nt, Staphylococcus aureus subsp. aureus N315
caauugcaaugaauaacaagaaaa

SEQ ID NO: 4058717 - RNA, 13 nt, Staphylococcus aureus subsp. aureus N315
caauugcauacgu

SEQ ID NO: 4058718 - RNA, 18 nt, Staphylococcus aureus subsp. aureus N315
caauugcauacguaaaug

SEQ ID NO: 4058719 - RNA, 13 nt, Staphylococcus aureus subsp. aureus N315
caauugcuuuacc

SEQ ID NO: 4058720 - RNA, 16 nt, Staphylococcus aureus subsp. aureus N315
caauuguuacuuuaac

SEQ ID NO: 4058721 - RNA, 20 nt, Staphylococcus aureus subsp. aureus N315
caauuguugcaaaauacgau

SEQ ID NO: 4058722 - RNA, 12 nt, Staphylococcus aureus subsp. aureus N315
caauuuaaauaa

SEQ ID NO: 4058723 - RNA, 22 nt, Staphylococcus aureus subsp. aureus N315
caauuuauuauuaacuguaccu

SEQ ID NO: 4058724 - RNA, 23 nt, Staphylococcus aureus subsp. aureus N315
caauuucacgcugaaauuuuuua

SEQ ID NO: 4058725 - RNA, 22 nt, Staphylococcus aureus subsp. aureus N315
caauuucuaggccacuaagacc

SEQ ID NO: 4058726 - RNA, 13 nt, Staphylococcus aureus subsp. aureus N315
caauuucuguaau

SEQ ID NO: 4058727 - RNA, 15 nt, Staphylococcus aureus subsp. aureus N315
caauuucuucauuuu

SEQ ID NO: 4058728 - RNA, 17 nt, Staphylococcus aureus subsp. aureus N315
caauuucuucauuuuca

SEQ ID NO: 4058729 - RNA, 18 nt, Staphylococcus aureus subsp. aureus N315
caauuucuucauuuucau

SEQ ID NO: 4058730 - RNA, 23 nt, Staphylococcus aureus subsp. aureus N315
caauuugcuguccacuauauccu

SEQ ID NO: 4058731 - RNA, 18 nt, Staphylococcus aureus subsp. aureus N315
caauuuggucauauaaac

SEQ ID NO: 4058732 - RNA, 19 nt, Staphylococcus aureus subsp. aureus N315
caauuuggucauauaaaca

SEQ ID NO: 4058733 - RNA, 13 nt, Staphylococcus aureus subsp. aureus N315
caauuuuaccaug

SEQ ID NO: 4058734 - RNA, 17 nt, Staphylococcus aureus subsp. aureus N315
caauuuuccguguuuau

SEQ ID NO: 4058735 - RNA, 15 nt, Staphylococcus aureus subsp. aureus N315
caauuuuuaaaaacc

SEQ ID NO: 4058736 - RNA, 21 nt, Staphylococcus aureus subsp. aureus N315
cacaaagaauuucgaaaagaa

SEQ ID NO: 4058737 - RNA, 12 nt, Staphylococcus aureus subsp. aureus N315
cacaaaugaaug

SEQ ID NO: 4058738 - RNA, 14 nt, Staphylococcus aureus subsp. aureus N315
cacaauauuuacca

SEQ ID NO: 4058739 - RNA, 21 nt, Staphylococcus aureus subsp. aureus N315
cacaauauuuaccacaaauau

SEQ ID NO: 4058740 - RNA, 20 nt, Staphylococcus aureus subsp. aureus N315
cacaauccuuucaucugcaa

SEQ ID NO: 4058741 - RNA, 17 nt, Staphylococcus aureus subsp. aureus N315
cacaaugauugaauauu

SEQ ID NO: 4058742 - RNA, 20 nt, Staphylococcus aureus subsp. aureus N315
cacaaugcccuuaaagcaca

SEQ ID NO: 4058743 - RNA, 15 nt, Staphylococcus aureus subsp. aureus N315
cacaauuguauaaug

SEQ ID NO: 4058744 - RNA, 18 nt, Staphylococcus aureus subsp. aureus N315
cacacacaguuuauaaua

SEQ ID NO: 4058745 - RNA, 21 nt, Staphylococcus aureus subsp. aureus N315
cacacagguaaauuuaaaaua

SEQ ID NO: 4058746 - RNA, 22 nt, Staphylococcus aureus subsp. aureus N315
cacacagguaaauuuaaaauaa

SEQ ID NO: 4058747 - RNA, 13 nt, Staphylococcus aureus subsp. aureus N315
cacacauaaaugu

SEQ ID NO: 4058748 - RNA, 14 nt, Staphylococcus aureus subsp. aureus N315
cacacccauacucu

SEQ ID NO: 4058749 - RNA, 11 nt, Staphylococcus aureus subsp. aureus N315
cacaccccaac

SEQ ID NO: 4058750 - RNA, 18 nt, Staphylococcus aureus subsp. aureus N315
cacacuauuguaagcuga

SEQ ID NO: 4058751 - RNA, 14 nt, Staphylococcus aureus subsp. aureus N315
cacacuuuaaacaa

SEQ ID NO: 4058752 - RNA, 15 nt, Staphylococcus aureus subsp. aureus N315
cacacuuuaaacaag

SEQ ID NO: 4058753 - RNA, 18 nt, Staphylococcus aureus subsp. aureus N315
cacagacguuuuugaauc

SEQ ID NO: 4058754 - RNA, 21 nt, Staphylococcus aureus subsp. aureus N315
cacagagaauuucgaaaagaa

SEQ ID NO: 4058755 - RNA, 21 nt, Staphylococcus aureus subsp. aureus N315
cacagcggaauacagaugaug

SEQ ID NO: 4058756 - RNA, 19 nt, Staphylococcus aureus subsp. aureus N315
cacaguggauuacagauga

SEQ ID NO: 4058757 - RNA, 21 nt, Staphylococcus aureus subsp. aureus N315
cacaguggauuacagaugaug

SEQ ID NO: 4058758 - RNA, 12 nt, Staphylococcus aureus subsp. aureus N315
cacauaaaauac

SEQ ID NO: 4058759 - RNA, 15 nt, Staphylococcus aureus subsp. aureus N315
cacauagaguaauuu

SEQ ID NO: 4058760 - RNA, 16 nt, Staphylococcus aureus subsp. aureus N315
cacaucuuuuugauaa

SEQ ID NO: 4058761 - RNA, 13 nt, Staphylococcus aureus subsp. aureus N315
cacaugaauuuua

SEQ ID NO: 4058762 - RNA, 17 nt, Staphylococcus aureus subsp. aureus N315
cacaugaggaucaacug

SEQ ID NO: 4058763 - RNA, 21 nt, Staphylococcus aureus subsp. aureus N315
cacaugcacuuuauuaaaaau

SEQ ID NO: 4058764 - RNA, 21 nt, Staphylococcus aureus subsp. aureus N315
cacauguacguuuuuuuaaau

SEQ ID NO: 4058765 - RNA, 17 nt, Staphylococcus aureus subsp. aureus N315
cacauucaaauaaauga

SEQ ID NO: 4058766 - RNA, 19 nt, Staphylococcus aureus subsp. aureus N315
cacauuccaucuuaaaaca

SEQ ID NO: 4058767 - RNA, 23 nt, Staphylococcus aureus subsp. aureus N315
cacauuccaucuuaaaacaacuu

SEQ ID NO: 4058768 - RNA, 16 nt, Staphylococcus aureus subsp. aureus N315
cacauucccguuaaua

SEQ ID NO: 4058769 - RNA, 17 nt, Staphylococcus aureus subsp. aureus N315
cacauuguuuacaaagu

SEQ ID NO: 4058770 - RNA, 18 nt, Staphylococcus aureus subsp. aureus N315
cacauuuacuuaagaacu

SEQ ID NO: 4058771 - RNA, 14 nt, Staphylococcus aureus subsp. aureus N315
cacauuuucaaauu

SEQ ID NO: 4058772 - RNA, 21 nt, Staphylococcus aureus subsp. aureus N315
caccaaugauagugaauaaug

SEQ ID NO: 4058773 - RNA, 17 nt, Staphylococcus aureus subsp. aureus N315
caccagccccaauuagc

SEQ ID NO: 4058774 - RNA, 22 nt, Staphylococcus aureus subsp. aureus N315
caccaguagucacuguuugcca

SEQ ID NO: 4058775 - RNA, 16 nt, Staphylococcus aureus subsp. aureus N315
caccauacuaaaacau

SEQ ID NO: 4058776 - RNA, 18 nt, Staphylococcus aureus subsp. aureus N315
caccauauuuaacauuuu

SEQ ID NO: 4058777 - RNA, 23 nt, Staphylococcus aureus subsp. aureus N315
caccaucuguaacuaauaugauu

SEQ ID NO: 4058778 - RNA, 19 nt, Staphylococcus aureus subsp. aureus N315
caccaugcugcacauucca

SEQ ID NO: 4058779 - RNA, 19 nt, Staphylococcus aureus subsp. aureus N315
caccauuuacuucauaagu

SEQ ID NO: 4058780 - RNA, 14 nt, Staphylococcus aureus subsp. aureus N315
caccccaacucgca

SEQ ID NO: 4058781 - RNA, 17 nt, Staphylococcus aureus subsp. aureus N315
cacccugcuuaucauua

SEQ ID NO: 4058782 - RNA, 21 nt, Staphylococcus aureus subsp. aureus N315
caccgacaaggauugaaaaaa

SEQ ID NO: 4058783 - RNA, 20 nt, Staphylococcus aureus subsp. aureus N315
caccgcguguuuuuaacaua

SEQ ID NO: 4058784 - RNA, 16 nt, Staphylococcus aureus subsp. aureus N315
caccuaaaaagaaaau

SEQ ID NO: 4058785 - RNA, 18 nt, Staphylococcus aureus subsp. aureus N315
caccuaaaaagaaaauua

SEQ ID NO: 4058786 - RNA, 13 nt, Staphylococcus aureus subsp. aureus N315
caccuacaaauau

SEQ ID NO: 4058787 - RNA, 14 nt, Staphylococcus aureus subsp. aureus N315
caccuauuaggauc

SEQ ID NO: 4058788 - RNA, 20 nt, Staphylococcus aureus subsp. aureus N315
caccuauuuuuugagcacuu

SEQ ID NO: 4058789 - RNA, 18 nt, Staphylococcus aureus subsp. aureus N315
caccucuaaguucaccua

SEQ ID NO: 4058790 - RNA, 12 nt, Staphylococcus aureus subsp. aureus N315
caccugcaauuu

SEQ ID NO: 4058791 - RNA, 20 nt, Staphylococcus aureus subsp. aureus N315
caccugcaauuuguaauaca

SEQ ID NO: 4058792 - RNA, 15 nt, Staphylococcus aureus subsp. aureus N315
caccugcagcauccu

SEQ ID NO: 4058793 - RNA, 17 nt, Staphylococcus aureus subsp. aureus N315
caccuuguuuaaguuuu

SEQ ID NO: 4058794 - RNA, 13 nt, Staphylococcus aureus subsp. aureus N315
caccuuuaucugu

SEQ ID NO: 4058795 - RNA, 14 nt, Staphylococcus aureus subsp. aureus N315
cacgaacaacauua

SEQ ID NO: 4058796 - RNA, 15 nt, Staphylococcus aureus subsp. aureus N315
cacgaacaacauuag

SEQ ID NO: 4058797 - RNA, 11 nt, Staphylococcus aureus subsp. aureus N315
cacgagaaaug

SEQ ID NO: 4058798 - RNA, 18 nt, Staphylococcus aureus subsp. aureus N315
cacgagcaacaucuuuug

SEQ ID NO: 4058799 - RNA, 13 nt, Staphylococcus aureus subsp. aureus N315
cacgauaaaaaua

SEQ ID NO: 4058800 - RNA, 20 nt, Staphylococcus aureus subsp. aureus N315
cacgauaaaaauaaaaaacg

SEQ ID NO: 4058801 - RNA, 23 nt, Staphylococcus aureus subsp. aureus N315
cacgauauaacauuaaaaugaua

SEQ ID NO: 4058802 - RNA, 14 nt, Staphylococcus aureus subsp. aureus N315
cacgauuuuuaaaa

SEQ ID NO: 4058803 - RNA, 16 nt, Staphylococcus aureus subsp. aureus N315
cacgcauuacuuuaga

SEQ ID NO: 4058804 - RNA, 21 nt, Staphylococcus aureus subsp. aureus N315
cacgcccgacaucauaaauga

SEQ ID NO: 4058805 - RNA, 13 nt, Staphylococcus aureus subsp. aureus N315
cacgcguucaaau

SEQ ID NO: 4058806 - RNA, 23 nt, Staphylococcus aureus subsp. aureus N315
cacgcuaacauucagugcaauga

SEQ ID NO: 4058807 - RNA, 21 nt, Staphylococcus aureus subsp. aureus N315
cacgcucauuuucuguugcag

SEQ ID NO: 4058808 - RNA, 16 nt, Staphylococcus aureus subsp. aureus N315
cacgcugaaauuuuuu

SEQ ID NO: 4058809 - RNA, 12 nt, Staphylococcus aureus subsp. aureus N315
cacguaaaauau

SEQ ID NO: 4058810 - RNA, 19 nt, Staphylococcus aureus subsp. aureus N315
cacguucuugguauuuuuu

SEQ ID NO: 4058811 - RNA, 19 nt, Staphylococcus aureus subsp. aureus N315
cacuaaaugugacuuuaaa

SEQ ID NO: 4058812 - RNA, 16 nt, Staphylococcus aureus subsp. aureus N315
cacuaacucaauauga

SEQ ID NO: 4058813 - RNA, 20 nt, Staphylococcus aureus subsp. aureus N315
cacuaacucaauaugauaau

SEQ ID NO: 4058814 - RNA, 13 nt, Staphylococcus aureus subsp. aureus N315
cacuaaguuuucu

SEQ ID NO: 4058815 - RNA, 24 nt, Staphylococcus aureus subsp. aureus N315
cacuacgcugaugaaugauugcau

SEQ ID NO: 4058816 - RNA, 18 nt, Staphylococcus aureus subsp. aureus N315
cacuagauaguuuauacu

SEQ ID NO: 4058817 - RNA, 15 nt, Staphylococcus aureus subsp. aureus N315
cacuaggaucuuuuc

SEQ ID NO: 4058818 - RNA, 18 nt, Staphylococcus aureus subsp. aureus N315
cacuaggauguucaucaa

SEQ ID NO: 4058819 - RNA, 11 nt, Staphylococcus aureus subsp. aureus N315
cacuauaaaag

SEQ ID NO: 4058820 - RNA, 13 nt, Staphylococcus aureus subsp. aureus N315
cacuauaauuucu

SEQ ID NO: 4058821 - RNA, 19 nt, Staphylococcus aureus subsp. aureus N315
cacuaucauuaucaaauaa

SEQ ID NO: 4058822 - RNA, 15 nt, Staphylococcus aureus subsp. aureus N315
cacuaucuuuugcuu

SEQ ID NO: 4058823 - RNA, 16 nt, Staphylococcus aureus subsp. aureus N315
cacuauuuuuaaauga

SEQ ID NO: 4058824 - RNA, 12 nt, Staphylococcus aureus subsp. aureus N315
cacuauuuuuau

SEQ ID NO: 4058825 - RNA, 20 nt, Staphylococcus aureus subsp. aureus N315
cacucacuucaacgucaucu

SEQ ID NO: 4058826 - RNA, 12 nt, Staphylococcus aureus subsp. aureus N315
cacucauaaccg

SEQ ID NO: 4058827 - RNA, 20 nt, Staphylococcus aureus subsp. aureus N315
cacucauaaccgcuucuuuu

SEQ ID NO: 4058828 - RNA, 19 nt, Staphylococcus aureus subsp. aureus N315
cacucauaaucaagucugc

SEQ ID NO: 4058829 - RNA, 15 nt, Staphylococcus aureus subsp. aureus N315
cacuccuauuguuuu

SEQ ID NO: 4058830 - RNA, 14 nt, Staphylococcus aureus subsp. aureus N315
cacuccucuauuuu

SEQ ID NO: 4058831 - RNA, 15 nt, Staphylococcus aureus subsp. aureus N315
cacuccuuaaacaaa

SEQ ID NO: 4058832 - RNA, 20 nt, Staphylococcus aureus subsp. aureus N315
cacuccuuaaacaaauaaau

SEQ ID NO: 4058833 - RNA, 23 nt, Staphylococcus aureus subsp. aureus N315
cacucuagagguaaaucuaucua

SEQ ID NO: 4058834 - RNA, 20 nt, Staphylococcus aureus subsp. aureus N315
cacucuuacucauuuuucuu

SEQ ID NO: 4058835 - RNA, 14 nt, Staphylococcus aureus subsp. aureus N315
cacugaaaucuaga

SEQ ID NO: 4058836 - RNA, 16 nt, Staphylococcus aureus subsp. aureus N315
cacugccaaucauucg

SEQ ID NO: 4058837 - RNA, 21 nt, Staphylococcus aureus subsp. aureus N315
cacuguauggucuggaauaaa

SEQ ID NO: 4058838 - RNA, 14 nt, Staphylococcus aureus subsp. aureus N315
cacuguauuuacua

SEQ ID NO: 4058839 - RNA, 16 nt, Staphylococcus aureus subsp. aureus N315
cacuguuaaagucugu

SEQ ID NO: 4058840 - RNA, 14 nt, Staphylococcus aureus subsp. aureus N315
cacuuaacucaaag

SEQ ID NO: 4058841 - RNA, 16 nt, Staphylococcus aureus subsp. aureus N315
cacuuaauauaaggaa

SEQ ID NO: 4058842 - RNA, 21 nt, Staphylococcus aureus subsp. aureus N315
cacuuaaucguucccauucuu

SEQ ID NO: 4058843 - RNA, 22 nt, Staphylococcus aureus subsp. aureus N315
cacuuaaucguucccauucuuu

SEQ ID NO: 4058844 - RNA, 23 nt, Staphylococcus aureus subsp. aureus N315
cacuuaaucguucccauucuuug

SEQ ID NO: 4058845 - RNA, 13 nt, Staphylococcus aureus subsp. aureus N315
cacuuacaaauau

SEQ ID NO: 4058846 - RNA, 16 nt, Staphylococcus aureus subsp. aureus N315
cacuuacugugaaaau

SEQ ID NO: 4058847 - RNA, 21 nt, Staphylococcus aureus subsp. aureus N315
cacuuacugugaaaauaccaa

SEQ ID NO: 4058848 - RNA, 23 nt, Staphylococcus aureus subsp. aureus N315
cacuuagauuccccuuuuugucu

SEQ ID NO: 4058849 - RNA, 14 nt, Staphylococcus aureus subsp. aureus N315
cacuuauaaacaaa

SEQ ID NO: 4058850 - RNA, 18 nt, Staphylococcus aureus subsp. aureus N315
cacuuauaaacaaaagau

SEQ ID NO: 4058851 - RNA, 18 nt, Staphylococcus aureus subsp. aureus N315
cacuuaugauacugauau

SEQ ID NO: 4058852 - RNA, 12 nt, Staphylococcus aureus subsp. aureus N315
cacuuauuauuu

SEQ ID NO: 4058853 - RNA, 20 nt, Staphylococcus aureus subsp. aureus N315
cacuucaacauauaaaucau

SEQ ID NO: 4058854 - RNA, 13 nt, Staphylococcus aureus subsp. aureus N315
cacuucaaguuau

SEQ ID NO: 4058855 - RNA, 16 nt, Staphylococcus aureus subsp. aureus N315
cacuucaguuaaaccu

SEQ ID NO: 4058856 - RNA, 17 nt, Staphylococcus aureus subsp. aureus N315
cacuucaguuaaaccuu

SEQ ID NO: 4058857 - RNA, 20 nt, Staphylococcus aureus subsp. aureus N315
cacuucaguuaaaccuucua

SEQ ID NO: 4058858 - RNA, 11 nt, Staphylococcus aureus subsp. aureus N315
cacuucauaaa

SEQ ID NO: 4058859 - RNA, 20 nt, Staphylococcus aureus subsp. aureus N315
cacuucgccaagccaucuuu

SEQ ID NO: 4058860 - RNA, 12 nt, Staphylococcus aureus subsp. aureus N315
cacuucguauug

SEQ ID NO: 4058861 - RNA, 12 nt, Staphylococcus aureus subsp. aureus N315
cacuucuucacc

SEQ ID NO: 4058862 - RNA, 18 nt, Staphylococcus aureus subsp. aureus N315
cacuuggauucaaaugac

SEQ ID NO: 4058863 - RNA, 22 nt, Staphylococcus aureus subsp. aureus N315
cacuugguacaccuacaaauau

SEQ ID NO: 4058864 - RNA, 23 nt, Staphylococcus aureus subsp. aureus N315
cacuuuaaacaagcaucaugaaa

SEQ ID NO: 4058865 - RNA, 16 nt, Staphylococcus aureus subsp. aureus N315
cacuuuaggguucauu

SEQ ID NO: 4058866 - RNA, 13 nt, Staphylococcus aureus subsp. aureus N315
cacuuuauaauuu

SEQ ID NO: 4058867 - RNA, 18 nt, Staphylococcus aureus subsp. aureus N315
cacuuucaaugacaucua

SEQ ID NO: 4058868 - RNA, 12 nt, Staphylococcus aureus subsp. aureus N315
cacuuucuacuc

SEQ ID NO: 4058869 - RNA, 19 nt, Staphylococcus aureus subsp. aureus N315
cacuuugaauacauguauu

SEQ ID NO: 4058870 - RNA, 14 nt, Staphylococcus aureus subsp. aureus N315
cacuuuucaugaug

SEQ ID NO: 4058871 - RNA, 14 nt, Staphylococcus aureus subsp. aureus N315
cacuuuuguuaaaa

SEQ ID NO: 4058872 - RNA, 17 nt, Staphylococcus aureus subsp. aureus N315
cacuuuuguuaaaaaau

SEQ ID NO: 4058873 - RNA, 20 nt, Staphylococcus aureus subsp. aureus N315
cacuuuuucuguaauaauua

SEQ ID NO: 4058874 - RNA, 20 nt, Staphylococcus aureus subsp. aureus N315
cacuuuuuuuaaaucuucua

SEQ ID NO: 4058875 - RNA, 18 nt, Staphylococcus aureus subsp. aureus N315
cagaaaagggcaaaaaag

SEQ ID NO: 4058876 - RNA, 13 nt, Staphylococcus aureus subsp. aureus N315
cagaacuaaugua

SEQ ID NO: 4058877 - RNA, 14 nt, Staphylococcus aureus subsp. aureus N315
cagaacuaugaaua

SEQ ID NO: 4058878 - RNA, 14 nt, Staphylococcus aureus subsp. aureus N315
cagaacugccaaua

SEQ ID NO: 4058879 - RNA, 21 nt, Staphylococcus aureus subsp. aureus N315
cagaacugccaauauaacauu

SEQ ID NO: 4058880 - RNA, 14 nt, Staphylococcus aureus subsp. aureus N315
cagacgaaucaaag

SEQ ID NO: 4058881 - RNA, 12 nt, Staphylococcus aureus subsp. aureus N315
cagacuccuaaa

SEQ ID NO: 4058882 - RNA, 14 nt, Staphylococcus aureus subsp. aureus N315
cagacuccuaaauu

SEQ ID NO: 4058883 - RNA, 16 nt, Staphylococcus aureus subsp. aureus N315
cagagaaauucgaaaa

SEQ ID NO: 4058884 - RNA, 20 nt, Staphylococcus aureus subsp. aureus N315
cagagaaauucgaaaagaaa

SEQ ID NO: 4058885 - RNA, 23 nt, Staphylococcus aureus subsp. aureus N315
cagagaaauucgaaaagaaauuc

SEQ ID NO: 4058886 - RNA, 15 nt, Staphylococcus aureus subsp. aureus N315
cagagaauuucgaaa

SEQ ID NO: 4058887 - RNA, 20 nt, Staphylococcus aureus subsp. aureus N315
cagagaauuucgaaaagaaa

SEQ ID NO: 4058888 - RNA, 23 nt, Staphylococcus aureus subsp. aureus N315
cagagaauuucgaaaagaaauuc

SEQ ID NO: 4058889 - RNA, 15 nt, Staphylococcus aureus subsp. aureus N315
cagagccauaaugag

SEQ ID NO: 4058890 - RNA, 21 nt, Staphylococcus aureus subsp. aureus N315
cagauaaguaauaauauaaau

SEQ ID NO: 4058891 - RNA, 13 nt, Staphylococcus aureus subsp. aureus N315
cagauaauuauuu

SEQ ID NO: 4058892 - RNA, 14 nt, Staphylococcus aureus subsp. aureus N315
cagauaauuauuuc

SEQ ID NO: 4058893 - RNA, 16 nt, Staphylococcus aureus subsp. aureus N315
cagauaauuauuucua

SEQ ID NO: 4058894 - RNA, 14 nt, Staphylococcus aureus subsp. aureus N315
cagauaauugaaaa

SEQ ID NO: 4058895 - RNA, 23 nt, Staphylococcus aureus subsp. aureus N315
cagauagaaugucgauauuucua

SEQ ID NO: 4058896 - RNA, 15 nt, Staphylococcus aureus subsp. aureus N315
cagauagguacuuau

SEQ ID NO: 4058897 - RNA, 16 nt, Staphylococcus aureus subsp. aureus N315
cagaugaaccaaaaaa

SEQ ID NO: 4058898 - RNA, 14 nt, Staphylococcus aureus subsp. aureus N315
cagauguugguuca

SEQ ID NO: 4058899 - RNA, 22 nt, Staphylococcus aureus subsp. aureus N315
cagauucaaacguuuucacuuc

SEQ ID NO: 4058900 - RNA, 14 nt, Staphylococcus aureus subsp. aureus N315
cagauugauauaaa

SEQ ID NO: 4058901 - RNA, 15 nt, Staphylococcus aureus subsp. aureus N315
cagauuuuaaaaauu

SEQ ID NO: 4058902 - RNA, 21 nt, Staphylococcus aureus subsp. aureus N315
cagauuuuaagugguuaucac

SEQ ID NO: 4058903 - RNA, 23 nt, Staphylococcus aureus subsp. aureus N315
cagcaaaaagcccuauuguuuuu

SEQ ID NO: 4058904 - RNA, 23 nt, Staphylococcus aureus subsp. aureus N315
cagcaaauaaaaucauaacgaca

SEQ ID NO: 4058905 - RNA, 20 nt, Staphylococcus aureus subsp. aureus N315
cagcaagagauagguuuugu

SEQ ID NO: 4058906 - RNA, 14 nt, Staphylococcus aureus subsp. aureus N315
cagcaguaagauau

SEQ ID NO: 4058907 - RNA, 18 nt, Staphylococcus aureus subsp. aureus N315
cagcaguaagauuauuuu

SEQ ID NO: 4058908 - RNA, 16 nt, Staphylococcus aureus subsp. aureus N315
cagcaguugcacaaau

SEQ ID NO: 4058909 - RNA, 23 nt, Staphylococcus aureus subsp. aureus N315
cagcaugaaucgcauuuaaauau

SEQ ID NO: 4058910 - RNA, 20 nt, Staphylococcus aureus subsp. aureus N315
cagcauuaaucguauuuuua

SEQ ID NO: 4058911 - RNA, 17 nt, Staphylococcus aureus subsp. aureus N315
cagcauugggacauaaa

SEQ ID NO: 4058912 - RNA, 15 nt, Staphylococcus aureus subsp. aureus N315
cagccucuauaagua

SEQ ID NO: 4058913 - RNA, 14 nt, Staphylococcus aureus subsp. aureus N315
cagcgaaauuugua

SEQ ID NO: 4058914 - RNA, 15 nt, Staphylococcus aureus subsp. aureus N315
cagcgaaauuuguaa

SEQ ID NO: 4058915 - RNA, 20 nt, Staphylococcus aureus subsp. aureus N315
cagcgauaacguacaaugua

SEQ ID NO: 4058916 - RNA, 15 nt, Staphylococcus aureus subsp. aureus N315
cagcuaaaaaguaua

SEQ ID NO: 4058917 - RNA, 13 nt, Staphylococcus aureus subsp. aureus N315
cagcuaaauauuu

SEQ ID NO: 4058918 - RNA, 19 nt, Staphylococcus aureus subsp. aureus N315
cagcuaaugucaugaaaau

SEQ ID NO: 4058919 - RNA, 19 nt, Staphylococcus aureus subsp. aureus N315
cagcucuuaaaucacuagc

SEQ ID NO: 4058920 - RNA, 14 nt, Staphylococcus aureus subsp. aureus N315
cagcuguauuuaau

SEQ ID NO: 4058921 - RNA, 17 nt, Staphylococcus aureus subsp. aureus N315
cagcuucuuuaacaauu

SEQ ID NO: 4058922 - RNA, 20 nt, Staphylococcus aureus subsp. aureus N315
cagcuucuuuaacaauugau

SEQ ID NO: 4058923 - RNA, 20 nt, Staphylococcus aureus subsp. aureus N315
cagcuugaccgccuaugaua

SEQ ID NO: 4058924 - RNA, 14 nt, Staphylococcus aureus subsp. aureus N315
cagcuuuuucauuc

SEQ ID NO: 4058925 - RNA, 10 nt, Staphylococcus aureus subsp. aureus N315
caggaaggaa

SEQ ID NO: 4058926 - RNA, 21 nt, Staphylococcus aureus subsp. aureus N315
caggaauaaauuuugcgaaaa

SEQ ID NO: 4058927 - RNA, 22 nt, Staphylococcus aureus subsp. aureus N315
caggagcgagccauuauuauuu

SEQ ID NO: 4058928 - RNA, 17 nt, Staphylococcus aureus subsp. aureus N315
caggcaacaacuuuuca

SEQ ID NO: 4058929 - RNA, 20 nt, Staphylococcus aureus subsp. aureus N315
caggcgaaccgaagcgcagu

SEQ ID NO: 4058930 - RNA, 23 nt, Staphylococcus aureus subsp. aureus N315
caggcgaaccgaagcgcagugac

SEQ ID NO: 4058931 - RNA, 14 nt, Staphylococcus aureus subsp. aureus N315
cagggaaaucaucu

SEQ ID NO: 4058932 - RNA, 21 nt, Staphylococcus aureus subsp. aureus N315
cagggucuagggcauugauuc

SEQ ID NO: 4058933 - RNA, 14 nt, Staphylococcus aureus subsp. aureus N315
cagguaaugcaagu

SEQ ID NO: 4058934 - RNA, 18 nt, Staphylococcus aureus subsp. aureus N315
cagguaaugcaaguuggg

SEQ ID NO: 4058935 - RNA, 19 nt, Staphylococcus aureus subsp. aureus N315
caggugacuuuccuaauuc

SEQ ID NO: 4058936 - RNA, 20 nt, Staphylococcus aureus subsp. aureus N315
caggugacuuuccuaauucu

SEQ ID NO: 4058937 - RNA, 13 nt, Staphylococcus aureus subsp. aureus N315
caggugauugacg

SEQ ID NO: 4058938 - RNA, 13 nt, Staphylococcus aureus subsp. aureus N315
cagguuaacauuu

SEQ ID NO: 4058939 - RNA, 15 nt, Staphylococcus aureus subsp. aureus N315
cagguuuuaugaauu

SEQ ID NO: 4058940 - RNA, 17 nt, Staphylococcus aureus subsp. aureus N315
caguaacaauaacaccu

SEQ ID NO: 4058941 - RNA, 19 nt, Staphylococcus aureus subsp. aureus N315
caguaaguaauaaaauaaa

SEQ ID NO: 4058942 - RNA, 11 nt, Staphylococcus aureus subsp. aureus N315
caguaauaaug

SEQ ID NO: 4058943 - RNA, 15 nt, Staphylococcus aureus subsp. aureus N315
caguaaucaaaguau

SEQ ID NO: 4058944 - RNA, 19 nt, Staphylococcus aureus subsp. aureus N315
caguaaucaugcauucuau

SEQ ID NO: 4058945 - RNA, 14 nt, Staphylococcus aureus subsp. aureus N315
caguacaaauaaca

SEQ ID NO: 4058946 - RNA, 22 nt, Staphylococcus aureus subsp. aureus N315
caguacgguuauuuaauaaugc

SEQ ID NO: 4058947 - RNA, 16 nt, Staphylococcus aureus subsp. aureus N315
caguaggacauauaaa

SEQ ID NO: 4058948 - RNA, 15 nt, Staphylococcus aureus subsp. aureus N315
caguaggauaauuuc

SEQ ID NO: 4058949 - RNA, 15 nt, Staphylococcus aureus subsp. aureus N315
caguagucacuguuu

SEQ ID NO: 4058950 - RNA, 21 nt, Staphylococcus aureus subsp. aureus N315
caguaguugacugaacgaaaa

SEQ ID NO: 4058951 - RNA, 16 nt, Staphylococcus aureus subsp. aureus N315
caguaguuuuaaaagu

SEQ ID NO: 4058952 - RNA, 15 nt, Staphylococcus aureus subsp. aureus N315
caguauauaucaaau

SEQ ID NO: 4058953 - RNA, 17 nt, Staphylococcus aureus subsp. aureus N315
caguauauaucaaauac

SEQ ID NO: 4058954 - RNA, 18 nt, Staphylococcus aureus subsp. aureus N315
caguauauaucaaauaca

SEQ ID NO: 4058955 - RNA, 17 nt, Staphylococcus aureus subsp. aureus N315
caguaucucuuuucuau

SEQ ID NO: 4058956 - RNA, 23 nt, Staphylococcus aureus subsp. aureus N315
caguauuugccuuuugaauaauu

SEQ ID NO: 4058957 - RNA, 17 nt, Staphylococcus aureus subsp. aureus N315
caguauuuuuugugccu

SEQ ID NO: 4058958 - RNA, 17 nt, Staphylococcus aureus subsp. aureus N315
cagucaacuacugucaa

SEQ ID NO: 4058959 - RNA, 20 nt, Staphylococcus aureus subsp. aureus N315
cagucaauuuuuucaucuuu

SEQ ID NO: 4058960 - RNA, 16 nt, Staphylococcus aureus subsp. aureus N315
cagucaguaaaaauac

SEQ ID NO: 4058961 - RNA, 18 nt, Staphylococcus aureus subsp. aureus N315
cagucauuugauuuaaaa

SEQ ID NO: 4058962 - RNA, 17 nt, Staphylococcus aureus subsp. aureus N315
cagucucuuugaagggg

SEQ ID NO: 4058963 - RNA, 22 nt, Staphylococcus aureus subsp. aureus N315
cagugaaucuaaacuauaauaa

SEQ ID NO: 4058964 - RNA, 12 nt, Staphylococcus aureus subsp. aureus N315
cagugaccucag

SEQ ID NO: 4058965 - RNA, 11 nt, Staphylococcus aureus subsp. aureus N315
cagugcaauga

SEQ ID NO: 4058966 - RNA, 15 nt, Staphylococcus aureus subsp. aureus N315
cagugccuugcugga

SEQ ID NO: 4058967 - RNA, 16 nt, Staphylococcus aureus subsp. aureus N315
cagugcuauguauuuu

SEQ ID NO: 4058968 - RNA, 17 nt, Staphylococcus aureus subsp. aureus N315
caguggauuacagauga

SEQ ID NO: 4058969 - RNA, 18 nt, Staphylococcus aureus subsp. aureus N315
caguggauuacagaugau

SEQ ID NO: 4058970 - RNA, 13 nt, Staphylococcus aureus subsp. aureus N315
caguguaugauga

SEQ ID NO: 4058971 - RNA, 17 nt, Staphylococcus aureus subsp. aureus N315
caguguugaauuucaaa

SEQ ID NO: 4058972 - RNA, 20 nt, Staphylococcus aureus subsp. aureus N315
caguguugggggccagccaa

SEQ ID NO: 4058973 - RNA, 18 nt, Staphylococcus aureus subsp. aureus N315
caguguuugacugaauga

SEQ ID NO: 4058974 - RNA, 15 nt, Staphylococcus aureus subsp. aureus N315
caguuaaaucacugc

SEQ ID NO: 4058975 - RNA, 14 nt, Staphylococcus aureus subsp. aureus N315
caguuaauaauuuu

SEQ ID NO: 4058976 - RNA, 13 nt, Staphylococcus aureus subsp. aureus N315
caguuaauaugaa

SEQ ID NO: 4058977 - RNA, 17 nt, Staphylococcus aureus subsp. aureus N315
caguuaugccugaagcg

SEQ ID NO: 4058978 - RNA, 18 nt, Staphylococcus aureus subsp. aureus N315
caguuauuuuaauaacga

SEQ ID NO: 4058979 - RNA, 14 nt, Staphylococcus aureus subsp. aureus N315
caguucuuagauuu

SEQ ID NO: 4058980 - RNA, 19 nt, Staphylococcus aureus subsp. aureus N315
caguugacuguaaaacaau

SEQ ID NO: 4058981 - RNA, 15 nt, Staphylococcus aureus subsp. aureus N315
caguugagucaauuu

SEQ ID NO: 4058982 - RNA, 22 nt, Staphylococcus aureus subsp. aureus N315
caguugguauaucgaaagguaa

SEQ ID NO: 4058983 - RNA, 18 nt, Staphylococcus aureus subsp. aureus N315
caguuguuuuuuugucag

SEQ ID NO: 4058984 - RNA, 15 nt, Staphylococcus aureus subsp. aureus N315
caguuucaagugcuu

SEQ ID NO: 4058985 - RNA, 13 nt, Staphylococcus aureus subsp. aureus N315
caguuucaaucgc

SEQ ID NO: 4058986 - RNA, 17 nt, Staphylococcus aureus subsp. aureus N315
caguuuccauaaauaaa

SEQ ID NO: 4058987 - RNA, 15 nt, Staphylococcus aureus subsp. aureus N315
caguuuuaaaugaaa

SEQ ID NO: 4058988 - RNA, 16 nt, Staphylococcus aureus subsp. aureus N315
caguuuuaaaugaaac

SEQ ID NO: 4058989 - RNA, 18 nt, Staphylococcus aureus subsp. aureus N315
caguuuuacuauaaugau

SEQ ID NO: 4058990 - RNA, 19 nt, Staphylococcus aureus subsp. aureus N315
caguuuugaagaauaaaaa

SEQ ID NO: 4058991 - RNA, 12 nt, Staphylococcus aureus subsp. aureus N315
caguuuuuauau

SEQ ID NO: 4058992 - RNA, 14 nt, Staphylococcus aureus subsp. aureus N315
cauaaaaaaagaac

SEQ ID NO: 4058993 - RNA, 15 nt, Staphylococcus aureus subsp. aureus N315
cauaaaaaaagaacu

SEQ ID NO: 4058994 - RNA, 13 nt, Staphylococcus aureus subsp. aureus N315
cauaaaaaaagag

SEQ ID NO: 4058995 - RNA, 19 nt, Staphylococcus aureus subsp. aureus N315
cauaaaacuuacauuacau

SEQ ID NO: 4058996 - RNA, 16 nt, Staphylococcus aureus subsp. aureus N315
cauaaaauuucugcuu

SEQ ID NO: 4058997 - RNA, 16 nt, Staphylococcus aureus subsp. aureus N315
cauaaagcuguuuauu

SEQ ID NO: 4058998 - RNA, 17 nt, Staphylococcus aureus subsp. aureus N315
cauaaagugcguuuuuc

SEQ ID NO: 4058999 - RNA, 19 nt, Staphylococcus aureus subsp. aureus N315
cauaaagugcguuuuucga

SEQ ID NO: 4059000 - RNA, 16 nt, Staphylococcus aureus subsp. aureus N315
cauaaaguuuauuuau

SEQ ID NO: 4059001 - RNA, 17 nt, Staphylococcus aureus subsp. aureus N315
cauaaauacaaaaauau

SEQ ID NO: 4059002 - RNA, 20 nt, Staphylococcus aureus subsp. aureus N315
cauaaauacaaaaauauagc

SEQ ID NO: 4059003 - RNA, 14 nt, Staphylococcus aureus subsp. aureus N315
cauaaauauaaaau

SEQ ID NO: 4059004 - RNA, 12 nt, Staphylococcus aureus subsp. aureus N315
cauaaaucaaug

SEQ ID NO: 4059005 - RNA, 18 nt, Staphylococcus aureus subsp. aureus N315
cauaaaucaugaaauaaa

SEQ ID NO: 4059006 - RNA, 17 nt, Staphylococcus aureus subsp. aureus N315
cauaaaucccuaaaaaa

SEQ ID NO: 4059007 - RNA, 14 nt, Staphylococcus aureus subsp. aureus N315
cauaaaugacugaa

SEQ ID NO: 4059008 - RNA, 17 nt, Staphylococcus aureus subsp. aureus N315
cauaaaugcuaaaagua

SEQ ID NO: 4059009 - RNA, 20 nt, Staphylococcus aureus subsp. aureus N315
cauaaaugcuaaaaguauaa

SEQ ID NO: 4059010 - RNA, 18 nt, Staphylococcus aureus subsp. aureus N315
cauaaauuaauauaguag

SEQ ID NO: 4059011 - RNA, 15 nt, Staphylococcus aureus subsp. aureus N315
cauaaauuagaugaa

SEQ ID NO: 4059012 - RNA, 21 nt, Staphylococcus aureus subsp. aureus N315
cauaaauuguuuuacaugauu

SEQ ID NO: 4059013 - RNA, 18 nt, Staphylococcus aureus subsp. aureus N315
cauaacauagaaaagcag

SEQ ID NO: 4059014 - RNA, 19 nt, Staphylococcus aureus subsp. aureus N315
cauaaccuguaauugauga

SEQ ID NO: 4059015 - RNA, 19 nt, Staphylococcus aureus subsp. aureus N315
cauaaccuugcuuugcaua

SEQ ID NO: 4059016 - RNA, 22 nt, Staphylococcus aureus subsp. aureus N315
cauaacgagcaguauauaucaa

SEQ ID NO: 4059017 - RNA, 17 nt, Staphylococcus aureus subsp. aureus N315
cauaacuagcaauuuga

SEQ ID NO: 4059018 - RNA, 14 nt, Staphylococcus aureus subsp. aureus N315
cauaacugaauaaa

SEQ ID NO: 4059019 - RNA, 16 nt, Staphylococcus aureus subsp. aureus N315
cauaacugaauaaacc

SEQ ID NO: 4059020 - RNA, 22 nt, Staphylococcus aureus subsp. aureus N315
cauaacuguaguuucuuaauua

SEQ ID NO: 4059021 - RNA, 18 nt, Staphylococcus aureus subsp. aureus N315
cauaacuuuauauauaaa

SEQ ID NO: 4059022 - RNA, 16 nt, Staphylococcus aureus subsp. aureus N315
cauaagaaaauacuaa

SEQ ID NO: 4059023 - RNA, 23 nt, Staphylococcus aureus subsp. aureus N315
cauaagauacaggcugauuuuuu

SEQ ID NO: 4059024 - RNA, 18 nt, Staphylococcus aureus subsp. aureus N315
cauaaggacucuguuuaa

SEQ ID NO: 4059025 - RNA, 16 nt, Staphylococcus aureus subsp. aureus N315
cauaagguacauaaau

SEQ ID NO: 4059026 - RNA, 16 nt, Staphylococcus aureus subsp. aureus N315
cauaagucacauuuau

SEQ ID NO: 4059027 - RNA, 13 nt, Staphylococcus aureus subsp. aureus N315
cauaauaaaaagg

SEQ ID NO: 4059028 - RNA, 22 nt, Staphylococcus aureus subsp. aureus N315
cauaauaaaucuaucuacucaa

SEQ ID NO: 4059029 - RNA, 17 nt, Staphylococcus aureus subsp. aureus N315
cauaaucaacauguguc

SEQ ID NO: 4059030 - RNA, 19 nt, Staphylococcus aureus subsp. aureus N315
cauaauccauucuucuugu

SEQ ID NO: 4059031 - RNA, 20 nt, Staphylococcus aureus subsp. aureus N315
cauaaucgggaugauaacca

SEQ ID NO: 4059032 - RNA, 12 nt, Staphylococcus aureus subsp. aureus N315
cauaaucuuuau

SEQ ID NO: 4059033 - RNA, 23 nt, Staphylococcus aureus subsp. aureus N315
cauaaucuuuauuaauaaauucu

SEQ ID NO: 4059034 - RNA, 24 nt, Staphylococcus aureus subsp. aureus N315
cauaaugaacaagggccauccauu

SEQ ID NO: 4059035 - RNA, 19 nt, Staphylococcus aureus subsp. aureus N315
cauaaugaacgauauucua

SEQ ID NO: 4059036 - RNA, 21 nt, Staphylococcus aureus subsp. aureus N315
cauaaugaauaauuaaaaaac

SEQ ID NO: 4059037 - RNA, 20 nt, Staphylococcus aureus subsp. aureus N315
cauaaugaauucauucaaua

SEQ ID NO: 4059038 - RNA, 20 nt, Staphylococcus aureus subsp. aureus N315
cauaaugacuauaacaccaa

SEQ ID NO: 4059039 - RNA, 15 nt, Staphylococcus aureus subsp. aureus N315
cauaaugaucaagua

SEQ ID NO: 4059040 - RNA, 11 nt, Staphylococcus aureus subsp. aureus N315
cauaaugguuc

SEQ ID NO: 4059041 - RNA, 15 nt, Staphylococcus aureus subsp. aureus N315
cauaauuaaauaacu

SEQ ID NO: 4059042 - RNA, 18 nt, Staphylococcus aureus subsp. aureus N315
cauaauuaccuuuccauu

SEQ ID NO: 4059043 - RNA, 19 nt, Staphylococcus aureus subsp. aureus N315
cauaauuaccuuuccauuc

SEQ ID NO: 4059044 - RNA, 14 nt, Staphylococcus aureus subsp. aureus N315
cauaauucuagaga

SEQ ID NO: 4059045 - RNA, 22 nt, Staphylococcus aureus subsp. aureus N315
cauaauuugauguucuugaaaa

SEQ ID NO: 4059046 - RNA, 15 nt, Staphylococcus aureus subsp. aureus N315
cauaauuuguugaua

SEQ ID NO: 4059047 - RNA, 13 nt, Staphylococcus aureus subsp. aureus N315
cauacaaauuuuu

SEQ ID NO: 4059048 - RNA, 18 nt, Staphylococcus aureus subsp. aureus N315
cauacaaauuuuuuuuau

SEQ ID NO: 4059049 - RNA, 14 nt, Staphylococcus aureus subsp. aureus N315
cauacacuaucauu

SEQ ID NO: 4059050 - RNA, 16 nt, Staphylococcus aureus subsp. aureus N315
cauacagccauugaca

SEQ ID NO: 4059051 - RNA, 15 nt, Staphylococcus aureus subsp. aureus N315
cauacauaacacaag

SEQ ID NO: 4059052 - RNA, 13 nt, Staphylococcus aureus subsp. aureus N315
cauacauaugcua

SEQ ID NO: 4059053 - RNA, 20 nt, Staphylococcus aureus subsp. aureus N315
cauaccaaaaacauuaacca

SEQ ID NO: 4059054 - RNA, 23 nt, Staphylococcus aureus subsp. aureus N315
cauaccacuugaauacuuuuuaa

SEQ ID NO: 4059055 - RNA, 15 nt, Staphylococcus aureus subsp. aureus N315
cauacccauauuaaa

SEQ ID NO: 4059056 - RNA, 17 nt, Staphylococcus aureus subsp. aureus N315
cauacccauauuaaauu

SEQ ID NO: 4059057 - RNA, 16 nt, Staphylococcus aureus subsp. aureus N315
cauaccggcaaauaac

SEQ ID NO: 4059058 - RNA, 17 nt, Staphylococcus aureus subsp. aureus N315
cauaccguacaaaggua

SEQ ID NO: 4059059 - RNA, 17 nt, Staphylococcus aureus subsp. aureus N315
cauaccuaauaacgcau

SEQ ID NO: 4059060 - RNA, 13 nt, Staphylococcus aureus subsp. aureus N315
cauaccuacaaau

SEQ ID NO: 4059061 - RNA, 17 nt, Staphylococcus aureus subsp. aureus N315
cauaccuacaaauaugu

SEQ ID NO: 4059062 - RNA, 17 nt, Staphylococcus aureus subsp. aureus N315
cauaccuuuauuauuua

SEQ ID NO: 4059063 - RNA, 18 nt, Staphylococcus aureus subsp. aureus N315
cauacgaauuaaaauaac

SEQ ID NO: 4059064 - RNA, 23 nt, Staphylococcus aureus subsp. aureus N315
cauacgaucuuuuucaaugugau

SEQ ID NO: 4059065 - RNA, 14 nt, Staphylococcus aureus subsp. aureus N315
cauacgcaaugauu

SEQ ID NO: 4059066 - RNA, 13 nt, Staphylococcus aureus subsp. aureus N315
cauacguaucaaa

SEQ ID NO: 4059067 - RNA, 18 nt, Staphylococcus aureus subsp. aureus N315
cauacuauaaaaauuuau

SEQ ID NO: 4059068 - RNA, 15 nt, Staphylococcus aureus subsp. aureus N315
cauacucacaaaaaa

SEQ ID NO: 4059069 - RNA, 16 nt, Staphylococcus aureus subsp. aureus N315
cauacucacaaaaaac

SEQ ID NO: 4059070 - RNA, 17 nt, Staphylococcus aureus subsp. aureus N315
cauacugauuaaacugu

SEQ ID NO: 4059071 - RNA, 13 nt, Staphylococcus aureus subsp. aureus N315
cauacuucaauaa

SEQ ID NO: 4059072 - RNA, 15 nt, Staphylococcus aureus subsp. aureus N315
cauacuucguuguca

SEQ ID NO: 4059073 - RNA, 17 nt, Staphylococcus aureus subsp. aureus N315
cauacuucuauuuuaua

SEQ ID NO: 4059074 - RNA, 18 nt, Staphylococcus aureus subsp. aureus N315
cauacuucuauuuuauaa

SEQ ID NO: 4059075 - RNA, 22 nt, Staphylococcus aureus subsp. aureus N315
cauacuuuuagcaacaguauuu

SEQ ID NO: 4059076 - RNA, 14 nt, Staphylococcus aureus subsp. aureus N315
cauagaccuaugaa

SEQ ID NO: 4059077 - RNA, 18 nt, Staphylococcus aureus subsp. aureus N315
cauagauaauugcuauaa

SEQ ID NO: 4059078 - RNA, 14 nt, Staphylococcus aureus subsp. aureus N315
cauagauacaaagu

SEQ ID NO: 4059079 - RNA, 17 nt, Staphylococcus aureus subsp. aureus N315
cauagaugcauaaaaac

SEQ ID NO: 4059080 - RNA, 21 nt, Staphylococcus aureus subsp. aureus N315
cauagaugcuucaaaaauuaa

SEQ ID NO: 4059081 - RNA, 22 nt, Staphylococcus aureus subsp. aureus N315
cauagcauuaagaugauugucu

SEQ ID NO: 4059082 - RNA, 18 nt, Staphylococcus aureus subsp. aureus N315
cauagcucuucuuuuucu

SEQ ID NO: 4059083 - RNA, 15 nt, Staphylococcus aureus subsp. aureus N315
cauaggcuugccaau

SEQ ID NO: 4059084 - RNA, 13 nt, Staphylococcus aureus subsp. aureus N315
cauagguaaccuu

SEQ ID NO: 4059085 - RNA, 16 nt, Staphylococcus aureus subsp. aureus N315
cauaguuauuaaaucu

SEQ ID NO: 4059086 - RNA, 14 nt, Staphylococcus aureus subsp. aureus N315
cauauaaacaacug

SEQ ID NO: 4059087 - RNA, 17 nt, Staphylococcus aureus subsp. aureus N315
cauauaaauauuuuuaa

SEQ ID NO: 4059088 - RNA, 23 nt, Staphylococcus aureus subsp. aureus N315
cauauaaauauuuuuaauuauuu

SEQ ID NO: 4059089 - RNA, 13 nt, Staphylococcus aureus subsp. aureus N315
cauauaaauguug

SEQ ID NO: 4059090 - RNA, 21 nt, Staphylococcus aureus subsp. aureus N315
cauauaagccccaccaugauu

SEQ ID NO: 4059091 - RNA, 23 nt, Staphylococcus aureus subsp. aureus N315
cauauaaugguugaauaacacua

SEQ ID NO: 4059092 - RNA, 20 nt, Staphylococcus aureus subsp. aureus N315
cauauaauuugggucguuag

SEQ ID NO: 4059093 - RNA, 16 nt, Staphylococcus aureus subsp. aureus N315
cauauacgacauuuuu

SEQ ID NO: 4059094 - RNA, 16 nt, Staphylococcus aureus subsp. aureus N315
cauauacucuaaaaaa

SEQ ID NO: 4059095 - RNA, 18 nt, Staphylococcus aureus subsp. aureus N315
cauauauauucguuacaa

SEQ ID NO: 4059096 - RNA, 14 nt, Staphylococcus aureus subsp. aureus N315
cauauaucaacaug

SEQ ID NO: 4059097 - RNA, 20 nt, Staphylococcus aureus subsp. aureus N315
cauauaugccgauugcucua

SEQ ID NO: 4059098 - RNA, 20 nt, Staphylococcus aureus subsp. aureus N315
cauauauuuuguuaauaagc

SEQ ID NO: 4059099 - RNA, 14 nt, Staphylococcus aureus subsp. aureus N315
cauaucaugaaugu

SEQ ID NO: 4059100 - RNA, 21 nt, Staphylococcus aureus subsp. aureus N315
cauaucggcccauaauagcua

SEQ ID NO: 4059101 - RNA, 15 nt, Staphylococcus aureus subsp. aureus N315
cauaucgucaauuuu

SEQ ID NO: 4059102 - RNA, 13 nt, Staphylococcus aureus subsp. aureus N315
cauaucuauuuuu

SEQ ID NO: 4059103 - RNA, 16 nt, Staphylococcus aureus subsp. aureus N315
cauaucuuuaucauua

SEQ ID NO: 4059104 - RNA, 13 nt, Staphylococcus aureus subsp. aureus N315
cauaucuuucaau

SEQ ID NO: 4059105 - RNA, 18 nt, Staphylococcus aureus subsp. aureus N315
cauaugacuuuauuucua

SEQ ID NO: 4059106 - RNA, 23 nt, Staphylococcus aureus subsp. aureus N315
cauauggugaacuguuaaacuca

SEQ ID NO: 4059107 - RNA, 15 nt, Staphylococcus aureus subsp. aureus N315
cauauguaauacaaa

SEQ ID NO: 4059108 - RNA, 18 nt, Staphylococcus aureus subsp. aureus N315
cauauguaauacaaaaga

SEQ ID NO: 4059109 - RNA, 18 nt, Staphylococcus aureus subsp. aureus N315
cauaugucuguuccucaa

SEQ ID NO: 4059110 - RNA, 14 nt, Staphylococcus aureus subsp. aureus N315
cauauguuggauuc

SEQ ID NO: 4059111 - RNA, 14 nt, Staphylococcus aureus subsp. aureus N315
cauauuaacuguua

SEQ ID NO: 4059112 - RNA, 20 nt, Staphylococcus aureus subsp. aureus N315
cauauuacuuuggaaauuua

SEQ ID NO: 4059113 - RNA, 18 nt, Staphylococcus aureus subsp. aureus N315
cauauucaauguuuuaaa

SEQ ID NO: 4059114 - RNA, 11 nt, Staphylococcus aureus subsp. aureus N315
cauauucacau

SEQ ID NO: 4059115 - RNA, 20 nt, Staphylococcus aureus subsp. aureus N315
cauauucauaauaucgauga

SEQ ID NO: 4059116 - RNA, 17 nt, Staphylococcus aureus subsp. aureus N315
cauauugugccgcuucu

SEQ ID NO: 4059117 - RNA, 22 nt, Staphylococcus aureus subsp. aureus N315
cauauuuagguaauacaucauc

SEQ ID NO: 4059118 - RNA, 13 nt, Staphylococcus aureus subsp. aureus N315
cauauuuauauuu

SEQ ID NO: 4059119 - RNA, 11 nt, Staphylococcus aureus subsp. aureus N315
cauauuuugau

SEQ ID NO: 4059120 - RNA, 21 nt, Staphylococcus aureus subsp. aureus N315
cauauuuuuuaguaauaacau

SEQ ID NO: 4059121 - RNA, 14 nt, Staphylococcus aureus subsp. aureus N315
caucaaaaauaaaa

SEQ ID NO: 4059122 - RNA, 17 nt, Staphylococcus aureus subsp. aureus N315
caucaaacaacaucacu

SEQ ID NO: 4059123 - RNA, 20 nt, Staphylococcus aureus subsp. aureus N315
caucaaacaacaucacuuua

SEQ ID NO: 4059124 - RNA, 20 nt, Staphylococcus aureus subsp. aureus N315
caucaaguauaaauguuauu

SEQ ID NO: 4059125 - RNA, 14 nt, Staphylococcus aureus subsp. aureus N315
caucaaguugauaa

SEQ ID NO: 4059126 - RNA, 18 nt, Staphylococcus aureus subsp. aureus N315
caucaauaaauauugauu

SEQ ID NO: 4059127 - RNA, 19 nt, Staphylococcus aureus subsp. aureus N315
caucaauaaauauugauuc

SEQ ID NO: 4059128 - RNA, 17 nt, Staphylococcus aureus subsp. aureus N315
caucaauaccauaauua

SEQ ID NO: 4059129 - RNA, 19 nt, Staphylococcus aureus subsp. aureus N315
caucaauaucuucuucuaa

SEQ ID NO: 4059130 - RNA, 14 nt, Staphylococcus aureus subsp. aureus N315
caucaauauugaua

SEQ ID NO: 4059131 - RNA, 22 nt, Staphylococcus aureus subsp. aureus N315
caucaaugagcaagucuucuaa

SEQ ID NO: 4059132 - RNA, 12 nt, Staphylococcus aureus subsp. aureus N315
caucaauuucua

SEQ ID NO: 4059133 - RNA, 15 nt, Staphylococcus aureus subsp. aureus N315
caucacgauauguug

SEQ ID NO: 4059134 - RNA, 18 nt, Staphylococcus aureus subsp. aureus N315
caucacucgcaaucgaga

SEQ ID NO: 4059135 - RNA, 13 nt, Staphylococcus aureus subsp. aureus N315
caucacuugcugu

SEQ ID NO: 4059136 - RNA, 20 nt, Staphylococcus aureus subsp. aureus N315
caucacuugcuguugcaaua

SEQ ID NO: 4059137 - RNA, 13 nt, Staphylococcus aureus subsp. aureus N315
caucacuuuuuaa

SEQ ID NO: 4059138 - RNA, 21 nt, Staphylococcus aureus subsp. aureus N315
caucaguaccaaagaaaucac

SEQ ID NO: 4059139 - RNA, 23 nt, Staphylococcus aureus subsp. aureus N315
caucaguugagugauuuuaaucu

SEQ ID NO: 4059140 - RNA, 14 nt, Staphylococcus aureus subsp. aureus N315
caucauaaucugcu

SEQ ID NO: 4059141 - RNA, 23 nt, Staphylococcus aureus subsp. aureus N315
caucauaaucuuuuccuaaaccu

SEQ ID NO: 4059142 - RNA, 12 nt, Staphylococcus aureus subsp. aureus N315
caucauauacau

SEQ ID NO: 4059143 - RNA, 23 nt, Staphylococcus aureus subsp. aureus N315
caucauaucauaccaaaaaguau

SEQ ID NO: 4059144 - RNA, 12 nt, Staphylococcus aureus subsp. aureus N315
caucaucaccau

SEQ ID NO: 4059145 - RNA, 13 nt, Staphylococcus aureus subsp. aureus N315
caucaucaccaua

SEQ ID NO: 4059146 - RNA, 17 nt, Staphylococcus aureus subsp. aureus N315
caucaucaccauacuaa

SEQ ID NO: 4059147 - RNA, 22 nt, Staphylococcus aureus subsp. aureus N315
caucaucacuguagauucaaau

SEQ ID NO: 4059148 - RNA, 22 nt, Staphylococcus aureus subsp. aureus N315
caucaugaacuuuuauugccau

SEQ ID NO: 4059149 - RNA, 14 nt, Staphylococcus aureus subsp. aureus N315
caucauguuuaucu

SEQ ID NO: 4059150 - RNA, 13 nt, Staphylococcus aureus subsp. aureus N315
caucauuaaaauc

SEQ ID NO: 4059151 - RNA, 19 nt, Staphylococcus aureus subsp. aureus N315
caucauuaguuuuuaaaau

SEQ ID NO: 4059152 - RNA, 21 nt, Staphylococcus aureus subsp. aureus N315
caucauucauauggaauacua

SEQ ID NO: 4059153 - RNA, 13 nt, Staphylococcus aureus subsp. aureus N315
caucauucucaaa

SEQ ID NO: 4059154 - RNA, 16 nt, Staphylococcus aureus subsp. aureus N315
caucauuuaaauauuu

SEQ ID NO: 4059155 - RNA, 21 nt, Staphylococcus aureus subsp. aureus N315
caucauuuguguaaaugaauu

SEQ ID NO: 4059156 - RNA, 15 nt, Staphylococcus aureus subsp. aureus N315
caucauuuucaauac

SEQ ID NO: 4059157 - RNA, 23 nt, Staphylococcus aureus subsp. aureus N315
caucauuuucaauacuugaaaga

SEQ ID NO: 4059158 - RNA, 22 nt, Staphylococcus aureus subsp. aureus N315
caucauuuuucguuguucauaa

SEQ ID NO: 4059159 - RNA, 19 nt, Staphylococcus aureus subsp. aureus N315
cauccaauuauguuuaucu

SEQ ID NO: 4059160 - RNA, 21 nt, Staphylococcus aureus subsp. aureus N315
cauccaauuauguuuaucuac

SEQ ID NO: 4059161 - RNA, 16 nt, Staphylococcus aureus subsp. aureus N315
cauccacaaucacagu

SEQ ID NO: 4059162 - RNA, 19 nt, Staphylococcus aureus subsp. aureus N315
cauccacuuuuugccuggc

SEQ ID NO: 4059163 - RNA, 17 nt, Staphylococcus aureus subsp. aureus N315
cauccaggcaacaacuu

SEQ ID NO: 4059164 - RNA, 13 nt, Staphylococcus aureus subsp. aureus N315
cauccauacaaau

SEQ ID NO: 4059165 - RNA, 14 nt, Staphylococcus aureus subsp. aureus N315
cauccauacaaauc

SEQ ID NO: 4059166 - RNA, 14 nt, Staphylococcus aureus subsp. aureus N315
cauccccagccauu

SEQ ID NO: 4059167 - RNA, 14 nt, Staphylococcus aureus subsp. aureus N315
cauccucauaauua

SEQ ID NO: 4059168 - RNA, 16 nt, Staphylococcus aureus subsp. aureus N315
caucgauaucuaaguc

SEQ ID NO: 4059169 - RNA, 20 nt, Staphylococcus aureus subsp. aureus N315
caucgauuuaucauuauuug

SEQ ID NO: 4059170 - RNA, 13 nt, Staphylococcus aureus subsp. aureus N315
caucgccauccca

SEQ ID NO: 4059171 - RNA, 22 nt, Staphylococcus aureus subsp. aureus N315
caucggcaccaguagcuaaugc

SEQ ID NO: 4059172 - RNA, 23 nt, Staphylococcus aureus subsp. aureus N315
caucguaaaaaacaaaaaaaccg

SEQ ID NO: 4059173 - RNA, 14 nt, Staphylococcus aureus subsp. aureus N315
caucguauagaugu

SEQ ID NO: 4059174 - RNA, 14 nt, Staphylococcus aureus subsp. aureus N315
caucguauucuuuu

SEQ ID NO: 4059175 - RNA, 21 nt, Staphylococcus aureus subsp. aureus N315
caucgucaucacuuuuuaaac

SEQ ID NO: 4059176 - RNA, 22 nt, Staphylococcus aureus subsp. aureus N315
caucgucaucacuuuuuaaacg

SEQ ID NO: 4059177 - RNA, 18 nt, Staphylococcus aureus subsp. aureus N315
caucuaaauaguuuuuca

SEQ ID NO: 4059178 - RNA, 19 nt, Staphylococcus aureus subsp. aureus N315
caucuaaccuuuucaucag

SEQ ID NO: 4059179 - RNA, 22 nt, Staphylococcus aureus subsp. aureus N315
caucuaaccuuuucaucaguug

SEQ ID NO: 4059180 - RNA, 14 nt, Staphylococcus aureus subsp. aureus N315
caucuaauuuuccu

SEQ ID NO: 4059181 - RNA, 17 nt, Staphylococcus aureus subsp. aureus N315
caucuacuauuuaaucu

SEQ ID NO: 4059182 - RNA, 17 nt, Staphylococcus aureus subsp. aureus N315
caucucagcaauacuaa

SEQ ID NO: 4059183 - RNA, 22 nt, Staphylococcus aureus subsp. aureus N315
caucuccaaaggccaugagcuc

SEQ ID NO: 4059184 - RNA, 14 nt, Staphylococcus aureus subsp. aureus N315
caucucuaugucuc

SEQ ID NO: 4059185 - RNA, 13 nt, Staphylococcus aureus subsp. aureus N315
caucucuauuuuu

SEQ ID NO: 4059186 - RNA, 12 nt, Staphylococcus aureus subsp. aureus N315
caucucuucugg

SEQ ID NO: 4059187 - RNA, 16 nt, Staphylococcus aureus subsp. aureus N315
caucugaaaaaauuaa

SEQ ID NO: 4059188 - RNA, 13 nt, Staphylococcus aureus subsp. aureus N315
caucugacugauu

SEQ ID NO: 4059189 - RNA, 23 nt, Staphylococcus aureus subsp. aureus N315
caucugaugaggcaauauuaaaa

SEQ ID NO: 4059190 - RNA, 15 nt, Staphylococcus aureus subsp. aureus N315
caucugcaagggauc

SEQ ID NO: 4059191 - RNA, 18 nt, Staphylococcus aureus subsp. aureus N315
caucuuaacaacuuuaau

SEQ ID NO: 4059192 - RNA, 19 nt, Staphylococcus aureus subsp. aureus N315
caucuuaucaagaauauaa

SEQ ID NO: 4059193 - RNA, 21 nt, Staphylococcus aureus subsp. aureus N315
caucuuaugacugcuuuuuau

SEQ ID NO: 4059194 - RNA, 22 nt, Staphylococcus aureus subsp. aureus N315
caucuucaagacgcauuguugu

SEQ ID NO: 4059195 - RNA, 23 nt, Staphylococcus aureus subsp. aureus N315
caucuucaagacgcauuguugua

SEQ ID NO: 4059196 - RNA, 22 nt, Staphylococcus aureus subsp. aureus N315
caucuucaauauuuaaauuuua

SEQ ID NO: 4059197 - RNA, 15 nt, Staphylococcus aureus subsp. aureus N315
caucuuguuguucug

SEQ ID NO: 4059198 - RNA, 17 nt, Staphylococcus aureus subsp. aureus N315
caucuuuauuuacaaug

SEQ ID NO: 4059199 - RNA, 12 nt, Staphylococcus aureus subsp. aureus N315
caucuuucaaau

SEQ ID NO: 4059200 - RNA, 17 nt, Staphylococcus aureus subsp. aureus N315
caucuuucaaaugcuua

SEQ ID NO: 4059201 - RNA, 14 nt, Staphylococcus aureus subsp. aureus N315
caucuuuuauggug

SEQ ID NO: 4059202 - RNA, 17 nt, Staphylococcus aureus subsp. aureus N315
caucuuuugguuuaucu

SEQ ID NO: 4059203 - RNA, 19 nt, Staphylococcus aureus subsp. aureus N315
caucuuuugguuuaucugu

SEQ ID NO: 4059204 - RNA, 12 nt, Staphylococcus aureus subsp. aureus N315
caugaaauaaaa

SEQ ID NO: 4059205 - RNA, 15 nt, Staphylococcus aureus subsp. aureus N315
caugacagcaucauc

SEQ ID NO: 4059206 - RNA, 16 nt, Staphylococcus aureus subsp. aureus N315
caugacagcaucauca

SEQ ID NO: 4059207 - RNA, 15 nt, Staphylococcus aureus subsp. aureus N315
caugacauucauuua

SEQ ID NO: 4059208 - RNA, 17 nt, Staphylococcus aureus subsp. aureus N315
caugacucacuaaucuc

SEQ ID NO: 4059209 - RNA, 20 nt, Staphylococcus aureus subsp. aureus N315
caugauaaaguauguuguca

SEQ ID NO: 4059210 - RNA, 17 nt, Staphylococcus aureus subsp. aureus N315
caugauacugaaauuuc

SEQ ID NO: 4059211 - RNA, 20 nt, Staphylococcus aureus subsp. aureus N315
caugaugauaaauugaguuu

SEQ ID NO: 4059212 - RNA, 16 nt, Staphylococcus aureus subsp. aureus N315
caugauugaaauccuu

SEQ ID NO: 4059213 - RNA, 17 nt, Staphylococcus aureus subsp. aureus N315
caugauuuacuaaugcu

SEQ ID NO: 4059214 - RNA, 14 nt, Staphylococcus aureus subsp. aureus N315
caugauuucuucuc

SEQ ID NO: 4059215 - RNA, 20 nt, Staphylococcus aureus subsp. aureus N315
caugccagaugcaaugauac

SEQ ID NO: 4059216 - RNA, 18 nt, Staphylococcus aureus subsp. aureus N315
caugcccgauaaaaccac

SEQ ID NO: 4059217 - RNA, 18 nt, Staphylococcus aureus subsp. aureus N315
caugccuuaugucauaua

SEQ ID NO: 4059218 - RNA, 13 nt, Staphylococcus aureus subsp. aureus N315
caugccuucauga

SEQ ID NO: 4059219 - RNA, 14 nt, Staphylococcus aureus subsp. aureus N315
caugccuucaugaa

SEQ ID NO: 4059220 - RNA, 23 nt, Staphylococcus aureus subsp. aureus N315
caugcgcaaaagcgcaggcgaac

SEQ ID NO: 4059221 - RNA, 16 nt, Staphylococcus aureus subsp. aureus N315
caugcucauuugauaa

SEQ ID NO: 4059222 - RNA, 17 nt, Staphylococcus aureus subsp. aureus N315
caugcuuaauuuaugug

SEQ ID NO: 4059223 - RNA, 12 nt, Staphylococcus aureus subsp. aureus N315
cauggaaaagug

SEQ ID NO: 4059224 - RNA, 17 nt, Staphylococcus aureus subsp. aureus N315
cauggaaaagugcgauu

SEQ ID NO: 4059225 - RNA, 15 nt, Staphylococcus aureus subsp. aureus N315
caugguaucuuuaau

SEQ ID NO: 4059226 - RNA, 19 nt, Staphylococcus aureus subsp. aureus N315
cauguaaaauuaaaugcuc

SEQ ID NO: 4059227 - RNA, 20 nt, Staphylococcus aureus subsp. aureus N315
cauguaaauaguuaguuuau

SEQ ID NO: 4059228 - RNA, 15 nt, Staphylococcus aureus subsp. aureus N315
cauguaacaaaauac

SEQ ID NO: 4059229 - RNA, 22 nt, Staphylococcus aureus subsp. aureus N315
cauguaacaaaauacccugcuu

SEQ ID NO: 4059230 - RNA, 16 nt, Staphylococcus aureus subsp. aureus N315
cauguaaugcuuaaaa

SEQ ID NO: 4059231 - RNA, 17 nt, Staphylococcus aureus subsp. aureus N315
cauguaaugcuuaaaaa

SEQ ID NO: 4059232 - RNA, 15 nt, Staphylococcus aureus subsp. aureus N315
cauguacaguuacuu

SEQ ID NO: 4059233 - RNA, 15 nt, Staphylococcus aureus subsp. aureus N315
cauguacauugguuu

SEQ ID NO: 4059234 - RNA, 19 nt, Staphylococcus aureus subsp. aureus N315
cauguacauugguuuuuac

SEQ ID NO: 4059235 - RNA, 20 nt, Staphylococcus aureus subsp. aureus N315
cauguacguuuuuuuaaaua

SEQ ID NO: 4059236 - RNA, 19 nt, Staphylococcus aureus subsp. aureus N315
cauguauaaaagauauaaa

SEQ ID NO: 4059237 - RNA, 19 nt, Staphylococcus aureus subsp. aureus N315
cauguauauggcaucauca

SEQ ID NO: 4059238 - RNA, 20 nt, Staphylococcus aureus subsp. aureus N315
cauguauucuuagauauuau

SEQ ID NO: 4059239 - RNA, 15 nt, Staphylococcus aureus subsp. aureus N315
cauguauuggccaaa

SEQ ID NO: 4059240 - RNA, 15 nt, Staphylococcus aureus subsp. aureus N315
caugucaauuuuuuc

SEQ ID NO: 4059241 - RNA, 21 nt, Staphylococcus aureus subsp. aureus N315
caugucaauuuuuucaugauu

SEQ ID NO: 4059242 - RNA, 22 nt, Staphylococcus aureus subsp. aureus N315
caugucuagauuuuaaaucaau

SEQ ID NO: 4059243 - RNA, 23 nt, Staphylococcus aureus subsp. aureus N315
caugugcaagugguaaaaaugaa

SEQ ID NO: 4059244 - RNA, 23 nt, Staphylococcus aureus subsp. aureus N315
cauguggcuggacaaucuuauca

SEQ ID NO: 4059245 - RNA, 16 nt, Staphylococcus aureus subsp. aureus N315
caugugucuuccaauc

SEQ ID NO: 4059246 - RNA, 15 nt, Staphylococcus aureus subsp. aureus N315
cauguguugcaauug

SEQ ID NO: 4059247 - RNA, 22 nt, Staphylococcus aureus subsp. aureus N315
cauguuccccauuaauuaacaa

SEQ ID NO: 4059248 - RNA, 19 nt, Staphylococcus aureus subsp. aureus N315
cauguuccgcuacaaaaca

SEQ ID NO: 4059249 - RNA, 16 nt, Staphylococcus aureus subsp. aureus N315
cauguucuuauaaaaa

SEQ ID NO: 4059250 - RNA, 18 nt, Staphylococcus aureus subsp. aureus N315
cauguucuuauaaaaaac

SEQ ID NO: 4059251 - RNA, 18 nt, Staphylococcus aureus subsp. aureus N315
cauguugauaaaaaggau

SEQ ID NO: 4059252 - RNA, 16 nt, Staphylococcus aureus subsp. aureus N315
cauguuggcaauuguu

SEQ ID NO: 4059253 - RNA, 19 nt, Staphylococcus aureus subsp. aureus N315
cauguuuggaugaacaaaa

SEQ ID NO: 4059254 - RNA, 21 nt, Staphylococcus aureus subsp. aureus N315
cauuaaaaaaucgaacuagac

SEQ ID NO: 4059255 - RNA, 22 nt, Staphylococcus aureus subsp. aureus N315
cauuaaaaacgauucauuauau

SEQ ID NO: 4059256 - RNA, 14 nt, Staphylococcus aureus subsp. aureus N315
cauuaaaaauaaaa

SEQ ID NO: 4059257 - RNA, 22 nt, Staphylococcus aureus subsp. aureus N315
cauuaaaaggaugugacaaaua

SEQ ID NO: 4059258 - RNA, 14 nt, Staphylococcus aureus subsp. aureus N315
cauuaaaauaauua

SEQ ID NO: 4059259 - RNA, 13 nt, Staphylococcus aureus subsp. aureus N315
cauuaaaaugaua

SEQ ID NO: 4059260 - RNA, 16 nt, Staphylococcus aureus subsp. aureus N315
cauuaaaccaaucaau

SEQ ID NO: 4059261 - RNA, 12 nt, Staphylococcus aureus subsp. aureus N315
cauuaaaccacu

SEQ ID NO: 4059262 - RNA, 19 nt, Staphylococcus aureus subsp. aureus N315
cauuaaauauuauuuugca

SEQ ID NO: 4059263 - RNA, 13 nt, Staphylococcus aureus subsp. aureus N315
cauuaaauugcuu

SEQ ID NO: 4059264 - RNA, 19 nt, Staphylococcus aureus subsp. aureus N315
cauuaagcuaugcuuuuuu

SEQ ID NO: 4059265 - RNA, 14 nt, Staphylococcus aureus subsp. aureus N315
cauuaaguacuuuu

SEQ ID NO: 4059266 - RNA, 12 nt, Staphylococcus aureus subsp. aureus N315
cauuaaguuaaa

SEQ ID NO: 4059267 - RNA, 17 nt, Staphylococcus aureus subsp. aureus N315
cauuaauaaauaauaac

SEQ ID NO: 4059268 - RNA, 13 nt, Staphylococcus aureus subsp. aureus N315
cauuaaucauuua

SEQ ID NO: 4059269 - RNA, 16 nt, Staphylococcus aureus subsp. aureus N315
cauuaauccuuuauau

SEQ ID NO: 4059270 - RNA, 17 nt, Staphylococcus aureus subsp. aureus N315
cauuaaucuauauaaaa

SEQ ID NO: 4059271 - RNA, 21 nt, Staphylococcus aureus subsp. aureus N315
cauuaaucuauauaaaaacug

SEQ ID NO: 4059272 - RNA, 20 nt, Staphylococcus aureus subsp. aureus N315
cauuaaugauagcaaugaau

SEQ ID NO: 4059273 - RNA, 20 nt, Staphylococcus aureus subsp. aureus N315
cauuaauuggauuuuuacaa

SEQ ID NO: 4059274 - RNA, 17 nt, Staphylococcus aureus subsp. aureus N315
cauuaauuucaugugca

SEQ ID NO: 4059275 - RNA, 22 nt, Staphylococcus aureus subsp. aureus N315
cauuacaaaucaugacauaaaa

SEQ ID NO: 4059276 - RNA, 14 nt, Staphylococcus aureus subsp. aureus N315
cauuacagauaauu

SEQ ID NO: 4059277 - RNA, 16 nt, Staphylococcus aureus subsp. aureus N315
cauuacagauaauuau

SEQ ID NO: 4059278 - RNA, 19 nt, Staphylococcus aureus subsp. aureus N315
cauuacauguuacugauga

SEQ ID NO: 4059279 - RNA, 17 nt, Staphylococcus aureus subsp. aureus N315
cauuacccuuuaaacuc

SEQ ID NO: 4059280 - RNA, 20 nt, Staphylococcus aureus subsp. aureus N315
cauuacgccaccaguuucaa

SEQ ID NO: 4059281 - RNA, 19 nt, Staphylococcus aureus subsp. aureus N315
cauuacgcucaucaccuuu

SEQ ID NO: 4059282 - RNA, 18 nt, Staphylococcus aureus subsp. aureus N315
cauuacuaauugaucagc

SEQ ID NO: 4059283 - RNA, 14 nt, Staphylococcus aureus subsp. aureus N315
cauuacuacuuuau

SEQ ID NO: 4059284 - RNA, 18 nt, Staphylococcus aureus subsp. aureus N315
cauuacuaucuucaucau

SEQ ID NO: 4059285 - RNA, 21 nt, Staphylococcus aureus subsp. aureus N315
cauuacuguaaaauucuauaa

SEQ ID NO: 4059286 - RNA, 15 nt, Staphylococcus aureus subsp. aureus N315
cauuagcaugauaaa

SEQ ID NO: 4059287 - RNA, 17 nt, Staphylococcus aureus subsp. aureus N315
cauuagcaugauaaagu

SEQ ID NO: 4059288 - RNA, 23 nt, Staphylococcus aureus subsp. aureus N315
cauuagccaaaucuuuaauaacc

SEQ ID NO: 4059289 - RNA, 22 nt, Staphylococcus aureus subsp. aureus N315
cauuagccacagcuaaugugua

SEQ ID NO: 4059290 - RNA, 14 nt, Staphylococcus aureus subsp. aureus N315
cauuaguacuaaac

SEQ ID NO: 4059291 - RNA, 15 nt, Staphylococcus aureus subsp. aureus N315
cauuaguugcauaau

SEQ ID NO: 4059292 - RNA, 18 nt, Staphylococcus aureus subsp. aureus N315
cauuaguuuuuaaaauua

SEQ ID NO: 4059293 - RNA, 17 nt, Staphylococcus aureus subsp. aureus N315
cauuauaaugauuuuua

SEQ ID NO: 4059294 - RNA, 20 nt, Staphylococcus aureus subsp. aureus N315
cauuauaugguucguccauu

SEQ ID NO: 4059295 - RNA, 21 nt, Staphylococcus aureus subsp. aureus N315
cauuaucaagaacuuuaaaaa

SEQ ID NO: 4059296 - RNA, 19 nt, Staphylococcus aureus subsp. aureus N315
cauuaucaagaauaacuau

SEQ ID NO: 4059297 - RNA, 20 nt, Staphylococcus aureus subsp. aureus N315
cauuaucaagaauaacuauu

SEQ ID NO: 4059298 - RNA, 18 nt, Staphylococcus aureus subsp. aureus N315
cauuaucaccuucaaacu

SEQ ID NO: 4059299 - RNA, 13 nt, Staphylococcus aureus subsp. aureus N315
cauuauuaaauag

SEQ ID NO: 4059300 - RNA, 17 nt, Staphylococcus aureus subsp. aureus N315
cauuauuaagugaguuu

SEQ ID NO: 4059301 - RNA, 16 nt, Staphylococcus aureus subsp. aureus N315
cauuauuauuuuaaua

SEQ ID NO: 4059302 - RNA, 17 nt, Staphylococcus aureus subsp. aureus N315
cauuauuuauauuuaga

SEQ ID NO: 4059303 - RNA, 18 nt, Staphylococcus aureus subsp. aureus N315
cauuauuugauaaauaaa

SEQ ID NO: 4059304 - RNA, 16 nt, Staphylococcus aureus subsp. aureus N315
cauuauuugcugcuaa

SEQ ID NO: 4059305 - RNA, 12 nt, Staphylococcus aureus subsp. aureus N315
cauucaaauaaa

SEQ ID NO: 4059306 - RNA, 19 nt, Staphylococcus aureus subsp. aureus N315
cauucaaguguaguaaaaa

SEQ ID NO: 4059307 - RNA, 21 nt, Staphylococcus aureus subsp. aureus N315
cauucaccaauauuaaugaau

SEQ ID NO: 4059308 - RNA, 19 nt, Staphylococcus aureus subsp. aureus N315
cauucaccuaaaaagaaaa

SEQ ID NO: 4059309 - RNA, 14 nt, Staphylococcus aureus subsp. aureus N315
cauucacuacuuuu

SEQ ID NO: 4059310 - RNA, 15 nt, Staphylococcus aureus subsp. aureus N315
cauucauaaaugacu

SEQ ID NO: 4059311 - RNA, 17 nt, Staphylococcus aureus subsp. aureus N315
cauucauaaaugacuga

SEQ ID NO: 4059312 - RNA, 18 nt, Staphylococcus aureus subsp. aureus N315
cauucauauggaauacua

SEQ ID NO: 4059313 - RNA, 23 nt, Staphylococcus aureus subsp. aureus N315
cauucaucaauggugaccaagau

SEQ ID NO: 4059314 - RNA, 14 nt, Staphylococcus aureus subsp. aureus N315
cauucaucgucuca

SEQ ID NO: 4059315 - RNA, 20 nt, Staphylococcus aureus subsp. aureus N315
cauucauuaagcuuuguuug

SEQ ID NO: 4059316 - RNA, 14 nt, Staphylococcus aureus subsp. aureus N315
cauucauuugcaaa

SEQ ID NO: 4059317 - RNA, 12 nt, Staphylococcus aureus subsp. aureus N315
cauuccaaaaau

SEQ ID NO: 4059318 - RNA, 13 nt, Staphylococcus aureus subsp. aureus N315
cauuccaaaaauu

SEQ ID NO: 4059319 - RNA, 19 nt, Staphylococcus aureus subsp. aureus N315
cauuccucuauuguaucuu

SEQ ID NO: 4059320 - RNA, 23 nt, Staphylococcus aureus subsp. aureus N315
cauucgaugcuaaaaauauugaa

SEQ ID NO: 4059321 - RNA, 14 nt, Staphylococcus aureus subsp. aureus N315
cauucuauacuuuu

SEQ ID NO: 4059322 - RNA, 15 nt, Staphylococcus aureus subsp. aureus N315
cauucuucaaaaaau

SEQ ID NO: 4059323 - RNA, 16 nt, Staphylococcus aureus subsp. aureus N315
cauucuucaaaaaaua

SEQ ID NO: 4059324 - RNA, 13 nt, Staphylococcus aureus subsp. aureus N315
cauucuuccaaca

SEQ ID NO: 4059325 - RNA, 22 nt, Staphylococcus aureus subsp. aureus N315
cauucuuccaacacccauauaa

SEQ ID NO: 4059326 - RNA, 19 nt, Staphylococcus aureus subsp. aureus N315
cauucuugaauaaauuuua

SEQ ID NO: 4059327 - RNA, 20 nt, Staphylococcus aureus subsp. aureus N315
cauucuuuaauauaaauuuu

SEQ ID NO: 4059328 - RNA, 15 nt, Staphylococcus aureus subsp. aureus N315
cauucuuuauagaaa

SEQ ID NO: 4059329 - RNA, 19 nt, Staphylococcus aureus subsp. aureus N315
cauucuuuuucucaaugug

SEQ ID NO: 4059330 - RNA, 21 nt, Staphylococcus aureus subsp. aureus N315
cauugaaaucgucuuacugcu

SEQ ID NO: 4059331 - RNA, 17 nt, Staphylococcus aureus subsp. aureus N315
cauugaauaaaugaagg

SEQ ID NO: 4059332 - RNA, 21 nt, Staphylococcus aureus subsp. aureus N315
cauugacacacccaaauuuag

SEQ ID NO: 4059333 - RNA, 22 nt, Staphylococcus aureus subsp. aureus N315
cauugaccaccuuuaucuguaa

SEQ ID NO: 4059334 - RNA, 21 nt, Staphylococcus aureus subsp. aureus N315
cauugagauaucuuauaacaa

SEQ ID NO: 4059335 - RNA, 13 nt, Staphylococcus aureus subsp. aureus N315
cauugauaaaaua

SEQ ID NO: 4059336 - RNA, 15 nt, Staphylococcus aureus subsp. aureus N315
cauugauaaaauaau

SEQ ID NO: 4059337 - RNA, 18 nt, Staphylococcus aureus subsp. aureus N315
cauugauaaauuuuuagu

SEQ ID NO: 4059338 - RNA, 16 nt, Staphylococcus aureus subsp. aureus N315
cauugaucuuuuauaa

SEQ ID NO: 4059339 - RNA, 18 nt, Staphylococcus aureus subsp. aureus N315
cauugaugucaauuucac

SEQ ID NO: 4059340 - RNA, 15 nt, Staphylococcus aureus subsp. aureus N315
cauuggauucuuuug

SEQ ID NO: 4059341 - RNA, 15 nt, Staphylococcus aureus subsp. aureus N315
cauuguaaaaugcuc

SEQ ID NO: 4059342 - RNA, 13 nt, Staphylococcus aureus subsp. aureus N315
cauuguaaaaugu

SEQ ID NO: 4059343 - RNA, 13 nt, Staphylococcus aureus subsp. aureus N315
cauuguaacucaa

SEQ ID NO: 4059344 - RNA, 13 nt, Staphylococcus aureus subsp. aureus N315
cauuguauaaaaa

SEQ ID NO: 4059345 - RNA, 22 nt, Staphylococcus aureus subsp. aureus N315
cauuguggcuuuuuuuauggug

SEQ ID NO: 4059346 - RNA, 15 nt, Staphylococcus aureus subsp. aureus N315
cauuguuauccaaaa

SEQ ID NO: 4059347 - RNA, 21 nt, Staphylococcus aureus subsp. aureus N315
cauuguuauuaucguaaaaaa

SEQ ID NO: 4059348 - RNA, 13 nt, Staphylococcus aureus subsp. aureus N315
cauuguuauuuau

SEQ ID NO: 4059349 - RNA, 15 nt, Staphylococcus aureus subsp. aureus N315
cauuguuauuuauac

SEQ ID NO: 4059350 - RNA, 17 nt, Staphylococcus aureus subsp. aureus N315
cauuguuuuacagucaa

SEQ ID NO: 4059351 - RNA, 15 nt, Staphylococcus aureus subsp. aureus N315
cauuuaaaaaucaaa

SEQ ID NO: 4059352 - RNA, 18 nt, Staphylococcus aureus subsp. aureus N315
cauuuaaaauauuuuuuc

SEQ ID NO: 4059353 - RNA, 20 nt, Staphylococcus aureus subsp. aureus N315
cauuuaaaauauuuuuucug

SEQ ID NO: 4059354 - RNA, 11 nt, Staphylococcus aureus subsp. aureus N315
cauuuaagccu

SEQ ID NO: 4059355 - RNA, 22 nt, Staphylococcus aureus subsp. aureus N315
cauuuaaggauuuccucgguuu

SEQ ID NO: 4059356 - RNA, 14 nt, Staphylococcus aureus subsp. aureus N315
cauuuaauacuuuu

SEQ ID NO: 4059357 - RNA, 16 nt, Staphylococcus aureus subsp. aureus N315
cauuuaauacuuuucu

SEQ ID NO: 4059358 - RNA, 23 nt, Staphylococcus aureus subsp. aureus N315
cauuuacuugauuagauuugugu

SEQ ID NO: 4059359 - RNA, 12 nt, Staphylococcus aureus subsp. aureus N315
cauuuaguuaaa

SEQ ID NO: 4059360 - RNA, 15 nt, Staphylococcus aureus subsp. aureus N315
cauuuaguuaaauac

SEQ ID NO: 4059361 - RNA, 14 nt, Staphylococcus aureus subsp. aureus N315
cauuuauaaacauu

SEQ ID NO: 4059362 - RNA, 18 nt, Staphylococcus aureus subsp. aureus N315
cauuuauaaacauugucc

SEQ ID NO: 4059363 - RNA, 17 nt, Staphylococcus aureus subsp. aureus N315
cauuuauaugauguuca

SEQ ID NO: 4059364 - RNA, 21 nt, Staphylococcus aureus subsp. aureus N315
cauuuauguguuggcuuuuau

SEQ ID NO: 4059365 - RNA, 12 nt, Staphylococcus aureus subsp. aureus N315
cauuuauuuuca

SEQ ID NO: 4059366 - RNA, 21 nt, Staphylococcus aureus subsp. aureus N315
cauuucaucaauaauuucuug

SEQ ID NO: 4059367 - RNA, 14 nt, Staphylococcus aureus subsp. aureus N315
cauuucauguguca

SEQ ID NO: 4059368 - RNA, 17 nt, Staphylococcus aureus subsp. aureus N315
cauuucaugugucacaa

SEQ ID NO: 4059369 - RNA, 20 nt, Staphylococcus aureus subsp. aureus N315
cauuucaugugucacaauga

SEQ ID NO: 4059370 - RNA, 16 nt, Staphylococcus aureus subsp. aureus N315
cauuuccuaugugcug

SEQ ID NO: 4059371 - RNA, 15 nt, Staphylococcus aureus subsp. aureus N315
cauuucguauauaua

SEQ ID NO: 4059372 - RNA, 20 nt, Staphylococcus aureus subsp. aureus N315
cauuucuauacaaucauuua

SEQ ID NO: 4059373 - RNA, 19 nt, Staphylococcus aureus subsp. aureus N315
cauuucugucccacuccca

SEQ ID NO: 4059374 - RNA, 20 nt, Staphylococcus aureus subsp. aureus N315
cauuucugucccacucccua

SEQ ID NO: 4059375 - RNA, 16 nt, Staphylococcus aureus subsp. aureus N315
cauuugaacaucauuu

SEQ ID NO: 4059376 - RNA, 15 nt, Staphylococcus aureus subsp. aureus N315
cauuugacauaaucc

SEQ ID NO: 4059377 - RNA, 13 nt, Staphylococcus aureus subsp. aureus N315
cauuugaccaagu

SEQ ID NO: 4059378 - RNA, 19 nt, Staphylococcus aureus subsp. aureus N315
cauuugcgauuucuucugc

SEQ ID NO: 4059379 - RNA, 23 nt, Staphylococcus aureus subsp. aureus N315
cauuugguggagaaccuuuaaaa

SEQ ID NO: 4059380 - RNA, 18 nt, Staphylococcus aureus subsp. aureus N315
cauuugguuuaacuuuau

SEQ ID NO: 4059381 - RNA, 14 nt, Staphylococcus aureus subsp. aureus N315
cauuuguauagauu

SEQ ID NO: 4059382 - RNA, 15 nt, Staphylococcus aureus subsp. aureus N315
cauuugucauaauag

SEQ ID NO: 4059383 - RNA, 23 nt, Staphylococcus aureus subsp. aureus N315
cauuugucauaauagauaaugca

SEQ ID NO: 4059384 - RNA, 13 nt, Staphylococcus aureus subsp. aureus N315
cauuuguguaaau

SEQ ID NO: 4059385 - RNA, 18 nt, Staphylococcus aureus subsp. aureus N315
cauuuguguuccugcuac

SEQ ID NO: 4059386 - RNA, 19 nt, Staphylococcus aureus subsp. aureus N315
cauuuguucaucugauaau

SEQ ID NO: 4059387 - RNA, 17 nt, Staphylococcus aureus subsp. aureus N315
cauuuguuguuauuaua

SEQ ID NO: 4059388 - RNA, 12 nt, Staphylococcus aureus subsp. aureus N315
cauuuuaaauaa

SEQ ID NO: 4059389 - RNA, 11 nt, Staphylococcus aureus subsp. aureus N315
cauuuuaagug

SEQ ID NO: 4059390 - RNA, 21 nt, Staphylococcus aureus subsp. aureus N315
cauuuuagauugacuaaguuu

SEQ ID NO: 4059391 - RNA, 20 nt, Staphylococcus aureus subsp. aureus N315
cauuuuagcaaaagcuuuua

SEQ ID NO: 4059392 - RNA, 16 nt, Staphylococcus aureus subsp. aureus N315
cauuuuaguuauacua

SEQ ID NO: 4059393 - RNA, 16 nt, Staphylococcus aureus subsp. aureus N315
cauuuuauaaaucaaa

SEQ ID NO: 4059394 - RNA, 15 nt, Staphylococcus aureus subsp. aureus N315
cauuuuauauuuuag

SEQ ID NO: 4059395 - RNA, 15 nt, Staphylococcus aureus subsp. aureus N315
cauuuuauccaaacc

SEQ ID NO: 4059396 - RNA, 15 nt, Staphylococcus aureus subsp. aureus N315
cauuuuaucugaaaa

SEQ ID NO: 4059397 - RNA, 19 nt, Staphylococcus aureus subsp. aureus N315
cauuuucaacauaauauuu

SEQ ID NO: 4059398 - RNA, 19 nt, Staphylococcus aureus subsp. aureus N315
cauuuucaaguuuaaaaua

SEQ ID NO: 4059399 - RNA, 23 nt, Staphylococcus aureus subsp. aureus N315
cauuuucaaguuuaaaauacgac

SEQ ID NO: 4059400 - RNA, 23 nt, Staphylococcus aureus subsp. aureus N315
cauuuucaauacuugaaagauuu

SEQ ID NO: 4059401 - RNA, 20 nt, Staphylococcus aureus subsp. aureus N315
cauuuugacgccagaauaaa

SEQ ID NO: 4059402 - RNA, 16 nt, Staphylococcus aureus subsp. aureus N315
cauuuuuaauuuugac

SEQ ID NO: 4059403 - RNA, 16 nt, Staphylococcus aureus subsp. aureus N315
cauuuuuucauuauua

SEQ ID NO: 4059404 - RNA, 12 nt, Staphylococcus aureus subsp. aureus N315
ccaaaaaguauu

SEQ ID NO: 4059405 - RNA, 22 nt, Staphylococcus aureus subsp. aureus N315
ccaaaaaucauccauaaaaaua

SEQ ID NO: 4059406 - RNA, 17 nt, Staphylococcus aureus subsp. aureus N315
ccaaaagaaauuuaaua

SEQ ID NO: 4059407 - RNA, 23 nt, Staphylococcus aureus subsp. aureus N315
ccaaaagaaauuuaauacaauuc

SEQ ID NO: 4059408 - RNA, 21 nt, Staphylococcus aureus subsp. aureus N315
ccaaaaguuauauaaauuugu

SEQ ID NO: 4059409 - RNA, 22 nt, Staphylococcus aureus subsp. aureus N315
ccaaacaaccugugauaaaaau

SEQ ID NO: 4059410 - RNA, 21 nt, Staphylococcus aureus subsp. aureus N315
ccaaagaaagcuaauaucaau

SEQ ID NO: 4059411 - RNA, 20 nt, Staphylococcus aureus subsp. aureus N315
ccaaagaaaucaccagauuu

SEQ ID NO: 4059412 - RNA, 16 nt, Staphylococcus aureus subsp. aureus N315
ccaaagcugaauuuua

SEQ ID NO: 4059413 - RNA, 13 nt, Staphylococcus aureus subsp. aureus N315
ccaaauaaauaua

SEQ ID NO: 4059414 - RNA, 15 nt, Staphylococcus aureus subsp. aureus N315
ccaaauaaauuaaau

SEQ ID NO: 4059415 - RNA, 20 nt, Staphylococcus aureus subsp. aureus N315
ccaaauauaguaauuguuau

SEQ ID NO: 4059416 - RNA, 16 nt, Staphylococcus aureus subsp. aureus N315
ccaaauccaucuaauu

SEQ ID NO: 4059417 - RNA, 17 nt, Staphylococcus aureus subsp. aureus N315
ccaaaucggaauaaaau

SEQ ID NO: 4059418 - RNA, 19 nt, Staphylococcus aureus subsp. aureus N315
ccaaaucggaauaaaauaa

SEQ ID NO: 4059419 - RNA, 18 nt, Staphylococcus aureus subsp. aureus N315
ccaaaucuuuaauaaccu

SEQ ID NO: 4059420 - RNA, 22 nt, Staphylococcus aureus subsp. aureus N315
ccaaaugugguggguauauaau

SEQ ID NO: 4059421 - RNA, 18 nt, Staphylococcus aureus subsp. aureus N315
ccaaauuggccauuggau

SEQ ID NO: 4059422 - RNA, 14 nt, Staphylococcus aureus subsp. aureus N315
ccaacaaaaagaau

SEQ ID NO: 4059423 - RNA, 12 nt, Staphylococcus aureus subsp. aureus N315
ccaacaacuaag

SEQ ID NO: 4059424 - RNA, 20 nt, Staphylococcus aureus subsp. aureus N315
ccaacaagguucuaaaucuu

SEQ ID NO: 4059425 - RNA, 22 nt, Staphylococcus aureus subsp. aureus N315
ccaacacagagaauuucgaaaa

SEQ ID NO: 4059426 - RNA, 13 nt, Staphylococcus aureus subsp. aureus N315
ccaacacauaaau

SEQ ID NO: 4059427 - RNA, 16 nt, Staphylococcus aureus subsp. aureus N315
ccaacaccuaauauuu

SEQ ID NO: 4059428 - RNA, 21 nt, Staphylococcus aureus subsp. aureus N315
ccaacauauaaaaaauuauua

SEQ ID NO: 4059429 - RNA, 23 nt, Staphylococcus aureus subsp. aureus N315
ccaacauauuuuaacuaugaaug

SEQ ID NO: 4059430 - RNA, 15 nt, Staphylococcus aureus subsp. aureus N315
ccaacaucuucaaca

SEQ ID NO: 4059431 - RNA, 20 nt, Staphylococcus aureus subsp. aureus N315
ccaacugucgguucaucuaa

SEQ ID NO: 4059432 - RNA, 13 nt, Staphylococcus aureus subsp. aureus N315
ccaacuuuuuuaa

SEQ ID NO: 4059433 - RNA, 17 nt, Staphylococcus aureus subsp. aureus N315
ccaagaacguguuugaa

SEQ ID NO: 4059434 - RNA, 21 nt, Staphylococcus aureus subsp. aureus N315
ccaagaagacauuggauuacu

SEQ ID NO: 4059435 - RNA, 20 nt, Staphylococcus aureus subsp. aureus N315
ccaagauaaaucaucauucu

SEQ ID NO: 4059436 - RNA, 16 nt, Staphylococcus aureus subsp. aureus N315
ccaagauuaugacaac

SEQ ID NO: 4059437 - RNA, 14 nt, Staphylococcus aureus subsp. aureus N315
ccaauaaaauguca

SEQ ID NO: 4059438 - RNA, 13 nt, Staphylococcus aureus subsp. aureus N315
ccaauaaacaacu

SEQ ID NO: 4059439 - RNA, 14 nt, Staphylococcus aureus subsp. aureus N315
ccaauaauaaauca

SEQ ID NO: 4059440 - RNA, 10 nt, Staphylococcus aureus subsp. aureus N315
ccaauaaucc

SEQ ID NO: 4059441 - RNA, 20 nt, Staphylococcus aureus subsp. aureus N315
ccaauacagaacuuuaauaa

SEQ ID NO: 4059442 - RNA, 18 nt, Staphylococcus aureus subsp. aureus N315
ccaauagguucauuauuu

SEQ ID NO: 4059443 - RNA, 21 nt, Staphylococcus aureus subsp. aureus N315
ccaauauauucaccuacaaca

SEQ ID NO: 4059444 - RNA, 14 nt, Staphylococcus aureus subsp. aureus N315
ccaauaucauauuu

SEQ ID NO: 4059445 - RNA, 16 nt, Staphylococcus aureus subsp. aureus N315
ccaauaucauauuuga

SEQ ID NO: 4059446 - RNA, 21 nt, Staphylococcus aureus subsp. aureus N315
ccaauauuaaugaauauaggc

SEQ ID NO: 4059447 - RNA, 16 nt, Staphylococcus aureus subsp. aureus N315
ccaaugauuguuaaua

SEQ ID NO: 4059448 - RNA, 23 nt, Staphylococcus aureus subsp. aureus N315
ccaaugcguggauguguuuuaau

SEQ ID NO: 4059449 - RNA, 18 nt, Staphylococcus aureus subsp. aureus N315
ccaaugcugaauaaauaa

SEQ ID NO: 4059450 - RNA, 16 nt, Staphylococcus aureus subsp. aureus N315
ccaauguauaaaaccu

SEQ ID NO: 4059451 - RNA, 12 nt, Staphylococcus aureus subsp. aureus N315
ccaauguguuua

SEQ ID NO: 4059452 - RNA, 14 nt, Staphylococcus aureus subsp. aureus N315
ccaauguguuuaac

SEQ ID NO: 4059453 - RNA, 22 nt, Staphylococcus aureus subsp. aureus N315
ccaauuaaaucgauuaagaaug

SEQ ID NO: 4059454 - RNA, 14 nt, Staphylococcus aureus subsp. aureus N315
ccaauuaauaaaca

SEQ ID NO: 4059455 - RNA, 22 nt, Staphylococcus aureus subsp. aureus N315
ccaauucauuuuauaaaucaaa

SEQ ID NO: 4059456 - RNA, 20 nt, Staphylococcus aureus subsp. aureus N315
ccaccacauuugguggagaa

SEQ ID NO: 4059457 - RNA, 14 nt, Staphylococcus aureus subsp. aureus N315
ccaccuuguuuaag

SEQ ID NO: 4059458 - RNA, 18 nt, Staphylococcus aureus subsp. aureus N315
ccacggcauuuaagccug

SEQ ID NO: 4059459 - RNA, 13 nt, Staphylococcus aureus subsp. aureus N315
ccacgguuuacca

SEQ ID NO: 4059460 - RNA, 22 nt, Staphylococcus aureus subsp. aureus N315
ccacuaagugaacuauuaaaac

SEQ ID NO: 4059461 - RNA, 15 nt, Staphylococcus aureus subsp. aureus N315
ccacuauauccuuuu

SEQ ID NO: 4059462 - RNA, 12 nt, Staphylococcus aureus subsp. aureus N315
ccacucaauucu

SEQ ID NO: 4059463 - RNA, 19 nt, Staphylococcus aureus subsp. aureus N315
ccacucaauucucuaacuu

SEQ ID NO: 4059464 - RNA, 19 nt, Staphylococcus aureus subsp. aureus N315
ccacucauaaucaagucug

SEQ ID NO: 4059465 - RNA, 23 nt, Staphylococcus aureus subsp. aureus N315
ccacuccuuaaacaaauaaaugu

SEQ ID NO: 4059466 - RNA, 14 nt, Staphylococcus aureus subsp. aureus N315
ccacuuaaucguuc

SEQ ID NO: 4059467 - RNA, 13 nt, Staphylococcus aureus subsp. aureus N315
ccacuucaucuaa

SEQ ID NO: 4059468 - RNA, 14 nt, Staphylococcus aureus subsp. aureus N315
ccacuucuucaccu

SEQ ID NO: 4059469 - RNA, 16 nt, Staphylococcus aureus subsp. aureus N315
ccacuugaauacuuuu

SEQ ID NO: 4059470 - RNA, 20 nt, Staphylococcus aureus subsp. aureus N315
ccacuugaauacuuuuuaac

SEQ ID NO: 4059471 - RNA, 21 nt, Staphylococcus aureus subsp. aureus N315
ccacuugaauacuuuuuaacu

SEQ ID NO: 4059472 - RNA, 19 nt, Staphylococcus aureus subsp. aureus N315
ccacuuuuguuaaaaaaug

SEQ ID NO: 4059473 - RNA, 22 nt, Staphylococcus aureus subsp. aureus N315
ccagaauguguuggcuuuuuga

SEQ ID NO: 4059474 - RNA, 15 nt, Staphylococcus aureus subsp. aureus N315
ccagaugaauuuuua

SEQ ID NO: 4059475 - RNA, 15 nt, Staphylococcus aureus subsp. aureus N315
ccagccauuaaaccu

SEQ ID NO: 4059476 - RNA, 22 nt, Staphylococcus aureus subsp. aureus N315
ccagccccaauuagccccagua

SEQ ID NO: 4059477 - RNA, 15 nt, Staphylococcus aureus subsp. aureus N315
ccagccuauucguuu

SEQ ID NO: 4059478 - RNA, 16 nt, Staphylococcus aureus subsp. aureus N315
ccagcuaaaccaucug

SEQ ID NO: 4059479 - RNA, 20 nt, Staphylococcus aureus subsp. aureus N315
ccagcuugaccgccuaugau

SEQ ID NO: 4059480 - RNA, 13 nt, Staphylococcus aureus subsp. aureus N315
ccaguauaauuuu

SEQ ID NO: 4059481 - RNA, 13 nt, Staphylococcus aureus subsp. aureus N315
ccaguaucucuuu

SEQ ID NO: 4059482 - RNA, 13 nt, Staphylococcus aureus subsp. aureus N315
ccagucauguccc

SEQ ID NO: 4059483 - RNA, 18 nt, Staphylococcus aureus subsp. aureus N315
ccagucauuguauaaaaa

SEQ ID NO: 4059484 - RNA, 13 nt, Staphylococcus aureus subsp. aureus N315
ccaguuucaagug

SEQ ID NO: 4059485 - RNA, 21 nt, Staphylococcus aureus subsp. aureus N315
ccauaaauaaaaugcuacaau

SEQ ID NO: 4059486 - RNA, 14 nt, Staphylococcus aureus subsp. aureus N315
ccauaaauauuaaa

SEQ ID NO: 4059487 - RNA, 17 nt, Staphylococcus aureus subsp. aureus N315
ccauaaauauuuaaaau

SEQ ID NO: 4059488 - RNA, 13 nt, Staphylococcus aureus subsp. aureus N315
ccauaacaauuuu

SEQ ID NO: 4059489 - RNA, 22 nt, Staphylococcus aureus subsp. aureus N315
ccauaaggauuuuuaauuuuau

SEQ ID NO: 4059490 - RNA, 13 nt, Staphylococcus aureus subsp. aureus N315
ccauaaguaaaac

SEQ ID NO: 4059491 - RNA, 20 nt, Staphylococcus aureus subsp. aureus N315
ccauaauuaaauaacuuuuu

SEQ ID NO: 4059492 - RNA, 13 nt, Staphylococcus aureus subsp. aureus N315
ccauaauuuaaau

SEQ ID NO: 4059493 - RNA, 21 nt, Staphylococcus aureus subsp. aureus N315
ccauacaaaucguaaacauaa

SEQ ID NO: 4059494 - RNA, 19 nt, Staphylococcus aureus subsp. aureus N315
ccauacauaugcuauauuu

SEQ ID NO: 4059495 - RNA, 16 nt, Staphylococcus aureus subsp. aureus N315
ccauacccauauuaaa

SEQ ID NO: 4059496 - RNA, 18 nt, Staphylococcus aureus subsp. aureus N315
ccauacgaucuuuuucaa

SEQ ID NO: 4059497 - RNA, 15 nt, Staphylococcus aureus subsp. aureus N315
ccauacuaaauaagu

SEQ ID NO: 4059498 - RNA, 21 nt, Staphylococcus aureus subsp. aureus N315
ccauacuaaauaaguaguuca

SEQ ID NO: 4059499 - RNA, 20 nt, Staphylococcus aureus subsp. aureus N315
ccauacuaaucguuccaaca

SEQ ID NO: 4059500 - RNA, 14 nt, Staphylococcus aureus subsp. aureus N315
ccauacucugggca

SEQ ID NO: 4059501 - RNA, 20 nt, Staphylococcus aureus subsp. aureus N315
ccauacuucuauuuuauaau

SEQ ID NO: 4059502 - RNA, 23 nt, Staphylococcus aureus subsp. aureus N315
ccauauaaagcugcgauauaacu

SEQ ID NO: 4059503 - RNA, 21 nt, Staphylococcus aureus subsp. aureus N315
ccauauuuguagccuacaacc

SEQ ID NO: 4059504 - RNA, 20 nt, Staphylococcus aureus subsp. aureus N315
ccaucaauauuuauauuaaa

SEQ ID NO: 4059505 - RNA, 23 nt, Staphylococcus aureus subsp. aureus N315
ccaucaauccaacuacugcaaca

SEQ ID NO: 4059506 - RNA, 15 nt, Staphylococcus aureus subsp. aureus N315
ccaucacgauauguu

SEQ ID NO: 4059507 - RNA, 14 nt, Staphylococcus aureus subsp. aureus N315
ccaucauaaauguu

SEQ ID NO: 4059508 - RNA, 15 nt, Staphylococcus aureus subsp. aureus N315
ccaucauuuguguuu

SEQ ID NO: 4059509 - RNA, 21 nt, Staphylococcus aureus subsp. aureus N315
ccaucccaacuuaauaaccau

SEQ ID NO: 4059510 - RNA, 16 nt, Staphylococcus aureus subsp. aureus N315
ccaucccauuaaacca

SEQ ID NO: 4059511 - RNA, 14 nt, Staphylococcus aureus subsp. aureus N315
ccaucccauucacc

SEQ ID NO: 4059512 - RNA, 16 nt, Staphylococcus aureus subsp. aureus N315
ccaucgcaacugauaa

SEQ ID NO: 4059513 - RNA, 23 nt, Staphylococcus aureus subsp. aureus N315
ccaucgcuuuuuccauuuuuuug

SEQ ID NO: 4059514 - RNA, 20 nt, Staphylococcus aureus subsp. aureus N315
ccaucguagcgcuuagauaa

SEQ ID NO: 4059515 - RNA, 20 nt, Staphylococcus aureus subsp. aureus N315
ccaucucgugaaaauaauac

SEQ ID NO: 4059516 - RNA, 18 nt, Staphylococcus aureus subsp. aureus N315
ccaucuucuugauuguaa

SEQ ID NO: 4059517 - RNA, 20 nt, Staphylococcus aureus subsp. aureus N315
ccaucuuuuagguaauaauu

SEQ ID NO: 4059518 - RNA, 16 nt, Staphylococcus aureus subsp. aureus N315
ccaugagaaaccgcuu

SEQ ID NO: 4059519 - RNA, 17 nt, Staphylococcus aureus subsp. aureus N315
ccaugauuagcgcacca

SEQ ID NO: 4059520 - RNA, 17 nt, Staphylococcus aureus subsp. aureus N315
ccaugcaaacucauuua

SEQ ID NO: 4059521 - RNA, 19 nt, Staphylococcus aureus subsp. aureus N315
ccaugcccgauaaaaccac

SEQ ID NO: 4059522 - RNA, 19 nt, Staphylococcus aureus subsp. aureus N315
ccaugugccuuugcuuuuu

SEQ ID NO: 4059523 - RNA, 19 nt, Staphylococcus aureus subsp. aureus N315
ccauuaaaucaacaagaac

SEQ ID NO: 4059524 - RNA, 13 nt, Staphylococcus aureus subsp. aureus N315
ccauuaaucauuu

SEQ ID NO: 4059525 - RNA, 14 nt, Staphylococcus aureus subsp. aureus N315
ccauuaauuacaua

SEQ ID NO: 4059526 - RNA, 22 nt, Staphylococcus aureus subsp. aureus N315
ccauuaucgcuguaaagucguu

SEQ ID NO: 4059527 - RNA, 21 nt, Staphylococcus aureus subsp. aureus N315
ccauucaauguuuaauuuucu

SEQ ID NO: 4059528 - RNA, 24 nt, Staphylococcus aureus subsp. aureus N315
ccauucaccaauauuaaugaauau

SEQ ID NO: 4059529 - RNA, 19 nt, Staphylococcus aureus subsp. aureus N315
ccauucaucgucucacuua

SEQ ID NO: 4059530 - RNA, 12 nt, Staphylococcus aureus subsp. aureus N315
ccauucauuaag

SEQ ID NO: 4059531 - RNA, 23 nt, Staphylococcus aureus subsp. aureus N315
ccauucgaaagccaauuaauaaa

SEQ ID NO: 4059532 - RNA, 18 nt, Staphylococcus aureus subsp. aureus N315
ccauugaucuuuuauaau

SEQ ID NO: 4059533 - RNA, 14 nt, Staphylococcus aureus subsp. aureus N315
ccauugcacuaugc

SEQ ID NO: 4059534 - RNA, 17 nt, Staphylococcus aureus subsp. aureus N315
ccauugcacuaugcaua

SEQ ID NO: 4059535 - RNA, 13 nt, Staphylococcus aureus subsp. aureus N315
ccauugucaugcc

SEQ ID NO: 4059536 - RNA, 21 nt, Staphylococcus aureus subsp. aureus N315
ccauuguuauccaaaacauuu

SEQ ID NO: 4059537 - RNA, 17 nt, Staphylococcus aureus subsp. aureus N315
ccauuguugauaaaugg

SEQ ID NO: 4059538 - RNA, 19 nt, Staphylococcus aureus subsp. aureus N315
ccauuuaacucaccuuuau

SEQ ID NO: 4059539 - RNA, 22 nt, Staphylococcus aureus subsp. aureus N315
ccauuucgauaccuaaaauacc

SEQ ID NO: 4059540 - RNA, 18 nt, Staphylococcus aureus subsp. aureus N315
ccauuuuuuuccaagcau

SEQ ID NO: 4059541 - RNA, 12 nt, Staphylococcus aureus subsp. aureus N315
cccaacacagaa

SEQ ID NO: 4059542 - RNA, 15 nt, Staphylococcus aureus subsp. aureus N315
cccaacacagagaaa

SEQ ID NO: 4059543 - RNA, 22 nt, Staphylococcus aureus subsp. aureus N315
cccaacacugagaauuucuaau

SEQ ID NO: 4059544 - RNA, 13 nt, Staphylococcus aureus subsp. aureus N315
cccaacauaucac

SEQ ID NO: 4059545 - RNA, 16 nt, Staphylococcus aureus subsp. aureus N315
cccaacgaugaaacuc

SEQ ID NO: 4059546 - RNA, 18 nt, Staphylococcus aureus subsp. aureus N315
cccaagaugguauugcuu

SEQ ID NO: 4059547 - RNA, 11 nt, Staphylococcus aureus subsp. aureus N315
cccacacccca

SEQ ID NO: 4059548 - RNA, 17 nt, Staphylococcus aureus subsp. aureus N315
cccagaugaauuuuuau

SEQ ID NO: 4059549 - RNA, 16 nt, Staphylococcus aureus subsp. aureus N315
cccauaccuacaaaua

SEQ ID NO: 4059550 - RNA, 16 nt, Staphylococcus aureus subsp. aureus N315
cccauguauaaggaua

SEQ ID NO: 4059551 - RNA, 17 nt, Staphylococcus aureus subsp. aureus N315
cccauucaccaauauua

SEQ ID NO: 4059552 - RNA, 15 nt, Staphylococcus aureus subsp. aureus N315
ccccaacucgcauug

SEQ ID NO: 4059553 - RNA, 20 nt, Staphylococcus aureus subsp. aureus N315
ccccaacuugcauugucugu

SEQ ID NO: 4059554 - RNA, 21 nt, Staphylococcus aureus subsp. aureus N315
ccccauuuauguguuggcuuu

SEQ ID NO: 4059555 - RNA, 12 nt, Staphylococcus aureus subsp. aureus N315
cccccaacacaa

SEQ ID NO: 4059556 - RNA, 17 nt, Staphylococcus aureus subsp. aureus N315
ccccucauucacaauga

SEQ ID NO: 4059557 - RNA, 16 nt, Staphylococcus aureus subsp. aureus N315
ccccuuacaacuuuag

SEQ ID NO: 4059558 - RNA, 18 nt, Staphylococcus aureus subsp. aureus N315
cccguaauaauuuacagg

SEQ ID NO: 4059559 - RNA, 15 nt, Staphylococcus aureus subsp. aureus N315
cccuaaagcuaaugc

SEQ ID NO: 4059560 - RNA, 22 nt, Staphylococcus aureus subsp. aureus N315
cccuacaaaguuuauacuuaau

SEQ ID NO: 4059561 - RNA, 21 nt, Staphylococcus aureus subsp. aureus N315
cccuacugcaccgauaucaua

SEQ ID NO: 4059562 - RNA, 16 nt, Staphylococcus aureus subsp. aureus N315
cccuaugaaauaacua

SEQ ID NO: 4059563 - RNA, 21 nt, Staphylococcus aureus subsp. aureus N315
cccuccuggugcugcaccaag

SEQ ID NO: 4059564 - RNA, 15 nt, Staphylococcus aureus subsp. aureus N315
cccugcuguuuuauu

SEQ ID NO: 4059565 - RNA, 20 nt, Staphylococcus aureus subsp. aureus N315
cccuuccuagggugccgucu

SEQ ID NO: 4059566 - RNA, 14 nt, Staphylococcus aureus subsp. aureus N315
cccuuuagucaugu

SEQ ID NO: 4059567 - RNA, 19 nt, Staphylococcus aureus subsp. aureus N315
cccuuuuugucucucaaca

SEQ ID NO: 4059568 - RNA, 24 nt, Staphylococcus aureus subsp. aureus N315
ccgaaaaaaccgagaaucuccauu

SEQ ID NO: 4059569 - RNA, 21 nt, Staphylococcus aureus subsp. aureus N315
ccgaaaauugcuaaaaaaauu

SEQ ID NO: 4059570 - RNA, 18 nt, Staphylococcus aureus subsp. aureus N315
ccgaacacaaaaaugaag

SEQ ID NO: 4059571 - RNA, 15 nt, Staphylococcus aureus subsp. aureus N315
ccgaagcgcagugac

SEQ ID NO: 4059572 - RNA, 14 nt, Staphylococcus aureus subsp. aureus N315
ccgaauaauuuuga

SEQ ID NO: 4059573 - RNA, 17 nt, Staphylococcus aureus subsp. aureus N315
ccgaccaacuugcacau

SEQ ID NO: 4059574 - RNA, 14 nt, Staphylococcus aureus subsp. aureus N315
ccgacuauuuuuga

SEQ ID NO: 4059575 - RNA, 17 nt, Staphylococcus aureus subsp. aureus N315
ccgacuuaauauugaau

SEQ ID NO: 4059576 - RNA, 21 nt, Staphylococcus aureus subsp. aureus N315
ccgauauaauuaauuugucca

SEQ ID NO: 4059577 - RNA, 13 nt, Staphylococcus aureus subsp. aureus N315
ccgauuguuucac

SEQ ID NO: 4059578 - RNA, 16 nt, Staphylococcus aureus subsp. aureus N315
ccgauuuugauauaaa

SEQ ID NO: 4059579 - RNA, 17 nt, Staphylococcus aureus subsp. aureus N315
ccgauuuugauauaaaa

SEQ ID NO: 4059580 - RNA, 18 nt, Staphylococcus aureus subsp. aureus N315
ccgcacuucuauauuaau

SEQ ID NO: 4059581 - RNA, 14 nt, Staphylococcus aureus subsp. aureus N315
ccgcagaccacauc

SEQ ID NO: 4059582 - RNA, 20 nt, Staphylococcus aureus subsp. aureus N315
ccgccaacuaauguuaaaau

SEQ ID NO: 4059583 - RNA, 14 nt, Staphylococcus aureus subsp. aureus N315
ccgccuaauaauaa

SEQ ID NO: 4059584 - RNA, 14 nt, Staphylococcus aureus subsp. aureus N315
ccggcuuuuucuuu

SEQ ID NO: 4059585 - RNA, 13 nt, Staphylococcus aureus subsp. aureus N315
ccguauuucaaau

SEQ ID NO: 4059586 - RNA, 16 nt, Staphylococcus aureus subsp. aureus N315
ccguuaaaaagacggu

SEQ ID NO: 4059587 - RNA, 21 nt, Staphylococcus aureus subsp. aureus N315
ccguuugaagucuguuuagaa

SEQ ID NO: 4059588 - RNA, 12 nt, Staphylococcus aureus subsp. aureus N315
ccuaaaaacaaa

SEQ ID NO: 4059589 - RNA, 19 nt, Staphylococcus aureus subsp. aureus N315
ccuaaaccucuaaauaaaa

SEQ ID NO: 4059590 - RNA, 19 nt, Staphylococcus aureus subsp. aureus N315
ccuaaagguaacuuuuuaa

SEQ ID NO: 4059591 - RNA, 21 nt, Staphylococcus aureus subsp. aureus N315
ccuaaagguaacuuuuuaacu

SEQ ID NO: 4059592 - RNA, 21 nt, Staphylococcus aureus subsp. aureus N315
ccuaaaucuuuaaauguauca

SEQ ID NO: 4059593 - RNA, 12 nt, Staphylococcus aureus subsp. aureus N315
ccuaaccuguuu

SEQ ID NO: 4059594 - RNA, 22 nt, Staphylococcus aureus subsp. aureus N315
ccuaagcucguuaauuuuauuu

SEQ ID NO: 4059595 - RNA, 16 nt, Staphylococcus aureus subsp. aureus N315
ccuaaggacuuuaugc

SEQ ID NO: 4059596 - RNA, 14 nt, Staphylococcus aureus subsp. aureus N315
ccuaauaaauaucu

SEQ ID NO: 4059597 - RNA, 21 nt, Staphylococcus aureus subsp. aureus N315
ccuaauacacuugauaaaacu

SEQ ID NO: 4059598 - RNA, 14 nt, Staphylococcus aureus subsp. aureus N315
ccuaauauuuuaaa

SEQ ID NO: 4059599 - RNA, 22 nt, Staphylococcus aureus subsp. aureus N315
ccuaaucugcaacgauuuuaaa

SEQ ID NO: 4059600 - RNA, 21 nt, Staphylococcus aureus subsp. aureus N315
ccuaaugagcccguuaaaaag

SEQ ID NO: 4059601 - RNA, 13 nt, Staphylococcus aureus subsp. aureus N315
ccuaaugcgacau

SEQ ID NO: 4059602 - RNA, 12 nt, Staphylococcus aureus subsp. aureus N315
ccuaaugcuuua

SEQ ID NO: 4059603 - RNA, 20 nt, Staphylococcus aureus subsp. aureus N315
ccuaauggucgugcuugcgg

SEQ ID NO: 4059604 - RNA, 17 nt, Staphylococcus aureus subsp. aureus N315
ccuaauucgccaucuuu

SEQ ID NO: 4059605 - RNA, 23 nt, Staphylococcus aureus subsp. aureus N315
ccuaauucgccaucuuuuuuagc

SEQ ID NO: 4059606 - RNA, 14 nt, Staphylococcus aureus subsp. aureus N315
ccuacaacaccaau

SEQ ID NO: 4059607 - RNA, 19 nt, Staphylococcus aureus subsp. aureus N315
ccuacaacaccaauugaaa

SEQ ID NO: 4059608 - RNA, 12 nt, Staphylococcus aureus subsp. aureus N315
ccuacugcuguc

SEQ ID NO: 4059609 - RNA, 18 nt, Staphylococcus aureus subsp. aureus N315
ccuacuuuucaacuuuag

SEQ ID NO: 4059610 - RNA, 15 nt, Staphylococcus aureus subsp. aureus N315
ccuagauaccaaacu

SEQ ID NO: 4059611 - RNA, 17 nt, Staphylococcus aureus subsp. aureus N315
ccuagauaccaaacugc

SEQ ID NO: 4059612 - RNA, 13 nt, Staphylococcus aureus subsp. aureus N315
ccuagcaaaaaua

SEQ ID NO: 4059613 - RNA, 16 nt, Staphylococcus aureus subsp. aureus N315
ccuagcaaaaauacuu

SEQ ID NO: 4059614 - RNA, 19 nt, Staphylococcus aureus subsp. aureus N315
ccuaggaaauaaaaaauaa

SEQ ID NO: 4059615 - RNA, 21 nt, Staphylococcus aureus subsp. aureus N315
ccuaggaaauaaaaaauaacc

SEQ ID NO: 4059616 - RNA, 20 nt, Staphylococcus aureus subsp. aureus N315
ccuaggaguaucuguuucua

SEQ ID NO: 4059617 - RNA, 16 nt, Staphylococcus aureus subsp. aureus N315
ccuagguuuauauauc

SEQ ID NO: 4059618 - RNA, 18 nt, Staphylococcus aureus subsp. aureus N315
ccuagguuuauauaucac

SEQ ID NO: 4059619 - RNA, 20 nt, Staphylococcus aureus subsp. aureus N315
ccuagguuuauauaucacau

SEQ ID NO: 4059620 - RNA, 14 nt, Staphylococcus aureus subsp. aureus N315
ccuauaagucucuu

SEQ ID NO: 4059621 - RNA, 17 nt, Staphylococcus aureus subsp. aureus N315
ccuauacauaacccuaa

SEQ ID NO: 4059622 - RNA, 18 nt, Staphylococcus aureus subsp. aureus N315
ccuauauuuuuagcuuua

SEQ ID NO: 4059623 - RNA, 13 nt, Staphylococcus aureus subsp. aureus N315
ccuauucccaaaa

SEQ ID NO: 4059624 - RNA, 22 nt, Staphylococcus aureus subsp. aureus N315
ccuauuccuaauaaauaucuua

SEQ ID NO: 4059625 - RNA, 18 nt, Staphylococcus aureus subsp. aureus N315
ccucaacauuaaaaugug

SEQ ID NO: 4059626 - RNA, 15 nt, Staphylococcus aureus subsp. aureus N315
ccucacuaacucaau

SEQ ID NO: 4059627 - RNA, 22 nt, Staphylococcus aureus subsp. aureus N315
ccucacuagauaguuuauacuu

SEQ ID NO: 4059628 - RNA, 14 nt, Staphylococcus aureus subsp. aureus N315
ccucauaaaucaug

SEQ ID NO: 4059629 - RNA, 13 nt, Staphylococcus aureus subsp. aureus N315
ccucaucgaguuu

SEQ ID NO: 4059630 - RNA, 17 nt, Staphylococcus aureus subsp. aureus N315
ccucauuccaggaagga

SEQ ID NO: 4059631 - RNA, 18 nt, Staphylococcus aureus subsp. aureus N315
ccuccuggugcugcacca

SEQ ID NO: 4059632 - RNA, 16 nt, Staphylococcus aureus subsp. aureus N315
ccucgguauucaauuc

SEQ ID NO: 4059633 - RNA, 23 nt, Staphylococcus aureus subsp. aureus N315
ccucuaacgguauaucauccaca

SEQ ID NO: 4059634 - RNA, 21 nt, Staphylococcus aureus subsp. aureus N315
ccucuaacguuaacaauauuc

SEQ ID NO: 4059635 - RNA, 18 nt, Staphylococcus aureus subsp. aureus N315
ccucucguaaauuguugu

SEQ ID NO: 4059636 - RNA, 22 nt, Staphylococcus aureus subsp. aureus N315
ccucugauacuucaccaucuuu

SEQ ID NO: 4059637 - RNA, 21 nt, Staphylococcus aureus subsp. aureus N315
ccucuguuuuguugguguuua

SEQ ID NO: 4059638 - RNA, 20 nt, Staphylococcus aureus subsp. aureus N315
ccugacaauucaucuaaccu

SEQ ID NO: 4059639 - RNA, 22 nt, Staphylococcus aureus subsp. aureus N315
ccugauuccacuacaaucauac

SEQ ID NO: 4059640 - RNA, 20 nt, Staphylococcus aureus subsp. aureus N315
ccugcaaaauguuacacaaa

SEQ ID NO: 4059641 - RNA, 18 nt, Staphylococcus aureus subsp. aureus N315
ccugcauauucacgauau

SEQ ID NO: 4059642 - RNA, 17 nt, Staphylococcus aureus subsp. aureus N315
ccugcuacaacuucuuc

SEQ ID NO: 4059643 - RNA, 16 nt, Staphylococcus aureus subsp. aureus N315
ccuggaauauuaacac

SEQ ID NO: 4059644 - RNA, 12 nt, Staphylococcus aureus subsp. aureus N315
ccugugauaaaa

SEQ ID NO: 4059645 - RNA, 18 nt, Staphylococcus aureus subsp. aureus N315
ccuguuacuuucacauuu

SEQ ID NO: 4059646 - RNA, 22 nt, Staphylococcus aureus subsp. aureus N315
ccuguuauugcaauaaaauuag

SEQ ID NO: 4059647 - RNA, 15 nt, Staphylococcus aureus subsp. aureus N315
ccuguugaauauacu

SEQ ID NO: 4059648 - RNA, 18 nt, Staphylococcus aureus subsp. aureus N315
ccuuaacuucauaauaua

SEQ ID NO: 4059649 - RNA, 15 nt, Staphylococcus aureus subsp. aureus N315
ccuuaauaucaugca

SEQ ID NO: 4059650 - RNA, 18 nt, Staphylococcus aureus subsp. aureus N315
ccuuacccaaaaaauugu

SEQ ID NO: 4059651 - RNA, 13 nt, Staphylococcus aureus subsp. aureus N315
ccuuauauuuuau

SEQ ID NO: 4059652 - RNA, 18 nt, Staphylococcus aureus subsp. aureus N315
ccuucaaaaguuuuugga

SEQ ID NO: 4059653 - RNA, 18 nt, Staphylococcus aureus subsp. aureus N315
ccuucaauguucaauuca

SEQ ID NO: 4059654 - RNA, 13 nt, Staphylococcus aureus subsp. aureus N315
ccuucaucacuau

SEQ ID NO: 4059655 - RNA, 15 nt, Staphylococcus aureus subsp. aureus N315
ccuucauuagccaaa

SEQ ID NO: 4059656 - RNA, 17 nt, Staphylococcus aureus subsp. aureus N315
ccuucauuagccaaauc

SEQ ID NO: 4059657 - RNA, 21 nt, Staphylococcus aureus subsp. aureus N315
ccuucauuagccaaaucuuua

SEQ ID NO: 4059658 - RNA, 15 nt, Staphylococcus aureus subsp. aureus N315
ccuuccaauaauaaa

SEQ ID NO: 4059659 - RNA, 21 nt, Staphylococcus aureus subsp. aureus N315
ccuucuguacguuuuaaauaa

SEQ ID NO: 4059660 - RNA, 15 nt, Staphylococcus aureus subsp. aureus N315
ccuucuuuauaacuu

SEQ ID NO: 4059661 - RNA, 15 nt, Staphylococcus aureus subsp. aureus N315
ccuucuuucgcuuca

SEQ ID NO: 4059662 - RNA, 17 nt, Staphylococcus aureus subsp. aureus N315
ccuucuuugaaaucaau

SEQ ID NO: 4059663 - RNA, 18 nt, Staphylococcus aureus subsp. aureus N315
ccuucuuugaaaucaaug

SEQ ID NO: 4059664 - RNA, 18 nt, Staphylococcus aureus subsp. aureus N315
ccuugauuuaauuuuuaa

SEQ ID NO: 4059665 - RNA, 15 nt, Staphylococcus aureus subsp. aureus N315
ccuuguaaauuuaaa

SEQ ID NO: 4059666 - RNA, 21 nt, Staphylococcus aureus subsp. aureus N315
ccuuguuuaaguuuuucaggg

SEQ ID NO: 4059667 - RNA, 18 nt, Staphylococcus aureus subsp. aureus N315
ccuuuaaaacaucauuca

SEQ ID NO: 4059668 - RNA, 13 nt, Staphylococcus aureus subsp. aureus N315
ccuuuaauaauau

SEQ ID NO: 4059669 - RNA, 15 nt, Staphylococcus aureus subsp. aureus N315
ccuuuaauuacacua

SEQ ID NO: 4059670 - RNA, 18 nt, Staphylococcus aureus subsp. aureus N315
ccuuuaauuacacuacgc

SEQ ID NO: 4059671 - RNA, 19 nt, Staphylococcus aureus subsp. aureus N315
ccuuuaauuguuaaaucac

SEQ ID NO: 4059672 - RNA, 20 nt, Staphylococcus aureus subsp. aureus N315
ccuuuaauuguuaaaucacc

SEQ ID NO: 4059673 - RNA, 19 nt, Staphylococcus aureus subsp. aureus N315
ccuuuacaacauacaugcc

SEQ ID NO: 4059674 - RNA, 20 nt, Staphylococcus aureus subsp. aureus N315
ccuuuacgccauucaucauc

SEQ ID NO: 4059675 - RNA, 16 nt, Staphylococcus aureus subsp. aureus N315
ccuuuagccaaugcuu

SEQ ID NO: 4059676 - RNA, 20 nt, Staphylococcus aureus subsp. aureus N315
ccuuucauuuuagcaaaagc

SEQ ID NO: 4059677 - RNA, 20 nt, Staphylococcus aureus subsp. aureus N315
ccuuuccauucguauaagaa

SEQ ID NO: 4059678 - RNA, 15 nt, Staphylococcus aureus subsp. aureus N315
ccuuugguucaauca

SEQ ID NO: 4059679 - RNA, 11 nt, Staphylococcus aureus subsp. aureus N315
ccuuuuuaaaa

SEQ ID NO: 4059680 - RNA, 17 nt, Staphylococcus aureus subsp. aureus N315
ccuuuuuauuuuuugga

SEQ ID NO: 4059681 - RNA, 17 nt, Staphylococcus aureus subsp. aureus N315
ccuuuuuguaauuguaa

SEQ ID NO: 4059682 - RNA, 21 nt, Staphylococcus aureus subsp. aureus N315
ccuuuuugucucucaacauuu

SEQ ID NO: 4059683 - RNA, 11 nt, Staphylococcus aureus subsp. aureus N315
ccuuuuuucuc

SEQ ID NO: 4059684 - RNA, 23 nt, Staphylococcus aureus subsp. aureus N315
cgaaaaccucuguuuuguuggug

SEQ ID NO: 4059685 - RNA, 23 nt, Staphylococcus aureus subsp. aureus N315
cgaaaagaaauucuacaggcaau

SEQ ID NO: 4059686 - RNA, 23 nt, Staphylococcus aureus subsp. aureus N315
cgaaaagaaauucuacagguaau

SEQ ID NO: 4059687 - RNA, 14 nt, Staphylococcus aureus subsp. aureus N315
cgaaaauaaaacaa

SEQ ID NO: 4059688 - RNA, 20 nt, Staphylococcus aureus subsp. aureus N315
cgaaaauagcuauuaaaaua

SEQ ID NO: 4059689 - RNA, 13 nt, Staphylococcus aureus subsp. aureus N315
cgaaaauaucauu

SEQ ID NO: 4059690 - RNA, 20 nt, Staphylococcus aureus subsp. aureus N315
cgaaaauugcuaaaaaaauu

SEQ ID NO: 4059691 - RNA, 23 nt, Staphylococcus aureus subsp. aureus N315
cgaaaauuucaggcguuaauaca

SEQ ID NO: 4059692 - RNA, 17 nt, Staphylococcus aureus subsp. aureus N315
cgaaagaugauauauuc

SEQ ID NO: 4059693 - RNA, 17 nt, Staphylococcus aureus subsp. aureus N315
cgaaaguagaauuauuu

SEQ ID NO: 4059694 - RNA, 13 nt, Staphylococcus aureus subsp. aureus N315
cgaaauaguucaa

SEQ ID NO: 4059695 - RNA, 19 nt, Staphylococcus aureus subsp. aureus N315
cgaaauaguucaaaauacu

SEQ ID NO: 4059696 - RNA, 15 nt, Staphylococcus aureus subsp. aureus N315
cgaaaugaaugagug

SEQ ID NO: 4059697 - RNA, 21 nt, Staphylococcus aureus subsp. aureus N315
cgaaaugcaaugagcaucuug

SEQ ID NO: 4059698 - RNA, 18 nt, Staphylococcus aureus subsp. aureus N315
cgaaauggugaacuaaau

SEQ ID NO: 4059699 - RNA, 13 nt, Staphylococcus aureus subsp. aureus N315
cgaaauucucuuu

SEQ ID NO: 4059700 - RNA, 22 nt, Staphylococcus aureus subsp. aureus N315
cgaacaucugaaaaaauuaaua

SEQ ID NO: 4059701 - RNA, 16 nt, Staphylococcus aureus subsp. aureus N315
cgaacaugaaugauau

SEQ ID NO: 4059702 - RNA, 23 nt, Staphylococcus aureus subsp. aureus N315
cgaaccgaagcgcagugaccuca

SEQ ID NO: 4059703 - RNA, 23 nt, Staphylococcus aureus subsp. aureus N315
cgaagggcggucaauuuuaccau

SEQ ID NO: 4059704 - RNA, 20 nt, Staphylococcus aureus subsp. aureus N315
cgaauaacguuggaaacuuc

SEQ ID NO: 4059705 - RNA, 16 nt, Staphylococcus aureus subsp. aureus N315
cgaauaacuguuuauc

SEQ ID NO: 4059706 - RNA, 22 nt, Staphylococcus aureus subsp. aureus N315
cgaauaacuguuuaucaugaug

SEQ ID NO: 4059707 - RNA, 17 nt, Staphylococcus aureus subsp. aureus N315
cgaauaucuuaaagaau

SEQ ID NO: 4059708 - RNA, 15 nt, Staphylococcus aureus subsp. aureus N315
cgaauuaaaauaacu

SEQ ID NO: 4059709 - RNA, 18 nt, Staphylococcus aureus subsp. aureus N315
cgaauuaagaaaaguuac

SEQ ID NO: 4059710 - RNA, 21 nt, Staphylococcus aureus subsp. aureus N315
cgaauucaacgaaagugauuu

SEQ ID NO: 4059711 - RNA, 20 nt, Staphylococcus aureus subsp. aureus N315
cgaauucaccuucccaguca

SEQ ID NO: 4059712 - RNA, 17 nt, Staphylococcus aureus subsp. aureus N315
cgaauucuccguuaauu

SEQ ID NO: 4059713 - RNA, 22 nt, Staphylococcus aureus subsp. aureus N315
cgaauucucgauuuuuuuauau

SEQ ID NO: 4059714 - RNA, 17 nt, Staphylococcus aureus subsp. aureus N315
cgaauugguaaaaaucu

SEQ ID NO: 4059715 - RNA, 20 nt, Staphylococcus aureus subsp. aureus N315
cgacaauuauaauaaaacuu

SEQ ID NO: 4059716 - RNA, 22 nt, Staphylococcus aureus subsp. aureus N315
cgacaauuauaauaaaacuugu

SEQ ID NO: 4059717 - RNA, 16 nt, Staphylococcus aureus subsp. aureus N315
cgacaccaacauauuu

SEQ ID NO: 4059718 - RNA, 17 nt, Staphylococcus aureus subsp. aureus N315
cgacacgaacaacauua

SEQ ID NO: 4059719 - RNA, 15 nt, Staphylococcus aureus subsp. aureus N315
cgacaggggcuuaac

SEQ ID NO: 4059720 - RNA, 10 nt, Staphylococcus aureus subsp. aureus N315
cgacaucuag

SEQ ID NO: 4059721 - RNA, 20 nt, Staphylococcus aureus subsp. aureus N315
cgacaucuagaugaaauugu

SEQ ID NO: 4059722 - RNA, 20 nt, Staphylococcus aureus subsp. aureus N315
cgacauguccauaauauccu

SEQ ID NO: 4059723 - RNA, 18 nt, Staphylococcus aureus subsp. aureus N315
cgacauuuguaaauauuu

SEQ ID NO: 4059724 - RNA, 21 nt, Staphylococcus aureus subsp. aureus N315
cgaccagucgcauauuuugau

SEQ ID NO: 4059725 - RNA, 16 nt, Staphylococcus aureus subsp. aureus N315
cgacguuuaaaugccc

SEQ ID NO: 4059726 - RNA, 14 nt, Staphylococcus aureus subsp. aureus N315
cgacuuaacuuaag

SEQ ID NO: 4059727 - RNA, 13 nt, Staphylococcus aureus subsp. aureus N315
cgacuucagauac

SEQ ID NO: 4059728 - RNA, 13 nt, Staphylococcus aureus subsp. aureus N315
cgagcaauucuuc

SEQ ID NO: 4059729 - RNA, 18 nt, Staphylococcus aureus subsp. aureus N315
cgagcaguauauaucaaa

SEQ ID NO: 4059730 - RNA, 17 nt, Staphylococcus aureus subsp. aureus N315
cgagccauuauuauuuu

SEQ ID NO: 4059731 - RNA, 15 nt, Staphylococcus aureus subsp. aureus N315
cgagcguugguaacg

SEQ ID NO: 4059732 - RNA, 20 nt, Staphylococcus aureus subsp. aureus N315
cgagcuaauaugucuagacu

SEQ ID NO: 4059733 - RNA, 19 nt, Staphylococcus aureus subsp. aureus N315
cgaggaaauccuuaaaugg

SEQ ID NO: 4059734 - RNA, 19 nt, Staphylococcus aureus subsp. aureus N315
cgaguaugguugauuacaa

SEQ ID NO: 4059735 - RNA, 23 nt, Staphylococcus aureus subsp. aureus N315
cgaguuuguuucuaaauucuuuu

SEQ ID NO: 4059736 - RNA, 17 nt, Staphylococcus aureus subsp. aureus N315
cgauaaaaguuguauuc

SEQ ID NO: 4059737 - RNA, 14 nt, Staphylococcus aureus subsp. aureus N315
cgauaaacuacaca

SEQ ID NO: 4059738 - RNA, 11 nt, Staphylococcus aureus subsp. aureus N315
cgauaaauaau

SEQ ID NO: 4059739 - RNA, 13 nt, Staphylococcus aureus subsp. aureus N315
cgauaaauaauaa

SEQ ID NO: 4059740 - RNA, 17 nt, Staphylococcus aureus subsp. aureus N315
cgauaaauguauuaaac

SEQ ID NO: 4059741 - RNA, 17 nt, Staphylococcus aureus subsp. aureus N315
cgauaacaauuuauuaa

SEQ ID NO: 4059742 - RNA, 19 nt, Staphylococcus aureus subsp. aureus N315
cgauaagauagcuauauuu

SEQ ID NO: 4059743 - RNA, 13 nt, Staphylococcus aureus subsp. aureus N315
cgauaauaacuag

SEQ ID NO: 4059744 - RNA, 14 nt, Staphylococcus aureus subsp. aureus N315
cgauaauagauacc

SEQ ID NO: 4059745 - RNA, 17 nt, Staphylococcus aureus subsp. aureus N315
cgauaauucuaacuuga

SEQ ID NO: 4059746 - RNA, 15 nt, Staphylococcus aureus subsp. aureus N315
cgauaccuaaaauac

SEQ ID NO: 4059747 - RNA, 23 nt, Staphylococcus aureus subsp. aureus N315
cgauauagugcuuguuuauuaca

SEQ ID NO: 4059748 - RNA, 20 nt, Staphylococcus aureus subsp. aureus N315
cgauauuaugucgagguguu

SEQ ID NO: 4059749 - RNA, 19 nt, Staphylococcus aureus subsp. aureus N315
cgaucaaauuuaauaauac

SEQ ID NO: 4059750 - RNA, 15 nt, Staphylococcus aureus subsp. aureus N315
cgaucaugccuucau

SEQ ID NO: 4059751 - RNA, 19 nt, Staphylococcus aureus subsp. aureus N315
cgaucuuuuuuauuuaauu

SEQ ID NO: 4059752 - RNA, 21 nt, Staphylococcus aureus subsp. aureus N315
cgaugaugauuuauaaaaacu

SEQ ID NO: 4059753 - RNA, 15 nt, Staphylococcus aureus subsp. aureus N315
cgaugcuaaaaauau

SEQ ID NO: 4059754 - RNA, 19 nt, Staphylococcus aureus subsp. aureus N315
cgauuaagaaugcaccaac

SEQ ID NO: 4059755 - RNA, 14 nt, Staphylococcus aureus subsp. aureus N315
cgauuaauuuucuu

SEQ ID NO: 4059756 - RNA, 19 nt, Staphylococcus aureus subsp. aureus N315
cgauuauauacuaguucaa

SEQ ID NO: 4059757 - RNA, 15 nt, Staphylococcus aureus subsp. aureus N315
cgauuaucugacauu

SEQ ID NO: 4059758 - RNA, 13 nt, Staphylococcus aureus subsp. aureus N315
cgauucaaccuua

SEQ ID NO: 4059759 - RNA, 15 nt, Staphylococcus aureus subsp. aureus N315
cgauuuguucaauga

SEQ ID NO: 4059760 - RNA, 13 nt, Staphylococcus aureus subsp. aureus N315
cgauuuucaagua

SEQ ID NO: 4059761 - RNA, 18 nt, Staphylococcus aureus subsp. aureus N315
cgcaauacgaauaucugu

SEQ ID NO: 4059762 - RNA, 19 nt, Staphylococcus aureus subsp. aureus N315
cgcaaugauaucuuuucca

SEQ ID NO: 4059763 - RNA, 15 nt, Staphylococcus aureus subsp. aureus N315
cgcaaugauuauaaa

SEQ ID NO: 4059764 - RNA, 13 nt, Staphylococcus aureus subsp. aureus N315
cgcaauuaaaagu

SEQ ID NO: 4059765 - RNA, 14 nt, Staphylococcus aureus subsp. aureus N315
cgcaauuuaauauu

SEQ ID NO: 4059766 - RNA, 16 nt, Staphylococcus aureus subsp. aureus N315
cgcaauuuuuaacaaa

SEQ ID NO: 4059767 - RNA, 11 nt, Staphylococcus aureus subsp. aureus N315
cgcauacuuuu

SEQ ID NO: 4059768 - RNA, 15 nt, Staphylococcus aureus subsp. aureus N315
cgcaucaaaaaugag

SEQ ID NO: 4059769 - RNA, 13 nt, Staphylococcus aureus subsp. aureus N315
cgcaucauguaua

SEQ ID NO: 4059770 - RNA, 18 nt, Staphylococcus aureus subsp. aureus N315
cgcaucuccaaaggccau

SEQ ID NO: 4059771 - RNA, 20 nt, Staphylococcus aureus subsp. aureus N315
cgcaucuuuugguuuaucug

SEQ ID NO: 4059772 - RNA, 12 nt, Staphylococcus aureus subsp. aureus N315
cgcauuguugua

SEQ ID NO: 4059773 - RNA, 23 nt, Staphylococcus aureus subsp. aureus N315
cgcauuuuuuauuccaaauuuga

SEQ ID NO: 4059774 - RNA, 16 nt, Staphylococcus aureus subsp. aureus N315
cgccaacuaauguuaa

SEQ ID NO: 4059775 - RNA, 22 nt, Staphylococcus aureus subsp. aureus N315
cgccaauacagaacuuuaauaa

SEQ ID NO: 4059776 - RNA, 12 nt, Staphylococcus aureus subsp. aureus N315
cgccauaaucau

SEQ ID NO: 4059777 - RNA, 18 nt, Staphylococcus aureus subsp. aureus N315
cgccauaaucuucauuaa

SEQ ID NO: 4059778 - RNA, 15 nt, Staphylococcus aureus subsp. aureus N315
cgcgauaaauaauaa

SEQ ID NO: 4059779 - RNA, 22 nt, Staphylococcus aureus subsp. aureus N315
cgcgcuuauugaaaagauaaac

SEQ ID NO: 4059780 - RNA, 20 nt, Staphylococcus aureus subsp. aureus N315
cgcuaauguaccaaucaaug

SEQ ID NO: 4059781 - RNA, 19 nt, Staphylococcus aureus subsp. aureus N315
cgcuaauuuuacucuguau

SEQ ID NO: 4059782 - RNA, 16 nt, Staphylococcus aureus subsp. aureus N315
cgcucuggauuuuucu

SEQ ID NO: 4059783 - RNA, 22 nt, Staphylococcus aureus subsp. aureus N315
cgcuguaauaccuuuacuuuca

SEQ ID NO: 4059784 - RNA, 19 nt, Staphylococcus aureus subsp. aureus N315
cgcuguggcucgaaaauaa

SEQ ID NO: 4059785 - RNA, 13 nt, Staphylococcus aureus subsp. aureus N315
cgcuguuuuaaau

SEQ ID NO: 4059786 - RNA, 23 nt, Staphylococcus aureus subsp. aureus N315
cgcuuaacccuaaagcuaaugca

SEQ ID NO: 4059787 - RNA, 22 nt, Staphylococcus aureus subsp. aureus N315
cgcuuagauaaauuaauaugaa

SEQ ID NO: 4059788 - RNA, 14 nt, Staphylococcus aureus subsp. aureus N315
cgcuuauuuuacua

SEQ ID NO: 4059789 - RNA, 20 nt, Staphylococcus aureus subsp. aureus N315
cgcuucauagucacuuuuaa

SEQ ID NO: 4059790 - RNA, 21 nt, Staphylococcus aureus subsp. aureus N315
cgcuucauugaugaugugcua

SEQ ID NO: 4059791 - RNA, 17 nt, Staphylococcus aureus subsp. aureus N315
cgcuuuauuacuuuaau

SEQ ID NO: 4059792 - RNA, 17 nt, Staphylococcus aureus subsp. aureus N315
cgcuuuauucuucccaa

SEQ ID NO: 4059793 - RNA, 14 nt, Staphylococcus aureus subsp. aureus N315
cgcuuugcccgucu

SEQ ID NO: 4059794 - RNA, 12 nt, Staphylococcus aureus subsp. aureus N315
cgcuuuuuaaaa

SEQ ID NO: 4059795 - RNA, 16 nt, Staphylococcus aureus subsp. aureus N315
cgcuuuuuaauuugua

SEQ ID NO: 4059796 - RNA, 13 nt, Staphylococcus aureus subsp. aureus N315
cgcuuuuucauag

SEQ ID NO: 4059797 - RNA, 23 nt, Staphylococcus aureus subsp. aureus N315
cgcuuuuuuuauuuuucuuuuug

SEQ ID NO: 4059798 - RNA, 21 nt, Staphylococcus aureus subsp. aureus N315
cgcuuuuuuuuauaaguuaaa

SEQ ID NO: 4059799 - RNA, 13 nt, Staphylococcus aureus subsp. aureus N315
cggaaauacaaug

SEQ ID NO: 4059800 - RNA, 15 nt, Staphylococcus aureus subsp. aureus N315
cggaagauaggauuu

SEQ ID NO: 4059801 - RNA, 12 nt, Staphylococcus aureus subsp. aureus N315
cggaauaaaaua

SEQ ID NO: 4059802 - RNA, 15 nt, Staphylococcus aureus subsp. aureus N315
cggaauaacuuuuua

SEQ ID NO: 4059803 - RNA, 21 nt, Staphylococcus aureus subsp. aureus N315
cggaauugguuuuuagugaaa

SEQ ID NO: 4059804 - RNA, 22 nt, Staphylococcus aureus subsp. aureus N315
cggaauugguuuuuagugaaaa

SEQ ID NO: 4059805 - RNA, 19 nt, Staphylococcus aureus subsp. aureus N315
cggacaaguugcacauuau

SEQ ID NO: 4059806 - RNA, 10 nt, Staphylococcus aureus subsp. aureus N315
cggacugaug

SEQ ID NO: 4059807 - RNA, 13 nt, Staphylococcus aureus subsp. aureus N315
cggaugagaaaug

SEQ ID NO: 4059808 - RNA, 21 nt, Staphylococcus aureus subsp. aureus N315
cggauguuucuucaauuuaau

SEQ ID NO: 4059809 - RNA, 17 nt, Staphylococcus aureus subsp. aureus N315
cggauuaucuaacucau

SEQ ID NO: 4059810 - RNA, 16 nt, Staphylococcus aureus subsp. aureus N315
cggcacauucauaccg

SEQ ID NO: 4059811 - RNA, 22 nt, Staphylococcus aureus subsp. aureus N315
cggcacauucauaccgaagaaa

SEQ ID NO: 4059812 - RNA, 13 nt, Staphylococcus aureus subsp. aureus N315
cggcccauaauag

SEQ ID NO: 4059813 - RNA, 13 nt, Staphylococcus aureus subsp. aureus N315
cggcuuuggauuu

SEQ ID NO: 4059814 - RNA, 13 nt, Staphylococcus aureus subsp. aureus N315
cggcuuuguaaaa

SEQ ID NO: 4059815 - RNA, 10 nt, Staphylococcus aureus subsp. aureus N315
cgggaaggaa

SEQ ID NO: 4059816 - RNA, 16 nt, Staphylococcus aureus subsp. aureus N315
cgggcccccaacacaa

SEQ ID NO: 4059817 - RNA, 17 nt, Staphylococcus aureus subsp. aureus N315
cggggaauuuuuaugca

SEQ ID NO: 4059818 - RNA, 21 nt, Staphylococcus aureus subsp. aureus N315
cggggccccaacaaaaagaau

SEQ ID NO: 4059819 - RNA, 19 nt, Staphylococcus aureus subsp. aureus N315
cggggccccaacaaagaag

SEQ ID NO: 4059820 - RNA, 22 nt, Staphylococcus aureus subsp. aureus N315
cgguacagauaggaaacuuaaa

SEQ ID NO: 4059821 - RNA, 19 nt, Staphylococcus aureus subsp. aureus N315
cgguauuuuaaauuuauaa

SEQ ID NO: 4059822 - RNA, 14 nt, Staphylococcus aureus subsp. aureus N315
cgguauuuucaaaa

SEQ ID NO: 4059823 - RNA, 22 nt, Staphylococcus aureus subsp. aureus N315
cggugaccuuauauuuuauuua

SEQ ID NO: 4059824 - RNA, 18 nt, Staphylococcus aureus subsp. aureus N315
cggugucaauauuguagg

SEQ ID NO: 4059825 - RNA, 15 nt, Staphylococcus aureus subsp. aureus N315
cgguuugaaaaugac

SEQ ID NO: 4059826 - RNA, 20 nt, Staphylococcus aureus subsp. aureus N315
cguaaaaucagucauucaca

SEQ ID NO: 4059827 - RNA, 12 nt, Staphylococcus aureus subsp. aureus N315
cguaaaaucaug

SEQ ID NO: 4059828 - RNA, 18 nt, Staphylococcus aureus subsp. aureus N315
cguaaacauaaugacauc

SEQ ID NO: 4059829 - RNA, 14 nt, Staphylococcus aureus subsp. aureus N315
cguaacuauaugaa

SEQ ID NO: 4059830 - RNA, 15 nt, Staphylococcus aureus subsp. aureus N315
cguaacuauaugaaa

SEQ ID NO: 4059831 - RNA, 20 nt, Staphylococcus aureus subsp. aureus N315
cguaagcaguuaauaagaaa

SEQ ID NO: 4059832 - RNA, 15 nt, Staphylococcus aureus subsp. aureus N315
cguaaugauauuacc

SEQ ID NO: 4059833 - RNA, 21 nt, Staphylococcus aureus subsp. aureus N315
cguaauguguuaauacuucau

SEQ ID NO: 4059834 - RNA, 20 nt, Staphylococcus aureus subsp. aureus N315
cguacauuuaugauuguuua

SEQ ID NO: 4059835 - RNA, 13 nt, Staphylococcus aureus subsp. aureus N315
cguauauguaauc

SEQ ID NO: 4059836 - RNA, 16 nt, Staphylococcus aureus subsp. aureus N315
cguaucauuuaaaaua

SEQ ID NO: 4059837 - RNA, 14 nt, Staphylococcus aureus subsp. aureus N315
cguaucuguuuaug

SEQ ID NO: 4059838 - RNA, 19 nt, Staphylococcus aureus subsp. aureus N315
cguaugcccucauaaauca

SEQ ID NO: 4059839 - RNA, 12 nt, Staphylococcus aureus subsp. aureus N315
cguauguuucuu

SEQ ID NO: 4059840 - RNA, 18 nt, Staphylococcus aureus subsp. aureus N315
cguauuagccaauaaaau

SEQ ID NO: 4059841 - RNA, 22 nt, Staphylococcus aureus subsp. aureus N315
cguauucuucaauaacaccuuu

SEQ ID NO: 4059842 - RNA, 17 nt, Staphylococcus aureus subsp. aureus N315
cgucacauauaaauauu

SEQ ID NO: 4059843 - RNA, 14 nt, Staphylococcus aureus subsp. aureus N315
cgucacucacuuca

SEQ ID NO: 4059844 - RNA, 13 nt, Staphylococcus aureus subsp. aureus N315
cgucgugauggcu

SEQ ID NO: 4059845 - RNA, 14 nt, Staphylococcus aureus subsp. aureus N315
cgucuacuauuuuu

SEQ ID NO: 4059846 - RNA, 17 nt, Staphylococcus aureus subsp. aureus N315
cgucuuaauucuucugu

SEQ ID NO: 4059847 - RNA, 23 nt, Staphylococcus aureus subsp. aureus N315
cgucuuaucuaaaucuucaucau

SEQ ID NO: 4059848 - RNA, 17 nt, Staphylococcus aureus subsp. aureus N315
cgucuuguaaacuucuu

SEQ ID NO: 4059849 - RNA, 12 nt, Staphylococcus aureus subsp. aureus N315
cgugaagaaaaa

SEQ ID NO: 4059850 - RNA, 15 nt, Staphylococcus aureus subsp. aureus N315
cgugaagaaaaaaug

SEQ ID NO: 4059851 - RNA, 22 nt, Staphylococcus aureus subsp. aureus N315
cgugaauucgaugacuuuuuaa

SEQ ID NO: 4059852 - RNA, 16 nt, Staphylococcus aureus subsp. aureus N315
cgugaggcugggacau

SEQ ID NO: 4059853 - RNA, 18 nt, Staphylococcus aureus subsp. aureus N315
cgugauggcuacuuuuuc

SEQ ID NO: 4059854 - RNA, 13 nt, Staphylococcus aureus subsp. aureus N315
cgugauuuuucau

SEQ ID NO: 4059855 - RNA, 18 nt, Staphylococcus aureus subsp. aureus N315
cgugcaaauaaaaaaguu

SEQ ID NO: 4059856 - RNA, 16 nt, Staphylococcus aureus subsp. aureus N315
cgugcauuuagaugau

SEQ ID NO: 4059857 - RNA, 14 nt, Staphylococcus aureus subsp. aureus N315
cgugguaugauuuu

SEQ ID NO: 4059858 - RNA, 17 nt, Staphylococcus aureus subsp. aureus N315
cgugguaugauuuuuga

SEQ ID NO: 4059859 - RNA, 21 nt, Staphylococcus aureus subsp. aureus N315
cgugguucaaaaaucauacca

SEQ ID NO: 4059860 - RNA, 14 nt, Staphylococcus aureus subsp. aureus N315
cguguaaaaaugau

SEQ ID NO: 4059861 - RNA, 15 nt, Staphylococcus aureus subsp. aureus N315
cgugucaaaugccgc

SEQ ID NO: 4059862 - RNA, 19 nt, Staphylococcus aureus subsp. aureus N315
cgugucaaaugccgcuucu

SEQ ID NO: 4059863 - RNA, 17 nt, Staphylococcus aureus subsp. aureus N315
cguguguuuucuuuuca

SEQ ID NO: 4059864 - RNA, 20 nt, Staphylococcus aureus subsp. aureus N315
cguguuugaauggcaaauau

SEQ ID NO: 4059865 - RNA, 21 nt, Staphylococcus aureus subsp. aureus N315
cguguuugaauguuuuugaua

SEQ ID NO: 4059866 - RNA, 11 nt, Staphylococcus aureus subsp. aureus N315
cguuaaaaaga

SEQ ID NO: 4059867 - RNA, 15 nt, Staphylococcus aureus subsp. aureus N315
cguuaauaucaugcu

SEQ ID NO: 4059868 - RNA, 22 nt, Staphylococcus aureus subsp. aureus N315
cguuacuuuggucaacuuuuuc

SEQ ID NO: 4059869 - RNA, 22 nt, Staphylococcus aureus subsp. aureus N315
cguuaguacggcugcuuuaacu

SEQ ID NO: 4059870 - RNA, 20 nt, Staphylococcus aureus subsp. aureus N315
cguuagugauaccuuuaauu

SEQ ID NO: 4059871 - RNA, 21 nt, Staphylococcus aureus subsp. aureus N315
cguuauaaguacaaauaauac

SEQ ID NO: 4059872 - RNA, 13 nt, Staphylococcus aureus subsp. aureus N315
cguuauucauuug

SEQ ID NO: 4059873 - RNA, 12 nt, Staphylococcus aureus subsp. aureus N315
cguuauuuuuug

SEQ ID NO: 4059874 - RNA, 22 nt, Staphylococcus aureus subsp. aureus N315
cguucauauaugauaaauauug

SEQ ID NO: 4059875 - RNA, 14 nt, Staphylococcus aureus subsp. aureus N315
cguucaucuaauuu

SEQ ID NO: 4059876 - RNA, 14 nt, Staphylococcus aureus subsp. aureus N315
cguucucuuaaaua

SEQ ID NO: 4059877 - RNA, 14 nt, Staphylococcus aureus subsp. aureus N315
cguucuguuuugcg

SEQ ID NO: 4059878 - RNA, 15 nt, Staphylococcus aureus subsp. aureus N315
cguugaccuuguucu

SEQ ID NO: 4059879 - RNA, 18 nt, Staphylococcus aureus subsp. aureus N315
cguugcaccuauuuuuug

SEQ ID NO: 4059880 - RNA, 20 nt, Staphylococcus aureus subsp. aureus N315
cguugugcagcaacugcauu

SEQ ID NO: 4059881 - RNA, 23 nt, Staphylococcus aureus subsp. aureus N315
cguuguucauaaucauaauaaga

SEQ ID NO: 4059882 - RNA, 21 nt, Staphylococcus aureus subsp. aureus N315
cguuucgucagauucaaacgu

SEQ ID NO: 4059883 - RNA, 19 nt, Staphylococcus aureus subsp. aureus N315
cguuucuuuguauaccuau

SEQ ID NO: 4059884 - RNA, 19 nt, Staphylococcus aureus subsp. aureus N315
cguuugaagaauguuucau

SEQ ID NO: 4059885 - RNA, 16 nt, Staphylococcus aureus subsp. aureus N315
cguuuguacuucacua

SEQ ID NO: 4059886 - RNA, 18 nt, Staphylococcus aureus subsp. aureus N315
cguuuguguguuuuaaaa

SEQ ID NO: 4059887 - RNA, 21 nt, Staphylococcus aureus subsp. aureus N315
cguuuuaauucaucaauaagg

SEQ ID NO: 4059888 - RNA, 23 nt, Staphylococcus aureus subsp. aureus N315
cguuuuaauucaucaauaaggca

SEQ ID NO: 4059889 - RNA, 15 nt, Staphylococcus aureus subsp. aureus N315
cguuuuagacauaaa

SEQ ID NO: 4059890 - RNA, 14 nt, Staphylococcus aureus subsp. aureus N315
cguuuuauauuuau

SEQ ID NO: 4059891 - RNA, 19 nt, Staphylococcus aureus subsp. aureus N315
cguuuugcuaaccaucaua

SEQ ID NO: 4059892 - RNA, 13 nt, Staphylococcus aureus subsp. aureus N315
cguuuuguagaua

SEQ ID NO: 4059893 - RNA, 14 nt, Staphylococcus aureus subsp. aureus N315
cguuuuuaaauaau

SEQ ID NO: 4059894 - RNA, 14 nt, Staphylococcus aureus subsp. aureus N315
cguuuuuauuacaa

SEQ ID NO: 4059895 - RNA, 17 nt, Staphylococcus aureus subsp. aureus N315
cguuuuuuuaaauacau

SEQ ID NO: 4059896 - RNA, 22 nt, Staphylococcus aureus subsp. aureus N315
cuaaaaaaacagcaguaagaua

SEQ ID NO: 4059897 - RNA, 12 nt, Staphylococcus aureus subsp. aureus N315
cuaaaaaacuaa

SEQ ID NO: 4059898 - RNA, 20 nt, Staphylococcus aureus subsp. aureus N315
cuaaaaacagcaguaagaca

SEQ ID NO: 4059899 - RNA, 20 nt, Staphylococcus aureus subsp. aureus N315
cuaaaaacggacaaguugca

SEQ ID NO: 4059900 - RNA, 14 nt, Staphylococcus aureus subsp. aureus N315
cuaaaaauaaaauc

SEQ ID NO: 4059901 - RNA, 14 nt, Staphylococcus aureus subsp. aureus N315
cuaaaaaugcuuua

SEQ ID NO: 4059902 - RNA, 23 nt, Staphylococcus aureus subsp. aureus N315
cuaaaaaugucguauauguaauc

SEQ ID NO: 4059903 - RNA, 22 nt, Staphylococcus aureus subsp. aureus N315
cuaaaaauucuggauuaaaccc

SEQ ID NO: 4059904 - RNA, 21 nt, Staphylococcus aureus subsp. aureus N315
cuaaaacaaauucauauuaac

SEQ ID NO: 4059905 - RNA, 21 nt, Staphylococcus aureus subsp. aureus N315
cuaaaacggaaauaaccacca

SEQ ID NO: 4059906 - RNA, 15 nt, Staphylococcus aureus subsp. aureus N315
cuaaaacuuuuucaa

SEQ ID NO: 4059907 - RNA, 18 nt, Staphylococcus aureus subsp. aureus N315
cuaaaaguuguaauuuaa

SEQ ID NO: 4059908 - RNA, 17 nt, Staphylococcus aureus subsp. aureus N315
cuaaaaguuucccaagc

SEQ ID NO: 4059909 - RNA, 13 nt, Staphylococcus aureus subsp. aureus N315
cuaaaauaaaauu

SEQ ID NO: 4059910 - RNA, 15 nt, Staphylococcus aureus subsp. aureus N315
cuaaaauaucaaaau

SEQ ID NO: 4059911 - RNA, 23 nt, Staphylococcus aureus subsp. aureus N315
cuaaaauaucaaaauauaaaauc

SEQ ID NO: 4059912 - RNA, 14 nt, Staphylococcus aureus subsp. aureus N315
cuaaaauuuccuca

SEQ ID NO: 4059913 - RNA, 21 nt, Staphylococcus aureus subsp. aureus N315
cuaaaauuugcucgugaaaag

SEQ ID NO: 4059914 - RNA, 18 nt, Staphylococcus aureus subsp. aureus N315
cuaaacaaugaugggaaa

SEQ ID NO: 4059915 - RNA, 19 nt, Staphylococcus aureus subsp. aureus N315
cuaaacauugcuuaacuuc

SEQ ID NO: 4059916 - RNA, 19 nt, Staphylococcus aureus subsp. aureus N315
cuaaacauuuuauacucug

SEQ ID NO: 4059917 - RNA, 18 nt, Staphylococcus aureus subsp. aureus N315
cuaaaccgauuaauauaa

SEQ ID NO: 4059918 - RNA, 18 nt, Staphylococcus aureus subsp. aureus N315
cuaaaccuuuuuuaaguu

SEQ ID NO: 4059919 - RNA, 15 nt, Staphylococcus aureus subsp. aureus N315
cuaaacgcuaaaauu

SEQ ID NO: 4059920 - RNA, 19 nt, Staphylococcus aureus subsp. aureus N315
cuaaacuauaauaauugga

SEQ ID NO: 4059921 - RNA, 17 nt, Staphylococcus aureus subsp. aureus N315
cuaaagcgauuuccauc

SEQ ID NO: 4059922 - RNA, 16 nt, Staphylococcus aureus subsp. aureus N315
cuaaagcuaauacacc

SEQ ID NO: 4059923 - RNA, 24 nt, Staphylococcus aureus subsp. aureus N315
cuaaagcuauaaaaaaucuuuuga

SEQ ID NO: 4059924 - RNA, 13 nt, Staphylococcus aureus subsp. aureus N315
cuaaagguaacuu

SEQ ID NO: 4059925 - RNA, 18 nt, Staphylococcus aureus subsp. aureus N315
cuaaagguauucuauuuu

SEQ ID NO: 4059926 - RNA, 14 nt, Staphylococcus aureus subsp. aureus N315
cuaaaguaaauaac

SEQ ID NO: 4059927 - RNA, 19 nt, Staphylococcus aureus subsp. aureus N315
cuaaaguguagccaaauaa

SEQ ID NO: 4059928 - RNA, 14 nt, Staphylococcus aureus subsp. aureus N315
cuaaauaaaauuaa

SEQ ID NO: 4059929 - RNA, 16 nt, Staphylococcus aureus subsp. aureus N315
cuaaauaauuucucaa

SEQ ID NO: 4059930 - RNA, 17 nt, Staphylococcus aureus subsp. aureus N315
cuaaauaauuucucaaa

SEQ ID NO: 4059931 - RNA, 23 nt, Staphylococcus aureus subsp. aureus N315
cuaaauaguuuuucauauucaca

SEQ ID NO: 4059932 - RNA, 13 nt, Staphylococcus aureus subsp. aureus N315
cuaaaucuuuaaa

SEQ ID NO: 4059933 - RNA, 21 nt, Staphylococcus aureus subsp. aureus N315
cuaaaugaauugcuuguucuu

SEQ ID NO: 4059934 - RNA, 10 nt, Staphylococcus aureus subsp. aureus N315
cuaaaugauu

SEQ ID NO: 4059935 - RNA, 16 nt, Staphylococcus aureus subsp. aureus N315
cuaaauuauuguuuau

SEQ ID NO: 4059936 - RNA, 22 nt, Staphylococcus aureus subsp. aureus N315
cuaaauuauuguuuaugccaug

SEQ ID NO: 4059937 - RNA, 23 nt, Staphylococcus aureus subsp. aureus N315
cuaaauuauuguuuaugccaugc

SEQ ID NO: 4059938 - RNA, 14 nt, Staphylococcus aureus subsp. aureus N315
cuaaauucuuuuug

SEQ ID NO: 4059939 - RNA, 11 nt, Staphylococcus aureus subsp. aureus N315
cuaaauugucg

SEQ ID NO: 4059940 - RNA, 24 nt, Staphylococcus aureus subsp. aureus N315
cuaacauuuucuuauuugauucua

SEQ ID NO: 4059941 - RNA, 18 nt, Staphylococcus aureus subsp. aureus N315
cuaaccaucauaaauguu

SEQ ID NO: 4059942 - RNA, 14 nt, Staphylococcus aureus subsp. aureus N315
cuaaccuauuaaaa

SEQ ID NO: 4059943 - RNA, 21 nt, Staphylococcus aureus subsp. aureus N315
cuaaccuauuaaaauaaacca

SEQ ID NO: 4059944 - RNA, 18 nt, Staphylococcus aureus subsp. aureus N315
cuaacgguauaucaucca

SEQ ID NO: 4059945 - RNA, 18 nt, Staphylococcus aureus subsp. aureus N315
cuaacucauaaucaacau

SEQ ID NO: 4059946 - RNA, 20 nt, Staphylococcus aureus subsp. aureus N315
cuaacucauaaucaacaugu

SEQ ID NO: 4059947 - RNA, 22 nt, Staphylococcus aureus subsp. aureus N315
cuaacucugaucuaaaaccaua

SEQ ID NO: 4059948 - RNA, 16 nt, Staphylococcus aureus subsp. aureus N315
cuaacuuguuuauuca

SEQ ID NO: 4059949 - RNA, 19 nt, Staphylococcus aureus subsp. aureus N315
cuaacuuuagggugcuuuu

SEQ ID NO: 4059950 - RNA, 22 nt, Staphylococcus aureus subsp. aureus N315
cuaacuuuaugggguguauuuu

SEQ ID NO: 4059951 - RNA, 17 nt, Staphylococcus aureus subsp. aureus N315
cuaagaguugaaauacu

SEQ ID NO: 4059952 - RNA, 17 nt, Staphylococcus aureus subsp. aureus N315
cuaagauacuuuuaaau

SEQ ID NO: 4059953 - RNA, 17 nt, Staphylococcus aureus subsp. aureus N315
cuaagcaucguaaaaaa

SEQ ID NO: 4059954 - RNA, 20 nt, Staphylococcus aureus subsp. aureus N315
cuaagcugauuaaaauguua

SEQ ID NO: 4059955 - RNA, 15 nt, Staphylococcus aureus subsp. aureus N315
cuaaggacuuuaugc

SEQ ID NO: 4059956 - RNA, 16 nt, Staphylococcus aureus subsp. aureus N315
cuaaggacuuuaugcc

SEQ ID NO: 4059957 - RNA, 14 nt, Staphylococcus aureus subsp. aureus N315
cuaaggcuaaugau

SEQ ID NO: 4059958 - RNA, 14 nt, Staphylococcus aureus subsp. aureus N315
cuaagguuguucua

SEQ ID NO: 4059959 - RNA, 22 nt, Staphylococcus aureus subsp. aureus N315
cuaagugaacuauuaaaaccaa

SEQ ID NO: 4059960 - RNA, 15 nt, Staphylococcus aureus subsp. aureus N315
cuaaguguuuuauag

SEQ ID NO: 4059961 - RNA, 15 nt, Staphylococcus aureus subsp. aureus N315
cuaaguuaugacuaa

SEQ ID NO: 4059962 - RNA, 22 nt, Staphylococcus aureus subsp. aureus N315
cuaauaaaaccgguacuuucau

SEQ ID NO: 4059963 - RNA, 14 nt, Staphylococcus aureus subsp. aureus N315
cuaauaacaaauag

SEQ ID NO: 4059964 - RNA, 14 nt, Staphylococcus aureus subsp. aureus N315
cuaauaauaaaaua

SEQ ID NO: 4059965 - RNA, 19 nt, Staphylococcus aureus subsp. aureus N315
cuaauaauuuguaauuccu

SEQ ID NO: 4059966 - RNA, 14 nt, Staphylococcus aureus subsp. aureus N315
cuaauacaaaacaa

SEQ ID NO: 4059967 - RNA, 15 nt, Staphylococcus aureus subsp. aureus N315
cuaauacaaaacaaa

SEQ ID NO: 4059968 - RNA, 16 nt, Staphylococcus aureus subsp. aureus N315
cuaauacaaaacaaau

SEQ ID NO: 4059969 - RNA, 23 nt, Staphylococcus aureus subsp. aureus N315
cuaauacacuugauaaaacuaau

SEQ ID NO: 4059970 - RNA, 22 nt, Staphylococcus aureus subsp. aureus N315
cuaauacauacggcaaauucaa

SEQ ID NO: 4059971 - RNA, 15 nt, Staphylococcus aureus subsp. aureus N315
cuaauacauacugau

SEQ ID NO: 4059972 - RNA, 22 nt, Staphylococcus aureus subsp. aureus N315
cuaauacuuucacuuuuuauau

SEQ ID NO: 4059973 - RNA, 15 nt, Staphylococcus aureus subsp. aureus N315
cuaauagcauuugua

SEQ ID NO: 4059974 - RNA, 20 nt, Staphylococcus aureus subsp. aureus N315
cuaauagcauuuguaaacag

SEQ ID NO: 4059975 - RNA, 13 nt, Staphylococcus aureus subsp. aureus N315
cuaauaugucuag

SEQ ID NO: 4059976 - RNA, 21 nt, Staphylococcus aureus subsp. aureus N315
cuaauaugucuagacuuauuu

SEQ ID NO: 4059977 - RNA, 18 nt, Staphylococcus aureus subsp. aureus N315
cuaauauuagauaucuua

SEQ ID NO: 4059978 - RNA, 15 nt, Staphylococcus aureus subsp. aureus N315
cuaauauuucuuaga

SEQ ID NO: 4059979 - RNA, 14 nt, Staphylococcus aureus subsp. aureus N315
cuaaucaauacuaa

SEQ ID NO: 4059980 - RNA, 19 nt, Staphylococcus aureus subsp. aureus N315
cuaauccucacuaacucaa

SEQ ID NO: 4059981 - RNA, 16 nt, Staphylococcus aureus subsp. aureus N315
cuaaucgacuuuuaca

SEQ ID NO: 4059982 - RNA, 17 nt, Staphylococcus aureus subsp. aureus N315
cuaaucguguauuauug

SEQ ID NO: 4059983 - RNA, 21 nt, Staphylococcus aureus subsp. aureus N315
cuaaucguuaauaaaccuaca

SEQ ID NO: 4059984 - RNA, 13 nt, Staphylococcus aureus subsp. aureus N315
cuaaucuaaauuc

SEQ ID NO: 4059985 - RNA, 11 nt, Staphylococcus aureus subsp. aureus N315
cuaaucuauuu

SEQ ID NO: 4059986 - RNA, 16 nt, Staphylococcus aureus subsp. aureus N315
cuaaucuuaauugucu

SEQ ID NO: 4059987 - RNA, 18 nt, Staphylococcus aureus subsp. aureus N315
cuaaucuugguucagcuu

SEQ ID NO: 4059988 - RNA, 22 nt, Staphylococcus aureus subsp. aureus N315
cuaaugauuaaaaaucaaagag

SEQ ID NO: 4059989 - RNA, 13 nt, Staphylococcus aureus subsp. aureus N315
cuaaugauuuauu

SEQ ID NO: 4059990 - RNA, 19 nt, Staphylococcus aureus subsp. aureus N315
cuaaugcauuauuauaaua

SEQ ID NO: 4059991 - RNA, 15 nt, Staphylococcus aureus subsp. aureus N315
cuaaugcuaauuuaa

SEQ ID NO: 4059992 - RNA, 17 nt, Staphylococcus aureus subsp. aureus N315
cuaaugcuaauuuaacu

SEQ ID NO: 4059993 - RNA, 18 nt, Staphylococcus aureus subsp. aureus N315
cuaaugucgcacuauaaa

SEQ ID NO: 4059994 - RNA, 20 nt, Staphylococcus aureus subsp. aureus N315
cuaauguguacuuaaaaaua

SEQ ID NO: 4059995 - RNA, 21 nt, Staphylococcus aureus subsp. aureus N315
cuaauguguacuuaaaaauag

SEQ ID NO: 4059996 - RNA, 19 nt, Staphylococcus aureus subsp. aureus N315
cuaauguguggauuuaauu

SEQ ID NO: 4059997 - RNA, 22 nt, Staphylococcus aureus subsp. aureus N315
cuaauuagguauaguguuugac

SEQ ID NO: 4059998 - RNA, 15 nt, Staphylococcus aureus subsp. aureus N315
cuaauucaagaacag

SEQ ID NO: 4059999 - RNA, 16 nt, Staphylococcus aureus subsp. aureus N315
cuaauucaaguguauu

SEQ ID NO: 4060000 - RNA, 20 nt, Staphylococcus aureus subsp. aureus N315
cuaauucuguuucaaagcug

SEQ ID NO: 4060001 - RNA, 23 nt, Staphylococcus aureus subsp. aureus N315
cuaauugaaggccauuuuuauuu

SEQ ID NO: 4060002 - RNA, 20 nt, Staphylococcus aureus subsp. aureus N315
cuaauuuaguaucuauacaa

SEQ ID NO: 4060003 - RNA, 12 nt, Staphylococcus aureus subsp. aureus N315
cuaauuucacaa

SEQ ID NO: 4060004 - RNA, 17 nt, Staphylococcus aureus subsp. aureus N315
cuaauuugcaaaaucaa

SEQ ID NO: 4060005 - RNA, 14 nt, Staphylococcus aureus subsp. aureus N315
uuucuuucuuuucu

SEQ ID NO: 4060006 - RNA, 16 nt, Staphylococcus aureus subsp. aureus N315
uuucuuuucaaaauaa

SEQ ID NO: 4060007 - RNA, 20 nt, Staphylococcus aureus subsp. aureus N315
uuucuuuuguuuuuauauua

SEQ ID NO: 4060008 - RNA, 14 nt, Staphylococcus aureus subsp. aureus N315
uuucuuuuuuaauu

SEQ ID NO: 4060009 - RNA, 20 nt, Staphylococcus aureus subsp. aureus N315
uuucuuuuuugcuguauaua

SEQ ID NO: 4060010 - RNA, 19 nt, Staphylococcus aureus subsp. aureus N315
uuugaaaaaguguuuaaau

SEQ ID NO: 4060011 - RNA, 23 nt, Staphylococcus aureus subsp. aureus N315
uuugaaaaaguguuuaaaugcua

SEQ ID NO: 4060012 - RNA, 23 nt, Staphylococcus aureus subsp. aureus N315
uuugaaagacauuuaaauauaac

SEQ ID NO: 4060013 - RNA, 19 nt, Staphylococcus aureus subsp. aureus N315
uuugaaauuucgacaucua

SEQ ID NO: 4060014 - RNA, 15 nt, Staphylococcus aureus subsp. aureus N315
uuugaacauauuaua

SEQ ID NO: 4060015 - RNA, 17 nt, Staphylococcus aureus subsp. aureus N315
uuugaagaauguuucau

SEQ ID NO: 4060016 - RNA, 13 nt, Staphylococcus aureus subsp. aureus N315
uuugaauaaaaaa

SEQ ID NO: 4060017 - RNA, 16 nt, Staphylococcus aureus subsp. aureus N315
uuugaauacuuuauuu

SEQ ID NO: 4060018 - RNA, 21 nt, Staphylococcus aureus subsp. aureus N315
uuugaaugcaaaucaaauaca

SEQ ID NO: 4060019 - RNA, 15 nt, Staphylococcus aureus subsp. aureus N315
uuugaauugacuuac

SEQ ID NO: 4060020 - RNA, 17 nt, Staphylococcus aureus subsp. aureus N315
uuugaauugacuuacau

SEQ ID NO: 4060021 - RNA, 12 nt, Staphylococcus aureus subsp. aureus N315
uuugaauuggga

SEQ ID NO: 4060022 - RNA, 17 nt, Staphylococcus aureus subsp. aureus N315
uuugacaaauccuaauu

SEQ ID NO: 4060023 - RNA, 19 nt, Staphylococcus aureus subsp. aureus N315
uuugacacauuauugaaau

SEQ ID NO: 4060024 - RNA, 18 nt, Staphylococcus aureus subsp. aureus N315
uuugacauaaaaaauaac

SEQ ID NO: 4060025 - RNA, 19 nt, Staphylococcus aureus subsp. aureus N315
uuugacauauuuuuuaaau

SEQ ID NO: 4060026 - RNA, 16 nt, Staphylococcus aureus subsp. aureus N315
uuugacaucuauuucu

SEQ ID NO: 4060027 - RNA, 18 nt, Staphylococcus aureus subsp. aureus N315
uuugacuucaguacaauc

SEQ ID NO: 4060028 - RNA, 18 nt, Staphylococcus aureus subsp. aureus N315
uuugagauauauuaaugu

SEQ ID NO: 4060029 - RNA, 21 nt, Staphylococcus aureus subsp. aureus N315
uuugagguguggaguaaagau

SEQ ID NO: 4060030 - RNA, 15 nt, Staphylococcus aureus subsp. aureus N315
uuugaguaaauuaau

SEQ ID NO: 4060031 - RNA, 23 nt, Staphylococcus aureus subsp. aureus N315
uuugaguauuugccuuuuuuauu

SEQ ID NO: 4060032 - RNA, 21 nt, Staphylococcus aureus subsp. aureus N315
uuugauaacaauuuuaaaucu

SEQ ID NO: 4060033 - RNA, 14 nt, Staphylococcus aureus subsp. aureus N315
uuugauaaugauag

SEQ ID NO: 4060034 - RNA, 22 nt, Staphylococcus aureus subsp. aureus N315
uuugauauaaaaagugaaagua

SEQ ID NO: 4060035 - RNA, 23 nt, Staphylococcus aureus subsp. aureus N315
uuugauauaaaaagugaaaguau

SEQ ID NO: 4060036 - RNA, 17 nt, Staphylococcus aureus subsp. aureus N315
uuugaucaacuauauau

SEQ ID NO: 4060037 - RNA, 20 nt, Staphylococcus aureus subsp. aureus N315
uuugauccaaaguacucaag

SEQ ID NO: 4060038 - RNA, 17 nt, Staphylococcus aureus subsp. aureus N315
uuugauuaaaaucugcu

SEQ ID NO: 4060039 - RNA, 16 nt, Staphylococcus aureus subsp. aureus N315
uuugauucuaaauaau

SEQ ID NO: 4060040 - RNA, 13 nt, Staphylococcus aureus subsp. aureus N315
uuugauuguuuaa

SEQ ID NO: 4060041 - RNA, 20 nt, Staphylococcus aureus subsp. aureus N315
uuugauuuggguaauguuuu

SEQ ID NO: 4060042 - RNA, 20 nt, Staphylococcus aureus subsp. aureus N315
uuugcaacaauauaauauac

SEQ ID NO: 4060043 - RNA, 19 nt, Staphylococcus aureus subsp. aureus N315
uuugcaacauauuuucaca

SEQ ID NO: 4060044 - RNA, 20 nt, Staphylococcus aureus subsp. aureus N315
uuugcaauugcaaugaauaa

SEQ ID NO: 4060045 - RNA, 21 nt, Staphylococcus aureus subsp. aureus N315
uuugcaauugcaaugaauaac

SEQ ID NO: 4060046 - RNA, 18 nt, Staphylococcus aureus subsp. aureus N315
uuugcaccuauaccucgu

SEQ ID NO: 4060047 - RNA, 22 nt, Staphylococcus aureus subsp. aureus N315
uuugcacgggugguuuuuaauu

SEQ ID NO: 4060048 - RNA, 17 nt, Staphylococcus aureus subsp. aureus N315
uuugcagauugauauaa

SEQ ID NO: 4060049 - RNA, 14 nt, Staphylococcus aureus subsp. aureus N315
uuugcauacauauc

SEQ ID NO: 4060050 - RNA, 16 nt, Staphylococcus aureus subsp. aureus N315
uuugcauacauaucuu

SEQ ID NO: 4060051 - RNA, 23 nt, Staphylococcus aureus subsp. aureus N315
uuugcauaccuauaaacauaucu

SEQ ID NO: 4060052 - RNA, 15 nt, Staphylococcus aureus subsp. aureus N315
uuugcaucacagaua

SEQ ID NO: 4060053 - RNA, 20 nt, Staphylococcus aureus subsp. aureus N315
uuugccccucauucacaaug

SEQ ID NO: 4060054 - RNA, 14 nt, Staphylococcus aureus subsp. aureus N315
uuugcgguguggcg

SEQ ID NO: 4060055 - RNA, 18 nt, Staphylococcus aureus subsp. aureus N315
uuugcgguuuuuuugauu

SEQ ID NO: 4060056 - RNA, 20 nt, Staphylococcus aureus subsp. aureus N315
uuugcucaaaaaugcuuaua

SEQ ID NO: 4060057 - RNA, 17 nt, Staphylococcus aureus subsp. aureus N315
uuugcuuaaaccuuaau

SEQ ID NO: 4060058 - RNA, 18 nt, Staphylococcus aureus subsp. aureus N315
uuugcuuuauuuucuugu

SEQ ID NO: 4060059 - RNA, 16 nt, Staphylococcus aureus subsp. aureus N315
uuugcuuuuuguaaug

SEQ ID NO: 4060060 - RNA, 14 nt, Staphylococcus aureus subsp. aureus N315
uuuggaaauaucuu

SEQ ID NO: 4060061 - RNA, 24 nt, Staphylococcus aureus subsp. aureus N315
uuuggcacauaaaucaauguacua

SEQ ID NO: 4060062 - RNA, 20 nt, Staphylococcus aureus subsp. aureus N315
uuugguaagcuaauuucuaa

SEQ ID NO: 4060063 - RNA, 18 nt, Staphylococcus aureus subsp. aureus N315
uuuggucaaguuuugguc

SEQ ID NO: 4060064 - RNA, 15 nt, Staphylococcus aureus subsp. aureus N315
uuugguggcuugcau

SEQ ID NO: 4060065 - RNA, 15 nt, Staphylococcus aureus subsp. aureus N315
uuugguuucuuaaca

SEQ ID NO: 4060066 - RNA, 15 nt, Staphylococcus aureus subsp. aureus N315
uuugguuugcuuuaa

SEQ ID NO: 4060067 - RNA, 22 nt, Staphylococcus aureus subsp. aureus N315
uuuguaaagcuuuaguuaaaua

SEQ ID NO: 4060068 - RNA, 20 nt, Staphylococcus aureus subsp. aureus N315
uuuguaaauauuuuuuaaaa

SEQ ID NO: 4060069 - RNA, 14 nt, Staphylococcus aureus subsp. aureus N315
uuuguaaauuuuua

SEQ ID NO: 4060070 - RNA, 15 nt, Staphylococcus aureus subsp. aureus N315
uuuguaaccuaaaaa

SEQ ID NO: 4060071 - RNA, 18 nt, Staphylococcus aureus subsp. aureus N315
uuuguaaccuaaaaacaa

SEQ ID NO: 4060072 - RNA, 19 nt, Staphylococcus aureus subsp. aureus N315
uuuguaauacaagcaauac

SEQ ID NO: 4060073 - RNA, 13 nt, Staphylococcus aureus subsp. aureus N315
uuuguaauacauc

SEQ ID NO: 4060074 - RNA, 20 nt, Staphylococcus aureus subsp. aureus N315
uuuguaaucccauuuuaaag

SEQ ID NO: 4060075 - RNA, 23 nt, Staphylococcus aureus subsp. aureus N315
uuuguaaucccauuuuaaaguca

SEQ ID NO: 4060076 - RNA, 22 nt, Staphylococcus aureus subsp. aureus N315
uuuguaauugaugauuacucca

SEQ ID NO: 4060077 - RNA, 17 nt, Staphylococcus aureus subsp. aureus N315
uuuguauaccuauuccu

SEQ ID NO: 4060078 - RNA, 20 nt, Staphylococcus aureus subsp. aureus N315
uuuguauauucuuuuuaacu

SEQ ID NO: 4060079 - RNA, 13 nt, Staphylococcus aureus subsp. aureus N315
uuuguaugaguuc

SEQ ID NO: 4060080 - RNA, 17 nt, Staphylococcus aureus subsp. aureus N315
uuuguaugauaaccauu

SEQ ID NO: 4060081 - RNA, 14 nt, Staphylococcus aureus subsp. aureus N315
uuuguauuagcauc

SEQ ID NO: 4060082 - RNA, 15 nt, Staphylococcus aureus subsp. aureus N315
uuuguauuguuugaa

SEQ ID NO: 4060083 - RNA, 14 nt, Staphylococcus aureus subsp. aureus N315
uuuguauuuaaaau

SEQ ID NO: 4060084 - RNA, 12 nt, Staphylococcus aureus subsp. aureus N315
uuuguauuuaug

SEQ ID NO: 4060085 - RNA, 22 nt, Staphylococcus aureus subsp. aureus N315
uuuguauuuauguuuucuaguu

SEQ ID NO: 4060086 - RNA, 17 nt, Staphylococcus aureus subsp. aureus N315
uuugucaguaacuuugu

SEQ ID NO: 4060087 - RNA, 19 nt, Staphylococcus aureus subsp. aureus N315
uuuguccagacaaccccca

SEQ ID NO: 4060088 - RNA, 13 nt, Staphylococcus aureus subsp. aureus N315
uuugucguuacua

SEQ ID NO: 4060089 - RNA, 15 nt, Staphylococcus aureus subsp. aureus N315
uuugucucucaacau

SEQ ID NO: 4060090 - RNA, 21 nt, Staphylococcus aureus subsp. aureus N315
uuugugaauuuauuuuguagu

SEQ ID NO: 4060091 - RNA, 11 nt, Staphylococcus aureus subsp. aureus N315
uuugugguaau

SEQ ID NO: 4060092 - RNA, 17 nt, Staphylococcus aureus subsp. aureus N315
uuuguucaaucacuaua

SEQ ID NO: 4060093 - RNA, 21 nt, Staphylococcus aureus subsp. aureus N315
uuuguugguguuuagucuuuu

SEQ ID NO: 4060094 - RNA, 12 nt, Staphylococcus aureus subsp. aureus N315
uuuguuuguaag

SEQ ID NO: 4060095 - RNA, 14 nt, Staphylococcus aureus subsp. aureus N315
uuuguuuuaaaaaa

SEQ ID NO: 4060096 - RNA, 12 nt, Staphylococcus aureus subsp. aureus N315
uuuguuuuaaau

SEQ ID NO: 4060097 - RNA, 13 nt, Staphylococcus aureus subsp. aureus N315
uuuguuuucagua

SEQ ID NO: 4060098 - RNA, 13 nt, Staphylococcus aureus subsp. aureus N315
uuuguuuuuauau

SEQ ID NO: 4060099 - RNA, 15 nt, Staphylococcus aureus subsp. aureus N315
uuuuaaaaaacauac

SEQ ID NO: 4060100 - RNA, 17 nt, Staphylococcus aureus subsp. aureus N315
uuuuaaaaaauuuaaau

SEQ ID NO: 4060101 - RNA, 16 nt, Staphylococcus aureus subsp. aureus N315
uuuuaaaaauacagcu

SEQ ID NO: 4060102 - RNA, 21 nt, Staphylococcus aureus subsp. aureus N315
uuuuaaaaucucauaauaauu

SEQ ID NO: 4060103 - RNA, 14 nt, Staphylococcus aureus subsp. aureus N315
uuuuaaaaugauag

SEQ ID NO: 4060104 - RNA, 22 nt, Staphylococcus aureus subsp. aureus N315
uuuuaaacaugaacaaucagau

SEQ ID NO: 4060105 - RNA, 23 nt, Staphylococcus aureus subsp. aureus N315
uuuuaaacucauccauugaucuu

SEQ ID NO: 4060106 - RNA, 16 nt, Staphylococcus aureus subsp. aureus N315
uuuuaaagguuaaaua

SEQ ID NO: 4060107 - RNA, 22 nt, Staphylococcus aureus subsp. aureus N315
uuuuaaagguuaaauauuuaau

SEQ ID NO: 4060108 - RNA, 16 nt, Staphylococcus aureus subsp. aureus N315
uuuuaaauaaaaugca

SEQ ID NO: 4060109 - RNA, 23 nt, Staphylococcus aureus subsp. aureus N315
uuuuaaauaaucgaaaauuucag

SEQ ID NO: 4060110 - RNA, 17 nt, Staphylococcus aureus subsp. aureus N315
uuuuaaaucauaaauua

SEQ ID NO: 4060111 - RNA, 18 nt, Staphylococcus aureus subsp. aureus N315
uuuuaaaucuacaauauu

SEQ ID NO: 4060112 - RNA, 17 nt, Staphylococcus aureus subsp. aureus N315
uuuuaaaucuauauaaa

SEQ ID NO: 4060113 - RNA, 13 nt, Staphylococcus aureus subsp. aureus N315
uuuuaaaucuuuu

SEQ ID NO: 4060114 - RNA, 17 nt, Staphylococcus aureus subsp. aureus N315
uuuuaaauguauuuuua

SEQ ID NO: 4060115 - RNA, 21 nt, Staphylococcus aureus subsp. aureus N315
uuuuaaauucuuauaaaauaa

SEQ ID NO: 4060116 - RNA, 17 nt, Staphylococcus aureus subsp. aureus N315
uuuuaaauuuaauuucg

SEQ ID NO: 4060117 - RNA, 21 nt, Staphylococcus aureus subsp. aureus N315
uuuuaacaaaauauacuaaau

SEQ ID NO: 4060118 - RNA, 21 nt, Staphylococcus aureus subsp. aureus N315
uuuuaacauagcuuaauaauu

SEQ ID NO: 4060119 - RNA, 21 nt, Staphylococcus aureus subsp. aureus N315
uuuuaacuauguuacuuauau

SEQ ID NO: 4060120 - RNA, 17 nt, Staphylococcus aureus subsp. aureus N315
uuuuaagaucaauauca

SEQ ID NO: 4060121 - RNA, 22 nt, Staphylococcus aureus subsp. aureus N315
uuuuaauaaugcagauucuuca

SEQ ID NO: 4060122 - RNA, 12 nt, Staphylococcus aureus subsp. aureus N315
uuuuaaugauuu

SEQ ID NO: 4060123 - RNA, 19 nt, Staphylococcus aureus subsp. aureus N315
uuuuaaugggcgauaaaag

SEQ ID NO: 4060124 - RNA, 20 nt, Staphylococcus aureus subsp. aureus N315
uuuuaauguauucuucuaau

SEQ ID NO: 4060125 - RNA, 11 nt, Staphylococcus aureus subsp. aureus N315
uuuuaauuauu

SEQ ID NO: 4060126 - RNA, 12 nt, Staphylococcus aureus subsp. aureus N315
uuuuaauuuuuu

SEQ ID NO: 4060127 - RNA, 22 nt, Staphylococcus aureus subsp. aureus N315
uuuuacaaacuucacaucaugu

SEQ ID NO: 4060128 - RNA, 21 nt, Staphylococcus aureus subsp. aureus N315
uuuuacaaagugauuuaaaaa

SEQ ID NO: 4060129 - RNA, 16 nt, Staphylococcus aureus subsp. aureus N315
uuuuacaaguuguuca

SEQ ID NO: 4060130 - RNA, 20 nt, Staphylococcus aureus subsp. aureus N315
uuuuacagucaacugcugcu

SEQ ID NO: 4060131 - RNA, 16 nt, Staphylococcus aureus subsp. aureus N315
uuuuacauuuucaaaa

SEQ ID NO: 4060132 - RNA, 20 nt, Staphylococcus aureus subsp. aureus N315
uuuuaccauugugaauaauu

SEQ ID NO: 4060133 - RNA, 21 nt, Staphylococcus aureus subsp. aureus N315
uuuuaccauugugaauaauuu

SEQ ID NO: 4060134 - RNA, 17 nt, Staphylococcus aureus subsp. aureus N315
uuuuaccuuuaauuaca

SEQ ID NO: 4060135 - RNA, 21 nt, Staphylococcus aureus subsp. aureus N315
uuuuacguaaucuaauacaua

SEQ ID NO: 4060136 - RNA, 21 nt, Staphylococcus aureus subsp. aureus N315
uuuuacuaggaauauaaaacu

SEQ ID NO: 4060137 - RNA, 20 nt, Staphylococcus aureus subsp. aureus N315
uuuuagacauaaaaaaagag

SEQ ID NO: 4060138 - RNA, 23 nt, Staphylococcus aureus subsp. aureus N315
uuuuagauuuaguuuuuuuaaag

SEQ ID NO: 4060139 - RNA, 15 nt, Staphylococcus aureus subsp. aureus N315
uuuuagcuuguuguu

SEQ ID NO: 4060140 - RNA, 20 nt, Staphylococcus aureus subsp. aureus N315
uuuuaggaugcauauauaua

SEQ ID NO: 4060141 - RNA, 15 nt, Staphylococcus aureus subsp. aureus N315
uuuuagguaauaauu

SEQ ID NO: 4060142 - RNA, 18 nt, Staphylococcus aureus subsp. aureus N315
uuuuagguaauaauucag

SEQ ID NO: 4060143 - RNA, 21 nt, Staphylococcus aureus subsp. aureus N315
uuuuagugacaaacauuuguu

SEQ ID NO: 4060144 - RNA, 15 nt, Staphylococcus aureus subsp. aureus N315
uuuuaguuaaaguga

SEQ ID NO: 4060145 - RNA, 23 nt, Staphylococcus aureus subsp. aureus N315
uuuuaguuagggaaauguagauu

SEQ ID NO: 4060146 - RNA, 14 nt, Staphylococcus aureus subsp. aureus N315
uuuuauaaaauaua

SEQ ID NO: 4060147 - RNA, 14 nt, Staphylococcus aureus subsp. aureus N315
uuuuauaaaucauu

SEQ ID NO: 4060148 - RNA, 16 nt, Staphylococcus aureus subsp. aureus N315
uuuuauaaguuaaaaa

SEQ ID NO: 4060149 - RNA, 14 nt, Staphylococcus aureus subsp. aureus N315
uuuuauaaucuuuu

SEQ ID NO: 4060150 - RNA, 13 nt, Staphylococcus aureus subsp. aureus N315
uuuuauaguaaua

SEQ ID NO: 4060151 - RNA, 23 nt, Staphylococcus aureus subsp. aureus N315
uuuuauaguaauagcuauauuuu

SEQ ID NO: 4060152 - RNA, 16 nt, Staphylococcus aureus subsp. aureus N315
uuuuauauccaucucc

SEQ ID NO: 4060153 - RNA, 22 nt, Staphylococcus aureus subsp. aureus N315
uuuuauauugcgaaaaauaauu

SEQ ID NO: 4060154 - RNA, 17 nt, Staphylococcus aureus subsp. aureus N315
uuuuauauuuaaacucu

SEQ ID NO: 4060155 - RNA, 21 nt, Staphylococcus aureus subsp. aureus N315
uuuuauauuuaaacucucuaa

SEQ ID NO: 4060156 - RNA, 18 nt, Staphylococcus aureus subsp. aureus N315
uuuuaucgaaauauuuau

SEQ ID NO: 4060157 - RNA, 16 nt, Staphylococcus aureus subsp. aureus N315
uuuuaucuaaacauuu

SEQ ID NO: 4060158 - RNA, 17 nt, Staphylococcus aureus subsp. aureus N315
uuuuaucugaaaauauc

SEQ ID NO: 4060159 - RNA, 14 nt, Staphylococcus aureus subsp. aureus N315
uuuuaucugaaucu

SEQ ID NO: 4060160 - RNA, 17 nt, Staphylococcus aureus subsp. aureus N315
uuuuaugaauugaguau

SEQ ID NO: 4060161 - RNA, 15 nt, Staphylococcus aureus subsp. aureus N315
uuuuaugauuugauu

SEQ ID NO: 4060162 - RNA, 23 nt, Staphylococcus aureus subsp. aureus N315
uuuuaugcacaaaaaaaucuccu

SEQ ID NO: 4060163 - RNA, 22 nt, Staphylococcus aureus subsp. aureus N315
uuuuauggcgguuugaaaauga

SEQ ID NO: 4060164 - RNA, 18 nt, Staphylococcus aureus subsp. aureus N315
uuuuaugguuuaauuuag

SEQ ID NO: 4060165 - RNA, 23 nt, Staphylococcus aureus subsp. aureus N315
uuuuaugucaauagcgguuuaaa

SEQ ID NO: 4060166 - RNA, 23 nt, Staphylococcus aureus subsp. aureus N315
uuuuauguccagccauuaaaccu

SEQ ID NO: 4060167 - RNA, 21 nt, Staphylococcus aureus subsp. aureus N315
uuuuauguucagaaauuuaau

SEQ ID NO: 4060168 - RNA, 18 nt, Staphylococcus aureus subsp. aureus N315
uuuuauguuuaaacauuu

SEQ ID NO: 4060169 - RNA, 13 nt, Staphylococcus aureus subsp. aureus N315
uuuuauuaauuaa

SEQ ID NO: 4060170 - RNA, 16 nt, Staphylococcus aureus subsp. aureus N315
uuuuauuaauuaaaaa

SEQ ID NO: 4060171 - RNA, 22 nt, Staphylococcus aureus subsp. aureus N315
uuuuauuauacacuuuuugaca

SEQ ID NO: 4060172 - RNA, 22 nt, Staphylococcus aureus subsp. aureus N315
uuuuauuaucagcccaaucagu

SEQ ID NO: 4060173 - RNA, 16 nt, Staphylococcus aureus subsp. aureus N315
uuuuauuaucuuuaau

SEQ ID NO: 4060174 - RNA, 23 nt, Staphylococcus aureus subsp. aureus N315
uuuuauucgauaauauaacugca

SEQ ID NO: 4060175 - RNA, 13 nt, Staphylococcus aureus subsp. aureus N315
uuuuauucuaaua

SEQ ID NO: 4060176 - RNA, 16 nt, Staphylococcus aureus subsp. aureus N315
uuuuauuguuuuggcu

SEQ ID NO: 4060177 - RNA, 16 nt, Staphylococcus aureus subsp. aureus N315
uuuuauuuacacacau

SEQ ID NO: 4060178 - RNA, 13 nt, Staphylococcus aureus subsp. aureus N315
uuuuauuuauauu

SEQ ID NO: 4060179 - RNA, 20 nt, Staphylococcus aureus subsp. aureus N315
uuuuauuuuuuucacuaauu

SEQ ID NO: 4060180 - RNA, 13 nt, Staphylococcus aureus subsp. aureus N315
uuuucaaaaauag

SEQ ID NO: 4060181 - RNA, 21 nt, Staphylococcus aureus subsp. aureus N315
uuuucaaacauauucauucua

SEQ ID NO: 4060182 - RNA, 13 nt, Staphylococcus aureus subsp. aureus N315
uuuucaaagccac

SEQ ID NO: 4060183 - RNA, 14 nt, Staphylococcus aureus subsp. aureus N315
uuuucaaaugaaaa

SEQ ID NO: 4060184 - RNA, 14 nt, Staphylococcus aureus subsp. aureus N315
uuuucaaauuucua

SEQ ID NO: 4060185 - RNA, 19 nt, Staphylococcus aureus subsp. aureus N315
uuuucaacauaauauuucu

SEQ ID NO: 4060186 - RNA, 12 nt, Staphylococcus aureus subsp. aureus N315
uuuucaacugua

SEQ ID NO: 4060187 - RNA, 12 nt, Staphylococcus aureus subsp. aureus N315
uuuucaacuuua

SEQ ID NO: 4060188 - RNA, 21 nt, Staphylococcus aureus subsp. aureus N315
uuuucaauaauugauucucug

SEQ ID NO: 4060189 - RNA, 15 nt, Staphylococcus aureus subsp. aureus N315
uuuucaauauuugau

SEQ ID NO: 4060190 - RNA, 21 nt, Staphylococcus aureus subsp. aureus N315
uuuucaauuagaaaauaucuu

SEQ ID NO: 4060191 - RNA, 22 nt, Staphylococcus aureus subsp. aureus N315
uuuucaauucgcucacauguga

SEQ ID NO: 4060192 - RNA, 16 nt, Staphylococcus aureus subsp. aureus N315
uuuucacgaauaucuu

SEQ ID NO: 4060193 - RNA, 22 nt, Staphylococcus aureus subsp. aureus N315
uuuucacuucgccaagccaucu

SEQ ID NO: 4060194 - RNA, 21 nt, Staphylococcus aureus subsp. aureus N315
uuuucauagaacaaaauguag

SEQ ID NO: 4060195 - RNA, 16 nt, Staphylococcus aureus subsp. aureus N315
uuuucauauacuuaac

SEQ ID NO: 4060196 - RNA, 13 nt, Staphylococcus aureus subsp. aureus N315
uuuuccaauaaua

SEQ ID NO: 4060197 - RNA, 18 nt, Staphylococcus aureus subsp. aureus N315
uuuucgaggucaucaaaa

SEQ ID NO: 4060198 - RNA, 18 nt, Staphylococcus aureus subsp. aureus N315
uuuucguauaauuuuaau

SEQ ID NO: 4060199 - RNA, 14 nt, Staphylococcus aureus subsp. aureus N315
uuuucuaaacaacu

SEQ ID NO: 4060200 - RNA, 15 nt, Staphylococcus aureus subsp. aureus N315
uuuucuaaauauaua

SEQ ID NO: 4060201 - RNA, 12 nt, Staphylococcus aureus subsp. aureus N315
uuuucuaaauga

SEQ ID NO: 4060202 - RNA, 14 nt, Staphylococcus aureus subsp. aureus N315
uuuucuaauuguuu

SEQ ID NO: 4060203 - RNA, 16 nt, Staphylococcus aureus subsp. aureus N315
uuuucuagcuauaucc

SEQ ID NO: 4060204 - RNA, 19 nt, Staphylococcus aureus subsp. aureus N315
uuuucuccaacgucauaac

SEQ ID NO: 4060205 - RNA, 20 nt, Staphylococcus aureus subsp. aureus N315
uuuucuuaguuugacaucua

SEQ ID NO: 4060206 - RNA, 22 nt, Staphylococcus aureus subsp. aureus N315
uuuucuugcauacgaauuaaaa

SEQ ID NO: 4060207 - RNA, 22 nt, Staphylococcus aureus subsp. aureus N315
uuuucuuuauuuuaaacaugaa

SEQ ID NO: 4060208 - RNA, 12 nt, Staphylococcus aureus subsp. aureus N315
uuuucuuuuguu

SEQ ID NO: 4060209 - RNA, 14 nt, Staphylococcus aureus subsp. aureus N315
uuuucuuuuuuaau

SEQ ID NO: 4060210 - RNA, 22 nt, Staphylococcus aureus subsp. aureus N315
uuuugaaacaucuaaauaguuu

SEQ ID NO: 4060211 - RNA, 12 nt, Staphylococcus aureus subsp. aureus N315
uuuugaauauuu

SEQ ID NO: 4060212 - RNA, 19 nt, Staphylococcus aureus subsp. aureus N315
uuuugaaucauacgaauuu

SEQ ID NO: 4060213 - RNA, 18 nt, Staphylococcus aureus subsp. aureus N315
uuuugaauguuucuccua

SEQ ID NO: 4060214 - RNA, 21 nt, Staphylococcus aureus subsp. aureus N315
uuuugacaguuuuaaaugaaa

SEQ ID NO: 4060215 - RNA, 20 nt, Staphylococcus aureus subsp. aureus N315
uuuugacuguuaaacaaggu

SEQ ID NO: 4060216 - RNA, 21 nt, Staphylococcus aureus subsp. aureus N315
uuuugagcacuuaauaaguca

SEQ ID NO: 4060217 - RNA, 18 nt, Staphylococcus aureus subsp. aureus N315
uuuugagucaauucgacu

SEQ ID NO: 4060218 - RNA, 16 nt, Staphylococcus aureus subsp. aureus N315
uuuugaguuauauuuu

SEQ ID NO: 4060219 - RNA, 13 nt, Staphylococcus aureus subsp. aureus N315
uuuugauauaaaa

SEQ ID NO: 4060220 - RNA, 23 nt, Staphylococcus aureus subsp. aureus N315
uuuugauauaaaaagugaaagua

SEQ ID NO: 4060221 - RNA, 14 nt, Staphylococcus aureus subsp. aureus N315
uuuugcaaaacgca

SEQ ID NO: 4060222 - RNA, 14 nt, Staphylococcus aureus subsp. aureus N315
uuuugcacuaaugg

SEQ ID NO: 4060223 - RNA, 22 nt, Staphylococcus aureus subsp. aureus N315
uuuugcaucacagauaaugcau

SEQ ID NO: 4060224 - RNA, 21 nt, Staphylococcus aureus subsp. aureus N315
uuuugcccaugucaugaauuu

SEQ ID NO: 4060225 - RNA, 16 nt, Staphylococcus aureus subsp. aureus N315
uuuugcgaaaauauca

SEQ ID NO: 4060226 - RNA, 17 nt, Staphylococcus aureus subsp. aureus N315
uuuugcgaaaauaucau

SEQ ID NO: 4060227 - RNA, 21 nt, Staphylococcus aureus subsp. aureus N315
uuuugcgaccggauguuucuu

SEQ ID NO: 4060228 - RNA, 15 nt, Staphylococcus aureus subsp. aureus N315
uuuugcuaaccauca

SEQ ID NO: 4060229 - RNA, 14 nt, Staphylococcus aureus subsp. aureus N315
uuuugcuguauaua

SEQ ID NO: 4060230 - RNA, 19 nt, Staphylococcus aureus subsp. aureus N315
uuuugcuuuguuugcuucu

SEQ ID NO: 4060231 - RNA, 23 nt, Staphylococcus aureus subsp. aureus N315
uuuuggagccccuuacaacuuua

SEQ ID NO: 4060232 - RNA, 15 nt, Staphylococcus aureus subsp. aureus N315
uuuuggcaauagcac

SEQ ID NO: 4060233 - RNA, 22 nt, Staphylococcus aureus subsp. aureus N315
uuuuggcuuaucaagcaccuua

SEQ ID NO: 4060234 - RNA, 15 nt, Staphylococcus aureus subsp. aureus N315
uuuuguaaacauggu

SEQ ID NO: 4060235 - RNA, 17 nt, Staphylococcus aureus subsp. aureus N315
uuuuguaucucugaaaa

SEQ ID NO: 4060236 - RNA, 16 nt, Staphylococcus aureus subsp. aureus N315
uuuugugauuuuuaau

SEQ ID NO: 4060237 - RNA, 19 nt, Staphylococcus aureus subsp. aureus N315
uuuugugggcguucugcua

SEQ ID NO: 4060238 - RNA, 15 nt, Staphylococcus aureus subsp. aureus N315
uuuuguuaauuuuuu

SEQ ID NO: 4060239 - RNA, 20 nt, Staphylococcus aureus subsp. aureus N315
uuuuguucuaaguguuuuau

SEQ ID NO: 4060240 - RNA, 12 nt, Staphylococcus aureus subsp. aureus N315
uuuuguugcuca

SEQ ID NO: 4060241 - RNA, 19 nt, Staphylococcus aureus subsp. aureus N315
uuuuuaaaauuaucaauug

SEQ ID NO: 4060242 - RNA, 11 nt, Staphylococcus aureus subsp. aureus N315
uuuuuaaauac

SEQ ID NO: 4060243 - RNA, 14 nt, Staphylococcus aureus subsp. aureus N315
uuuuuaaaucuaca

SEQ ID NO: 4060244 - RNA, 17 nt, Staphylococcus aureus subsp. aureus N315
uuuuuaaaugauuuaau

SEQ ID NO: 4060245 - RNA, 13 nt, Staphylococcus aureus subsp. aureus N315
uuuuuaaauuuaa

SEQ ID NO: 4060246 - RNA, 12 nt, Staphylococcus aureus subsp. aureus N315
uuuuuaacaaaa

SEQ ID NO: 4060247 - RNA, 23 nt, Staphylococcus aureus subsp. aureus N315
uuuuuaacauagcuuaauaauua

SEQ ID NO: 4060248 - RNA, 16 nt, Staphylococcus aureus subsp. aureus N315
uuuuuaacugccauau

SEQ ID NO: 4060249 - RNA, 12 nt, Staphylococcus aureus subsp. aureus N315
uuuuuaauaauu

SEQ ID NO: 4060250 - RNA, 16 nt, Staphylococcus aureus subsp. aureus N315
uuuuuaauauauuuau

SEQ ID NO: 4060251 - RNA, 18 nt, Staphylococcus aureus subsp. aureus N315
uuuuuaauguauucuucu

SEQ ID NO: 4060252 - RNA, 16 nt, Staphylococcus aureus subsp. aureus N315
uuuuuaauuauuuccc

SEQ ID NO: 4060253 - RNA, 19 nt, Staphylococcus aureus subsp. aureus N315
uuuuuaauuuguauuuaaa

SEQ ID NO: 4060254 - RNA, 15 nt, Staphylococcus aureus subsp. aureus N315
uuuuuaauuuugaca

SEQ ID NO: 4060255 - RNA, 19 nt, Staphylococcus aureus subsp. aureus N315
uuuuuacuaggaauauaaa

SEQ ID NO: 4060256 - RNA, 15 nt, Staphylococcus aureus subsp. aureus N315
uuuuuaguaauaaca

SEQ ID NO: 4060257 - RNA, 13 nt, Staphylococcus aureus subsp. aureus N315
uuuuuaguaguuu

SEQ ID NO: 4060258 - RNA, 22 nt, Staphylococcus aureus subsp. aureus N315
uuuuuaguuagaaaguauuuau

SEQ ID NO: 4060259 - RNA, 11 nt, Staphylococcus aureus subsp. aureus N315
uuuuuauauua

SEQ ID NO: 4060260 - RNA, 11 nt, Staphylococcus aureus subsp. aureus N315
uuuuuauauug

SEQ ID NO: 4060261 - RNA, 12 nt, Staphylococcus aureus subsp. aureus N315
uuuuuaucaugu

SEQ ID NO: 4060262 - RNA, 23 nt, Staphylococcus aureus subsp. aureus N315
uuuuuaucgaaagguauaucuuc

SEQ ID NO: 4060263 - RNA, 20 nt, Staphylococcus aureus subsp. aureus N315
uuuuuaugcacaaaaaaauc

SEQ ID NO: 4060264 - RNA, 17 nt, Staphylococcus aureus subsp. aureus N315
uuuuuauuaguauucaa

SEQ ID NO: 4060265 - RNA, 13 nt, Staphylococcus aureus subsp. aureus N315
uuuuuauuauaau

SEQ ID NO: 4060266 - RNA, 13 nt, Staphylococcus aureus subsp. aureus N315
uuuuuauuaugaa

SEQ ID NO: 4060267 - RNA, 14 nt, Staphylococcus aureus subsp. aureus N315
uuuuucaaauaaua

SEQ ID NO: 4060268 - RNA, 16 nt, Staphylococcus aureus subsp. aureus N315
uuuuucaaauauauca

SEQ ID NO: 4060269 - RNA, 14 nt, Staphylococcus aureus subsp. aureus N315
uuuuucaaugucua

SEQ ID NO: 4060270 - RNA, 14 nt, Staphylococcus aureus subsp. aureus N315
uuuuucaauucgcu

SEQ ID NO: 4060271 - RNA, 22 nt, Staphylococcus aureus subsp. aureus N315
uuuuucagcuguccgauuuuuu

SEQ ID NO: 4060272 - RNA, 16 nt, Staphylococcus aureus subsp. aureus N315
uuuuucaucauuaaaa

SEQ ID NO: 4060273 - RNA, 17 nt, Staphylococcus aureus subsp. aureus N315
uuuuucgaaguggcaaa

SEQ ID NO: 4060274 - RNA, 13 nt, Staphylococcus aureus subsp. aureus N315
uuuuucguuguuc

SEQ ID NO: 4060275 - RNA, 19 nt, Staphylococcus aureus subsp. aureus N315
uuuuucuccuuuguauaag

SEQ ID NO: 4060276 - RNA, 18 nt, Staphylococcus aureus subsp. aureus N315
uuuuucuuucucuaacau

SEQ ID NO: 4060277 - RNA, 20 nt, Staphylococcus aureus subsp. aureus N315
uuuuugaaauuucgacaucu

SEQ ID NO: 4060278 - RNA, 17 nt, Staphylococcus aureus subsp. aureus N315
uuuuugaauaucuaaug

SEQ ID NO: 4060279 - RNA, 14 nt, Staphylococcus aureus subsp. aureus N315
uuuuugaauuuaau

SEQ ID NO: 4060280 - RNA, 17 nt, Staphylococcus aureus subsp. aureus N315
uuuuugagcacuuaaua

SEQ ID NO: 4060281 - RNA, 15 nt, Staphylococcus aureus subsp. aureus N315
uuuuuggcuuaucaa

SEQ ID NO: 4060282 - RNA, 15 nt, Staphylococcus aureus subsp. aureus N315
uuuuuggucaccaaa

SEQ ID NO: 4060283 - RNA, 15 nt, Staphylococcus aureus subsp. aureus N315
uuuuuguaauacauc

SEQ ID NO: 4060284 - RNA, 13 nt, Staphylococcus aureus subsp. aureus N315
uuuuuguauuuau

SEQ ID NO: 4060285 - RNA, 21 nt, Staphylococcus aureus subsp. aureus N315
uuuuuguccccagcccuuuuc

SEQ ID NO: 4060286 - RNA, 15 nt, Staphylococcus aureus subsp. aureus N315
uuuuugugccuuucu

SEQ ID NO: 4060287 - RNA, 18 nt, Staphylococcus aureus subsp. aureus N315
uuuuuguugcaauugccu

SEQ ID NO: 4060288 - RNA, 13 nt, Staphylococcus aureus subsp. aureus N315
uuuuuguuuucaa

SEQ ID NO: 4060289 - RNA, 22 nt, Staphylococcus aureus subsp. aureus N315
uuuuuguuuucaaaugaaaaua

SEQ ID NO: 4060290 - RNA, 12 nt, Staphylococcus aureus subsp. aureus N315
uuuuuuaaauac

SEQ ID NO: 4060291 - RNA, 12 nt, Staphylococcus aureus subsp. aureus N315
uuuuuuauuaau

SEQ ID NO: 4060292 - RNA, 14 nt, Staphylococcus aureus subsp. aureus N315
uuuuuuauucuaau

SEQ ID NO: 4060293 - RNA, 23 nt, Staphylococcus aureus subsp. aureus N315
uuaaagucuguugguuuaucagc

SEQ ID NO: 4060294 - RNA, 14 nt, Staphylococcus aureus subsp. aureus N315
uuaaagucuucauc

SEQ ID NO: 4060295 - RNA, 22 nt, Staphylococcus aureus subsp. aureus N315
uuaaaguguuucaacauauuau

SEQ ID NO: 4060296 - RNA, 17 nt, Staphylococcus aureus subsp. aureus N315
uuaaaguuuaaauauuc

SEQ ID NO: 4060297 - RNA, 18 nt, Staphylococcus aureus subsp. aureus N315
uuaaaguuuaaauauuca

SEQ ID NO: 4060298 - RNA, 17 nt, Staphylococcus aureus subsp. aureus N315
uuaaaguuuuguucaau

SEQ ID NO: 4060299 - RNA, 22 nt, Staphylococcus aureus subsp. aureus N315
uuaaaguuuuguucaauaugau

SEQ ID NO: 4060300 - RNA, 15 nt, Staphylococcus aureus subsp. aureus N315
uuaaauaaaugacuu

SEQ ID NO: 4060301 - RNA, 16 nt, Staphylococcus aureus subsp. aureus N315
uuaaauaaucaacaaa

SEQ ID NO: 4060302 - RNA, 22 nt, Staphylococcus aureus subsp. aureus N315
uuaaauaaucgaaaauuucagg

SEQ ID NO: 4060303 - RNA, 15 nt, Staphylococcus aureus subsp. aureus N315
uuaaauaaugauaaa

SEQ ID NO: 4060304 - RNA, 23 nt, Staphylococcus aureus subsp. aureus N315
uuaaauaaugauaaauuaaagcu

SEQ ID NO: 4060305 - RNA, 19 nt, Staphylococcus aureus subsp. aureus N315
uuaaauacgccaaauauca

SEQ ID NO: 4060306 - RNA, 20 nt, Staphylococcus aureus subsp. aureus N315
uuaaauacgccaaauaucag

SEQ ID NO: 4060307 - RNA, 14 nt, Staphylococcus aureus subsp. aureus N315
uuaaauacuauaua

SEQ ID NO: 4060308 - RNA, 19 nt, Staphylococcus aureus subsp. aureus N315
uuaaauagaugagaaagua

SEQ ID NO: 4060309 - RNA, 21 nt, Staphylococcus aureus subsp. aureus N315
uuaaauaggugauuauauaua

SEQ ID NO: 4060310 - RNA, 11 nt, Staphylococcus aureus subsp. aureus N315
uuaaauaucau

SEQ ID NO: 4060311 - RNA, 13 nt, Staphylococcus aureus subsp. aureus N315
uuaaauaucauac

SEQ ID NO: 4060312 - RNA, 14 nt, Staphylococcus aureus subsp. aureus N315
uuaaauaucaugca

SEQ ID NO: 4060313 - RNA, 15 nt, Staphylococcus aureus subsp. aureus N315
uuaaauauucuuauc

SEQ ID NO: 4060314 - RNA, 17 nt, Staphylococcus aureus subsp. aureus N315
uuaaauauuuaaccuuu

SEQ ID NO: 4060315 - RNA, 15 nt, Staphylococcus aureus subsp. aureus N315
uuaaaucaacaagaa

SEQ ID NO: 4060316 - RNA, 19 nt, Staphylococcus aureus subsp. aureus N315
uuaaaucaacaucaucuuu

SEQ ID NO: 4060317 - RNA, 19 nt, Staphylococcus aureus subsp. aureus N315
uuaaaucaccaacaacuuu

SEQ ID NO: 4060318 - RNA, 20 nt, Staphylococcus aureus subsp. aureus N315
uuaaaucaccaacaacuuug

SEQ ID NO: 4060319 - RNA, 20 nt, Staphylococcus aureus subsp. aureus N315
uuaaaucacuagcuaaugca

SEQ ID NO: 4060320 - RNA, 22 nt, Staphylococcus aureus subsp. aureus N315
uuaaaucauugcgugcuucacu

SEQ ID NO: 4060321 - RNA, 15 nt, Staphylococcus aureus subsp. aureus N315
uuaaaucuacuuugu

SEQ ID NO: 4060322 - RNA, 19 nt, Staphylococcus aureus subsp. aureus N315
uuaaaucugauucauuaaa

SEQ ID NO: 4060323 - RNA, 13 nt, Staphylococcus aureus subsp. aureus N315
uuaaaucuucuag

SEQ ID NO: 4060324 - RNA, 15 nt, Staphylococcus aureus subsp. aureus N315
uuaaaugaaacuuug

SEQ ID NO: 4060325 - RNA, 21 nt, Staphylococcus aureus subsp. aureus N315
uuaaaugaugcaguaaaacca

SEQ ID NO: 4060326 - RNA, 20 nt, Staphylococcus aureus subsp. aureus N315
uuaaaugauggguauuuugu

SEQ ID NO: 4060327 - RNA, 20 nt, Staphylococcus aureus subsp. aureus N315
uuaaaugauucuuuauaagc

SEQ ID NO: 4060328 - RNA, 16 nt, Staphylococcus aureus subsp. aureus N315
uuaaaugauuuaauaa

SEQ ID NO: 4060329 - RNA, 21 nt, Staphylococcus aureus subsp. aureus N315
uuaaauguacauuguaaauau

SEQ ID NO: 4060330 - RNA, 14 nt, Staphylococcus aureus subsp. aureus N315
uuaaauuaaagcaa

SEQ ID NO: 4060331 - RNA, 14 nt, Staphylococcus aureus subsp. aureus N315
uuaaauuaagaaua

SEQ ID NO: 4060332 - RNA, 14 nt, Staphylococcus aureus subsp. aureus N315
uuaaauuauauacc

SEQ ID NO: 4060333 - RNA, 15 nt, Staphylococcus aureus subsp. aureus N315
uuaaauuauauguuu

SEQ ID NO: 4060334 - RNA, 21 nt, Staphylococcus aureus subsp. aureus N315
uuaaauuauauguuuuuauua

SEQ ID NO: 4060335 - RNA, 19 nt, Staphylococcus aureus subsp. aureus N315
uuaaauuauuuaauuuuuc

SEQ ID NO: 4060336 - RNA, 21 nt, Staphylococcus aureus subsp. aureus N315
uuaaauuauuuaauuuuucua

SEQ ID NO: 4060337 - RNA, 21 nt, Staphylococcus aureus subsp. aureus N315
uuaaauucaucuuaucaagaa

SEQ ID NO: 4060338 - RNA, 12 nt, Staphylococcus aureus subsp. aureus N315
uuaaauucauuu

SEQ ID NO: 4060339 - RNA, 18 nt, Staphylococcus aureus subsp. aureus N315
uuaaauucauuuuaagug

SEQ ID NO: 4060340 - RNA, 13 nt, Staphylococcus aureus subsp. aureus N315
uuaaauucuaaaa

SEQ ID NO: 4060341 - RNA, 18 nt, Staphylococcus aureus subsp. aureus N315
uuaaauucuuauaaaaua

SEQ ID NO: 4060342 - RNA, 15 nt, Staphylococcus aureus subsp. aureus N315
uuaaauugaaauguu

SEQ ID NO: 4060343 - RNA, 18 nt, Staphylococcus aureus subsp. aureus N315
uuaaauuggaaucccaau

SEQ ID NO: 4060344 - RNA, 17 nt, Staphylococcus aureus subsp. aureus N315
uuaaauuuguguucaaa

SEQ ID NO: 4060345 - RNA, 14 nt, Staphylococcus aureus subsp. aureus N315
uuaaauuuuaaguu

SEQ ID NO: 4060346 - RNA, 17 nt, Staphylococcus aureus subsp. aureus N315
uuaaauuuucaucauaa

SEQ ID NO: 4060347 - RNA, 19 nt, Staphylococcus aureus subsp. aureus N315
uuaaauuuucaucauaauc

SEQ ID NO: 4060348 - RNA, 15 nt, Staphylococcus aureus subsp. aureus N315
uuaacaacaaauaua

SEQ ID NO: 4060349 - RNA, 16 nt, Staphylococcus aureus subsp. aureus N315
uuaacaacaaauauaa

SEQ ID NO: 4060350 - RNA, 12 nt, Staphylococcus aureus subsp. aureus N315
uuaacaacauga

SEQ ID NO: 4060351 - RNA, 14 nt, Staphylococcus aureus subsp. aureus N315
uuaacaauauuaaa

SEQ ID NO: 4060352 - RNA, 18 nt, Staphylococcus aureus subsp. aureus N315
uuaacaauugauugcucu

SEQ ID NO: 4060353 - RNA, 17 nt, Staphylococcus aureus subsp. aureus N315
uuaacacauucaaauaa

SEQ ID NO: 4060354 - RNA, 22 nt, Staphylococcus aureus subsp. aureus N315
uuaacagcgugaauauaaguaa

SEQ ID NO: 4060355 - RNA, 19 nt, Staphylococcus aureus subsp. aureus N315
uuaacaguuguaaucauug

SEQ ID NO: 4060356 - RNA, 14 nt, Staphylococcus aureus subsp. aureus N315
uuaacauaaaauga

SEQ ID NO: 4060357 - RNA, 20 nt, Staphylococcus aureus subsp. aureus N315
uuaacauccugcuuauuaau

SEQ ID NO: 4060358 - RNA, 15 nt, Staphylococcus aureus subsp. aureus N315
uuaacaucugaaucu

SEQ ID NO: 4060359 - RNA, 15 nt, Staphylococcus aureus subsp. aureus N315
uuaacauuauccauu

SEQ ID NO: 4060360 - RNA, 20 nt, Staphylococcus aureus subsp. aureus N315
uuaacauuuauucuuucucu

SEQ ID NO: 4060361 - RNA, 18 nt, Staphylococcus aureus subsp. aureus N315
uuaacauuugucauaaua

SEQ ID NO: 4060362 - RNA, 20 nt, Staphylococcus aureus subsp. aureus N315
uuaaccaguauaauuuucug

SEQ ID NO: 4060363 - RNA, 15 nt, Staphylococcus aureus subsp. aureus N315
uuaaccauuuaaaaa

SEQ ID NO: 4060364 - RNA, 17 nt, Staphylococcus aureus subsp. aureus N315
uuaaccauuuaaaaauu

SEQ ID NO: 4060365 - RNA, 15 nt, Staphylococcus aureus subsp. aureus N315
uuaacccacauuaaa

SEQ ID NO: 4060366 - RNA, 18 nt, Staphylococcus aureus subsp. aureus N315
uuaacccacauuaaauau

SEQ ID NO: 4060367 - RNA, 18 nt, Staphylococcus aureus subsp. aureus N315
uuaaccuugauuuaauuu

SEQ ID NO: 4060368 - RNA, 18 nt, Staphylococcus aureus subsp. aureus N315
uuaacggaaauacaauga

SEQ ID NO: 4060369 - RNA, 15 nt, Staphylococcus aureus subsp. aureus N315
uuaacgucauuuuua

SEQ ID NO: 4060370 - RNA, 16 nt, Staphylococcus aureus subsp. aureus N315
uuaacuauaaauagaa

SEQ ID NO: 4060371 - RNA, 17 nt, Staphylococcus aureus subsp. aureus N315
uuaacuauguuacuuau

SEQ ID NO: 4060372 - RNA, 24 nt, Staphylococcus aureus subsp. aureus N315
uuaacuauguuacuuauauauuca

SEQ ID NO: 4060373 - RNA, 14 nt, Staphylococcus aureus subsp. aureus N315
uuaacucaaagaaa

SEQ ID NO: 4060374 - RNA, 20 nt, Staphylococcus aureus subsp. aureus N315
uuaacucaccuuuaucauua

SEQ ID NO: 4060375 - RNA, 17 nt, Staphylococcus aureus subsp. aureus N315
uuaacucuugaaacaca

SEQ ID NO: 4060376 - RNA, 15 nt, Staphylococcus aureus subsp. aureus N315
uuaacugcaaacuug

SEQ ID NO: 4060377 - RNA, 14 nt, Staphylococcus aureus subsp. aureus N315
uuaacugccauaua

SEQ ID NO: 4060378 - RNA, 22 nt, Staphylococcus aureus subsp. aureus N315
uuaacugguugauaaauaaacu

SEQ ID NO: 4060379 - RNA, 20 nt, Staphylococcus aureus subsp. aureus N315
uuaacuguacgauucaauuu

SEQ ID NO: 4060380 - RNA, 14 nt, Staphylococcus aureus subsp. aureus N315
uuaacuuauauacg

SEQ ID NO: 4060381 - RNA, 12 nt, Staphylococcus aureus subsp. aureus N315
uuaacuuuaaua

SEQ ID NO: 4060382 - RNA, 13 nt, Staphylococcus aureus subsp. aureus N315
uuaacuuuaauua

SEQ ID NO: 4060383 - RNA, 20 nt, Staphylococcus aureus subsp. aureus N315
uuaacuuuccgccuucaauc

SEQ ID NO: 4060384 - RNA, 14 nt, Staphylococcus aureus subsp. aureus N315
uuaagaaaaguuac

SEQ ID NO: 4060385 - RNA, 16 nt, Staphylococcus aureus subsp. aureus N315
uuaagaaaucaacaac

SEQ ID NO: 4060386 - RNA, 23 nt, Staphylococcus aureus subsp. aureus N315
uuaagaauaaucgaacauaaaua

SEQ ID NO: 4060387 - RNA, 15 nt, Staphylococcus aureus subsp. aureus N315
uuaagaauacaugac

SEQ ID NO: 4060388 - RNA, 15 nt, Staphylococcus aureus subsp. aureus N315
uuaagauuuuaacuu

SEQ ID NO: 4060389 - RNA, 22 nt, Staphylococcus aureus subsp. aureus N315
uuaagccagcagguuucacaaa

SEQ ID NO: 4060390 - RNA, 13 nt, Staphylococcus aureus subsp. aureus N315
uuaagcccuuccc

SEQ ID NO: 4060391 - RNA, 19 nt, Staphylococcus aureus subsp. aureus N315
uuaagccugauguaccacu

SEQ ID NO: 4060392 - RNA, 15 nt, Staphylococcus aureus subsp. aureus N315
uuaagcuaucuaaac

SEQ ID NO: 4060393 - RNA, 19 nt, Staphylococcus aureus subsp. aureus N315
uuaagcuaucuaaaccuuu

SEQ ID NO: 4060394 - RNA, 22 nt, Staphylococcus aureus subsp. aureus N315
uuaagcucauuucaauauuaaa

SEQ ID NO: 4060395 - RNA, 23 nt, Staphylococcus aureus subsp. aureus N315
uuaaguaaucugcaaaugccucu

SEQ ID NO: 4060396 - RNA, 18 nt, Staphylococcus aureus subsp. aureus N315
uuaaguacaacaguugca

SEQ ID NO: 4060397 - RNA, 14 nt, Staphylococcus aureus subsp. aureus N315
uuaaguaguuguua

SEQ ID NO: 4060398 - RNA, 19 nt, Staphylococcus aureus subsp. aureus N315
uuaaguaguuguuauauuc

SEQ ID NO: 4060399 - RNA, 22 nt, Staphylococcus aureus subsp. aureus N315
uuaagugcaauaacaccaauug

SEQ ID NO: 4060400 - RNA, 17 nt, Staphylococcus aureus subsp. aureus N315
uuaagugggacuuuuua

SEQ ID NO: 4060401 - RNA, 19 nt, Staphylococcus aureus subsp. aureus N315
uuaaguugaaaaccucuuu

SEQ ID NO: 4060402 - RNA, 18 nt, Staphylococcus aureus subsp. aureus N315
uuaauaaaauucuauaau

SEQ ID NO: 4060403 - RNA, 12 nt, Staphylococcus aureus subsp. aureus N315
uuaauaaaccua

SEQ ID NO: 4060404 - RNA, 19 nt, Staphylococcus aureus subsp. aureus N315
uuaauaaacgcuucauagu

SEQ ID NO: 4060405 - RNA, 22 nt, Staphylococcus aureus subsp. aureus N315
uuaauaaauugacucaaagaua

SEQ ID NO: 4060406 - RNA, 22 nt, Staphylococcus aureus subsp. aureus N315
uuaauaaauuguuaucguucaa

SEQ ID NO: 4060407 - RNA, 13 nt, Staphylococcus aureus subsp. aureus N315
uuaauaaauuuaa

SEQ ID NO: 4060408 - RNA, 22 nt, Staphylococcus aureus subsp. aureus N315
uuaauaaauuuaacguuauuca

SEQ ID NO: 4060409 - RNA, 21 nt, Staphylococcus aureus subsp. aureus N315
uuaauaacauccccaaaaaua

SEQ ID NO: 4060410 - RNA, 20 nt, Staphylococcus aureus subsp. aureus N315
uuaauaacccauuuucaaaa

SEQ ID NO: 4060411 - RNA, 16 nt, Staphylococcus aureus subsp. aureus N315
uuaauaaccuuuaaaa

SEQ ID NO: 4060412 - RNA, 19 nt, Staphylococcus aureus subsp. aureus N315
uuaauaaccuuuaaaacau

SEQ ID NO: 4060413 - RNA, 21 nt, Staphylococcus aureus subsp. aureus N315
uuaauaaccuuuaaaacauca

SEQ ID NO: 4060414 - RNA, 23 nt, Staphylococcus aureus subsp. aureus N315
uuaauaaccuuuaaaacaucauu

SEQ ID NO: 4060415 - RNA, 16 nt, Staphylococcus aureus subsp. aureus N315
uuaauaacguacauuu

SEQ ID NO: 4060416 - RNA, 13 nt, Staphylococcus aureus subsp. aureus N315
uuaauaauaagua

SEQ ID NO: 4060417 - RNA, 17 nt, Staphylococcus aureus subsp. aureus N315
uuaauaaugaauucuau

SEQ ID NO: 4060418 - RNA, 12 nt, Staphylococcus aureus subsp. aureus N315
uuaauaauuaau

SEQ ID NO: 4060419 - RNA, 19 nt, Staphylococcus aureus subsp. aureus N315
uuaauaauuuguuuuauuu

SEQ ID NO: 4060420 - RNA, 19 nt, Staphylococcus aureus subsp. aureus N315
uuaauacaagucuuuacuc

SEQ ID NO: 4060421 - RNA, 13 nt, Staphylococcus aureus subsp. aureus N315
uuaauacaauuca

SEQ ID NO: 4060422 - RNA, 15 nt, Staphylococcus aureus subsp. aureus N315
uuaauacaucaauau

SEQ ID NO: 4060423 - RNA, 16 nt, Staphylococcus aureus subsp. aureus N315
uuaauacgauaauaac

SEQ ID NO: 4060424 - RNA, 16 nt, Staphylococcus aureus subsp. aureus N315
uuaauacguuuaauaa

SEQ ID NO: 4060425 - RNA, 18 nt, Staphylococcus aureus subsp. aureus N315
uuaauacuaccguuuuua

SEQ ID NO: 4060426 - RNA, 20 nt, Staphylococcus aureus subsp. aureus N315
uuaauacuaccguuuuuaua

SEQ ID NO: 4060427 - RNA, 23 nt, Staphylococcus aureus subsp. aureus N315
uuaauacuuuucucgauuaauuu

SEQ ID NO: 4060428 - RNA, 17 nt, Staphylococcus aureus subsp. aureus N315
uuaauagaaagagguuu

SEQ ID NO: 4060429 - RNA, 18 nt, Staphylococcus aureus subsp. aureus N315
uuaauagagaaagaauaa

SEQ ID NO: 4060430 - RNA, 20 nt, Staphylococcus aureus subsp. aureus N315
uuaauagagacauuuuaucu

SEQ ID NO: 4060431 - RNA, 17 nt, Staphylococcus aureus subsp. aureus N315
uuaauaguguuauauug

SEQ ID NO: 4060432 - RNA, 14 nt, Staphylococcus aureus subsp. aureus N315
uuaauauaaaauaa

SEQ ID NO: 4060433 - RNA, 15 nt, Staphylococcus aureus subsp. aureus N315
uuaauauaaauauca

SEQ ID NO: 4060434 - RNA, 22 nt, Staphylococcus aureus subsp. aureus N315
uuaauauaaauuuugaauuaca

SEQ ID NO: 4060435 - RNA, 18 nt, Staphylococcus aureus subsp. aureus N315
uuaauauaacuucuauua

SEQ ID NO: 4060436 - RNA, 14 nt, Staphylococcus aureus subsp. aureus N315
uuaauauaauaccu

SEQ ID NO: 4060437 - RNA, 14 nt, Staphylococcus aureus subsp. aureus N315
uuaauauaauuaau

SEQ ID NO: 4060438 - RNA, 16 nt, Staphylococcus aureus subsp. aureus N315
uuaauauaauuaauuu

SEQ ID NO: 4060439 - RNA, 14 nt, Staphylococcus aureus subsp. aureus N315
uuaauauaauuauu

SEQ ID NO: 4060440 - RNA, 13 nt, Staphylococcus aureus subsp. aureus N315
uuaauauauuuau

SEQ ID NO: 4060441 - RNA, 14 nt, Staphylococcus aureus subsp. aureus N315
uuaauauauuuauu

SEQ ID NO: 4060442 - RNA, 23 nt, Staphylococcus aureus subsp. aureus N315
uuaauaucacgaucuuuaaaguc

SEQ ID NO: 4060443 - RNA, 21 nt, Staphylococcus aureus subsp. aureus N315
uuaauaucauauucaaaauaa

SEQ ID NO: 4060444 - RNA, 16 nt, Staphylococcus aureus subsp. aureus N315
uuaauaugaacaaaaa

SEQ ID NO: 4060445 - RNA, 13 nt, Staphylococcus aureus subsp. aureus N315
uuaauaugcaaug

SEQ ID NO: 4060446 - RNA, 14 nt, Staphylococcus aureus subsp. aureus N315
uuaauauugauuaa

SEQ ID NO: 4060447 - RNA, 18 nt, Staphylococcus aureus subsp. aureus N315
uuaauauuugauaacaaa

SEQ ID NO: 4060448 - RNA, 12 nt, Staphylococcus aureus subsp. aureus N315
uuaauauuuucu

SEQ ID NO: 4060449 - RNA, 14 nt, Staphylococcus aureus subsp. aureus N315
uuaaucaauuuaau

SEQ ID NO: 4060450 - RNA, 16 nt, Staphylococcus aureus subsp. aureus N315
uuaaucaauuuaauua

SEQ ID NO: 4060451 - RNA, 18 nt, Staphylococcus aureus subsp. aureus N315
uuaaucauuuaucuagac

SEQ ID NO: 4060452 - RNA, 23 nt, Staphylococcus aureus subsp. aureus N315
uuaauccgauuuugauauaaaaa

SEQ ID NO: 4060453 - RNA, 16 nt, Staphylococcus aureus subsp. aureus N315
uuaaucgcucuaaaua

SEQ ID NO: 4060454 - RNA, 18 nt, Staphylococcus aureus subsp. aureus N315
uuaaucgcucuaaauagu

SEQ ID NO: 4060455 - RNA, 19 nt, Staphylococcus aureus subsp. aureus N315
uuaaucggaucauuauuua

SEQ ID NO: 4060456 - RNA, 15 nt, Staphylococcus aureus subsp. aureus N315
uuaaucgggcuauau

SEQ ID NO: 4060457 - RNA, 22 nt, Staphylococcus aureus subsp. aureus N315
uuaaucguauuagccaauaaaa

SEQ ID NO: 4060458 - RNA, 19 nt, Staphylococcus aureus subsp. aureus N315
uuaaucuucgucauaagga

SEQ ID NO: 4060459 - RNA, 22 nt, Staphylococcus aureus subsp. aureus N315
uuaaugacuucuuuauauuuau

SEQ ID NO: 4060460 - RNA, 15 nt, Staphylococcus aureus subsp. aureus N315
uuaaugauuuuucau

SEQ ID NO: 4060461 - RNA, 19 nt, Staphylococcus aureus subsp. aureus N315
uuaaugauuuuucaucaau

SEQ ID NO: 4060462 - RNA, 20 nt, Staphylococcus aureus subsp. aureus N315
uuaaugccugcccuuuaguc

SEQ ID NO: 4060463 - RNA, 20 nt, Staphylococcus aureus subsp. aureus N315
uuaaugcuucaaauguaaca

SEQ ID NO: 4060464 - RNA, 22 nt, Staphylococcus aureus subsp. aureus N315
uuaaugcuucaaauguaacauu

SEQ ID NO: 4060465 - RNA, 13 nt, Staphylococcus aureus subsp. aureus N315
uuaaugcuuuagc

SEQ ID NO: 4060466 - RNA, 19 nt, Staphylococcus aureus subsp. aureus N315
uuaauggcaacuaagauga

SEQ ID NO: 4060467 - RNA, 22 nt, Staphylococcus aureus subsp. aureus N315
uuaauggcagcgaucuuuuuua

SEQ ID NO: 4060468 - RNA, 21 nt, Staphylococcus aureus subsp. aureus N315
uuaauguauucuucuaauucu

SEQ ID NO: 4060469 - RNA, 17 nt, Staphylococcus aureus subsp. aureus N315
uuaaugucuuaaaauug

SEQ ID NO: 4060470 - RNA, 11 nt, Staphylococcus aureus subsp. aureus N315
uuaauguguaa

SEQ ID NO: 4060471 - RNA, 14 nt, Staphylococcus aureus subsp. aureus N315
uuaauguuugcuuu

SEQ ID NO: 4060472 - RNA, 20 nt, Staphylococcus aureus subsp. aureus N315
uuaauuaaaauacaaauuac

SEQ ID NO: 4060473 - RNA, 13 nt, Staphylococcus aureus subsp. aureus N315
uuaauuaaagauu

SEQ ID NO: 4060474 - RNA, 19 nt, Staphylococcus aureus subsp. aureus N315
uuaauuaaagcaucuucaa

SEQ ID NO: 4060475 - RNA, 20 nt, Staphylococcus aureus subsp. aureus N315
uuaauuaaagcaucuucaau

SEQ ID NO: 4060476 - RNA, 23 nt, Staphylococcus aureus subsp. aureus N315
uuaauuaaagcaucuucaauauu

SEQ ID NO: 4060477 - RNA, 20 nt, Staphylococcus aureus subsp. aureus N315
uuaauuaauaauuuaacuaa

SEQ ID NO: 4060478 - RNA, 14 nt, Staphylococcus aureus subsp. aureus N315
uuaauuaauuauca

SEQ ID NO: 4060479 - RNA, 18 nt, Staphylococcus aureus subsp. aureus N315
uuaauuacagguuuaauu

SEQ ID NO: 4060480 - RNA, 20 nt, Staphylococcus aureus subsp. aureus N315
uuaauuacgucauaaaauac

SEQ ID NO: 4060481 - RNA, 20 nt, Staphylococcus aureus subsp. aureus N315
uuaauuauguauuuuuauuu

SEQ ID NO: 4060482 - RNA, 21 nt, Staphylococcus aureus subsp. aureus N315
uuaauuauguauuuuuauuua

SEQ ID NO: 4060483 - RNA, 18 nt, Staphylococcus aureus subsp. aureus N315
uuaauucgccuaaauggu

SEQ ID NO: 4060484 - RNA, 22 nt, Staphylococcus aureus subsp. aureus N315
uuaauucuauuuuugauuuaau

SEQ ID NO: 4060485 - RNA, 17 nt, Staphylococcus aureus subsp. aureus N315
uuaauucugauuauguu

SEQ ID NO: 4060486 - RNA, 13 nt, Staphylococcus aureus subsp. aureus N315
uuaauucuuaauc

SEQ ID NO: 4060487 - RNA, 18 nt, Staphylococcus aureus subsp. aureus N315
uuaauugaaugaaaauaa

SEQ ID NO: 4060488 - RNA, 19 nt, Staphylococcus aureus subsp. aureus N315
uuaauugcuguaaauauuc

SEQ ID NO: 4060489 - RNA, 21 nt, Staphylococcus aureus subsp. aureus N315
uuaauugcuuucacauuguuu

SEQ ID NO: 4060490 - RNA, 15 nt, Staphylococcus aureus subsp. aureus N315
uuaauuguuaaauca

SEQ ID NO: 4060491 - RNA, 15 nt, Staphylococcus aureus subsp. aureus N315
uuaauuguuuaauaa

SEQ ID NO: 4060492 - RNA, 23 nt, Staphylococcus aureus subsp. aureus N315
uuaauuuaacggaaauacaauga

SEQ ID NO: 4060493 - RNA, 16 nt, Staphylococcus aureus subsp. aureus N315
uuaauuuacaauuaau

SEQ ID NO: 4060494 - RNA, 15 nt, Staphylococcus aureus subsp. aureus N315
uuaauuucaacauua

SEQ ID NO: 4060495 - RNA, 13 nt, Staphylococcus aureus subsp. aureus N315
uuaauuucacuuu

SEQ ID NO: 4060496 - RNA, 16 nt, Staphylococcus aureus subsp. aureus N315
uuaauuucaugugcaa

SEQ ID NO: 4060497 - RNA, 19 nt, Staphylococcus aureus subsp. aureus N315
uuaauuucugguaaaaaaa

SEQ ID NO: 4060498 - RNA, 20 nt, Staphylococcus aureus subsp. aureus N315
uuaauuuguauuuaaaauca

SEQ ID NO: 4060499 - RNA, 17 nt, Staphylococcus aureus subsp. aureus N315
uuaauuuguuuuaaaua

SEQ ID NO: 4060500 - RNA, 18 nt, Staphylococcus aureus subsp. aureus N315
uuaauuuguuuuaaauac

SEQ ID NO: 4060501 - RNA, 15 nt, Staphylococcus aureus subsp. aureus N315
uuaauuuuaaauauu

SEQ ID NO: 4060502 - RNA, 15 nt, Staphylococcus aureus subsp. aureus N315
uuaauuuuaccauca

SEQ ID NO: 4060503 - RNA, 18 nt, Staphylococcus aureus subsp. aureus N315
uuaauuuuaugucccaau

SEQ ID NO: 4060504 - RNA, 23 nt, Staphylococcus aureus subsp. aureus N315
uuaauuuuaugucccaaugcuga

SEQ ID NO: 4060505 - RNA, 12 nt, Staphylococcus aureus subsp. aureus N315
uuaauuuuauua

SEQ ID NO: 4060506 - RNA, 14 nt, Staphylococcus aureus subsp. aureus N315
uuaauuuugacaua

SEQ ID NO: 4060507 - RNA, 19 nt, Staphylococcus aureus subsp. aureus N315
uuaauuuugauauuuuuca

SEQ ID NO: 4060508 - RNA, 12 nt, Staphylococcus aureus subsp. aureus N315
uuaauuuuucaa

SEQ ID NO: 4060509 - RNA, 14 nt, Staphylococcus aureus subsp. aureus N315
uuaauuuuucauua

SEQ ID NO: 4060510 - RNA, 15 nt, Staphylococcus aureus subsp. aureus N315
uuaauuuuucuaaau

SEQ ID NO: 4060511 - RNA, 17 nt, Staphylococcus aureus subsp. aureus N315
uuaauuuuucuaaauga

SEQ ID NO: 4060512 - RNA, 14 nt, Staphylococcus aureus subsp. aureus N315
uuaauuuuuuauua

SEQ ID NO: 4060513 - RNA, 21 nt, Staphylococcus aureus subsp. aureus N315
uuacaaaagaaucauuuaaau

SEQ ID NO: 4060514 - RNA, 13 nt, Staphylococcus aureus subsp. aureus N315
uuacaaacuucac

SEQ ID NO: 4060515 - RNA, 16 nt, Staphylococcus aureus subsp. aureus N315
uuacaaacuucacauc

SEQ ID NO: 4060516 - RNA, 21 nt, Staphylococcus aureus subsp. aureus N315
uuacaaaguuaaccauacaua

SEQ ID NO: 4060517 - RNA, 13 nt, Staphylococcus aureus subsp. aureus N315
uuacaaauauacu

SEQ ID NO: 4060518 - RNA, 17 nt, Staphylococcus aureus subsp. aureus N315
uuacaaaucaugacaua

SEQ ID NO: 4060519 - RNA, 21 nt, Staphylococcus aureus subsp. aureus N315
uuacaaaucaugacauaaaac

SEQ ID NO: 4060520 - RNA, 17 nt, Staphylococcus aureus subsp. aureus N315
uuacaaaugaagguguu

SEQ ID NO: 4060521 - RNA, 22 nt, Staphylococcus aureus subsp. aureus N315
uuacaaaugaagguguugaaaa

SEQ ID NO: 4060522 - RNA, 17 nt, Staphylococcus aureus subsp. aureus N315
uuacaauaaagacauau

SEQ ID NO: 4060523 - RNA, 23 nt, Staphylococcus aureus subsp. aureus N315
uuacaauaagcgcaauuaaaagu

SEQ ID NO: 4060524 - RNA, 19 nt, Staphylococcus aureus subsp. aureus N315
uuacaaucaucacacauaa

SEQ ID NO: 4060525 - RNA, 20 nt, Staphylococcus aureus subsp. aureus N315
uuacaaugcgcaaugaaaac

SEQ ID NO: 4060526 - RNA, 14 nt, Staphylococcus aureus subsp. aureus N315
uuacaauuguucuc

SEQ ID NO: 4060527 - RNA, 15 nt, Staphylococcus aureus subsp. aureus N315
uuacaccuauaccuc

SEQ ID NO: 4060528 - RNA, 23 nt, Staphylococcus aureus subsp. aureus N315
uuacacuaaaaccuauuccuaau

SEQ ID NO: 4060529 - RNA, 16 nt, Staphylococcus aureus subsp. aureus N315
uuacagguugaauaaa

SEQ ID NO: 4060530 - RNA, 19 nt, Staphylococcus aureus subsp. aureus N315
uuacagguuuuaaaauuaa

SEQ ID NO: 4060531 - RNA, 20 nt, Staphylococcus aureus subsp. aureus N315
uuacagguuuuaaaauuaaa

SEQ ID NO: 4060532 - RNA, 18 nt, Staphylococcus aureus subsp. aureus N315
uuacauauacgacauuuu

SEQ ID NO: 4060533 - RNA, 15 nt, Staphylococcus aureus subsp. aureus N315
uuacauauugcauuu

SEQ ID NO: 4060534 - RNA, 22 nt, Staphylococcus aureus subsp. aureus N315
uuacaugcaccuuuacaacaua

SEQ ID NO: 4060535 - RNA, 12 nt, Staphylococcus aureus subsp. aureus N315
uuacauuacaua

SEQ ID NO: 4060536 - RNA, 21 nt, Staphylococcus aureus subsp. aureus N315
uuacauucuauacuuuuaauu

SEQ ID NO: 4060537 - RNA, 16 nt, Staphylococcus aureus subsp. aureus N315
uuacauuuuaugucca

SEQ ID NO: 4060538 - RNA, 14 nt, Staphylococcus aureus subsp. aureus N315
uuacauuuucaaaa

SEQ ID NO: 4060539 - RNA, 12 nt, Staphylococcus aureus subsp. aureus N315
uuaccaaaauuu

SEQ ID NO: 4060540 - RNA, 14 nt, Staphylococcus aureus subsp. aureus N315
uuaccaucuuuaau

SEQ ID NO: 4060541 - RNA, 14 nt, Staphylococcus aureus subsp. aureus N315
uuacccuuuaaacu

SEQ ID NO: 4060542 - RNA, 19 nt, Staphylococcus aureus subsp. aureus N315
uuaccuaauaggauuuccu

SEQ ID NO: 4060543 - RNA, 18 nt, Staphylococcus aureus subsp. aureus N315
uuaccuguuucuauauua

SEQ ID NO: 4060544 - RNA, 23 nt, Staphylococcus aureus subsp. aureus N315
uuaccuguuucuauauuaauaau

SEQ ID NO: 4060545 - RNA, 13 nt, Staphylococcus aureus subsp. aureus N315
uuaccuuuaauua

SEQ ID NO: 4060546 - RNA, 15 nt, Staphylococcus aureus subsp. aureus N315
uuaccuuuuaaggca

SEQ ID NO: 4060547 - RNA, 15 nt, Staphylococcus aureus subsp. aureus N315
uuacgaaaguagaau

SEQ ID NO: 4060548 - RNA, 23 nt, Staphylococcus aureus subsp. aureus N315
uuacgacauacuugucguauucu

SEQ ID NO: 4060549 - RNA, 18 nt, Staphylococcus aureus subsp. aureus N315
uuacgaucauaaauauuu

SEQ ID NO: 4060550 - RNA, 21 nt, Staphylococcus aureus subsp. aureus N315
uuacgaucauaaauauuuucu

SEQ ID NO: 4060551 - RNA, 20 nt, Staphylococcus aureus subsp. aureus N315
uuacggcauaauuuuuuaau

SEQ ID NO: 4060552 - RNA, 12 nt, Staphylococcus aureus subsp. aureus N315
uuacuaaaacaa

SEQ ID NO: 4060553 - RNA, 15 nt, Staphylococcus aureus subsp. aureus N315
uuacuaccuauuaau

SEQ ID NO: 4060554 - RNA, 15 nt, Staphylococcus aureus subsp. aureus N315
uuacuacuuaauuaa

SEQ ID NO: 4060555 - RNA, 16 nt, Staphylococcus aureus subsp. aureus N315
uuacuacuuaauuaau

SEQ ID NO: 4060556 - RNA, 18 nt, Staphylococcus aureus subsp. aureus N315
uuacuaggaauauaaaac

SEQ ID NO: 4060557 - RNA, 18 nt, Staphylococcus aureus subsp. aureus N315
uuacuauggcauuauugc

SEQ ID NO: 4060558 - RNA, 15 nt, Staphylococcus aureus subsp. aureus N315
uuacuauuaaaggaa

SEQ ID NO: 4060559 - RNA, 18 nt, Staphylococcus aureus subsp. aureus N315
uuacucauauugaauacu

SEQ ID NO: 4060560 - RNA, 17 nt, Staphylococcus aureus subsp. aureus N315
uuacucauuuuucuugu

SEQ ID NO: 4060561 - RNA, 13 nt, Staphylococcus aureus subsp. aureus N315
uuacuccuuacaa

SEQ ID NO: 4060562 - RNA, 19 nt, Staphylococcus aureus subsp. aureus N315
uuacucuacacucaaacaa

SEQ ID NO: 4060563 - RNA, 15 nt, Staphylococcus aureus subsp. aureus N315
uuacuguaaauauga

SEQ ID NO: 4060564 - RNA, 16 nt, Staphylococcus aureus subsp. aureus N315
uuacuuauauauucaa

SEQ ID NO: 4060565 - RNA, 17 nt, Staphylococcus aureus subsp. aureus N315
uuacuuauauauucaau

SEQ ID NO: 4060566 - RNA, 11 nt, Staphylococcus aureus subsp. aureus N315
uuacuucaguu

SEQ ID NO: 4060567 - RNA, 13 nt, Staphylococcus aureus subsp. aureus N315
uuacuucaguuug

SEQ ID NO: 4060568 - RNA, 18 nt, Staphylococcus aureus subsp. aureus N315
uuacuucuaauaguaaug

SEQ ID NO: 4060569 - RNA, 17 nt, Staphylococcus aureus subsp. aureus N315
uuacuugcuuuuucaaa

SEQ ID NO: 4060570 - RNA, 22 nt, Staphylococcus aureus subsp. aureus N315
uuacuugcuuuuucaaauaaua

SEQ ID NO: 4060571 - RNA, 16 nt, Staphylococcus aureus subsp. aureus N315
uuacuuucgcuugcaa

SEQ ID NO: 4060572 - RNA, 16 nt, Staphylococcus aureus subsp. aureus N315
uuacuuuggaaauuua

SEQ ID NO: 4060573 - RNA, 22 nt, Staphylococcus aureus subsp. aureus N315
uuacuuuucuaaacaacuucug

SEQ ID NO: 4060574 - RNA, 19 nt, Staphylococcus aureus subsp. aureus N315
uuagaaaaguaaguaaaau

SEQ ID NO: 4060575 - RNA, 19 nt, Staphylococcus aureus subsp. aureus N315
uuagaaaguauuuauuucu

SEQ ID NO: 4060576 - RNA, 23 nt, Staphylococcus aureus subsp. aureus N315
uuagaaccaucauucauauggaa

SEQ ID NO: 4060577 - RNA, 13 nt, Staphylococcus aureus subsp. aureus N315
uuagaagaaacuu

SEQ ID NO: 4060578 - RNA, 18 nt, Staphylococcus aureus subsp. aureus N315
uuagaagaugauuauucu

SEQ ID NO: 4060579 - RNA, 20 nt, Staphylococcus aureus subsp. aureus N315
uuagaagaugauuauucucu

SEQ ID NO: 4060580 - RNA, 22 nt, Staphylococcus aureus subsp. aureus N315
uuagaauaagaaauaaaaggaa

SEQ ID NO: 4060581 - RNA, 19 nt, Staphylococcus aureus subsp. aureus N315
uuagaauuaguacuugaaa

SEQ ID NO: 4060582 - RNA, 18 nt, Staphylococcus aureus subsp. aureus N315
uuagacgcuguuuuaaau

SEQ ID NO: 4060583 - RNA, 18 nt, Staphylococcus aureus subsp. aureus N315
uuagacuaaaaaacuaac

SEQ ID NO: 4060584 - RNA, 16 nt, Staphylococcus aureus subsp. aureus N315
uuagagaagaauucuc

SEQ ID NO: 4060585 - RNA, 22 nt, Staphylococcus aureus subsp. aureus N315
uuagauaaacucuaaauaaaca

SEQ ID NO: 4060586 - RNA, 17 nt, Staphylococcus aureus subsp. aureus N315
uuagauauauaaagguu

SEQ ID NO: 4060587 - RNA, 20 nt, Staphylococcus aureus subsp. aureus N315
uuagauauauuugaaaggua

SEQ ID NO: 4060588 - RNA, 21 nt, Staphylococcus aureus subsp. aureus N315
uuagauauauuugaaagguaa

SEQ ID NO: 4060589 - RNA, 15 nt, Staphylococcus aureus subsp. aureus N315
uuagauaucuuaauc

SEQ ID NO: 4060590 - RNA, 16 nt, Staphylococcus aureus subsp. aureus N315
uuagaugcauaaaaaa

SEQ ID NO: 4060591 - RNA, 19 nt, Staphylococcus aureus subsp. aureus N315
uuagaugcauaaaaaaaga

SEQ ID NO: 4060592 - RNA, 20 nt, Staphylococcus aureus subsp. aureus N315
uuagaugcauaaaaaaagaa

SEQ ID NO: 4060593 - RNA, 14 nt, Staphylococcus aureus subsp. aureus N315
uuagauugacuaag

SEQ ID NO: 4060594 - RNA, 17 nt, Staphylococcus aureus subsp. aureus N315
uuagauuuuauauaaaa

SEQ ID NO: 4060595 - RNA, 18 nt, Staphylococcus aureus subsp. aureus N315
uuagauuuuauauaaaaa

SEQ ID NO: 4060596 - RNA, 19 nt, Staphylococcus aureus subsp. aureus N315
uuagauuuucacuaauauu

SEQ ID NO: 4060597 - RNA, 20 nt, Staphylococcus aureus subsp. aureus N315
uuagcaaaaauauuuaaacu

SEQ ID NO: 4060598 - RNA, 15 nt, Staphylococcus aureus subsp. aureus N315
uuagcaaauauuucu

SEQ ID NO: 4060599 - RNA, 14 nt, Staphylococcus aureus subsp. aureus N315
uuagcauacauuaa

SEQ ID NO: 4060600 - RNA, 13 nt, Staphylococcus aureus subsp. aureus N315
uuagcaucaaaaa

SEQ ID NO: 4060601 - RNA, 14 nt, Staphylococcus aureus subsp. aureus N315
uuagcaucugcaug

SEQ ID NO: 4060602 - RNA, 17 nt, Staphylococcus aureus subsp. aureus N315
uuagccaaaucuuuaau

SEQ ID NO: 4060603 - RNA, 19 nt, Staphylococcus aureus subsp. aureus N315
uuagccaauaccgaauaau

SEQ ID NO: 4060604 - RNA, 14 nt, Staphylococcus aureus subsp. aureus N315
uuagcccuccuaag

SEQ ID NO: 4060605 - RNA, 19 nt, Staphylococcus aureus subsp. aureus N315
uuagcgcaccaauuaucaa

SEQ ID NO: 4060606 - RNA, 15 nt, Staphylococcus aureus subsp. aureus N315
uuagcuugcuuacaa

SEQ ID NO: 4060607 - RNA, 15 nt, Staphylococcus aureus subsp. aureus N315
uuaggcgacuuaacu

SEQ ID NO: 4060608 - RNA, 17 nt, Staphylococcus aureus subsp. aureus N315
uuaggcuuaaauauaau

SEQ ID NO: 4060609 - RNA, 21 nt, Staphylococcus aureus subsp. aureus N315
uuaggcuuauuaacuuuuccu

SEQ ID NO: 4060610 - RNA, 17 nt, Staphylococcus aureus subsp. aureus N315
uuagggaaauguagauu

SEQ ID NO: 4060611 - RNA, 22 nt, Staphylococcus aureus subsp. aureus N315
uuagguaauacaucaucaaguu

SEQ ID NO: 4060612 - RNA, 12 nt, Staphylococcus aureus subsp. aureus N315
uuagguauauaa

SEQ ID NO: 4060613 - RNA, 19 nt, Staphylococcus aureus subsp. aureus N315
uuaggucuacgaucaaaau

SEQ ID NO: 4060614 - RNA, 14 nt, Staphylococcus aureus subsp. aureus N315
uuagguuacuuauu

SEQ ID NO: 4060615 - RNA, 13 nt, Staphylococcus aureus subsp. aureus N315
uuaguaaauauag

SEQ ID NO: 4060616 - RNA, 15 nt, Staphylococcus aureus subsp. aureus N315
uuaguaaggaauauu

SEQ ID NO: 4060617 - RNA, 19 nt, Staphylococcus aureus subsp. aureus N315
uuaguaaggaauauuuccc

SEQ ID NO: 4060618 - RNA, 12 nt, Staphylococcus aureus subsp. aureus N315
uuaguaauaaca

SEQ ID NO: 4060619 - RNA, 19 nt, Staphylococcus aureus subsp. aureus N315
uuaguaauaacaucuaaau

SEQ ID NO: 4060620 - RNA, 18 nt, Staphylococcus aureus subsp. aureus N315
uuaguaauuuuuaaaucu

SEQ ID NO: 4060621 - RNA, 14 nt, Staphylococcus aureus subsp. aureus N315
uuaguacaaaauug

SEQ ID NO: 4060622 - RNA, 15 nt, Staphylococcus aureus subsp. aureus N315
uuaguacaaaauugu

SEQ ID NO: 4060623 - RNA, 18 nt, Staphylococcus aureus subsp. aureus N315
uuaguacacguguauugu

SEQ ID NO: 4060624 - RNA, 20 nt, Staphylococcus aureus subsp. aureus N315
uuaguacauauguuguuucu

SEQ ID NO: 4060625 - RNA, 21 nt, Staphylococcus aureus subsp. aureus N315
uuaguacggcugcuuuaacug

SEQ ID NO: 4060626 - RNA, 22 nt, Staphylococcus aureus subsp. aureus N315
uuaguacuaaaccgauuaauau

SEQ ID NO: 4060627 - RNA, 24 nt, Staphylococcus aureus subsp. aureus N315
uuaguacuaaaccgauuaauauaa

SEQ ID NO: 4060628 - RNA, 18 nt, Staphylococcus aureus subsp. aureus N315
uuaguacuuugauaucua

SEQ ID NO: 4060629 - RNA, 17 nt, Staphylococcus aureus subsp. aureus N315
uuaguaguuguacuucu

SEQ ID NO: 4060630 - RNA, 18 nt, Staphylococcus aureus subsp. aureus N315
uuaguauaaauaaaaaua

SEQ ID NO: 4060631 - RNA, 14 nt, Staphylococcus aureus subsp. aureus N315
uuaguaucuauaca

SEQ ID NO: 4060632 - RNA, 19 nt, Staphylococcus aureus subsp. aureus N315
uuaguauggaauaaauggu

SEQ ID NO: 4060633 - RNA, 14 nt, Staphylococcus aureus subsp. aureus N315
uuagucauguuugg

SEQ ID NO: 4060634 - RNA, 17 nt, Staphylococcus aureus subsp. aureus N315
uuagucuuuuuaaguau

SEQ ID NO: 4060635 - RNA, 23 nt, Staphylococcus aureus subsp. aureus N315
uuagugaaacaauuuguaacuau

SEQ ID NO: 4060636 - RNA, 23 nt, Staphylococcus aureus subsp. aureus N315
uuagugacaaguaugucaucuuc

SEQ ID NO: 4060637 - RNA, 18 nt, Staphylococcus aureus subsp. aureus N315
uuaguuaauuauuuagau

SEQ ID NO: 4060638 - RNA, 15 nt, Staphylococcus aureus subsp. aureus N315
uuaguuauacuacua

SEQ ID NO: 4060639 - RNA, 13 nt, Staphylococcus aureus subsp. aureus N315
uuaguuuuuaaaa

SEQ ID NO: 4060640 - RNA, 21 nt, Staphylococcus aureus subsp. aureus N315
uuauaaaaaaucaguuuuuaa

SEQ ID NO: 4060641 - RNA, 20 nt, Staphylococcus aureus subsp. aureus N315
uuauaaaaacagcagugaag

SEQ ID NO: 4060642 - RNA, 21 nt, Staphylococcus aureus subsp. aureus N315
uuauaaaaaggccucuugaaa

SEQ ID NO: 4060643 - RNA, 16 nt, Staphylococcus aureus subsp. aureus N315
uuauaaacauagguag

SEQ ID NO: 4060644 - RNA, 22 nt, Staphylococcus aureus subsp. aureus N315
uuauaaagacaccuucaauauc

SEQ ID NO: 4060645 - RNA, 23 nt, Staphylococcus aureus subsp. aureus N315
uuauaaagauagaaugaauaauu

SEQ ID NO: 4060646 - RNA, 13 nt, Staphylococcus aureus subsp. aureus N315
uuauaaagcugcg

SEQ ID NO: 4060647 - RNA, 21 nt, Staphylococcus aureus subsp. aureus N315
uuauaaagcugcgaaacuugu

SEQ ID NO: 4060648 - RNA, 13 nt, Staphylococcus aureus subsp. aureus N315
uuauaaauauuuu

SEQ ID NO: 4060649 - RNA, 16 nt, Staphylococcus aureus subsp. aureus N315
uuauaaauauuuuuug

SEQ ID NO: 4060650 - RNA, 15 nt, Staphylococcus aureus subsp. aureus N315
uuauaaaucaaagag

SEQ ID NO: 4060651 - RNA, 17 nt, Staphylococcus aureus subsp. aureus N315
uuauaaaucaaagagga

SEQ ID NO: 4060652 - RNA, 19 nt, Staphylococcus aureus subsp. aureus N315
uuauaaauucuaucuauaa

SEQ ID NO: 4060653 - RNA, 12 nt, Staphylococcus aureus subsp. aureus N315
uuauaaauuucg

SEQ ID NO: 4060654 - RNA, 23 nt, Staphylococcus aureus subsp. aureus N315
uuauaaauuucgauuaauugaau

SEQ ID NO: 4060655 - RNA, 17 nt, Staphylococcus aureus subsp. aureus N315
uuauaacauccccuucu

SEQ ID NO: 4060656 - RNA, 16 nt, Staphylococcus aureus subsp. aureus N315
uuauaacauucuucaa

SEQ ID NO: 4060657 - RNA, 19 nt, Staphylococcus aureus subsp. aureus N315
uuauaacgcuuuaauauaa

SEQ ID NO: 4060658 - RNA, 14 nt, Staphylococcus aureus subsp. aureus N315
uuauaaguaaauaa

SEQ ID NO: 4060659 - RNA, 16 nt, Staphylococcus aureus subsp. aureus N315
uuauaaguaaauaaua

SEQ ID NO: 4060660 - RNA, 12 nt, Staphylococcus aureus subsp. aureus N315
uuauaaguacaa

SEQ ID NO: 4060661 - RNA, 22 nt, Staphylococcus aureus subsp. aureus N315
uuauaaguaucgccaucauuca

SEQ ID NO: 4060662 - RNA, 21 nt, Staphylococcus aureus subsp. aureus N315
uuauaauacguguguuuucuu

SEQ ID NO: 4060663 - RNA, 15 nt, Staphylococcus aureus subsp. aureus N315
uuauaauagagaaac

SEQ ID NO: 4060664 - RNA, 17 nt, Staphylococcus aureus subsp. aureus N315
uuauaauauuaaauugc

SEQ ID NO: 4060665 - RNA, 17 nt, Staphylococcus aureus subsp. aureus N315
uuauaauggcaguaguu

SEQ ID NO: 4060666 - RNA, 17 nt, Staphylococcus aureus subsp. aureus N315
uuauacacuuacaaaua

SEQ ID NO: 4060667 - RNA, 12 nt, Staphylococcus aureus subsp. aureus N315
uuauacauguac

SEQ ID NO: 4060668 - RNA, 19 nt, Staphylococcus aureus subsp. aureus N315
uuauacauguacauuauca

SEQ ID NO: 4060669 - RNA, 16 nt, Staphylococcus aureus subsp. aureus N315
uuauacauuagccaca

SEQ ID NO: 4060670 - RNA, 22 nt, Staphylococcus aureus subsp. aureus N315
uuauacgaaucacaguuauaua

SEQ ID NO: 4060671 - RNA, 23 nt, Staphylococcus aureus subsp. aureus N315
uuauacgugcuuuaaaguuguug

SEQ ID NO: 4060672 - RNA, 19 nt, Staphylococcus aureus subsp. aureus N315
uuauacuaaauugagaagu

SEQ ID NO: 4060673 - RNA, 13 nt, Staphylococcus aureus subsp. aureus N315
uuauacuacuauu

SEQ ID NO: 4060674 - RNA, 23 nt, Staphylococcus aureus subsp. aureus N315
uuauacuauaaauacaaauauau

SEQ ID NO: 4060675 - RNA, 19 nt, Staphylococcus aureus subsp. aureus N315
uuauacuuuuggucuguug

SEQ ID NO: 4060676 - RNA, 20 nt, Staphylococcus aureus subsp. aureus N315
uuauagccuucauuugcgau

SEQ ID NO: 4060677 - RNA, 16 nt, Staphylococcus aureus subsp. aureus N315
uuauagguauaagaau

SEQ ID NO: 4060678 - RNA, 15 nt, Staphylococcus aureus subsp. aureus N315
uuauagugguaaaaa

SEQ ID NO: 4060679 - RNA, 14 nt, Staphylococcus aureus subsp. aureus N315
uuauauaaaauuuc

SEQ ID NO: 4060680 - RNA, 23 nt, Staphylococcus aureus subsp. aureus N315
uuauauaaaauuucauauuguuu

SEQ ID NO: 4060681 - RNA, 22 nt, Staphylococcus aureus subsp. aureus N315
uuauauaacacgauaauuauac

SEQ ID NO: 4060682 - RNA, 17 nt, Staphylococcus aureus subsp. aureus N315
uuauauaauucuucaaa

SEQ ID NO: 4060683 - RNA, 21 nt, Staphylococcus aureus subsp. aureus N315
uuauauagauugccauucaua

SEQ ID NO: 4060684 - RNA, 14 nt, Staphylococcus aureus subsp. aureus N315
uuauauaucacaua

SEQ ID NO: 4060685 - RNA, 15 nt, Staphylococcus aureus subsp. aureus N315
uuauauauucaauaa

SEQ ID NO: 4060686 - RNA, 16 nt, Staphylococcus aureus subsp. aureus N315
uuauauauucaauaau

SEQ ID NO: 4060687 - RNA, 13 nt, Staphylococcus aureus subsp. aureus N315
uuauaucaaaauc

SEQ ID NO: 4060688 - RNA, 21 nt, Staphylococcus aureus subsp. aureus N315
uuauaucauucuguguaaaua

SEQ ID NO: 4060689 - RNA, 23 nt, Staphylococcus aureus subsp. aureus N315
uuauauccaucuccaccauuaau

SEQ ID NO: 4060690 - RNA, 16 nt, Staphylococcus aureus subsp. aureus N315
uuauaucuuaaguaca

SEQ ID NO: 4060691 - RNA, 20 nt, Staphylococcus aureus subsp. aureus N315
uuauaugaagcguuuuuauu

SEQ ID NO: 4060692 - RNA, 14 nt, Staphylococcus aureus subsp. aureus N315
uuauaugcaacuua

SEQ ID NO: 4060693 - RNA, 15 nt, Staphylococcus aureus subsp. aureus N315
uuauauguuauauua

SEQ ID NO: 4060694 - RNA, 21 nt, Staphylococcus aureus subsp. aureus N315
uuauauguuuuaugauuuucu

SEQ ID NO: 4060695 - RNA, 19 nt, Staphylococcus aureus subsp. aureus N315
uuauauucaacuuauuauu

SEQ ID NO: 4060696 - RNA, 15 nt, Staphylococcus aureus subsp. aureus N315
uuauauugcaaaaau

SEQ ID NO: 4060697 - RNA, 17 nt, Staphylococcus aureus subsp. aureus N315
uuauauugcaaaaauaa

SEQ ID NO: 4060698 - RNA, 18 nt, Staphylococcus aureus subsp. aureus N315
uuauauugcaaaaauaau

SEQ ID NO: 4060699 - RNA, 22 nt, Staphylococcus aureus subsp. aureus N315
uuauauugcaaaaauaauauga

SEQ ID NO: 4060700 - RNA, 14 nt, Staphylococcus aureus subsp. aureus N315
uuauauuguauuuu

SEQ ID NO: 4060701 - RNA, 18 nt, Staphylococcus aureus subsp. aureus N315
uuauauuguauuuuauuu

SEQ ID NO: 4060702 - RNA, 14 nt, Staphylococcus aureus subsp. aureus N315
uuauauuuaaacuc

SEQ ID NO: 4060703 - RNA, 13 nt, Staphylococcus aureus subsp. aureus N315
uuauauuuuauua

SEQ ID NO: 4060704 - RNA, 17 nt, Staphylococcus aureus subsp. aureus N315
uuauauuuuauuuaaaa

SEQ ID NO: 4060705 - RNA, 18 nt, Staphylococcus aureus subsp. aureus N315
uuauauuuuauuuaaaaa

SEQ ID NO: 4060706 - RNA, 19 nt, Staphylococcus aureus subsp. aureus N315
uuauauuuugaaucaguau

SEQ ID NO: 4060707 - RNA, 18 nt, Staphylococcus aureus subsp. aureus N315
uuauauuuuucuucaguu

SEQ ID NO: 4060708 - RNA, 14 nt, Staphylococcus aureus subsp. aureus N315
uuaucaaauugacc

SEQ ID NO: 4060709 - RNA, 15 nt, Staphylococcus aureus subsp. aureus N315
uuaucaacaaauuua

SEQ ID NO: 4060710 - RNA, 17 nt, Staphylococcus aureus subsp. aureus N315
uuaucaacauaaaauuu

SEQ ID NO: 4060711 - RNA, 20 nt, Staphylococcus aureus subsp. aureus N315
uuaucaacgauuuugucuuu

SEQ ID NO: 4060712 - RNA, 20 nt, Staphylococcus aureus subsp. aureus N315
uuaucaauuucuauuucacu

SEQ ID NO: 4060713 - RNA, 20 nt, Staphylococcus aureus subsp. aureus N315
uuaucacgugcuucguuuuu

SEQ ID NO: 4060714 - RNA, 18 nt, Staphylococcus aureus subsp. aureus N315
uuaucagcgaaauuugua

SEQ ID NO: 4060715 - RNA, 14 nt, Staphylococcus aureus subsp. aureus N315
uuaucagguuaaca

SEQ ID NO: 4060716 - RNA, 18 nt, Staphylococcus aureus subsp. aureus N315
uuaucaucacacucuccc

SEQ ID NO: 4060717 - RNA, 14 nt, Staphylococcus aureus subsp. aureus N315
uuaucaucuauuca

SEQ ID NO: 4060718 - RNA, 16 nt, Staphylococcus aureus subsp. aureus N315
uuaucauuacagauaa

SEQ ID NO: 4060719 - RNA, 12 nt, Staphylococcus aureus subsp. aureus N315
uuaucauuauuc

SEQ ID NO: 4060720 - RNA, 13 nt, Staphylococcus aureus subsp. aureus N315
uuaucauuauucg

SEQ ID NO: 4060721 - RNA, 20 nt, Staphylococcus aureus subsp. aureus N315
uuaucauuuuuaauuuugac

SEQ ID NO: 4060722 - RNA, 15 nt, Staphylococcus aureus subsp. aureus N315
uuauccaaaacauuu

SEQ ID NO: 4060723 - RNA, 17 nt, Staphylococcus aureus subsp. aureus N315
uuaucgaagaaacauua

SEQ ID NO: 4060724 - RNA, 17 nt, Staphylococcus aureus subsp. aureus N315
uuaucgaucgguauuuu

SEQ ID NO: 4060725 - RNA, 17 nt, Staphylococcus aureus subsp. aureus N315
uuaucguaaaaaaacgu

SEQ ID NO: 4060726 - RNA, 17 nt, Staphylococcus aureus subsp. aureus N315
uuaucgugaagaaaaaa

SEQ ID NO: 4060727 - RNA, 15 nt, Staphylococcus aureus subsp. aureus N315
uuaucuaaacauuuu

SEQ ID NO: 4060728 - RNA, 20 nt, Staphylococcus aureus subsp. aureus N315
uuaucuaaagcuauaaaaaa

SEQ ID NO: 4060729 - RNA, 20 nt, Staphylococcus aureus subsp. aureus N315
uuaucuaaaucuucaucauc

SEQ ID NO: 4060730 - RNA, 14 nt, Staphylococcus aureus subsp. aureus N315
uuaucuaacucaua

SEQ ID NO: 4060731 - RNA, 14 nt, Staphylococcus aureus subsp. aureus N315
uuaucuauauauga

SEQ ID NO: 4060732 - RNA, 16 nt, Staphylococcus aureus subsp. aureus N315
uuaucugaaaauauca

SEQ ID NO: 4060733 - RNA, 19 nt, Staphylococcus aureus subsp. aureus N315
uuaucuguagaaacacuuu

SEQ ID NO: 4060734 - RNA, 20 nt, Staphylococcus aureus subsp. aureus N315
uuaucuguagauuagcuuaa

SEQ ID NO: 4060735 - RNA, 13 nt, Staphylococcus aureus subsp. aureus N315
uuaucuuuaagua

SEQ ID NO: 4060736 - RNA, 16 nt, Staphylococcus aureus subsp. aureus N315
uuaucuuuaauuuaca

SEQ ID NO: 4060737 - RNA, 15 nt, Staphylococcus aureus subsp. aureus N315
uuaucuuuacgauaa

SEQ ID NO: 4060738 - RNA, 13 nt, Staphylococcus aureus subsp. aureus N315
uuaugaaaaguaa

SEQ ID NO: 4060739 - RNA, 20 nt, Staphylococcus aureus subsp. aureus N315
uuaugacaaaguucugcaau

SEQ ID NO: 4060740 - RNA, 15 nt, Staphylococcus aureus subsp. aureus N315
uuaugagcuuaauaa

SEQ ID NO: 4060741 - RNA, 14 nt, Staphylococcus aureus subsp. aureus N315
uuaugaggcugagu

SEQ ID NO: 4060742 - RNA, 20 nt, Staphylococcus aureus subsp. aureus N315
uuaugauacugauauuuaga

SEQ ID NO: 4060743 - RNA, 14 nt, Staphylococcus aureus subsp. aureus N315
uuaugauuauauuu

SEQ ID NO: 4060744 - RNA, 19 nt, Staphylococcus aureus subsp. aureus N315
uuaugcauauguaauacaa

SEQ ID NO: 4060745 - RNA, 21 nt, Staphylococcus aureus subsp. aureus N315
uuaugcauauguaauacaaaa

SEQ ID NO: 4060746 - RNA, 18 nt, Staphylococcus aureus subsp. aureus N315
uuaugcaugcgcaaaagc

SEQ ID NO: 4060747 - RNA, 21 nt, Staphylococcus aureus subsp. aureus N315
uuaugcaugcgcaaaagcgca

SEQ ID NO: 4060748 - RNA, 23 nt, Staphylococcus aureus subsp. aureus N315
uuaugccaacacguuuuaagcca

SEQ ID NO: 4060749 - RNA, 18 nt, Staphylococcus aureus subsp. aureus N315
uuaugccauucauuaagc

SEQ ID NO: 4060750 - RNA, 17 nt, Staphylococcus aureus subsp. aureus N315
uuaugcccgauaauucu

SEQ ID NO: 4060751 - RNA, 16 nt, Staphylococcus aureus subsp. aureus N315
uuaugcuagaaaguaa

SEQ ID NO: 4060752 - RNA, 14 nt, Staphylococcus aureus subsp. aureus N315
uuaugcuuuaaauc

SEQ ID NO: 4060753 - RNA, 22 nt, Staphylococcus aureus subsp. aureus N315
uuauggcagauccauaaggauu

SEQ ID NO: 4060754 - RNA, 17 nt, Staphylococcus aureus subsp. aureus N315
uuaugggguguauuuuu

SEQ ID NO: 4060755 - RNA, 14 nt, Staphylococcus aureus subsp. aureus N315
uuauguaaaaaaua

SEQ ID NO: 4060756 - RNA, 15 nt, Staphylococcus aureus subsp. aureus N315
uuauguacuacauac

SEQ ID NO: 4060757 - RNA, 18 nt, Staphylococcus aureus subsp. aureus N315
uuauguagauuuuaauau

SEQ ID NO: 4060758 - RNA, 15 nt, Staphylococcus aureus subsp. aureus N315
uuaugucccaaugcu

SEQ ID NO: 4060759 - RNA, 12 nt, Staphylococcus aureus subsp. aureus N315
uuaugugcauca

SEQ ID NO: 4060760 - RNA, 18 nt, Staphylococcus aureus subsp. aureus N315
uuaugugcuaaucuauuu

SEQ ID NO: 4060761 - RNA, 20 nt, Staphylococcus aureus subsp. aureus N315
uuauguuauaaauucuaucu

SEQ ID NO: 4060762 - RNA, 17 nt, Staphylococcus aureus subsp. aureus N315
uuauguucgauuauucu

SEQ ID NO: 4060763 - RNA, 13 nt, Staphylococcus aureus subsp. aureus N315
uuauuaaauaaca

SEQ ID NO: 4060764 - RNA, 12 nt, Staphylococcus aureus subsp. aureus N315
uuauuaaaucag

SEQ ID NO: 4060765 - RNA, 13 nt, Staphylococcus aureus subsp. aureus N315
uuauuaaaucuuu

SEQ ID NO: 4060766 - RNA, 12 nt, Staphylococcus aureus subsp. aureus N315
uuauuaacuuua

SEQ ID NO: 4060767 - RNA, 18 nt, Staphylococcus aureus subsp. aureus N315
uuauuaacuuuaauauaa

SEQ ID NO: 4060768 - RNA, 22 nt, Staphylococcus aureus subsp. aureus N315
uuauuaaggggguaauacuaua

SEQ ID NO: 4060769 - RNA, 23 nt, Staphylococcus aureus subsp. aureus N315
uuauuaauaaauucucuuggaua

SEQ ID NO: 4060770 - RNA, 22 nt, Staphylococcus aureus subsp. aureus N315
uuauuaauggcaacuaagauga

SEQ ID NO: 4060771 - RNA, 22 nt, Staphylococcus aureus subsp. aureus N315
uuauuaauuaaaaaauuccuag

SEQ ID NO: 4060772 - RNA, 22 nt, Staphylococcus aureus subsp. aureus N315
uuauuaauucugauuauguuca

SEQ ID NO: 4060773 - RNA, 22 nt, Staphylococcus aureus subsp. aureus N315
uuauuacaaacauuccucuauu

SEQ ID NO: 4060774 - RNA, 21 nt, Staphylococcus aureus subsp. aureus N315
uuauuacaaugaaaaaacgag

SEQ ID NO: 4060775 - RNA, 18 nt, Staphylococcus aureus subsp. aureus N315
uuauuacauaauuuaucu

SEQ ID NO: 4060776 - RNA, 21 nt, Staphylococcus aureus subsp. aureus N315
uuauuaccauaacuuuauaua

SEQ ID NO: 4060777 - RNA, 17 nt, Staphylococcus aureus subsp. aureus N315
uuauuaggauucaauaa

SEQ ID NO: 4060778 - RNA, 23 nt, Staphylococcus aureus subsp. aureus N315
uuauuaggggagauuagagaaga

SEQ ID NO: 4060779 - RNA, 21 nt, Staphylococcus aureus subsp. aureus N315
uuauuaguauucaaaaaauau

SEQ ID NO: 4060780 - RNA, 12 nt, Staphylococcus aureus subsp. aureus N315
uuauuauaaaau

SEQ ID NO: 4060781 - RNA, 12 nt, Staphylococcus aureus subsp. aureus N315
uuauuauacaua

SEQ ID NO: 4060782 - RNA, 14 nt, Staphylococcus aureus subsp. aureus N315
uuauuauauaauaa

SEQ ID NO: 4060783 - RNA, 15 nt, Staphylococcus aureus subsp. aureus N315
uuauuaucuuuguaa

SEQ ID NO: 4060784 - RNA, 19 nt, Staphylococcus aureus subsp. aureus N315
uuauuaucuuuguaaauuu

SEQ ID NO: 4060785 - RNA, 16 nt, Staphylococcus aureus subsp. aureus N315
uuauuaugaauuauua

SEQ ID NO: 4060786 - RNA, 20 nt, Staphylococcus aureus subsp. aureus N315
uuauuaugaauuauuaauaa

SEQ ID NO: 4060787 - RNA, 13 nt, Staphylococcus aureus subsp. aureus N315
uuauuauguguuu

SEQ ID NO: 4060788 - RNA, 20 nt, Staphylococcus aureus subsp. aureus N315
uuauuauguuauaaauucua

SEQ ID NO: 4060789 - RNA, 12 nt, Staphylococcus aureus subsp. aureus N315
uuauuauuaaau

SEQ ID NO: 4060790 - RNA, 20 nt, Staphylococcus aureus subsp. aureus N315
uuauuauuacaaugaaaaaa

SEQ ID NO: 4060791 - RNA, 16 nt, Staphylococcus aureus subsp. aureus N315
uuauuauuuuguauuu

SEQ ID NO: 4060792 - RNA, 20 nt, Staphylococcus aureus subsp. aureus N315
uuauuauuuuguauuuuuca

SEQ ID NO: 4060793 - RNA, 13 nt, Staphylococcus aureus subsp. aureus N315
uuauucaauauuu

SEQ ID NO: 4060794 - RNA, 15 nt, Staphylococcus aureus subsp. aureus N315
uuauucguuaacaau

SEQ ID NO: 4060795 - RNA, 13 nt, Staphylococcus aureus subsp. aureus N315
uuauucuaaauau

SEQ ID NO: 4060796 - RNA, 13 nt, Staphylococcus aureus subsp. aureus N315
uuauucuaauaca

SEQ ID NO: 4060797 - RNA, 14 nt, Staphylococcus aureus subsp. aureus N315
uuauucuaauacaa

SEQ ID NO: 4060798 - RNA, 15 nt, Staphylococcus aureus subsp. aureus N315
uuauucuaauacaaa

SEQ ID NO: 4060799 - RNA, 14 nt, Staphylococcus aureus subsp. aureus N315
uuauucucuuuauu

SEQ ID NO: 4060800 - RNA, 14 nt, Staphylococcus aureus subsp. aureus N315
uuauucuucacuuu

SEQ ID NO: 4060801 - RNA, 13 nt, Staphylococcus aureus subsp. aureus N315
uuauucuucccaa

SEQ ID NO: 4060802 - RNA, 12 nt, Staphylococcus aureus subsp. aureus N315
uuauucuuucuc

SEQ ID NO: 4060803 - RNA, 15 nt, Staphylococcus aureus subsp. aureus N315
uuauugaaaagauaa

SEQ ID NO: 4060804 - RNA, 13 nt, Staphylococcus aureus subsp. aureus N315
uuauugaaacuaa

SEQ ID NO: 4060805 - RNA, 22 nt, Staphylococcus aureus subsp. aureus N315
uuauugagaauauuuauuguuu

SEQ ID NO: 4060806 - RNA, 14 nt, Staphylococcus aureus subsp. aureus N315
uuauugaugaaaac

SEQ ID NO: 4060807 - RNA, 18 nt, Staphylococcus aureus subsp. aureus N315
uuauugccgguuaaauua

SEQ ID NO: 4060808 - RNA, 20 nt, Staphylococcus aureus subsp. aureus N315
uuauugccgguuaaauuauu

SEQ ID NO: 4060809 - RNA, 22 nt, Staphylococcus aureus subsp. aureus N315
uuauugucaucauguucuaaug

SEQ ID NO: 4060810 - RNA, 17 nt, Staphylococcus aureus subsp. aureus N315
uuauuguuuuuaaaauc

SEQ ID NO: 4060811 - RNA, 13 nt, Staphylococcus aureus subsp. aureus N315
uuauuuaaaaugc

SEQ ID NO: 4060812 - RNA, 15 nt, Staphylococcus aureus subsp. aureus N315
uuauuuaauaacgaa

SEQ ID NO: 4060813 - RNA, 20 nt, Staphylococcus aureus subsp. aureus N315
uuauuuaaucguaacauauc

SEQ ID NO: 4060814 - RNA, 20 nt, Staphylococcus aureus subsp. aureus N315
uuauuuagaauucuaaaaga

SEQ ID NO: 4060815 - RNA, 17 nt, Staphylococcus aureus subsp. aureus N315
uuauuuauacuaaagca

SEQ ID NO: 4060816 - RNA, 23 nt, Staphylococcus aureus subsp. aureus N315
uuauuuccuguuacuuucacauu

SEQ ID NO: 4060817 - RNA, 22 nt, Staphylococcus aureus subsp. aureus N315
uuauuugaaaugauaagaauca

SEQ ID NO: 4060818 - RNA, 19 nt, Staphylococcus aureus subsp. aureus N315
uuauuugauaaauaaaauu

SEQ ID NO: 4060819 - RNA, 18 nt, Staphylococcus aureus subsp. aureus N315
uuauuuguuuaauuaucu

SEQ ID NO: 4060820 - RNA, 12 nt, Staphylococcus aureus subsp. aureus N315
uuauuuucaaua

SEQ ID NO: 4060821 - RNA, 17 nt, Staphylococcus aureus subsp. aureus N315
uuauuuucaauaaauaa

SEQ ID NO: 4060822 - RNA, 20 nt, Staphylococcus aureus subsp. aureus N315
uuauuuucaauaaauaaaca

SEQ ID NO: 4060823 - RNA, 17 nt, Staphylococcus aureus subsp. aureus N315
uuauuuucaauaaauuu

SEQ ID NO: 4060824 - RNA, 18 nt, Staphylococcus aureus subsp. aureus N315
uuauuuucaguuaaaaua

SEQ ID NO: 4060825 - RNA, 23 nt, Staphylococcus aureus subsp. aureus N315
uuauuuucauauaaauagcuucu

SEQ ID NO: 4060826 - RNA, 21 nt, Staphylococcus aureus subsp. aureus N315
uuauuuucuuuggugaaagua

SEQ ID NO: 4060827 - RNA, 16 nt, Staphylococcus aureus subsp. aureus N315
uuauuuuuauucaguu

SEQ ID NO: 4060828 - RNA, 17 nt, Staphylococcus aureus subsp. aureus N315
uuauuuuuuucuuucuu

SEQ ID NO: 4060829 - RNA, 12 nt, Staphylococcus aureus subsp. aureus N315
uucaaaaaauau

SEQ ID NO: 4060830 - RNA, 13 nt, Staphylococcus aureus subsp. aureus N315
uucaaaaaauauu

SEQ ID NO: 4060831 - RNA, 14 nt, Staphylococcus aureus subsp. aureus N315
uucaaaaaauauuu

SEQ ID NO: 4060832 - RNA, 22 nt, Staphylococcus aureus subsp. aureus N315
uucaaaaagguauucaaauaaa

SEQ ID NO: 4060833 - RNA, 16 nt, Staphylococcus aureus subsp. aureus N315
uucaaaaaucauacca

SEQ ID NO: 4060834 - RNA, 20 nt, Staphylococcus aureus subsp. aureus N315
uucaaaacguuuaauugcag

SEQ ID NO: 4060835 - RNA, 17 nt, Staphylococcus aureus subsp. aureus N315
uucaaaacuagcaguaa

SEQ ID NO: 4060836 - RNA, 20 nt, Staphylococcus aureus subsp. aureus N315
uucaaaacuagcaguaauau

SEQ ID NO: 4060837 - RNA, 14 nt, Staphylococcus aureus subsp. aureus N315
uucaaaacugccaa

SEQ ID NO: 4060838 - RNA, 23 nt, Staphylococcus aureus subsp. aureus N315
uucaaaagaaauuguguuucuuu

SEQ ID NO: 4060839 - RNA, 15 nt, Staphylococcus aureus subsp. aureus N315
uucaaaaguaaaagc

SEQ ID NO: 4060840 - RNA, 13 nt, Staphylococcus aureus subsp. aureus N315
uucaaaauaguaa

SEQ ID NO: 4060841 - RNA, 17 nt, Staphylococcus aureus subsp. aureus N315
uucaaaaucuuuaucag

SEQ ID NO: 4060842 - RNA, 13 nt, Staphylococcus aureus subsp. aureus N315
uucaaacaauaca

SEQ ID NO: 4060843 - RNA, 13 nt, Staphylococcus aureus subsp. aureus N315
uucaaacagaaau

SEQ ID NO: 4060844 - RNA, 12 nt, Staphylococcus aureus subsp. aureus N315
uucaaagcgaua

SEQ ID NO: 4060845 - RNA, 17 nt, Staphylococcus aureus subsp. aureus N315
uucaaagcugucaacuu

SEQ ID NO: 4060846 - RNA, 15 nt, Staphylococcus aureus subsp. aureus N315
uucaaaguagacauu

SEQ ID NO: 4060847 - RNA, 15 nt, Staphylococcus aureus subsp. aureus N315
uucaaauaauauaaa

SEQ ID NO: 4060848 - RNA, 16 nt, Staphylococcus aureus subsp. aureus N315
uucaaauaauauaaaa

SEQ ID NO: 4060849 - RNA, 19 nt, Staphylococcus aureus subsp. aureus N315
uucaaauauaucuaauacu

SEQ ID NO: 4060850 - RNA, 21 nt, Staphylococcus aureus subsp. aureus N315
uucaaaucuggcacuuaagcu

SEQ ID NO: 4060851 - RNA, 21 nt, Staphylococcus aureus subsp. aureus N315
uucaaaugcuuaauaaaauca

SEQ ID NO: 4060852 - RNA, 19 nt, Staphylococcus aureus subsp. aureus N315
uucaaauguaacauuaaaa

SEQ ID NO: 4060853 - RNA, 19 nt, Staphylococcus aureus subsp. aureus N315
uucaaauguaguuaagaua

SEQ ID NO: 4060854 - RNA, 13 nt, Staphylococcus aureus subsp. aureus N315
uucaaauguugaa

SEQ ID NO: 4060855 - RNA, 14 nt, Staphylococcus aureus subsp. aureus N315
uucaaauuaauuaa

SEQ ID NO: 4060856 - RNA, 13 nt, Staphylococcus aureus subsp. aureus N315
uucaaauuauaac

SEQ ID NO: 4060857 - RNA, 15 nt, Staphylococcus aureus subsp. aureus N315
uucaaauugguuuuc

SEQ ID NO: 4060858 - RNA, 13 nt, Staphylococcus aureus subsp. aureus N315
uucaaauuuacca

SEQ ID NO: 4060859 - RNA, 22 nt, Staphylococcus aureus subsp. aureus N315
uucaacaauuucaaugucugca

SEQ ID NO: 4060860 - RNA, 14 nt, Staphylococcus aureus subsp. aureus N315
uucaacauaacuca

SEQ ID NO: 4060861 - RNA, 14 nt, Staphylococcus aureus subsp. aureus N315
uucaaccaauuauu

SEQ ID NO: 4060862 - RNA, 17 nt, Staphylococcus aureus subsp. aureus N315
uucaaccaauuauuaaa

SEQ ID NO: 4060863 - RNA, 22 nt, Staphylococcus aureus subsp. aureus N315
uucaacgcauauucuauuguug

SEQ ID NO: 4060864 - RNA, 21 nt, Staphylococcus aureus subsp. aureus N315
uucaacgucgaauguuucuuc

SEQ ID NO: 4060865 - RNA, 15 nt, Staphylococcus aureus subsp. aureus N315
uucaacuaauuuaaa

SEQ ID NO: 4060866 - RNA, 13 nt, Staphylococcus aureus subsp. aureus N315
uucaacuuauaaa

SEQ ID NO: 4060867 - RNA, 16 nt, Staphylococcus aureus subsp. aureus N315
uucaacuuauuauuua

SEQ ID NO: 4060868 - RNA, 18 nt, Staphylococcus aureus subsp. aureus N315
uucaacuuguuuccuaca

SEQ ID NO: 4060869 - RNA, 19 nt, Staphylococcus aureus subsp. aureus N315
uucaacuuguuuccuacac

SEQ ID NO: 4060870 - RNA, 14 nt, Staphylococcus aureus subsp. aureus N315
uucaacuuuaauca

SEQ ID NO: 4060871 - RNA, 19 nt, Staphylococcus aureus subsp. aureus N315
uucaacuuuaaucaaaaaa

SEQ ID NO: 4060872 - RNA, 11 nt, Staphylococcus aureus subsp. aureus N315
uucaagaacaa

SEQ ID NO: 4060873 - RNA, 14 nt, Staphylococcus aureus subsp. aureus N315
uucaagaccaaaua

SEQ ID NO: 4060874 - RNA, 18 nt, Staphylococcus aureus subsp. aureus N315
uucaagaccaugcaaacu

SEQ ID NO: 4060875 - RNA, 17 nt, Staphylococcus aureus subsp. aureus N315
uucaagagguuuuauuu

SEQ ID NO: 4060876 - RNA, 14 nt, Staphylococcus aureus subsp. aureus N315
uucaagcuuaauaa

SEQ ID NO: 4060877 - RNA, 20 nt, Staphylococcus aureus subsp. aureus N315
uucaaguaauggauugauaa

SEQ ID NO: 4060878 - RNA, 21 nt, Staphylococcus aureus subsp. aureus N315
uucaaguaauggauugauaau

SEQ ID NO: 4060879 - RNA, 21 nt, Staphylococcus aureus subsp. aureus N315
uucaaguauauccgcaucuuu

SEQ ID NO: 4060880 - RNA, 13 nt, Staphylococcus aureus subsp. aureus N315
uucaaguuuaaaa

SEQ ID NO: 4060881 - RNA, 19 nt, Staphylococcus aureus subsp. aureus N315
uucaauaaaaaugguauuc

SEQ ID NO: 4060882 - RNA, 15 nt, Staphylococcus aureus subsp. aureus N315
uucaauaaauaaaca

SEQ ID NO: 4060883 - RNA, 16 nt, Staphylococcus aureus subsp. aureus N315
uucaauaaucuuaggu

SEQ ID NO: 4060884 - RNA, 12 nt, Staphylococcus aureus subsp. aureus N315
uucaauaauuca

SEQ ID NO: 4060885 - RNA, 21 nt, Staphylococcus aureus subsp. aureus N315
uucaauacgaaguguuauaaa

SEQ ID NO: 4060886 - RNA, 21 nt, Staphylococcus aureus subsp. aureus N315
uucaauauuacuuuaucucau

SEQ ID NO: 4060887 - RNA, 20 nt, Staphylococcus aureus subsp. aureus N315
uucaauauucuuaucauuca

SEQ ID NO: 4060888 - RNA, 12 nt, Staphylococcus aureus subsp. aureus N315
uucaaucauuca

SEQ ID NO: 4060889 - RNA, 22 nt, Staphylococcus aureus subsp. aureus N315
uucaauccaagcaaucuuagua

SEQ ID NO: 4060890 - RNA, 14 nt, Staphylococcus aureus subsp. aureus N315
uucaauccuuuguu

SEQ ID NO: 4060891 - RNA, 22 nt, Staphylococcus aureus subsp. aureus N315
uucaaucgcauuuuguuucaac

SEQ ID NO: 4060892 - RNA, 15 nt, Staphylococcus aureus subsp. aureus N315
uucaaucguuucuuc

SEQ ID NO: 4060893 - RNA, 16 nt, Staphylococcus aureus subsp. aureus N315
uucaaugaauucauuu

SEQ ID NO: 4060894 - RNA, 19 nt, Staphylococcus aureus subsp. aureus N315
uucaaugagaagcugucuu

SEQ ID NO: 4060895 - RNA, 19 nt, Staphylococcus aureus subsp. aureus N315
uucaauguaucaccuaauu

SEQ ID NO: 4060896 - RNA, 16 nt, Staphylococcus aureus subsp. aureus N315
uucaaugucuacuuug

SEQ ID NO: 4060897 - RNA, 18 nt, Staphylococcus aureus subsp. aureus N315
uucaaugucuacuuugaa

SEQ ID NO: 4060898 - RNA, 14 nt, Staphylococcus aureus subsp. aureus N315
uucaaugucugcau

SEQ ID NO: 4060899 - RNA, 18 nt, Staphylococcus aureus subsp. aureus N315
uucaauguuuaauuuucu

SEQ ID NO: 4060900 - RNA, 21 nt, Staphylococcus aureus subsp. aureus N315
uucaauguuuaauuuucuaaa

SEQ ID NO: 4060901 - RNA, 13 nt, Staphylococcus aureus subsp. aureus N315
uucaauuagaaaa

SEQ ID NO: 4060902 - RNA, 15 nt, Staphylococcus aureus subsp. aureus N315
uucaauuagaaaaua

SEQ ID NO: 4060903 - RNA, 13 nt, Staphylococcus aureus subsp. aureus N315
uucaauuaucaaa

SEQ ID NO: 4060904 - RNA, 20 nt, Staphylococcus aureus subsp. aureus N315
uucaauucuagucaaccuug

SEQ ID NO: 4060905 - RNA, 23 nt, Staphylococcus aureus subsp. aureus N315
uucaauugacauuaaugauagca

SEQ ID NO: 4060906 - RNA, 19 nt, Staphylococcus aureus subsp. aureus N315
uucaauugucucaauaaug

SEQ ID NO: 4060907 - RNA, 21 nt, Staphylococcus aureus subsp. aureus N315
uucaauuuaauguauugagaa

SEQ ID NO: 4060908 - RNA, 17 nt, Staphylococcus aureus subsp. aureus N315
uucacauucuugaauaa

SEQ ID NO: 4060909 - RNA, 14 nt, Staphylococcus aureus subsp. aureus N315
uucaccaacuuuuu

SEQ ID NO: 4060910 - RNA, 19 nt, Staphylococcus aureus subsp. aureus N315
uucaccaucuguaacuaau

SEQ ID NO: 4060911 - RNA, 20 nt, Staphylococcus aureus subsp. aureus N315
uucaccauuucguguuccaa

SEQ ID NO: 4060912 - RNA, 14 nt, Staphylococcus aureus subsp. aureus N315
uucaccguaaucuu

SEQ ID NO: 4060913 - RNA, 18 nt, Staphylococcus aureus subsp. aureus N315
uucaccguaaucuuuuaa

SEQ ID NO: 4060914 - RNA, 14 nt, Staphylococcus aureus subsp. aureus N315
uucaccuaaaaaga

SEQ ID NO: 4060915 - RNA, 13 nt, Staphylococcus aureus subsp. aureus N315
uucaccuaaucuu

SEQ ID NO: 4060916 - RNA, 17 nt, Staphylococcus aureus subsp. aureus N315
uucacgauauaacauua

SEQ ID NO: 4060917 - RNA, 24 nt, Staphylococcus aureus subsp. aureus N315
uucacgauuucuuuaugauaauaa

SEQ ID NO: 4060918 - RNA, 21 nt, Staphylococcus aureus subsp. aureus N315
uucacgauuuuuaaaaugcuu

SEQ ID NO: 4060919 - RNA, 21 nt, Staphylococcus aureus subsp. aureus N315
uucacuaaauucaauaaucuu

SEQ ID NO: 4060920 - RNA, 13 nt, Staphylococcus aureus subsp. aureus N315
uucacuaauauuu

SEQ ID NO: 4060921 - RNA, 17 nt, Staphylococcus aureus subsp. aureus N315
uucacuaauauuucuua

SEQ ID NO: 4060922 - RNA, 23 nt, Staphylococcus aureus subsp. aureus N315
uucacuaauauuucuuagauacu

SEQ ID NO: 4060923 - RNA, 14 nt, Staphylococcus aureus subsp. aureus N315
uucacucuguaaua

SEQ ID NO: 4060924 - RNA, 16 nt, Staphylococcus aureus subsp. aureus N315
uucacuguauaaauaa

SEQ ID NO: 4060925 - RNA, 21 nt, Staphylococcus aureus subsp. aureus N315
uucagaacuacaauucauaag

SEQ ID NO: 4060926 - RNA, 13 nt, Staphylococcus aureus subsp. aureus N315
uucagauagguac

SEQ ID NO: 4060927 - RNA, 22 nt, Staphylococcus aureus subsp. aureus N315
uucagauauacuguauaguaac

SEQ ID NO: 4060928 - RNA, 14 nt, Staphylococcus aureus subsp. aureus N315
uucagaugaauaau

SEQ ID NO: 4060929 - RNA, 22 nt, Staphylococcus aureus subsp. aureus N315
uucagcaccagaacaauucaau

SEQ ID NO: 4060930 - RNA, 22 nt, Staphylococcus aureus subsp. aureus N315
uucagcuaauucgucuacauau

SEQ ID NO: 4060931 - RNA, 19 nt, Staphylococcus aureus subsp. aureus N315
uucagcuucuaaguaauau

SEQ ID NO: 4060932 - RNA, 21 nt, Staphylococcus aureus subsp. aureus N315
uucaggaauaucuuucaaauu

SEQ ID NO: 4060933 - RNA, 16 nt, Staphylococcus aureus subsp. aureus N315
uucagggucaacauca

SEQ ID NO: 4060934 - RNA, 20 nt, Staphylococcus aureus subsp. aureus N315
uucaggguuuaagauuuuau

SEQ ID NO: 4060935 - RNA, 22 nt, Staphylococcus aureus subsp. aureus N315
uucagguucaaaauugcugaca

SEQ ID NO: 4060936 - RNA, 16 nt, Staphylococcus aureus subsp. aureus N315
uucaguaacugauuuu

SEQ ID NO: 4060937 - RNA, 17 nt, Staphylococcus aureus subsp. aureus N315
uucaguacgaacaacua

SEQ ID NO: 4060938 - RNA, 22 nt, Staphylococcus aureus subsp. aureus N315
uucaguacgguuauuuaauaau

SEQ ID NO: 4060939 - RNA, 19 nt, Staphylococcus aureus subsp. aureus N315
uucaguaggacauauaaau

SEQ ID NO: 4060940 - RNA, 22 nt, Staphylococcus aureus subsp. aureus N315
uucaguauagacuauaggucuu

SEQ ID NO: 4060941 - RNA, 15 nt, Staphylococcus aureus subsp. aureus N315
uucaguuaaaauaac

SEQ ID NO: 4060942 - RNA, 14 nt, Staphylococcus aureus subsp. aureus N315
uucaguuaaaccuu

SEQ ID NO: 4060943 - RNA, 13 nt, Staphylococcus aureus subsp. aureus N315
uucaguuaaauca

SEQ ID NO: 4060944 - RNA, 13 nt, Staphylococcus aureus subsp. aureus N315
uucaguuguuuuu

SEQ ID NO: 4060945 - RNA, 16 nt, Staphylococcus aureus subsp. aureus N315
uucauaaaauuuaaaa

SEQ ID NO: 4060946 - RNA, 19 nt, Staphylococcus aureus subsp. aureus N315
uucauaaaauuuaaaacaa

SEQ ID NO: 4060947 - RNA, 20 nt, Staphylococcus aureus subsp. aureus N315
uucauaaaguuuauuuaugu

SEQ ID NO: 4060948 - RNA, 13 nt, Staphylococcus aureus subsp. aureus N315
uucauaaaugcuu

SEQ ID NO: 4060949 - RNA, 23 nt, Staphylococcus aureus subsp. aureus N315
uucauaaauuguuuuacaugauu

SEQ ID NO: 4060950 - RNA, 14 nt, Staphylococcus aureus subsp. aureus N315
uucauaagaaaaau

SEQ ID NO: 4060951 - RNA, 14 nt, Staphylococcus aureus subsp. aureus N315
uucauaaucauaau

SEQ ID NO: 4060952 - RNA, 15 nt, Staphylococcus aureus subsp. aureus N315
uucauaaucauaaua

SEQ ID NO: 4060953 - RNA, 16 nt, Staphylococcus aureus subsp. aureus N315
uucauaaugaucaagu

SEQ ID NO: 4060954 - RNA, 13 nt, Staphylococcus aureus subsp. aureus N315
uucauaauuaaca

SEQ ID NO: 4060955 - RNA, 20 nt, Staphylococcus aureus subsp. aureus N315
uucauaauuaacacauucaa

SEQ ID NO: 4060956 - RNA, 14 nt, Staphylococcus aureus subsp. aureus N315
uucauaauuaauaa

SEQ ID NO: 4060957 - RNA, 21 nt, Staphylococcus aureus subsp. aureus N315
uucauacacuaucauuaucaa

SEQ ID NO: 4060958 - RNA, 22 nt, Staphylococcus aureus subsp. aureus N315
uucauacacugcacaucauaau

SEQ ID NO: 4060959 - RNA, 19 nt, Staphylococcus aureus subsp. aureus N315
uucauacgcucaaucgcau

SEQ ID NO: 4060960 - RNA, 23 nt, Staphylococcus aureus subsp. aureus N315
uucauagugguguuuauaucuuu

SEQ ID NO: 4060961 - RNA, 18 nt, Staphylococcus aureus subsp. aureus N315
uucauaguguuuguaaug

SEQ ID NO: 4060962 - RNA, 22 nt, Staphylococcus aureus subsp. aureus N315
uucauauuuagguaauacauca

SEQ ID NO: 4060963 - RNA, 15 nt, Staphylococcus aureus subsp. aureus N315
uucaucaaacaacau

SEQ ID NO: 4060964 - RNA, 17 nt, Staphylococcus aureus subsp. aureus N315
uucaucaaacaacauca

SEQ ID NO: 4060965 - RNA, 20 nt, Staphylococcus aureus subsp. aureus N315
uucaucaaauccaaaaucuu

SEQ ID NO: 4060966 - RNA, 17 nt, Staphylococcus aureus subsp. aureus N315
uucaucaaguugauaau

SEQ ID NO: 4060967 - RNA, 13 nt, Staphylococcus aureus subsp. aureus N315
uucaucaauaagg

SEQ ID NO: 4060968 - RNA, 15 nt, Staphylococcus aureus subsp. aureus N315
uucaucaauaaggca

SEQ ID NO: 4060969 - RNA, 13 nt, Staphylococcus aureus subsp. aureus N315
uucaucaauaauu

SEQ ID NO: 4060970 - RNA, 23 nt, Staphylococcus aureus subsp. aureus N315
uucaucaguugagugauuuuaau

SEQ ID NO: 4060971 - RNA, 16 nt, Staphylococcus aureus subsp. aureus N315
uucaucauuaaaauca

SEQ ID NO: 4060972 - RNA, 20 nt, Staphylococcus aureus subsp. aureus N315
uucaucgucucacuuaauaa

SEQ ID NO: 4060973 - RNA, 18 nt, Staphylococcus aureus subsp. aureus N315
uucaucguucauauauuu

SEQ ID NO: 4060974 - RNA, 14 nt, Staphylococcus aureus subsp. aureus N315
uucaucuaaaauga

SEQ ID NO: 4060975 - RNA, 15 nt, Staphylococcus aureus subsp. aureus N315
uucaucuaaaaugag

SEQ ID NO: 4060976 - RNA, 16 nt, Staphylococcus aureus subsp. aureus N315
uucaucuaauuuuccu

SEQ ID NO: 4060977 - RNA, 17 nt, Staphylococcus aureus subsp. aureus N315
uucaucugacugauuuu

SEQ ID NO: 4060978 - RNA, 22 nt, Staphylococcus aureus subsp. aureus N315
uucaucugguauuuuaugacgu

SEQ ID NO: 4060979 - RNA, 13 nt, Staphylococcus aureus subsp. aureus N315
uucaucuuaucaa

SEQ ID NO: 4060980 - RNA, 20 nt, Staphylococcus aureus subsp. aureus N315
uucaucuucaaacagacuua

SEQ ID NO: 4060981 - RNA, 12 nt, Staphylococcus aureus subsp. aureus N315
uucaucuucaac

SEQ ID NO: 4060982 - RNA, 12 nt, Staphylococcus aureus subsp. aureus N315
uucaucuugcaa

SEQ ID NO: 4060983 - RNA, 12 nt, Staphylococcus aureus subsp. aureus N315
uucaugaacagc

SEQ ID NO: 4060984 - RNA, 14 nt, Staphylococcus aureus subsp. aureus N315
uucaugaauaauua

SEQ ID NO: 4060985 - RNA, 15 nt, Staphylococcus aureus subsp. aureus N315
uucaugauuuacuaa

SEQ ID NO: 4060986 - RNA, 16 nt, Staphylococcus aureus subsp. aureus N315
uucauggccaaauguu

SEQ ID NO: 4060987 - RNA, 15 nt, Staphylococcus aureus subsp. aureus N315
uucauguaaauaguu

SEQ ID NO: 4060988 - RNA, 16 nt, Staphylococcus aureus subsp. aureus N315
uucauguacgaaaauu

SEQ ID NO: 4060989 - RNA, 15 nt, Staphylococcus aureus subsp. aureus N315
uucauguccaucuuu

SEQ ID NO: 4060990 - RNA, 22 nt, Staphylococcus aureus subsp. aureus N315
uucaugugcaagugguaaaaau

SEQ ID NO: 4060991 - RNA, 19 nt, Staphylococcus aureus subsp. aureus N315
uucaugugucauaauccau

SEQ ID NO: 4060992 - RNA, 17 nt, Staphylococcus aureus subsp. aureus N315
uucauguuugauucuaa

SEQ ID NO: 4060993 - RNA, 14 nt, Staphylococcus aureus subsp. aureus N315
uucauuaauacaag

SEQ ID NO: 4060994 - RNA, 18 nt, Staphylococcus aureus subsp. aureus N315
uucauuagccaaaucuuu

SEQ ID NO: 4060995 - RNA, 19 nt, Staphylococcus aureus subsp. aureus N315
uucauuaguugcauaauca

SEQ ID NO: 4060996 - RNA, 21 nt, Staphylococcus aureus subsp. aureus N315
uucauuauagugugucauaau

SEQ ID NO: 4060997 - RNA, 16 nt, Staphylococcus aureus subsp. aureus N315
uucauuauauaauucu

SEQ ID NO: 4060998 - RNA, 21 nt, Staphylococcus aureus subsp. aureus N315
uucauuauauaauucuucaaa

SEQ ID NO: 4060999 - RNA, 14 nt, Staphylococcus aureus subsp. aureus N315
uucauuauaugguu

SEQ ID NO: 4061000 - RNA, 12 nt, Staphylococcus aureus subsp. aureus N315
uucauuaucauu

SEQ ID NO: 4061001 - RNA, 16 nt, Staphylococcus aureus subsp. aureus N315
uucauuauuuaaauaa

SEQ ID NO: 4061002 - RNA, 17 nt, Staphylococcus aureus subsp. aureus N315
uucauugcguaagguau

SEQ ID NO: 4061003 - RNA, 14 nt, Staphylococcus aureus subsp. aureus N315
uucauuguaaauuu

SEQ ID NO: 4061004 - RNA, 14 nt, Staphylococcus aureus subsp. aureus N315
uucauuguaacuca

SEQ ID NO: 4061005 - RNA, 21 nt, Staphylococcus aureus subsp. aureus N315
uucauuguauguugaaaguga

SEQ ID NO: 4061006 - RNA, 12 nt, Staphylococcus aureus subsp. aureus N315
uucauuuaaaaa

SEQ ID NO: 4061007 - RNA, 17 nt, Staphylococcus aureus subsp. aureus N315
uucauuuaguuaaauac

SEQ ID NO: 4061008 - RNA, 20 nt, Staphylococcus aureus subsp. aureus N315
uucauuuguaggaaacgguu

SEQ ID NO: 4061009 - RNA, 19 nt, Staphylococcus aureus subsp. aureus N315
uucauuuguauuaauuuga

SEQ ID NO: 4061010 - RNA, 16 nt, Staphylococcus aureus subsp. aureus N315
uucauuuuaaauuuaa

SEQ ID NO: 4061011 - RNA, 15 nt, Staphylococcus aureus subsp. aureus N315
uuccaaacacacugu

SEQ ID NO: 4061012 - RNA, 22 nt, Staphylococcus aureus subsp. aureus N315
uuccaaagaaagcuaauaucaa

SEQ ID NO: 4061013 - RNA, 23 nt, Staphylococcus aureus subsp. aureus N315
uuccaaauguucagguucaaaau

SEQ ID NO: 4061014 - RNA, 24 nt, Staphylococcus aureus subsp. aureus N315
uuccaaauugaaauuauccuacug

SEQ ID NO: 4061015 - RNA, 18 nt, Staphylococcus aureus subsp. aureus N315
uuccaaauugcaaaguaa

SEQ ID NO: 4061016 - RNA, 16 nt, Staphylococcus aureus subsp. aureus N315
uuccaacaacuaagau

SEQ ID NO: 4061017 - RNA, 16 nt, Staphylococcus aureus subsp. aureus N315
uuccaaguuaaugcac

SEQ ID NO: 4061018 - RNA, 17 nt, Staphylococcus aureus subsp. aureus N315
uuccaauaauaaaccua

SEQ ID NO: 4061019 - RNA, 19 nt, Staphylococcus aureus subsp. aureus N315
uuccaauaauaaaccuaaa

SEQ ID NO: 4061020 - RNA, 17 nt, Staphylococcus aureus subsp. aureus N315
uuccaaucaacuucaua

SEQ ID NO: 4061021 - RNA, 19 nt, Staphylococcus aureus subsp. aureus N315
uuccacuucaucuaaauga

SEQ ID NO: 4061022 - RNA, 13 nt, Staphylococcus aureus subsp. aureus N315
uuccaguaugauu

SEQ ID NO: 4061023 - RNA, 19 nt, Staphylococcus aureus subsp. aureus N315
uuccauaaauaaaaugcua

SEQ ID NO: 4061024 - RNA, 14 nt, Staphylococcus aureus subsp. aureus N315
uuccauaaauauuu

SEQ ID NO: 4061025 - RNA, 12 nt, Staphylococcus aureus subsp. aureus N315
uuccaucuuaaa

SEQ ID NO: 4061026 - RNA, 22 nt, Staphylococcus aureus subsp. aureus N315
uucccagucaugucccauaaca

SEQ ID NO: 4061027 - RNA, 19 nt, Staphylococcus aureus subsp. aureus N315
uucccguuaauaucaugcu

SEQ ID NO: 4061028 - RNA, 12 nt, Staphylococcus aureus subsp. aureus N315
uucccuacugcu

SEQ ID NO: 4061029 - RNA, 15 nt, Staphylococcus aureus subsp. aureus N315
uucccuaugaaauaa

SEQ ID NO: 4061030 - RNA, 17 nt, Staphylococcus aureus subsp. aureus N315
uucccuguuaugaagua

SEQ ID NO: 4061031 - RNA, 18 nt, Staphylococcus aureus subsp. aureus N315
uuccuaaaccucuaaaua

SEQ ID NO: 4061032 - RNA, 18 nt, Staphylococcus aureus subsp. aureus N315
uuccuaauucuugagcaa

SEQ ID NO: 4061033 - RNA, 23 nt, Staphylococcus aureus subsp. aureus N315
uuccuacacuguuuuauaaauga

SEQ ID NO: 4061034 - RNA, 18 nt, Staphylococcus aureus subsp. aureus N315
uuccuaccccgugaaucu

SEQ ID NO: 4061035 - RNA, 22 nt, Staphylococcus aureus subsp. aureus N315
uuccuagcuuuuaugucuaguu

SEQ ID NO: 4061036 - RNA, 16 nt, Staphylococcus aureus subsp. aureus N315
uuccuauuaggaucca

SEQ ID NO: 4061037 - RNA, 19 nt, Staphylococcus aureus subsp. aureus N315
uuccucaacgggaacauca

SEQ ID NO: 4061038 - RNA, 22 nt, Staphylococcus aureus subsp. aureus N315
uuccucuccuucggcucucgcu

SEQ ID NO: 4061039 - RNA, 22 nt, Staphylococcus aureus subsp. aureus N315
uuccucuggaacuuuaauacca

SEQ ID NO: 4061040 - RNA, 15 nt, Staphylococcus aureus subsp. aureus N315
uuccugauacaauga

SEQ ID NO: 4061041 - RNA, 21 nt, Staphylococcus aureus subsp. aureus N315
uuccugauauuucaacuuuuu

SEQ ID NO: 4061042 - RNA, 15 nt, Staphylococcus aureus subsp. aureus N315
uuccugcuacaacuu

SEQ ID NO: 4061043 - RNA, 15 nt, Staphylococcus aureus subsp. aureus N315
uuccuuguuggucug

SEQ ID NO: 4061044 - RNA, 22 nt, Staphylococcus aureus subsp. aureus N315
uuccuuguuuuaaacuuauuaa

SEQ ID NO: 4061045 - RNA, 19 nt, Staphylococcus aureus subsp. aureus N315
uuccuuuagcaaaaauauu

SEQ ID NO: 4061046 - RNA, 23 nt, Staphylococcus aureus subsp. aureus N315
uuccuuuagcaaaaauauuuaaa

SEQ ID NO: 4061047 - RNA, 22 nt, Staphylococcus aureus subsp. aureus N315
uucgaaaagaaauucuacaaac

SEQ ID NO: 4061048 - RNA, 18 nt, Staphylococcus aureus subsp. aureus N315
uucgaaaaucucuguauu

SEQ ID NO: 4061049 - RNA, 14 nt, Staphylococcus aureus subsp. aureus N315
uucgaaauagguau

SEQ ID NO: 4061050 - RNA, 23 nt, Staphylococcus aureus subsp. aureus N315
uucgaacgauauuuuaaaaagua

SEQ ID NO: 4061051 - RNA, 16 nt, Staphylococcus aureus subsp. aureus N315
uucgaacgcuugaaaa

SEQ ID NO: 4061052 - RNA, 17 nt, Staphylococcus aureus subsp. aureus N315
uucgaacuaucaauaua

SEQ ID NO: 4061053 - RNA, 17 nt, Staphylococcus aureus subsp. aureus N315
uucgaacuuuuguucua

SEQ ID NO: 4061054 - RNA, 22 nt, Staphylococcus aureus subsp. aureus N315
uucgaagucauaugcauacacu

SEQ ID NO: 4061055 - RNA, 19 nt, Staphylococcus aureus subsp. aureus N315
uucgaauuuaacaucuuug

SEQ ID NO: 4061056 - RNA, 23 nt, Staphylococcus aureus subsp. aureus N315
uucgacacgcccgacaucauaaa

SEQ ID NO: 4061057 - RNA, 20 nt, Staphylococcus aureus subsp. aureus N315
uucgacuacaaguuuauaau

SEQ ID NO: 4061058 - RNA, 18 nt, Staphylococcus aureus subsp. aureus N315
uucgacuguauacgacgu

SEQ ID NO: 4061059 - RNA, 19 nt, Staphylococcus aureus subsp. aureus N315
uucgauaauauaacugcau

SEQ ID NO: 4061060 - RNA, 12 nt, Staphylococcus aureus subsp. aureus N315
uucgauggcugc

SEQ ID NO: 4061061 - RNA, 21 nt, Staphylococcus aureus subsp. aureus N315
uucgauuaucuacuauuuguu

SEQ ID NO: 4061062 - RNA, 15 nt, Staphylococcus aureus subsp. aureus N315
uucgauuauucuuaa

SEQ ID NO: 4061063 - RNA, 19 nt, Staphylococcus aureus subsp. aureus N315
uucgauuauuuagauaaaa

SEQ ID NO: 4061064 - RNA, 13 nt, Staphylococcus aureus subsp. aureus N315
uucgauucauaaa

SEQ ID NO: 4061065 - RNA, 14 nt, Staphylococcus aureus subsp. aureus N315
uucgcauacuuuuu

SEQ ID NO: 4061066 - RNA, 20 nt, Staphylococcus aureus subsp. aureus N315
uucgcauacuuuuucagaau

SEQ ID NO: 4061067 - RNA, 17 nt, Staphylococcus aureus subsp. aureus N315
uucgcaucguucccugc

SEQ ID NO: 4061068 - RNA, 23 nt, Staphylococcus aureus subsp. aureus N315
uucgcuaauaauacgucguaaug

SEQ ID NO: 4061069 - RNA, 19 nt, Staphylococcus aureus subsp. aureus N315
uucgcugcuacaccaccug

SEQ ID NO: 4061070 - RNA, 19 nt, Staphylococcus aureus subsp. aureus N315
uucggaauuugcacaaaga

SEQ ID NO: 4061071 - RNA, 16 nt, Staphylococcus aureus subsp. aureus N315
uucggaugagaaaugu

SEQ ID NO: 4061072 - RNA, 15 nt, Staphylococcus aureus subsp. aureus N315
uucggcuuuccuaau

SEQ ID NO: 4061073 - RNA, 22 nt, Staphylococcus aureus subsp. aureus N315
uucguaaaucgugucaaaugcc

SEQ ID NO: 4061074 - RNA, 14 nt, Staphylococcus aureus subsp. aureus N315
uucguaauaaacau

SEQ ID NO: 4061075 - RNA, 17 nt, Staphylococcus aureus subsp. aureus N315
uucguaauguguuaaua

SEQ ID NO: 4061076 - RNA, 19 nt, Staphylococcus aureus subsp. aureus N315
uucguacaucguugccauu

SEQ ID NO: 4061077 - RNA, 23 nt, Staphylococcus aureus subsp. aureus N315
uucguacuaguucgauucaugaa

SEQ ID NO: 4061078 - RNA, 15 nt, Staphylococcus aureus subsp. aureus N315
uucguacuuccaaua

SEQ ID NO: 4061079 - RNA, 19 nt, Staphylococcus aureus subsp. aureus N315
uucguagcaugacauuaag

SEQ ID NO: 4061080 - RNA, 15 nt, Staphylococcus aureus subsp. aureus N315
uucguauguuucuuu

SEQ ID NO: 4061081 - RNA, 20 nt, Staphylococcus aureus subsp. aureus N315
uucguauguuucuuuauuau

SEQ ID NO: 4061082 - RNA, 18 nt, Staphylococcus aureus subsp. aureus N315
uucguguuccaauuuuau

SEQ ID NO: 4061083 - RNA, 15 nt, Staphylococcus aureus subsp. aureus N315
uucguucuaaaagga

SEQ ID NO: 4061084 - RNA, 17 nt, Staphylococcus aureus subsp. aureus N315
uucguuguucauaauca

SEQ ID NO: 4061085 - RNA, 17 nt, Staphylococcus aureus subsp. aureus N315
uucguuucuguuucauc

SEQ ID NO: 4061086 - RNA, 19 nt, Staphylococcus aureus subsp. aureus N315
uucguuuuaauaaauuguu

SEQ ID NO: 4061087 - RNA, 12 nt, Staphylococcus aureus subsp. aureus N315
uucguuuuacua

SEQ ID NO: 4061088 - RNA, 18 nt, Staphylococcus aureus subsp. aureus N315
uucuaaaaaauuaaaaau

SEQ ID NO: 4061089 - RNA, 12 nt, Staphylococcus aureus subsp. aureus N315
uucuaaauaaac

SEQ ID NO: 4061090 - RNA, 13 nt, Staphylococcus aureus subsp. aureus N315
uucuaaaucuugu

SEQ ID NO: 4061091 - RNA, 22 nt, Staphylococcus aureus subsp. aureus N315
uucuaacggcguuuguuucuua

SEQ ID NO: 4061092 - RNA, 21 nt, Staphylococcus aureus subsp. aureus N315
uucuaacgguaaauaaccacu

SEQ ID NO: 4061093 - RNA, 19 nt, Staphylococcus aureus subsp. aureus N315
uucuaacugcaaagccaug

SEQ ID NO: 4061094 - RNA, 22 nt, Staphylococcus aureus subsp. aureus N315
uucuaacuugaacagauucacc

SEQ ID NO: 4061095 - RNA, 13 nt, Staphylococcus aureus subsp. aureus N315
uucuaagucucuu

SEQ ID NO: 4061096 - RNA, 17 nt, Staphylococcus aureus subsp. aureus N315
uucuaaguguugaccau

SEQ ID NO: 4061097 - RNA, 15 nt, Staphylococcus aureus subsp. aureus N315
uucuaaguguuuuau

SEQ ID NO: 4061098 - RNA, 20 nt, Staphylococcus aureus subsp. aureus N315
uucuaaguuugcguuuuaau

SEQ ID NO: 4061099 - RNA, 13 nt, Staphylococcus aureus subsp. aureus N315
uucuaauacaaac

SEQ ID NO: 4061100 - RNA, 20 nt, Staphylococcus aureus subsp. aureus N315
uucuaaucguuaauaaaccu

SEQ ID NO: 4061101 - RNA, 13 nt, Staphylococcus aureus subsp. aureus N315
uucuaaucuaaau

SEQ ID NO: 4061102 - RNA, 16 nt, Staphylococcus aureus subsp. aureus N315
uucuaaugcuaauuua

SEQ ID NO: 4061103 - RNA, 20 nt, Staphylococcus aureus subsp. aureus N315
uucuaauugaaaucaucuua

SEQ ID NO: 4061104 - RNA, 19 nt, Staphylococcus aureus subsp. aureus N315
uucuaauuguuguaauucu

SEQ ID NO: 4061105 - RNA, 13 nt, Staphylococcus aureus subsp. aureus N315
uucuaauuguuuu

SEQ ID NO: 4061106 - RNA, 14 nt, Staphylococcus aureus subsp. aureus N315
uucuaauuuuucac

SEQ ID NO: 4061107 - RNA, 13 nt, Staphylococcus aureus subsp. aureus N315
uucuacaaacaau

SEQ ID NO: 4061108 - RNA, 18 nt, Staphylococcus aureus subsp. aureus N315
uucuacaggcaaugcaag

SEQ ID NO: 4061109 - RNA, 19 nt, Staphylococcus aureus subsp. aureus N315
uucuacaggcaaugcaagu

SEQ ID NO: 4061110 - RNA, 20 nt, Staphylococcus aureus subsp. aureus N315
uucuacaggcaaugcaaguu

SEQ ID NO: 4061111 - RNA, 18 nt, Staphylococcus aureus subsp. aureus N315
uucuacagguaaugcaag

SEQ ID NO: 4061112 - RNA, 20 nt, Staphylococcus aureus subsp. aureus N315
uucuacagguaaugcaaguu

SEQ ID NO: 4061113 - RNA, 21 nt, Staphylococcus aureus subsp. aureus N315
uucuacagguaaugcaaguug

SEQ ID NO: 4061114 - RNA, 13 nt, Staphylococcus aureus subsp. aureus N315
uucuaccaauaau

SEQ ID NO: 4061115 - RNA, 21 nt, Staphylococcus aureus subsp. aureus N315
uucuacccauaauuuaaauga

SEQ ID NO: 4061116 - RNA, 14 nt, Staphylococcus aureus subsp. aureus N315
uucuagauucauau

SEQ ID NO: 4061117 - RNA, 14 nt, Staphylococcus aureus subsp. aureus N315
uucuagugaaauac

SEQ ID NO: 4061118 - RNA, 17 nt, Staphylococcus aureus subsp. aureus N315
uucuauaaauagaauuu

SEQ ID NO: 4061119 - RNA, 14 nt, Staphylococcus aureus subsp. aureus N315
uucuauaauuuuaa

SEQ ID NO: 4061120 - RNA, 16 nt, Staphylococcus aureus subsp. aureus N315
uucuauacauuccaaa

SEQ ID NO: 4061121 - RNA, 16 nt, Staphylococcus aureus subsp. aureus N315
uucuauacuuuuaauu

SEQ ID NO: 4061122 - RNA, 20 nt, Staphylococcus aureus subsp. aureus N315
uucuauacuuuuaauuguau

SEQ ID NO: 4061123 - RNA, 17 nt, Staphylococcus aureus subsp. aureus N315
uucuauauaguaaaaua

SEQ ID NO: 4061124 - RNA, 18 nt, Staphylococcus aureus subsp. aureus N315
uucuauauaguaaaauaa

SEQ ID NO: 4061125 - RNA, 12 nt, Staphylococcus aureus subsp. aureus N315
uucuauauuaau

SEQ ID NO: 4061126 - RNA, 13 nt, Staphylococcus aureus subsp. aureus N315
uucuaucaaauaa

SEQ ID NO: 4061127 - RNA, 16 nt, Staphylococcus aureus subsp. aureus N315
uucuaucaaauaauga

SEQ ID NO: 4061128 - RNA, 23 nt, Staphylococcus aureus subsp. aureus N315
uucuaucacacgcauacaggaaa

SEQ ID NO: 4061129 - RNA, 13 nt, Staphylococcus aureus subsp. aureus N315
uucuauuaauaau

SEQ ID NO: 4061130 - RNA, 21 nt, Staphylococcus aureus subsp. aureus N315
uucuauuccuucuaacauauc

SEQ ID NO: 4061131 - RNA, 14 nt, Staphylococcus aureus subsp. aureus N315
uucuauuuuauaau

SEQ ID NO: 4061132 - RNA, 18 nt, Staphylococcus aureus subsp. aureus N315
uucuauuuuauaauaaau

SEQ ID NO: 4061133 - RNA, 16 nt, Staphylococcus aureus subsp. aureus N315
uucuauuuucauagau

SEQ ID NO: 4061134 - RNA, 17 nt, Staphylococcus aureus subsp. aureus N315
uucuauuuucauagaug

SEQ ID NO: 4061135 - RNA, 15 nt, Staphylococcus aureus subsp. aureus N315
uucuauuuuucaauu

SEQ ID NO: 4061136 - RNA, 21 nt, Staphylococcus aureus subsp. aureus N315
uucuauuuuugauuuaauaau

SEQ ID NO: 4061137 - RNA, 23 nt, Staphylococcus aureus subsp. aureus N315
uucucaacaaaucuauaaauauc

SEQ ID NO: 4061138 - RNA, 17 nt, Staphylococcus aureus subsp. aureus N315
uucucacaacugcauau

SEQ ID NO: 4061139 - RNA, 19 nt, Staphylococcus aureus subsp. aureus N315
uucucaucuauuuaauaau

SEQ ID NO: 4061140 - RNA, 13 nt, Staphylococcus aureus subsp. aureus N315
uucucauuauaau

SEQ ID NO: 4061141 - RNA, 15 nt, Staphylococcus aureus subsp. aureus N315
uucucauuauaauga

SEQ ID NO: 4061142 - RNA, 17 nt, Staphylococcus aureus subsp. aureus N315
uucuccaacgucauaac

SEQ ID NO: 4061143 - RNA, 21 nt, Staphylococcus aureus subsp. aureus N315
uucuccuucaauguucaauuc

SEQ ID NO: 4061144 - RNA, 12 nt, Staphylococcus aureus subsp. aureus N315
uucucguguaaa

SEQ ID NO: 4061145 - RNA, 17 nt, Staphylococcus aureus subsp. aureus N315
uucucuaacuuuaccaa

SEQ ID NO: 4061146 - RNA, 19 nt, Staphylococcus aureus subsp. aureus N315
uucucuaacuuuaccaaua

SEQ ID NO: 4061147 - RNA, 23 nt, Staphylococcus aureus subsp. aureus N315
uucucuacuaauauucuaggcaa

SEQ ID NO: 4061148 - RNA, 19 nt, Staphylococcus aureus subsp. aureus N315
uucucuguagauaucaaag

SEQ ID NO: 4061149 - RNA, 20 nt, Staphylococcus aureus subsp. aureus N315
uucugaaacuuuaauacuac

SEQ ID NO: 4061150 - RNA, 23 nt, Staphylococcus aureus subsp. aureus N315
uucugaauguauucagucaguaa

SEQ ID NO: 4061151 - RNA, 16 nt, Staphylococcus aureus subsp. aureus N315
uucugauucuucacua

SEQ ID NO: 4061152 - RNA, 20 nt, Staphylococcus aureus subsp. aureus N315
uucugcuguauggaaaguug

SEQ ID NO: 4061153 - RNA, 10 nt, Staphylococcus aureus subsp. aureus N315
uucugcuucu

SEQ ID NO: 4061154 - RNA, 16 nt, Staphylococcus aureus subsp. aureus N315
uucuguaauaauauca

SEQ ID NO: 4061155 - RNA, 17 nt, Staphylococcus aureus subsp. aureus N315
uucuguaauaauaucac

SEQ ID NO: 4061156 - RNA, 14 nt, Staphylococcus aureus subsp. aureus N315
uucuguaauaauua

SEQ ID NO: 4061157 - RNA, 17 nt, Staphylococcus aureus subsp. aureus N315
uucuguccaaaaagguu

SEQ ID NO: 4061158 - RNA, 20 nt, Staphylococcus aureus subsp. aureus N315
uucugucccacucccuaaua

SEQ ID NO: 4061159 - RNA, 13 nt, Staphylococcus aureus subsp. aureus N315
uucugucuguaaa

SEQ ID NO: 4061160 - RNA, 12 nt, Staphylococcus aureus subsp. aureus N315
uucuguuucauc

SEQ ID NO: 4061161 - RNA, 20 nt, Staphylococcus aureus subsp. aureus N315
uucuuaaaauaugauuuaaa

SEQ ID NO: 4061162 - RNA, 22 nt, Staphylococcus aureus subsp. aureus N315
uucuuaaaucaacaucaucuuu

SEQ ID NO: 4061163 - RNA, 16 nt, Staphylococcus aureus subsp. aureus N315
uucuuaacauaaaaug

SEQ ID NO: 4061164 - RNA, 18 nt, Staphylococcus aureus subsp. aureus N315
uucuuaacauaaaaugag

SEQ ID NO: 4061165 - RNA, 19 nt, Staphylococcus aureus subsp. aureus N315
uucuuagauuuucacuaau

SEQ ID NO: 4061166 - RNA, 18 nt, Staphylococcus aureus subsp. aureus N315
uucuuaguuugacaucua

SEQ ID NO: 4061167 - RNA, 11 nt, Staphylococcus aureus subsp. aureus N315
uucuuauaaaa

SEQ ID NO: 4061168 - RNA, 12 nt, Staphylococcus aureus subsp. aureus N315
uucuuauaaaaa

SEQ ID NO: 4061169 - RNA, 16 nt, Staphylococcus aureus subsp. aureus N315
uucuuauaaaaaucuu

SEQ ID NO: 4061170 - RNA, 13 nt, Staphylococcus aureus subsp. aureus N315
uucuuaucaguuu

SEQ ID NO: 4061171 - RNA, 17 nt, Staphylococcus aureus subsp. aureus N315
uucuuaucauuucaaau

SEQ ID NO: 4061172 - RNA, 22 nt, Staphylococcus aureus subsp. aureus N315
uucuuaucuguaccguuuuuua

SEQ ID NO: 4061173 - RNA, 13 nt, Staphylococcus aureus subsp. aureus N315
uucuuauucaaau

SEQ ID NO: 4061174 - RNA, 18 nt, Staphylococcus aureus subsp. aureus N315
uucuuauuuauucauaac

SEQ ID NO: 4061175 - RNA, 23 nt, Staphylococcus aureus subsp. aureus N315
uucuuauuuauucauaacguguu

SEQ ID NO: 4061176 - RNA, 12 nt, Staphylococcus aureus subsp. aureus N315
uucuuauuugaa

SEQ ID NO: 4061177 - RNA, 19 nt, Staphylococcus aureus subsp. aureus N315
uucuuauuugauucuauuu

SEQ ID NO: 4061178 - RNA, 16 nt, Staphylococcus aureus subsp. aureus N315
uucuucaaaaaauaau

SEQ ID NO: 4061179 - RNA, 15 nt, Staphylococcus aureus subsp. aureus N315
uucuucaacaauuuc

SEQ ID NO: 4061180 - RNA, 21 nt, Staphylococcus aureus subsp. aureus N315
uucuucaacaauuucaauguc

SEQ ID NO: 4061181 - RNA, 18 nt, Staphylococcus aureus subsp. aureus N315
uucuucaaccauuuguuc

SEQ ID NO: 4061182 - RNA, 19 nt, Staphylococcus aureus subsp. aureus N315
uucuucaaccauuuguucu

SEQ ID NO: 4061183 - RNA, 13 nt, Staphylococcus aureus subsp. aureus N315
uucuucaauuguc

SEQ ID NO: 4061184 - RNA, 23 nt, Staphylococcus aureus subsp. aureus N315
uucuucaccaguuugugguaaug

SEQ ID NO: 4061185 - RNA, 17 nt, Staphylococcus aureus subsp. aureus N315
uucuucacuaaaaauau

SEQ ID NO: 4061186 - RNA, 16 nt, Staphylococcus aureus subsp. aureus N315
uucuucagguguuuua

SEQ ID NO: 4061187 - RNA, 17 nt, Staphylococcus aureus subsp. aureus N315
uucuucagguguuuuac

SEQ ID NO: 4061188 - RNA, 17 nt, Staphylococcus aureus subsp. aureus N315
uucuucaguuaaaucuu

SEQ ID NO: 4061189 - RNA, 15 nt, Staphylococcus aureus subsp. aureus N315
uucuucauaguucaa

SEQ ID NO: 4061190 - RNA, 12 nt, Staphylococcus aureus subsp. aureus N315
uucuucaucuuu

SEQ ID NO: 4061191 - RNA, 22 nt, Staphylococcus aureus subsp. aureus N315
uucuuccaacacccauauaauu

SEQ ID NO: 4061192 - RNA, 12 nt, Staphylococcus aureus subsp. aureus N315
uucuucugcuaa

SEQ ID NO: 4061193 - RNA, 14 nt, Staphylococcus aureus subsp. aureus N315
uucuucuuuuuuau

SEQ ID NO: 4061194 - RNA, 12 nt, Staphylococcus aureus subsp. aureus N315
uucuugaauaaa

SEQ ID NO: 4061195 - RNA, 22 nt, Staphylococcus aureus subsp. aureus N315
uucuuggucugcuguaucauca

SEQ ID NO: 4061196 - RNA, 16 nt, Staphylococcus aureus subsp. aureus N315
uucuuguucuaaaaua

SEQ ID NO: 4061197 - RNA, 21 nt, Staphylococcus aureus subsp. aureus N315
uucuuguuuagggaaucccau

SEQ ID NO: 4061198 - RNA, 21 nt, Staphylococcus aureus subsp. aureus N315
uucuuuaauauaaauuuugaa

SEQ ID NO: 4061199 - RNA, 15 nt, Staphylococcus aureus subsp. aureus N315
uucuuuacuaaagau

SEQ ID NO: 4061200 - RNA, 21 nt, Staphylococcus aureus subsp. aureus N315
uucuuuacuucuuucaaaaac

SEQ ID NO: 4061201 - RNA, 20 nt, Staphylococcus aureus subsp. aureus N315
uucuuuauagaaaccaaaaa

SEQ ID NO: 4061202 - RNA, 23 nt, Staphylococcus aureus subsp. aureus N315
uucuuuaugauaauaagaauauu

SEQ ID NO: 4061203 - RNA, 16 nt, Staphylococcus aureus subsp. aureus N315
uucuuuauuagaauga

SEQ ID NO: 4061204 - RNA, 20 nt, Staphylococcus aureus subsp. aureus N315
uucuuuauuagaaugaaacc

SEQ ID NO: 4061205 - RNA, 24 nt, Staphylococcus aureus subsp. aureus N315
uucuuucaggcuuuguuuuucacu

SEQ ID NO: 4061206 - RNA, 12 nt, Staphylococcus aureus subsp. aureus N315
uucuuucauaaa

SEQ ID NO: 4061207 - RNA, 12 nt, Staphylococcus aureus subsp. aureus N315
uucuuucauaau

SEQ ID NO: 4061208 - RNA, 12 nt, Staphylococcus aureus subsp. aureus N315
uucuuucuaaaa

SEQ ID NO: 4061209 - RNA, 13 nt, Staphylococcus aureus subsp. aureus N315
uucuuucuaaaau

SEQ ID NO: 4061210 - RNA, 12 nt, Staphylococcus aureus subsp. aureus N315
uucuuugucauc

SEQ ID NO: 4061211 - RNA, 17 nt, Staphylococcus aureus subsp. aureus N315
uucuuuguguuugcuuu

SEQ ID NO: 4061212 - RNA, 21 nt, Staphylococcus aureus subsp. aureus N315
uucuuuguguuugcuuuuauu

SEQ ID NO: 4061213 - RNA, 18 nt, Staphylococcus aureus subsp. aureus N315
uucuuuuaaguuaucaaa

SEQ ID NO: 4061214 - RNA, 17 nt, Staphylococcus aureus subsp. aureus N315
uucuuuucgaaaaucuc

SEQ ID NO: 4061215 - RNA, 21 nt, Staphylococcus aureus subsp. aureus N315
uucuuuuguaauaauugcaug

SEQ ID NO: 4061216 - RNA, 13 nt, Staphylococcus aureus subsp. aureus N315
uucuuuuguaauu

SEQ ID NO: 4061217 - RNA, 19 nt, Staphylococcus aureus subsp. aureus N315
uucuuuuguaauugaaaug

SEQ ID NO: 4061218 - RNA, 11 nt, Staphylococcus aureus subsp. aureus N315
uucuuuuuaaa

SEQ ID NO: 4061219 - RNA, 11 nt, Staphylococcus aureus subsp. aureus N315
uucuuuuuaac

SEQ ID NO: 4061220 - RNA, 20 nt, Staphylococcus aureus subsp. aureus N315
uucuuuuucagcuaauuguc

SEQ ID NO: 4061221 - RNA, 15 nt, Staphylococcus aureus subsp. aureus N315
uucuuuuucuauaca

SEQ ID NO: 4061222 - RNA, 22 nt, Staphylococcus aureus subsp. aureus N315
uucuuuuugcguuuuuaaauaa

SEQ ID NO: 4061223 - RNA, 18 nt, Staphylococcus aureus subsp. aureus N315
uucuuuuuguuguuuuaa

SEQ ID NO: 4061224 - RNA, 23 nt, Staphylococcus aureus subsp. aureus N315
uucuuuuuuaauucuauuuuuga

SEQ ID NO: 4061225 - RNA, 20 nt, Staphylococcus aureus subsp. aureus N315
uugaaaaaccaaguuuugca

SEQ ID NO: 4061226 - RNA, 13 nt, Staphylococcus aureus subsp. aureus N315
uugaaaaagacua

SEQ ID NO: 4061227 - RNA, 16 nt, Staphylococcus aureus subsp. aureus N315
uugaaaaauuaaaaaa

SEQ ID NO: 4061228 - RNA, 19 nt, Staphylococcus aureus subsp. aureus N315
uugaaaaauuaaaaaacaa

SEQ ID NO: 4061229 - RNA, 16 nt, Staphylococcus aureus subsp. aureus N315
uugaaaagauaaacaa

SEQ ID NO: 4061230 - RNA, 12 nt, Staphylococcus aureus subsp. aureus N315
uugaaaaguuug

SEQ ID NO: 4061231 - RNA, 13 nt, Staphylococcus aureus subsp. aureus N315
uugaaaauuucac

SEQ ID NO: 4061232 - RNA, 19 nt, Staphylococcus aureus subsp. aureus N315
uugaaacuaauaauuugua

SEQ ID NO: 4061233 - RNA, 21 nt, Staphylococcus aureus subsp. aureus N315
uugaaaggaauguuuaaaaaa

SEQ ID NO: 4061234 - RNA, 17 nt, Staphylococcus aureus subsp. aureus N315
uugaaauaaucuaguau

SEQ ID NO: 4061235 - RNA, 15 nt, Staphylococcus aureus subsp. aureus N315
uugaaauguuuauca

SEQ ID NO: 4061236 - RNA, 19 nt, Staphylococcus aureus subsp. aureus N315
uugaaauuauuauuuaaau

SEQ ID NO: 4061237 - RNA, 16 nt, Staphylococcus aureus subsp. aureus N315
uugaaauugacaguuu

SEQ ID NO: 4061238 - RNA, 17 nt, Staphylococcus aureus subsp. aureus N315
uugaacaacaucuuuug

SEQ ID NO: 4061239 - RNA, 15 nt, Staphylococcus aureus subsp. aureus N315
uugaacaauucuuca

SEQ ID NO: 4061240 - RNA, 23 nt, Staphylococcus aureus subsp. aureus N315
uugaacauauuauaaaaguguaa

SEQ ID NO: 4061241 - RNA, 21 nt, Staphylococcus aureus subsp. aureus N315
uugaaccggaaauuaaaucga

SEQ ID NO: 4061242 - RNA, 19 nt, Staphylococcus aureus subsp. aureus N315
uugaacuuuaguauauuca

SEQ ID NO: 4061243 - RNA, 11 nt, Staphylococcus aureus subsp. aureus N315
uugaacuuuua

SEQ ID NO: 4061244 - RNA, 23 nt, Staphylococcus aureus subsp. aureus N315
uugaagaaggaugaguuuaaaaa

SEQ ID NO: 4061245 - RNA, 17 nt, Staphylococcus aureus subsp. aureus N315
uugaagcuaauucauau

SEQ ID NO: 4061246 - RNA, 21 nt, Staphylococcus aureus subsp. aureus N315
uugaagcuaauucauauucaa

SEQ ID NO: 4061247 - RNA, 15 nt, Staphylococcus aureus subsp. aureus N315
uugaagggagcauuu

SEQ ID NO: 4061248 - RNA, 20 nt, Staphylococcus aureus subsp. aureus N315
uugaagggagcauuucauua

SEQ ID NO: 4061249 - RNA, 22 nt, Staphylococcus aureus subsp. aureus N315
uugaaguaugcacaucauugau

SEQ ID NO: 4061250 - RNA, 22 nt, Staphylococcus aureus subsp. aureus N315
uugaagugaguuuaucuacauu

SEQ ID NO: 4061251 - RNA, 17 nt, Staphylococcus aureus subsp. aureus N315
uugaagugauuugccaa

SEQ ID NO: 4061252 - RNA, 17 nt, Staphylococcus aureus subsp. aureus N315
uugaauaaauuuuauuc

SEQ ID NO: 4061253 - RNA, 19 nt, Staphylococcus aureus subsp. aureus N315
uugaauaauauauuuagga

SEQ ID NO: 4061254 - RNA, 11 nt, Staphylococcus aureus subsp. aureus N315
uugaauaauca

SEQ ID NO: 4061255 - RNA, 17 nt, Staphylococcus aureus subsp. aureus N315
uugaauaccuuuuauua

SEQ ID NO: 4061256 - RNA, 15 nt, Staphylococcus aureus subsp. aureus N315
uugaauacuuuauuu

SEQ ID NO: 4061257 - RNA, 14 nt, Staphylococcus aureus subsp. aureus N315
uugaauauaaaaaa

SEQ ID NO: 4061258 - RNA, 15 nt, Staphylococcus aureus subsp. aureus N315
uugaauauaaaaaag

SEQ ID NO: 4061259 - RNA, 20 nt, Staphylococcus aureus subsp. aureus N315
uugaauaucacuuuagauaa

SEQ ID NO: 4061260 - RNA, 16 nt, Staphylococcus aureus subsp. aureus N315
uugaauauuugcuuuu

SEQ ID NO: 4061261 - RNA, 11 nt, Staphylococcus aureus subsp. aureus N315
uugaauauuuu

SEQ ID NO: 4061262 - RNA, 16 nt, Staphylococcus aureus subsp. aureus N315
uugaaucaacaguuuu

SEQ ID NO: 4061263 - RNA, 20 nt, Staphylococcus aureus subsp. aureus N315
uugaaucaacaguuuuauua

SEQ ID NO: 4061264 - RNA, 17 nt, Staphylococcus aureus subsp. aureus N315
uugaaucaguauaauca

SEQ ID NO: 4061265 - RNA, 15 nt, Staphylococcus aureus subsp. aureus N315
uugaaucuuguugaa

SEQ ID NO: 4061266 - RNA, 17 nt, Staphylococcus aureus subsp. aureus N315
uugaaucuuguugaacu

SEQ ID NO: 4061267 - RNA, 23 nt, Staphylococcus aureus subsp. aureus N315
uugaaugaaguaauauauaaaag

SEQ ID NO: 4061268 - RNA, 17 nt, Staphylococcus aureus subsp. aureus N315
uugaaugguauaauucc

SEQ ID NO: 4061269 - RNA, 18 nt, Staphylococcus aureus subsp. aureus N315
uugaaugguauaauuccu

SEQ ID NO: 4061270 - RNA, 14 nt, Staphylococcus aureus subsp. aureus N315
uugaauguuucucc

SEQ ID NO: 4061271 - RNA, 22 nt, Staphylococcus aureus subsp. aureus N315
uugaauuaacaauauuaaauuu

SEQ ID NO: 4061272 - RNA, 23 nt, Staphylococcus aureus subsp. aureus N315
uugaauugacuuacauuuuaaua

SEQ ID NO: 4061273 - RNA, 13 nt, Staphylococcus aureus subsp. aureus N315
uugaauuuuauua

SEQ ID NO: 4061274 - RNA, 19 nt, Staphylococcus aureus subsp. aureus N315
uugacaaguugcugaauaa

SEQ ID NO: 4061275 - RNA, 15 nt, Staphylococcus aureus subsp. aureus N315
uugacauauuuuuua

SEQ ID NO: 4061276 - RNA, 18 nt, Staphylococcus aureus subsp. aureus N315
uugacauguguuaaacca

SEQ ID NO: 4061277 - RNA, 17 nt, Staphylococcus aureus subsp. aureus N315
uugacauuugaccaagu

SEQ ID NO: 4061278 - RNA, 16 nt, Staphylococcus aureus subsp. aureus N315
uugaccacuuuuguua

SEQ ID NO: 4061279 - RNA, 21 nt, Staphylococcus aureus subsp. aureus N315
uugaccgccuaugauauaugu

SEQ ID NO: 4061280 - RNA, 13 nt, Staphylococcus aureus subsp. aureus N315
uugaccuucaguu

SEQ ID NO: 4061281 - RNA, 14 nt, Staphylococcus aureus subsp. aureus N315
uugacuaaguuugu

SEQ ID NO: 4061282 - RNA, 20 nt, Staphylococcus aureus subsp. aureus N315
uugacuaaguuuguuuucuu

SEQ ID NO: 4061283 - RNA, 20 nt, Staphylococcus aureus subsp. aureus N315
uugacucaaagauauacuua

SEQ ID NO: 4061284 - RNA, 14 nt, Staphylococcus aureus subsp. aureus N315
uugagaauauuaag

SEQ ID NO: 4061285 - RNA, 19 nt, Staphylococcus aureus subsp. aureus N315
uugagacaaaaauaaacca

SEQ ID NO: 4061286 - RNA, 14 nt, Staphylococcus aureus subsp. aureus N315
uugagacaacauug

SEQ ID NO: 4061287 - RNA, 16 nt, Staphylococcus aureus subsp. aureus N315
uugagacguuuuccau

SEQ ID NO: 4061288 - RNA, 18 nt, Staphylococcus aureus subsp. aureus N315
uugagagauuauuuaaaa

SEQ ID NO: 4061289 - RNA, 15 nt, Staphylococcus aureus subsp. aureus N315
uugagcaaugucuuu

SEQ ID NO: 4061290 - RNA, 19 nt, Staphylococcus aureus subsp. aureus N315
uugaguacuaaucaauacu

SEQ ID NO: 4061291 - RNA, 20 nt, Staphylococcus aureus subsp. aureus N315
uugaguacuaaucaauacua

SEQ ID NO: 4061292 - RNA, 21 nt, Staphylococcus aureus subsp. aureus N315
uugaguacuaaucaauacuaa

SEQ ID NO: 4061293 - RNA, 22 nt, Staphylococcus aureus subsp. aureus N315
uugaguaucaugcuuuuaauau

SEQ ID NO: 4061294 - RNA, 15 nt, Staphylococcus aureus subsp. aureus N315
uugaguauuaaauuu

SEQ ID NO: 4061295 - RNA, 17 nt, Staphylococcus aureus subsp. aureus N315
uugagucaauucgacuc

SEQ ID NO: 4061296 - RNA, 19 nt, Staphylococcus aureus subsp. aureus N315
uugauaaaaaaugaauguu

SEQ ID NO: 4061297 - RNA, 14 nt, Staphylococcus aureus subsp. aureus N315
uugauaaaauaaau

SEQ ID NO: 4061298 - RNA, 16 nt, Staphylococcus aureus subsp. aureus N315
uugauaaaauaaauaa

SEQ ID NO: 4061299 - RNA, 13 nt, Staphylococcus aureus subsp. aureus N315
uugauaaaauaau

SEQ ID NO: 4061300 - RNA, 17 nt, Staphylococcus aureus subsp. aureus N315
uugauaaauauugaaca

SEQ ID NO: 4061301 - RNA, 20 nt, Staphylococcus aureus subsp. aureus N315
uugauaacaaaacgauugau

SEQ ID NO: 4061302 - RNA, 21 nt, Staphylococcus aureus subsp. aureus N315
uugauaaguagaaaauaugac

SEQ ID NO: 4061303 - RNA, 22 nt, Staphylococcus aureus subsp. aureus N315
uugauaaguucuagauuauuua

SEQ ID NO: 4061304 - RNA, 22 nt, Staphylococcus aureus subsp. aureus N315
uugauacguaaacacuuuagua

SEQ ID NO: 4061305 - RNA, 20 nt, Staphylococcus aureus subsp. aureus N315
uugauagcaccguaacauau

SEQ ID NO: 4061306 - RNA, 17 nt, Staphylococcus aureus subsp. aureus N315
uugauaguaauaguuaa

SEQ ID NO: 4061307 - RNA, 22 nt, Staphylococcus aureus subsp. aureus N315
uugauaguaaucucucgcuaaa

SEQ ID NO: 4061308 - RNA, 22 nt, Staphylococcus aureus subsp. aureus N315
uugauagugguagccaauauca

SEQ ID NO: 4061309 - RNA, 20 nt, Staphylococcus aureus subsp. aureus N315
uugauaguuguaucauuaau

SEQ ID NO: 4061310 - RNA, 18 nt, Staphylococcus aureus subsp. aureus N315
uugauaugcucucuucaa

SEQ ID NO: 4061311 - RNA, 19 nt, Staphylococcus aureus subsp. aureus N315
uugauauggcguauucacc

SEQ ID NO: 4061312 - RNA, 18 nt, Staphylococcus aureus subsp. aureus N315
uugauaugguuagagaaa

SEQ ID NO: 4061313 - RNA, 21 nt, Staphylococcus aureus subsp. aureus N315
uugauaugguuagagaaaaau

SEQ ID NO: 4061314 - RNA, 22 nt, Staphylococcus aureus subsp. aureus N315
uugauaugguuagagaaaaauc

SEQ ID NO: 4061315 - RNA, 11 nt, Staphylococcus aureus subsp. aureus N315
uugauauguuu

SEQ ID NO: 4061316 - RNA, 16 nt, Staphylococcus aureus subsp. aureus N315
uugauauucuaaaaaa

SEQ ID NO: 4061317 - RNA, 13 nt, Staphylococcus aureus subsp. aureus N315
uugauauuucauc

SEQ ID NO: 4061318 - RNA, 17 nt, Staphylococcus aureus subsp. aureus N315
uugauauuuuucacgua

SEQ ID NO: 4061319 - RNA, 17 nt, Staphylococcus aureus subsp. aureus N315
uugaucaaaaauguuau

SEQ ID NO: 4061320 - RNA, 14 nt, Staphylococcus aureus subsp. aureus N315
uugaucauaauuca

SEQ ID NO: 4061321 - RNA, 18 nt, Staphylococcus aureus subsp. aureus N315
uugaucauuugacauaau

SEQ ID NO: 4061322 - RNA, 24 nt, Staphylococcus aureus subsp. aureus N315
uugauccaaaguacucaaguaauc

SEQ ID NO: 4061323 - RNA, 18 nt, Staphylococcus aureus subsp. aureus N315
uugaucgauuguuuauua

SEQ ID NO: 4061324 - RNA, 16 nt, Staphylococcus aureus subsp. aureus N315
uugaucuuugacaugu

SEQ ID NO: 4061325 - RNA, 19 nt, Staphylococcus aureus subsp. aureus N315
uugaugaugaugugcuuua

SEQ ID NO: 4061326 - RNA, 16 nt, Staphylococcus aureus subsp. aureus N315
uugaugucaauuucac

SEQ ID NO: 4061327 - RNA, 15 nt, Staphylococcus aureus subsp. aureus N315
uugaugucacauaug

SEQ ID NO: 4061328 - RNA, 20 nt, Staphylococcus aureus subsp. aureus N315
uugauguguugcauuacuau

SEQ ID NO: 4061329 - RNA, 18 nt, Staphylococcus aureus subsp. aureus N315
uugauguucuugaaaaca

SEQ ID NO: 4061330 - RNA, 14 nt, Staphylococcus aureus subsp. aureus N315
uugauuaaaagugu

SEQ ID NO: 4061331 - RNA, 18 nt, Staphylococcus aureus subsp. aureus N315
uugauuaacacaauccuu

SEQ ID NO: 4061332 - RNA, 17 nt, Staphylococcus aureus subsp. aureus N315
uugauuagcauaccuuu

SEQ ID NO: 4061333 - RNA, 22 nt, Staphylococcus aureus subsp. aureus N315
uugauuaucauuguucauacgc

SEQ ID NO: 4061334 - RNA, 18 nt, Staphylococcus aureus subsp. aureus N315
uugauuauucuuugauua

SEQ ID NO: 4061335 - RNA, 19 nt, Staphylococcus aureus subsp. aureus N315
uugauucauuucgauuaau

SEQ ID NO: 4061336 - RNA, 16 nt, Staphylococcus aureus subsp. aureus N315
uugauucuacuucacc

SEQ ID NO: 4061337 - RNA, 18 nt, Staphylococcus aureus subsp. aureus N315
uugauucuagugaaauac

SEQ ID NO: 4061338 - RNA, 15 nt, Staphylococcus aureus subsp. aureus N315
uugauucuauuucuu

SEQ ID NO: 4061339 - RNA, 20 nt, Staphylococcus aureus subsp. aureus N315
uugauucuucaccaguuugu

SEQ ID NO: 4061340 - RNA, 15 nt, Staphylococcus aureus subsp. aureus N315
uugauugcaaaaaaa

SEQ ID NO: 4061341 - RNA, 16 nt, Staphylococcus aureus subsp. aureus N315
uugauugcaaaaaaac

SEQ ID NO: 4061342 - RNA, 17 nt, Staphylococcus aureus subsp. aureus N315
uugauuguauuuuucaa

SEQ ID NO: 4061343 - RNA, 15 nt, Staphylococcus aureus subsp. aureus N315
uugauuuacgugcau

SEQ ID NO: 4061344 - RNA, 18 nt, Staphylococcus aureus subsp. aureus N315
uugauuuugaauaaaaaa

SEQ ID NO: 4061345 - RNA, 20 nt, Staphylococcus aureus subsp. aureus N315
uugauuuugaaucacauuaa

SEQ ID NO: 4061346 - RNA, 18 nt, Staphylococcus aureus subsp. aureus N315
uugauuuuuugaaauguu

SEQ ID NO: 4061347 - RNA, 14 nt, Staphylococcus aureus subsp. aureus N315
uugcaaaauacgau

SEQ ID NO: 4061348 - RNA, 15 nt, Staphylococcus aureus subsp. aureus N315
uugcaaaguaacaau

SEQ ID NO: 4061349 - RNA, 21 nt, Staphylococcus aureus subsp. aureus N315
uugcaaauauaucaucucuau

SEQ ID NO: 4061350 - RNA, 19 nt, Staphylococcus aureus subsp. aureus N315
uugcaaauuaucauuaaau

SEQ ID NO: 4061351 - RNA, 20 nt, Staphylococcus aureus subsp. aureus N315
uugcaaauuaucauuaaauu

SEQ ID NO: 4061352 - RNA, 13 nt, Staphylococcus aureus subsp. aureus N315
uugcaaguauuuu

SEQ ID NO: 4061353 - RNA, 18 nt, Staphylococcus aureus subsp. aureus N315
uugcaauaauucaucuug

SEQ ID NO: 4061354 - RNA, 16 nt, Staphylococcus aureus subsp. aureus N315
uugcaauugcaaugaa

SEQ ID NO: 4061355 - RNA, 20 nt, Staphylococcus aureus subsp. aureus N315
uugcaauugcaaugaauaac

SEQ ID NO: 4061356 - RNA, 19 nt, Staphylococcus aureus subsp. aureus N315
uugcacaaagauauguuua

SEQ ID NO: 4061357 - RNA, 21 nt, Staphylococcus aureus subsp. aureus N315
uugcacaguuucaucuucaac

SEQ ID NO: 4061358 - RNA, 22 nt, Staphylococcus aureus subsp. aureus N315
uugcacgucuuguaucaacauu

SEQ ID NO: 4061359 - RNA, 16 nt, Staphylococcus aureus subsp. aureus N315
uugcacuaugcauaau

SEQ ID NO: 4061360 - RNA, 18 nt, Staphylococcus aureus subsp. aureus N315
uugcacucuuuucucguu

SEQ ID NO: 4061361 - RNA, 22 nt, Staphylococcus aureus subsp. aureus N315
uugcauauccuucaaagauuuu

SEQ ID NO: 4061362 - RNA, 14 nt, Staphylococcus aureus subsp. aureus N315
uugcauccaugcug

SEQ ID NO: 4061363 - RNA, 19 nt, Staphylococcus aureus subsp. aureus N315
uugcaugacagcaaauuuu

SEQ ID NO: 4061364 - RNA, 13 nt, Staphylococcus aureus subsp. aureus N315
uugcauguaaaau

SEQ ID NO: 4061365 - RNA, 14 nt, Staphylococcus aureus subsp. aureus N315
uugcauguaaaauu

SEQ ID NO: 4061366 - RNA, 21 nt, Staphylococcus aureus subsp. aureus N315
uugccaaaaguuauauaaauu

SEQ ID NO: 4061367 - RNA, 22 nt, Staphylococcus aureus subsp. aureus N315
uugccacuuuguggauucucuu

SEQ ID NO: 4061368 - RNA, 19 nt, Staphylococcus aureus subsp. aureus N315
uugccauacccauauuaaa

SEQ ID NO: 4061369 - RNA, 20 nt, Staphylococcus aureus subsp. aureus N315
uugccucaauaucuuuaauu

SEQ ID NO: 4061370 - RNA, 15 nt, Staphylococcus aureus subsp. aureus N315
uugccucguccauug

SEQ ID NO: 4061371 - RNA, 21 nt, Staphylococcus aureus subsp. aureus N315
uugccuggcaacguucuacuc

SEQ ID NO: 4061372 - RNA, 14 nt, Staphylococcus aureus subsp. aureus N315
uugccuuucauuuu

SEQ ID NO: 4061373 - RNA, 16 nt, Staphylococcus aureus subsp. aureus N315
uugccuuuugaauaau

SEQ ID NO: 4061374 - RNA, 21 nt, Staphylococcus aureus subsp. aureus N315
uugcgauauacgaauccucau

SEQ ID NO: 4061375 - RNA, 22 nt, Staphylococcus aureus subsp. aureus N315
uugcgauuucuucugcuaacuc

SEQ ID NO: 4061376 - RNA, 16 nt, Staphylococcus aureus subsp. aureus N315
uugcgguuggcucuuu

SEQ ID NO: 4061377 - RNA, 17 nt, Staphylococcus aureus subsp. aureus N315
uugcguuuaauaacauu

SEQ ID NO: 4061378 - RNA, 23 nt, Staphylococcus aureus subsp. aureus N315
uugcguuuguguguuuuaaaauu

SEQ ID NO: 4061379 - RNA, 18 nt, Staphylococcus aureus subsp. aureus N315
uugcuaaaaaaauuaaaa

SEQ ID NO: 4061380 - RNA, 21 nt, Staphylococcus aureus subsp. aureus N315
uugcuaaaauaucaaaauaua

SEQ ID NO: 4061381 - RNA, 20 nt, Staphylococcus aureus subsp. aureus N315
uugcuagucauaauuuaaaa

SEQ ID NO: 4061382 - RNA, 19 nt, Staphylococcus aureus subsp. aureus N315
uugcuagugcucuugcaau

SEQ ID NO: 4061383 - RNA, 23 nt, Staphylococcus aureus subsp. aureus N315
uugcuauuucaacaaacauaaau

SEQ ID NO: 4061384 - RNA, 22 nt, Staphylococcus aureus subsp. aureus N315
uugcucaccuuuagacaauauu

SEQ ID NO: 4061385 - RNA, 14 nt, Staphylococcus aureus subsp. aureus N315
uugcucuaauccaa

SEQ ID NO: 4061386 - RNA, 14 nt, Staphylococcus aureus subsp. aureus N315
uugcugaauaaaau

SEQ ID NO: 4061387 - RNA, 21 nt, Staphylococcus aureus subsp. aureus N315
uugcugcuguacaauuucgcu

SEQ ID NO: 4061388 - RNA, 13 nt, Staphylococcus aureus subsp. aureus N315
uugcuggauuaca

SEQ ID NO: 4061389 - RNA, 18 nt, Staphylococcus aureus subsp. aureus N315
uugcuucauuauauaauu

SEQ ID NO: 4061390 - RNA, 22 nt, Staphylococcus aureus subsp. aureus N315
uugcuugaaauuauuauuuaaa

SEQ ID NO: 4061391 - RNA, 19 nt, Staphylococcus aureus subsp. aureus N315
uugcuuguacgauaacuac

SEQ ID NO: 4061392 - RNA, 13 nt, Staphylococcus aureus subsp. aureus N315
uugcuuuaauuug

SEQ ID NO: 4061393 - RNA, 14 nt, Staphylococcus aureus subsp. aureus N315
uugcuuuaauuuga

SEQ ID NO: 4061394 - RNA, 21 nt, Staphylococcus aureus subsp. aureus N315
uugcuuuaauuugauuaaauu

SEQ ID NO: 4061395 - RNA, 13 nt, Staphylococcus aureus subsp. aureus N315
uugcuuuuuacua

SEQ ID NO: 4061396 - RNA, 14 nt, Staphylococcus aureus subsp. aureus N315
uugcuuuuuacuau

SEQ ID NO: 4061397 - RNA, 21 nt, Staphylococcus aureus subsp. aureus N315
uugcuuuuucaaauaauauaa

SEQ ID NO: 4061398 - RNA, 14 nt, Staphylococcus aureus subsp. aureus N315
uuggaaaaauaaau

SEQ ID NO: 4061399 - RNA, 14 nt, Staphylococcus aureus subsp. aureus N315
uuggaaaaauugug

SEQ ID NO: 4061400 - RNA, 14 nt, Staphylococcus aureus subsp. aureus N315
uuggaaagauggga

SEQ ID NO: 4061401 - RNA, 19 nt, Staphylococcus aureus subsp. aureus N315
uuggaaauaucuuacugcu

SEQ ID NO: 4061402 - RNA, 18 nt, Staphylococcus aureus subsp. aureus N315
uuggaaauuuauuauaaa

SEQ ID NO: 4061403 - RNA, 18 nt, Staphylococcus aureus subsp. aureus N315
uuggaacauauucauaau

SEQ ID NO: 4061404 - RNA, 16 nt, Staphylococcus aureus subsp. aureus N315
uuggaagcaauuaugg

SEQ ID NO: 4061405 - RNA, 14 nt, Staphylococcus aureus subsp. aureus N315
uuggaaucaucuuu

SEQ ID NO: 4061406 - RNA, 14 nt, Staphylococcus aureus subsp. aureus N315
uuggaucuuucaaa

SEQ ID NO: 4061407 - RNA, 19 nt, Staphylococcus aureus subsp. aureus N315
uuggauguaauagagaagg

SEQ ID NO: 4061408 - RNA, 17 nt, Staphylococcus aureus subsp. aureus N315
uuggauucaaaugacau

SEQ ID NO: 4061409 - RNA, 20 nt, Staphylococcus aureus subsp. aureus N315
uuggauucuuuuguaauaau

SEQ ID NO: 4061410 - RNA, 23 nt, Staphylococcus aureus subsp. aureus N315
uuggcaauuguuuaucuccuaaa

SEQ ID NO: 4061411 - RNA, 18 nt, Staphylococcus aureus subsp. aureus N315
uuggcagugaucuuuuuu

SEQ ID NO: 4061412 - RNA, 20 nt, Staphylococcus aureus subsp. aureus N315
uuggcaugucgguuaaucca

SEQ ID NO: 4061413 - RNA, 18 nt, Staphylococcus aureus subsp. aureus N315
uuggcguauuuuuuguuc

SEQ ID NO: 4061414 - RNA, 22 nt, Staphylococcus aureus subsp. aureus N315
uuggcucuuuuuauuuauaacu

SEQ ID NO: 4061415 - RNA, 21 nt, Staphylococcus aureus subsp. aureus N315
uuggcuggcccccaacacuga

SEQ ID NO: 4061416 - RNA, 16 nt, Staphylococcus aureus subsp. aureus N315
uuggcuugaaguuguu

SEQ ID NO: 4061417 - RNA, 15 nt, Staphylococcus aureus subsp. aureus N315
uugggaauugaccac

SEQ ID NO: 4061418 - RNA, 20 nt, Staphylococcus aureus subsp. aureus N315
uugggcugauaauaaaaguu

SEQ ID NO: 4061419 - RNA, 17 nt, Staphylococcus aureus subsp. aureus N315
uuggggaugggccccaa

SEQ ID NO: 4061420 - RNA, 20 nt, Staphylococcus aureus subsp. aureus N315
uuggggccccgacuauuuuu

SEQ ID NO: 4061421 - RNA, 23 nt, Staphylococcus aureus subsp. aureus N315
uugguauacaguuuuacuauaau

SEQ ID NO: 4061422 - RNA, 20 nt, Staphylococcus aureus subsp. aureus N315
uugguauaucgaaagguaac

SEQ ID NO: 4061423 - RNA, 18 nt, Staphylococcus aureus subsp. aureus N315
uugguauucaucuucaaa

SEQ ID NO: 4061424 - RNA, 13 nt, Staphylococcus aureus subsp. aureus N315
uugguauugguaa

SEQ ID NO: 4061425 - RNA, 16 nt, Staphylococcus aureus subsp. aureus N315
uuggucaaguaaaugu

SEQ ID NO: 4061426 - RNA, 16 nt, Staphylococcus aureus subsp. aureus N315
uuggucaaguuuuggu

SEQ ID NO: 4061427 - RNA, 22 nt, Staphylococcus aureus subsp. aureus N315
uuggucaccuacagauaaagcu

SEQ ID NO: 4061428 - RNA, 19 nt, Staphylococcus aureus subsp. aureus N315
uuggugaguguuucauaau

SEQ ID NO: 4061429 - RNA, 23 nt, Staphylococcus aureus subsp. aureus N315
uugguggaugucaugucuagauu

SEQ ID NO: 4061430 - RNA, 16 nt, Staphylococcus aureus subsp. aureus N315
uugguguuuagucuuu

SEQ ID NO: 4061431 - RNA, 15 nt, Staphylococcus aureus subsp. aureus N315
uugguugaacuguuu

SEQ ID NO: 4061432 - RNA, 17 nt, Staphylococcus aureus subsp. aureus N315
uuguaaaaauacauaau

SEQ ID NO: 4061433 - RNA, 15 nt, Staphylococcus aureus subsp. aureus N315
uuguaaauaaaacua

SEQ ID NO: 4061434 - RNA, 20 nt, Staphylococcus aureus subsp. aureus N315
uuguaaauaaaacuaucuac

SEQ ID NO: 4061435 - RNA, 21 nt, Staphylococcus aureus subsp. aureus N315
uuguaaauauuuuuuaaaaug

SEQ ID NO: 4061436 - RNA, 20 nt, Staphylococcus aureus subsp. aureus N315
uuguaacaagcauuuuucaa

SEQ ID NO: 4061437 - RNA, 18 nt, Staphylococcus aureus subsp. aureus N315
uuguaacacacuuauaau

SEQ ID NO: 4061438 - RNA, 21 nt, Staphylococcus aureus subsp. aureus N315
uuguaacucaauaugaaaccu

SEQ ID NO: 4061439 - RNA, 22 nt, Staphylococcus aureus subsp. aureus N315
uuguaagucgcucuagacauua

SEQ ID NO: 4061440 - RNA, 18 nt, Staphylococcus aureus subsp. aureus N315
uuguaaucccauuuuaaa

SEQ ID NO: 4061441 - RNA, 16 nt, Staphylococcus aureus subsp. aureus N315
uuguaauugaaaugau

SEQ ID NO: 4061442 - RNA, 21 nt, Staphylococcus aureus subsp. aureus N315
uuguacaaaaaauuguaaguc

SEQ ID NO: 4061443 - RNA, 23 nt, Staphylococcus aureus subsp. aureus N315
uuguacaguaauauucaacuugu

SEQ ID NO: 4061444 - RNA, 16 nt, Staphylococcus aureus subsp. aureus N315
uuguacauauguguau

SEQ ID NO: 4061445 - RNA, 19 nt, Staphylococcus aureus subsp. aureus N315
uuguacaucauuaaauauu

SEQ ID NO: 4061446 - RNA, 21 nt, Staphylococcus aureus subsp. aureus N315
uuguaccaaauaaauuaaauu

SEQ ID NO: 4061447 - RNA, 21 nt, Staphylococcus aureus subsp. aureus N315
uuguacgcuucaauuauuuca

SEQ ID NO: 4061448 - RNA, 11 nt, Staphylococcus aureus subsp. aureus N315
uuguacuucuu

SEQ ID NO: 4061449 - RNA, 23 nt, Staphylococcus aureus subsp. aureus N315
uuguagggaguauuguuuuauau

SEQ ID NO: 4061450 - RNA, 19 nt, Staphylococcus aureus subsp. aureus N315
uuguauaaagauuuaaguc

SEQ ID NO: 4061451 - RNA, 17 nt, Staphylococcus aureus subsp. aureus N315
uuguauagaauguguau

SEQ ID NO: 4061452 - RNA, 18 nt, Staphylococcus aureus subsp. aureus N315
uuguauagaauguguaug

SEQ ID NO: 4061453 - RNA, 20 nt, Staphylococcus aureus subsp. aureus N315
uuguauagauuguauuuaau

SEQ ID NO: 4061454 - RNA, 22 nt, Staphylococcus aureus subsp. aureus N315
uuguauagauuguauuuaauaa

SEQ ID NO: 4061455 - RNA, 21 nt, Staphylococcus aureus subsp. aureus N315
uuguauaugauuaaauaauca

SEQ ID NO: 4061456 - RNA, 18 nt, Staphylococcus aureus subsp. aureus N315
uuguauuuaauaaguuaa

SEQ ID NO: 4061457 - RNA, 21 nt, Staphylococcus aureus subsp. aureus N315
uuguauuuccuuaauaugcac

SEQ ID NO: 4061458 - RNA, 13 nt, Staphylococcus aureus subsp. aureus N315
uuguauuuuucaa

SEQ ID NO: 4061459 - RNA, 15 nt, Staphylococcus aureus subsp. aureus N315
uuguauuuuucaaau

SEQ ID NO: 4061460 - RNA, 21 nt, Staphylococcus aureus subsp. aureus N315
uugucaaaauugaacuuugua

SEQ ID NO: 4061461 - RNA, 19 nt, Staphylococcus aureus subsp. aureus N315
uugucacgauagauuuauc

SEQ ID NO: 4061462 - RNA, 12 nt, Staphylococcus aureus subsp. aureus N315
uugucaucuuuu

SEQ ID NO: 4061463 - RNA, 13 nt, Staphylococcus aureus subsp. aureus N315
uugucaugccuuc

SEQ ID NO: 4061464 - RNA, 14 nt, Staphylococcus aureus subsp. aureus N315
uugucaugccuuca

SEQ ID NO: 4061465 - RNA, 19 nt, Staphylococcus aureus subsp. aureus N315
uugucauuugaacaucauu

SEQ ID NO: 4061466 - RNA, 16 nt, Staphylococcus aureus subsp. aureus N315
uugucauuuugauuaa

SEQ ID NO: 4061467 - RNA, 17 nt, Staphylococcus aureus subsp. aureus N315
uuguccaugccuuaugu

SEQ ID NO: 4061468 - RNA, 14 nt, Staphylococcus aureus subsp. aureus N315
uuguccguuuauag

SEQ ID NO: 4061469 - RNA, 21 nt, Staphylococcus aureus subsp. aureus N315
uugucggacgauauauacaaa

SEQ ID NO: 4061470 - RNA, 22 nt, Staphylococcus aureus subsp. aureus N315
uugucguucucguguaaaaugc

SEQ ID NO: 4061471 - RNA, 16 nt, Staphylococcus aureus subsp. aureus N315
uugucucaauaauguu

SEQ ID NO: 4061472 - RNA, 15 nt, Staphylococcus aureus subsp. aureus N315
uugucuuuuauauuu

SEQ ID NO: 4061473 - RNA, 17 nt, Staphylococcus aureus subsp. aureus N315
uugucuuuuuuaucaug

SEQ ID NO: 4061474 - RNA, 18 nt, Staphylococcus aureus subsp. aureus N315
uugugaaauuagagaacg

SEQ ID NO: 4061475 - RNA, 15 nt, Staphylococcus aureus subsp. aureus N315
uugugaauaauuuca

SEQ ID NO: 4061476 - RNA, 21 nt, Staphylococcus aureus subsp. aureus N315
uugugacgcugguaauauuuu

SEQ ID NO: 4061477 - RNA, 16 nt, Staphylococcus aureus subsp. aureus N315
uugugauaauucuuca

SEQ ID NO: 4061478 - RNA, 17 nt, Staphylococcus aureus subsp. aureus N315
uugugauuuuuaauaau

SEQ ID NO: 4061479 - RNA, 14 nt, Staphylococcus aureus subsp. aureus N315
uugugccaacaaag

SEQ ID NO: 4061480 - RNA, 20 nt, Staphylococcus aureus subsp. aureus N315
uugugccaacaaagcuucca

SEQ ID NO: 4061481 - RNA, 15 nt, Staphylococcus aureus subsp. aureus N315
uugugcuuuuccaua

SEQ ID NO: 4061482 - RNA, 23 nt, Staphylococcus aureus subsp. aureus N315
uuguggcguaguuugaauuggga

SEQ ID NO: 4061483 - RNA, 20 nt, Staphylococcus aureus subsp. aureus N315
uugugggcguucugcuaauc

SEQ ID NO: 4061484 - RNA, 19 nt, Staphylococcus aureus subsp. aureus N315
uugugguaaucauguaaug

SEQ ID NO: 4061485 - RNA, 22 nt, Staphylococcus aureus subsp. aureus N315
uugugguaaugauuuugcuuua

SEQ ID NO: 4061486 - RNA, 17 nt, Staphylococcus aureus subsp. aureus N315
uugugguauuaauuaca

SEQ ID NO: 4061487 - RNA, 19 nt, Staphylococcus aureus subsp. aureus N315
uuguguaucuguaacauaa

SEQ ID NO: 4061488 - RNA, 18 nt, Staphylococcus aureus subsp. aureus N315
uuguguauuguuuuacuu

SEQ ID NO: 4061489 - RNA, 24 nt, Staphylococcus aureus subsp. aureus N315
uuguguauuuuuauuguuuuggcu

SEQ ID NO: 4061490 - RNA, 13 nt, Staphylococcus aureus subsp. aureus N315
uuguguuauguau

SEQ ID NO: 4061491 - RNA, 13 nt, Staphylococcus aureus subsp. aureus N315
uuguguugaauca

SEQ ID NO: 4061492 - RNA, 22 nt, Staphylococcus aureus subsp. aureus N315
uuguuaccaaacaauacauaau

SEQ ID NO: 4061493 - RNA, 13 nt, Staphylococcus aureus subsp. aureus N315
uuguuagcaucug

SEQ ID NO: 4061494 - RNA, 18 nt, Staphylococcus aureus subsp. aureus N315
uuguuauaaguaaauaau

SEQ ID NO: 4061495 - RNA, 19 nt, Staphylococcus aureus subsp. aureus N315
uuguuauaaguaaauaaua

SEQ ID NO: 4061496 - RNA, 15 nt, Staphylococcus aureus subsp. aureus N315
uuguuauaucuaauu

SEQ ID NO: 4061497 - RNA, 19 nt, Staphylococcus aureus subsp. aureus N315
uuguuaucguucaauguua

SEQ ID NO: 4061498 - RNA, 17 nt, Staphylococcus aureus subsp. aureus N315
uuguucaacuaaauuuu

SEQ ID NO: 4061499 - RNA, 20 nt, Staphylococcus aureus subsp. aureus N315
uuguucaauucagcaaugag

SEQ ID NO: 4061500 - RNA, 12 nt, Staphylococcus aureus subsp. aureus N315
uuguucagauuu

SEQ ID NO: 4061501 - RNA, 14 nt, Staphylococcus aureus subsp. aureus N315
uuguucuaauuguu

SEQ ID NO: 4061502 - RNA, 22 nt, Staphylococcus aureus subsp. aureus N315
uuguucuccgaucaugccuuca

SEQ ID NO: 4061503 - RNA, 20 nt, Staphylococcus aureus subsp. aureus N315
uuguucuuucuuguucuaaa

SEQ ID NO: 4061504 - RNA, 19 nt, Staphylococcus aureus subsp. aureus N315
uuguugaauaauuaauguu

SEQ ID NO: 4061505 - RNA, 14 nt, Staphylococcus aureus subsp. aureus N315
uuguugcaaugauu

SEQ ID NO: 4061506 - RNA, 15 nt, Staphylococcus aureus subsp. aureus N315
uuguuggggcccaca

SEQ ID NO: 4061507 - RNA, 14 nt, Staphylococcus aureus subsp. aureus N315
uuguugguuuugca

SEQ ID NO: 4061508 - RNA, 15 nt, Staphylococcus aureus subsp. aureus N315
uuguuuaagaaugua

SEQ ID NO: 4061509 - RNA, 17 nt, Staphylococcus aureus subsp. aureus N315
uuguuuaaguuuuucag

SEQ ID NO: 4061510 - RNA, 17 nt, Staphylococcus aureus subsp. aureus N315
uuguuuaccuaaaucuu

SEQ ID NO: 4061511 - RNA, 13 nt, Staphylococcus aureus subsp. aureus N315
uuguuuagaaaag

SEQ ID NO: 4061512 - RNA, 12 nt, Staphylococcus aureus subsp. aureus N315
uuguuugcuucu

SEQ ID NO: 4061513 - RNA, 20 nt, Staphylococcus aureus subsp. aureus N315
uuguuuucaaaugaaaauac

SEQ ID NO: 4061514 - RNA, 22 nt, Staphylococcus aureus subsp. aureus N315
uuguuuucaucaugcauaauca

SEQ ID NO: 4061515 - RNA, 16 nt, Staphylococcus aureus subsp. aureus N315
uuguuuuccaauaaua

SEQ ID NO: 4061516 - RNA, 19 nt, Staphylococcus aureus subsp. aureus N315
uuguuuugacaaauccuaa

SEQ ID NO: 4061517 - RNA, 23 nt, Staphylococcus aureus subsp. aureus N315
uuuaaaaaacauaccugcauauu

SEQ ID NO: 4061518 - RNA, 11 nt, Staphylococcus aureus subsp. aureus N315
uuuaaaaaacu

SEQ ID NO: 4061519 - RNA, 18 nt, Staphylococcus aureus subsp. aureus N315
uuuaaaaaauuuaaauaa

SEQ ID NO: 4061520 - RNA, 17 nt, Staphylococcus aureus subsp. aureus N315
uuuaaaaaauuuaaugu

SEQ ID NO: 4061521 - RNA, 22 nt, Staphylococcus aureus subsp. aureus N315
uuuaaaaauaaaaaaccaauaa

SEQ ID NO: 4061522 - RNA, 12 nt, Staphylococcus aureus subsp. aureus N315
uuuaaaaauaca

SEQ ID NO: 4061523 - RNA, 21 nt, Staphylococcus aureus subsp. aureus N315
uuuaaaaauagccuucaaaau

SEQ ID NO: 4061524 - RNA, 22 nt, Staphylococcus aureus subsp. aureus N315
uuuaaaaaugcugguaaauguu

SEQ ID NO: 4061525 - RNA, 16 nt, Staphylococcus aureus subsp. aureus N315
uuuaaaaauucauaau

SEQ ID NO: 4061526 - RNA, 22 nt, Staphylococcus aureus subsp. aureus N315
uuuaaaacaaugauuaaaauua

SEQ ID NO: 4061527 - RNA, 22 nt, Staphylococcus aureus subsp. aureus N315
uuuaaaacaucauucacaaguu

SEQ ID NO: 4061528 - RNA, 14 nt, Staphylococcus aureus subsp. aureus N315
uuuaaaauaauaga

SEQ ID NO: 4061529 - RNA, 11 nt, Staphylococcus aureus subsp. aureus N315
uuuaaaauacg

SEQ ID NO: 4061530 - RNA, 13 nt, Staphylococcus aureus subsp. aureus N315
uuuaaaauauuau

SEQ ID NO: 4061531 - RNA, 16 nt, Staphylococcus aureus subsp. aureus N315
uuuaaaaucucauaau

SEQ ID NO: 4061532 - RNA, 13 nt, Staphylococcus aureus subsp. aureus N315
uuuaaaauuauca

SEQ ID NO: 4061533 - RNA, 18 nt, Staphylococcus aureus subsp. aureus N315
uuuaaaauuugugcauuc

SEQ ID NO: 4061534 - RNA, 23 nt, Staphylococcus aureus subsp. aureus N315
uuuaaacaagcaucaugaaauua

SEQ ID NO: 4061535 - RNA, 20 nt, Staphylococcus aureus subsp. aureus N315
uuuaaacaucuauaacaaaa

SEQ ID NO: 4061536 - RNA, 23 nt, Staphylococcus aureus subsp. aureus N315
uuuaaaccguguucuuuaaugua

SEQ ID NO: 4061537 - RNA, 17 nt, Staphylococcus aureus subsp. aureus N315
uuuaaaccuguuaaugu

SEQ ID NO: 4061538 - RNA, 21 nt, Staphylococcus aureus subsp. aureus N315
uuuaaacguacauuuuuauga

SEQ ID NO: 4061539 - RNA, 15 nt, Staphylococcus aureus subsp. aureus N315
uuuaaagaaaauuuc

SEQ ID NO: 4061540 - RNA, 20 nt, Staphylococcus aureus subsp. aureus N315
uuuaaaguaaccacaacaau

SEQ ID NO: 4061541 - RNA, 18 nt, Staphylococcus aureus subsp. aureus N315
uuuaaauaaaauuguuga

SEQ ID NO: 4061542 - RNA, 18 nt, Staphylococcus aureus subsp. aureus N315
uuuaaauaaaugacuuca

SEQ ID NO: 4061543 - RNA, 23 nt, Staphylococcus aureus subsp. aureus N315
uuuaaauaauaauucauaaaugc

SEQ ID NO: 4061544 - RNA, 15 nt, Staphylococcus aureus subsp. aureus N315
uuuaaaucauaaauu

SEQ ID NO: 4061545 - RNA, 16 nt, Staphylococcus aureus subsp. aureus N315
uuuaaaucuauauaaa

SEQ ID NO: 4061546 - RNA, 20 nt, Staphylococcus aureus subsp. aureus N315
uuuaaaucuguacuucuaau

SEQ ID NO: 4061547 - RNA, 18 nt, Staphylococcus aureus subsp. aureus N315
uuuaaaucuuguucuaau

SEQ ID NO: 4061548 - RNA, 12 nt, Staphylococcus aureus subsp. aureus N315
uuuaaaugauau

SEQ ID NO: 4061549 - RNA, 23 nt, Staphylococcus aureus subsp. aureus N315
uuuaaaugauuucacuucauaaa

SEQ ID NO: 4061550 - RNA, 20 nt, Staphylococcus aureus subsp. aureus N315
uuuaaauucuuauaaaauaa

SEQ ID NO: 4061551 - RNA, 23 nt, Staphylococcus aureus subsp. aureus N315
uuuaaauugacuuuaauugcucu

SEQ ID NO: 4061552 - RNA, 22 nt, Staphylococcus aureus subsp. aureus N315
uuuaaauuggaaucccaaugcu

SEQ ID NO: 4061553 - RNA, 13 nt, Staphylococcus aureus subsp. aureus N315
uuuaaauuuaaga

SEQ ID NO: 4061554 - RNA, 14 nt, Staphylococcus aureus subsp. aureus N315
uuuaaauuuaagaa

SEQ ID NO: 4061555 - RNA, 14 nt, Staphylococcus aureus subsp. aureus N315
uuuaaauuuauaau

SEQ ID NO: 4061556 - RNA, 15 nt, Staphylococcus aureus subsp. aureus N315
uuuaaauuuucauca

SEQ ID NO: 4061557 - RNA, 15 nt, Staphylococcus aureus subsp. aureus N315
uuuaacaaaauauac

SEQ ID NO: 4061558 - RNA, 18 nt, Staphylococcus aureus subsp. aureus N315
uuuaacaaaauuaagaag

SEQ ID NO: 4061559 - RNA, 14 nt, Staphylococcus aureus subsp. aureus N315
uuuaacaacacuac

SEQ ID NO: 4061560 - RNA, 23 nt, Staphylococcus aureus subsp. aureus N315
uuuaacaauacuacuuaaugacu

SEQ ID NO: 4061561 - RNA, 20 nt, Staphylococcus aureus subsp. aureus N315
uuuaacaaugcgauuaaacu

SEQ ID NO: 4061562 - RNA, 10 nt, Staphylococcus aureus subsp. aureus N315
uuuaacauag

SEQ ID NO: 4061563 - RNA, 24 nt, Staphylococcus aureus subsp. aureus N315
uuuaacauuuauucuuucucuauu

SEQ ID NO: 4061564 - RNA, 14 nt, Staphylococcus aureus subsp. aureus N315
uuuaacauuucuga

SEQ ID NO: 4061565 - RNA, 16 nt, Staphylococcus aureus subsp. aureus N315
uuuaacccacauuaaa

SEQ ID NO: 4061566 - RNA, 15 nt, Staphylococcus aureus subsp. aureus N315
uuuaacggaaauaca

SEQ ID NO: 4061567 - RNA, 13 nt, Staphylococcus aureus subsp. aureus N315
uuuaacuaaacca

SEQ ID NO: 4061568 - RNA, 18 nt, Staphylococcus aureus subsp. aureus N315
uuuaacugguugauaaau

SEQ ID NO: 4061569 - RNA, 22 nt, Staphylococcus aureus subsp. aureus N315
uuuaacuuauauacguugauua

SEQ ID NO: 4061570 - RNA, 14 nt, Staphylococcus aureus subsp. aureus N315
uuuaacuuccuaaa

SEQ ID NO: 4061571 - RNA, 20 nt, Staphylococcus aureus subsp. aureus N315
uuuaacuuccuaaaauuuac

SEQ ID NO: 4061572 - RNA, 18 nt, Staphylococcus aureus subsp. aureus N315
uuuaagaagucgaauuca

SEQ ID NO: 4061573 - RNA, 14 nt, Staphylococcus aureus subsp. aureus N315
uuuaagaauguaca

SEQ ID NO: 4061574 - RNA, 23 nt, Staphylococcus aureus subsp. aureus N315
uuuaagcugcucgauauaugucu

SEQ ID NO: 4061575 - RNA, 20 nt, Staphylococcus aureus subsp. aureus N315
uuuaaguaauucauuugcuu

SEQ ID NO: 4061576 - RNA, 19 nt, Staphylococcus aureus subsp. aureus N315
uuuaaguuaucaaauugac

SEQ ID NO: 4061577 - RNA, 14 nt, Staphylococcus aureus subsp. aureus N315
uuuaaguuuauaau

SEQ ID NO: 4061578 - RNA, 17 nt, Staphylococcus aureus subsp. aureus N315
uuuaauaaaccagugcg

SEQ ID NO: 4061579 - RNA, 14 nt, Staphylococcus aureus subsp. aureus N315
uuuaauaacaaaau

SEQ ID NO: 4061580 - RNA, 17 nt, Staphylococcus aureus subsp. aureus N315
uuuaauaacaaaauuaa

SEQ ID NO: 4061581 - RNA, 19 nt, Staphylococcus aureus subsp. aureus N315
uuuaauaaccuuuaaaaca

SEQ ID NO: 4061582 - RNA, 21 nt, Staphylococcus aureus subsp. aureus N315
uuuaauaaccuuuaaaacauc

SEQ ID NO: 4061583 - RNA, 20 nt, Staphylococcus aureus subsp. aureus N315
uuuaauaacguacauuuaug

SEQ ID NO: 4061584 - RNA, 16 nt, Staphylococcus aureus subsp. aureus N315
uuuaauaaguuaaugu

SEQ ID NO: 4061585 - RNA, 21 nt, Staphylococcus aureus subsp. aureus N315
uuuaauaauguaucauuucag

SEQ ID NO: 4061586 - RNA, 14 nt, Staphylococcus aureus subsp. aureus N315
uuuaauaauuaaau

SEQ ID NO: 4061587 - RNA, 17 nt, Staphylococcus aureus subsp. aureus N315
uuuaauaccuaugauau

SEQ ID NO: 4061588 - RNA, 21 nt, Staphylococcus aureus subsp. aureus N315
uuuaauacuauaguaagaaaa

SEQ ID NO: 4061589 - RNA, 13 nt, Staphylococcus aureus subsp. aureus N315
uuuaauauaaauu

SEQ ID NO: 4061590 - RNA, 19 nt, Staphylococcus aureus subsp. aureus N315
uuuaauauugacauuuaca

SEQ ID NO: 4061591 - RNA, 18 nt, Staphylococcus aureus subsp. aureus N315
uuuaauauuguuaauuca

SEQ ID NO: 4061592 - RNA, 19 nt, Staphylococcus aureus subsp. aureus N315
uuuaauauuugauaacaaa

SEQ ID NO: 4061593 - RNA, 13 nt, Staphylococcus aureus subsp. aureus N315
uuuaaucaaaaaa

SEQ ID NO: 4061594 - RNA, 23 nt, Staphylococcus aureus subsp. aureus N315
uuuaaucacaucuuuuugauaau

SEQ ID NO: 4061595 - RNA, 21 nt, Staphylococcus aureus subsp. aureus N315
uuuaaucguaacauaucagcu

SEQ ID NO: 4061596 - RNA, 21 nt, Staphylococcus aureus subsp. aureus N315
uuuaaucguauuagccaauaa

SEQ ID NO: 4061597 - RNA, 18 nt, Staphylococcus aureus subsp. aureus N315
uuuaaucuuauucgcacc

SEQ ID NO: 4061598 - RNA, 22 nt, Staphylococcus aureus subsp. aureus N315
uuuaaugagcuuuucuaaugcu

SEQ ID NO: 4061599 - RNA, 22 nt, Staphylococcus aureus subsp. aureus N315
uuuaaugggcgugccauuaaaa

SEQ ID NO: 4061600 - RNA, 16 nt, Staphylococcus aureus subsp. aureus N315
uuuaaugucuaaaaau

SEQ ID NO: 4061601 - RNA, 16 nt, Staphylococcus aureus subsp. aureus N315
uuuaauguuaaacaau

SEQ ID NO: 4061602 - RNA, 16 nt, Staphylococcus aureus subsp. aureus N315
uuuaauuaaaauacaa

SEQ ID NO: 4061603 - RNA, 16 nt, Staphylococcus aureus subsp. aureus N315
uuuaauuaauuaucau

SEQ ID NO: 4061604 - RNA, 14 nt, Staphylococcus aureus subsp. aureus N315
uuuaauuaauuauu

SEQ ID NO: 4061605 - RNA, 15 nt, Staphylococcus aureus subsp. aureus N315
uuuaauuaauuauua

SEQ ID NO: 4061606 - RNA, 17 nt, Staphylococcus aureus subsp. aureus N315
uuuaauuagaaauucuc

SEQ ID NO: 4061607 - RNA, 15 nt, Staphylococcus aureus subsp. aureus N315
uuuaauuauuucccu

SEQ ID NO: 4061608 - RNA, 17 nt, Staphylococcus aureus subsp. aureus N315
uuuaauuauuuuaaaaa

SEQ ID NO: 4061609 - RNA, 16 nt, Staphylococcus aureus subsp. aureus N315
uuuaauuauuuucucg

SEQ ID NO: 4061610 - RNA, 14 nt, Staphylococcus aureus subsp. aureus N315
uuuaauucaucaau

SEQ ID NO: 4061611 - RNA, 21 nt, Staphylococcus aureus subsp. aureus N315
uuuaauuccaaagaaagcuaa

SEQ ID NO: 4061612 - RNA, 22 nt, Staphylococcus aureus subsp. aureus N315
uuuaauucugguuuaaugagcu

SEQ ID NO: 4061613 - RNA, 13 nt, Staphylococcus aureus subsp. aureus N315
uuuaauugucuca

SEQ ID NO: 4061614 - RNA, 13 nt, Staphylococcus aureus subsp. aureus N315
uuuaauuguuuaa

SEQ ID NO: 4061615 - RNA, 16 nt, Staphylococcus aureus subsp. aureus N315
uuuaauuuacaauuaa

SEQ ID NO: 4061616 - RNA, 18 nt, Staphylococcus aureus subsp. aureus N315
uuuaauuuacaauuaauu

SEQ ID NO: 4061617 - RNA, 18 nt, Staphylococcus aureus subsp. aureus N315
uuuaauuuaguacucaau

SEQ ID NO: 4061618 - RNA, 21 nt, Staphylococcus aureus subsp. aureus N315
uuuaauuuaguuauaauuucu

SEQ ID NO: 4061619 - RNA, 14 nt, Staphylococcus aureus subsp. aureus N315
uuuaauuucacuuu

SEQ ID NO: 4061620 - RNA, 15 nt, Staphylococcus aureus subsp. aureus N315
uuuaauuuucagaau

SEQ ID NO: 4061621 - RNA, 16 nt, Staphylococcus aureus subsp. aureus N315
uuuaauuuucuaaaua

SEQ ID NO: 4061622 - RNA, 19 nt, Staphylococcus aureus subsp. aureus N315
uuuaauuuugacauaaaaa

SEQ ID NO: 4061623 - RNA, 16 nt, Staphylococcus aureus subsp. aureus N315
uuuaauuuuuaaugua

SEQ ID NO: 4061624 - RNA, 17 nt, Staphylococcus aureus subsp. aureus N315
uuuaauuuuucauuaau

SEQ ID NO: 4061625 - RNA, 15 nt, Staphylococcus aureus subsp. aureus N315
uuuaauuuuucuaaa

SEQ ID NO: 4061626 - RNA, 20 nt, Staphylococcus aureus subsp. aureus N315
uuuacaaacuucacaucaug

SEQ ID NO: 4061627 - RNA, 19 nt, Staphylococcus aureus subsp. aureus N315
uuuacaaauguauaaauaa

SEQ ID NO: 4061628 - RNA, 20 nt, Staphylococcus aureus subsp. aureus N315
uuuacaagucuuauuuguuu

SEQ ID NO: 4061629 - RNA, 12 nt, Staphylococcus aureus subsp. aureus N315
uuuacaaucaac

SEQ ID NO: 4061630 - RNA, 19 nt, Staphylococcus aureus subsp. aureus N315
uuuacagaacguucauaua

SEQ ID NO: 4061631 - RNA, 23 nt, Staphylococcus aureus subsp. aureus N315
uuuacauggcuuagguuuaauuu

SEQ ID NO: 4061632 - RNA, 17 nt, Staphylococcus aureus subsp. aureus N315
uuuaccaauaucaugca

SEQ ID NO: 4061633 - RNA, 14 nt, Staphylococcus aureus subsp. aureus N315
uuuaccacuuauaa

SEQ ID NO: 4061634 - RNA, 20 nt, Staphylococcus aureus subsp. aureus N315
uuuaccucuugauaaaauaa

SEQ ID NO: 4061635 - RNA, 22 nt, Staphylococcus aureus subsp. aureus N315
uuuaccuucgcauacuuuuuca

SEQ ID NO: 4061636 - RNA, 13 nt, Staphylococcus aureus subsp. aureus N315
uuuacgauaaaua

SEQ ID NO: 4061637 - RNA, 15 nt, Staphylococcus aureus subsp. aureus N315
uuuacgugcauugua

SEQ ID NO: 4061638 - RNA, 14 nt, Staphylococcus aureus subsp. aureus N315
uuuacguucugauu

SEQ ID NO: 4061639 - RNA, 15 nt, Staphylococcus aureus subsp. aureus N315
uuuacuaaacuuuug

SEQ ID NO: 4061640 - RNA, 22 nt, Staphylococcus aureus subsp. aureus N315
uuuacuaggaauauaaaacugu

SEQ ID NO: 4061641 - RNA, 15 nt, Staphylococcus aureus subsp. aureus N315
uuuacuauuaaagga

SEQ ID NO: 4061642 - RNA, 16 nt, Staphylococcus aureus subsp. aureus N315
uuuacucaaaccaucu

SEQ ID NO: 4061643 - RNA, 22 nt, Staphylococcus aureus subsp. aureus N315
uuuacucauauugaauacuucu

SEQ ID NO: 4061644 - RNA, 14 nt, Staphylococcus aureus subsp. aureus N315
uuuacucuaaagga

SEQ ID NO: 4061645 - RNA, 16 nt, Staphylococcus aureus subsp. aureus N315
uuuacucuacacucaa

SEQ ID NO: 4061646 - RNA, 18 nt, Staphylococcus aureus subsp. aureus N315
uuuacugcuucgacauug

SEQ ID NO: 4061647 - RNA, 16 nt, Staphylococcus aureus subsp. aureus N315
uuuacuguaaucaauc

SEQ ID NO: 4061648 - RNA, 11 nt, Staphylococcus aureus subsp. aureus N315
uuuacuuaauc

SEQ ID NO: 4061649 - RNA, 13 nt, Staphylococcus aureus subsp. aureus N315
uuuacuucauaag

SEQ ID NO: 4061650 - RNA, 17 nt, Staphylococcus aureus subsp. aureus N315
uuuagaauaagaaauaa

SEQ ID NO: 4061651 - RNA, 15 nt, Staphylococcus aureus subsp. aureus N315
uuuagacaauauuuu

SEQ ID NO: 4061652 - RNA, 17 nt, Staphylococcus aureus subsp. aureus N315
uuuagacauuaaaaaau

SEQ ID NO: 4061653 - RNA, 17 nt, Staphylococcus aureus subsp. aureus N315
uuuagaugcauaaaaaa

SEQ ID NO: 4061654 - RNA, 17 nt, Staphylococcus aureus subsp. aureus N315
uuuagauucuuuucuga

SEQ ID NO: 4061655 - RNA, 19 nt, Staphylococcus aureus subsp. aureus N315
uuuagauuucaugauguua

SEQ ID NO: 4061656 - RNA, 12 nt, Staphylococcus aureus subsp. aureus N315
uuuagcauugcc

SEQ ID NO: 4061657 - RNA, 13 nt, Staphylococcus aureus subsp. aureus N315
uuuagccaaugcu

SEQ ID NO: 4061658 - RNA, 17 nt, Staphylococcus aureus subsp. aureus N315
uuuagccccagcaaaua

SEQ ID NO: 4061659 - RNA, 14 nt, Staphylococcus aureus subsp. aureus N315
uuuaggcaaauaac

SEQ ID NO: 4061660 - RNA, 18 nt, Staphylococcus aureus subsp. aureus N315
uuuaggugcuuuaaugcc

SEQ ID NO: 4061661 - RNA, 22 nt, Staphylococcus aureus subsp. aureus N315
uuuagguucuucaucuuuuaug

SEQ ID NO: 4061662 - RNA, 19 nt, Staphylococcus aureus subsp. aureus N315
uuuaguacauauguuguuu

SEQ ID NO: 4061663 - RNA, 14 nt, Staphylococcus aureus subsp. aureus N315
uuuaguauaaauaa

SEQ ID NO: 4061664 - RNA, 15 nt, Staphylococcus aureus subsp. aureus N315
uuuaguauaaauaaa

SEQ ID NO: 4061665 - RNA, 21 nt, Staphylococcus aureus subsp. aureus N315
uuuaguaucuauacaauuaug

SEQ ID NO: 4061666 - RNA, 18 nt, Staphylococcus aureus subsp. aureus N315
uuuaguaucucauuuuuu

SEQ ID NO: 4061667 - RNA, 21 nt, Staphylococcus aureus subsp. aureus N315
uuuaguauguuuuauuuucuu

SEQ ID NO: 4061668 - RNA, 19 nt, Staphylococcus aureus subsp. aureus N315
uuuagucauuacaaaucau

SEQ ID NO: 4061669 - RNA, 20 nt, Staphylococcus aureus subsp. aureus N315
uuuaguccuucuuuacuaaa

SEQ ID NO: 4061670 - RNA, 15 nt, Staphylococcus aureus subsp. aureus N315
uuuagugaaaaaguu

SEQ ID NO: 4061671 - RNA, 17 nt, Staphylococcus aureus subsp. aureus N315
uuuagugaaaagaacac

SEQ ID NO: 4061672 - RNA, 14 nt, Staphylococcus aureus subsp. aureus N315
uuuagugacaaaca

SEQ ID NO: 4061673 - RNA, 14 nt, Staphylococcus aureus subsp. aureus N315
uuuaguuaaaguac

SEQ ID NO: 4061674 - RNA, 14 nt, Staphylococcus aureus subsp. aureus N315
uuuaguuaaaguga

SEQ ID NO: 4061675 - RNA, 22 nt, Staphylococcus aureus subsp. aureus N315
uuuaguuagcccuauucaacua

SEQ ID NO: 4061676 - RNA, 21 nt, Staphylococcus aureus subsp. aureus N315
uuuaguucaaagcgauaaagu

SEQ ID NO: 4061677 - RNA, 21 nt, Staphylococcus aureus subsp. aureus N315
uuuaguucacaugaauuuuaa

SEQ ID NO: 4061678 - RNA, 17 nt, Staphylococcus aureus subsp. aureus N315
uuuauaaaaaaaucccu

SEQ ID NO: 4061679 - RNA, 14 nt, Staphylococcus aureus subsp. aureus N315
uuuauaaaaacuua

SEQ ID NO: 4061680 - RNA, 13 nt, Staphylococcus aureus subsp. aureus N315
uuuauaaaauaua

SEQ ID NO: 4061681 - RNA, 15 nt, Staphylococcus aureus subsp. aureus N315
uuuauaaaucaaaga

SEQ ID NO: 4061682 - RNA, 23 nt, Staphylococcus aureus subsp. aureus N315
uuuauaaaugaauuauuuaaaau

SEQ ID NO: 4061683 - RNA, 12 nt, Staphylococcus aureus subsp. aureus N315
uuuauaaauuaa

SEQ ID NO: 4061684 - RNA, 22 nt, Staphylococcus aureus subsp. aureus N315
uuuauaagccuuuucaaacaua

SEQ ID NO: 4061685 - RNA, 21 nt, Staphylococcus aureus subsp. aureus N315
uuuauaaguaucgccaucauu

SEQ ID NO: 4061686 - RNA, 12 nt, Staphylococcus aureus subsp. aureus N315
uuuauaaguauu

SEQ ID NO: 4061687 - RNA, 14 nt, Staphylococcus aureus subsp. aureus N315
uuuauaauuuuuga

SEQ ID NO: 4061688 - RNA, 13 nt, Staphylococcus aureus subsp. aureus N315
uuuauacauaaau

SEQ ID NO: 4061689 - RNA, 18 nt, Staphylococcus aureus subsp. aureus N315
uuuauacauguacauuau

SEQ ID NO: 4061690 - RNA, 13 nt, Staphylococcus aureus subsp. aureus N315
uuuauacuuaaua

SEQ ID NO: 4061691 - RNA, 14 nt, Staphylococcus aureus subsp. aureus N315
uuuauagaaaauua

SEQ ID NO: 4061692 - RNA, 16 nt, Staphylococcus aureus subsp. aureus N315
uuuauagaaaauuaac

SEQ ID NO: 4061693 - RNA, 18 nt, Staphylococcus aureus subsp. aureus N315
uuuauagaaaccaaaaaa

SEQ ID NO: 4061694 - RNA, 14 nt, Staphylococcus aureus subsp. aureus N315
uuuauaguucuauu

SEQ ID NO: 4061695 - RNA, 23 nt, Staphylococcus aureus subsp. aureus N315
uuuauauaaaaaagaaauaucua

SEQ ID NO: 4061696 - RNA, 13 nt, Staphylococcus aureus subsp. aureus N315
uuuauauaaguga

SEQ ID NO: 4061697 - RNA, 16 nt, Staphylococcus aureus subsp. aureus N315
uuuauaucaaaaaaua

SEQ ID NO: 4061698 - RNA, 13 nt, Staphylococcus aureus subsp. aureus N315
uuuauauccaucu

SEQ ID NO: 4061699 - RNA, 22 nt, Staphylococcus aureus subsp. aureus N315
uuuauaucuuaaguacauaaau

SEQ ID NO: 4061700 - RNA, 16 nt, Staphylococcus aureus subsp. aureus N315
uuuauauuaaauacua

SEQ ID NO: 4061701 - RNA, 16 nt, Staphylococcus aureus subsp. aureus N315
uuuauauuauuucaau

SEQ ID NO: 4061702 - RNA, 18 nt, Staphylococcus aureus subsp. aureus N315
uuuauauuuaaacucucu

SEQ ID NO: 4061703 - RNA, 14 nt, Staphylococcus aureus subsp. aureus N315
uuuauauuuaucag

SEQ ID NO: 4061704 - RNA, 16 nt, Staphylococcus aureus subsp. aureus N315
uuuauauuuauuuuau

SEQ ID NO: 4061705 - RNA, 12 nt, Staphylococcus aureus subsp. aureus N315
uuuauauuuuau

SEQ ID NO: 4061706 - RNA, 15 nt, Staphylococcus aureus subsp. aureus N315
uuuauauuuuuauca

SEQ ID NO: 4061707 - RNA, 19 nt, Staphylococcus aureus subsp. aureus N315
uuuaucaaauucaucagua

SEQ ID NO: 4061708 - RNA, 17 nt, Staphylococcus aureus subsp. aureus N315
uuuaucaacaaauuuaa

SEQ ID NO: 4061709 - RNA, 16 nt, Staphylococcus aureus subsp. aureus N315
uuuaucaacaaauuuu

SEQ ID NO: 4061710 - RNA, 14 nt, Staphylococcus aureus subsp. aureus N315
uuuaucaauuucua

SEQ ID NO: 4061711 - RNA, 19 nt, Staphylococcus aureus subsp. aureus N315
uuuaucaugaugauaaauu

SEQ ID NO: 4061712 - RNA, 12 nt, Staphylococcus aureus subsp. aureus N315
uuuauccaaacc

SEQ ID NO: 4061713 - RNA, 19 nt, Staphylococcus aureus subsp. aureus N315
uuuauccaaaccaauuuua

SEQ ID NO: 4061714 - RNA, 20 nt, Staphylococcus aureus subsp. aureus N315
uuuauccaaaccaauuuuaa

SEQ ID NO: 4061715 - RNA, 18 nt, Staphylococcus aureus subsp. aureus N315
uuuaucgaucgguauuuu

SEQ ID NO: 4061716 - RNA, 15 nt, Staphylococcus aureus subsp. aureus N315
uuuaucgccaauuaa

SEQ ID NO: 4061717 - RNA, 19 nt, Staphylococcus aureus subsp. aureus N315
uuuaucuccuaaagguaac

SEQ ID NO: 4061718 - RNA, 15 nt, Staphylococcus aureus subsp. aureus N315
uuuaucugcaaaaug

SEQ ID NO: 4061719 - RNA, 19 nt, Staphylococcus aureus subsp. aureus N315
uuuaucuguaacaaagucu

SEQ ID NO: 4061720 - RNA, 15 nt, Staphylococcus aureus subsp. aureus N315
uuuaugacaaaguuc

SEQ ID NO: 4061721 - RNA, 16 nt, Staphylococcus aureus subsp. aureus N315
uuuaugacaaaguucu

SEQ ID NO: 4061722 - RNA, 20 nt, Staphylococcus aureus subsp. aureus N315
uuuaugacaaaguucugcaa

SEQ ID NO: 4061723 - RNA, 17 nt, Staphylococcus aureus subsp. aureus N315
uuuaugauaauaagaau

SEQ ID NO: 4061724 - RNA, 20 nt, Staphylococcus aureus subsp. aureus N315
uuuaugauaauaagaauauu

SEQ ID NO: 4061725 - RNA, 12 nt, Staphylococcus aureus subsp. aureus N315
uuuaugauuguu

SEQ ID NO: 4061726 - RNA, 13 nt, Staphylococcus aureus subsp. aureus N315
uuuaugcuuuaaa

SEQ ID NO: 4061727 - RNA, 17 nt, Staphylococcus aureus subsp. aureus N315
uuuauggcgguuugaaa

SEQ ID NO: 4061728 - RNA, 13 nt, Staphylococcus aureus subsp. aureus N315
uuuaugguguggu

SEQ ID NO: 4061729 - RNA, 15 nt, Staphylococcus aureus subsp. aureus N315
uuuauguaacuacua

SEQ ID NO: 4061730 - RNA, 13 nt, Staphylococcus aureus subsp. aureus N315
uuuauguugcguu

SEQ ID NO: 4061731 - RNA, 17 nt, Staphylococcus aureus subsp. aureus N315
uuuauguuuuaauuucu

SEQ ID NO: 4061732 - RNA, 20 nt, Staphylococcus aureus subsp. aureus N315
uuuauuaaagaaacaugauu

SEQ ID NO: 4061733 - RNA, 23 nt, Staphylococcus aureus subsp. aureus N315
uuuauuaguuauguuagucuuuu

SEQ ID NO: 4061734 - RNA, 17 nt, Staphylococcus aureus subsp. aureus N315
uuuauucagauauuaau

SEQ ID NO: 4061735 - RNA, 15 nt, Staphylococcus aureus subsp. aureus N315
uuuauucgcuuguuc

SEQ ID NO: 4061736 - RNA, 15 nt, Staphylococcus aureus subsp. aureus N315
uuuauucuaaauaua

SEQ ID NO: 4061737 - RNA, 16 nt, Staphylococcus aureus subsp. aureus N315
uuuauucuaaguuaaa

SEQ ID NO: 4061738 - RNA, 14 nt, Staphylococcus aureus subsp. aureus N315
uuuauucuucaguu

SEQ ID NO: 4061739 - RNA, 12 nt, Staphylococcus aureus subsp. aureus N315
uuuauucuuccc

SEQ ID NO: 4061740 - RNA, 21 nt, Staphylococcus aureus subsp. aureus N315
uuuauugagcuuuguuugaaa

SEQ ID NO: 4061741 - RNA, 19 nt, Staphylococcus aureus subsp. aureus N315
uuuauugaggauaauuauu

SEQ ID NO: 4061742 - RNA, 20 nt, Staphylococcus aureus subsp. aureus N315
uuuauuuaacacuucaguua

SEQ ID NO: 4061743 - RNA, 17 nt, Staphylococcus aureus subsp. aureus N315
uuuauuuaaucguaaca

SEQ ID NO: 4061744 - RNA, 14 nt, Staphylococcus aureus subsp. aureus N315
uuuauuuaauuauu

SEQ ID NO: 4061745 - RNA, 19 nt, Staphylococcus aureus subsp. aureus N315
uuuauuuagaauaaacuuu

SEQ ID NO: 4061746 - RNA, 14 nt, Staphylococcus aureus subsp. aureus N315
uuuauuuauucuaa

SEQ ID NO: 4061747 - RNA, 12 nt, Staphylococcus aureus subsp. aureus N315
uuuauuucuaua

SEQ ID NO: 4061748 - RNA, 16 nt, Staphylococcus aureus subsp. aureus N315
uuuauuuuaauauuuu

SEQ ID NO: 4061749 - RNA, 17 nt, Staphylococcus aureus subsp. aureus N315
uuuauuuuagcagcagu

SEQ ID NO: 4061750 - RNA, 14 nt, Staphylococcus aureus subsp. aureus N315
uuuauuuuauaaga

SEQ ID NO: 4061751 - RNA, 13 nt, Staphylococcus aureus subsp. aureus N315
uuuauuuugauua

SEQ ID NO: 4061752 - RNA, 23 nt, Staphylococcus aureus subsp. aureus N315
uuucaaaaaaagcugauuucuau

SEQ ID NO: 4061753 - RNA, 11 nt, Staphylococcus aureus subsp. aureus N315
uuucaaaaaua

SEQ ID NO: 4061754 - RNA, 14 nt, Staphylococcus aureus subsp. aureus N315
uuucaaaacuagca

SEQ ID NO: 4061755 - RNA, 23 nt, Staphylococcus aureus subsp. aureus N315
uuucaaagcugucaacuugucua

SEQ ID NO: 4061756 - RNA, 22 nt, Staphylococcus aureus subsp. aureus N315
uuucaaauaauauaaaacgaua

SEQ ID NO: 4061757 - RNA, 23 nt, Staphylococcus aureus subsp. aureus N315
uuucaaauuaauuaaaccaauac

SEQ ID NO: 4061758 - RNA, 15 nt, Staphylococcus aureus subsp. aureus N315
uuucaacauaauauu

SEQ ID NO: 4061759 - RNA, 16 nt, Staphylococcus aureus subsp. aureus N315
uuucaacauaauauuu

SEQ ID NO: 4061760 - RNA, 15 nt, Staphylococcus aureus subsp. aureus N315
uuucaacauauuaua

SEQ ID NO: 4061761 - RNA, 11 nt, Staphylococcus aureus subsp. aureus N315
uuucaacauuu

SEQ ID NO: 4061762 - RNA, 18 nt, Staphylococcus aureus subsp. aureus N315
uuucaacgcauauucuau

SEQ ID NO: 4061763 - RNA, 19 nt, Staphylococcus aureus subsp. aureus N315
uuucaacgcauauucuauu

SEQ ID NO: 4061764 - RNA, 20 nt, Staphylococcus aureus subsp. aureus N315
uuucaacuuuuuaauaauac

SEQ ID NO: 4061765 - RNA, 17 nt, Staphylococcus aureus subsp. aureus N315
uuucaagaccaaauauu

SEQ ID NO: 4061766 - RNA, 23 nt, Staphylococcus aureus subsp. aureus N315
uuucaagugcuugguuaaaguua

SEQ ID NO: 4061767 - RNA, 17 nt, Staphylococcus aureus subsp. aureus N315
uuucaaguuuaaaauac

SEQ ID NO: 4061768 - RNA, 19 nt, Staphylococcus aureus subsp. aureus N315
uuucaaguuuaaaauacga

SEQ ID NO: 4061769 - RNA, 13 nt, Staphylococcus aureus subsp. aureus N315
uuucaauaaauaa

SEQ ID NO: 4061770 - RNA, 13 nt, Staphylococcus aureus subsp. aureus N315
uuucaauaaauuu

SEQ ID NO: 4061771 - RNA, 17 nt, Staphylococcus aureus subsp. aureus N315
uuucaauauuaaaauac

SEQ ID NO: 4061772 - RNA, 14 nt, Staphylococcus aureus subsp. aureus N315
uuucaauuaaaugu

SEQ ID NO: 4061773 - RNA, 14 nt, Staphylococcus aureus subsp. aureus N315
uuucaauuagaaaa

SEQ ID NO: 4061774 - RNA, 12 nt, Staphylococcus aureus subsp. aureus N315
uuucaauuugga

SEQ ID NO: 4061775 - RNA, 22 nt, Staphylococcus aureus subsp. aureus N315
uuucacuacgucaagcuuugcu

SEQ ID NO: 4061776 - RNA, 17 nt, Staphylococcus aureus subsp. aureus N315
uuucacucauauuacuu

SEQ ID NO: 4061777 - RNA, 17 nt, Staphylococcus aureus subsp. aureus N315
uuucacuugaccacuuu

SEQ ID NO: 4061778 - RNA, 18 nt, Staphylococcus aureus subsp. aureus N315
uuucacuuuaacuucuuu

SEQ ID NO: 4061779 - RNA, 13 nt, Staphylococcus aureus subsp. aureus N315
uuucagaaugaac

SEQ ID NO: 4061780 - RNA, 16 nt, Staphylococcus aureus subsp. aureus N315
uuucagcaguugcaca

SEQ ID NO: 4061781 - RNA, 19 nt, Staphylococcus aureus subsp. aureus N315
uuucagcgauaacguacaa

SEQ ID NO: 4061782 - RNA, 19 nt, Staphylococcus aureus subsp. aureus N315
uuucaggcuuuguuuuuca

SEQ ID NO: 4061783 - RNA, 14 nt, Staphylococcus aureus subsp. aureus N315
uuucaguagaugcu

SEQ ID NO: 4061784 - RNA, 15 nt, Staphylococcus aureus subsp. aureus N315
uuucaguauacucau

SEQ ID NO: 4061785 - RNA, 15 nt, Staphylococcus aureus subsp. aureus N315
uuucaguuaaaauaa

SEQ ID NO: 4061786 - RNA, 14 nt, Staphylococcus aureus subsp. aureus N315
uuucaguucuuaga

SEQ ID NO: 4061787 - RNA, 17 nt, Staphylococcus aureus subsp. aureus N315
uuucauaaacucuuaca

SEQ ID NO: 4061788 - RNA, 16 nt, Staphylococcus aureus subsp. aureus N315
uuucauaaaguuuauu

SEQ ID NO: 4061789 - RNA, 19 nt, Staphylococcus aureus subsp. aureus N315
uuucauaaauuguuuuaca

SEQ ID NO: 4061790 - RNA, 23 nt, Staphylococcus aureus subsp. aureus N315
uuucauaauuaacacauucaaau

SEQ ID NO: 4061791 - RNA, 19 nt, Staphylococcus aureus subsp. aureus N315
uuucauaauuaauaacauc

SEQ ID NO: 4061792 - RNA, 22 nt, Staphylococcus aureus subsp. aureus N315
uuucauaccuugauuauaugcu

SEQ ID NO: 4061793 - RNA, 18 nt, Staphylococcus aureus subsp. aureus N315
uuucauagaugcauaaaa

SEQ ID NO: 4061794 - RNA, 23 nt, Staphylococcus aureus subsp. aureus N315
uuucauagaugcauaaaaaccua

SEQ ID NO: 4061795 - RNA, 23 nt, Staphylococcus aureus subsp. aureus N315
uuucauauaaauagcuucuuaaa

SEQ ID NO: 4061796 - RNA, 19 nt, Staphylococcus aureus subsp. aureus N315
uuucauaugcaucaacaga

SEQ ID NO: 4061797 - RNA, 16 nt, Staphylococcus aureus subsp. aureus N315
uuucauauggugaacu

SEQ ID NO: 4061798 - RNA, 17 nt, Staphylococcus aureus subsp. aureus N315
uuucauauuguuuagga

SEQ ID NO: 4061799 - RNA, 14 nt, Staphylococcus aureus subsp. aureus N315
uuucaucaaaucca

SEQ ID NO: 4061800 - RNA, 13 nt, Staphylococcus aureus subsp. aureus N315
uuucaucaauauc

SEQ ID NO: 4061801 - RNA, 11 nt, Staphylococcus aureus subsp. aureus N315
uuucaucuuuc

SEQ ID NO: 4061802 - RNA, 20 nt, Staphylococcus aureus subsp. aureus N315
uuucaugcacuuuaacauaa

SEQ ID NO: 4061803 - RNA, 22 nt, Staphylococcus aureus subsp. aureus N315
uuucaugugucacaaugaccau

SEQ ID NO: 4061804 - RNA, 22 nt, Staphylococcus aureus subsp. aureus N315
uuucauguuugauucuaaauaa

SEQ ID NO: 4061805 - RNA, 20 nt, Staphylococcus aureus subsp. aureus N315
uuucauuguaacucaauaug

SEQ ID NO: 4061806 - RNA, 17 nt, Staphylococcus aureus subsp. aureus N315
uuucauuuacuucuucu

SEQ ID NO: 4061807 - RNA, 13 nt, Staphylococcus aureus subsp. aureus N315
uuucauuuuuuca

SEQ ID NO: 4061808 - RNA, 20 nt, Staphylococcus aureus subsp. aureus N315
uuuccaaauugcaaaguaac

SEQ ID NO: 4061809 - RNA, 13 nt, Staphylococcus aureus subsp. aureus N315
uuuccaauaucuu

SEQ ID NO: 4061810 - RNA, 19 nt, Staphylococcus aureus subsp. aureus N315
uuuccaaucuauuaaugcu

SEQ ID NO: 4061811 - RNA, 22 nt, Staphylococcus aureus subsp. aureus N315
uuuccaccggacaauguagaua

SEQ ID NO: 4061812 - RNA, 13 nt, Staphylococcus aureus subsp. aureus N315
uuuccacugcaac

SEQ ID NO: 4061813 - RNA, 20 nt, Staphylococcus aureus subsp. aureus N315
uuuccauaaauaaaaugcua

SEQ ID NO: 4061814 - RNA, 22 nt, Staphylococcus aureus subsp. aureus N315
uuuccauaaauauuuaaaauau

SEQ ID NO: 4061815 - RNA, 23 nt, Staphylococcus aureus subsp. aureus N315
uuucccuacugcuugugugaaau

SEQ ID NO: 4061816 - RNA, 13 nt, Staphylococcus aureus subsp. aureus N315
uuuccguguuuau

SEQ ID NO: 4061817 - RNA, 17 nt, Staphylococcus aureus subsp. aureus N315
uuuccguguuuauuuuu

SEQ ID NO: 4061818 - RNA, 13 nt, Staphylococcus aureus subsp. aureus N315
uuuccuaauucuu

SEQ ID NO: 4061819 - RNA, 14 nt, Staphylococcus aureus subsp. aureus N315
uuuccuaauucuug

SEQ ID NO: 4061820 - RNA, 19 nt, Staphylococcus aureus subsp. aureus N315
uuuccucgguuuuauuuuu

SEQ ID NO: 4061821 - RNA, 21 nt, Staphylococcus aureus subsp. aureus N315
uuuccucgguuuuauuuuuau

SEQ ID NO: 4061822 - RNA, 18 nt, Staphylococcus aureus subsp. aureus N315
uuuccuguuacuuucaca

SEQ ID NO: 4061823 - RNA, 23 nt, Staphylococcus aureus subsp. aureus N315
uuuccuuggacucagugcuaugu

SEQ ID NO: 4061824 - RNA, 22 nt, Staphylococcus aureus subsp. aureus N315
uuucgacguaccaauuagcaug

SEQ ID NO: 4061825 - RNA, 21 nt, Staphylococcus aureus subsp. aureus N315
uuucgaguaugguugauuaca

SEQ ID NO: 4061826 - RNA, 13 nt, Staphylococcus aureus subsp. aureus N315
uuucgauauuugu

SEQ ID NO: 4061827 - RNA, 18 nt, Staphylococcus aureus subsp. aureus N315
uuucggacgauugaacau

SEQ ID NO: 4061828 - RNA, 19 nt, Staphylococcus aureus subsp. aureus N315
uuucguaacauuuaaaaaa

SEQ ID NO: 4061829 - RNA, 16 nt, Staphylococcus aureus subsp. aureus N315
uuucguauaauuuuaa

SEQ ID NO: 4061830 - RNA, 15 nt, Staphylococcus aureus subsp. aureus N315
uuucguauuuuucuu

SEQ ID NO: 4061831 - RNA, 17 nt, Staphylococcus aureus subsp. aureus N315
uuucguauuuuucuugg

SEQ ID NO: 4061832 - RNA, 17 nt, Staphylococcus aureus subsp. aureus N315
uuucgucuacuauuuuu

SEQ ID NO: 4061833 - RNA, 21 nt, Staphylococcus aureus subsp. aureus N315
uuucgucuuguaaacuucuuu

SEQ ID NO: 4061834 - RNA, 19 nt, Staphylococcus aureus subsp. aureus N315
uuucguguuccaauuuuau

SEQ ID NO: 4061835 - RNA, 20 nt, Staphylococcus aureus subsp. aureus N315
uuucuaaaucuaacuggaaa

SEQ ID NO: 4061836 - RNA, 15 nt, Staphylococcus aureus subsp. aureus N315
uuucuaaguuuguug

SEQ ID NO: 4061837 - RNA, 16 nt, Staphylococcus aureus subsp. aureus N315
uuucuaauuaaacgcu

SEQ ID NO: 4061838 - RNA, 19 nt, Staphylococcus aureus subsp. aureus N315
uuucuaauugaaaucaucu

SEQ ID NO: 4061839 - RNA, 23 nt, Staphylococcus aureus subsp. aureus N315
uuucuaauugaaaucaucuuaug

SEQ ID NO: 4061840 - RNA, 17 nt, Staphylococcus aureus subsp. aureus N315
uuucuacuguauaagug

SEQ ID NO: 4061841 - RNA, 12 nt, Staphylococcus aureus subsp. aureus N315
uuucuagcaugu

SEQ ID NO: 4061842 - RNA, 22 nt, Staphylococcus aureus subsp. aureus N315
uuucuagcuuguuuguuacaua

SEQ ID NO: 4061843 - RNA, 17 nt, Staphylococcus aureus subsp. aureus N315
uuucuaggccacuaaga

SEQ ID NO: 4061844 - RNA, 22 nt, Staphylococcus aureus subsp. aureus N315
uuucuaggccacuaagaccaug

SEQ ID NO: 4061845 - RNA, 14 nt, Staphylococcus aureus subsp. aureus N315
uuucuaguuuaaca

SEQ ID NO: 4061846 - RNA, 23 nt, Staphylococcus aureus subsp. aureus N315
uuucuauagaaaaaguauuacuu

SEQ ID NO: 4061847 - RNA, 18 nt, Staphylococcus aureus subsp. aureus N315
uuucuauagaauuuuuca

SEQ ID NO: 4061848 - RNA, 12 nt, Staphylococcus aureus subsp. aureus N315
uuucuaucaaau

SEQ ID NO: 4061849 - RNA, 18 nt, Staphylococcus aureus subsp. aureus N315
uuucuauggcacaaauga

SEQ ID NO: 4061850 - RNA, 22 nt, Staphylococcus aureus subsp. aureus N315
uuucucaaacguucaucuaauu

SEQ ID NO: 4061851 - RNA, 16 nt, Staphylococcus aureus subsp. aureus N315
uuucucaaugugagau

SEQ ID NO: 4061852 - RNA, 14 nt, Staphylococcus aureus subsp. aureus N315
uuucucacugcugu

SEQ ID NO: 4061853 - RNA, 17 nt, Staphylococcus aureus subsp. aureus N315
uuucuccuuuguauaag

SEQ ID NO: 4061854 - RNA, 12 nt, Staphylococcus aureus subsp. aureus N315
uuucucuaaaua

SEQ ID NO: 4061855 - RNA, 13 nt, Staphylococcus aureus subsp. aureus N315
uuucucuaaauaa

SEQ ID NO: 4061856 - RNA, 21 nt, Staphylococcus aureus subsp. aureus N315
uuucugacaacuuaauagaaa

SEQ ID NO: 4061857 - RNA, 22 nt, Staphylococcus aureus subsp. aureus N315
uuucugacugugaagcugugcu

SEQ ID NO: 4061858 - RNA, 22 nt, Staphylococcus aureus subsp. aureus N315
uuucugacuuuuaaaaaacaua

SEQ ID NO: 4061859 - RNA, 19 nt, Staphylococcus aureus subsp. aureus N315
uuucugagaagaaauauau

SEQ ID NO: 4061860 - RNA, 22 nt, Staphylococcus aureus subsp. aureus N315
uuucugaucgacuaauuuuucu

SEQ ID NO: 4061861 - RNA, 14 nt, Staphylococcus aureus subsp. aureus N315
uuucuguaccaaau

SEQ ID NO: 4061862 - RNA, 15 nt, Staphylococcus aureus subsp. aureus N315
uuucuuaacauaaaa

SEQ ID NO: 4061863 - RNA, 10 nt, Staphylococcus aureus subsp. aureus N315
uuucuuaauu

SEQ ID NO: 4061864 - RNA, 14 nt, Staphylococcus aureus subsp. aureus N315
uuucuuagauacuc

SEQ ID NO: 4061865 - RNA, 15 nt, Staphylococcus aureus subsp. aureus N315
uuucuucaauugucu

SEQ ID NO: 4061866 - RNA, 19 nt, Staphylococcus aureus subsp. aureus N315
uuucuucauaguucaaauu

SEQ ID NO: 4061867 - RNA, 15 nt, Staphylococcus aureus subsp. aureus N315
uuucuucauuaucaa

SEQ ID NO: 4061868 - RNA, 12 nt, Staphylococcus aureus subsp. aureus N315
uuucuucauuug

SEQ ID NO: 4061869 - RNA, 21 nt, Staphylococcus aureus subsp. aureus N315
uuucuucauuuucauuguaug

SEQ ID NO: 4061870 - RNA, 12 nt, Staphylococcus aureus subsp. aureus N315
uuucuucugcua

SEQ ID NO: 4061871 - RNA, 23 nt, Staphylococcus aureus subsp. aureus N315
uuucuugaugaauuaaacugauc

SEQ ID NO: 4061872 - RNA, 17 nt, Staphylococcus aureus subsp. aureus N315
uuucuuguguauuuuua

SEQ ID NO: 4061873 - RNA, 18 nt, Staphylococcus aureus subsp. aureus N315
uuucuuguucuaaaauaa

SEQ ID NO: 4061874 - RNA, 17 nt, Staphylococcus aureus subsp. aureus N315
aaaaaucauccauaaaa

SEQ ID NO: 4061875 - RNA, 20 nt, Staphylococcus aureus subsp. aureus N315
aaaaaucauucaccuaaaaa

SEQ ID NO: 4061876 - RNA, 20 nt, Staphylococcus aureus subsp. aureus N315
aaaaauccggaacauuaaaa

SEQ ID NO: 4061877 - RNA, 22 nt, Staphylococcus aureus subsp. aureus N315
aaaaauccggaacauuaaaagg

SEQ ID NO: 4061878 - RNA, 23 nt, Staphylococcus aureus subsp. aureus N315
aaaaaucgaauuuucaaagacgu

SEQ ID NO: 4061879 - RNA, 22 nt, Staphylococcus aureus subsp. aureus N315
aaaaaucuucuccaaucaucau

SEQ ID NO: 4061880 - RNA, 20 nt, Staphylococcus aureus subsp. aureus N315
aaaaaucuuuugauagcuaa

SEQ ID NO: 4061881 - RNA, 19 nt, Staphylococcus aureus subsp. aureus N315
aaaaaugaagaauacaaau

SEQ ID NO: 4061882 - RNA, 12 nt, Staphylococcus aureus subsp. aureus N315
aaaaaugaugua

SEQ ID NO: 4061883 - RNA, 18 nt, Staphylococcus aureus subsp. aureus N315
aaaaaugcgcuuccaauu

SEQ ID NO: 4061884 - RNA, 19 nt, Staphylococcus aureus subsp. aureus N315
aaaaaugcugguaaauguu

SEQ ID NO: 4061885 - RNA, 17 nt, Staphylococcus aureus subsp. aureus N315
aaaaaugcuguuuuaug

SEQ ID NO: 4061886 - RNA, 21 nt, Staphylococcus aureus subsp. aureus N315
aaaaaugcuuauauaaacaaa

SEQ ID NO: 4061887 - RNA, 22 nt, Staphylococcus aureus subsp. aureus N315
aaaaauggaaccacgucuuaau

SEQ ID NO: 4061888 - RNA, 21 nt, Staphylococcus aureus subsp. aureus N315
aaaaauggcgaaaaagcuaaa

SEQ ID NO: 4061889 - RNA, 15 nt, Staphylococcus aureus subsp. aureus N315
aaaaauuaaaaaaca

SEQ ID NO: 4061890 - RNA, 14 nt, Staphylococcus aureus subsp. aureus N315
aaaaauuaaaaauu

SEQ ID NO: 4061891 - RNA, 14 nt, Staphylococcus aureus subsp. aureus N315
aaaaauuaaaaugu

SEQ ID NO: 4061892 - RNA, 23 nt, Staphylococcus aureus subsp. aureus N315
aaaaauuaacuauacuuuuauag

SEQ ID NO: 4061893 - RNA, 14 nt, Staphylococcus aureus subsp. aureus N315
aaaaauuauuaaaa

SEQ ID NO: 4061894 - RNA, 19 nt, Staphylococcus aureus subsp. aureus N315
aaaaauugcaaugcuauca

SEQ ID NO: 4061895 - RNA, 12 nt, Staphylococcus aureus subsp. aureus N315
aaaaauuguaaa

SEQ ID NO: 4061896 - RNA, 22 nt, Staphylococcus aureus subsp. aureus N315
aaaaauuguucaauauuuauca

SEQ ID NO: 4061897 - RNA, 13 nt, Staphylococcus aureus subsp. aureus N315
aaaaauuuauuca

SEQ ID NO: 4061898 - RNA, 16 nt, Staphylococcus aureus subsp. aureus N315
aaaaauuuauucaaaa

SEQ ID NO: 4061899 - RNA, 16 nt, Staphylococcus aureus subsp. aureus N315
aaaaauuucaaaaaua

SEQ ID NO: 4061900 - RNA, 12 nt, Staphylococcus aureus subsp. aureus N315
aaaaauuucaau

SEQ ID NO: 4061901 - RNA, 14 nt, Staphylococcus aureus subsp. aureus N315
aaaaauuucaauaa

SEQ ID NO: 4061902 - RNA, 22 nt, Staphylococcus aureus subsp. aureus N315
aaaaauuucgccucaucuaauu

SEQ ID NO: 4061903 - RNA, 16 nt, Staphylococcus aureus subsp. aureus N315
aaaacaaaaaaaccga

SEQ ID NO: 4061904 - RNA, 15 nt, Staphylococcus aureus subsp. aureus N315
aaaacaaaaaauauc

SEQ ID NO: 4061905 - RNA, 16 nt, Staphylococcus aureus subsp. aureus N315
aaaacaaaaaauaucu

SEQ ID NO: 4061906 - RNA, 16 nt, Staphylococcus aureus subsp. aureus N315
aaaacaaauauuagaa

SEQ ID NO: 4061907 - RNA, 22 nt, Staphylococcus aureus subsp. aureus N315
aaaacaaauauuagaacauuua

SEQ ID NO: 4061908 - RNA, 17 nt, Staphylococcus aureus subsp. aureus N315
aaaacaaugauuaaaau

SEQ ID NO: 4061909 - RNA, 22 nt, Staphylococcus aureus subsp. aureus N315
aaaacaccuucguuuaaauuca

SEQ ID NO: 4061910 - RNA, 19 nt, Staphylococcus aureus subsp. aureus N315
aaaacaguguagcacaaga

SEQ ID NO: 4061911 - RNA, 18 nt, Staphylococcus aureus subsp. aureus N315
aaaacauaaauacaaaaa

SEQ ID NO: 4061912 - RNA, 12 nt, Staphylococcus aureus subsp. aureus N315
aaaacauaccug

SEQ ID NO: 4061913 - RNA, 16 nt, Staphylococcus aureus subsp. aureus N315
aaaacauuauuaagug

SEQ ID NO: 4061914 - RNA, 13 nt, Staphylococcus aureus subsp. aureus N315
aaaacauuuugug

SEQ ID NO: 4061915 - RNA, 17 nt, Staphylococcus aureus subsp. aureus N315
aaaaccgaacaucugaa

SEQ ID NO: 4061916 - RNA, 21 nt, Staphylococcus aureus subsp. aureus N315
aaaaccgaacaucugaaaaaa

SEQ ID NO: 4061917 - RNA, 18 nt, Staphylococcus aureus subsp. aureus N315
aaaaccgaggaaauccuu

SEQ ID NO: 4061918 - RNA, 20 nt, Staphylococcus aureus subsp. aureus N315
aaaaccgaggaaauccuuaa

SEQ ID NO: 4061919 - RNA, 21 nt, Staphylococcus aureus subsp. aureus N315
aaaaccgcuauaaaauuuuga

SEQ ID NO: 4061920 - RNA, 22 nt, Staphylococcus aureus subsp. aureus N315
aaaaccgcuauaaaauuuugaa

SEQ ID NO: 4061921 - RNA, 13 nt, Staphylococcus aureus subsp. aureus N315
aaaaccucuuuuu

SEQ ID NO: 4061922 - RNA, 19 nt, Staphylococcus aureus subsp. aureus N315
aaaaccuuacccaaaaaau

SEQ ID NO: 4061923 - RNA, 21 nt, Staphylococcus aureus subsp. aureus N315
aaaaccuuuucaaauuauaac

SEQ ID NO: 4061924 - RNA, 14 nt, Staphylococcus aureus subsp. aureus N315
aaaacgagauuaca

SEQ ID NO: 4061925 - RNA, 13 nt, Staphylococcus aureus subsp. aureus N315
aaaacgauaauaa

SEQ ID NO: 4061926 - RNA, 15 nt, Staphylococcus aureus subsp. aureus N315
aaaacgauaauaaua

SEQ ID NO: 4061927 - RNA, 15 nt, Staphylococcus aureus subsp. aureus N315
aaaacgauucauuau

SEQ ID NO: 4061928 - RNA, 21 nt, Staphylococcus aureus subsp. aureus N315
aaaacgauucauuauaugguu

SEQ ID NO: 4061929 - RNA, 19 nt, Staphylococcus aureus subsp. aureus N315
aaaacgcauugcgaaagaa

SEQ ID NO: 4061930 - RNA, 21 nt, Staphylococcus aureus subsp. aureus N315
aaaacgcauugcgaaagaaag

SEQ ID NO: 4061931 - RNA, 16 nt, Staphylococcus aureus subsp. aureus N315
aaaacgugacauuuuc

SEQ ID NO: 4061932 - RNA, 16 nt, Staphylococcus aureus subsp. aureus N315
aaaacgugcaaauaaa

SEQ ID NO: 4061933 - RNA, 18 nt, Staphylococcus aureus subsp. aureus N315
aaaacguugaguauuacu

SEQ ID NO: 4061934 - RNA, 12 nt, Staphylococcus aureus subsp. aureus N315
aaaacguuuaau

SEQ ID NO: 4061935 - RNA, 14 nt, Staphylococcus aureus subsp. aureus N315
aaaacuaaagggac

SEQ ID NO: 4061936 - RNA, 19 nt, Staphylococcus aureus subsp. aureus N315
aaaacuaaagguauucuau

SEQ ID NO: 4061937 - RNA, 20 nt, Staphylococcus aureus subsp. aureus N315
aaaacuaaucaaauuaguca

SEQ ID NO: 4061938 - RNA, 16 nt, Staphylococcus aureus subsp. aureus N315
aaaacuacauuugguu

SEQ ID NO: 4061939 - RNA, 16 nt, Staphylococcus aureus subsp. aureus N315
aaaacuacugauuuau

SEQ ID NO: 4061940 - RNA, 16 nt, Staphylococcus aureus subsp. aureus N315
aaaacuagaacuuagu

SEQ ID NO: 4061941 - RNA, 16 nt, Staphylococcus aureus subsp. aureus N315
aaaacuaucugauuaa

SEQ ID NO: 4061942 - RNA, 13 nt, Staphylococcus aureus subsp. aureus N315
aaaacuauuuuaa

SEQ ID NO: 4061943 - RNA, 16 nt, Staphylococcus aureus subsp. aureus N315
aaaacucuaaaaguug

SEQ ID NO: 4061944 - RNA, 18 nt, Staphylococcus aureus subsp. aureus N315
aaaacuguaaaucaucau

SEQ ID NO: 4061945 - RNA, 21 nt, Staphylococcus aureus subsp. aureus N315
aaaacuucccuuuggaagcaa

SEQ ID NO: 4061946 - RNA, 15 nt, Staphylococcus aureus subsp. aureus N315
aaaacuuguaaucau

SEQ ID NO: 4061947 - RNA, 12 nt, Staphylococcus aureus subsp. aureus N315
aaaagaaauucu

SEQ ID NO: 4061948 - RNA, 16 nt, Staphylococcus aureus subsp. aureus N315
aaaagaaauucuacag

SEQ ID NO: 4061949 - RNA, 20 nt, Staphylococcus aureus subsp. aureus N315
aaaagaacuacgcauuuuaa

SEQ ID NO: 4061950 - RNA, 16 nt, Staphylococcus aureus subsp. aureus N315
aaaagaaucauuuaaa

SEQ ID NO: 4061951 - RNA, 19 nt, Staphylococcus aureus subsp. aureus N315
aaaagaaucauuuaaauca

SEQ ID NO: 4061952 - RNA, 22 nt, Staphylococcus aureus subsp. aureus N315
aaaagaauuauucaaguaauau

SEQ ID NO: 4061953 - RNA, 13 nt, Staphylococcus aureus subsp. aureus N315
aaaagacaaucuc

SEQ ID NO: 4061954 - RNA, 12 nt, Staphylococcus aureus subsp. aureus N315
aaaagacagaaa

SEQ ID NO: 4061955 - RNA, 14 nt, Staphylococcus aureus subsp. aureus N315
aaaagacagaaauu

SEQ ID NO: 4061956 - RNA, 22 nt, Staphylococcus aureus subsp. aureus N315
aaaagacggugaccuuauauuu

SEQ ID NO: 4061957 - RNA, 22 nt, Staphylococcus aureus subsp. aureus N315
aaaagagaaacaaaacaaaaaa

SEQ ID NO: 4061958 - RNA, 12 nt, Staphylococcus aureus subsp. aureus N315
aaaagagaccuu

SEQ ID NO: 4061959 - RNA, 18 nt, Staphylococcus aureus subsp. aureus N315
aaaagagguuuucauuaa

SEQ ID NO: 4061960 - RNA, 16 nt, Staphylococcus aureus subsp. aureus N315
aaaagauaaauaaaag

SEQ ID NO: 4061961 - RNA, 16 nt, Staphylococcus aureus subsp. aureus N315
aaaagauauaaacauu

SEQ ID NO: 4061962 - RNA, 21 nt, Staphylococcus aureus subsp. aureus N315
aaaaucauucaccuaaaaaga

SEQ ID NO: 4061963 - RNA, 21 nt, Staphylococcus aureus subsp. aureus N315
aaaauccuaagcaucguaaaa

SEQ ID NO: 4061964 - RNA, 18 nt, Staphylococcus aureus subsp. aureus N315
aaaaucggcuuucuaagu

SEQ ID NO: 4061965 - RNA, 20 nt, Staphylococcus aureus subsp. aureus N315
aaaaucgguuugauuaaaau

SEQ ID NO: 4061966 - RNA, 23 nt, Staphylococcus aureus subsp. aureus N315
aaaaucguauagauuaaaaaauc

SEQ ID NO: 4061967 - RNA, 23 nt, Staphylococcus aureus subsp. aureus N315
aaaaucucauaauaauucaguaa

SEQ ID NO: 4061968 - RNA, 17 nt, Staphylococcus aureus subsp. aureus N315
aaaaucuuuaacauuug

SEQ ID NO: 4061969 - RNA, 15 nt, Staphylococcus aureus subsp. aureus N315
aaaaucuuuaacucu

SEQ ID NO: 4061970 - RNA, 12 nt, Staphylococcus aureus subsp. aureus N315
aaaaucuuuacu

SEQ ID NO: 4061971 - RNA, 18 nt, Staphylococcus aureus subsp. aureus N315
aaaaugaauaauugcuaa

SEQ ID NO: 4061972 - RNA, 19 nt, Staphylococcus aureus subsp. aureus N315
aaaaugaauguuaagacau

SEQ ID NO: 4061973 - RNA, 16 nt, Staphylococcus aureus subsp. aureus N315
aaaaugacgauacgua

SEQ ID NO: 4061974 - RNA, 17 nt, Staphylococcus aureus subsp. aureus N315
aaaaugaguacaacaua

SEQ ID NO: 4061975 - RNA, 21 nt, Staphylococcus aureus subsp. aureus N315
aaaaugauagcuaaacauuuu

SEQ ID NO: 4061976 - RNA, 14 nt, Staphylococcus aureus subsp. aureus N315
aaaaugaugcacua

SEQ ID NO: 4061977 - RNA, 23 nt, Staphylococcus aureus subsp. aureus N315
aaaaugcaauuuuucacuuauaa

SEQ ID NO: 4061978 - RNA, 16 nt, Staphylococcus aureus subsp. aureus N315
aaaaugcauuacuacu

SEQ ID NO: 4061979 - RNA, 13 nt, Staphylococcus aureus subsp. aureus N315
aaaaugccaacua

SEQ ID NO: 4061980 - RNA, 21 nt, Staphylococcus aureus subsp. aureus N315
aaaaugcgcuuccaauuuaaa

SEQ ID NO: 4061981 - RNA, 23 nt, Staphylococcus aureus subsp. aureus N315
aaaaugcgcuuccaauuuaaaau

SEQ ID NO: 4061982 - RNA, 15 nt, Staphylococcus aureus subsp. aureus N315
aaaaugguuaaaauc

SEQ ID NO: 4061983 - RNA, 22 nt, Staphylococcus aureus subsp. aureus N315
aaaauguaggcgccauaaucau

SEQ ID NO: 4061984 - RNA, 15 nt, Staphylococcus aureus subsp. aureus N315
aaaaugucauuugaa

SEQ ID NO: 4061985 - RNA, 17 nt, Staphylococcus aureus subsp. aureus N315
aaaaugucuuugaaaaa

SEQ ID NO: 4061986 - RNA, 21 nt, Staphylococcus aureus subsp. aureus N315
aaaauguguuaaaauauauuu

SEQ ID NO: 4061987 - RNA, 15 nt, Staphylococcus aureus subsp. aureus N315
aaaauguuacacaaa

SEQ ID NO: 4061988 - RNA, 24 nt, Staphylococcus aureus subsp. aureus N315
aaaauguuaggugaaaccauacua

SEQ ID NO: 4061989 - RNA, 17 nt, Staphylococcus aureus subsp. aureus N315
aaaauguuuaacaauaa

SEQ ID NO: 4061990 - RNA, 21 nt, Staphylococcus aureus subsp. aureus N315
aaaauuacuuagcaaacaauu

SEQ ID NO: 4061991 - RNA, 18 nt, Staphylococcus aureus subsp. aureus N315
aaaauuauauaaauuacc

SEQ ID NO: 4061992 - RNA, 15 nt, Staphylococcus aureus subsp. aureus N315
aaaauuauguaaaaa

SEQ ID NO: 4061993 - RNA, 14 nt, Staphylococcus aureus subsp. aureus N315
aaaauuauuaaaaa

SEQ ID NO: 4061994 - RNA, 10 nt, Staphylococcus aureus subsp. aureus N315
aaaauuauuu

SEQ ID NO: 4061995 - RNA, 22 nt, Staphylococcus aureus subsp. aureus N315
aaaauuauuuggcucuauauca

SEQ ID NO: 4061996 - RNA, 21 nt, Staphylococcus aureus subsp. aureus N315
aaaauucuauaaauagaauuu

SEQ ID NO: 4061997 - RNA, 15 nt, Staphylococcus aureus subsp. aureus N315
aaaauucuggauuaa

SEQ ID NO: 4061998 - RNA, 13 nt, Staphylococcus aureus subsp. aureus N315
aaaauugaacuuu

SEQ ID NO: 4061999 - RNA, 21 nt, Staphylococcus aureus subsp. aureus N315
aaaauugauauugcaaaacuu

SEQ ID NO: 4062000 - RNA, 16 nt, Staphylococcus aureus subsp. aureus N315
aaaauugcuaaaaaaa

SEQ ID NO: 4062001 - RNA, 21 nt, Staphylococcus aureus subsp. aureus N315
aaaauugguuuggauaaaaug

SEQ ID NO: 4062002 - RNA, 22 nt, Staphylococcus aureus subsp. aureus N315
aaaauugguuuggauaaaauga

SEQ ID NO: 4062003 - RNA, 23 nt, Staphylococcus aureus subsp. aureus N315
aaaauugguuuggauaaaaugau

SEQ ID NO: 4062004 - RNA, 23 nt, Staphylococcus aureus subsp. aureus N315
aaaauugugccauuugcaacaau

SEQ ID NO: 4062005 - RNA, 19 nt, Staphylococcus aureus subsp. aureus N315
aaaauuuauucaaaauuca

SEQ ID NO: 4062006 - RNA, 19 nt, Staphylococcus aureus subsp. aureus N315
aaaauuucaccgcuuucaa

SEQ ID NO: 4062007 - RNA, 20 nt, Staphylococcus aureus subsp. aureus N315
aaaauuucauauuguuuagg

SEQ ID NO: 4062008 - RNA, 12 nt, Staphylococcus aureus subsp. aureus N315
aaaauuucugcu

SEQ ID NO: 4062009 - RNA, 22 nt, Staphylococcus aureus subsp. aureus N315
aaaauuugaaauauaccaacca

SEQ ID NO: 4062010 - RNA, 18 nt, Staphylococcus aureus subsp. aureus N315
aaaauuugaauugacuua

SEQ ID NO: 4062011 - RNA, 18 nt, Staphylococcus aureus subsp. aureus N315
aaaauuugugcauucauc

SEQ ID NO: 4062012 - RNA, 23 nt, Staphylococcus aureus subsp. aureus N315
aaaauuuucuugguuugagaauc

SEQ ID NO: 4062013 - RNA, 14 nt, Staphylococcus aureus subsp. aureus N315
aaaauuuugaagaa

SEQ ID NO: 4062014 - RNA, 16 nt, Staphylococcus aureus subsp. aureus N315
aaaauuuuuaaaaaaa

SEQ ID NO: 4062015 - RNA, 15 nt, Staphylococcus aureus subsp. aureus N315
aaacaaaaaacuucc

SEQ ID NO: 4062016 - RNA, 13 nt, Staphylococcus aureus subsp. aureus N315
aaacaaaaaauau

SEQ ID NO: 4062017 - RNA, 21 nt, Staphylococcus aureus subsp. aureus N315
aaacaaaaaauaucuuuuugu

SEQ ID NO: 4062018 - RNA, 15 nt, Staphylococcus aureus subsp. aureus N315
aaacaaaaaucuacu

SEQ ID NO: 4062019 - RNA, 14 nt, Staphylococcus aureus subsp. aureus N315
aaacaaaacaaaaa

SEQ ID NO: 4062020 - RNA, 14 nt, Staphylococcus aureus subsp. aureus N315
aaacaaaagaaagu

SEQ ID NO: 4062021 - RNA, 21 nt, Staphylococcus aureus subsp. aureus N315
aaacaaagcucaauaaauuau

SEQ ID NO: 4062022 - RNA, 16 nt, Staphylococcus aureus subsp. aureus N315
aaacaaaucuuuuaaa

SEQ ID NO: 4062023 - RNA, 12 nt, Staphylococcus aureus subsp. aureus N315
aaacaacaucac

SEQ ID NO: 4062024 - RNA, 20 nt, Staphylococcus aureus subsp. aureus N315
aaacaacaucgauuuaucau

SEQ ID NO: 4062025 - RNA, 13 nt, Staphylococcus aureus subsp. aureus N315
aaacaauaaaaaa

SEQ ID NO: 4062026 - RNA, 20 nt, Staphylococcus aureus subsp. aureus N315
aaacaauaaaaaaccaagug

SEQ ID NO: 4062027 - RNA, 17 nt, Staphylococcus aureus subsp. aureus N315
aaacaaugauuaaaauu

SEQ ID NO: 4062028 - RNA, 13 nt, Staphylococcus aureus subsp. aureus N315
aaacaaugcaagu

SEQ ID NO: 4062029 - RNA, 20 nt, Staphylococcus aureus subsp. aureus N315
aaacaaugcgguaaaaacuc

SEQ ID NO: 4062030 - RNA, 17 nt, Staphylococcus aureus subsp. aureus N315
aaacaauuacaaaauca

SEQ ID NO: 4062031 - RNA, 13 nt, Staphylococcus aureus subsp. aureus N315
aaacaauuuugua

SEQ ID NO: 4062032 - RNA, 23 nt, Staphylococcus aureus subsp. aureus N315
aaacacacuaaaagcugauguga

SEQ ID NO: 4062033 - RNA, 20 nt, Staphylococcus aureus subsp. aureus N315
aaacacagacguuuuugaau

SEQ ID NO: 4062034 - RNA, 22 nt, Staphylococcus aureus subsp. aureus N315
aaacacaguacaaauaacaaac

SEQ ID NO: 4062035 - RNA, 18 nt, Staphylococcus aureus subsp. aureus N315
aaacacccugcuuaucau

SEQ ID NO: 4062036 - RNA, 19 nt, Staphylococcus aureus subsp. aureus N315
aaacacccugcuuaucauu

SEQ ID NO: 4062037 - RNA, 22 nt, Staphylococcus aureus subsp. aureus N315
aaacagaaauugcgaauuguua

SEQ ID NO: 4062038 - RNA, 14 nt, Staphylococcus aureus subsp. aureus N315
aaacagcaaauaaa

SEQ ID NO: 4062039 - RNA, 17 nt, Staphylococcus aureus subsp. aureus N315
aaacagcaguaagauau

SEQ ID NO: 4062040 - RNA, 13 nt, Staphylococcus aureus subsp. aureus N315
aaacaguguagca

SEQ ID NO: 4062041 - RNA, 21 nt, Staphylococcus aureus subsp. aureus N315
aaacauaauuaccuuuccauu

SEQ ID NO: 4062042 - RNA, 14 nt, Staphylococcus aureus subsp. aureus N315
aaacauagaugcuu

SEQ ID NO: 4062043 - RNA, 13 nt, Staphylococcus aureus subsp. aureus N315
aaacauaucuucu

SEQ ID NO: 4062044 - RNA, 21 nt, Staphylococcus aureus subsp. aureus N315
aaacauguacaauuuuuaaaa

SEQ ID NO: 4062045 - RNA, 18 nt, Staphylococcus aureus subsp. aureus N315
aaacauuaaaauaauuaa

SEQ ID NO: 4062046 - RNA, 17 nt, Staphylococcus aureus subsp. aureus N315
aaacauuaaucuauaua

SEQ ID NO: 4062047 - RNA, 20 nt, Staphylococcus aureus subsp. aureus N315
aaacauucccuuaauaauaa

SEQ ID NO: 4062048 - RNA, 21 nt, Staphylococcus aureus subsp. aureus N315
aaacauucccuuaauaauaag

SEQ ID NO: 4062049 - RNA, 13 nt, Staphylococcus aureus subsp. aureus N315
aaagacagcagua

SEQ ID NO: 4062050 - RNA, 16 nt, Staphylococcus aureus subsp. aureus N315
aaagacaugagauuau

SEQ ID NO: 4062051 - RNA, 23 nt, Staphylococcus aureus subsp. aureus N315
aaagacggugaccuuauauuuua

SEQ ID NO: 4062052 - RNA, 19 nt, Staphylococcus aureus subsp. aureus N315
aaagacuacaagucauuau

SEQ ID NO: 4062053 - RNA, 21 nt, Staphylococcus aureus subsp. aureus N315
aaagacuauauaacacaauac

SEQ ID NO: 4062054 - RNA, 22 nt, Staphylococcus aureus subsp. aureus N315
aaagacucaauuucauuugaaa

SEQ ID NO: 4062055 - RNA, 21 nt, Staphylococcus aureus subsp. aureus N315
aaagacugaaccguauaaugc

SEQ ID NO: 4062056 - RNA, 21 nt, Staphylococcus aureus subsp. aureus N315
aaagacuuuccaccauaugug

SEQ ID NO: 4062057 - RNA, 22 nt, Staphylococcus aureus subsp. aureus N315
aaagagaaacaaaacaaaaaau

SEQ ID NO: 4062058 - RNA, 22 nt, Staphylococcus aureus subsp. aureus N315
aaagagauacugguuaguaaaa

SEQ ID NO: 4062059 - RNA, 13 nt, Staphylococcus aureus subsp. aureus N315
aaagagcguguua

SEQ ID NO: 4062060 - RNA, 22 nt, Staphylococcus aureus subsp. aureus N315
aaagaggcgccacaacauguuu

SEQ ID NO: 4062061 - RNA, 12 nt, Staphylococcus aureus subsp. aureus N315
aaagauacugcu

SEQ ID NO: 4062062 - RNA, 16 nt, Staphylococcus aureus subsp. aureus N315
aaagauauaaacauuu

SEQ ID NO: 4062063 - RNA, 13 nt, Staphylococcus aureus subsp. aureus N315
aaagauauacuua

SEQ ID NO: 4062064 - RNA, 14 nt, Staphylococcus aureus subsp. aureus N315
aaagauauagaauu

SEQ ID NO: 4062065 - RNA, 16 nt, Staphylococcus aureus subsp. aureus N315
aaagauauagaauuca

SEQ ID NO: 4062066 - RNA, 14 nt, Staphylococcus aureus subsp. aureus N315
aaagauauguuuau

SEQ ID NO: 4062067 - RNA, 13 nt, Staphylococcus aureus subsp. aureus N315
aaagaucauuaaa

SEQ ID NO: 4062068 - RNA, 16 nt, Staphylococcus aureus subsp. aureus N315
aaagaucgauacuuuu

SEQ ID NO: 4062069 - RNA, 14 nt, Staphylococcus aureus subsp. aureus N315
aaagaugaaaaagu

SEQ ID NO: 4062070 - RNA, 14 nt, Staphylococcus aureus subsp. aureus N315
aaagaugaaaaucu

SEQ ID NO: 4062071 - RNA, 17 nt, Staphylococcus aureus subsp. aureus N315
aaagaugaaaaucuuua

SEQ ID NO: 4062072 - RNA, 21 nt, Staphylococcus aureus subsp. aureus N315
aaagaugaaaaucuuuaacuc

SEQ ID NO: 4062073 - RNA, 16 nt, Staphylococcus aureus subsp. aureus N315
aaagaugggauuucac

SEQ ID NO: 4062074 - RNA, 23 nt, Staphylococcus aureus subsp. aureus N315
aaagaugguuuuguuuugcucuu

SEQ ID NO: 4062075 - RNA, 13 nt, Staphylococcus aureus subsp. aureus N315
aaagaugucgaaa

SEQ ID NO: 4062076 - RNA, 19 nt, Staphylococcus aureus subsp. aureus N315
aaagauuagaugauauuua

SEQ ID NO: 4062077 - RNA, 18 nt, Staphylococcus aureus subsp. aureus N315
aaagauuauuauuacaau

SEQ ID NO: 4062078 - RNA, 20 nt, Staphylococcus aureus subsp. aureus N315
aaagauuuuguugaacguuu

SEQ ID NO: 4062079 - RNA, 16 nt, Staphylococcus aureus subsp. aureus N315
aaagcaaauuauauag

SEQ ID NO: 4062080 - RNA, 13 nt, Staphylococcus aureus subsp. aureus N315
aaagcacauguau

SEQ ID NO: 4062081 - RNA, 21 nt, Staphylococcus aureus subsp. aureus N315
aaagcacccuaauuuguuagu

SEQ ID NO: 4062082 - RNA, 17 nt, Staphylococcus aureus subsp. aureus N315
aaagcagucgaacaaug

SEQ ID NO: 4062083 - RNA, 17 nt, Staphylococcus aureus subsp. aureus N315
aaagcaguuaaugaauc

SEQ ID NO: 4062084 - RNA, 22 nt, Staphylococcus aureus subsp. aureus N315
aaagcaucuucaauauuuaaau

SEQ ID NO: 4062085 - RNA, 23 nt, Staphylococcus aureus subsp. aureus N315
aaagcaucuucaauauuuaaauu

SEQ ID NO: 4062086 - RNA, 12 nt, Staphylococcus aureus subsp. aureus N315
aaagcaucuuua

SEQ ID NO: 4062087 - RNA, 15 nt, Staphylococcus aureus subsp. aureus N315
aaagccaauuaauaa

SEQ ID NO: 4062088 - RNA, 18 nt, Staphylococcus aureus subsp. aureus N315
aaagccaccuaaaucucc

SEQ ID NO: 4062089 - RNA, 15 nt, Staphylococcus aureus subsp. aureus N315
aaagcccuaagcucg

SEQ ID NO: 4062090 - RNA, 16 nt, Staphylococcus aureus subsp. aureus N315
aaagccuucuaucucu

SEQ ID NO: 4062091 - RNA, 17 nt, Staphylococcus aureus subsp. aureus N315
aaagcgaauuaucuuua

SEQ ID NO: 4062092 - RNA, 22 nt, Staphylococcus aureus subsp. aureus N315
aaagcguccucuugugaaauua

SEQ ID NO: 4062093 - RNA, 16 nt, Staphylococcus aureus subsp. aureus N315
aaagcgugguucccaa

SEQ ID NO: 4062094 - RNA, 22 nt, Staphylococcus aureus subsp. aureus N315
aaagcuaauggcuaauacaaaa

SEQ ID NO: 4062095 - RNA, 15 nt, Staphylococcus aureus subsp. aureus N315
aaagcuauaaaaaau

SEQ ID NO: 4062096 - RNA, 18 nt, Staphylococcus aureus subsp. aureus N315
aaagcuauaaaaaaucuu

SEQ ID NO: 4062097 - RNA, 23 nt, Staphylococcus aureus subsp. aureus N315
aaagcuauaaaaaaucuuuugau

SEQ ID NO: 4062098 - RNA, 23 nt, Staphylococcus aureus subsp. aureus N315
aaagcuauauaugaauugaguau

SEQ ID NO: 4062099 - RNA, 19 nt, Staphylococcus aureus subsp. aureus N315
aaagcuccagucauuuguu

SEQ ID NO: 4062100 - RNA, 23 nt, Staphylococcus aureus subsp. aureus N315
aaagcuggggaagaccauuuuau

SEQ ID NO: 4062101 - RNA, 15 nt, Staphylococcus aureus subsp. aureus N315
aaagcugucaacuug

SEQ ID NO: 4062102 - RNA, 18 nt, Staphylococcus aureus subsp. aureus N315
aaagcuuccaaauguuca

SEQ ID NO: 4062103 - RNA, 14 nt, Staphylococcus aureus subsp. aureus N315
aaagcuugauuuaa

SEQ ID NO: 4062104 - RNA, 18 nt, Staphylococcus aureus subsp. aureus N315
aaagcuugauuuaacaac

SEQ ID NO: 4062105 - RNA, 17 nt, Staphylococcus aureus subsp. aureus N315
aaagcuuuaguuaaaua

SEQ ID NO: 4062106 - RNA, 21 nt, Staphylococcus aureus subsp. aureus N315
aaagcuuuuuugcuuuuauaa

SEQ ID NO: 4062107 - RNA, 20 nt, Staphylococcus aureus subsp. aureus N315
aaaggaaggauuuuagauuu

SEQ ID NO: 4062108 - RNA, 16 nt, Staphylococcus aureus subsp. aureus N315
aaaggaccacuuagau

SEQ ID NO: 4062109 - RNA, 19 nt, Staphylococcus aureus subsp. aureus N315
aaaggauggauacuuaaag

SEQ ID NO: 4062110 - RNA, 18 nt, Staphylococcus aureus subsp. aureus N315
aaaggaugugacaaauac

SEQ ID NO: 4062111 - RNA, 14 nt, Staphylococcus aureus subsp. aureus N315
aaaggauuauuaac

SEQ ID NO: 4062112 - RNA, 21 nt, Staphylococcus aureus subsp. aureus N315
aaaggauuauuaacuuuaaua

SEQ ID NO: 4062113 - RNA, 22 nt, Staphylococcus aureus subsp. aureus N315
aaaggauuauuaacuuuaauau

SEQ ID NO: 4062114 - RNA, 15 nt, Staphylococcus aureus subsp. aureus N315
aaaggcauucuucca

SEQ ID NO: 4062115 - RNA, 17 nt, Staphylococcus aureus subsp. aureus N315
aaaggcgaaacauuaaa

SEQ ID NO: 4062116 - RNA, 15 nt, Staphylococcus aureus subsp. aureus N315
aaaggcucauuuguu

SEQ ID NO: 4062117 - RNA, 18 nt, Staphylococcus aureus subsp. aureus N315
aaaggcucauuuguuaaa

SEQ ID NO: 4062118 - RNA, 22 nt, Staphylococcus aureus subsp. aureus N315
aaagguauaucuucauuuaaaa

SEQ ID NO: 4062119 - RNA, 18 nt, Staphylococcus aureus subsp. aureus N315
aaagguauucuauuuuuc

SEQ ID NO: 4062120 - RNA, 21 nt, Staphylococcus aureus subsp. aureus N315
aaaggucaaaaaauuaaucaa

SEQ ID NO: 4062121 - RNA, 17 nt, Staphylococcus aureus subsp. aureus N315
aaaggucccauuaaaau

SEQ ID NO: 4062122 - RNA, 23 nt, Staphylococcus aureus subsp. aureus N315
aaaggugugggcuuuauuaucau

SEQ ID NO: 4062123 - RNA, 20 nt, Staphylococcus aureus subsp. aureus N315
aaagguuguuuuucaucauu

SEQ ID NO: 4062124 - RNA, 21 nt, Staphylococcus aureus subsp. aureus N315
aaagguuuacuauuaaaggaa

SEQ ID NO: 4062125 - RNA, 15 nt, Staphylococcus aureus subsp. aureus N315
aaaguaaaagcuuuc

SEQ ID NO: 4062126 - RNA, 13 nt, Staphylococcus aureus subsp. aureus N315
aaaguaaauuaca

SEQ ID NO: 4062127 - RNA, 13 nt, Staphylococcus aureus subsp. aureus N315
aaaguaacauacu

SEQ ID NO: 4062128 - RNA, 21 nt, Staphylococcus aureus subsp. aureus N315
aaaguaacauacuauaaaaau

SEQ ID NO: 4062129 - RNA, 15 nt, Staphylococcus aureus subsp. aureus N315
aaaguaaguaaaaua

SEQ ID NO: 4062130 - RNA, 13 nt, Staphylococcus aureus subsp. aureus N315
aaaguaauaugag

SEQ ID NO: 4062131 - RNA, 22 nt, Staphylococcus aureus subsp. aureus N315
aaaguaauaugagugaaaguuu

SEQ ID NO: 4062132 - RNA, 17 nt, Staphylococcus aureus subsp. aureus N315
aaaguaauuaaauacuu

SEQ ID NO: 4062133 - RNA, 19 nt, Staphylococcus aureus subsp. aureus N315
aaaguacuuacaaauauac

SEQ ID NO: 4062134 - RNA, 19 nt, Staphylococcus aureus subsp. aureus N315
aaaguacuuuaaaauugua

SEQ ID NO: 4062135 - RNA, 18 nt, Staphylococcus aureus subsp. aureus N315
aaaguagaauuauuuaga

SEQ ID NO: 4062136 - RNA, 13 nt, Staphylococcus aureus subsp. aureus N315
aaaguauauugcu

SEQ ID NO: 4062137 - RNA, 15 nt, Staphylococcus aureus subsp. aureus N315
aaaguauauugcuua

SEQ ID NO: 4062138 - RNA, 22 nt, Staphylococcus aureus subsp. aureus N315
aaaguaucgccaaucuauugca

SEQ ID NO: 4062139 - RNA, 21 nt, Staphylococcus aureus subsp. aureus N315
aaaguaucuaugaaauuuuuu

SEQ ID NO: 4062140 - RNA, 21 nt, Staphylococcus aureus subsp. aureus N315
aaaguauuagauauauuugaa

SEQ ID NO: 4062141 - RNA, 13 nt, Staphylococcus aureus subsp. aureus N315
aaagucaacaauu

SEQ ID NO: 4062142 - RNA, 14 nt, Staphylococcus aureus subsp. aureus N315
aaagucaauuuaaa

SEQ ID NO: 4062143 - RNA, 20 nt, Staphylococcus aureus subsp. aureus N315
aaagucauaggcuugccaau

SEQ ID NO: 4062144 - RNA, 15 nt, Staphylococcus aureus subsp. aureus N315
aaagucauuaaaugu

SEQ ID NO: 4062145 - RNA, 21 nt, Staphylococcus aureus subsp. aureus N315
aaagucguuguugaaauuaaa

SEQ ID NO: 4062146 - RNA, 22 nt, Staphylococcus aureus subsp. aureus N315
aaagucguuguugaaauuaaau

SEQ ID NO: 4062147 - RNA, 21 nt, Staphylococcus aureus subsp. aureus N315
aaagucuguugguuuaucagc

SEQ ID NO: 4062148 - RNA, 14 nt, Staphylococcus aureus subsp. aureus N315
aaagucuucaucuu

SEQ ID NO: 4062149 - RNA, 19 nt, Staphylococcus aureus subsp. aureus N315
aaagucuucuucaacaauu

SEQ ID NO: 4062150 - RNA, 13 nt, Staphylococcus aureus subsp. aureus N315
aaagucuuuaaua

SEQ ID NO: 4062151 - RNA, 19 nt, Staphylococcus aureus subsp. aureus N315
aaagugaaaacuucucuau

SEQ ID NO: 4062152 - RNA, 15 nt, Staphylococcus aureus subsp. aureus N315
aaagugaaaguauua

SEQ ID NO: 4062153 - RNA, 13 nt, Staphylococcus aureus subsp. aureus N315
aaagugaauauua

SEQ ID NO: 4062154 - RNA, 22 nt, Staphylococcus aureus subsp. aureus N315
aaagugauaauuaaaauaagau

SEQ ID NO: 4062155 - RNA, 14 nt, Staphylococcus aureus subsp. aureus N315
aaagugauuuaaaa

SEQ ID NO: 4062156 - RNA, 16 nt, Staphylococcus aureus subsp. aureus N315
aaagugcgauuaucag

SEQ ID NO: 4062157 - RNA, 18 nt, Staphylococcus aureus subsp. aureus N315
aaagugcgguuauuuaua

SEQ ID NO: 4062158 - RNA, 15 nt, Staphylococcus aureus subsp. aureus N315
aaagugguuuuacug

SEQ ID NO: 4062159 - RNA, 21 nt, Staphylococcus aureus subsp. aureus N315
aaaguguaauguuccccugaa

SEQ ID NO: 4062160 - RNA, 16 nt, Staphylococcus aureus subsp. aureus N315
aaaguguuaugaauua

SEQ ID NO: 4062161 - RNA, 20 nt, Staphylococcus aureus subsp. aureus N315
aaaguuagacuaaaaaacua

SEQ ID NO: 4062162 - RNA, 21 nt, Staphylococcus aureus subsp. aureus N315
aaaguugcacuugguucauaa

SEQ ID NO: 4062163 - RNA, 16 nt, Staphylococcus aureus subsp. aureus N315
aaaguuguaauuuaaa

SEQ ID NO: 4062164 - RNA, 17 nt, Staphylococcus aureus subsp. aureus N315
aaaguuguaauuuaaaa

SEQ ID NO: 4062165 - RNA, 14 nt, Staphylococcus aureus subsp. aureus N315
aaaguuuauacuua

SEQ ID NO: 4062166 - RNA, 17 nt, Staphylococcus aureus subsp. aureus N315
aaaguuuauuuauguuc

SEQ ID NO: 4062167 - RNA, 11 nt, Staphylococcus aureus subsp. aureus N315
aaaguuucucc

SEQ ID NO: 4062168 - RNA, 13 nt, Staphylococcus aureus subsp. aureus N315
aaaguuucuccac

SEQ ID NO: 4062169 - RNA, 15 nt, Staphylococcus aureus subsp. aureus N315
aaaguuucuccaccu

SEQ ID NO: 4062170 - RNA, 16 nt, Staphylococcus aureus subsp. aureus N315
aaaguuuguauauucu

SEQ ID NO: 4062171 - RNA, 22 nt, Staphylococcus aureus subsp. aureus N315
aaaguuuguauauucuuuuuaa

SEQ ID NO: 4062172 - RNA, 18 nt, Staphylococcus aureus subsp. aureus N315
aaaguuuucauuuaacau

SEQ ID NO: 4062173 - RNA, 22 nt, Staphylococcus aureus subsp. aureus N315
aaaguuuucauuuaacauguau

SEQ ID NO: 4062174 - RNA, 14 nt, Staphylococcus aureus subsp. aureus N315
aaaguuuuugucuu

SEQ ID NO: 4062175 - RNA, 17 nt, Staphylococcus aureus subsp. aureus N315
aaaguuuuugucuuaau

SEQ ID NO: 4062176 - RNA, 15 nt, Staphylococcus aureus subsp. aureus N315
aaauaaaaaaacacc

SEQ ID NO: 4062177 - RNA, 13 nt, Staphylococcus aureus subsp. aureus N315
aaauaaaaaaugc

SEQ ID NO: 4062178 - RNA, 16 nt, Staphylococcus aureus subsp. aureus N315
aaauaaaaauauugcg

SEQ ID NO: 4062179 - RNA, 13 nt, Staphylococcus aureus subsp. aureus N315
aaauaaaaauuau

SEQ ID NO: 4062180 - RNA, 21 nt, Staphylococcus aureus subsp. aureus N315
aaauaaaacgacucauuauaa

SEQ ID NO: 4062181 - RNA, 19 nt, Staphylococcus aureus subsp. aureus N315
aaauaaaacgcuucauaua

SEQ ID NO: 4062182 - RNA, 12 nt, Staphylococcus aureus subsp. aureus N315
aaauaaaaugcu

SEQ ID NO: 4062183 - RNA, 14 nt, Staphylococcus aureus subsp. aureus N315
aaauaaaauuaaaa

SEQ ID NO: 4062184 - RNA, 15 nt, Staphylococcus aureus subsp. aureus N315
aaauaaaauuaaaac

SEQ ID NO: 4062185 - RNA, 22 nt, Staphylococcus aureus subsp. aureus N315
aaauaaaauuuuuuucauaauu

SEQ ID NO: 4062186 - RNA, 16 nt, Staphylococcus aureus subsp. aureus N315
aaauaaaccacgcaca

SEQ ID NO: 4062187 - RNA, 14 nt, Staphylococcus aureus subsp. aureus N315
aaauaaaccaugcu

SEQ ID NO: 4062188 - RNA, 22 nt, Staphylococcus aureus subsp. aureus N315
aaauaaacgauugauuaucaua

SEQ ID NO: 4062189 - RNA, 14 nt, Staphylococcus aureus subsp. aureus N315
aaauaaauaagcaa

SEQ ID NO: 4062190 - RNA, 16 nt, Staphylococcus aureus subsp. aureus N315
aaauaaauacaauaga

SEQ ID NO: 4062191 - RNA, 22 nt, Staphylococcus aureus subsp. aureus N315
aaauaaaucuccauuaaucauu

SEQ ID NO: 4062192 - RNA, 22 nt, Staphylococcus aureus subsp. aureus N315
aaauaaauguccgacuugauaa

SEQ ID NO: 4062193 - RNA, 12 nt, Staphylococcus aureus subsp. aureus N315
aaauaaauuaaa

SEQ ID NO: 4062194 - RNA, 19 nt, Staphylococcus aureus subsp. aureus N315
aaauaaauuuuacgaaaau

SEQ ID NO: 4062195 - RNA, 21 nt, Staphylococcus aureus subsp. aureus N315
aaauaaauuuugcgaaaauau

SEQ ID NO: 4062196 - RNA, 16 nt, Staphylococcus aureus subsp. aureus N315
aaauaacaaacauuaa

SEQ ID NO: 4062197 - RNA, 16 nt, Staphylococcus aureus subsp. aureus N315
aaauaacaauagugac

SEQ ID NO: 4062198 - RNA, 12 nt, Staphylococcus aureus subsp. aureus N315
aaauaaccauuu

SEQ ID NO: 4062199 - RNA, 20 nt, Staphylococcus aureus subsp. aureus N315
aaauaaccgcacuuucuauu

SEQ ID NO: 4062200 - RNA, 19 nt, Staphylococcus aureus subsp. aureus N315
aaauaacugcuaauuuuuu

SEQ ID NO: 4062201 - RNA, 14 nt, Staphylococcus aureus subsp. aureus N315
aaauaacuucguuu

SEQ ID NO: 4062202 - RNA, 20 nt, Staphylococcus aureus subsp. aureus N315
aaauaacuucguuuuaauaa

SEQ ID NO: 4062203 - RNA, 18 nt, Staphylococcus aureus subsp. aureus N315
aaauaagcuuguaacaag

SEQ ID NO: 4062204 - RNA, 22 nt, Staphylococcus aureus subsp. aureus N315
aaauaauaaguugaauauaaaa

SEQ ID NO: 4062205 - RNA, 23 nt, Staphylococcus aureus subsp. aureus N315
aaauaauaaguugaauauaaaaa

SEQ ID NO: 4062206 - RNA, 21 nt, Staphylococcus aureus subsp. aureus N315
aaauaauaauucauaaaugcu

SEQ ID NO: 4062207 - RNA, 13 nt, Staphylococcus aureus subsp. aureus N315
aaauaauauaaaa

SEQ ID NO: 4062208 - RNA, 17 nt, Staphylococcus aureus subsp. aureus N315
aaauaaucgaacagaaa

SEQ ID NO: 4062209 - RNA, 19 nt, Staphylococcus aureus subsp. aureus N315
aaauaaucgaacagaaaau

SEQ ID NO: 4062210 - RNA, 17 nt, Staphylococcus aureus subsp. aureus N315
aaauaaugucuuacuuu

SEQ ID NO: 4062211 - RNA, 19 nt, Staphylococcus aureus subsp. aureus N315
aaauaauuaugaaaaguaa

SEQ ID NO: 4062212 - RNA, 22 nt, Staphylococcus aureus subsp. aureus N315
aaauaauuuaaaggcauaauaa

SEQ ID NO: 4062213 - RNA, 19 nt, Staphylococcus aureus subsp. aureus N315
aaauacaaagccuuaauau

SEQ ID NO: 4062214 - RNA, 12 nt, Staphylococcus aureus subsp. aureus N315
aaauacaaauau

SEQ ID NO: 4062215 - RNA, 18 nt, Staphylococcus aureus subsp. aureus N315
aaauacaaugaauuguua

SEQ ID NO: 4062216 - RNA, 13 nt, Staphylococcus aureus subsp. aureus N315
aaauacauaauca

SEQ ID NO: 4062217 - RNA, 15 nt, Staphylococcus aureus subsp. aureus N315
aaauacaucggaauu

SEQ ID NO: 4062218 - RNA, 22 nt, Staphylococcus aureus subsp. aureus N315
aaauacaugugggauaucuucu

SEQ ID NO: 4062219 - RNA, 17 nt, Staphylococcus aureus subsp. aureus N315
aaauaccgucuucucua

SEQ ID NO: 4062220 - RNA, 19 nt, Staphylococcus aureus subsp. aureus N315
aaauacgacaccaacauau

SEQ ID NO: 4062221 - RNA, 16 nt, Staphylococcus aureus subsp. aureus N315
aaauacgguacagaua

SEQ ID NO: 4062222 - RNA, 13 nt, Staphylococcus aureus subsp. aureus N315
aaauacguuuaau

SEQ ID NO: 4062223 - RNA, 15 nt, Staphylococcus aureus subsp. aureus N315
aaauacuaagauuag

SEQ ID NO: 4062224 - RNA, 15 nt, Staphylococcus aureus subsp. aureus N315
aaaucaacaagaacu

SEQ ID NO: 4062225 - RNA, 16 nt, Staphylococcus aureus subsp. aureus N315
aaaucaacaucaucuu

SEQ ID NO: 4062226 - RNA, 22 nt, Staphylococcus aureus subsp. aureus N315
aaaucaagacucccuuuuuaaa

SEQ ID NO: 4062227 - RNA, 23 nt, Staphylococcus aureus subsp. aureus N315
aaaucaagacucccuuuuuaaaa

SEQ ID NO: 4062228 - RNA, 13 nt, Staphylococcus aureus subsp. aureus N315
aaaucaauaccaa

SEQ ID NO: 4062229 - RNA, 15 nt, Staphylococcus aureus subsp. aureus N315
aaaucaauacuuuca

SEQ ID NO: 4062230 - RNA, 12 nt, Staphylococcus aureus subsp. aureus N315
aaaucaauccau

SEQ ID NO: 4062231 - RNA, 13 nt, Staphylococcus aureus subsp. aureus N315
aaaucaauccauc

SEQ ID NO: 4062232 - RNA, 15 nt, Staphylococcus aureus subsp. aureus N315
aaaucaauccaucaa

SEQ ID NO: 4062233 - RNA, 13 nt, Staphylococcus aureus subsp. aureus N315
aaaucaauguacu

SEQ ID NO: 4062234 - RNA, 18 nt, Staphylococcus aureus subsp. aureus N315
aaaucaccagauuuuaag

SEQ ID NO: 4062235 - RNA, 23 nt, Staphylococcus aureus subsp. aureus N315
aaaucacgauuuucaaguaauga

SEQ ID NO: 4062236 - RNA, 14 nt, Staphylococcus aureus subsp. aureus N315
aaaucacgccauaa

SEQ ID NO: 4062237 - RNA, 15 nt, Staphylococcus aureus subsp. aureus N315
aaaucacugcuuuca

SEQ ID NO: 4062238 - RNA, 22 nt, Staphylococcus aureus subsp. aureus N315
aaaucacuugguaaaacaucgu

SEQ ID NO: 4062239 - RNA, 13 nt, Staphylococcus aureus subsp. aureus N315
aaaucaguaauau

SEQ ID NO: 4062240 - RNA, 15 nt, Staphylococcus aureus subsp. aureus N315
aaaucaguaauauca

SEQ ID NO: 4062241 - RNA, 16 nt, Staphylococcus aureus subsp. aureus N315
aaaucaguaauaucaa

SEQ ID NO: 4062242 - RNA, 18 nt, Staphylococcus aureus subsp. aureus N315
aaaucagucauucacaua

SEQ ID NO: 4062243 - RNA, 20 nt, Staphylococcus aureus subsp. aureus N315
aaaucaguuuuuaaaucaaa

SEQ ID NO: 4062244 - RNA, 13 nt, Staphylococcus aureus subsp. aureus N315
aaaucauaaauaa

SEQ ID NO: 4062245 - RNA, 14 nt, Staphylococcus aureus subsp. aureus N315
aaaucauaaauaac

SEQ ID NO: 4062246 - RNA, 13 nt, Staphylococcus aureus subsp. aureus N315
aaaucauaacgac

SEQ ID NO: 4062247 - RNA, 21 nt, Staphylococcus aureus subsp. aureus N315
aaaucauacgagaaauuagaa

SEQ ID NO: 4062248 - RNA, 13 nt, Staphylococcus aureus subsp. aureus N315
aaaucauauauuu

SEQ ID NO: 4062249 - RNA, 18 nt, Staphylococcus aureus subsp. aureus N315
aaaucauauauuucuauu

SEQ ID NO: 4062250 - RNA, 13 nt, Staphylococcus aureus subsp. aureus N315
aaaucaucauaac

SEQ ID NO: 4062251 - RNA, 19 nt, Staphylococcus aureus subsp. aureus N315
aaaucaugaaauaaaaaaa

SEQ ID NO: 4062252 - RNA, 18 nt, Staphylococcus aureus subsp. aureus N315
aaaucauuaguuguauca

SEQ ID NO: 4062253 - RNA, 16 nt, Staphylococcus aureus subsp. aureus N315
aaaucauucauuugca

SEQ ID NO: 4062254 - RNA, 18 nt, Staphylococcus aureus subsp. aureus N315
aaaucauucauuugcaaa

SEQ ID NO: 4062255 - RNA, 19 nt, Staphylococcus aureus subsp. aureus N315
aaaucauucauuugcaaag

SEQ ID NO: 4062256 - RNA, 19 nt, Staphylococcus aureus subsp. aureus N315
aaaucauucuuuauagaaa

SEQ ID NO: 4062257 - RNA, 17 nt, Staphylococcus aureus subsp. aureus N315
aaaucauuuaaauuagu

SEQ ID NO: 4062258 - RNA, 16 nt, Staphylococcus aureus subsp. aureus N315
aaauccaaaaucuuua

SEQ ID NO: 4062259 - RNA, 16 nt, Staphylococcus aureus subsp. aureus N315
aaauccacacauuaag

SEQ ID NO: 4062260 - RNA, 13 nt, Staphylococcus aureus subsp. aureus N315
aaaucccuaaaaa

SEQ ID NO: 4062261 - RNA, 20 nt, Staphylococcus aureus subsp. aureus N315
aaauccguuaaaauuuuaau

SEQ ID NO: 4062262 - RNA, 22 nt, Staphylococcus aureus subsp. aureus N315
aaauccuaagcaucguaaaaaa

SEQ ID NO: 4062263 - RNA, 16 nt, Staphylococcus aureus subsp. aureus N315
aaauccuaauuuuucu

SEQ ID NO: 4062264 - RNA, 15 nt, Staphylococcus aureus subsp. aureus N315
aaauccuuaaaugga

SEQ ID NO: 4062265 - RNA, 24 nt, Staphylococcus aureus subsp. aureus N315
aaauccuuaaauggagauucucgg

SEQ ID NO: 4062266 - RNA, 14 nt, Staphylococcus aureus subsp. aureus N315
aaaucgaacaaaug

SEQ ID NO: 4062267 - RNA, 16 nt, Staphylococcus aureus subsp. aureus N315
aaaucgaauugaugga

SEQ ID NO: 4062268 - RNA, 23 nt, Staphylococcus aureus subsp. aureus N315
aaaucgaauugguaaaaaucuca

SEQ ID NO: 4062269 - RNA, 22 nt, Staphylococcus aureus subsp. aureus N315
aaaucgauacuaauaucuucuu

SEQ ID NO: 4062270 - RNA, 15 nt, Staphylococcus aureus subsp. aureus N315
aaaucggaauaaaau

SEQ ID NO: 4062271 - RNA, 23 nt, Staphylococcus aureus subsp. aureus N315
aaaucguauagauuaaaaaauca

SEQ ID NO: 4062272 - RNA, 15 nt, Staphylococcus aureus subsp. aureus N315
aaaucguuaaggaaa

SEQ ID NO: 4062273 - RNA, 19 nt, Staphylococcus aureus subsp. aureus N315
aaaucguuaaggaaagcuu

SEQ ID NO: 4062274 - RNA, 16 nt, Staphylococcus aureus subsp. aureus N315
aaaucuaauuauucau

SEQ ID NO: 4062275 - RNA, 13 nt, Staphylococcus aureus subsp. aureus N315
aaaucuacaauau

SEQ ID NO: 4062276 - RNA, 15 nt, Staphylococcus aureus subsp. aureus N315
aaaucuacaauauua

SEQ ID NO: 4062277 - RNA, 18 nt, Staphylococcus aureus subsp. aureus N315
aaaucuacaauauuaaaa

SEQ ID NO: 4062278 - RNA, 20 nt, Staphylococcus aureus subsp. aureus N315
aaaucuauaaauaucaauaa

SEQ ID NO: 4062279 - RNA, 13 nt, Staphylococcus aureus subsp. aureus N315
aaaucuauauaaa

SEQ ID NO: 4062280 - RNA, 15 nt, Staphylococcus aureus subsp. aureus N315
aaaucuauauaaagu

SEQ ID NO: 4062281 - RNA, 18 nt, Staphylococcus aureus subsp. aureus N315
aaaucuaucuacucaaau

SEQ ID NO: 4062282 - RNA, 14 nt, Staphylococcus aureus subsp. aureus N315
aaaucucauaauaa

SEQ ID NO: 4062283 - RNA, 16 nt, Staphylococcus aureus subsp. aureus N315
aaaucucauaauaauu

SEQ ID NO: 4062284 - RNA, 13 nt, Staphylococcus aureus subsp. aureus N315
aaaucuccauuaa

SEQ ID NO: 4062285 - RNA, 17 nt, Staphylococcus aureus subsp. aureus N315
aaaucuccauuaaucau

SEQ ID NO: 4062286 - RNA, 18 nt, Staphylococcus aureus subsp. aureus N315
aaaucuccauuaaucauu

SEQ ID NO: 4062287 - RNA, 20 nt, Staphylococcus aureus subsp. aureus N315
aaaucugcuugugugucauu

SEQ ID NO: 4062288 - RNA, 21 nt, Staphylococcus aureus subsp. aureus N315
aaaucugcuuuauuuuaucau

SEQ ID NO: 4062289 - RNA, 23 nt, Staphylococcus aureus subsp. aureus N315
aaaucuggcacuuaagcuuuaau

SEQ ID NO: 4062290 - RNA, 23 nt, Staphylococcus aureus subsp. aureus N315
aaaucuguuuaaauuuaaaagaa

SEQ ID NO: 4062291 - RNA, 21 nt, Staphylococcus aureus subsp. aureus N315
aaaucuuaugaugucauguau

SEQ ID NO: 4062292 - RNA, 14 nt, Staphylococcus aureus subsp. aureus N315
aaaucuucuccaau

SEQ ID NO: 4062293 - RNA, 21 nt, Staphylococcus aureus subsp. aureus N315
aaaucuuguuggauuuuaaca

SEQ ID NO: 4062294 - RNA, 23 nt, Staphylococcus aureus subsp. aureus N315
aaaucuuguuggauuuuaacaag

SEQ ID NO: 4062295 - RNA, 13 nt, Staphylococcus aureus subsp. aureus N315
aaaucuuuaaaug

SEQ ID NO: 4062296 - RNA, 14 nt, Staphylococcus aureus subsp. aureus N315
aaaucuuuaaaugu

SEQ ID NO: 4062297 - RNA, 19 nt, Staphylococcus aureus subsp. aureus N315
aaaucuuuaacauuugucc

SEQ ID NO: 4062298 - RNA, 16 nt, Staphylococcus aureus subsp. aureus N315
aaaucuuuacuuguaa

SEQ ID NO: 4062299 - RNA, 22 nt, Staphylococcus aureus subsp. aureus N315
aaaucuuuugagacguuuucca

SEQ ID NO: 4062300 - RNA, 22 nt, Staphylococcus aureus subsp. aureus N315
aaaugaaaguaccuaaaauaga

SEQ ID NO: 4062301 - RNA, 19 nt, Staphylococcus aureus subsp. aureus N315
aaaugaaugaagacgaaua

SEQ ID NO: 4062302 - RNA, 20 nt, Staphylococcus aureus subsp. aureus N315
aaaugaauguuaagacauau

SEQ ID NO: 4062303 - RNA, 23 nt, Staphylococcus aureus subsp. aureus N315
aaaugaauguuaagacauaugca

SEQ ID NO: 4062304 - RNA, 21 nt, Staphylococcus aureus subsp. aureus N315
aaaugaauuauuuaaaaugcu

SEQ ID NO: 4062305 - RNA, 15 nt, Staphylococcus aureus subsp. aureus N315
aaaugaauugcuugu

SEQ ID NO: 4062306 - RNA, 19 nt, Staphylococcus aureus subsp. aureus N315
aaaugaauugucuuaauau

SEQ ID NO: 4062307 - RNA, 15 nt, Staphylococcus aureus subsp. aureus N315
aaaugacauuuaaua

SEQ ID NO: 4062308 - RNA, 18 nt, Staphylococcus aureus subsp. aureus N315
aaaugacgcucgagcucu

SEQ ID NO: 4062309 - RNA, 21 nt, Staphylococcus aureus subsp. aureus N315
aaaugacgugcuuuuaaaugu

SEQ ID NO: 4062310 - RNA, 23 nt, Staphylococcus aureus subsp. aureus N315
aaaugacgugcuuuuaaauguau

SEQ ID NO: 4062311 - RNA, 13 nt, Staphylococcus aureus subsp. aureus N315
aaauuauuauuua

SEQ ID NO: 4062312 - RNA, 12 nt, Staphylococcus aureus subsp. aureus N315
aaauuauuuaau

SEQ ID NO: 4062313 - RNA, 17 nt, Staphylococcus aureus subsp. aureus N315
aaauuauuuaauuuuuc

SEQ ID NO: 4062314 - RNA, 19 nt, Staphylococcus aureus subsp. aureus N315
aaauuauuuaauuuuucua

SEQ ID NO: 4062315 - RNA, 18 nt, Staphylococcus aureus subsp. aureus N315
aaauucaacgucaucaaa

SEQ ID NO: 4062316 - RNA, 21 nt, Staphylococcus aureus subsp. aureus N315
aaauucaacuuuaaucaaaaa

SEQ ID NO: 4062317 - RNA, 11 nt, Staphylococcus aureus subsp. aureus N315
aaauucauuug

SEQ ID NO: 4062318 - RNA, 13 nt, Staphylococcus aureus subsp. aureus N315
aaauucauuugua

SEQ ID NO: 4062319 - RNA, 19 nt, Staphylococcus aureus subsp. aureus N315
aaauucgacucaaacaaua

SEQ ID NO: 4062320 - RNA, 21 nt, Staphylococcus aureus subsp. aureus N315
aaauucuacaggcaaugcaag

SEQ ID NO: 4062321 - RNA, 22 nt, Staphylococcus aureus subsp. aureus N315
aaauucuacaggcaaugcgagu

SEQ ID NO: 4062322 - RNA, 17 nt, Staphylococcus aureus subsp. aureus N315
aaauucuacagguaaug

SEQ ID NO: 4062323 - RNA, 21 nt, Staphylococcus aureus subsp. aureus N315
aaauucuacagguaaugcaag

SEQ ID NO: 4062324 - RNA, 22 nt, Staphylococcus aureus subsp. aureus N315
aaauucuacagguaaugcaagu

SEQ ID NO: 4062325 - RNA, 17 nt, Staphylococcus aureus subsp. aureus N315
aaauucucaguguuggg

SEQ ID NO: 4062326 - RNA, 18 nt, Staphylococcus aureus subsp. aureus N315
aaauucuuauaaaauaaa

SEQ ID NO: 4062327 - RNA, 18 nt, Staphylococcus aureus subsp. aureus N315
aaauucuuuucaagaaau

SEQ ID NO: 4062328 - RNA, 13 nt, Staphylococcus aureus subsp. aureus N315
aaauucuuuugua

SEQ ID NO: 4062329 - RNA, 16 nt, Staphylococcus aureus subsp. aureus N315
aaauugaaauguuuau

SEQ ID NO: 4062330 - RNA, 22 nt, Staphylococcus aureus subsp. aureus N315
aaauugaaauguuuaucaauuc

SEQ ID NO: 4062331 - RNA, 13 nt, Staphylococcus aureus subsp. aureus N315
aaauugaaauuau

SEQ ID NO: 4062332 - RNA, 18 nt, Staphylococcus aureus subsp. aureus N315
aaauugaacuuuguaucu

SEQ ID NO: 4062333 - RNA, 22 nt, Staphylococcus aureus subsp. aureus N315
aaauugaauaucacuuuagaua

SEQ ID NO: 4062334 - RNA, 19 nt, Staphylococcus aureus subsp. aureus N315
aaauugaccgacaaaacuu

SEQ ID NO: 4062335 - RNA, 15 nt, Staphylococcus aureus subsp. aureus N315
aaauugacgcauuaa

SEQ ID NO: 4062336 - RNA, 15 nt, Staphylococcus aureus subsp. aureus N315
aaauugacucaaaga

SEQ ID NO: 4062337 - RNA, 19 nt, Staphylococcus aureus subsp. aureus N315
aaauugaguauauucaaaa

SEQ ID NO: 4062338 - RNA, 21 nt, Staphylococcus aureus subsp. aureus N315
aaauugauauugcaaaacuug

SEQ ID NO: 4062339 - RNA, 19 nt, Staphylococcus aureus subsp. aureus N315
aaauugcaaaguaacaaua

SEQ ID NO: 4062340 - RNA, 13 nt, Staphylococcus aureus subsp. aureus N315
aaauugcaaugcu

SEQ ID NO: 4062341 - RNA, 17 nt, Staphylococcus aureus subsp. aureus N315
aaauugccuuucauuuu

SEQ ID NO: 4062342 - RNA, 20 nt, Staphylococcus aureus subsp. aureus N315
aaauugccuuucauuuuagc

SEQ ID NO: 4062343 - RNA, 21 nt, Staphylococcus aureus subsp. aureus N315
aaauugcuaaaaaaauuaaaa

SEQ ID NO: 4062344 - RNA, 17 nt, Staphylococcus aureus subsp. aureus N315
aaauugcuauauuagua

SEQ ID NO: 4062345 - RNA, 13 nt, Staphylococcus aureus subsp. aureus N315
aaauugcugacac

SEQ ID NO: 4062346 - RNA, 17 nt, Staphylococcus aureus subsp. aureus N315
aaauugcuugaaauuau

SEQ ID NO: 4062347 - RNA, 18 nt, Staphylococcus aureus subsp. aureus N315
aaauugcuugaaauuauu

SEQ ID NO: 4062348 - RNA, 23 nt, Staphylococcus aureus subsp. aureus N315
aaauugguuuggauaaaaugaua

SEQ ID NO: 4062349 - RNA, 12 nt, Staphylococcus aureus subsp. aureus N315
aaauuguaaaac

SEQ ID NO: 4062350 - RNA, 13 nt, Staphylococcus aureus subsp. aureus N315
aaauuguauagaa

SEQ ID NO: 4062351 - RNA, 14 nt, Staphylococcus aureus subsp. aureus N315
aaauuguauagaau

SEQ ID NO: 4062352 - RNA, 21 nt, Staphylococcus aureus subsp. aureus N315
aaauuguaugaauaauauggu

SEQ ID NO: 4062353 - RNA, 23 nt, Staphylococcus aureus subsp. aureus N315
aaauuguggagaucuaacaauau

SEQ ID NO: 4062354 - RNA, 20 nt, Staphylococcus aureus subsp. aureus N315
aaauuguggcguaguuugaa

SEQ ID NO: 4062355 - RNA, 16 nt, Staphylococcus aureus subsp. aureus N315
aaauuguguugaauca

SEQ ID NO: 4062356 - RNA, 14 nt, Staphylococcus aureus subsp. aureus N315
aaauuguguuucuu

SEQ ID NO: 4062357 - RNA, 15 nt, Staphylococcus aureus subsp. aureus N315
aaauuuaaaagaaaa

SEQ ID NO: 4062358 - RNA, 12 nt, Staphylococcus aureus subsp. aureus N315
aaauuuaaaaua

SEQ ID NO: 4062359 - RNA, 11 nt, Staphylococcus aureus subsp. aureus N315
aaauuuaaaua

SEQ ID NO: 4062360 - RNA, 16 nt, Staphylococcus aureus subsp. aureus N315
aaauuuaaauauugaa

SEQ ID NO: 4062361 - RNA, 14 nt, Staphylococcus aureus subsp. aureus N315
aaauuuaacuauga

SEQ ID NO: 4062362 - RNA, 17 nt, Staphylococcus aureus subsp. aureus N315
aaauuuaagaaugcgaa

SEQ ID NO: 4062363 - RNA, 14 nt, Staphylococcus aureus subsp. aureus N315
aaauuuaauacaau

SEQ ID NO: 4062364 - RNA, 15 nt, Staphylococcus aureus subsp. aureus N315
aaauuuaauauuguu

SEQ ID NO: 4062365 - RNA, 21 nt, Staphylococcus aureus subsp. aureus N315
aaauuuacgaaaguagaauua

SEQ ID NO: 4062366 - RNA, 22 nt, Staphylococcus aureus subsp. aureus N315
aaauuuacgaaaguagaauuau

SEQ ID NO: 4062367 - RNA, 21 nt, Staphylococcus aureus subsp. aureus N315
aaauuuaguuaaguauuuaaa

SEQ ID NO: 4062368 - RNA, 12 nt, Staphylococcus aureus subsp. aureus N315
aaauuuauuaua

SEQ ID NO: 4062369 - RNA, 18 nt, Staphylococcus aureus subsp. aureus N315
aaauuuauuauaaaauag

SEQ ID NO: 4062370 - RNA, 22 nt, Staphylococcus aureus subsp. aureus N315
aaauuuauuauaaaauagaagu

SEQ ID NO: 4062371 - RNA, 13 nt, Staphylococcus aureus subsp. aureus N315
aaauuuauuuuua

SEQ ID NO: 4062372 - RNA, 17 nt, Staphylococcus aureus subsp. aureus N315
aaauuuauuuuuaauuu

SEQ ID NO: 4062373 - RNA, 15 nt, Staphylococcus aureus subsp. aureus N315
aaauuucaaaaauag

SEQ ID NO: 4062374 - RNA, 21 nt, Staphylococcus aureus subsp. aureus N315
aaauuucaagguauacacaaa

SEQ ID NO: 4062375 - RNA, 17 nt, Staphylococcus aureus subsp. aureus N315
aaauuucaggcguuaau

SEQ ID NO: 4062376 - RNA, 22 nt, Staphylococcus aureus subsp. aureus N315
aaauuucauaaaguuuauuuau

SEQ ID NO: 4062377 - RNA, 15 nt, Staphylococcus aureus subsp. aureus N315
aaauuucgacaucua

SEQ ID NO: 4062378 - RNA, 16 nt, Staphylococcus aureus subsp. aureus N315
aaauuucgacaucuag

SEQ ID NO: 4062379 - RNA, 23 nt, Staphylococcus aureus subsp. aureus N315
aaauuucgccucaucuaauuuau

SEQ ID NO: 4062380 - RNA, 17 nt, Staphylococcus aureus subsp. aureus N315
aaauuugaaauauacca

SEQ ID NO: 4062381 - RNA, 18 nt, Staphylococcus aureus subsp. aureus N315
aaauuugugauuaugcau

SEQ ID NO: 4062382 - RNA, 20 nt, Staphylococcus aureus subsp. aureus N315
aaauuugugcauucaucaau

SEQ ID NO: 4062383 - RNA, 18 nt, Staphylococcus aureus subsp. aureus N315
aaauuuguguucaaauca

SEQ ID NO: 4062384 - RNA, 19 nt, Staphylococcus aureus subsp. aureus N315
aaauuuguguucaaaucac

SEQ ID NO: 4062385 - RNA, 19 nt, Staphylococcus aureus subsp. aureus N315
aaauuuuuuagugaaaaag

SEQ ID NO: 4062386 - RNA, 20 nt, Staphylococcus aureus subsp. aureus N315
aaauuuuuuagugaaaaagu

SEQ ID NO: 4062387 - RNA, 14 nt, Staphylococcus aureus subsp. aureus N315
aacaaaaagaauuu

SEQ ID NO: 4062388 - RNA, 19 nt, Staphylococcus aureus subsp. aureus N315
aacaaaaagguucuccacc

SEQ ID NO: 4062389 - RNA, 22 nt, Staphylococcus aureus subsp. aureus N315
aacaaaacuugagcuauucaua

SEQ ID NO: 4062390 - RNA, 18 nt, Staphylococcus aureus subsp. aureus N315
aacaaaagaucgauacuu

SEQ ID NO: 4062391 - RNA, 18 nt, Staphylococcus aureus subsp. aureus N315
aacaaaauauacuaaauu

SEQ ID NO: 4062392 - RNA, 13 nt, Staphylococcus aureus subsp. aureus N315
aacaaaauuaaga

SEQ ID NO: 4062393 - RNA, 23 nt, Staphylococcus aureus subsp. aureus N315
aacaaaauuaagaagaaauacuu

SEQ ID NO: 4062394 - RNA, 14 nt, Staphylococcus aureus subsp. aureus N315
aacaaacauaaaua

SEQ ID NO: 4062395 - RNA, 11 nt, Staphylococcus aureus subsp. aureus N315
aacaaagaagc

SEQ ID NO: 4062396 - RNA, 13 nt, Staphylococcus aureus subsp. aureus N315
aacaaagcuucca

SEQ ID NO: 4062397 - RNA, 23 nt, Staphylococcus aureus subsp. aureus N315
aacaaaguaauccccgaagcaca

SEQ ID NO: 4062398 - RNA, 17 nt, Staphylococcus aureus subsp. aureus N315
aacaaagugcaauuauu

SEQ ID NO: 4062399 - RNA, 15 nt, Staphylococcus aureus subsp. aureus N315
aaccuauuaaaauaa

SEQ ID NO: 4062400 - RNA, 20 nt, Staphylococcus aureus subsp. aureus N315
aaccuauuaaaauaaaccac

SEQ ID NO: 4062401 - RNA, 13 nt, Staphylococcus aureus subsp. aureus N315
aaccuauuaauua

SEQ ID NO: 4062402 - RNA, 22 nt, Staphylococcus aureus subsp. aureus N315
aaccuauuuuuuauaugaugaa

SEQ ID NO: 4062403 - RNA, 21 nt, Staphylococcus aureus subsp. aureus N315
aaccucuaagguuaaauuacu

SEQ ID NO: 4062404 - RNA, 23 nt, Staphylococcus aureus subsp. aureus N315
aaccucugauguguuauguuaga

SEQ ID NO: 4062405 - RNA, 22 nt, Staphylococcus aureus subsp. aureus N315
aaccucuguuuuguugguguuu

SEQ ID NO: 4062406 - RNA, 20 nt, Staphylococcus aureus subsp. aureus N315
aaccuguucuuuauuuaaag

SEQ ID NO: 4062407 - RNA, 17 nt, Staphylococcus aureus subsp. aureus N315
aaccuuacccaaaaaau

SEQ ID NO: 4062408 - RNA, 13 nt, Staphylococcus aureus subsp. aureus N315
aaccuugauuuaa

SEQ ID NO: 4062409 - RNA, 14 nt, Staphylococcus aureus subsp. aureus N315
aaccuuuaaaacau

SEQ ID NO: 4062410 - RNA, 14 nt, Staphylococcus aureus subsp. aureus N315
aaccuuuauuuuca

SEQ ID NO: 4062411 - RNA, 15 nt, Staphylococcus aureus subsp. aureus N315
aaccuuuucaaauua

SEQ ID NO: 4062412 - RNA, 20 nt, Staphylococcus aureus subsp. aureus N315
aaccuuuuuguuuucaauaa

SEQ ID NO: 4062413 - RNA, 17 nt, Staphylococcus aureus subsp. aureus N315
aacgaaauuguuaucua

SEQ ID NO: 4062414 - RNA, 21 nt, Staphylococcus aureus subsp. aureus N315
aacgaagucagucaauucaaa

SEQ ID NO: 4062415 - RNA, 21 nt, Staphylococcus aureus subsp. aureus N315
aacgaaucgccuacuauaaau

SEQ ID NO: 4062416 - RNA, 17 nt, Staphylococcus aureus subsp. aureus N315
aacgaauguuccuuguu

SEQ ID NO: 4062417 - RNA, 15 nt, Staphylococcus aureus subsp. aureus N315
aacgacauuguuuag

SEQ ID NO: 4062418 - RNA, 13 nt, Staphylococcus aureus subsp. aureus N315
aacgagauuacac

SEQ ID NO: 4062419 - RNA, 17 nt, Staphylococcus aureus subsp. aureus N315
aacgagcuggugagaaa

SEQ ID NO: 4062420 - RNA, 22 nt, Staphylococcus aureus subsp. aureus N315
aacgagcuggugagaaauugaa

SEQ ID NO: 4062421 - RNA, 18 nt, Staphylococcus aureus subsp. aureus N315
aacgagucauaaauauaa

SEQ ID NO: 4062422 - RNA, 17 nt, Staphylococcus aureus subsp. aureus N315
aacgauaaauuaacuua

SEQ ID NO: 4062423 - RNA, 21 nt, Staphylococcus aureus subsp. aureus N315
aacgauaacaauuuauuaaaa

SEQ ID NO: 4062424 - RNA, 17 nt, Staphylococcus aureus subsp. aureus N315
aacgauaagauagcuau

SEQ ID NO: 4062425 - RNA, 23 nt, Staphylococcus aureus subsp. aureus N315
aacgauaagauagcuauauuuag

SEQ ID NO: 4062426 - RNA, 15 nt, Staphylococcus aureus subsp. aureus N315
aacgauaccaaauau

SEQ ID NO: 4062427 - RNA, 18 nt, Staphylococcus aureus subsp. aureus N315
aacgauagacauugagau

SEQ ID NO: 4062428 - RNA, 20 nt, Staphylococcus aureus subsp. aureus N315
aacgauaguaguacacgaau

SEQ ID NO: 4062429 - RNA, 17 nt, Staphylococcus aureus subsp. aureus N315
aacgauagugguacuau

SEQ ID NO: 4062430 - RNA, 13 nt, Staphylococcus aureus subsp. aureus N315
aacgauauuuuaa

SEQ ID NO: 4062431 - RNA, 14 nt, Staphylococcus aureus subsp. aureus N315
aacgaugcuacuua

SEQ ID NO: 4062432 - RNA, 19 nt, Staphylococcus aureus subsp. aureus N315
aacgaugcuacuuaaagcu

SEQ ID NO: 4062433 - RNA, 18 nt, Staphylococcus aureus subsp. aureus N315
aacgcacuauuuuuauaa

SEQ ID NO: 4062434 - RNA, 20 nt, Staphylococcus aureus subsp. aureus N315
aacgcauauucuauuguugu

SEQ ID NO: 4062435 - RNA, 18 nt, Staphylococcus aureus subsp. aureus N315
aacgcauugcgaaagaaa

SEQ ID NO: 4062436 - RNA, 16 nt, Staphylococcus aureus subsp. aureus N315
aacgccucaacacuuu

SEQ ID NO: 4062437 - RNA, 18 nt, Staphylococcus aureus subsp. aureus N315
aacgccucaacacuuucu

SEQ ID NO: 4062438 - RNA, 16 nt, Staphylococcus aureus subsp. aureus N315
aacgcuaauuuuacuc

SEQ ID NO: 4062439 - RNA, 14 nt, Staphylococcus aureus subsp. aureus N315
aacggaaauaacca

SEQ ID NO: 4062440 - RNA, 18 nt, Staphylococcus aureus subsp. aureus N315
aacgguaaauaaccacuu

SEQ ID NO: 4062441 - RNA, 15 nt, Staphylococcus aureus subsp. aureus N315
aacgguaauuucuau

SEQ ID NO: 4062442 - RNA, 14 nt, Staphylococcus aureus subsp. aureus N315
aacgguagaauaaa

SEQ ID NO: 4062443 - RNA, 16 nt, Staphylococcus aureus subsp. aureus N315
aacgguagaauaaaag

SEQ ID NO: 4062444 - RNA, 19 nt, Staphylococcus aureus subsp. aureus N315
aacgguaucaacauauuua

SEQ ID NO: 4062445 - RNA, 15 nt, Staphylococcus aureus subsp. aureus N315
aacguacauuuuuau

SEQ ID NO: 4062446 - RNA, 17 nt, Staphylococcus aureus subsp. aureus N315
aacguacauuuuuauga

SEQ ID NO: 4062447 - RNA, 18 nt, Staphylococcus aureus subsp. aureus N315
aacguauauaaguuaaaa

SEQ ID NO: 4062448 - RNA, 15 nt, Staphylococcus aureus subsp. aureus N315
aacguaucauuuaaa

SEQ ID NO: 4062449 - RNA, 15 nt, Staphylococcus aureus subsp. aureus N315
aacgucaacagcaua

SEQ ID NO: 4062450 - RNA, 22 nt, Staphylococcus aureus subsp. aureus N315
aacgucacaugccaucuuugua

SEQ ID NO: 4062451 - RNA, 22 nt, Staphylococcus aureus subsp. aureus N315
aacgucauauguuuuauaauaa

SEQ ID NO: 4062452 - RNA, 20 nt, Staphylococcus aureus subsp. aureus N315
aacguuauucguuaacaauc

SEQ ID NO: 4062453 - RNA, 16 nt, Staphylococcus aureus subsp. aureus N315
aacguuauuuucaaua

SEQ ID NO: 4062454 - RNA, 19 nt, Staphylococcus aureus subsp. aureus N315
aacguucaaucguuucuuc

SEQ ID NO: 4062455 - RNA, 20 nt, Staphylococcus aureus subsp. aureus N315
aacguucaaucguuucuucc

SEQ ID NO: 4062456 - RNA, 17 nt, Staphylococcus aureus subsp. aureus N315
aacguugaguauuacuu

SEQ ID NO: 4062457 - RNA, 23 nt, Staphylococcus aureus subsp. aureus N315
aacuaaaaagcgugguucccaau

SEQ ID NO: 4062458 - RNA, 19 nt, Staphylococcus aureus subsp. aureus N315
aacuaaaacgauaauaaua

SEQ ID NO: 4062459 - RNA, 15 nt, Staphylococcus aureus subsp. aureus N315
aacuaaaccauugaa

SEQ ID NO: 4062460 - RNA, 20 nt, Staphylococcus aureus subsp. aureus N315
aacuaaagguauucuauuuu

SEQ ID NO: 4062461 - RNA, 22 nt, Staphylococcus aureus subsp. aureus N315
aacuaaauacgagcguugguaa

SEQ ID NO: 4062462 - RNA, 14 nt, Staphylococcus aureus subsp. aureus N315
aacuaaauuaaaag

SEQ ID NO: 4062463 - RNA, 18 nt, Staphylococcus aureus subsp. aureus N315
aacuaacacgucacaugg

SEQ ID NO: 4062464 - RNA, 17 nt, Staphylococcus aureus subsp. aureus N315
aacuaacauaauuuuua

SEQ ID NO: 4062465 - RNA, 17 nt, Staphylococcus aureus subsp. aureus N315
aacuaaguuauuuagua

SEQ ID NO: 4062466 - RNA, 16 nt, Staphylococcus aureus subsp. aureus N315
aacuaauaacaaauag

SEQ ID NO: 4062467 - RNA, 14 nt, Staphylococcus aureus subsp. aureus N315
aacuaauaauuugu

SEQ ID NO: 4062468 - RNA, 20 nt, Staphylococcus aureus subsp. aureus N315
aacuaauaauuuguaauucc

SEQ ID NO: 4062469 - RNA, 20 nt, Staphylococcus aureus subsp. aureus N315
aacuaaucguguauuauuga

SEQ ID NO: 4062470 - RNA, 16 nt, Staphylococcus aureus subsp. aureus N315
aacuaauguuaaaaua

SEQ ID NO: 4062471 - RNA, 13 nt, Staphylococcus aureus subsp. aureus N315
aacuaauuuaaag

SEQ ID NO: 4062472 - RNA, 16 nt, Staphylococcus aureus subsp. aureus N315
aacuaauuuaaagcau

SEQ ID NO: 4062473 - RNA, 22 nt, Staphylococcus aureus subsp. aureus N315
aacuacacacguagaaagaugu

SEQ ID NO: 4062474 - RNA, 14 nt, Staphylococcus aureus subsp. aureus N315
aacuacgcauuuua

SEQ ID NO: 4062475 - RNA, 23 nt, Staphylococcus aureus subsp. aureus N315
aacuacgcauuuuaaauaaaaug

SEQ ID NO: 4062476 - RNA, 16 nt, Staphylococcus aureus subsp. aureus N315
aacuacugcaacacca

SEQ ID NO: 4062477 - RNA, 18 nt, Staphylococcus aureus subsp. aureus N315
aacuagaaaacauaaaua

SEQ ID NO: 4062478 - RNA, 15 nt, Staphylococcus aureus subsp. aureus N315
aacuagaaugauuaa

SEQ ID NO: 4062479 - RNA, 22 nt, Staphylococcus aureus subsp. aureus N315
aacuaguguaaugucucuuuuc

SEQ ID NO: 4062480 - RNA, 20 nt, Staphylococcus aureus subsp. aureus N315
aacuauauauaguugaucaa

SEQ ID NO: 4062481 - RNA, 15 nt, Staphylococcus aureus subsp. aureus N315
aacuaucgauacuaa

SEQ ID NO: 4062482 - RNA, 14 nt, Staphylococcus aureus subsp. aureus N315
aacuaucugauuaa

SEQ ID NO: 4062483 - RNA, 17 nt, Staphylococcus aureus subsp. aureus N315
aacuauuaaaaccaaaa

SEQ ID NO: 4062484 - RNA, 17 nt, Staphylococcus aureus subsp. aureus N315
aacuauuaucgaagaaa

SEQ ID NO: 4062485 - RNA, 15 nt, Staphylococcus aureus subsp. aureus N315
aacuauugaaaauag

SEQ ID NO: 4062486 - RNA, 18 nt, Staphylococcus aureus subsp. aureus N315
aacucaaaaagccaacac

SEQ ID NO: 4062487 - RNA, 12 nt, Staphylococcus aureus subsp. aureus N315
aacucaauauga

SEQ ID NO: 4062488 - RNA, 14 nt, Staphylococcus aureus subsp. aureus N315
aacucauaccaaaa

SEQ ID NO: 4062489 - RNA, 22 nt, Staphylococcus aureus subsp. aureus N315
aacucaugcauaagaaauacua

SEQ ID NO: 4062490 - RNA, 13 nt, Staphylococcus aureus subsp. aureus N315
aacucauuuauaa

SEQ ID NO: 4062491 - RNA, 20 nt, Staphylococcus aureus subsp. aureus N315
aacucgcauugccuguagaa

SEQ ID NO: 4062492 - RNA, 23 nt, Staphylococcus aureus subsp. aureus N315
aacucgcgagaccuauaagucuc

SEQ ID NO: 4062493 - RNA, 19 nt, Staphylococcus aureus subsp. aureus N315
aacucguuauagauaagua

SEQ ID NO: 4062494 - RNA, 20 nt, Staphylococcus aureus subsp. aureus N315
aacucguuauagauaaguag

SEQ ID NO: 4062495 - RNA, 22 nt, Staphylococcus aureus subsp. aureus N315
aacucuaaaagccaucuuaccu

SEQ ID NO: 4062496 - RNA, 22 nt, Staphylococcus aureus subsp. aureus N315
aacucuaaauauaauagaaaua

SEQ ID NO: 4062497 - RNA, 15 nt, Staphylococcus aureus subsp. aureus N315
aacucucuaaaaagc

SEQ ID NO: 4062498 - RNA, 18 nt, Staphylococcus aureus subsp. aureus N315
aacucuuuaauuuuacca

SEQ ID NO: 4062499 - RNA, 14 nt, Staphylococcus aureus subsp. aureus N315
aacugaaauuuuuc

SEQ ID NO: 4062500 - RNA, 16 nt, Staphylococcus aureus subsp. aureus N315
aacugaauuaaagcau

SEQ ID NO: 4062501 - RNA, 19 nt, Staphylococcus aureus subsp. aureus N315
aacugacccuugucaguuu

SEQ ID NO: 4062502 - RNA, 23 nt, Staphylococcus aureus subsp. aureus N315
aacugaguucaauuaaauuauau

SEQ ID NO: 4062503 - RNA, 17 nt, Staphylococcus aureus subsp. aureus N315
aacugauaaaaggggaa

SEQ ID NO: 4062504 - RNA, 21 nt, Staphylococcus aureus subsp. aureus N315
aacugaucauuuucauuuaau

SEQ ID NO: 4062505 - RNA, 22 nt, Staphylococcus aureus subsp. aureus N315
aacugauugggcugauaauaaa

SEQ ID NO: 4062506 - RNA, 20 nt, Staphylococcus aureus subsp. aureus N315
aacugcaaagccauguguag

SEQ ID NO: 4062507 - RNA, 14 nt, Staphylococcus aureus subsp. aureus N315
aacuggaacuuaca

SEQ ID NO: 4062508 - RNA, 16 nt, Staphylococcus aureus subsp. aureus N315
aacugguugauaaaua

SEQ ID NO: 4062509 - RNA, 13 nt, Staphylococcus aureus subsp. aureus N315
aacuguaaaacau

SEQ ID NO: 4062510 - RNA, 22 nt, Staphylococcus aureus subsp. aureus N315
aacugucgcucauccucauuaa

SEQ ID NO: 4062511 - RNA, 23 nt, Staphylococcus aureus subsp. aureus N315
aacugugauauuaauugaaaaac

SEQ ID NO: 4062512 - RNA, 13 nt, Staphylococcus aureus subsp. aureus N315
aacugugauucau

SEQ ID NO: 4062513 - RNA, 21 nt, Staphylococcus aureus subsp. aureus N315
aacugugcaugacgauaauga

SEQ ID NO: 4062514 - RNA, 23 nt, Staphylococcus aureus subsp. aureus N315
aacugugcaugacgauaaugaaa

SEQ ID NO: 4062515 - RNA, 22 nt, Staphylococcus aureus subsp. aureus N315
aacuguucuaaccauucguaau

SEQ ID NO: 4062516 - RNA, 22 nt, Staphylococcus aureus subsp. aureus N315
aacuguucuuucgucuuguaaa

SEQ ID NO: 4062517 - RNA, 15 nt, Staphylococcus aureus subsp. aureus N315
aacuguuuaucauga

SEQ ID NO: 4062518 - RNA, 13 nt, Staphylococcus aureus subsp. aureus N315
aacuuaaaaauga

SEQ ID NO: 4062519 - RNA, 13 nt, Staphylococcus aureus subsp. aureus N315
aacuuaaaacuau

SEQ ID NO: 4062520 - RNA, 11 nt, Staphylococcus aureus subsp. aureus N315
aacuuaaauau

SEQ ID NO: 4062521 - RNA, 20 nt, Staphylococcus aureus subsp. aureus N315
aacuuaaugcuucaaaugua

SEQ ID NO: 4062522 - RNA, 18 nt, Staphylococcus aureus subsp. aureus N315
aacuuacauuacauauau

SEQ ID NO: 4062523 - RNA, 14 nt, Staphylococcus aureus subsp. aureus N315
aacuuacuuuugua

SEQ ID NO: 4062524 - RNA, 23 nt, Staphylococcus aureus subsp. aureus N315
aacuuagcuuagucaauguauau

SEQ ID NO: 4062525 - RNA, 20 nt, Staphylococcus aureus subsp. aureus N315
aacuuagguuauuauaaaau

SEQ ID NO: 4062526 - RNA, 20 nt, Staphylococcus aureus subsp. aureus N315
aacuuauauacguugauuaa

SEQ ID NO: 4062527 - RNA, 13 nt, Staphylococcus aureus subsp. aureus N315
aacuuauuauuua

SEQ ID NO: 4062528 - RNA, 18 nt, Staphylococcus aureus subsp. aureus N315
aacuuauucaaacagucc

SEQ ID NO: 4062529 - RNA, 13 nt, Staphylococcus aureus subsp. aureus N315
aacuuauucuuca

SEQ ID NO: 4062530 - RNA, 15 nt, Staphylococcus aureus subsp. aureus N315
aacuuauuugccaua

SEQ ID NO: 4062531 - RNA, 14 nt, Staphylococcus aureus subsp. aureus N315
aacuucauaauaua

SEQ ID NO: 4062532 - RNA, 15 nt, Staphylococcus aureus subsp. aureus N315
aacuuccaacauaua

SEQ ID NO: 4062533 - RNA, 13 nt, Staphylococcus aureus subsp. aureus N315
aacuuccuaaaau

SEQ ID NO: 4062534 - RNA, 20 nt, Staphylococcus aureus subsp. aureus N315
aacuuccuuuuuauuuuuug

SEQ ID NO: 4062535 - RNA, 12 nt, Staphylococcus aureus subsp. aureus N315
aacuucuacagu

SEQ ID NO: 4062536 - RNA, 13 nt, Staphylococcus aureus subsp. aureus N315
aacuucucuuagu

SEQ ID NO: 4062537 - RNA, 22 nt, Staphylococcus aureus subsp. aureus N315
aacuucuucuccguauuuaccu

SEQ ID NO: 4062538 - RNA, 13 nt, Staphylococcus aureus subsp. aureus N315
aacuucuuuucuu

SEQ ID NO: 4062539 - RNA, 21 nt, Staphylococcus aureus subsp. aureus N315
aacuucuuuuguuuuaccauc

SEQ ID NO: 4062540 - RNA, 22 nt, Staphylococcus aureus subsp. aureus N315
aacuucuuuuguuuuaccauca

SEQ ID NO: 4062541 - RNA, 11 nt, Staphylococcus aureus subsp. aureus N315
aacuucuuuuu

SEQ ID NO: 4062542 - RNA, 15 nt, Staphylococcus aureus subsp. aureus N315
aacuucuuuuuugua

SEQ ID NO: 4062543 - RNA, 18 nt, Staphylococcus aureus subsp. aureus N315
aacuugaacuaaaacgau

SEQ ID NO: 4062544 - RNA, 22 nt, Staphylococcus aureus subsp. aureus N315
aacuugagcuauucauagaccu

SEQ ID NO: 4062545 - RNA, 19 nt, Staphylococcus aureus subsp. aureus N315
aacuugaucauuauaaaau

SEQ ID NO: 4062546 - RNA, 20 nt, Staphylococcus aureus subsp. aureus N315
aacuugaucauuauaaaaug

SEQ ID NO: 4062547 - RNA, 21 nt, Staphylococcus aureus subsp. aureus N315
aacuugaucauuauaaaaugg

SEQ ID NO: 4062548 - RNA, 14 nt, Staphylococcus aureus subsp. aureus N315
aacuugauuaugua

SEQ ID NO: 4062549 - RNA, 15 nt, Staphylococcus aureus subsp. aureus N315
aacuugcgauaaguu

SEQ ID NO: 4062550 - RNA, 14 nt, Staphylococcus aureus subsp. aureus N315
aacuuggcaaugaa

SEQ ID NO: 4062551 - RNA, 14 nt, Staphylococcus aureus subsp. aureus N315
aacuuguaaucaua

SEQ ID NO: 4062552 - RNA, 24 nt, Staphylococcus aureus subsp. aureus N315
aacuuguauuguuuguagaaauua

SEQ ID NO: 4062553 - RNA, 19 nt, Staphylococcus aureus subsp. aureus N315
aacuuuaaaaauuaaguaa

SEQ ID NO: 4062554 - RNA, 13 nt, Staphylococcus aureus subsp. aureus N315
aacuuuaauacua

SEQ ID NO: 4062555 - RNA, 15 nt, Staphylococcus aureus subsp. aureus N315
aacuuuaauauaagu

SEQ ID NO: 4062556 - RNA, 20 nt, Staphylococcus aureus subsp. aureus N315
aacuuuaauauaaguauaau

SEQ ID NO: 4062557 - RNA, 20 nt, Staphylococcus aureus subsp. aureus N315
aacuuuaauuaaagcaucuu

SEQ ID NO: 4062558 - RNA, 22 nt, Staphylococcus aureus subsp. aureus N315
aacuuuaauuaaagcaucuuca

SEQ ID NO: 4062559 - RNA, 22 nt, Staphylococcus aureus subsp. aureus N315
aacuuuaauuuuucauuaauac

SEQ ID NO: 4062560 - RNA, 20 nt, Staphylococcus aureus subsp. aureus N315
aacuuuaccaauaucaugca

SEQ ID NO: 4062561 - RNA, 16 nt, Staphylococcus aureus subsp. aureus N315
aacuuuacgauaaaua

SEQ ID NO: 4062562 - RNA, 16 nt, Staphylococcus aureus subsp. aureus N315
aacuuuagacauaaaa

SEQ ID NO: 4062563 - RNA, 17 nt, Staphylococcus aureus subsp. aureus N315
aacuuugugugcuuuau

SEQ ID NO: 4062564 - RNA, 23 nt, Staphylococcus aureus subsp. aureus N315
aacuuuugggaagcgucuuuuuu

SEQ ID NO: 4062565 - RNA, 17 nt, Staphylococcus aureus subsp. aureus N315
aacuuuuuaacugccau

SEQ ID NO: 4062566 - RNA, 15 nt, Staphylococcus aureus subsp. aureus N315
aacuuuuuuaacagc

SEQ ID NO: 4062567 - RNA, 21 nt, Staphylococcus aureus subsp. aureus N315
aagaaaaaccugggacauuaa

SEQ ID NO: 4062568 - RNA, 20 nt, Staphylococcus aureus subsp. aureus N315
aagaaaaagugauaauuaaa

SEQ ID NO: 4062569 - RNA, 24 nt, Staphylococcus aureus subsp. aureus N315
aagaaaaauguguuaaaauauauu

SEQ ID NO: 4062570 - RNA, 20 nt, Staphylococcus aureus subsp. aureus N315
aagaaaaguauaaauauaaa

SEQ ID NO: 4062571 - RNA, 15 nt, Staphylococcus aureus subsp. aureus N315
aagaaaauacuaaca

SEQ ID NO: 4062572 - RNA, 18 nt, Staphylococcus aureus subsp. aureus N315
aagaaaauacuaacaauu

SEQ ID NO: 4062573 - RNA, 15 nt, Staphylococcus aureus subsp. aureus N315
aagauguauaugaau

SEQ ID NO: 4062574 - RNA, 16 nt, Staphylococcus aureus subsp. aureus N315
aagaugucgaaaagua

SEQ ID NO: 4062575 - RNA, 22 nt, Staphylococcus aureus subsp. aureus N315
aagaugugcaucccgaaaguua

SEQ ID NO: 4062576 - RNA, 23 nt, Staphylococcus aureus subsp. aureus N315
aagauguugaguuguaaguuauu

SEQ ID NO: 4062577 - RNA, 22 nt, Staphylococcus aureus subsp. aureus N315
aagauuagaugauauuuaacaa

SEQ ID NO: 4062578 - RNA, 15 nt, Staphylococcus aureus subsp. aureus N315
aagauuaugaaaaca

SEQ ID NO: 4062579 - RNA, 16 nt, Staphylococcus aureus subsp. aureus N315
aagauuaugaaaacau

SEQ ID NO: 4062580 - RNA, 21 nt, Staphylococcus aureus subsp. aureus N315
aagauuaugaaaacauuauua

SEQ ID NO: 4062581 - RNA, 18 nt, Staphylococcus aureus subsp. aureus N315
aagauuauuauuacaaug

SEQ ID NO: 4062582 - RNA, 21 nt, Staphylococcus aureus subsp. aureus N315
aagauuauuugcgauaucagc

SEQ ID NO: 4062583 - RNA, 20 nt, Staphylococcus aureus subsp. aureus N315
aagauuuaagucauuacgua

SEQ ID NO: 4062584 - RNA, 18 nt, Staphylococcus aureus subsp. aureus N315
aagauuuuguuuugaguu

SEQ ID NO: 4062585 - RNA, 14 nt, Staphylococcus aureus subsp. aureus N315
aagcaauacgauug

SEQ ID NO: 4062586 - RNA, 23 nt, Staphylococcus aureus subsp. aureus N315
aagcaauacgauugcaauugcuu

SEQ ID NO: 4062587 - RNA, 13 nt, Staphylococcus aureus subsp. aureus N315
aagcaaucauaau

SEQ ID NO: 4062588 - RNA, 20 nt, Staphylococcus aureus subsp. aureus N315
aagcaauuauggagcggaag

SEQ ID NO: 4062589 - RNA, 23 nt, Staphylococcus aureus subsp. aureus N315
aagcacaauauuuaccacaaaua

SEQ ID NO: 4062590 - RNA, 17 nt, Staphylococcus aureus subsp. aureus N315
aagcacagaaaauuaua

SEQ ID NO: 4062591 - RNA, 19 nt, Staphylococcus aureus subsp. aureus N315
aagcacagaaaauuauacu

SEQ ID NO: 4062592 - RNA, 14 nt, Staphylococcus aureus subsp. aureus N315
aagcaucgaacaau

SEQ ID NO: 4062593 - RNA, 15 nt, Staphylococcus aureus subsp. aureus N315
aagcaucguaaaaaa

SEQ ID NO: 4062594 - RNA, 18 nt, Staphylococcus aureus subsp. aureus N315
aagcaucguaaaaaacaa

SEQ ID NO: 4062595 - RNA, 18 nt, Staphylococcus aureus subsp. aureus N315
aagcaucuucaauauuua

SEQ ID NO: 4062596 - RNA, 21 nt, Staphylococcus aureus subsp. aureus N315
aagcaucuucaauauuuaaau

SEQ ID NO: 4062597 - RNA, 20 nt, Staphylococcus aureus subsp. aureus N315
aagcaugacacucauucaau

SEQ ID NO: 4062598 - RNA, 11 nt, Staphylococcus aureus subsp. aureus N315
aagcauuuguc

SEQ ID NO: 4062599 - RNA, 14 nt, Staphylococcus aureus subsp. aureus N315
aagcauuuuucaau

SEQ ID NO: 4062600 - RNA, 20 nt, Staphylococcus aureus subsp. aureus N315
aagcauuuuucaauuauagu

SEQ ID NO: 4062601 - RNA, 16 nt, Staphylococcus aureus subsp. aureus N315
aagccaacacauaaau

SEQ ID NO: 4062602 - RNA, 13 nt, Staphylococcus aureus subsp. aureus N315
aagccacagcuuu

SEQ ID NO: 4062603 - RNA, 13 nt, Staphylococcus aureus subsp. aureus N315
aagccaucaauau

SEQ ID NO: 4062604 - RNA, 15 nt, Staphylococcus aureus subsp. aureus N315
aagccaucuuucuuu

SEQ ID NO: 4062605 - RNA, 23 nt, Staphylococcus aureus subsp. aureus N315
aagcccaugcccgauaaaaccac

SEQ ID NO: 4062606 - RNA, 14 nt, Staphylococcus aureus subsp. aureus N315
aagccuacuuuguc

SEQ ID NO: 4062607 - RNA, 17 nt, Staphylococcus aureus subsp. aureus N315
aagccugauguaccacu

SEQ ID NO: 4062608 - RNA, 20 nt, Staphylococcus aureus subsp. aureus N315
aagccuucaauaguuucaau

SEQ ID NO: 4062609 - RNA, 14 nt, Staphylococcus aureus subsp. aureus N315
aagccuucuauaua

SEQ ID NO: 4062610 - RNA, 13 nt, Staphylococcus aureus subsp. aureus N315
aagcgauuuccau

SEQ ID NO: 4062611 - RNA, 14 nt, Staphylococcus aureus subsp. aureus N315
aagcgcaauuaaaa

SEQ ID NO: 4062612 - RNA, 23 nt, Staphylococcus aureus subsp. aureus N315
aagcgcaugcuugaacuuuuauu

SEQ ID NO: 4062613 - RNA, 17 nt, Staphylococcus aureus subsp. aureus N315
aagcgcuuggauuuuuu

SEQ ID NO: 4062614 - RNA, 21 nt, Staphylococcus aureus subsp. aureus N315
aagcguucgugauagaaguuu

SEQ ID NO: 4062615 - RNA, 15 nt, Staphylococcus aureus subsp. aureus N315
aagcguucucccuuu

SEQ ID NO: 4062616 - RNA, 20 nt, Staphylococcus aureus subsp. aureus N315
aagcguucucuaauuucaca

SEQ ID NO: 4062617 - RNA, 15 nt, Staphylococcus aureus subsp. aureus N315
aagcuaaagaguuau

SEQ ID NO: 4062618 - RNA, 15 nt, Staphylococcus aureus subsp. aureus N315
aagcuaaauguuaau

SEQ ID NO: 4062619 - RNA, 14 nt, Staphylococcus aureus subsp. aureus N315
aagcuaaguuugaa

SEQ ID NO: 4062620 - RNA, 16 nt, Staphylococcus aureus subsp. aureus N315
aagcuaaguuugaagg

SEQ ID NO: 4062621 - RNA, 13 nt, Staphylococcus aureus subsp. aureus N315
aagcuaaugcaag

SEQ ID NO: 4062622 - RNA, 17 nt, Staphylococcus aureus subsp. aureus N315
aagcuaauucauauuca

SEQ ID NO: 4062623 - RNA, 23 nt, Staphylococcus aureus subsp. aureus N315
aagcuaauucauauucaaauuua

SEQ ID NO: 4062624 - RNA, 14 nt, Staphylococcus aureus subsp. aureus N315
aagcuauaaaaaau

SEQ ID NO: 4062625 - RNA, 16 nt, Staphylococcus aureus subsp. aureus N315
aagcuauauaugaauu

SEQ ID NO: 4062626 - RNA, 18 nt, Staphylococcus aureus subsp. aureus N315
aagcuaucguaaacaaca

SEQ ID NO: 4062627 - RNA, 20 nt, Staphylococcus aureus subsp. aureus N315
aagcucaugaaucagaugau

SEQ ID NO: 4062628 - RNA, 22 nt, Staphylococcus aureus subsp. aureus N315
aagcucaugaaucagaugauuu

SEQ ID NO: 4062629 - RNA, 19 nt, Staphylococcus aureus subsp. aureus N315
aagcugacgaaaagucagc

SEQ ID NO: 4062630 - RNA, 14 nt, Staphylococcus aureus subsp. aureus N315
aagcugauuucuau

SEQ ID NO: 4062631 - RNA, 21 nt, Staphylococcus aureus subsp. aureus N315
aagcugauuucuaucaaauaa

SEQ ID NO: 4062632 - RNA, 23 nt, Staphylococcus aureus subsp. aureus N315
aagcugauuucuaucaaauaaug

SEQ ID NO: 4062633 - RNA, 18 nt, Staphylococcus aureus subsp. aureus N315
aagcugauuuuucauuga

SEQ ID NO: 4062634 - RNA, 17 nt, Staphylococcus aureus subsp. aureus N315
aagcugucuuacugcug

SEQ ID NO: 4062635 - RNA, 23 nt, Staphylococcus aureus subsp. aureus N315
aagcugugcugucauuuucugcu

SEQ ID NO: 4062636 - RNA, 23 nt, Staphylococcus aureus subsp. aureus N315
aagcuguuggugaguguuucaua

SEQ ID NO: 4062637 - RNA, 13 nt, Staphylococcus aureus subsp. aureus N315
aagcuuauuaaau

SEQ ID NO: 4062638 - RNA, 24 nt, Staphylococcus aureus subsp. aureus N315
aagcuucauauuuagguaauacau

SEQ ID NO: 4062639 - RNA, 20 nt, Staphylococcus aureus subsp. aureus N315
aagcuucuguguuggggccc

SEQ ID NO: 4062640 - RNA, 17 nt, Staphylococcus aureus subsp. aureus N315
aagcuuuaguuaaauag

SEQ ID NO: 4062641 - RNA, 19 nt, Staphylococcus aureus subsp. aureus N315
aagcuuuuacgccuucuuu

SEQ ID NO: 4062642 - RNA, 18 nt, Staphylococcus aureus subsp. aureus N315
aagcuuuuucuuucucua

SEQ ID NO: 4062643 - RNA, 21 nt, Staphylococcus aureus subsp. aureus N315
aagcuuuuuugcuuuuauaau

SEQ ID NO: 4062644 - RNA, 23 nt, Staphylococcus aureus subsp. aureus N315
aagcuuuuuugcuuuuauaauaa

SEQ ID NO: 4062645 - RNA, 13 nt, Staphylococcus aureus subsp. aureus N315
aaggaaagcuuca

SEQ ID NO: 4062646 - RNA, 23 nt, Staphylococcus aureus subsp. aureus N315
aaggaauaauuuuaaaaauaaaa

SEQ ID NO: 4062647 - RNA, 20 nt, Staphylococcus aureus subsp. aureus N315
aaggaauagcuacaauuaaa

SEQ ID NO: 4062648 - RNA, 20 nt, Staphylococcus aureus subsp. aureus N315
aaggaaucguaaagcuguug

SEQ ID NO: 4062649 - RNA, 12 nt, Staphylococcus aureus subsp. aureus N315
aaggacaggaau

SEQ ID NO: 4062650 - RNA, 17 nt, Staphylococcus aureus subsp. aureus N315
aaggacaggaauaaauu

SEQ ID NO: 4062651 - RNA, 17 nt, Staphylococcus aureus subsp. aureus N315
aaggauaagaacgagaa

SEQ ID NO: 4062652 - RNA, 14 nt, Staphylococcus aureus subsp. aureus N315
aaggauauugaaaa

SEQ ID NO: 4062653 - RNA, 12 nt, Staphylococcus aureus subsp. aureus N315
aaggaucauguu

SEQ ID NO: 4062654 - RNA, 16 nt, Staphylococcus aureus subsp. aureus N315
aaggaugaguuuaaaa

SEQ ID NO: 4062655 - RNA, 20 nt, Staphylococcus aureus subsp. aureus N315
aaggaugaugugaauguuuu

SEQ ID NO: 4062656 - RNA, 21 nt, Staphylococcus aureus subsp. aureus N315
aaggcaauuuuccguguuuau

SEQ ID NO: 4062657 - RNA, 14 nt, Staphylococcus aureus subsp. aureus N315
aaggccauuuuuau

SEQ ID NO: 4062658 - RNA, 20 nt, Staphylococcus aureus subsp. aureus N315
aaggcuagcuaaaauuugcu

SEQ ID NO: 4062659 - RNA, 14 nt, Staphylococcus aureus subsp. aureus N315
aaggcucauuuguu

SEQ ID NO: 4062660 - RNA, 22 nt, Staphylococcus aureus subsp. aureus N315
aagugaacuauuaaaaccaaaa

SEQ ID NO: 4062661 - RNA, 13 nt, Staphylococcus aureus subsp. aureus N315
aagugacacugua

SEQ ID NO: 4062662 - RNA, 14 nt, Staphylococcus aureus subsp. aureus N315
aagugauaauuaaa

SEQ ID NO: 4062663 - RNA, 19 nt, Staphylococcus aureus subsp. aureus N315
aagugaugaccaauauucu

SEQ ID NO: 4062664 - RNA, 19 nt, Staphylococcus aureus subsp. aureus N315
aagugcagauguugguuca

SEQ ID NO: 4062665 - RNA, 18 nt, Staphylococcus aureus subsp. aureus N315
aagugccguccauuucca

SEQ ID NO: 4062666 - RNA, 21 nt, Staphylococcus aureus subsp. aureus N315
aagugccuugccaugauuuaa

SEQ ID NO: 4062667 - RNA, 17 nt, Staphylococcus aureus subsp. aureus N315
aagugcgguuauuuaua

SEQ ID NO: 4062668 - RNA, 23 nt, Staphylococcus aureus subsp. aureus N315
aagugcgguuuaaucuauauaua

SEQ ID NO: 4062669 - RNA, 23 nt, Staphylococcus aureus subsp. aureus N315
aagugcuaagagguauacaguua

SEQ ID NO: 4062670 - RNA, 15 nt, Staphylococcus aureus subsp. aureus N315
aagugcucaaauuuu

SEQ ID NO: 4062671 - RNA, 20 nt, Staphylococcus aureus subsp. aureus N315
aagugcuguuacuucucccu

SEQ ID NO: 4062672 - RNA, 20 nt, Staphylococcus aureus subsp. aureus N315
aagugcuugguuaaaguuaa

SEQ ID NO: 4062673 - RNA, 13 nt, Staphylococcus aureus subsp. aureus N315
aagugguaaaaau

SEQ ID NO: 4062674 - RNA, 17 nt, Staphylococcus aureus subsp. aureus N315
aagugguaaaaaugaac

SEQ ID NO: 4062675 - RNA, 17 nt, Staphylococcus aureus subsp. aureus N315
aagugguuguucccauu

SEQ ID NO: 4062676 - RNA, 18 nt, Staphylococcus aureus subsp. aureus N315
aaguguaaaugaaaguac

SEQ ID NO: 4062677 - RNA, 19 nt, Staphylococcus aureus subsp. aureus N315
aaguguagccaaauaaauu

SEQ ID NO: 4062678 - RNA, 17 nt, Staphylococcus aureus subsp. aureus N315
aaguguaguaaaaauca

SEQ ID NO: 4062679 - RNA, 15 nt, Staphylococcus aureus subsp. aureus N315
aaguguuaaugucuu

SEQ ID NO: 4062680 - RNA, 14 nt, Staphylococcus aureus subsp. aureus N315
aaguguuauaaaua

SEQ ID NO: 4062681 - RNA, 20 nt, Staphylococcus aureus subsp. aureus N315
aaguguuauaaauagagaac

SEQ ID NO: 4062682 - RNA, 19 nt, Staphylococcus aureus subsp. aureus N315
aaguguugaccauuaucaa

SEQ ID NO: 4062683 - RNA, 22 nt, Staphylococcus aureus subsp. aureus N315
aaguuaaaaccuuuucaaauua

SEQ ID NO: 4062684 - RNA, 23 nt, Staphylococcus aureus subsp. aureus N315
aaguuaaaaccuuuucaaauuau

SEQ ID NO: 4062685 - RNA, 19 nt, Staphylococcus aureus subsp. aureus N315
aaguuaaaauugguuugga

SEQ ID NO: 4062686 - RNA, 18 nt, Staphylococcus aureus subsp. aureus N315
aaguuaacuauaacaaua

SEQ ID NO: 4062687 - RNA, 19 nt, Staphylococcus aureus subsp. aureus N315
aaguuaacuauaacaauag

SEQ ID NO: 4062688 - RNA, 18 nt, Staphylococcus aureus subsp. aureus N315
aaguuaagucgccuaacu

SEQ ID NO: 4062689 - RNA, 15 nt, Staphylococcus aureus subsp. aureus N315
aaguuaaucagaaaa

SEQ ID NO: 4062690 - RNA, 14 nt, Staphylococcus aureus subsp. aureus N315
aaguuaauuaugua

SEQ ID NO: 4062691 - RNA, 15 nt, Staphylococcus aureus subsp. aureus N315
aaguuacaauaucau

SEQ ID NO: 4062692 - RNA, 15 nt, Staphylococcus aureus subsp. aureus N315
aaguuacuuacgcca

SEQ ID NO: 4062693 - RNA, 19 nt, Staphylococcus aureus subsp. aureus N315
aaguuagacuaaaaaacua

SEQ ID NO: 4062694 - RNA, 18 nt, Staphylococcus aureus subsp. aureus N315
aaguuauauaaauuugua

SEQ ID NO: 4062695 - RNA, 18 nt, Staphylococcus aureus subsp. aureus N315
aaguuaucaaauugaccg

SEQ ID NO: 4062696 - RNA, 19 nt, Staphylococcus aureus subsp. aureus N315
aaguuaucugcuuuucuau

SEQ ID NO: 4062697 - RNA, 20 nt, Staphylococcus aureus subsp. aureus N315
aaguuaugaugggaaaaaau

SEQ ID NO: 4062698 - RNA, 18 nt, Staphylococcus aureus subsp. aureus N315
aaguuauuuaguacauag

SEQ ID NO: 4062699 - RNA, 16 nt, Staphylococcus aureus subsp. aureus N315
aaguuauuuauucagc

SEQ ID NO: 4062700 - RNA, 15 nt, Staphylococcus aureus subsp. aureus N315
aaguugaauauaaaa

SEQ ID NO: 4062701 - RNA, 14 nt, Staphylococcus aureus subsp. aureus N315
aaguugcuuagcuu

SEQ ID NO: 4062702 - RNA, 19 nt, Staphylococcus aureus subsp. aureus N315
aaguuggcggggccccaac

SEQ ID NO: 4062703 - RNA, 23 nt, Staphylococcus aureus subsp. aureus N315
aaguuggcggggccccaacacag

SEQ ID NO: 4062704 - RNA, 21 nt, Staphylococcus aureus subsp. aureus N315
aaguuggggaugggccccaac

SEQ ID NO: 4062705 - RNA, 18 nt, Staphylococcus aureus subsp. aureus N315
aaguugguccaaaucgug

SEQ ID NO: 4062706 - RNA, 16 nt, Staphylococcus aureus subsp. aureus N315
aaguuguugaaauuuc

SEQ ID NO: 4062707 - RNA, 19 nt, Staphylococcus aureus subsp. aureus N315
aaguuguugaaauuucugu

SEQ ID NO: 4062708 - RNA, 14 nt, Staphylococcus aureus subsp. aureus N315
aaguuuaaaauacg

SEQ ID NO: 4062709 - RNA, 18 nt, Staphylococcus aureus subsp. aureus N315
aaguuuaagucaguccau

SEQ ID NO: 4062710 - RNA, 18 nt, Staphylococcus aureus subsp. aureus N315
aaguuuaaucguauuagc

SEQ ID NO: 4062711 - RNA, 16 nt, Staphylococcus aureus subsp. aureus N315
aaguuuauacuuaaua

SEQ ID NO: 4062712 - RNA, 19 nt, Staphylococcus aureus subsp. aureus N315
aaguuuaucugaguuauag

SEQ ID NO: 4062713 - RNA, 13 nt, Staphylococcus aureus subsp. aureus N315
aaguuuccuaucu

SEQ ID NO: 4062714 - RNA, 22 nt, Staphylococcus aureus subsp. aureus N315
aaguuucgcugcuacaccaccu

SEQ ID NO: 4062715 - RNA, 16 nt, Staphylococcus aureus subsp. aureus N315
aaguuucggaaaaaga

SEQ ID NO: 4062716 - RNA, 13 nt, Staphylococcus aureus subsp. aureus N315
aaguuugaaucau

SEQ ID NO: 4062717 - RNA, 17 nt, Staphylococcus aureus subsp. aureus N315
aaguuugauagaugaua

SEQ ID NO: 4062718 - RNA, 13 nt, Staphylococcus aureus subsp. aureus N315
aaguuuucauuuu

SEQ ID NO: 4062719 - RNA, 13 nt, Staphylococcus aureus subsp. aureus N315
aaguuuuucaggg

SEQ ID NO: 4062720 - RNA, 23 nt, Staphylococcus aureus subsp. aureus N315
aaguuuuucaggguuuaagauuu

SEQ ID NO: 4062721 - RNA, 13 nt, Staphylococcus aureus subsp. aureus N315
aauaaaaaaugca

SEQ ID NO: 4062722 - RNA, 21 nt, Staphylococcus aureus subsp. aureus N315
aauaaaaaccaauauuucugg

SEQ ID NO: 4062723 - RNA, 16 nt, Staphylococcus aureus subsp. aureus N315
aauaaaaaggagcgac

SEQ ID NO: 4062724 - RNA, 17 nt, Staphylococcus aureus subsp. aureus N315
aauaaaaauacauaauu

SEQ ID NO: 4062725 - RNA, 15 nt, Staphylococcus aureus subsp. aureus N315
aauaaaaauuauaua

SEQ ID NO: 4062726 - RNA, 17 nt, Staphylococcus aureus subsp. aureus N315
aauaaaaauuauauaaa

SEQ ID NO: 4062727 - RNA, 13 nt, Staphylococcus aureus subsp. aureus N315
aauaaaacaaauu

SEQ ID NO: 4062728 - RNA, 21 nt, Staphylococcus aureus subsp. aureus N315
aauaaaacgacucauuauaaa

SEQ ID NO: 4062729 - RNA, 20 nt, Staphylococcus aureus subsp. aureus N315
aauaaaacgcuucauauaaa

SEQ ID NO: 4062730 - RNA, 20 nt, Staphylococcus aureus subsp. aureus N315
aauaaaacgugcaaauaaaa

SEQ ID NO: 4062731 - RNA, 13 nt, Staphylococcus aureus subsp. aureus N315
aauaaaaggcuuu

SEQ ID NO: 4062732 - RNA, 19 nt, Staphylococcus aureus subsp. aureus N315
aauaaaaggcuuuguuaaa

SEQ ID NO: 4062733 - RNA, 15 nt, Staphylococcus aureus subsp. aureus N315
aauaaaauucuauaa

SEQ ID NO: 4062734 - RNA, 22 nt, Staphylococcus aureus subsp. aureus N315
aauaaaauugugccauuugcaa

SEQ ID NO: 4062735 - RNA, 16 nt, Staphylococcus aureus subsp. aureus N315
aauaaacaacuaaagg

SEQ ID NO: 4062736 - RNA, 15 nt, Staphylococcus aureus subsp. aureus N315
aauaaacaacugcaa

SEQ ID NO: 4062737 - RNA, 20 nt, Staphylococcus aureus subsp. aureus N315
aauaaaccacgcacaucuaa

SEQ ID NO: 4062738 - RNA, 12 nt, Staphylococcus aureus subsp. aureus N315
aauaaaccagug

SEQ ID NO: 4062739 - RNA, 22 nt, Staphylococcus aureus subsp. aureus N315
aauaaaccgauuguuucaccag

SEQ ID NO: 4062740 - RNA, 21 nt, Staphylococcus aureus subsp. aureus N315
aauaaagggaguccguuaauu

SEQ ID NO: 4062741 - RNA, 19 nt, Staphylococcus aureus subsp. aureus N315
aauaaauaagcaaucauaa

SEQ ID NO: 4062742 - RNA, 14 nt, Staphylococcus aureus subsp. aureus N315
aauaaauacaauag

SEQ ID NO: 4062743 - RNA, 16 nt, Staphylococcus aureus subsp. aureus N315
aauaaauacaauguua

SEQ ID NO: 4062744 - RNA, 22 nt, Staphylococcus aureus subsp. aureus N315
aauaaauagacugccaauaaaa

SEQ ID NO: 4062745 - RNA, 21 nt, Staphylococcus aureus subsp. aureus N315
aauaaaucauuaguuguauca

SEQ ID NO: 4062746 - RNA, 17 nt, Staphylococcus aureus subsp. aureus N315
aauaaaucuaucuacuc

SEQ ID NO: 4062747 - RNA, 18 nt, Staphylococcus aureus subsp. aureus N315
aauaauucccuaggaaau

SEQ ID NO: 4062748 - RNA, 14 nt, Staphylococcus aureus subsp. aureus N315
aauaauugaugaaa

SEQ ID NO: 4062749 - RNA, 16 nt, Staphylococcus aureus subsp. aureus N315
aauaauugcauguaaa

SEQ ID NO: 4062750 - RNA, 17 nt, Staphylococcus aureus subsp. aureus N315
aauaauugcauguaaaa

SEQ ID NO: 4062751 - RNA, 22 nt, Staphylococcus aureus subsp. aureus N315
aauaauugcauguaaaauuaaa

SEQ ID NO: 4062752 - RNA, 23 nt, Staphylococcus aureus subsp. aureus N315
aauaauugcauguaaaauuaaau

SEQ ID NO: 4062753 - RNA, 13 nt, Staphylococcus aureus subsp. aureus N315
aauaauugcuaaa

SEQ ID NO: 4062754 - RNA, 16 nt, Staphylococcus aureus subsp. aureus N315
aauaauuggaaucauc

SEQ ID NO: 4062755 - RNA, 17 nt, Staphylococcus aureus subsp. aureus N315
aauaauuggaaucaucu

SEQ ID NO: 4062756 - RNA, 18 nt, Staphylococcus aureus subsp. aureus N315
aauaauuggaaucaucuu

SEQ ID NO: 4062757 - RNA, 17 nt, Staphylococcus aureus subsp. aureus N315
aauaauuggcugaugaa

SEQ ID NO: 4062758 - RNA, 18 nt, Staphylococcus aureus subsp. aureus N315
aauaauuuuuuuccuuuc

SEQ ID NO: 4062759 - RNA, 14 nt, Staphylococcus aureus subsp. aureus N315
aauacaaaaauaua

SEQ ID NO: 4062760 - RNA, 14 nt, Staphylococcus aureus subsp. aureus N315
aauacaaaacaaau

SEQ ID NO: 4062761 - RNA, 14 nt, Staphylococcus aureus subsp. aureus N315
aauacaaagaauua

SEQ ID NO: 4062762 - RNA, 22 nt, Staphylococcus aureus subsp. aureus N315
aauacaaagccuuaauaucaug

SEQ ID NO: 4062763 - RNA, 19 nt, Staphylococcus aureus subsp. aureus N315
aauacaagucuuuacucua

SEQ ID NO: 4062764 - RNA, 19 nt, Staphylococcus aureus subsp. aureus N315
aauacaauuucuucauuuu

SEQ ID NO: 4062765 - RNA, 15 nt, Staphylococcus aureus subsp. aureus N315
aauacacuugauaaa

SEQ ID NO: 4062766 - RNA, 23 nt, Staphylococcus aureus subsp. aureus N315
aauacacuugauaaaacuaauga

SEQ ID NO: 4062767 - RNA, 12 nt, Staphylococcus aureus subsp. aureus N315
aauacagaugau

SEQ ID NO: 4062768 - RNA, 15 nt, Staphylococcus aureus subsp. aureus N315
aauacagaugaugcu

SEQ ID NO: 4062769 - RNA, 19 nt, Staphylococcus aureus subsp. aureus N315
aauacagcuagcaagaaua

SEQ ID NO: 4062770 - RNA, 15 nt, Staphylococcus aureus subsp. aureus N315
aauacauaaugguuc

SEQ ID NO: 4062771 - RNA, 16 nt, Staphylococcus aureus subsp. aureus N315
aauacauacugauuaa

SEQ ID NO: 4062772 - RNA, 14 nt, Staphylococcus aureus subsp. aureus N315
aauacaucaucaag

SEQ ID NO: 4062773 - RNA, 16 nt, Staphylococcus aureus subsp. aureus N315
aauacauccauacuuc

SEQ ID NO: 4062774 - RNA, 11 nt, Staphylococcus aureus subsp. aureus N315
aauacaucuaa

SEQ ID NO: 4062775 - RNA, 18 nt, Staphylococcus aureus subsp. aureus N315
aauacaucuaauaaauau

SEQ ID NO: 4062776 - RNA, 19 nt, Staphylococcus aureus subsp. aureus N315
aauacaucuaauaaauaua

SEQ ID NO: 4062777 - RNA, 15 nt, Staphylococcus aureus subsp. aureus N315
aauacaugaguaaaa

SEQ ID NO: 4062778 - RNA, 22 nt, Staphylococcus aureus subsp. aureus N315
aauacaugaguaaaacucaugc

SEQ ID NO: 4062779 - RNA, 16 nt, Staphylococcus aureus subsp. aureus N315
aauacauguauuugaa

SEQ ID NO: 4062780 - RNA, 20 nt, Staphylococcus aureus subsp. aureus N315
aauacaugugggauaucuuc

SEQ ID NO: 4062781 - RNA, 15 nt, Staphylococcus aureus subsp. aureus N315
aauacauuuugcucu

SEQ ID NO: 4062782 - RNA, 23 nt, Staphylococcus aureus subsp. aureus N315
aauaccuaucccuguaaaaccau

SEQ ID NO: 4062783 - RNA, 23 nt, Staphylococcus aureus subsp. aureus N315
aauaccuaugauauaugcugcaa

SEQ ID NO: 4062784 - RNA, 17 nt, Staphylococcus aureus subsp. aureus N315
aauaccuccccaacuua

SEQ ID NO: 4062785 - RNA, 20 nt, Staphylococcus aureus subsp. aureus N315
aauaccucuacauuauauug

SEQ ID NO: 4062786 - RNA, 15 nt, Staphylococcus aureus subsp. aureus N315
aauaccuucaauuga

SEQ ID NO: 4062787 - RNA, 20 nt, Staphylococcus aureus subsp. aureus N315
aauaccuuugccguauuuca

SEQ ID NO: 4062788 - RNA, 23 nt, Staphylococcus aureus subsp. aureus N315
aauaccuuugccguauuucaaau

SEQ ID NO: 4062789 - RNA, 13 nt, Staphylococcus aureus subsp. aureus N315
aauaccuuuuucu

SEQ ID NO: 4062790 - RNA, 20 nt, Staphylococcus aureus subsp. aureus N315
aauaccuuuuucuaaaccaa

SEQ ID NO: 4062791 - RNA, 22 nt, Staphylococcus aureus subsp. aureus N315
aauacgacaccaacauauuuua

SEQ ID NO: 4062792 - RNA, 21 nt, Staphylococcus aureus subsp. aureus N315
aauacgaguguuuuaaucuua

SEQ ID NO: 4062793 - RNA, 21 nt, Staphylococcus aureus subsp. aureus N315
aauacgaugaugauuuauaaa

SEQ ID NO: 4062794 - RNA, 16 nt, Staphylococcus aureus subsp. aureus N315
aauacgcuugauaaaa

SEQ ID NO: 4062795 - RNA, 15 nt, Staphylococcus aureus subsp. aureus N315
aauacgucaucuuua

SEQ ID NO: 4062796 - RNA, 21 nt, Staphylococcus aureus subsp. aureus N315
aauacguguguuuucuuuuca

SEQ ID NO: 4062797 - RNA, 16 nt, Staphylococcus aureus subsp. aureus N315
aauacguuuaauguau

SEQ ID NO: 4062798 - RNA, 21 nt, Staphylococcus aureus subsp. aureus N315
aauacuaagauuagcuaugaa

SEQ ID NO: 4062799 - RNA, 21 nt, Staphylococcus aureus subsp. aureus N315
aauacuacacuccccuuauca

SEQ ID NO: 4062800 - RNA, 22 nt, Staphylococcus aureus subsp. aureus N315
aauacuacacuccccuuaucaa

SEQ ID NO: 4062801 - RNA, 14 nt, Staphylococcus aureus subsp. aureus N315
aauacuacauauaa

SEQ ID NO: 4062802 - RNA, 22 nt, Staphylococcus aureus subsp. aureus N315
aauacuaccguuuuuauauacu

SEQ ID NO: 4062803 - RNA, 14 nt, Staphylococcus aureus subsp. aureus N315
aauacuauacugau

SEQ ID NO: 4062804 - RNA, 19 nt, Staphylococcus aureus subsp. aureus N315
aauacuauacugaugaaaa

SEQ ID NO: 4062805 - RNA, 14 nt, Staphylococcus aureus subsp. aureus N315
aauacuauauauaa

SEQ ID NO: 4062806 - RNA, 14 nt, Staphylococcus aureus subsp. aureus N315
aauacuauaugaaa

SEQ ID NO: 4062807 - RNA, 19 nt, Staphylococcus aureus subsp. aureus N315
aauacuauaugaaaagaga

SEQ ID NO: 4062808 - RNA, 21 nt, Staphylococcus aureus subsp. aureus N315
aauacucaacacgauagucau

SEQ ID NO: 4062809 - RNA, 15 nt, Staphylococcus aureus subsp. aureus N315
aauacucaguuuauu

SEQ ID NO: 4062810 - RNA, 17 nt, Staphylococcus aureus subsp. aureus N315
aauacucuucaaucuac

SEQ ID NO: 4062811 - RNA, 17 nt, Staphylococcus aureus subsp. aureus N315
aauacuguauuuuaacg

SEQ ID NO: 4062812 - RNA, 16 nt, Staphylococcus aureus subsp. aureus N315
aauacuucauauccuu

SEQ ID NO: 4062813 - RNA, 20 nt, Staphylococcus aureus subsp. aureus N315
aauacuugaaagauuuguag

SEQ ID NO: 4062814 - RNA, 16 nt, Staphylococcus aureus subsp. aureus N315
aauacuuuauuugaua

SEQ ID NO: 4062815 - RNA, 22 nt, Staphylococcus aureus subsp. aureus N315
aauacuuucaaacaaaucuuuu

SEQ ID NO: 4062816 - RNA, 19 nt, Staphylococcus aureus subsp. aureus N315
aauacuuuuuauauaauuc

SEQ ID NO: 4062817 - RNA, 12 nt, Staphylococcus aureus subsp. aureus N315
aauacuuuuuga

SEQ ID NO: 4062818 - RNA, 17 nt, Staphylococcus aureus subsp. aureus N315
aauagaaaaauuucaaa

SEQ ID NO: 4062819 - RNA, 22 nt, Staphylococcus aureus subsp. aureus N315
aauagaaagcgcauuugucauc

SEQ ID NO: 4062820 - RNA, 14 nt, Staphylococcus aureus subsp. aureus N315
aauagaaauaauca

SEQ ID NO: 4062821 - RNA, 21 nt, Staphylococcus aureus subsp. aureus N315
aauagaacgaaauaguucaaa

SEQ ID NO: 4062822 - RNA, 19 nt, Staphylococcus aureus subsp. aureus N315
aauagaagguuauuuuuua

SEQ ID NO: 4062823 - RNA, 22 nt, Staphylococcus aureus subsp. aureus N315
aauagaagguuauuuuuuaugg

SEQ ID NO: 4062824 - RNA, 20 nt, Staphylococcus aureus subsp. aureus N315
aauagacugccaauaaaaug

SEQ ID NO: 4062825 - RNA, 22 nt, Staphylococcus aureus subsp. aureus N315
aauagacugccaauaaaaugca

SEQ ID NO: 4062826 - RNA, 16 nt, Staphylococcus aureus subsp. aureus N315
aauagagaaagaauaa

SEQ ID NO: 4062827 - RNA, 15 nt, Staphylococcus aureus subsp. aureus N315
aauagauaauauaua

SEQ ID NO: 4062828 - RNA, 17 nt, Staphylococcus aureus subsp. aureus N315
aauagauaaugcaccug

SEQ ID NO: 4062829 - RNA, 13 nt, Staphylococcus aureus subsp. aureus N315
aauagaugagaaa

SEQ ID NO: 4062830 - RNA, 19 nt, Staphylococcus aureus subsp. aureus N315
aauagaugagaaaguaaaa

SEQ ID NO: 4062831 - RNA, 16 nt, Staphylococcus aureus subsp. aureus N315
aauagauugaaaaaau

SEQ ID NO: 4062832 - RNA, 15 nt, Staphylococcus aureus subsp. aureus N315
aauagcaguuucuga

SEQ ID NO: 4062833 - RNA, 20 nt, Staphylococcus aureus subsp. aureus N315
aauagcauuuguaaacagua

SEQ ID NO: 4062834 - RNA, 18 nt, Staphylococcus aureus subsp. aureus N315
aauaugauaacucguaau

SEQ ID NO: 4062835 - RNA, 14 nt, Staphylococcus aureus subsp. aureus N315
aauaugauauuaag

SEQ ID NO: 4062836 - RNA, 14 nt, Staphylococcus aureus subsp. aureus N315
aauaugauguuaaa

SEQ ID NO: 4062837 - RNA, 17 nt, Staphylococcus aureus subsp. aureus N315
aauaugauguuaaaaaa

SEQ ID NO: 4062838 - RNA, 23 nt, Staphylococcus aureus subsp. aureus N315
aauaugauguuaaaaaauaugua

SEQ ID NO: 4062839 - RNA, 19 nt, Staphylococcus aureus subsp. aureus N315
aauaugauugaaugaagcu

SEQ ID NO: 4062840 - RNA, 18 nt, Staphylococcus aureus subsp. aureus N315
aauaugauugcaaauuau

SEQ ID NO: 4062841 - RNA, 17 nt, Staphylococcus aureus subsp. aureus N315
aauaugcuuuuaauagu

SEQ ID NO: 4062842 - RNA, 18 nt, Staphylococcus aureus subsp. aureus N315
aauauggaauuucauaua

SEQ ID NO: 4062843 - RNA, 17 nt, Staphylococcus aureus subsp. aureus N315
aauauguaaucagguuu

SEQ ID NO: 4062844 - RNA, 17 nt, Staphylococcus aureus subsp. aureus N315
aauaugugcaugagacu

SEQ ID NO: 4062845 - RNA, 23 nt, Staphylococcus aureus subsp. aureus N315
aauauguggcgcucuuauaaaga

SEQ ID NO: 4062846 - RNA, 11 nt, Staphylococcus aureus subsp. aureus N315
aauauuaaaau

SEQ ID NO: 4062847 - RNA, 12 nt, Staphylococcus aureus subsp. aureus N315
aauauuaaaauc

SEQ ID NO: 4062848 - RNA, 21 nt, Staphylococcus aureus subsp. aureus N315
aauauuaaauucaucuugcaa

SEQ ID NO: 4062849 - RNA, 21 nt, Staphylococcus aureus subsp. aureus N315
aauauuaaauuucugaacaua

SEQ ID NO: 4062850 - RNA, 15 nt, Staphylococcus aureus subsp. aureus N315
aauauuaagauguau

SEQ ID NO: 4062851 - RNA, 22 nt, Staphylococcus aureus subsp. aureus N315
aauauuaagauguauaugaauu

SEQ ID NO: 4062852 - RNA, 12 nt, Staphylococcus aureus subsp. aureus N315
aauauuauaagu

SEQ ID NO: 4062853 - RNA, 20 nt, Staphylococcus aureus subsp. aureus N315
aauauuauaaguugcauaua

SEQ ID NO: 4062854 - RNA, 18 nt, Staphylococcus aureus subsp. aureus N315
aauauuauuaaaucaaag

SEQ ID NO: 4062855 - RNA, 21 nt, Staphylococcus aureus subsp. aureus N315
aauauuauuuuuaagugauga

SEQ ID NO: 4062856 - RNA, 22 nt, Staphylococcus aureus subsp. aureus N315
aauauucguagcaugacauuaa

SEQ ID NO: 4062857 - RNA, 13 nt, Staphylococcus aureus subsp. aureus N315
aauauucuuauca

SEQ ID NO: 4062858 - RNA, 13 nt, Staphylococcus aureus subsp. aureus N315
aauauugaacaau

SEQ ID NO: 4062859 - RNA, 12 nt, Staphylococcus aureus subsp. aureus N315
aauauugaauaa

SEQ ID NO: 4062860 - RNA, 15 nt, Staphylococcus aureus subsp. aureus N315
aauauugaugaauaa

SEQ ID NO: 4062861 - RNA, 19 nt, Staphylococcus aureus subsp. aureus N315
aauauugaugaauaaauag

SEQ ID NO: 4062862 - RNA, 20 nt, Staphylococcus aureus subsp. aureus N315
aauauugauucuagugaaau

SEQ ID NO: 4062863 - RNA, 16 nt, Staphylococcus aureus subsp. aureus N315
aauauugcguuuaauu

SEQ ID NO: 4062864 - RNA, 19 nt, Staphylococcus aureus subsp. aureus N315
aauauuggaauacucuuca

SEQ ID NO: 4062865 - RNA, 16 nt, Staphylococcus aureus subsp. aureus N315
aauauuggacuuugcu

SEQ ID NO: 4062866 - RNA, 17 nt, Staphylococcus aureus subsp. aureus N315
aauauuuaaaauauuau

SEQ ID NO: 4062867 - RNA, 17 nt, Staphylococcus aureus subsp. aureus N315
aauauuuaaacuaguaa

SEQ ID NO: 4062868 - RNA, 16 nt, Staphylococcus aureus subsp. aureus N315
aauauuuaaauuuuaa

SEQ ID NO: 4062869 - RNA, 21 nt, Staphylococcus aureus subsp. aureus N315
aauauuuacauugccacuuuu

SEQ ID NO: 4062870 - RNA, 18 nt, Staphylococcus aureus subsp. aureus N315
aauauuuaccacaaauau

SEQ ID NO: 4062871 - RNA, 15 nt, Staphylococcus aureus subsp. aureus N315
aauauuuauauuaaa

SEQ ID NO: 4062872 - RNA, 23 nt, Staphylococcus aureus subsp. aureus N315
aauauuuaucaauaaaucaguag

SEQ ID NO: 4062873 - RNA, 19 nt, Staphylococcus aureus subsp. aureus N315
aauauuuauuguuuuuaaa

SEQ ID NO: 4062874 - RNA, 21 nt, Staphylococcus aureus subsp. aureus N315
aauauuuauuguuuuuaaaau

SEQ ID NO: 4062875 - RNA, 15 nt, Staphylococcus aureus subsp. aureus N315
aauauuucuuaccau

SEQ ID NO: 4062876 - RNA, 20 nt, Staphylococcus aureus subsp. aureus N315
aauauuuggaaguuuucaga

SEQ ID NO: 4062877 - RNA, 13 nt, Staphylococcus aureus subsp. aureus N315
aauauuuuaucug

SEQ ID NO: 4062878 - RNA, 19 nt, Staphylococcus aureus subsp. aureus N315
aauauuuuucaauuaaaug

SEQ ID NO: 4062879 - RNA, 23 nt, Staphylococcus aureus subsp. aureus N315
aauauuuuucaauuaaauguuua

SEQ ID NO: 4062880 - RNA, 16 nt, Staphylococcus aureus subsp. aureus N315
aauauuuuuuaaaaug

SEQ ID NO: 4062881 - RNA, 16 nt, Staphylococcus aureus subsp. aureus N315
aaucaaaauuaugacu

SEQ ID NO: 4062882 - RNA, 12 nt, Staphylococcus aureus subsp. aureus N315
aaucaaagagga

SEQ ID NO: 4062883 - RNA, 21 nt, Staphylococcus aureus subsp. aureus N315
aaucaaagaggcacagcggaa

SEQ ID NO: 4062884 - RNA, 20 nt, Staphylococcus aureus subsp. aureus N315
aaucaaagaggcuuuaaaau

SEQ ID NO: 4062885 - RNA, 17 nt, Staphylococcus aureus subsp. aureus N315
aaucaaagcuauauaug

SEQ ID NO: 4062886 - RNA, 17 nt, Staphylococcus aureus subsp. aureus N315
aaucaaauacaucaauu

SEQ ID NO: 4062887 - RNA, 16 nt, Staphylococcus aureus subsp. aureus N315
aaucaacaauuuaaac

SEQ ID NO: 4062888 - RNA, 14 nt, Staphylococcus aureus subsp. aureus N315
aaucaacccaucau

SEQ ID NO: 4062889 - RNA, 15 nt, Staphylococcus aureus subsp. aureus N315
aaucaagaaauguua

SEQ ID NO: 4062890 - RNA, 21 nt, Staphylococcus aureus subsp. aureus N315
aaucaagacucccuuuuuaaa

SEQ ID NO: 4062891 - RNA, 13 nt, Staphylococcus aureus subsp. aureus N315
aaucaagcaaugc

SEQ ID NO: 4062892 - RNA, 16 nt, Staphylococcus aureus subsp. aureus N315
aaucaagcuagcauca

SEQ ID NO: 4062893 - RNA, 13 nt, Staphylococcus aureus subsp. aureus N315
aaucacaaauuca

SEQ ID NO: 4062894 - RNA, 14 nt, Staphylococcus aureus subsp. aureus N315
aaucacaauacgaa

SEQ ID NO: 4062895 - RNA, 13 nt, Staphylococcus aureus subsp. aureus N315
aaucacaauauaa

SEQ ID NO: 4062896 - RNA, 18 nt, Staphylococcus aureus subsp. aureus N315
aaucacaggaaaaucgua

SEQ ID NO: 4062897 - RNA, 14 nt, Staphylococcus aureus subsp. aureus N315
aaucacaguuauau

SEQ ID NO: 4062898 - RNA, 15 nt, Staphylococcus aureus subsp. aureus N315
aaucacaguuauaua

SEQ ID NO: 4062899 - RNA, 19 nt, Staphylococcus aureus subsp. aureus N315
aaucaccuuauugaugaaa

SEQ ID NO: 4062900 - RNA, 20 nt, Staphylococcus aureus subsp. aureus N315
aaucaccuuauugaugaaaa

SEQ ID NO: 4062901 - RNA, 17 nt, Staphylococcus aureus subsp. aureus N315
aaucacgauuuucaagu

SEQ ID NO: 4062902 - RNA, 19 nt, Staphylococcus aureus subsp. aureus N315
aaucacgauuuucaaguaa

SEQ ID NO: 4062903 - RNA, 15 nt, Staphylococcus aureus subsp. aureus N315
aaucacgcuaacauu

SEQ ID NO: 4062904 - RNA, 20 nt, Staphylococcus aureus subsp. aureus N315
aaucacuaucuguuguuaua

SEQ ID NO: 4062905 - RNA, 22 nt, Staphylococcus aureus subsp. aureus N315
aaucacuccucuauuuuaugau

SEQ ID NO: 4062906 - RNA, 16 nt, Staphylococcus aureus subsp. aureus N315
aaucagaugauuuaau

SEQ ID NO: 4062907 - RNA, 16 nt, Staphylococcus aureus subsp. aureus N315
aaucagcuauaaaagu

SEQ ID NO: 4062908 - RNA, 24 nt, Staphylococcus aureus subsp. aureus N315
aaucagcuuuuucacauugccuaa

SEQ ID NO: 4062909 - RNA, 14 nt, Staphylococcus aureus subsp. aureus N315
aaucaguaauaaug

SEQ ID NO: 4062910 - RNA, 15 nt, Staphylococcus aureus subsp. aureus N315
aaucaguauuuacuu

SEQ ID NO: 4062911 - RNA, 21 nt, Staphylococcus aureus subsp. aureus N315
aaucaguuucaucaaguauaa

SEQ ID NO: 4062912 - RNA, 17 nt, Staphylococcus aureus subsp. aureus N315
aaucaguuuuuaaauca

SEQ ID NO: 4062913 - RNA, 15 nt, Staphylococcus aureus subsp. aureus N315
aaucauaauaagauu

SEQ ID NO: 4062914 - RNA, 14 nt, Staphylococcus aureus subsp. aureus N315
aaucauaaugaaua

SEQ ID NO: 4062915 - RNA, 20 nt, Staphylococcus aureus subsp. aureus N315
aaucauaaugaauaauuaaa

SEQ ID NO: 4062916 - RNA, 18 nt, Staphylococcus aureus subsp. aureus N315
aaucauaccggcaaauaa

SEQ ID NO: 4062917 - RNA, 12 nt, Staphylococcus aureus subsp. aureus N315
aaucauagauau

SEQ ID NO: 4062918 - RNA, 22 nt, Staphylococcus aureus subsp. aureus N315
aaucauagauauaagaaaucca

SEQ ID NO: 4062919 - RNA, 16 nt, Staphylococcus aureus subsp. aureus N315
aaucauagcaacaucg

SEQ ID NO: 4062920 - RNA, 16 nt, Staphylococcus aureus subsp. aureus N315
aaucauauauuucuau

SEQ ID NO: 4062921 - RNA, 14 nt, Staphylococcus aureus subsp. aureus N315
aaucaucacacaua

SEQ ID NO: 4062922 - RNA, 13 nt, Staphylococcus aureus subsp. aureus N315
aaucuuacugcuu

SEQ ID NO: 4062923 - RNA, 21 nt, Staphylococcus aureus subsp. aureus N315
aaucuuaugaugucauguauu

SEQ ID NO: 4062924 - RNA, 13 nt, Staphylococcus aureus subsp. aureus N315
aaucuuauuuugu

SEQ ID NO: 4062925 - RNA, 12 nt, Staphylococcus aureus subsp. aureus N315
aaucuucaucau

SEQ ID NO: 4062926 - RNA, 17 nt, Staphylococcus aureus subsp. aureus N315
aaucuucuaauuaagaa

SEQ ID NO: 4062927 - RNA, 18 nt, Staphylococcus aureus subsp. aureus N315
aaucuucuaauuaagaau

SEQ ID NO: 4062928 - RNA, 20 nt, Staphylococcus aureus subsp. aureus N315
aaucuucuccaaucaucauu

SEQ ID NO: 4062929 - RNA, 23 nt, Staphylococcus aureus subsp. aureus N315
aaucuucuccaaucaucauuaaa

SEQ ID NO: 4062930 - RNA, 16 nt, Staphylococcus aureus subsp. aureus N315
aaucuugauuauauuu

SEQ ID NO: 4062931 - RNA, 19 nt, Staphylococcus aureus subsp. aureus N315
aaucuuguugaacucugau

SEQ ID NO: 4062932 - RNA, 22 nt, Staphylococcus aureus subsp. aureus N315
aaucuuguuggauuuuaacaag

SEQ ID NO: 4062933 - RNA, 19 nt, Staphylococcus aureus subsp. aureus N315
aaucuuguuuucauuuaaa

SEQ ID NO: 4062934 - RNA, 21 nt, Staphylococcus aureus subsp. aureus N315
aaucuuuacuuguaauuaaua

SEQ ID NO: 4062935 - RNA, 15 nt, Staphylococcus aureus subsp. aureus N315
aaucuuuaucaguuu

SEQ ID NO: 4062936 - RNA, 15 nt, Staphylococcus aureus subsp. aureus N315
aaucuuuuagcuuuu

SEQ ID NO: 4062937 - RNA, 19 nt, Staphylococcus aureus subsp. aureus N315
aaucuuuuagcuuuuguaa

SEQ ID NO: 4062938 - RNA, 14 nt, Staphylococcus aureus subsp. aureus N315
aaugaaaaaacgag

SEQ ID NO: 4062939 - RNA, 14 nt, Staphylococcus aureus subsp. aureus N315
aaugaagaauacaa

SEQ ID NO: 4062940 - RNA, 15 nt, Staphylococcus aureus subsp. aureus N315
aaugaagaauacaaa

SEQ ID NO: 4062941 - RNA, 19 nt, Staphylococcus aureus subsp. aureus N315
aaugaagaauacaaauauu

SEQ ID NO: 4062942 - RNA, 22 nt, Staphylococcus aureus subsp. aureus N315
aaugaauaaucaaaguucguaa

SEQ ID NO: 4062943 - RNA, 16 nt, Staphylococcus aureus subsp. aureus N315
aaugaauaauuaaaaa

SEQ ID NO: 4062944 - RNA, 16 nt, Staphylococcus aureus subsp. aureus N315
aaugaaucaauugcau

SEQ ID NO: 4062945 - RNA, 15 nt, Staphylococcus aureus subsp. aureus N315
aaugaauuauuuaaa

SEQ ID NO: 4062946 - RNA, 14 nt, Staphylococcus aureus subsp. aureus N315
aaugacgagaauua

SEQ ID NO: 4062947 - RNA, 20 nt, Staphylococcus aureus subsp. aureus N315
aaugacgugcuuuuaaaugu

SEQ ID NO: 4062948 - RNA, 21 nt, Staphylococcus aureus subsp. aureus N315
aaugacgugcuuuuaaaugua

SEQ ID NO: 4062949 - RNA, 13 nt, Staphylococcus aureus subsp. aureus N315
aaugacuaaaucg

SEQ ID NO: 4062950 - RNA, 18 nt, Staphylococcus aureus subsp. aureus N315
aaugacuaaaucgacaua

SEQ ID NO: 4062951 - RNA, 17 nt, Staphylococcus aureus subsp. aureus N315
aaugacuauaacaccaa

SEQ ID NO: 4062952 - RNA, 23 nt, Staphylococcus aureus subsp. aureus N315
aaugacuauaacaccaauuaaau

SEQ ID NO: 4062953 - RNA, 21 nt, Staphylococcus aureus subsp. aureus N315
aaugacugaauuaauauccaa

SEQ ID NO: 4062954 - RNA, 20 nt, Staphylococcus aureus subsp. aureus N315
aaugacuguugguuugauca

SEQ ID NO: 4062955 - RNA, 21 nt, Staphylococcus aureus subsp. aureus N315
aaugacuguugguuugaucau

SEQ ID NO: 4062956 - RNA, 20 nt, Staphylococcus aureus subsp. aureus N315
aaugacuucacauuuauccu

SEQ ID NO: 4062957 - RNA, 19 nt, Staphylococcus aureus subsp. aureus N315
aaugacuucuuuauauuua

SEQ ID NO: 4062958 - RNA, 23 nt, Staphylococcus aureus subsp. aureus N315
aaugagaaugugcuuguaacaag

SEQ ID NO: 4062959 - RNA, 20 nt, Staphylococcus aureus subsp. aureus N315
aaugagcccguuaaaaagac

SEQ ID NO: 4062960 - RNA, 17 nt, Staphylococcus aureus subsp. aureus N315
aaugaguaugacgaaau

SEQ ID NO: 4062961 - RNA, 18 nt, Staphylococcus aureus subsp. aureus N315
aaugagugcuuauuuguu

SEQ ID NO: 4062962 - RNA, 16 nt, Staphylococcus aureus subsp. aureus N315
aaugauaauccaccaa

SEQ ID NO: 4062963 - RNA, 17 nt, Staphylococcus aureus subsp. aureus N315
aaugauaccuuuaaauc

SEQ ID NO: 4062964 - RNA, 15 nt, Staphylococcus aureus subsp. aureus N315
aaugauagugaauaa

SEQ ID NO: 4062965 - RNA, 23 nt, Staphylococcus aureus subsp. aureus N315
aaugauauacuugaagaaaagua

SEQ ID NO: 4062966 - RNA, 12 nt, Staphylococcus aureus subsp. aureus N315
aaugauaucuuu

SEQ ID NO: 4062967 - RNA, 17 nt, Staphylococcus aureus subsp. aureus N315
aaugauaucuuuuccaa

SEQ ID NO: 4062968 - RNA, 20 nt, Staphylococcus aureus subsp. aureus N315
aaugaucaucguauagaugu

SEQ ID NO: 4062969 - RNA, 18 nt, Staphylococcus aureus subsp. aureus N315
aaugaucaucuauauuua

SEQ ID NO: 4062970 - RNA, 14 nt, Staphylococcus aureus subsp. aureus N315
aaugaugacaucaa

SEQ ID NO: 4062971 - RNA, 17 nt, Staphylococcus aureus subsp. aureus N315
aaugauggguaguuaau

SEQ ID NO: 4062972 - RNA, 17 nt, Staphylococcus aureus subsp. aureus N315
aaugauggguauuuugu

SEQ ID NO: 4062973 - RNA, 19 nt, Staphylococcus aureus subsp. aureus N315
aaugauggguauuuuguuc

SEQ ID NO: 4062974 - RNA, 12 nt, Staphylococcus aureus subsp. aureus N315
aaugauuauaaa

SEQ ID NO: 4062975 - RNA, 14 nt, Staphylococcus aureus subsp. aureus N315
aaugauuauaaaua

SEQ ID NO: 4062976 - RNA, 17 nt, Staphylococcus aureus subsp. aureus N315
aaugauuauaaauacau

SEQ ID NO: 4062977 - RNA, 21 nt, Staphylococcus aureus subsp. aureus N315
aaugauucuuaucuuuaauca

SEQ ID NO: 4062978 - RNA, 23 nt, Staphylococcus aureus subsp. aureus N315
aaugauucuuaucuuuaaucaaa

SEQ ID NO: 4062979 - RNA, 18 nt, Staphylococcus aureus subsp. aureus N315
aaugauugacgauuuaau

SEQ ID NO: 4062980 - RNA, 22 nt, Staphylococcus aureus subsp. aureus N315
aaugauugacgauuuaauuaaa

SEQ ID NO: 4062981 - RNA, 15 nt, Staphylococcus aureus subsp. aureus N315
aaugauugcauugau

SEQ ID NO: 4062982 - RNA, 22 nt, Staphylococcus aureus subsp. aureus N315
aaugauugucuuauaagauaua

SEQ ID NO: 4062983 - RNA, 16 nt, Staphylococcus aureus subsp. aureus N315
aaugauuguuuuaagu

SEQ ID NO: 4062984 - RNA, 23 nt, Staphylococcus aureus subsp. aureus N315
aaugauuuaauaaaaaccaauau

SEQ ID NO: 4062985 - RNA, 16 nt, Staphylococcus aureus subsp. aureus N315
aaugauuuauucuaaa

SEQ ID NO: 4062986 - RNA, 19 nt, Staphylococcus aureus subsp. aureus N315
aaugauuuuauaauauuau

SEQ ID NO: 4062987 - RNA, 22 nt, Staphylococcus aureus subsp. aureus N315
aaugauuuuuauuauugucauc

SEQ ID NO: 4062988 - RNA, 16 nt, Staphylococcus aureus subsp. aureus N315
aaugcaacuaaaacua

SEQ ID NO: 4062989 - RNA, 19 nt, Staphylococcus aureus subsp. aureus N315
aaugcagauucuucaccaa

SEQ ID NO: 4062990 - RNA, 13 nt, Staphylococcus aureus subsp. aureus N315
aaugcauagcucu

SEQ ID NO: 4062991 - RNA, 19 nt, Staphylococcus aureus subsp. aureus N315
aaugcauagcucuucuuuu

SEQ ID NO: 4062992 - RNA, 19 nt, Staphylococcus aureus subsp. aureus N315
aaugcaugcuucucaauuu

SEQ ID NO: 4062993 - RNA, 17 nt, Staphylococcus aureus subsp. aureus N315
aaugcauuacuacuuua

SEQ ID NO: 4062994 - RNA, 16 nt, Staphylococcus aureus subsp. aureus N315
aaugccaaauauagua

SEQ ID NO: 4062995 - RNA, 16 nt, Staphylococcus aureus subsp. aureus N315
aaugccggucauaaca

SEQ ID NO: 4062996 - RNA, 15 nt, Staphylococcus aureus subsp. aureus N315
aaugccuaauuuugu

SEQ ID NO: 4062997 - RNA, 20 nt, Staphylococcus aureus subsp. aureus N315
aaugccugcccuuuagucau

SEQ ID NO: 4062998 - RNA, 18 nt, Staphylococcus aureus subsp. aureus N315
aaugcgaagauuuuuaac

SEQ ID NO: 4062999 - RNA, 16 nt, Staphylococcus aureus subsp. aureus N315
aaugcuaauuuaacug

SEQ ID NO: 4063000 - RNA, 15 nt, Staphylococcus aureus subsp. aureus N315
aaugcuacuauuaaa

SEQ ID NO: 4063001 - RNA, 14 nt, Staphylococcus aureus subsp. aureus N315
aaugcuauauuuag

SEQ ID NO: 4063002 - RNA, 14 nt, Staphylococcus aureus subsp. aureus N315
aaugcuauauuucg

SEQ ID NO: 4063003 - RNA, 13 nt, Staphylococcus aureus subsp. aureus N315
aaugcuaucaugc

SEQ ID NO: 4063004 - RNA, 15 nt, Staphylococcus aureus subsp. aureus N315
aaugcucuauauauc

SEQ ID NO: 4063005 - RNA, 20 nt, Staphylococcus aureus subsp. aureus N315
aaugcucuauauauccauuc

SEQ ID NO: 4063006 - RNA, 15 nt, Staphylococcus aureus subsp. aureus N315
aaugcuguuuuaugg

SEQ ID NO: 4063007 - RNA, 13 nt, Staphylococcus aureus subsp. aureus N315
aaugcuuauauaa

SEQ ID NO: 4063008 - RNA, 18 nt, Staphylococcus aureus subsp. aureus N315
aaugcuugaauuuuauua

SEQ ID NO: 4063009 - RNA, 18 nt, Staphylococcus aureus subsp. aureus N315
aauuaaauuauauguuuu

SEQ ID NO: 4063010 - RNA, 14 nt, Staphylococcus aureus subsp. aureus N315
aauuaaauucaaau

SEQ ID NO: 4063011 - RNA, 11 nt, Staphylococcus aureus subsp. aureus N315
aauuaacaaua

SEQ ID NO: 4063012 - RNA, 12 nt, Staphylococcus aureus subsp. aureus N315
aauuaacaauau

SEQ ID NO: 4063013 - RNA, 19 nt, Staphylococcus aureus subsp. aureus N315
aauuaacaauauuaaauuu

SEQ ID NO: 4063014 - RNA, 19 nt, Staphylococcus aureus subsp. aureus N315
aauuaaccuugauuuaauu

SEQ ID NO: 4063015 - RNA, 23 nt, Staphylococcus aureus subsp. aureus N315
aauuaaccuugauuuaauuuuua

SEQ ID NO: 4063016 - RNA, 22 nt, Staphylococcus aureus subsp. aureus N315
aauuaagaaaaucauucauuug

SEQ ID NO: 4063017 - RNA, 22 nt, Staphylococcus aureus subsp. aureus N315
aauuaauaacauccccaaaaau

SEQ ID NO: 4063018 - RNA, 11 nt, Staphylococcus aureus subsp. aureus N315
aauuaauaauu

SEQ ID NO: 4063019 - RNA, 19 nt, Staphylococcus aureus subsp. aureus N315
aauuaauagagacauuuua

SEQ ID NO: 4063020 - RNA, 14 nt, Staphylococcus aureus subsp. aureus N315
aauuaaucccuuca

SEQ ID NO: 4063021 - RNA, 18 nt, Staphylococcus aureus subsp. aureus N315
aauuaaucccuucaaaau

SEQ ID NO: 4063022 - RNA, 18 nt, Staphylococcus aureus subsp. aureus N315
aauuaaucggaucauuau

SEQ ID NO: 4063023 - RNA, 13 nt, Staphylococcus aureus subsp. aureus N315
aauuaaugauaaa

SEQ ID NO: 4063024 - RNA, 12 nt, Staphylococcus aureus subsp. aureus N315
aauuaauguaau

SEQ ID NO: 4063025 - RNA, 22 nt, Staphylococcus aureus subsp. aureus N315
aauuaauuacuuucauuguaaa

SEQ ID NO: 4063026 - RNA, 14 nt, Staphylococcus aureus subsp. aureus N315
aauuaauuaucuua

SEQ ID NO: 4063027 - RNA, 19 nt, Staphylococcus aureus subsp. aureus N315
aauuaauuauuauauaaua

SEQ ID NO: 4063028 - RNA, 22 nt, Staphylococcus aureus subsp. aureus N315
aauuaauucgccuaaaugguuu

SEQ ID NO: 4063029 - RNA, 18 nt, Staphylococcus aureus subsp. aureus N315
aauuaauugcuuucacau

SEQ ID NO: 4063030 - RNA, 16 nt, Staphylococcus aureus subsp. aureus N315
aauuacaaaaguauga

SEQ ID NO: 4063031 - RNA, 20 nt, Staphylococcus aureus subsp. aureus N315
aauuacaauauaauuuccua

SEQ ID NO: 4063032 - RNA, 19 nt, Staphylococcus aureus subsp. aureus N315
aauuacaggaauugcuuua

SEQ ID NO: 4063033 - RNA, 20 nt, Staphylococcus aureus subsp. aureus N315
aauuacaggaauugcuuuaa

SEQ ID NO: 4063034 - RNA, 15 nt, Staphylococcus aureus subsp. aureus N315
aauuacagguuuaau

SEQ ID NO: 4063035 - RNA, 20 nt, Staphylococcus aureus subsp. aureus N315
aauuacauaagaugauuuag

SEQ ID NO: 4063036 - RNA, 14 nt, Staphylococcus aureus subsp. aureus N315
aauuaccaaugaau

SEQ ID NO: 4063037 - RNA, 22 nt, Staphylococcus aureus subsp. aureus N315
aauuaccaaugaauaaauugau

SEQ ID NO: 4063038 - RNA, 16 nt, Staphylococcus aureus subsp. aureus N315
aauuaccguuuauuuc

SEQ ID NO: 4063039 - RNA, 18 nt, Staphylococcus aureus subsp. aureus N315
aauuaccguuuauuucgu

SEQ ID NO: 4063040 - RNA, 21 nt, Staphylococcus aureus subsp. aureus N315
aauuaccuuuccauucguaua

SEQ ID NO: 4063041 - RNA, 21 nt, Staphylococcus aureus subsp. aureus N315
aauuacucuuuuucuuucaua

SEQ ID NO: 4063042 - RNA, 21 nt, Staphylococcus aureus subsp. aureus N315
aauuacuugcacaccagugcc

SEQ ID NO: 4063043 - RNA, 21 nt, Staphylococcus aureus subsp. aureus N315
aauuacuuuaacaguuguaau

SEQ ID NO: 4063044 - RNA, 18 nt, Staphylococcus aureus subsp. aureus N315
aauuacuuucauuguaaa

SEQ ID NO: 4063045 - RNA, 13 nt, Staphylococcus aureus subsp. aureus N315
aauuagaaaauau

SEQ ID NO: 4063046 - RNA, 13 nt, Staphylococcus aureus subsp. aureus N315
aauuagaaauucu

SEQ ID NO: 4063047 - RNA, 13 nt, Staphylococcus aureus subsp. aureus N315
aauuagaaccauc

SEQ ID NO: 4063048 - RNA, 14 nt, Staphylococcus aureus subsp. aureus N315
aauuagauuuaaaa

SEQ ID NO: 4063049 - RNA, 19 nt, Staphylococcus aureus subsp. aureus N315
aauuagccccaguauagaa

SEQ ID NO: 4063050 - RNA, 17 nt, Staphylococcus aureus subsp. aureus N315
aauuaggauuaacauaa

SEQ ID NO: 4063051 - RNA, 17 nt, Staphylococcus aureus subsp. aureus N315
aauuaggucauuuuuau

SEQ ID NO: 4063052 - RNA, 14 nt, Staphylococcus aureus subsp. aureus N315
aauuagucccauua

SEQ ID NO: 4063053 - RNA, 21 nt, Staphylococcus aureus subsp. aureus N315
aauuaguuuuuguuuacagau

SEQ ID NO: 4063054 - RNA, 22 nt, Staphylococcus aureus subsp. aureus N315
aauuauaaguagugauuuuuua

SEQ ID NO: 4063055 - RNA, 12 nt, Staphylococcus aureus subsp. aureus N315
aauuauauaccc

SEQ ID NO: 4063056 - RNA, 23 nt, Staphylococcus aureus subsp. aureus N315
aauuaucauaaagauaagauggu

SEQ ID NO: 4063057 - RNA, 20 nt, Staphylococcus aureus subsp. aureus N315
aauuaucauaugugauuuaa

SEQ ID NO: 4063058 - RNA, 12 nt, Staphylococcus aureus subsp. aureus N315
aauuaucauuac

SEQ ID NO: 4063059 - RNA, 15 nt, Staphylococcus aureus subsp. aureus N315
aauuauccuacugcu

SEQ ID NO: 4063060 - RNA, 17 nt, Staphylococcus aureus subsp. aureus N315
aauuaucuauauaugaa

SEQ ID NO: 4063061 - RNA, 15 nt, Staphylococcus aureus subsp. aureus N315
aauuaucuuaaguca

SEQ ID NO: 4063062 - RNA, 20 nt, Staphylococcus aureus subsp. aureus N315
aauuaucuuaagucaucaau

SEQ ID NO: 4063063 - RNA, 21 nt, Staphylococcus aureus subsp. aureus N315
aauuaucuuuacgauaaacua

SEQ ID NO: 4063064 - RNA, 19 nt, Staphylococcus aureus subsp. aureus N315
aauuauggagcggaagaua

SEQ ID NO: 4063065 - RNA, 20 nt, Staphylococcus aureus subsp. aureus N315
aauuauguauuuuuauuuau

SEQ ID NO: 4063066 - RNA, 22 nt, Staphylococcus aureus subsp. aureus N315
aauuauuaacgcaaaaauacuc

SEQ ID NO: 4063067 - RNA, 13 nt, Staphylococcus aureus subsp. aureus N315
aauuauuaauaaa

SEQ ID NO: 4063068 - RNA, 15 nt, Staphylococcus aureus subsp. aureus N315
aauuauuaauuuaau

SEQ ID NO: 4063069 - RNA, 15 nt, Staphylococcus aureus subsp. aureus N315
aauuauuauaauaaa

SEQ ID NO: 4063070 - RNA, 19 nt, Staphylococcus aureus subsp. aureus N315
aauuauuauaauaaauaga

SEQ ID NO: 4063071 - RNA, 18 nt, Staphylococcus aureus subsp. aureus N315
aauuauuauaguuuagau

SEQ ID NO: 4063072 - RNA, 20 nt, Staphylococcus aureus subsp. aureus N315
aauuauuauuuaaauuuuca

SEQ ID NO: 4063073 - RNA, 18 nt, Staphylococcus aureus subsp. aureus N315
aauuauugagaauauuua

SEQ ID NO: 4063074 - RNA, 19 nt, Staphylococcus aureus subsp. aureus N315
aauuauuuauucauuauag

SEQ ID NO: 4063075 - RNA, 18 nt, Staphylococcus aureus subsp. aureus N315
aauuauuucaauuaucaa

SEQ ID NO: 4063076 - RNA, 11 nt, Staphylococcus aureus subsp. aureus N315
aauuauuucau

SEQ ID NO: 4063077 - RNA, 13 nt, Staphylococcus aureus subsp. aureus N315
aauuauuucucuu

SEQ ID NO: 4063078 - RNA, 14 nt, Staphylococcus aureus subsp. aureus N315
aauuauuuuaaaaa

SEQ ID NO: 4063079 - RNA, 17 nt, Staphylococcus aureus subsp. aureus N315
aauuauuuuaaaaaaug

SEQ ID NO: 4063080 - RNA, 20 nt, Staphylococcus aureus subsp. aureus N315
aauuauuuuaaaaaaugaug

SEQ ID NO: 4063081 - RNA, 19 nt, Staphylococcus aureus subsp. aureus N315
aauuauuuucucgauacaa

SEQ ID NO: 4063082 - RNA, 16 nt, Staphylococcus aureus subsp. aureus N315
aauuauuuuucaaaua

SEQ ID NO: 4063083 - RNA, 18 nt, Staphylococcus aureus subsp. aureus N315
aauuauuuuucaaauaua

SEQ ID NO: 4063084 - RNA, 18 nt, Staphylococcus aureus subsp. aureus N315
aauucaaaaugccaagaa

SEQ ID NO: 4063085 - RNA, 19 nt, Staphylococcus aureus subsp. aureus N315
aauucaaccaauuauuaaa

SEQ ID NO: 4063086 - RNA, 13 nt, Staphylococcus aureus subsp. aureus N315
aauucaacgucau

SEQ ID NO: 4063087 - RNA, 19 nt, Staphylococcus aureus subsp. aureus N315
aauucaacgucaucaaaac

SEQ ID NO: 4063088 - RNA, 23 nt, Staphylococcus aureus subsp. aureus N315
aauucaacuuuaaucaaaaaaga

SEQ ID NO: 4063089 - RNA, 17 nt, Staphylococcus aureus subsp. aureus N315
aauucaagaccaugcaa

SEQ ID NO: 4063090 - RNA, 17 nt, Staphylococcus aureus subsp. aureus N315
aauucaaguguauuaaa

SEQ ID NO: 4063091 - RNA, 15 nt, Staphylococcus aureus subsp. aureus N315
aauucaauaaucuua

SEQ ID NO: 4063092 - RNA, 14 nt, Staphylococcus aureus subsp. aureus N315
aauucaauauuaau

SEQ ID NO: 4063093 - RNA, 15 nt, Staphylococcus aureus subsp. aureus N315
aauucaaugauuuuu

SEQ ID NO: 4063094 - RNA, 17 nt, Staphylococcus aureus subsp. aureus N315
aauucacgcaauaucau

SEQ ID NO: 4063095 - RNA, 14 nt, Staphylococcus aureus subsp. aureus N315
aauucauaaaugcu

SEQ ID NO: 4063096 - RNA, 16 nt, Staphylococcus aureus subsp. aureus N315
aauucauaagaaaaau

SEQ ID NO: 4063097 - RNA, 17 nt, Staphylococcus aureus subsp. aureus N315
aauugcuuuagaaaguc

SEQ ID NO: 4063098 - RNA, 18 nt, Staphylococcus aureus subsp. aureus N315
aauugcuuucacauuguu

SEQ ID NO: 4063099 - RNA, 16 nt, Staphylococcus aureus subsp. aureus N315
aauuggaacacgaaau

SEQ ID NO: 4063100 - RNA, 22 nt, Staphylococcus aureus subsp. aureus N315
aauuggaaucaucuuuuugaaa

SEQ ID NO: 4063101 - RNA, 20 nt, Staphylococcus aureus subsp. aureus N315
aauuggauguaauagagaag

SEQ ID NO: 4063102 - RNA, 16 nt, Staphylococcus aureus subsp. aureus N315
aauuggauuaaauacg

SEQ ID NO: 4063103 - RNA, 22 nt, Staphylococcus aureus subsp. aureus N315
aauuggcaacggcacauucaua

SEQ ID NO: 4063104 - RNA, 18 nt, Staphylococcus aureus subsp. aureus N315
aauugguuuuuagugaaa

SEQ ID NO: 4063105 - RNA, 15 nt, Staphylococcus aureus subsp. aureus N315
aauuguaaagcauga

SEQ ID NO: 4063106 - RNA, 22 nt, Staphylococcus aureus subsp. aureus N315
aauuguaaagcaugaauagcuu

SEQ ID NO: 4063107 - RNA, 16 nt, Staphylococcus aureus subsp. aureus N315
aauuguaaucuauuuu

SEQ ID NO: 4063108 - RNA, 16 nt, Staphylococcus aureus subsp. aureus N315
aauuguauuuucugcu

SEQ ID NO: 4063109 - RNA, 23 nt, Staphylococcus aureus subsp. aureus N315
aauugucguucucguguaaaaug

SEQ ID NO: 4063110 - RNA, 19 nt, Staphylococcus aureus subsp. aureus N315
aauugucucaucauuuaaa

SEQ ID NO: 4063111 - RNA, 22 nt, Staphylococcus aureus subsp. aureus N315
aauugucucaucauuuaaaauu

SEQ ID NO: 4063112 - RNA, 22 nt, Staphylococcus aureus subsp. aureus N315
aauugugccauuugcaacaaua

SEQ ID NO: 4063113 - RNA, 21 nt, Staphylococcus aureus subsp. aureus N315
aauuguguugaaucaacaguu

SEQ ID NO: 4063114 - RNA, 16 nt, Staphylococcus aureus subsp. aureus N315
aauuguguuucuuuua

SEQ ID NO: 4063115 - RNA, 19 nt, Staphylococcus aureus subsp. aureus N315
aauuguuagauaaucucau

SEQ ID NO: 4063116 - RNA, 22 nt, Staphylococcus aureus subsp. aureus N315
aauuguuaguuuucuuaaaaga

SEQ ID NO: 4063117 - RNA, 11 nt, Staphylococcus aureus subsp. aureus N315
aauuguuaucg

SEQ ID NO: 4063118 - RNA, 13 nt, Staphylococcus aureus subsp. aureus N315
aauuguucuaaua

SEQ ID NO: 4063119 - RNA, 18 nt, Staphylococcus aureus subsp. aureus N315
aauuguuguacauguauu

SEQ ID NO: 4063120 - RNA, 19 nt, Staphylococcus aureus subsp. aureus N315
aauuguuuaauaacaaaau

SEQ ID NO: 4063121 - RNA, 14 nt, Staphylococcus aureus subsp. aureus N315
aauuguuuacuaua

SEQ ID NO: 4063122 - RNA, 17 nt, Staphylococcus aureus subsp. aureus N315
aauuguuuuuucuuauu

SEQ ID NO: 4063123 - RNA, 14 nt, Staphylococcus aureus subsp. aureus N315
aauuuaaaagaaaa

SEQ ID NO: 4063124 - RNA, 13 nt, Staphylococcus aureus subsp. aureus N315
aauuuaaagcauc

SEQ ID NO: 4063125 - RNA, 15 nt, Staphylococcus aureus subsp. aureus N315
aauuuaaagcaucau

SEQ ID NO: 4063126 - RNA, 22 nt, Staphylococcus aureus subsp. aureus N315
aauuuaaagcaucauauacaua

SEQ ID NO: 4063127 - RNA, 11 nt, Staphylococcus aureus subsp. aureus N315
aauuuaaauaa

SEQ ID NO: 4063128 - RNA, 12 nt, Staphylococcus aureus subsp. aureus N315
aauuuaaauauu

SEQ ID NO: 4063129 - RNA, 13 nt, Staphylococcus aureus subsp. aureus N315
aauuuaaaugaua

SEQ ID NO: 4063130 - RNA, 19 nt, Staphylococcus aureus subsp. aureus N315
aauuuaaaugauauugaaa

SEQ ID NO: 4063131 - RNA, 12 nt, Staphylococcus aureus subsp. aureus N315
aauuuaaaugcu

SEQ ID NO: 4063132 - RNA, 19 nt, Staphylococcus aureus subsp. aureus N315
aauuuaacggaaauacaau

SEQ ID NO: 4063133 - RNA, 17 nt, Staphylococcus aureus subsp. aureus N315
aauuuaacuaugaaauu

SEQ ID NO: 4063134 - RNA, 19 nt, Staphylococcus aureus subsp. aureus N315
aauuuaauacuauaguaag

SEQ ID NO: 4063135 - RNA, 20 nt, Staphylococcus aureus subsp. aureus N315
aauuuaauaggcuauguaaa

SEQ ID NO: 4063136 - RNA, 16 nt, Staphylococcus aureus subsp. aureus N315
aauuuaauauuauaag

SEQ ID NO: 4063137 - RNA, 16 nt, Staphylococcus aureus subsp. aureus N315
aauuuaauauuguuaa

SEQ ID NO: 4063138 - RNA, 16 nt, Staphylococcus aureus subsp. aureus N315
aauuuaauuaagaaaa

SEQ ID NO: 4063139 - RNA, 15 nt, Staphylococcus aureus subsp. aureus N315
aauuuaauugguucu

SEQ ID NO: 4063140 - RNA, 18 nt, Staphylococcus aureus subsp. aureus N315
aauuuaauugguucuucu

SEQ ID NO: 4063141 - RNA, 17 nt, Staphylococcus aureus subsp. aureus N315
aauuuacucaaaccauc

SEQ ID NO: 4063142 - RNA, 21 nt, Staphylococcus aureus subsp. aureus N315
aauuuacucaaaccaucuuau

SEQ ID NO: 4063143 - RNA, 17 nt, Staphylococcus aureus subsp. aureus N315
aauuuagauauuauaaa

SEQ ID NO: 4063144 - RNA, 16 nt, Staphylococcus aureus subsp. aureus N315
aauuuagaugcauaaa

SEQ ID NO: 4063145 - RNA, 20 nt, Staphylococcus aureus subsp. aureus N315
aauuuagcaaauauuucugg

SEQ ID NO: 4063146 - RNA, 17 nt, Staphylococcus aureus subsp. aureus N315
aauuuaggcaugucaaa

SEQ ID NO: 4063147 - RNA, 15 nt, Staphylococcus aureus subsp. aureus N315
aauuuaguauaaaua

SEQ ID NO: 4063148 - RNA, 17 nt, Staphylococcus aureus subsp. aureus N315
aauuuagucauuacaaa

SEQ ID NO: 4063149 - RNA, 18 nt, Staphylococcus aureus subsp. aureus N315
aauuuagucauuacaaau

SEQ ID NO: 4063150 - RNA, 15 nt, Staphylococcus aureus subsp. aureus N315
aauuuaguccuucuu

SEQ ID NO: 4063151 - RNA, 12 nt, Staphylococcus aureus subsp. aureus N315
aauuuagugaaa

SEQ ID NO: 4063152 - RNA, 13 nt, Staphylococcus aureus subsp. aureus N315
aauuuagugaaac

SEQ ID NO: 4063153 - RNA, 16 nt, Staphylococcus aureus subsp. aureus N315
aauuuagugaaacaau

SEQ ID NO: 4063154 - RNA, 20 nt, Staphylococcus aureus subsp. aureus N315
aauuuaguuauaauuucugu

SEQ ID NO: 4063155 - RNA, 16 nt, Staphylococcus aureus subsp. aureus N315
aauuuauauagucuau

SEQ ID NO: 4063156 - RNA, 17 nt, Staphylococcus aureus subsp. aureus N315
aauuuaucaauuucuau

SEQ ID NO: 4063157 - RNA, 22 nt, Staphylococcus aureus subsp. aureus N315
aauuuauguguugugauauaua

SEQ ID NO: 4063158 - RNA, 17 nt, Staphylococcus aureus subsp. aureus N315
aauuuauguugcguuaa

SEQ ID NO: 4063159 - RNA, 20 nt, Staphylococcus aureus subsp. aureus N315
aauuuauguugcguuaaaua

SEQ ID NO: 4063160 - RNA, 22 nt, Staphylococcus aureus subsp. aureus N315
aauuuauuaaaacgaaguuauu

SEQ ID NO: 4063161 - RNA, 17 nt, Staphylococcus aureus subsp. aureus N315
aauuuauuauaaaauag

SEQ ID NO: 4063162 - RNA, 12 nt, Staphylococcus aureus subsp. aureus N315
aauuuauuauua

SEQ ID NO: 4063163 - RNA, 13 nt, Staphylococcus aureus subsp. aureus N315
aauuuauuuugua

SEQ ID NO: 4063164 - RNA, 12 nt, Staphylococcus aureus subsp. aureus N315
aauuucaaaaau

SEQ ID NO: 4063165 - RNA, 12 nt, Staphylococcus aureus subsp. aureus N315
aauuucaaaaua

SEQ ID NO: 4063166 - RNA, 15 nt, Staphylococcus aureus subsp. aureus N315
aauuucaaaauagua

SEQ ID NO: 4063167 - RNA, 19 nt, Staphylococcus aureus subsp. aureus N315
aauuucaaaauaguaaagu

SEQ ID NO: 4063168 - RNA, 14 nt, Staphylococcus aureus subsp. aureus N315
aauuucaauaaugu

SEQ ID NO: 4063169 - RNA, 18 nt, Staphylococcus aureus subsp. aureus N315
aauuucaaugucugcauc

SEQ ID NO: 4063170 - RNA, 19 nt, Staphylococcus aureus subsp. aureus N315
aauuucacgcugaaauuuu

SEQ ID NO: 4063171 - RNA, 21 nt, Staphylococcus aureus subsp. aureus N315
aauuucacuuuaacuucuuuu

SEQ ID NO: 4063172 - RNA, 20 nt, Staphylococcus aureus subsp. aureus N315
aauuucauaaaguuuauuua

SEQ ID NO: 4063173 - RNA, 19 nt, Staphylococcus aureus subsp. aureus N315
aauuucauuugaaauaguu

SEQ ID NO: 4063174 - RNA, 16 nt, Staphylococcus aureus subsp. aureus N315
aauuuccaaaguaaua

SEQ ID NO: 4063175 - RNA, 21 nt, Staphylococcus aureus subsp. aureus N315
aauuuccaauaucuucuuuua

SEQ ID NO: 4063176 - RNA, 17 nt, Staphylococcus aureus subsp. aureus N315
aauuucgaaaagaaauu

SEQ ID NO: 4063177 - RNA, 16 nt, Staphylococcus aureus subsp. aureus N315
aauuucgacaucuaga

SEQ ID NO: 4063178 - RNA, 12 nt, Staphylococcus aureus subsp. aureus N315
aauuucgauuaa

SEQ ID NO: 4063179 - RNA, 18 nt, Staphylococcus aureus subsp. aureus N315
aauuucgauuuucaccaa

SEQ ID NO: 4063180 - RNA, 13 nt, Staphylococcus aureus subsp. aureus N315
aauuucgcacaau

SEQ ID NO: 4063181 - RNA, 15 nt, Staphylococcus aureus subsp. aureus N315
aauuucugaacauaa

SEQ ID NO: 4063182 - RNA, 17 nt, Staphylococcus aureus subsp. aureus N315
aauuucugcuucuuuua

SEQ ID NO: 4063183 - RNA, 23 nt, Staphylococcus aureus subsp. aureus N315
aauuucuguuuacgccauaagaa

SEQ ID NO: 4063184 - RNA, 16 nt, Staphylococcus aureus subsp. aureus N315
aauuugaaaguaaauu

SEQ ID NO: 4063185 - RNA, 11 nt, Staphylococcus aureus subsp. aureus N315
acaaaugaaaa

SEQ ID NO: 4063186 - RNA, 22 nt, Staphylococcus aureus subsp. aureus N315
acaaaugaagguguugaaaagu

SEQ ID NO: 4063187 - RNA, 19 nt, Staphylococcus aureus subsp. aureus N315
acaaauguauaaauaauaa

SEQ ID NO: 4063188 - RNA, 11 nt, Staphylococcus aureus subsp. aureus N315
acaaauuauua

SEQ ID NO: 4063189 - RNA, 22 nt, Staphylococcus aureus subsp. aureus N315
acaaauugcaauggcaaccuuu

SEQ ID NO: 4063190 - RNA, 21 nt, Staphylococcus aureus subsp. aureus N315
acaaauuugaauauacuuaau

SEQ ID NO: 4063191 - RNA, 15 nt, Staphylococcus aureus subsp. aureus N315
acaacaaucaaauua

SEQ ID NO: 4063192 - RNA, 14 nt, Staphylococcus aureus subsp. aureus N315
acaacauaacaaag

SEQ ID NO: 4063193 - RNA, 21 nt, Staphylococcus aureus subsp. aureus N315
acaacaugauuucuucuccuu

SEQ ID NO: 4063194 - RNA, 21 nt, Staphylococcus aureus subsp. aureus N315
acaacauuauuuauauuuaga

SEQ ID NO: 4063195 - RNA, 17 nt, Staphylococcus aureus subsp. aureus N315
acaaccgucccauaaaa

SEQ ID NO: 4063196 - RNA, 21 nt, Staphylococcus aureus subsp. aureus N315
acaaccucugauacuucacca

SEQ ID NO: 4063197 - RNA, 18 nt, Staphylococcus aureus subsp. aureus N315
acaaccugugauaaaaau

SEQ ID NO: 4063198 - RNA, 21 nt, Staphylococcus aureus subsp. aureus N315
acaaccugugauaaaaaucuu

SEQ ID NO: 4063199 - RNA, 16 nt, Staphylococcus aureus subsp. aureus N315
acaacucguuuuucca

SEQ ID NO: 4063200 - RNA, 13 nt, Staphylococcus aureus subsp. aureus N315
acaacugauuuaa

SEQ ID NO: 4063201 - RNA, 13 nt, Staphylococcus aureus subsp. aureus N315
acaacuucuucuc

SEQ ID NO: 4063202 - RNA, 23 nt, Staphylococcus aureus subsp. aureus N315
acaacuucuucuccguauuuacc

SEQ ID NO: 4063203 - RNA, 19 nt, Staphylococcus aureus subsp. aureus N315
acaacuugaacuaaaacga

SEQ ID NO: 4063204 - RNA, 16 nt, Staphylococcus aureus subsp. aureus N315
acaacuuuaauuuuuc

SEQ ID NO: 4063205 - RNA, 17 nt, Staphylococcus aureus subsp. aureus N315
acaacuuuaauuuuuca

SEQ ID NO: 4063206 - RNA, 22 nt, Staphylococcus aureus subsp. aureus N315
acaacuuuaguuguuaggggcu

SEQ ID NO: 4063207 - RNA, 19 nt, Staphylococcus aureus subsp. aureus N315
acaagaacuuagaaaugca

SEQ ID NO: 4063208 - RNA, 21 nt, Staphylococcus aureus subsp. aureus N315
acaagaacuuagaaaugcaau

SEQ ID NO: 4063209 - RNA, 14 nt, Staphylococcus aureus subsp. aureus N315
acaagcaucaccaa

SEQ ID NO: 4063210 - RNA, 15 nt, Staphylococcus aureus subsp. aureus N315
acaagcaucaugaaa

SEQ ID NO: 4063211 - RNA, 20 nt, Staphylococcus aureus subsp. aureus N315
acaagcaucaugaaauuaga

SEQ ID NO: 4063212 - RNA, 16 nt, Staphylococcus aureus subsp. aureus N315
acaagcauuuuucaau

SEQ ID NO: 4063213 - RNA, 16 nt, Staphylococcus aureus subsp. aureus N315
acaagcuuuuuucaau

SEQ ID NO: 4063214 - RNA, 15 nt, Staphylococcus aureus subsp. aureus N315
acaagguuucaagag

SEQ ID NO: 4063215 - RNA, 16 nt, Staphylococcus aureus subsp. aureus N315
acaaguaaaacgcauu

SEQ ID NO: 4063216 - RNA, 15 nt, Staphylococcus aureus subsp. aureus N315
acaaguacaauaaua

SEQ ID NO: 4063217 - RNA, 18 nt, Staphylococcus aureus subsp. aureus N315
acaaguacaauaauaccu

SEQ ID NO: 4063218 - RNA, 15 nt, Staphylococcus aureus subsp. aureus N315
acaaguauaaaugca

SEQ ID NO: 4063219 - RNA, 18 nt, Staphylococcus aureus subsp. aureus N315
acaaguugcacauuauaa

SEQ ID NO: 4063220 - RNA, 20 nt, Staphylococcus aureus subsp. aureus N315
acaaguugcugaauaaaaua

SEQ ID NO: 4063221 - RNA, 15 nt, Staphylococcus aureus subsp. aureus N315
acaaguuguucaauu

SEQ ID NO: 4063222 - RNA, 18 nt, Staphylococcus aureus subsp. aureus N315
acaaguuucgcagcuuua

SEQ ID NO: 4063223 - RNA, 14 nt, Staphylococcus aureus subsp. aureus N315
acaauaaagacaua

SEQ ID NO: 4063224 - RNA, 15 nt, Staphylococcus aureus subsp. aureus N315
acaauaacuguucuu

SEQ ID NO: 4063225 - RNA, 20 nt, Staphylococcus aureus subsp. aureus N315
acaauaagcgcaauuaaaag

SEQ ID NO: 4063226 - RNA, 16 nt, Staphylococcus aureus subsp. aureus N315
acaauaaugugcaagu

SEQ ID NO: 4063227 - RNA, 15 nt, Staphylococcus aureus subsp. aureus N315
acaauacaaaucgau

SEQ ID NO: 4063228 - RNA, 16 nt, Staphylococcus aureus subsp. aureus N315
acaauacauaaugguu

SEQ ID NO: 4063229 - RNA, 15 nt, Staphylococcus aureus subsp. aureus N315
acaauacgaaaucaa

SEQ ID NO: 4063230 - RNA, 19 nt, Staphylococcus aureus subsp. aureus N315
acaauacuucguauugaau

SEQ ID NO: 4063231 - RNA, 16 nt, Staphylococcus aureus subsp. aureus N315
acaauagguacaacua

SEQ ID NO: 4063232 - RNA, 22 nt, Staphylococcus aureus subsp. aureus N315
acaauaguauuaacuauaaaua

SEQ ID NO: 4063233 - RNA, 17 nt, Staphylococcus aureus subsp. aureus N315
acaauauaauauacaca

SEQ ID NO: 4063234 - RNA, 22 nt, Staphylococcus aureus subsp. aureus N315
acaauauagaaaaugaguacaa

SEQ ID NO: 4063235 - RNA, 13 nt, Staphylococcus aureus subsp. aureus N315
acaauaugauuaa

SEQ ID NO: 4063236 - RNA, 18 nt, Staphylococcus aureus subsp. aureus N315
acaauauucguaaauccu

SEQ ID NO: 4063237 - RNA, 14 nt, Staphylococcus aureus subsp. aureus N315
acaauauugacuuu

SEQ ID NO: 4063238 - RNA, 19 nt, Staphylococcus aureus subsp. aureus N315
acaauauuuaccacaaaua

SEQ ID NO: 4063239 - RNA, 23 nt, Staphylococcus aureus subsp. aureus N315
acaauauuuuuacauauuuauac

SEQ ID NO: 4063240 - RNA, 18 nt, Staphylococcus aureus subsp. aureus N315
acaaucaacuuagaauuu

SEQ ID NO: 4063241 - RNA, 15 nt, Staphylococcus aureus subsp. aureus N315
acaaucacaaauuca

SEQ ID NO: 4063242 - RNA, 15 nt, Staphylococcus aureus subsp. aureus N315
acaaucacaguauga

SEQ ID NO: 4063243 - RNA, 19 nt, Staphylococcus aureus subsp. aureus N315
acaaucacaguaugauuag

SEQ ID NO: 4063244 - RNA, 19 nt, Staphylococcus aureus subsp. aureus N315
acaaucagauaaguuacua

SEQ ID NO: 4063245 - RNA, 21 nt, Staphylococcus aureus subsp. aureus N315
acaaucauagauauaagaaau

SEQ ID NO: 4063246 - RNA, 20 nt, Staphylococcus aureus subsp. aureus N315
acaaucggaagcauauuucu

SEQ ID NO: 4063247 - RNA, 19 nt, Staphylococcus aureus subsp. aureus N315
acaaucuccauuagaacua

SEQ ID NO: 4063248 - RNA, 16 nt, Staphylococcus aureus subsp. aureus N315
acaaucuuaucauaau

SEQ ID NO: 4063249 - RNA, 15 nt, Staphylococcus aureus subsp. aureus N315
acaaugaaaaaacga

SEQ ID NO: 4063250 - RNA, 23 nt, Staphylococcus aureus subsp. aureus N315
acaaugaauuucuaauuuaguau

SEQ ID NO: 4063251 - RNA, 16 nt, Staphylococcus aureus subsp. aureus N315
acaaugauuaaaauua

SEQ ID NO: 4063252 - RNA, 15 nt, Staphylococcus aureus subsp. aureus N315
acaaugauuacuuua

SEQ ID NO: 4063253 - RNA, 21 nt, Staphylococcus aureus subsp. aureus N315
acaaugcagcuguauuuaaua

SEQ ID NO: 4063254 - RNA, 17 nt, Staphylococcus aureus subsp. aureus N315
acaaugcgcaaugaaaa

SEQ ID NO: 4063255 - RNA, 15 nt, Staphylococcus aureus subsp. aureus N315
acaauggaugccgcu

SEQ ID NO: 4063256 - RNA, 21 nt, Staphylococcus aureus subsp. aureus N315
acaauggaugccgcucuuuuu

SEQ ID NO: 4063257 - RNA, 13 nt, Staphylococcus aureus subsp. aureus N315
acaauguauuacc

SEQ ID NO: 4063258 - RNA, 19 nt, Staphylococcus aureus subsp. aureus N315
acaauguuauuagauacuu

SEQ ID NO: 4063259 - RNA, 16 nt, Staphylococcus aureus subsp. aureus N315
acaauuauaaaugauu

SEQ ID NO: 4063260 - RNA, 20 nt, Staphylococcus aureus subsp. aureus N315
acaauucaagaccaugcaaa

SEQ ID NO: 4063261 - RNA, 16 nt, Staphylococcus aureus subsp. aureus N315
acaauucauaagaaaa

SEQ ID NO: 4063262 - RNA, 20 nt, Staphylococcus aureus subsp. aureus N315
acaauucauaagaaaaaugu

SEQ ID NO: 4063263 - RNA, 13 nt, Staphylococcus aureus subsp. aureus N315
acaauugcagaga

SEQ ID NO: 4063264 - RNA, 22 nt, Staphylococcus aureus subsp. aureus N315
acaauuguauaaugugcgucac

SEQ ID NO: 4063265 - RNA, 14 nt, Staphylococcus aureus subsp. aureus N315
acaauuuaaaaagc

SEQ ID NO: 4063266 - RNA, 13 nt, Staphylococcus aureus subsp. aureus N315
acaauuuaaacgc

SEQ ID NO: 4063267 - RNA, 17 nt, Staphylococcus aureus subsp. aureus N315
acaauuuauuaaaacga

SEQ ID NO: 4063268 - RNA, 13 nt, Staphylococcus aureus subsp. aureus N315
acaauuugcauaa

SEQ ID NO: 4063269 - RNA, 15 nt, Staphylococcus aureus subsp. aureus N315
acaauuuuccuucca

SEQ ID NO: 4063270 - RNA, 16 nt, Staphylococcus aureus subsp. aureus N315
acaauuuuccuuccaa

SEQ ID NO: 4063271 - RNA, 18 nt, Staphylococcus aureus subsp. aureus N315
acaauuuuguacauuucu

SEQ ID NO: 4063272 - RNA, 13 nt, Staphylococcus aureus subsp. aureus N315
acaauuuuuaaaa

SEQ ID NO: 4063273 - RNA, 15 nt, Staphylococcus aureus subsp. aureus N315
acauaacacaaguua

SEQ ID NO: 4063274 - RNA, 17 nt, Staphylococcus aureus subsp. aureus N315
acauaacagcuaaaaau

SEQ ID NO: 4063275 - RNA, 18 nt, Staphylococcus aureus subsp. aureus N315
acauaaccgaugugauuu

SEQ ID NO: 4063276 - RNA, 15 nt, Staphylococcus aureus subsp. aureus N315
acauaaccuugcuuu

SEQ ID NO: 4063277 - RNA, 14 nt, Staphylococcus aureus subsp. aureus N315
acauaacuaugcuu

SEQ ID NO: 4063278 - RNA, 21 nt, Staphylococcus aureus subsp. aureus N315
acauaaggucuuggacuaaua

SEQ ID NO: 4063279 - RNA, 12 nt, Staphylococcus aureus subsp. aureus N315
acauaaugacau

SEQ ID NO: 4063280 - RNA, 20 nt, Staphylococcus aureus subsp. aureus N315
acauaauuaacuuucuuuug

SEQ ID NO: 4063281 - RNA, 22 nt, Staphylococcus aureus subsp. aureus N315
acauaauuaacuuucuuuuguu

SEQ ID NO: 4063282 - RNA, 16 nt, Staphylococcus aureus subsp. aureus N315
acauaauuuaucaauu

SEQ ID NO: 4063283 - RNA, 22 nt, Staphylococcus aureus subsp. aureus N315
acauaauuuuuauuuacacaca

SEQ ID NO: 4063284 - RNA, 15 nt, Staphylococcus aureus subsp. aureus N315
acauacagucaauac

SEQ ID NO: 4063285 - RNA, 14 nt, Staphylococcus aureus subsp. aureus N315
acauacauuuugaa

SEQ ID NO: 4063286 - RNA, 15 nt, Staphylococcus aureus subsp. aureus N315
acauacauuuugaaa

SEQ ID NO: 4063287 - RNA, 14 nt, Staphylococcus aureus subsp. aureus N315
acauacguuauuuu

SEQ ID NO: 4063288 - RNA, 14 nt, Staphylococcus aureus subsp. aureus N315
acauacuauaaaaa

SEQ ID NO: 4063289 - RNA, 16 nt, Staphylococcus aureus subsp. aureus N315
acauacuauaaaaauu

SEQ ID NO: 4063290 - RNA, 14 nt, Staphylococcus aureus subsp. aureus N315
acauacugauuaaa

SEQ ID NO: 4063291 - RNA, 17 nt, Staphylococcus aureus subsp. aureus N315
acauagacacuuaacuu

SEQ ID NO: 4063292 - RNA, 17 nt, Staphylococcus aureus subsp. aureus N315
acauagaugcuucaaaa

SEQ ID NO: 4063293 - RNA, 20 nt, Staphylococcus aureus subsp. aureus N315
acauagcuuaauaauuaaua

SEQ ID NO: 4063294 - RNA, 22 nt, Staphylococcus aureus subsp. aureus N315
acauagguauaaucauuuaaac

SEQ ID NO: 4063295 - RNA, 22 nt, Staphylococcus aureus subsp. aureus N315
acauaguuucuucuauuauauu

SEQ ID NO: 4063296 - RNA, 16 nt, Staphylococcus aureus subsp. aureus N315
acauauaaaaaauuau

SEQ ID NO: 4063297 - RNA, 16 nt, Staphylococcus aureus subsp. aureus N315
acauauaaaucauuuc

SEQ ID NO: 4063298 - RNA, 19 nt, Staphylococcus aureus subsp. aureus N315
acauaucacgagcuuuuaa

SEQ ID NO: 4063299 - RNA, 19 nt, Staphylococcus aureus subsp. aureus N315
acauauguacuauuaucua

SEQ ID NO: 4063300 - RNA, 23 nt, Staphylococcus aureus subsp. aureus N315
acauaugucuuucuaaguuugaa

SEQ ID NO: 4063301 - RNA, 19 nt, Staphylococcus aureus subsp. aureus N315
acauauguguaugauagaa

SEQ ID NO: 4063302 - RNA, 20 nt, Staphylococcus aureus subsp. aureus N315
acauauguguaugauagaau

SEQ ID NO: 4063303 - RNA, 18 nt, Staphylococcus aureus subsp. aureus N315
acauauuaugauacgcuu

SEQ ID NO: 4063304 - RNA, 14 nt, Staphylococcus aureus subsp. aureus N315
acauauucauaaua

SEQ ID NO: 4063305 - RNA, 13 nt, Staphylococcus aureus subsp. aureus N315
acauauuggcuug

SEQ ID NO: 4063306 - RNA, 15 nt, Staphylococcus aureus subsp. aureus N315
acauauuuauacuga

SEQ ID NO: 4063307 - RNA, 19 nt, Staphylococcus aureus subsp. aureus N315
acauauuuauacugaucaa

SEQ ID NO: 4063308 - RNA, 15 nt, Staphylococcus aureus subsp. aureus N315
acauauuuucacaau

SEQ ID NO: 4063309 - RNA, 15 nt, Staphylococcus aureus subsp. aureus N315
acauauuuuuuaaau

SEQ ID NO: 4063310 - RNA, 14 nt, Staphylococcus aureus subsp. aureus N315
acaucaaauuuuuc

SEQ ID NO: 4063311 - RNA, 14 nt, Staphylococcus aureus subsp. aureus N315
acaucaauaucuuc

SEQ ID NO: 4063312 - RNA, 17 nt, Staphylococcus aureus subsp. aureus N315
acaucaauaucuucuuc

SEQ ID NO: 4063313 - RNA, 14 nt, Staphylococcus aureus subsp. aureus N315
acaucaauuacucu

SEQ ID NO: 4063314 - RNA, 15 nt, Staphylococcus aureus subsp. aureus N315
acaucagauauaagu

SEQ ID NO: 4063315 - RNA, 23 nt, Staphylococcus aureus subsp. aureus N315
acaucaguaaaaacgaaauuguu

SEQ ID NO: 4063316 - RNA, 15 nt, Staphylococcus aureus subsp. aureus N315
acaucauaauaaauc

SEQ ID NO: 4063317 - RNA, 13 nt, Staphylococcus aureus subsp. aureus N315
acaucaucaaguu

SEQ ID NO: 4063318 - RNA, 17 nt, Staphylococcus aureus subsp. aureus N315
acaucaucgccagcauu

SEQ ID NO: 4063319 - RNA, 17 nt, Staphylococcus aureus subsp. aureus N315
acaucaucuuuaauuuu

SEQ ID NO: 4063320 - RNA, 13 nt, Staphylococcus aureus subsp. aureus N315
acaucauuaaaua

SEQ ID NO: 4063321 - RNA, 15 nt, Staphylococcus aureus subsp. aureus N315
acaucauuaaauauu

SEQ ID NO: 4063322 - RNA, 17 nt, Staphylococcus aureus subsp. aureus N315
acaucauuaaauauuua

SEQ ID NO: 4063323 - RNA, 15 nt, Staphylococcus aureus subsp. aureus N315
acaucauucacaagu

SEQ ID NO: 4063324 - RNA, 23 nt, Staphylococcus aureus subsp. aureus N315
acauccaauuauguuuaucuacu

SEQ ID NO: 4063325 - RNA, 20 nt, Staphylococcus aureus subsp. aureus N315
acauccucauaauuaucaua

SEQ ID NO: 4063326 - RNA, 22 nt, Staphylococcus aureus subsp. aureus N315
acauccucauaauuaucauaua

SEQ ID NO: 4063327 - RNA, 15 nt, Staphylococcus aureus subsp. aureus N315
acaucgccaauuuga

SEQ ID NO: 4063328 - RNA, 22 nt, Staphylococcus aureus subsp. aureus N315
acaucgccaauuugauuaguaa

SEQ ID NO: 4063329 - RNA, 14 nt, Staphylococcus aureus subsp. aureus N315
acaucggaauucaa

SEQ ID NO: 4063330 - RNA, 19 nt, Staphylococcus aureus subsp. aureus N315
acaucuaagugauauacga

SEQ ID NO: 4063331 - RNA, 16 nt, Staphylococcus aureus subsp. aureus N315
acaucuaauaaauaua

SEQ ID NO: 4063332 - RNA, 16 nt, Staphylococcus aureus subsp. aureus N315
acaucuacaucaaauu

SEQ ID NO: 4063333 - RNA, 20 nt, Staphylococcus aureus subsp. aureus N315
acaucuagaugaaauugugu

SEQ ID NO: 4063334 - RNA, 16 nt, Staphylococcus aureus subsp. aureus N315
acaucuauaacaaaau

SEQ ID NO: 4063335 - RNA, 20 nt, Staphylococcus aureus subsp. aureus N315
acaucuauaacaaaaucuca

SEQ ID NO: 4063336 - RNA, 14 nt, Staphylococcus aureus subsp. aureus N315
acaucuauuucuug

SEQ ID NO: 4063337 - RNA, 13 nt, Staphylococcus aureus subsp. aureus N315
acaucugaaaaaa

SEQ ID NO: 4063338 - RNA, 23 nt, Staphylococcus aureus subsp. aureus N315
acaucuuucgagguaauuucacc

SEQ ID NO: 4063339 - RNA, 12 nt, Staphylococcus aureus subsp. aureus N315
acaucuuuuguu

SEQ ID NO: 4063340 - RNA, 13 nt, Staphylococcus aureus subsp. aureus N315
acaucuuuuugau

SEQ ID NO: 4063341 - RNA, 14 nt, Staphylococcus aureus subsp. aureus N315
acaugaacaaucag

SEQ ID NO: 4063342 - RNA, 20 nt, Staphylococcus aureus subsp. aureus N315
acaugaacaaucagauaagu

SEQ ID NO: 4063343 - RNA, 21 nt, Staphylococcus aureus subsp. aureus N315
acaugaacaaucagauaaguu

SEQ ID NO: 4063344 - RNA, 19 nt, Staphylococcus aureus subsp. aureus N315
acaugaauuuuaauauauu

SEQ ID NO: 4063345 - RNA, 16 nt, Staphylococcus aureus subsp. aureus N315
acaugacauucauuua

SEQ ID NO: 4063346 - RNA, 22 nt, Staphylococcus aureus subsp. aureus N315
acaugagauuauuuuuuuaaau

SEQ ID NO: 4063347 - RNA, 15 nt, Staphylococcus aureus subsp. aureus N315
acaugaguaaaacuc

SEQ ID NO: 4063348 - RNA, 15 nt, Staphylococcus aureus subsp. aureus N315
acaugauaauuuuua

SEQ ID NO: 4063349 - RNA, 16 nt, Staphylococcus aureus subsp. aureus N315
acaugauaauuuuuag

SEQ ID NO: 4063350 - RNA, 15 nt, Staphylococcus aureus subsp. aureus N315
acaugauacugaaau

SEQ ID NO: 4063351 - RNA, 18 nt, Staphylococcus aureus subsp. aureus N315
acaugauacugaaauuuc

SEQ ID NO: 4063352 - RNA, 14 nt, Staphylococcus aureus subsp. aureus N315
acaugccaauggaa

SEQ ID NO: 4063353 - RNA, 19 nt, Staphylococcus aureus subsp. aureus N315
acaugcuuggacauauacu

SEQ ID NO: 4063354 - RNA, 23 nt, Staphylococcus aureus subsp. aureus N315
acauggcuuagguuuaauuuuaa

SEQ ID NO: 4063355 - RNA, 18 nt, Staphylococcus aureus subsp. aureus N315
acaugggcaaucacuccu

SEQ ID NO: 4063356 - RNA, 22 nt, Staphylococcus aureus subsp. aureus N315
acaugguugauucgauaugaau

SEQ ID NO: 4063357 - RNA, 18 nt, Staphylococcus aureus subsp. aureus N315
acauguacaauuuuuaaa

SEQ ID NO: 4063358 - RNA, 20 nt, Staphylococcus aureus subsp. aureus N315
acauguauuggccaaacaac

SEQ ID NO: 4063359 - RNA, 18 nt, Staphylococcus aureus subsp. aureus N315
acauguauuuaguaucau

SEQ ID NO: 4063360 - RNA, 12 nt, Staphylococcus aureus subsp. aureus N315
acaugugaaaua

SEQ ID NO: 4063361 - RNA, 19 nt, Staphylococcus aureus subsp. aureus N315
accaccugauaaugcaugu

SEQ ID NO: 4063362 - RNA, 19 nt, Staphylococcus aureus subsp. aureus N315
accacgauaucuagcugcu

SEQ ID NO: 4063363 - RNA, 14 nt, Staphylococcus aureus subsp. aureus N315
accacuaagugaac

SEQ ID NO: 4063364 - RNA, 16 nt, Staphylococcus aureus subsp. aureus N315
accacuauuuuuaaau

SEQ ID NO: 4063365 - RNA, 20 nt, Staphylococcus aureus subsp. aureus N315
accacucaauucucuaacuu

SEQ ID NO: 4063366 - RNA, 23 nt, Staphylococcus aureus subsp. aureus N315
accacuugaauacuuuuuaacug

SEQ ID NO: 4063367 - RNA, 18 nt, Staphylococcus aureus subsp. aureus N315
accacuuuuguuaaaaaa

SEQ ID NO: 4063368 - RNA, 19 nt, Staphylococcus aureus subsp. aureus N315
accacuuuuguuaaaaaau

SEQ ID NO: 4063369 - RNA, 18 nt, Staphylococcus aureus subsp. aureus N315
accacuuuuucuguaaua

SEQ ID NO: 4063370 - RNA, 14 nt, Staphylococcus aureus subsp. aureus N315
accagcuaaccaaa

SEQ ID NO: 4063371 - RNA, 14 nt, Staphylococcus aureus subsp. aureus N315
accagucguaauga

SEQ ID NO: 4063372 - RNA, 18 nt, Staphylococcus aureus subsp. aureus N315
accaguggaaauuaugua

SEQ ID NO: 4063373 - RNA, 14 nt, Staphylococcus aureus subsp. aureus N315
accaguuucuggua

SEQ ID NO: 4063374 - RNA, 23 nt, Staphylococcus aureus subsp. aureus N315
accaguuugaucauaauucagug

SEQ ID NO: 4063375 - RNA, 17 nt, Staphylococcus aureus subsp. aureus N315
accauaacaauuuuguu

SEQ ID NO: 4063376 - RNA, 18 nt, Staphylococcus aureus subsp. aureus N315
accauaacuuuauauaua

SEQ ID NO: 4063377 - RNA, 20 nt, Staphylococcus aureus subsp. aureus N315
accauacuaaaacaugauac

SEQ ID NO: 4063378 - RNA, 14 nt, Staphylococcus aureus subsp. aureus N315
accauacucuaacu

SEQ ID NO: 4063379 - RNA, 15 nt, Staphylococcus aureus subsp. aureus N315
accauacucuaacuu

SEQ ID NO: 4063380 - RNA, 16 nt, Staphylococcus aureus subsp. aureus N315
accauauuuuuagaaa

SEQ ID NO: 4063381 - RNA, 21 nt, Staphylococcus aureus subsp. aureus N315
accaucaacgccauauuuauu

SEQ ID NO: 4063382 - RNA, 20 nt, Staphylococcus aureus subsp. aureus N315
accaucucaacuaaucgugu

SEQ ID NO: 4063383 - RNA, 14 nt, Staphylococcus aureus subsp. aureus N315
accaucucuauuuu

SEQ ID NO: 4063384 - RNA, 17 nt, Staphylococcus aureus subsp. aureus N315
accaucugaaucaguua

SEQ ID NO: 4063385 - RNA, 20 nt, Staphylococcus aureus subsp. aureus N315
accaucuucuugauuguaaa

SEQ ID NO: 4063386 - RNA, 19 nt, Staphylococcus aureus subsp. aureus N315
accaugcaaacucauuuau

SEQ ID NO: 4063387 - RNA, 20 nt, Staphylococcus aureus subsp. aureus N315
accaugcugcacauuccauc

SEQ ID NO: 4063388 - RNA, 15 nt, Staphylococcus aureus subsp. aureus N315
accauguuuuuuaag

SEQ ID NO: 4063389 - RNA, 14 nt, Staphylococcus aureus subsp. aureus N315
accauuaauuacau

SEQ ID NO: 4063390 - RNA, 20 nt, Staphylococcus aureus subsp. aureus N315
accauuaucaagaacuuuaa

SEQ ID NO: 4063391 - RNA, 14 nt, Staphylococcus aureus subsp. aureus N315
accauuaugauuaa

SEQ ID NO: 4063392 - RNA, 22 nt, Staphylococcus aureus subsp. aureus N315
accauucgaaagccaauuaaua

SEQ ID NO: 4063393 - RNA, 20 nt, Staphylococcus aureus subsp. aureus N315
accauucuaccaguugauuu

SEQ ID NO: 4063394 - RNA, 21 nt, Staphylococcus aureus subsp. aureus N315
accauugcacaguuucaucuu

SEQ ID NO: 4063395 - RNA, 16 nt, Staphylococcus aureus subsp. aureus N315
accauuguauuauccu

SEQ ID NO: 4063396 - RNA, 21 nt, Staphylococcus aureus subsp. aureus N315
accauugugaauaauuucagu

SEQ ID NO: 4063397 - RNA, 17 nt, Staphylococcus aureus subsp. aureus N315
accauuuaacucaccuu

SEQ ID NO: 4063398 - RNA, 16 nt, Staphylococcus aureus subsp. aureus N315
accauuuuauauuuua

SEQ ID NO: 4063399 - RNA, 13 nt, Staphylococcus aureus subsp. aureus N315
acccaaaaaauug

SEQ ID NO: 4063400 - RNA, 11 nt, Staphylococcus aureus subsp. aureus N315
acccaaucauu

SEQ ID NO: 4063401 - RNA, 18 nt, Staphylococcus aureus subsp. aureus N315
acccauaauuuaaaugau

SEQ ID NO: 4063402 - RNA, 16 nt, Staphylococcus aureus subsp. aureus N315
acccauauuaaauuuu

SEQ ID NO: 4063403 - RNA, 23 nt, Staphylococcus aureus subsp. aureus N315
acccauuuuuuuccaagcaucau

SEQ ID NO: 4063404 - RNA, 19 nt, Staphylococcus aureus subsp. aureus N315
accccauucacuacuuuuu

SEQ ID NO: 4063405 - RNA, 21 nt, Staphylococcus aureus subsp. aureus N315
acccuaaugagcccguuaaaa

SEQ ID NO: 4063406 - RNA, 23 nt, Staphylococcus aureus subsp. aureus N315
acccuaauuuguuaguuuaaguc

SEQ ID NO: 4063407 - RNA, 20 nt, Staphylococcus aureus subsp. aureus N315
acccucauuuuuauaaauuu

SEQ ID NO: 4063408 - RNA, 20 nt, Staphylococcus aureus subsp. aureus N315
accgacaaggauugaaaaaa

SEQ ID NO: 4063409 - RNA, 19 nt, Staphylococcus aureus subsp. aureus N315
accgacaauuauaauaaaa

SEQ ID NO: 4063410 - RNA, 22 nt, Staphylococcus aureus subsp. aureus N315
accgacacuccacaaguggaac

SEQ ID NO: 4063411 - RNA, 17 nt, Staphylococcus aureus subsp. aureus N315
accgauuguuaauuuaa

SEQ ID NO: 4063412 - RNA, 17 nt, Staphylococcus aureus subsp. aureus N315
accgcacuucuauauua

SEQ ID NO: 4063413 - RNA, 19 nt, Staphylococcus aureus subsp. aureus N315
accgcacuucuauauuaau

SEQ ID NO: 4063414 - RNA, 21 nt, Staphylococcus aureus subsp. aureus N315
accgcacuuucuauuaauaua

SEQ ID NO: 4063415 - RNA, 19 nt, Staphylococcus aureus subsp. aureus N315
accgccaacuaauguuaaa

SEQ ID NO: 4063416 - RNA, 16 nt, Staphylococcus aureus subsp. aureus N315
accgcuuaauucuuca

SEQ ID NO: 4063417 - RNA, 18 nt, Staphylococcus aureus subsp. aureus N315
accgcuucuuuuaaguua

SEQ ID NO: 4063418 - RNA, 19 nt, Staphylococcus aureus subsp. aureus N315
accguaacuauaugaaaug

SEQ ID NO: 4063419 - RNA, 13 nt, Staphylococcus aureus subsp. aureus N315
accguaauuuuaa

SEQ ID NO: 4063420 - RNA, 21 nt, Staphylococcus aureus subsp. aureus N315
accguuaguacggcugcuuua

SEQ ID NO: 4063421 - RNA, 20 nt, Staphylococcus aureus subsp. aureus N315
accguuuuuuauaaaucauu

SEQ ID NO: 4063422 - RNA, 16 nt, Staphylococcus aureus subsp. aureus N315
accuaaaaacagcagu

SEQ ID NO: 4063423 - RNA, 12 nt, Staphylococcus aureus subsp. aureus N315
accuaaaauacc

SEQ ID NO: 4063424 - RNA, 19 nt, Staphylococcus aureus subsp. aureus N315
accuaaaugauuaauaaca

SEQ ID NO: 4063425 - RNA, 19 nt, Staphylococcus aureus subsp. aureus N315
accuaagcugauuaaaaug

SEQ ID NO: 4063426 - RNA, 16 nt, Staphylococcus aureus subsp. aureus N315
accuaaguuaauuuau

SEQ ID NO: 4063427 - RNA, 23 nt, Staphylococcus aureus subsp. aureus N315
accuaauauauuacuaaccuauu

SEQ ID NO: 4063428 - RNA, 16 nt, Staphylococcus aureus subsp. aureus N315
accuaaucugcaacga

SEQ ID NO: 4063429 - RNA, 22 nt, Staphylococcus aureus subsp. aureus N315
accuaauuguuaagagguuuug

SEQ ID NO: 4063430 - RNA, 12 nt, Staphylococcus aureus subsp. aureus N315
accuacaaauau

SEQ ID NO: 4063431 - RNA, 18 nt, Staphylococcus aureus subsp. aureus N315
accuacaaauauguaauc

SEQ ID NO: 4063432 - RNA, 14 nt, Staphylococcus aureus subsp. aureus N315
accuacaaauauuu

SEQ ID NO: 4063433 - RNA, 14 nt, Staphylococcus aureus subsp. aureus N315
accuacaacaccaa

SEQ ID NO: 4063434 - RNA, 20 nt, Staphylococcus aureus subsp. aureus N315
accuacaacgaagaauccua

SEQ ID NO: 4063435 - RNA, 16 nt, Staphylococcus aureus subsp. aureus N315
accuacacggucccaa

SEQ ID NO: 4063436 - RNA, 17 nt, Staphylococcus aureus subsp. aureus N315
accuacacggucccaag

SEQ ID NO: 4063437 - RNA, 21 nt, Staphylococcus aureus subsp. aureus N315
accuacgauucgaaauaggua

SEQ ID NO: 4063438 - RNA, 19 nt, Staphylococcus aureus subsp. aureus N315
accuacuuugauauguuuc

SEQ ID NO: 4063439 - RNA, 22 nt, Staphylococcus aureus subsp. aureus N315
accuacuuugauauguuuccuc

SEQ ID NO: 4063440 - RNA, 18 nt, Staphylococcus aureus subsp. aureus N315
accuacuuuuucaauaug

SEQ ID NO: 4063441 - RNA, 19 nt, Staphylococcus aureus subsp. aureus N315
accuacuuuuucaauaugu

SEQ ID NO: 4063442 - RNA, 19 nt, Staphylococcus aureus subsp. aureus N315
accuagggauaauuuuauu

SEQ ID NO: 4063443 - RNA, 13 nt, Staphylococcus aureus subsp. aureus N315
accuauaccucgu

SEQ ID NO: 4063444 - RNA, 14 nt, Staphylococcus aureus subsp. aureus N315
accuauauuaagca

SEQ ID NO: 4063445 - RNA, 21 nt, Staphylococcus aureus subsp. aureus N315
accuaucccuguaaaaccaua

SEQ ID NO: 4063446 - RNA, 18 nt, Staphylococcus aureus subsp. aureus N315
accuaugauauaugcugc

SEQ ID NO: 4063447 - RNA, 18 nt, Staphylococcus aureus subsp. aureus N315
accuauuaaaauaaacca

SEQ ID NO: 4063448 - RNA, 15 nt, Staphylococcus aureus subsp. aureus N315
acgcauuuuaaauaa

SEQ ID NO: 4063449 - RNA, 18 nt, Staphylococcus aureus subsp. aureus N315
acgcauuuuaaauaaaau

SEQ ID NO: 4063450 - RNA, 21 nt, Staphylococcus aureus subsp. aureus N315
acgccaaauaucaguaauaau

SEQ ID NO: 4063451 - RNA, 15 nt, Staphylococcus aureus subsp. aureus N315
acgccauaagaaaau

SEQ ID NO: 4063452 - RNA, 23 nt, Staphylococcus aureus subsp. aureus N315
acgccuggaaucgcguuuaacaa

SEQ ID NO: 4063453 - RNA, 13 nt, Staphylococcus aureus subsp. aureus N315
acgccuuuccauu

SEQ ID NO: 4063454 - RNA, 22 nt, Staphylococcus aureus subsp. aureus N315
acgcuaauggaugaauauauug

SEQ ID NO: 4063455 - RNA, 15 nt, Staphylococcus aureus subsp. aureus N315
acgcuaauuuuacuc

SEQ ID NO: 4063456 - RNA, 21 nt, Staphylococcus aureus subsp. aureus N315
acgcuagcauaucuuuaucau

SEQ ID NO: 4063457 - RNA, 19 nt, Staphylococcus aureus subsp. aureus N315
acgcucaugaguuucucau

SEQ ID NO: 4063458 - RNA, 23 nt, Staphylococcus aureus subsp. aureus N315
acgcucaugaguuucucaucuac

SEQ ID NO: 4063459 - RNA, 22 nt, Staphylococcus aureus subsp. aureus N315
acgcugaaauuuuuuagugaaa

SEQ ID NO: 4063460 - RNA, 16 nt, Staphylococcus aureus subsp. aureus N315
acgcugguaauauuuu

SEQ ID NO: 4063461 - RNA, 19 nt, Staphylococcus aureus subsp. aureus N315
acgcugguaauauuuuugu

SEQ ID NO: 4063462 - RNA, 15 nt, Staphylococcus aureus subsp. aureus N315
acgcuucaauuauuu

SEQ ID NO: 4063463 - RNA, 13 nt, Staphylococcus aureus subsp. aureus N315
acgcuugauaaaa

SEQ ID NO: 4063464 - RNA, 15 nt, Staphylococcus aureus subsp. aureus N315
acgcuuuuuaaaaaa

SEQ ID NO: 4063465 - RNA, 16 nt, Staphylococcus aureus subsp. aureus N315
acggaacuacuacauu

SEQ ID NO: 4063466 - RNA, 14 nt, Staphylococcus aureus subsp. aureus N315
acggaauaacuuuu

SEQ ID NO: 4063467 - RNA, 17 nt, Staphylococcus aureus subsp. aureus N315
acggcacauucauaccg

SEQ ID NO: 4063468 - RNA, 14 nt, Staphylococcus aureus subsp. aureus N315
acggcugcuuuaac

SEQ ID NO: 4063469 - RNA, 16 nt, Staphylococcus aureus subsp. aureus N315
acggcugcuuuaacug

SEQ ID NO: 4063470 - RNA, 16 nt, Staphylococcus aureus subsp. aureus N315
acgggugguuuuuaau

SEQ ID NO: 4063471 - RNA, 13 nt, Staphylococcus aureus subsp. aureus N315
acgguauaucauc

SEQ ID NO: 4063472 - RNA, 21 nt, Staphylococcus aureus subsp. aureus N315
acgguauuuucaaaacugcca

SEQ ID NO: 4063473 - RNA, 22 nt, Staphylococcus aureus subsp. aureus N315
acgguauuuucaaaacugccaa

SEQ ID NO: 4063474 - RNA, 19 nt, Staphylococcus aureus subsp. aureus N315
acguaauccuuggaaacga

SEQ ID NO: 4063475 - RNA, 14 nt, Staphylococcus aureus subsp. aureus N315
acguaaugaaucaa

SEQ ID NO: 4063476 - RNA, 16 nt, Staphylococcus aureus subsp. aureus N315
acguaaugaaucaauu

SEQ ID NO: 4063477 - RNA, 16 nt, Staphylococcus aureus subsp. aureus N315
acguauacaaauugau

SEQ ID NO: 4063478 - RNA, 20 nt, Staphylococcus aureus subsp. aureus N315
acguauagaugcuaauguaa

SEQ ID NO: 4063479 - RNA, 17 nt, Staphylococcus aureus subsp. aureus N315
acguauauaaguuaaaa

SEQ ID NO: 4063480 - RNA, 18 nt, Staphylococcus aureus subsp. aureus N315
acguauauaaguuaaaau

SEQ ID NO: 4063481 - RNA, 23 nt, Staphylococcus aureus subsp. aureus N315
acguauauacgauugaguugaaa

SEQ ID NO: 4063482 - RNA, 17 nt, Staphylococcus aureus subsp. aureus N315
acguaucaagaaaaagu

SEQ ID NO: 4063483 - RNA, 16 nt, Staphylococcus aureus subsp. aureus N315
acguaucauuuaaaau

SEQ ID NO: 4063484 - RNA, 15 nt, Staphylococcus aureus subsp. aureus N315
acgucacuuuauuaa

SEQ ID NO: 4063485 - RNA, 19 nt, Staphylococcus aureus subsp. aureus N315
acgucacuuuauuaaauaa

SEQ ID NO: 4063486 - RNA, 14 nt, Staphylococcus aureus subsp. aureus N315
acgucauuuuuaau

SEQ ID NO: 4063487 - RNA, 20 nt, Staphylococcus aureus subsp. aureus N315
acgucgaauguuucuucguu

SEQ ID NO: 4063488 - RNA, 10 nt, Staphylococcus aureus subsp. aureus N315
acgucuaccu

SEQ ID NO: 4063489 - RNA, 21 nt, Staphylococcus aureus subsp. aureus N315
acgucuuuccauuuaucaaca

SEQ ID NO: 4063490 - RNA, 16 nt, Staphylococcus aureus subsp. aureus N315
acgugcuuuaaaguug

SEQ ID NO: 4063491 - RNA, 18 nt, Staphylococcus aureus subsp. aureus N315
acgugguugguuaccauc

SEQ ID NO: 4063492 - RNA, 21 nt, Staphylococcus aureus subsp. aureus N315
acguguguuuucuuuucaaaa

SEQ ID NO: 4063493 - RNA, 16 nt, Staphylococcus aureus subsp. aureus N315
acguucaucuaauuuu

SEQ ID NO: 4063494 - RNA, 22 nt, Staphylococcus aureus subsp. aureus N315
acguucuugguauuuuuuaaau

SEQ ID NO: 4063495 - RNA, 21 nt, Staphylococcus aureus subsp. aureus N315
acguuuaauaccuaugauaua

SEQ ID NO: 4063496 - RNA, 15 nt, Staphylococcus aureus subsp. aureus N315
acguuuccaaucuau

SEQ ID NO: 4063497 - RNA, 16 nt, Staphylococcus aureus subsp. aureus N315
acguuugcauauccuu

SEQ ID NO: 4063498 - RNA, 19 nt, Staphylococcus aureus subsp. aureus N315
acguuuuaaauaaaugacu

SEQ ID NO: 4063499 - RNA, 16 nt, Staphylococcus aureus subsp. aureus N315
acguuuucuagguaau

SEQ ID NO: 4063500 - RNA, 20 nt, Staphylococcus aureus subsp. aureus N315
acguuuugguuguucuuuuu

SEQ ID NO: 4063501 - RNA, 15 nt, Staphylococcus aureus subsp. aureus N315
acguuuuugaaucag

SEQ ID NO: 4063502 - RNA, 15 nt, Staphylococcus aureus subsp. aureus N315
acguuuuuuuauaaa

SEQ ID NO: 4063503 - RNA, 15 nt, Staphylococcus aureus subsp. aureus N315
acuaaaaauauauuu

SEQ ID NO: 4063504 - RNA, 16 nt, Staphylococcus aureus subsp. aureus N315
acuaaaaauauauuuc

SEQ ID NO: 4063505 - RNA, 19 nt, Staphylococcus aureus subsp. aureus N315
acuaaaacaaauucauauu

SEQ ID NO: 4063506 - RNA, 20 nt, Staphylococcus aureus subsp. aureus N315
acuaaaacaugauacguggu

SEQ ID NO: 4063507 - RNA, 19 nt, Staphylococcus aureus subsp. aureus N315
acuaaaaguguuaugaauu

SEQ ID NO: 4063508 - RNA, 21 nt, Staphylococcus aureus subsp. aureus N315
acuaaaccgauuaauauaaua

SEQ ID NO: 4063509 - RNA, 13 nt, Staphylococcus aureus subsp. aureus N315
acuaaacgauaaa

SEQ ID NO: 4063510 - RNA, 16 nt, Staphylococcus aureus subsp. aureus N315
acuaaacgauaaauua

SEQ ID NO: 4063511 - RNA, 21 nt, Staphylococcus aureus subsp. aureus N315
acuaaacgauaaauuaacuua

SEQ ID NO: 4063512 - RNA, 14 nt, Staphylococcus aureus subsp. aureus N315
acuaaacuuuucuu

SEQ ID NO: 4063513 - RNA, 16 nt, Staphylococcus aureus subsp. aureus N315
acuaaacuuuucuuca

SEQ ID NO: 4063514 - RNA, 18 nt, Staphylococcus aureus subsp. aureus N315
acuaaagguauucuauuu

SEQ ID NO: 4063515 - RNA, 13 nt, Staphylococcus aureus subsp. aureus N315
acuaaaucauuuu

SEQ ID NO: 4063516 - RNA, 12 nt, Staphylococcus aureus subsp. aureus N315
acuaaaugaauu

SEQ ID NO: 4063517 - RNA, 22 nt, Staphylococcus aureus subsp. aureus N315
acuaaaugaauugcuuguucuu

SEQ ID NO: 4063518 - RNA, 14 nt, Staphylococcus aureus subsp. aureus N315
acuaaauuaaaagu

SEQ ID NO: 4063519 - RNA, 16 nt, Staphylococcus aureus subsp. aureus N315
acuaaauucaauaauc

SEQ ID NO: 4063520 - RNA, 18 nt, Staphylococcus aureus subsp. aureus N315
acuaacaaccguuuuaag

SEQ ID NO: 4063521 - RNA, 20 nt, Staphylococcus aureus subsp. aureus N315
acuaacauaauuuuuauuua

SEQ ID NO: 4063522 - RNA, 16 nt, Staphylococcus aureus subsp. aureus N315
acuaaccuauuaaaau

SEQ ID NO: 4063523 - RNA, 17 nt, Staphylococcus aureus subsp. aureus N315
acuaaccuauuaaaaua

SEQ ID NO: 4063524 - RNA, 21 nt, Staphylococcus aureus subsp. aureus N315
acuaacguaaaggugauauuu

SEQ ID NO: 4063525 - RNA, 22 nt, Staphylococcus aureus subsp. aureus N315
acuaacguaaaggugauauuug

SEQ ID NO: 4063526 - RNA, 15 nt, Staphylococcus aureus subsp. aureus N315
acuaacugaagacac

SEQ ID NO: 4063527 - RNA, 17 nt, Staphylococcus aureus subsp. aureus N315
acuaagaccaugagaaa

SEQ ID NO: 4063528 - RNA, 21 nt, Staphylococcus aureus subsp. aureus N315
acuaagauaucuggauuaacu

SEQ ID NO: 4063529 - RNA, 19 nt, Staphylococcus aureus subsp. aureus N315
acuaaguaaccaagucuaa

SEQ ID NO: 4063530 - RNA, 17 nt, Staphylococcus aureus subsp. aureus N315
acuaaguauaguguuaa

SEQ ID NO: 4063531 - RNA, 17 nt, Staphylococcus aureus subsp. aureus N315
acuaagugaacuauuaa

SEQ ID NO: 4063532 - RNA, 23 nt, Staphylococcus aureus subsp. aureus N315
acuaagugaacuauuaaaaccaa

SEQ ID NO: 4063533 - RNA, 20 nt, Staphylococcus aureus subsp. aureus N315
acuaagugaauuaucuauau

SEQ ID NO: 4063534 - RNA, 20 nt, Staphylococcus aureus subsp. aureus N315
acuaaguuauuuaguacaua

SEQ ID NO: 4063535 - RNA, 17 nt, Staphylococcus aureus subsp. aureus N315
acucaggcuuaauuaau

SEQ ID NO: 4063536 - RNA, 16 nt, Staphylococcus aureus subsp. aureus N315
acucaguuuauugagg

SEQ ID NO: 4063537 - RNA, 14 nt, Staphylococcus aureus subsp. aureus N315
acucauaaucaagu

SEQ ID NO: 4063538 - RNA, 21 nt, Staphylococcus aureus subsp. aureus N315
acucauacaaauuuuuuuuau

SEQ ID NO: 4063539 - RNA, 16 nt, Staphylococcus aureus subsp. aureus N315
acucauaccaaaaaca

SEQ ID NO: 4063540 - RNA, 19 nt, Staphylococcus aureus subsp. aureus N315
acucauaccaaaaacauua

SEQ ID NO: 4063541 - RNA, 21 nt, Staphylococcus aureus subsp. aureus N315
acucauaccaaaaacauuaac

SEQ ID NO: 4063542 - RNA, 21 nt, Staphylococcus aureus subsp. aureus N315
acucaucuguccgauaucuuu

SEQ ID NO: 4063543 - RNA, 23 nt, Staphylococcus aureus subsp. aureus N315
acucauuauaaaugaaucgcuuu

SEQ ID NO: 4063544 - RNA, 16 nt, Staphylococcus aureus subsp. aureus N315
acucauuuauaaacau

SEQ ID NO: 4063545 - RNA, 17 nt, Staphylococcus aureus subsp. aureus N315
acucauuuauaaacauu

SEQ ID NO: 4063546 - RNA, 12 nt, Staphylococcus aureus subsp. aureus N315
acucauuuucug

SEQ ID NO: 4063547 - RNA, 20 nt, Staphylococcus aureus subsp. aureus N315
acucccgcauuauuauuaaa

SEQ ID NO: 4063548 - RNA, 14 nt, Staphylococcus aureus subsp. aureus N315
acucccuuuuuaaa

SEQ ID NO: 4063549 - RNA, 15 nt, Staphylococcus aureus subsp. aureus N315
acuccuccaaagcua

SEQ ID NO: 4063550 - RNA, 19 nt, Staphylococcus aureus subsp. aureus N315
acuccuuaaacaaauaaau

SEQ ID NO: 4063551 - RNA, 15 nt, Staphylococcus aureus subsp. aureus N315
acuccuuauuuuucg

SEQ ID NO: 4063552 - RNA, 24 nt, Staphylococcus aureus subsp. aureus N315
acucguaaauuuuaucuaaacauu

SEQ ID NO: 4063553 - RNA, 15 nt, Staphylococcus aureus subsp. aureus N315
acucguaaucauagc

SEQ ID NO: 4063554 - RNA, 19 nt, Staphylococcus aureus subsp. aureus N315
acucuaaaaguuguaauuu

SEQ ID NO: 4063555 - RNA, 12 nt, Staphylococcus aureus subsp. aureus N315
acucuaaaggaa

SEQ ID NO: 4063556 - RNA, 18 nt, Staphylococcus aureus subsp. aureus N315
acucuagagguaaaucua

SEQ ID NO: 4063557 - RNA, 16 nt, Staphylococcus aureus subsp. aureus N315
acucuccuuuuuuaaa

SEQ ID NO: 4063558 - RNA, 19 nt, Staphylococcus aureus subsp. aureus N315
acucugagcacuuagcaau

SEQ ID NO: 4063559 - RNA, 22 nt, Staphylococcus aureus subsp. aureus N315
acucugauauugaucugauuuc

SEQ ID NO: 4063560 - RNA, 24 nt, Staphylococcus aureus subsp. aureus N315
acucuucaguacgaacaacuaaca

SEQ ID NO: 4063561 - RNA, 18 nt, Staphylococcus aureus subsp. aureus N315
acugaaacuaaauuaaaa

SEQ ID NO: 4063562 - RNA, 20 nt, Staphylococcus aureus subsp. aureus N315
acugaaauuucauaaaguuu

SEQ ID NO: 4063563 - RNA, 15 nt, Staphylococcus aureus subsp. aureus N315
acugaaauuuuuccg

SEQ ID NO: 4063564 - RNA, 21 nt, Staphylococcus aureus subsp. aureus N315
acugaagacaccuuaucacuu

SEQ ID NO: 4063565 - RNA, 17 nt, Staphylococcus aureus subsp. aureus N315
acugagaaaucuuaaag

SEQ ID NO: 4063566 - RNA, 19 nt, Staphylococcus aureus subsp. aureus N315
acugagaaaucuuaaagau

SEQ ID NO: 4063567 - RNA, 19 nt, Staphylococcus aureus subsp. aureus N315
acugagcaacaaaagaugu

SEQ ID NO: 4063568 - RNA, 22 nt, Staphylococcus aureus subsp. aureus N315
acugauaaaaggggaaaucauu

SEQ ID NO: 4063569 - RNA, 13 nt, Staphylococcus aureus subsp. aureus N315
acugauaauacug

SEQ ID NO: 4063570 - RNA, 22 nt, Staphylococcus aureus subsp. aureus N315
acugauucaccagguuuuuuau

SEQ ID NO: 4063571 - RNA, 18 nt, Staphylococcus aureus subsp. aureus N315
acugauuuuguuucaaac

SEQ ID NO: 4063572 - RNA, 18 nt, Staphylococcus aureus subsp. aureus N315
acugcaacaccacacagc

SEQ ID NO: 4063573 - RNA, 21 nt, Staphylococcus aureus subsp. aureus N315
acugcaacaccacacagcauu

SEQ ID NO: 4063574 - RNA, 13 nt, Staphylococcus aureus subsp. aureus N315
acugcaauuauuu

SEQ ID NO: 4063575 - RNA, 19 nt, Staphylococcus aureus subsp. aureus N315
acugcacaucauaauaaau

SEQ ID NO: 4063576 - RNA, 14 nt, Staphylococcus aureus subsp. aureus N315
acugcauauaaagu

SEQ ID NO: 4063577 - RNA, 16 nt, Staphylococcus aureus subsp. aureus N315
acugcauauaaaguca

SEQ ID NO: 4063578 - RNA, 16 nt, Staphylococcus aureus subsp. aureus N315
acugccaauaaaaugc

SEQ ID NO: 4063579 - RNA, 17 nt, Staphylococcus aureus subsp. aureus N315
acugccauauagauauu

SEQ ID NO: 4063580 - RNA, 17 nt, Staphylococcus aureus subsp. aureus N315
acugccauauguuuuag

SEQ ID NO: 4063581 - RNA, 20 nt, Staphylococcus aureus subsp. aureus N315
acugccauucuuuuucucaa

SEQ ID NO: 4063582 - RNA, 23 nt, Staphylococcus aureus subsp. aureus N315
acugccuaauacacuugauaaaa

SEQ ID NO: 4063583 - RNA, 16 nt, Staphylococcus aureus subsp. aureus N315
acugccuuuuuguaau

SEQ ID NO: 4063584 - RNA, 16 nt, Staphylococcus aureus subsp. aureus N315
acugcgacauguccau

SEQ ID NO: 4063585 - RNA, 14 nt, Staphylococcus aureus subsp. aureus N315
acugcuaauuuuuu

SEQ ID NO: 4063586 - RNA, 19 nt, Staphylococcus aureus subsp. aureus N315
acugcuaauuuuuucauca

SEQ ID NO: 4063587 - RNA, 22 nt, Staphylococcus aureus subsp. aureus N315
acugcuaauuuuuucaucauuc

SEQ ID NO: 4063588 - RNA, 20 nt, Staphylococcus aureus subsp. aureus N315
acugcuguucucuauuuaua

SEQ ID NO: 4063589 - RNA, 15 nt, Staphylococcus aureus subsp. aureus N315
acugcuguucuuuuu

SEQ ID NO: 4063590 - RNA, 16 nt, Staphylococcus aureus subsp. aureus N315
acugcuuucaaguaau

SEQ ID NO: 4063591 - RNA, 22 nt, Staphylococcus aureus subsp. aureus N315
acugcuuuggacacaauaccuu

SEQ ID NO: 4063592 - RNA, 23 nt, Staphylococcus aureus subsp. aureus N315
acugcuuuuuuauucuaauacaa

SEQ ID NO: 4063593 - RNA, 13 nt, Staphylococcus aureus subsp. aureus N315
acuguaaaacaau

SEQ ID NO: 4063594 - RNA, 15 nt, Staphylococcus aureus subsp. aureus N315
acuguaaaauucuau

SEQ ID NO: 4063595 - RNA, 15 nt, Staphylococcus aureus subsp. aureus N315
acuguaguacuauag

SEQ ID NO: 4063596 - RNA, 18 nt, Staphylococcus aureus subsp. aureus N315
acuguaguggaagacaau

SEQ ID NO: 4063597 - RNA, 23 nt, Staphylococcus aureus subsp. aureus N315
acuguauaaauaaccgcacuuuc

SEQ ID NO: 4063598 - RNA, 19 nt, Staphylococcus aureus subsp. aureus N315
acuguauaaggauguacua

SEQ ID NO: 4063599 - RNA, 12 nt, Staphylococcus aureus subsp. aureus N315
acuguauaccuc

SEQ ID NO: 4063600 - RNA, 21 nt, Staphylococcus aureus subsp. aureus N315
acuguauaccucuuagcacuu

SEQ ID NO: 4063601 - RNA, 16 nt, Staphylococcus aureus subsp. aureus N315
acugucgguucaucua

SEQ ID NO: 4063602 - RNA, 15 nt, Staphylococcus aureus subsp. aureus N315
acugucucaucuucu

SEQ ID NO: 4063603 - RNA, 23 nt, Staphylococcus aureus subsp. aureus N315
acugucucaucuucuaaaucaau

SEQ ID NO: 4063604 - RNA, 18 nt, Staphylococcus aureus subsp. aureus N315
acugugauucauucguac

SEQ ID NO: 4063605 - RNA, 22 nt, Staphylococcus aureus subsp. aureus N315
acuguucuuucgucuuguaaac

SEQ ID NO: 4063606 - RNA, 18 nt, Staphylococcus aureus subsp. aureus N315
acuguugacauuugacca

SEQ ID NO: 4063607 - RNA, 15 nt, Staphylococcus aureus subsp. aureus N315
acuguuggaauaccu

SEQ ID NO: 4063608 - RNA, 16 nt, Staphylococcus aureus subsp. aureus N315
acuguuggaauaccuu

SEQ ID NO: 4063609 - RNA, 14 nt, Staphylococcus aureus subsp. aureus N315
acuguugguuugau

SEQ ID NO: 4063610 - RNA, 16 nt, Staphylococcus aureus subsp. aureus N315
acuguuugcuuuauca

SEQ ID NO: 4063611 - RNA, 18 nt, Staphylococcus aureus subsp. aureus N315
acuguuuuauuaugaauu

SEQ ID NO: 4063612 - RNA, 15 nt, Staphylococcus aureus subsp. aureus N315
acuuaaaaaugaaau

SEQ ID NO: 4063613 - RNA, 17 nt, Staphylococcus aureus subsp. aureus N315
acuuaaaacuauaaccu

SEQ ID NO: 4063614 - RNA, 12 nt, Staphylococcus aureus subsp. aureus N315
acuuaaaauuua

SEQ ID NO: 4063615 - RNA, 13 nt, Staphylococcus aureus subsp. aureus N315
acuuaaaauuuaa

SEQ ID NO: 4063616 - RNA, 15 nt, Staphylococcus aureus subsp. aureus N315
acuuaaagauuuacc

SEQ ID NO: 4063617 - RNA, 13 nt, Staphylococcus aureus subsp. aureus N315
acuuaaccauuua

SEQ ID NO: 4063618 - RNA, 15 nt, Staphylococcus aureus subsp. aureus N315
acuuaacuuaagcuc

SEQ ID NO: 4063619 - RNA, 13 nt, Staphylococcus aureus subsp. aureus N315
acuuaauaucaua

SEQ ID NO: 4063620 - RNA, 16 nt, Staphylococcus aureus subsp. aureus N315
acuuaaugcuucaaau

SEQ ID NO: 4063621 - RNA, 17 nt, Staphylococcus aureus subsp. aureus N315
acuuaaugcuucaaaug

SEQ ID NO: 4063622 - RNA, 22 nt, Staphylococcus aureus subsp. aureus N315
acuuuaaaguuaaaguuuuguu

SEQ ID NO: 4063623 - RNA, 19 nt, Staphylococcus aureus subsp. aureus N315
acuuuaacaguuguaauca

SEQ ID NO: 4063624 - RNA, 20 nt, Staphylococcus aureus subsp. aureus N315
acuuuaacauaucgcgcauc

SEQ ID NO: 4063625 - RNA, 22 nt, Staphylococcus aureus subsp. aureus N315
acuuuaacauaucgcgcaucaa

SEQ ID NO: 4063626 - RNA, 11 nt, Staphylococcus aureus subsp. aureus N315
acuuuaacuuc

SEQ ID NO: 4063627 - RNA, 20 nt, Staphylococcus aureus subsp. aureus N315
acuuuaauaccagcauccau

SEQ ID NO: 4063628 - RNA, 22 nt, Staphylococcus aureus subsp. aureus N315
acuuuaauaccagcauccauug

SEQ ID NO: 4063629 - RNA, 23 nt, Staphylococcus aureus subsp. aureus N315
acuuuaauaucagguacaaaugg

SEQ ID NO: 4063630 - RNA, 15 nt, Staphylococcus aureus subsp. aureus N315
acuuuaauuaaagca

SEQ ID NO: 4063631 - RNA, 20 nt, Staphylococcus aureus subsp. aureus N315
acuuuaauugcucuuuaaca

SEQ ID NO: 4063632 - RNA, 21 nt, Staphylococcus aureus subsp. aureus N315
acuuuaauuuagugaaacaau

SEQ ID NO: 4063633 - RNA, 13 nt, Staphylococcus aureus subsp. aureus N315
acuuuaauuuuuc

SEQ ID NO: 4063634 - RNA, 14 nt, Staphylococcus aureus subsp. aureus N315
acuuuaauuuuuca

SEQ ID NO: 4063635 - RNA, 15 nt, Staphylococcus aureus subsp. aureus N315
acuuuaauuuuucau

SEQ ID NO: 4063636 - RNA, 20 nt, Staphylococcus aureus subsp. aureus N315
acuuuaccaauaucaugcaa

SEQ ID NO: 4063637 - RNA, 13 nt, Staphylococcus aureus subsp. aureus N315
acuuuaccaucuu

SEQ ID NO: 4063638 - RNA, 22 nt, Staphylococcus aureus subsp. aureus N315
acuuuagaaagugauucccaaa

SEQ ID NO: 4063639 - RNA, 20 nt, Staphylococcus aureus subsp. aureus N315
acuuuagauaaacucuaaau

SEQ ID NO: 4063640 - RNA, 12 nt, Staphylococcus aureus subsp. aureus N315
acuuuauauaua

SEQ ID NO: 4063641 - RNA, 18 nt, Staphylococcus aureus subsp. aureus N315
acuuuaugaaauuucagu

SEQ ID NO: 4063642 - RNA, 22 nt, Staphylococcus aureus subsp. aureus N315
acuuuauuucuauaucuauuua

SEQ ID NO: 4063643 - RNA, 20 nt, Staphylococcus aureus subsp. aureus N315
acuuucaaacaaaucuuuua

SEQ ID NO: 4063644 - RNA, 15 nt, Staphylococcus aureus subsp. aureus N315
acuuucacuuuuuau

SEQ ID NO: 4063645 - RNA, 20 nt, Staphylococcus aureus subsp. aureus N315
acuuucaguaauuguuacua

SEQ ID NO: 4063646 - RNA, 17 nt, Staphylococcus aureus subsp. aureus N315
acuuuccgccuucaauc

SEQ ID NO: 4063647 - RNA, 14 nt, Staphylococcus aureus subsp. aureus N315
acuuucgaucuucu

SEQ ID NO: 4063648 - RNA, 16 nt, Staphylococcus aureus subsp. aureus N315
acuuucgcuugcaaag

SEQ ID NO: 4063649 - RNA, 16 nt, Staphylococcus aureus subsp. aureus N315
acuuucguauuuuucu

SEQ ID NO: 4063650 - RNA, 22 nt, Staphylococcus aureus subsp. aureus N315
acuuucuaagauacguugaugu

SEQ ID NO: 4063651 - RNA, 21 nt, Staphylococcus aureus subsp. aureus N315
acuuucuacucugauuacaua

SEQ ID NO: 4063652 - RNA, 22 nt, Staphylococcus aureus subsp. aureus N315
acuuucucaucuauuuaauaau

SEQ ID NO: 4063653 - RNA, 18 nt, Staphylococcus aureus subsp. aureus N315
acuuucuuuuguuuuuau

SEQ ID NO: 4063654 - RNA, 17 nt, Staphylococcus aureus subsp. aureus N315
acuuugauauguuuccu

SEQ ID NO: 4063655 - RNA, 15 nt, Staphylococcus aureus subsp. aureus N315
acuuuggcaaaguca

SEQ ID NO: 4063656 - RNA, 17 nt, Staphylococcus aureus subsp. aureus N315
acuuuggucaacuuuuu

SEQ ID NO: 4063657 - RNA, 19 nt, Staphylococcus aureus subsp. aureus N315
acuuugucuuuaaugaaag

SEQ ID NO: 4063658 - RNA, 20 nt, Staphylococcus aureus subsp. aureus N315
acuuuguggauucucuuuau

SEQ ID NO: 4063659 - RNA, 21 nt, Staphylococcus aureus subsp. aureus N315
acuuugugugcuuuaucucua

SEQ ID NO: 4063660 - RNA, 13 nt, Staphylococcus aureus subsp. aureus N315
acuuuguucaugu

SEQ ID NO: 4063661 - RNA, 19 nt, Staphylococcus aureus subsp. aureus N315
acuuuguucugcuuuuucu

SEQ ID NO: 4063662 - RNA, 21 nt, Staphylococcus aureus subsp. aureus N315
acuuuguucugcuuuuucuuu

SEQ ID NO: 4063663 - RNA, 22 nt, Staphylococcus aureus subsp. aureus N315
acuuuguucugcuuuuucuuua

SEQ ID NO: 4063664 - RNA, 16 nt, Staphylococcus aureus subsp. aureus N315
acuuuuacaaucauca

SEQ ID NO: 4063665 - RNA, 23 nt, Staphylococcus aureus subsp. aureus N315
acuuuuacuuucucaucuauuua

SEQ ID NO: 4063666 - RNA, 15 nt, Staphylococcus aureus subsp. aureus N315
acuuuuagaguuuuu

SEQ ID NO: 4063667 - RNA, 22 nt, Staphylococcus aureus subsp. aureus N315
acuuuuagaguuuuuauuauua

SEQ ID NO: 4063668 - RNA, 15 nt, Staphylococcus aureus subsp. aureus N315
acuuuuauagaaaau

SEQ ID NO: 4063669 - RNA, 15 nt, Staphylococcus aureus subsp. aureus N315
acuuuuauugccaua

SEQ ID NO: 4063670 - RNA, 14 nt, Staphylococcus aureus subsp. aureus N315
acuuuucauauaaa

SEQ ID NO: 4063671 - RNA, 14 nt, Staphylococcus aureus subsp. aureus N315
acuuuucuaaacaa

SEQ ID NO: 4063672 - RNA, 23 nt, Staphylococcus aureus subsp. aureus N315
acuuuucucgauuaauuuucuuu

SEQ ID NO: 4063673 - RNA, 11 nt, Staphylococcus aureus subsp. aureus N315
acuuuugauuu

SEQ ID NO: 4063674 - RNA, 14 nt, Staphylococcus aureus subsp. aureus N315
acuuuugcaucaca

SEQ ID NO: 4063675 - RNA, 20 nt, Staphylococcus aureus subsp. aureus N315
acuuuuggucuguugaaguc

SEQ ID NO: 4063676 - RNA, 15 nt, Staphylococcus aureus subsp. aureus N315
acuuuuguuaaaaaa

SEQ ID NO: 4063677 - RNA, 16 nt, Staphylococcus aureus subsp. aureus N315
acuuuuguuaaaaaau

SEQ ID NO: 4063678 - RNA, 19 nt, Staphylococcus aureus subsp. aureus N315
acuuuuguuaaaaaaugga

SEQ ID NO: 4063679 - RNA, 23 nt, Staphylococcus aureus subsp. aureus N315
acuuuuuaaacguacauuuuuau

SEQ ID NO: 4063680 - RNA, 12 nt, Staphylococcus aureus subsp. aureus N315
acuuuuuaaagg

SEQ ID NO: 4063681 - RNA, 14 nt, Staphylococcus aureus subsp. aureus N315
acuuuuuaaaggac

SEQ ID NO: 4063682 - RNA, 15 nt, Staphylococcus aureus subsp. aureus N315
acuuuuuaacugcca

SEQ ID NO: 4063683 - RNA, 17 nt, Staphylococcus aureus subsp. aureus N315
acuuuuuaauuccaaag

SEQ ID NO: 4063684 - RNA, 18 nt, Staphylococcus aureus subsp. aureus N315
acuuuuuauaucaaaauc

SEQ ID NO: 4063685 - RNA, 21 nt, Staphylococcus aureus subsp. aureus N315
acuuuuuauuaguauucaaaa

SEQ ID NO: 4063686 - RNA, 18 nt, Staphylococcus aureus subsp. aureus N315
acuuuuucagaaugaacu

SEQ ID NO: 4063687 - RNA, 22 nt, Staphylococcus aureus subsp. aureus N315
acuuuuugacauauuuuuuaaa

SEQ ID NO: 4063688 - RNA, 16 nt, Staphylococcus aureus subsp. aureus N315
acuuuuugaguaucca

SEQ ID NO: 4063689 - RNA, 22 nt, Staphylococcus aureus subsp. aureus N315
acuuuuugaguauccaauacua

SEQ ID NO: 4063690 - RNA, 20 nt, Staphylococcus aureus subsp. aureus N315
acuuuuuugagcauuuuuau

SEQ ID NO: 4063691 - RNA, 14 nt, Staphylococcus aureus subsp. aureus N315
acuuuuuuguucaa

SEQ ID NO: 4063692 - RNA, 12 nt, Staphylococcus aureus subsp. aureus N315
agaaaaaaugau

SEQ ID NO: 4063693 - RNA, 19 nt, Staphylococcus aureus subsp. aureus N315
agaaaaagugauaauuaaa

SEQ ID NO: 4063694 - RNA, 18 nt, Staphylococcus aureus subsp. aureus N315
agaaaaaguuuuucugac

SEQ ID NO: 4063695 - RNA, 14 nt, Staphylococcus aureus subsp. aureus N315
agaaaaauaugauu

SEQ ID NO: 4063696 - RNA, 18 nt, Staphylococcus aureus subsp. aureus N315
agaaaacauaaauacaaa

SEQ ID NO: 4063697 - RNA, 16 nt, Staphylococcus aureus subsp. aureus N315
agaaaacuagaacuua

SEQ ID NO: 4063698 - RNA, 16 nt, Staphylococcus aureus subsp. aureus N315
agaaaacuauuuuaaa

SEQ ID NO: 4063699 - RNA, 17 nt, Staphylococcus aureus subsp. aureus N315
agaaaacuauuuuaaaa

SEQ ID NO: 4063700 - RNA, 15 nt, Staphylococcus aureus subsp. aureus N315
agaaaagcaguaaga

SEQ ID NO: 4063701 - RNA, 21 nt, Staphylococcus aureus subsp. aureus N315
agaaaagcagucgaacaauga

SEQ ID NO: 4063702 - RNA, 22 nt, Staphylococcus aureus subsp. aureus N315
agaaaagcagucgaacaaugau

SEQ ID NO: 4063703 - RNA, 23 nt, Staphylococcus aureus subsp. aureus N315
agaaaaggcucauuuguuaaauu

SEQ ID NO: 4063704 - RNA, 17 nt, Staphylococcus aureus subsp. aureus N315
agaaaagggcaaaaaag

SEQ ID NO: 4063705 - RNA, 16 nt, Staphylococcus aureus subsp. aureus N315
agaaaaguaaguaaaa

SEQ ID NO: 4063706 - RNA, 20 nt, Staphylococcus aureus subsp. aureus N315
agaaaaguaaguaaaauaaa

SEQ ID NO: 4063707 - RNA, 20 nt, Staphylococcus aureus subsp. aureus N315
agaaaaguauaaauauaaaa

SEQ ID NO: 4063708 - RNA, 15 nt, Staphylococcus aureus subsp. aureus N315
agaaaaugaguacaa

SEQ ID NO: 4063709 - RNA, 21 nt, Staphylococcus aureus subsp. aureus N315
agaauugcaacgcaucacaaa

SEQ ID NO: 4063710 - RNA, 15 nt, Staphylococcus aureus subsp. aureus N315
agaauuuaaaagaga

SEQ ID NO: 4063711 - RNA, 17 nt, Staphylococcus aureus subsp. aureus N315
agaauuuaaaagagaau

SEQ ID NO: 4063712 - RNA, 14 nt, Staphylococcus aureus subsp. aureus N315
agaauuucaucaaa

SEQ ID NO: 4063713 - RNA, 17 nt, Staphylococcus aureus subsp. aureus N315
agaauuucaucaaaucc

SEQ ID NO: 4063714 - RNA, 16 nt, Staphylococcus aureus subsp. aureus N315
agaauuucgaaaagaa

SEQ ID NO: 4063715 - RNA, 17 nt, Staphylococcus aureus subsp. aureus N315
agaauuucgaaaagaaa

SEQ ID NO: 4063716 - RNA, 18 nt, Staphylococcus aureus subsp. aureus N315
agaauuucgaaaagaaau

SEQ ID NO: 4063717 - RNA, 21 nt, Staphylococcus aureus subsp. aureus N315
agaauuucgaaaagaaauucu

SEQ ID NO: 4063718 - RNA, 21 nt, Staphylococcus aureus subsp. aureus N315
agaauuuuaauuaauuaucau

SEQ ID NO: 4063719 - RNA, 17 nt, Staphylococcus aureus subsp. aureus N315
agacaaccgauauaauu

SEQ ID NO: 4063720 - RNA, 20 nt, Staphylococcus aureus subsp. aureus N315
agacaaccgauauaauuaau

SEQ ID NO: 4063721 - RNA, 14 nt, Staphylococcus aureus subsp. aureus N315
agacaauaaaucuu

SEQ ID NO: 4063722 - RNA, 20 nt, Staphylococcus aureus subsp. aureus N315
agacaauaaugcacgcgugc

SEQ ID NO: 4063723 - RNA, 12 nt, Staphylococcus aureus subsp. aureus N315
agacaauauuuu

SEQ ID NO: 4063724 - RNA, 15 nt, Staphylococcus aureus subsp. aureus N315
agacaccuucaauau

SEQ ID NO: 4063725 - RNA, 17 nt, Staphylococcus aureus subsp. aureus N315
agacacggccugcaagu

SEQ ID NO: 4063726 - RNA, 14 nt, Staphylococcus aureus subsp. aureus N315
agacacuuaacuug

SEQ ID NO: 4063727 - RNA, 10 nt, Staphylococcus aureus subsp. aureus N315
agacagaaau

SEQ ID NO: 4063728 - RNA, 13 nt, Staphylococcus aureus subsp. aureus N315
agacauaaaaaaa

SEQ ID NO: 4063729 - RNA, 14 nt, Staphylococcus aureus subsp. aureus N315
agacauaaaaaaag

SEQ ID NO: 4063730 - RNA, 20 nt, Staphylococcus aureus subsp. aureus N315
agacauaaggucuuggacua

SEQ ID NO: 4063731 - RNA, 18 nt, Staphylococcus aureus subsp. aureus N315
agacauacucacaaaaaa

SEQ ID NO: 4063732 - RNA, 19 nt, Staphylococcus aureus subsp. aureus N315
agacaucaucuauuuuuaa

SEQ ID NO: 4063733 - RNA, 15 nt, Staphylococcus aureus subsp. aureus N315
agacaugagauuauu

SEQ ID NO: 4063734 - RNA, 12 nt, Staphylococcus aureus subsp. aureus N315
agacauuaaaaa

SEQ ID NO: 4063735 - RNA, 17 nt, Staphylococcus aureus subsp. aureus N315
agacauuuuaucugaaa

SEQ ID NO: 4063736 - RNA, 12 nt, Staphylococcus aureus subsp. aureus N315
agaccaaauauu

SEQ ID NO: 4063737 - RNA, 16 nt, Staphylococcus aureus subsp. aureus N315
agaccacuauuuuuaa

SEQ ID NO: 4063738 - RNA, 18 nt, Staphylococcus aureus subsp. aureus N315
agaccacuauuuuuaaau

SEQ ID NO: 4063739 - RNA, 22 nt, Staphylococcus aureus subsp. aureus N315
agacccaccguuaaaauauaug

SEQ ID NO: 4063740 - RNA, 17 nt, Staphylococcus aureus subsp. aureus N315
agaccuucaauaucuuc

SEQ ID NO: 4063741 - RNA, 12 nt, Staphylococcus aureus subsp. aureus N315
agacgaacauca

SEQ ID NO: 4063742 - RNA, 16 nt, Staphylococcus aureus subsp. aureus N315
agacgauuucaaugag

SEQ ID NO: 4063743 - RNA, 16 nt, Staphylococcus aureus subsp. aureus N315
agacgcuguuuuaaau

SEQ ID NO: 4063744 - RNA, 17 nt, Staphylococcus aureus subsp. aureus N315
agacguuuuugaaucag

SEQ ID NO: 4063745 - RNA, 18 nt, Staphylococcus aureus subsp. aureus N315
agacuaaaaugaaugaag

SEQ ID NO: 4063746 - RNA, 22 nt, Staphylococcus aureus subsp. aureus N315
agacucaauuucauuugaaaua

SEQ ID NO: 4063747 - RNA, 14 nt, Staphylococcus aureus subsp. aureus N315
agacucacuucuua

SEQ ID NO: 4063748 - RNA, 16 nt, Staphylococcus aureus subsp. aureus N315
agacuccuaaauuauu

SEQ ID NO: 4063749 - RNA, 17 nt, Staphylococcus aureus subsp. aureus N315
agacuccuaaauuauug

SEQ ID NO: 4063750 - RNA, 17 nt, Staphylococcus aureus subsp. aureus N315
agacucuccuuuuuuaa

SEQ ID NO: 4063751 - RNA, 15 nt, Staphylococcus aureus subsp. aureus N315
agacugccaauaaaa

SEQ ID NO: 4063752 - RNA, 20 nt, Staphylococcus aureus subsp. aureus N315
agacugccaauaaaaugcaa

SEQ ID NO: 4063753 - RNA, 17 nt, Staphylococcus aureus subsp. aureus N315
agacuuauucaacguau

SEQ ID NO: 4063754 - RNA, 16 nt, Staphylococcus aureus subsp. aureus N315
agacuucuuucaauua

SEQ ID NO: 4063755 - RNA, 22 nt, Staphylococcus aureus subsp. aureus N315
agacuugguuacuuaguaagga

SEQ ID NO: 4063756 - RNA, 24 nt, Staphylococcus aureus subsp. aureus N315
agacuugguuacuuaguaaggaau

SEQ ID NO: 4063757 - RNA, 16 nt, Staphylococcus aureus subsp. aureus N315
agagaaacaaaacaaa

SEQ ID NO: 4063758 - RNA, 21 nt, Staphylococcus aureus subsp. aureus N315
agagaaacaaaacaaaaaaua

SEQ ID NO: 4063759 - RNA, 23 nt, Staphylococcus aureus subsp. aureus N315
agagaaagaauaaauguuaaaga

SEQ ID NO: 4063760 - RNA, 17 nt, Staphylococcus aureus subsp. aureus N315
agagaaauucgaaaaga

SEQ ID NO: 4063761 - RNA, 20 nt, Staphylococcus aureus subsp. aureus N315
agagaaauucgaaaagaaau

SEQ ID NO: 4063762 - RNA, 21 nt, Staphylococcus aureus subsp. aureus N315
agagaaauucgaaaagaaauu

SEQ ID NO: 4063763 - RNA, 12 nt, Staphylococcus aureus subsp. aureus N315
agagaacagcag

SEQ ID NO: 4063764 - RNA, 20 nt, Staphylococcus aureus subsp. aureus N315
agagaaguuucuauagaauu

SEQ ID NO: 4063765 - RNA, 19 nt, Staphylococcus aureus subsp. aureus N315
agagaauauagauuuugua

SEQ ID NO: 4063766 - RNA, 20 nt, Staphylococcus aureus subsp. aureus N315
agagaaucaauuauugaaaa

SEQ ID NO: 4063767 - RNA, 20 nt, Staphylococcus aureus subsp. aureus N315
agagaauuucgaaaagaaau

SEQ ID NO: 4063768 - RNA, 23 nt, Staphylococcus aureus subsp. aureus N315
agagaauuuuaauuaauuaucau

SEQ ID NO: 4063769 - RNA, 12 nt, Staphylococcus aureus subsp. aureus N315
agagacauuuua

SEQ ID NO: 4063770 - RNA, 17 nt, Staphylococcus aureus subsp. aureus N315
agagacuuauuuuauac

SEQ ID NO: 4063771 - RNA, 13 nt, Staphylococcus aureus subsp. aureus N315
agagaugaaagau

SEQ ID NO: 4063772 - RNA, 13 nt, Staphylococcus aureus subsp. aureus N315
agagaugggcuaa

SEQ ID NO: 4063773 - RNA, 23 nt, Staphylococcus aureus subsp. aureus N315
agagaugggcuaagguuguucua

SEQ ID NO: 4063774 - RNA, 16 nt, Staphylococcus aureus subsp. aureus N315
agagauguauaaaacu

SEQ ID NO: 4063775 - RNA, 15 nt, Staphylococcus aureus subsp. aureus N315
agagccacuaaugau

SEQ ID NO: 4063776 - RNA, 17 nt, Staphylococcus aureus subsp. aureus N315
agaggacgcuuuauucu

SEQ ID NO: 4063777 - RNA, 17 nt, Staphylococcus aureus subsp. aureus N315
agaggagaaagcuaaug

SEQ ID NO: 4063778 - RNA, 17 nt, Staphylococcus aureus subsp. aureus N315
agagguaaaucuguuua

SEQ ID NO: 4063779 - RNA, 17 nt, Staphylococcus aureus subsp. aureus N315
agagguacuagaauuaa

SEQ ID NO: 4063780 - RNA, 19 nt, Staphylococcus aureus subsp. aureus N315
agaggucuccaauacuuuu

SEQ ID NO: 4063781 - RNA, 23 nt, Staphylococcus aureus subsp. aureus N315
agaguaguucggaugagaaaugu

SEQ ID NO: 4063782 - RNA, 16 nt, Staphylococcus aureus subsp. aureus N315
agaguuaauccucauu

SEQ ID NO: 4063783 - RNA, 16 nt, Staphylococcus aureus subsp. aureus N315
agaguuuuuauuauua

SEQ ID NO: 4063784 - RNA, 17 nt, Staphylococcus aureus subsp. aureus N315
agaguuuuuauuauuag

SEQ ID NO: 4063785 - RNA, 18 nt, Staphylococcus aureus subsp. aureus N315
agauaaagcuucgucaau

SEQ ID NO: 4063786 - RNA, 21 nt, Staphylococcus aureus subsp. aureus N315
agauaaauaaaaggcauucuu

SEQ ID NO: 4063787 - RNA, 12 nt, Staphylococcus aureus subsp. aureus N315
agauaaaucauc

SEQ ID NO: 4063788 - RNA, 15 nt, Staphylococcus aureus subsp. aureus N315
agauaaauuaauaug

SEQ ID NO: 4063789 - RNA, 16 nt, Staphylococcus aureus subsp. aureus N315
agauaaauuaauauga

SEQ ID NO: 4063790 - RNA, 20 nt, Staphylococcus aureus subsp. aureus N315
agauaacuagaaugauuaaa

SEQ ID NO: 4063791 - RNA, 15 nt, Staphylococcus aureus subsp. aureus N315
agauaacuagcaaau

SEQ ID NO: 4063792 - RNA, 17 nt, Staphylococcus aureus subsp. aureus N315
agauaaguaauaauaua

SEQ ID NO: 4063793 - RNA, 15 nt, Staphylococcus aureus subsp. aureus N315
agauaauuuucaauu

SEQ ID NO: 4063794 - RNA, 16 nt, Staphylococcus aureus subsp. aureus N315
agauaauuuucaauua

SEQ ID NO: 4063795 - RNA, 23 nt, Staphylococcus aureus subsp. aureus N315
agauacauuaucaagaauaacua

SEQ ID NO: 4063796 - RNA, 16 nt, Staphylococcus aureus subsp. aureus N315
agauaccaaacugccu

SEQ ID NO: 4063797 - RNA, 14 nt, Staphylococcus aureus subsp. aureus N315
agcaauaucaucau

SEQ ID NO: 4063798 - RNA, 19 nt, Staphylococcus aureus subsp. aureus N315
agcaauaucaucauuuaaa

SEQ ID NO: 4063799 - RNA, 21 nt, Staphylococcus aureus subsp. aureus N315
agcaaugcaugcuucucaauu

SEQ ID NO: 4063800 - RNA, 22 nt, Staphylococcus aureus subsp. aureus N315
agcaauuucgauugcguuuucu

SEQ ID NO: 4063801 - RNA, 14 nt, Staphylococcus aureus subsp. aureus N315
agcacaaacuaaaa

SEQ ID NO: 4063802 - RNA, 14 nt, Staphylococcus aureus subsp. aureus N315
agcacaauauuuac

SEQ ID NO: 4063803 - RNA, 17 nt, Staphylococcus aureus subsp. aureus N315
agcacagcgauuaaaug

SEQ ID NO: 4063804 - RNA, 20 nt, Staphylococcus aureus subsp. aureus N315
agcacagcgauuaaaugaug

SEQ ID NO: 4063805 - RNA, 18 nt, Staphylococcus aureus subsp. aureus N315
agcaccguaacauaugua

SEQ ID NO: 4063806 - RNA, 23 nt, Staphylococcus aureus subsp. aureus N315
agcaccguaacauauguacuauu

SEQ ID NO: 4063807 - RNA, 16 nt, Staphylococcus aureus subsp. aureus N315
agcaccuuaccuacuu

SEQ ID NO: 4063808 - RNA, 15 nt, Staphylococcus aureus subsp. aureus N315
agcacgagaaauguc

SEQ ID NO: 4063809 - RNA, 16 nt, Staphylococcus aureus subsp. aureus N315
agcacuaucuuuugcu

SEQ ID NO: 4063810 - RNA, 17 nt, Staphylococcus aureus subsp. aureus N315
agcacuaucuuuugcuu

SEQ ID NO: 4063811 - RNA, 22 nt, Staphylococcus aureus subsp. aureus N315
agcaguaggauaauuucaauuu

SEQ ID NO: 4063812 - RNA, 21 nt, Staphylococcus aureus subsp. aureus N315
agcaguugacuguaaaacaau

SEQ ID NO: 4063813 - RNA, 21 nt, Staphylococcus aureus subsp. aureus N315
agcaguugcacaaauugcaau

SEQ ID NO: 4063814 - RNA, 21 nt, Staphylococcus aureus subsp. aureus N315
agcaguuguugguuuugcaac

SEQ ID NO: 4063815 - RNA, 14 nt, Staphylococcus aureus subsp. aureus N315
agcaguuucugaga

SEQ ID NO: 4063816 - RNA, 21 nt, Staphylococcus aureus subsp. aureus N315
agcauaccuuuauuauuuaau

SEQ ID NO: 4063817 - RNA, 17 nt, Staphylococcus aureus subsp. aureus N315
agcauaucucaagauau

SEQ ID NO: 4063818 - RNA, 13 nt, Staphylococcus aureus subsp. aureus N315
agcauauuucuaa

SEQ ID NO: 4063819 - RNA, 19 nt, Staphylococcus aureus subsp. aureus N315
agcaucacaguguugaauu

SEQ ID NO: 4063820 - RNA, 22 nt, Staphylococcus aureus subsp. aureus N315
agcaucaccaauggcagaugau

SEQ ID NO: 4063821 - RNA, 14 nt, Staphylococcus aureus subsp. aureus N315
agcaucauuuuucg

SEQ ID NO: 4063822 - RNA, 14 nt, Staphylococcus aureus subsp. aureus N315
agcaucgaacaauc

SEQ ID NO: 4063823 - RNA, 19 nt, Staphylococcus aureus subsp. aureus N315
agcaucgauuuauuauuac

SEQ ID NO: 4063824 - RNA, 17 nt, Staphylococcus aureus subsp. aureus N315
agcaucuacaauauuca

SEQ ID NO: 4063825 - RNA, 18 nt, Staphylococcus aureus subsp. aureus N315
agcaucuccaauuuaauc

SEQ ID NO: 4063826 - RNA, 16 nt, Staphylococcus aureus subsp. aureus N315
agcaucugcaugguuu

SEQ ID NO: 4063827 - RNA, 23 nt, Staphylococcus aureus subsp. aureus N315
agcaucugcaugguuugcugguu

SEQ ID NO: 4063828 - RNA, 20 nt, Staphylococcus aureus subsp. aureus N315
agcauuaaauuccaugucaa

SEQ ID NO: 4063829 - RNA, 19 nt, Staphylococcus aureus subsp. aureus N315
agcauuaaucguauuuuua

SEQ ID NO: 4063830 - RNA, 17 nt, Staphylococcus aureus subsp. aureus N315
agcauuacgccaccagu

SEQ ID NO: 4063831 - RNA, 18 nt, Staphylococcus aureus subsp. aureus N315
agcauuagcaaauauuau

SEQ ID NO: 4063832 - RNA, 22 nt, Staphylococcus aureus subsp. aureus N315
agcauuagcaaauauuauuaaa

SEQ ID NO: 4063833 - RNA, 22 nt, Staphylococcus aureus subsp. aureus N315
agcauugagauggucuuuuaau

SEQ ID NO: 4063834 - RNA, 19 nt, Staphylococcus aureus subsp. aureus N315
agcauugggacauaaaauu

SEQ ID NO: 4063835 - RNA, 20 nt, Staphylococcus aureus subsp. aureus N315
agcauugggacauaaaauua

SEQ ID NO: 4063836 - RNA, 22 nt, Staphylococcus aureus subsp. aureus N315
agccaaaucuuuaauaaccuuu

SEQ ID NO: 4063837 - RNA, 23 nt, Staphylococcus aureus subsp. aureus N315
agccaaaucuuuaauaaccuuua

SEQ ID NO: 4063838 - RNA, 16 nt, Staphylococcus aureus subsp. aureus N315
agccaacacauaaaug

SEQ ID NO: 4063839 - RNA, 17 nt, Staphylococcus aureus subsp. aureus N315
agccaagauaaaucauc

SEQ ID NO: 4063840 - RNA, 22 nt, Staphylococcus aureus subsp. aureus N315
agccacagcuuuaaguuauuuu

SEQ ID NO: 4063841 - RNA, 16 nt, Staphylococcus aureus subsp. aureus N315
agccaccuaaaucucc

SEQ ID NO: 4063842 - RNA, 13 nt, Staphylococcus aureus subsp. aureus N315
agccaucaauauu

SEQ ID NO: 4063843 - RNA, 14 nt, Staphylococcus aureus subsp. aureus N315
agccaucuuucuuu

SEQ ID NO: 4063844 - RNA, 20 nt, Staphylococcus aureus subsp. aureus N315
agccaugauacgaugcguga

SEQ ID NO: 4063845 - RNA, 22 nt, Staphylococcus aureus subsp. aureus N315
agccauuauuauuuuuuucuuu

SEQ ID NO: 4063846 - RNA, 17 nt, Staphylococcus aureus subsp. aureus N315
agccauuuguuguaaac

SEQ ID NO: 4063847 - RNA, 23 nt, Staphylococcus aureus subsp. aureus N315
agccauuuguuguaaaccagcua

SEQ ID NO: 4063848 - RNA, 18 nt, Staphylococcus aureus subsp. aureus N315
agccccagcaaauacuuc

SEQ ID NO: 4063849 - RNA, 18 nt, Staphylococcus aureus subsp. aureus N315
agccccuuacaaccuuug

SEQ ID NO: 4063850 - RNA, 16 nt, Staphylococcus aureus subsp. aureus N315
agccccuuacaacuuu

SEQ ID NO: 4063851 - RNA, 14 nt, Staphylococcus aureus subsp. aureus N315
agcccguuaaaaag

SEQ ID NO: 4063852 - RNA, 14 nt, Staphylococcus aureus subsp. aureus N315
agcccuauuuuuaa

SEQ ID NO: 4063853 - RNA, 16 nt, Staphylococcus aureus subsp. aureus N315
agcccugacaauucau

SEQ ID NO: 4063854 - RNA, 19 nt, Staphylococcus aureus subsp. aureus N315
agcccugacaauucaucua

SEQ ID NO: 4063855 - RNA, 15 nt, Staphylococcus aureus subsp. aureus N315
agccuacaaccuuug

SEQ ID NO: 4063856 - RNA, 20 nt, Staphylococcus aureus subsp. aureus N315
agccuacuuugucugcaauu

SEQ ID NO: 4063857 - RNA, 22 nt, Staphylococcus aureus subsp. aureus N315
agccuagaacauugauuauugu

SEQ ID NO: 4063858 - RNA, 19 nt, Staphylococcus aureus subsp. aureus N315
agccugaaauagaaauguc

SEQ ID NO: 4063859 - RNA, 15 nt, Staphylococcus aureus subsp. aureus N315
agccuuuucaaacau

SEQ ID NO: 4063860 - RNA, 21 nt, Staphylococcus aureus subsp. aureus N315
agcgaaaguaucuaugaaauu

SEQ ID NO: 4063861 - RNA, 12 nt, Staphylococcus aureus subsp. aureus N315
agcgauuaaaug

SEQ ID NO: 4063862 - RNA, 17 nt, Staphylococcus aureus subsp. aureus N315
agcgcaggcgcuccuac

SEQ ID NO: 4063863 - RNA, 22 nt, Staphylococcus aureus subsp. aureus N315
agcggaaauaugauugaaugaa

SEQ ID NO: 4063864 - RNA, 13 nt, Staphylococcus aureus subsp. aureus N315
agcggaauacaga

SEQ ID NO: 4063865 - RNA, 19 nt, Staphylococcus aureus subsp. aureus N315
agcggaauacagaugaugc

SEQ ID NO: 4063866 - RNA, 18 nt, Staphylococcus aureus subsp. aureus N315
agcggacugaaagaaaag

SEQ ID NO: 4063867 - RNA, 19 nt, Staphylococcus aureus subsp. aureus N315
agcggccgugguaugauuu

SEQ ID NO: 4063868 - RNA, 12 nt, Staphylococcus aureus subsp. aureus N315
agcguaaaguuu

SEQ ID NO: 4063869 - RNA, 18 nt, Staphylococcus aureus subsp. aureus N315
agcguaauggauuauuau

SEQ ID NO: 4063870 - RNA, 22 nt, Staphylococcus aureus subsp. aureus N315
agcguagcgaaaguaucuauga

SEQ ID NO: 4063871 - RNA, 16 nt, Staphylococcus aureus subsp. aureus N315
agcguauuuuaaugau

SEQ ID NO: 4063872 - RNA, 22 nt, Staphylococcus aureus subsp. aureus N315
agcguccucuugugaaauuaga

SEQ ID NO: 4063873 - RNA, 15 nt, Staphylococcus aureus subsp. aureus N315
agcguucgugauaga

SEQ ID NO: 4063874 - RNA, 14 nt, Staphylococcus aureus subsp. aureus N315
agcguuuuuauuac

SEQ ID NO: 4063875 - RNA, 14 nt, Staphylococcus aureus subsp. aureus N315
agcuaaacgacauu

SEQ ID NO: 4063876 - RNA, 17 nt, Staphylococcus aureus subsp. aureus N315
agcuaauaacgcugcac

SEQ ID NO: 4063877 - RNA, 13 nt, Staphylococcus aureus subsp. aureus N315
agcuaaugcaagc

SEQ ID NO: 4063878 - RNA, 18 nt, Staphylococcus aureus subsp. aureus N315
agcuaauggcuaauacaa

SEQ ID NO: 4063879 - RNA, 22 nt, Staphylococcus aureus subsp. aureus N315
agcuaauuucuaauacauacug

SEQ ID NO: 4063880 - RNA, 15 nt, Staphylococcus aureus subsp. aureus N315
agcuacaauuaaagu

SEQ ID NO: 4063881 - RNA, 16 nt, Staphylococcus aureus subsp. aureus N315
agcuacaauuuucuca

SEQ ID NO: 4063882 - RNA, 15 nt, Staphylococcus aureus subsp. aureus N315
agcuagcuacaaagu

SEQ ID NO: 4063883 - RNA, 14 nt, Staphylococcus aureus subsp. aureus N315
agcuaggguuaaaa

SEQ ID NO: 4063884 - RNA, 17 nt, Staphylococcus aureus subsp. aureus N315
aggcaacuuuuauuacu

SEQ ID NO: 4063885 - RNA, 15 nt, Staphylococcus aureus subsp. aureus N315
aggcaauauuaaaau

SEQ ID NO: 4063886 - RNA, 13 nt, Staphylococcus aureus subsp. aureus N315
aggcaaugcaagu

SEQ ID NO: 4063887 - RNA, 23 nt, Staphylococcus aureus subsp. aureus N315
aggcaaugcaaguuggcggggcc

SEQ ID NO: 4063888 - RNA, 21 nt, Staphylococcus aureus subsp. aureus N315
aggcaauguaaugguuaauaa

SEQ ID NO: 4063889 - RNA, 22 nt, Staphylococcus aureus subsp. aureus N315
aggcacagcggaauacagauga

SEQ ID NO: 4063890 - RNA, 22 nt, Staphylococcus aureus subsp. aureus N315
aggcacaguggauuacagauga

SEQ ID NO: 4063891 - RNA, 23 nt, Staphylococcus aureus subsp. aureus N315
aggcacaguggauuacagaugau

SEQ ID NO: 4063892 - RNA, 18 nt, Staphylococcus aureus subsp. aureus N315
aggcacuaguuaauucua

SEQ ID NO: 4063893 - RNA, 14 nt, Staphylococcus aureus subsp. aureus N315
aggcauaacuguau

SEQ ID NO: 4063894 - RNA, 23 nt, Staphylococcus aureus subsp. aureus N315
aggcauaauuugugguaugacug

SEQ ID NO: 4063895 - RNA, 15 nt, Staphylococcus aureus subsp. aureus N315
aggcaucucacaauc

SEQ ID NO: 4063896 - RNA, 16 nt, Staphylococcus aureus subsp. aureus N315
aggcauucuuccaaca

SEQ ID NO: 4063897 - RNA, 19 nt, Staphylococcus aureus subsp. aureus N315
aggccauuuuuauuuaaca

SEQ ID NO: 4063898 - RNA, 19 nt, Staphylococcus aureus subsp. aureus N315
aggcgcuguuccaaauuca

SEQ ID NO: 4063899 - RNA, 18 nt, Staphylococcus aureus subsp. aureus N315
aggcgcuuguaaaauuuu

SEQ ID NO: 4063900 - RNA, 17 nt, Staphylococcus aureus subsp. aureus N315
aggcuuaaauauaauga

SEQ ID NO: 4063901 - RNA, 19 nt, Staphylococcus aureus subsp. aureus N315
aggcuuaaauauaaugauc

SEQ ID NO: 4063902 - RNA, 22 nt, Staphylococcus aureus subsp. aureus N315
aggcuuaaauauaaugauccag

SEQ ID NO: 4063903 - RNA, 15 nt, Staphylococcus aureus subsp. aureus N315
aggcuuauuaacuuu

SEQ ID NO: 4063904 - RNA, 21 nt, Staphylococcus aureus subsp. aureus N315
agggacagaaaagggcaaaaa

SEQ ID NO: 4063905 - RNA, 13 nt, Staphylococcus aureus subsp. aureus N315
agggcaaaaaagg

SEQ ID NO: 4063906 - RNA, 22 nt, Staphylococcus aureus subsp. aureus N315
agggcauugagauuggaagggc

SEQ ID NO: 4063907 - RNA, 11 nt, Staphylococcus aureus subsp. aureus N315
agggccccaac

SEQ ID NO: 4063908 - RNA, 15 nt, Staphylococcus aureus subsp. aureus N315
agggccccaacacag

SEQ ID NO: 4063909 - RNA, 21 nt, Staphylococcus aureus subsp. aureus N315
agggcggucaauuuuaccaug

SEQ ID NO: 4063910 - RNA, 16 nt, Staphylococcus aureus subsp. aureus N315
aggggccccaacacag

SEQ ID NO: 4063911 - RNA, 21 nt, Staphylococcus aureus subsp. aureus N315
aggggccccaacacagagaau

SEQ ID NO: 4063912 - RNA, 21 nt, Staphylococcus aureus subsp. aureus N315
aggggcuucuuucuaaaauaa

SEQ ID NO: 4063913 - RNA, 15 nt, Staphylococcus aureus subsp. aureus N315
aggggcuuuuaugca

SEQ ID NO: 4063914 - RNA, 16 nt, Staphylococcus aureus subsp. aureus N315
aggggcuuuuaugcau

SEQ ID NO: 4063915 - RNA, 16 nt, Staphylococcus aureus subsp. aureus N315
agggggcuucuuuguu

SEQ ID NO: 4063916 - RNA, 21 nt, Staphylococcus aureus subsp. aureus N315
aggguauugaaauaauauaaa

SEQ ID NO: 4063917 - RNA, 23 nt, Staphylococcus aureus subsp. aureus N315
aggguuugccagucauuguauaa

SEQ ID NO: 4063918 - RNA, 19 nt, Staphylococcus aureus subsp. aureus N315
agguaaaucuguuuaaauu

SEQ ID NO: 4063919 - RNA, 23 nt, Staphylococcus aureus subsp. aureus N315
agguaaaucuguuuaaauuuaaa

SEQ ID NO: 4063920 - RNA, 12 nt, Staphylococcus aureus subsp. aureus N315
agguaaauuuaa

SEQ ID NO: 4063921 - RNA, 16 nt, Staphylococcus aureus subsp. aureus N315
agguaaauuuaaaaua

SEQ ID NO: 4063922 - RNA, 15 nt, Staphylococcus aureus subsp. aureus N315
agguaacuaaaaugu

SEQ ID NO: 4063923 - RNA, 15 nt, Staphylococcus aureus subsp. aureus N315
agguaagugcucaaa

SEQ ID NO: 4063924 - RNA, 17 nt, Staphylococcus aureus subsp. aureus N315
agguaauaaagcugauu

SEQ ID NO: 4063925 - RNA, 13 nt, Staphylococcus aureus subsp. aureus N315
agguaauacuuuu

SEQ ID NO: 4063926 - RNA, 12 nt, Staphylococcus aureus subsp. aureus N315
agguaaugcaag

SEQ ID NO: 4063927 - RNA, 13 nt, Staphylococcus aureus subsp. aureus N315
agguaaugcaagu

SEQ ID NO: 4063928 - RNA, 23 nt, Staphylococcus aureus subsp. aureus N315
agguaaugcaaguuggcggggcc

SEQ ID NO: 4063929 - RNA, 17 nt, Staphylococcus aureus subsp. aureus N315
agguaaugcaaguuggg

SEQ ID NO: 4063930 - RNA, 17 nt, Staphylococcus aureus subsp. aureus N315
agguaauuuaacauuuu

SEQ ID NO: 4063931 - RNA, 17 nt, Staphylococcus aureus subsp. aureus N315
agguacuuaucugaagc

SEQ ID NO: 4063932 - RNA, 14 nt, Staphylococcus aureus subsp. aureus N315
agguauaaucauuu

SEQ ID NO: 4063933 - RNA, 15 nt, Staphylococcus aureus subsp. aureus N315
agguauacacaaauu

SEQ ID NO: 4063934 - RNA, 22 nt, Staphylococcus aureus subsp. aureus N315
agguauagcaaguuuauaaauu

SEQ ID NO: 4063935 - RNA, 21 nt, Staphylococcus aureus subsp. aureus N315
agguauaggugcaguuaaauu

SEQ ID NO: 4063936 - RNA, 17 nt, Staphylococcus aureus subsp. aureus N315
agguaugaaauaacaau

SEQ ID NO: 4063937 - RNA, 17 nt, Staphylococcus aureus subsp. aureus N315
agguauucaaauaaaca

SEQ ID NO: 4063938 - RNA, 13 nt, Staphylococcus aureus subsp. aureus N315
aggucaaaaaauu

SEQ ID NO: 4063939 - RNA, 19 nt, Staphylococcus aureus subsp. aureus N315
aggucaaaaaauuaaucaa

SEQ ID NO: 4063940 - RNA, 21 nt, Staphylococcus aureus subsp. aureus N315
aggucaaaaaauuaaucaauu

SEQ ID NO: 4063941 - RNA, 19 nt, Staphylococcus aureus subsp. aureus N315
aggucaccuuuaaauuuac

SEQ ID NO: 4063942 - RNA, 22 nt, Staphylococcus aureus subsp. aureus N315
aggucaucugaugaggcaauau

SEQ ID NO: 4063943 - RNA, 18 nt, Staphylococcus aureus subsp. aureus N315
aggucuacgaucaaaauc

SEQ ID NO: 4063944 - RNA, 20 nt, Staphylococcus aureus subsp. aureus N315
aggugacuuuccuaauucuu

SEQ ID NO: 4063945 - RNA, 15 nt, Staphylococcus aureus subsp. aureus N315
aggugauuauauaua

SEQ ID NO: 4063946 - RNA, 19 nt, Staphylococcus aureus subsp. aureus N315
aggugauuauauauauuaa

SEQ ID NO: 4063947 - RNA, 17 nt, Staphylococcus aureus subsp. aureus N315
aggugauugaacaauaa

SEQ ID NO: 4063948 - RNA, 19 nt, Staphylococcus aureus subsp. aureus N315
aggugcaguuaaauuaaac

SEQ ID NO: 4063949 - RNA, 17 nt, Staphylococcus aureus subsp. aureus N315
agguuaaauauuuaauu

SEQ ID NO: 4063950 - RNA, 23 nt, Staphylococcus aureus subsp. aureus N315
agguuaaccucuaagguuaaauu

SEQ ID NO: 4063951 - RNA, 16 nt, Staphylococcus aureus subsp. aureus N315
agguuauauuuaaaug

SEQ ID NO: 4063952 - RNA, 16 nt, Staphylococcus aureus subsp. aureus N315
agguuauuuuuuaugg

SEQ ID NO: 4063953 - RNA, 16 nt, Staphylococcus aureus subsp. aureus N315
agguucaaaauugcug

SEQ ID NO: 4063954 - RNA, 17 nt, Staphylococcus aureus subsp. aureus N315
agguucaaaauugcuga

SEQ ID NO: 4063955 - RNA, 14 nt, Staphylococcus aureus subsp. aureus N315
agguugaagaagga

SEQ ID NO: 4063956 - RNA, 21 nt, Staphylococcus aureus subsp. aureus N315
agguuguuuuucaucauuaaa

SEQ ID NO: 4063957 - RNA, 23 nt, Staphylococcus aureus subsp. aureus N315
agguuguuuuucaucauuaaaau

SEQ ID NO: 4063958 - RNA, 23 nt, Staphylococcus aureus subsp. aureus N315
agguuuaaacaucuauaacaaaa

SEQ ID NO: 4063959 - RNA, 18 nt, Staphylococcus aureus subsp. aureus N315
agguuucacaaauucuuu

SEQ ID NO: 4063960 - RNA, 16 nt, Staphylococcus aureus subsp. aureus N315
agguuuguaagacaac

SEQ ID NO: 4063961 - RNA, 14 nt, Staphylococcus aureus subsp. aureus N315
agguuuuaugaauu

SEQ ID NO: 4063962 - RNA, 14 nt, Staphylococcus aureus subsp. aureus N315
aguaaaaaucacag

SEQ ID NO: 4063963 - RNA, 14 nt, Staphylococcus aureus subsp. aureus N315
aguaaaauaaaaaa

SEQ ID NO: 4063964 - RNA, 15 nt, Staphylococcus aureus subsp. aureus N315
aguaaaauaaaaaau

SEQ ID NO: 4063965 - RNA, 20 nt, Staphylococcus aureus subsp. aureus N315
aguaaaaucuuuaacauuug

SEQ ID NO: 4063966 - RNA, 17 nt, Staphylococcus aureus subsp. aureus N315
aguaaacgagacaucau

SEQ ID NO: 4063967 - RNA, 21 nt, Staphylococcus aureus subsp. aureus N315
aguaaagggagguauauacaa

SEQ ID NO: 4063968 - RNA, 16 nt, Staphylococcus aureus subsp. aureus N315
aguaaagugaaauaaa

SEQ ID NO: 4063969 - RNA, 11 nt, Staphylococcus aureus subsp. aureus N315
aguaaaucaaa

SEQ ID NO: 4063970 - RNA, 12 nt, Staphylococcus aureus subsp. aureus N315
aguaaauguuuu

SEQ ID NO: 4063971 - RNA, 14 nt, Staphylococcus aureus subsp. aureus N315
aguauuaaauuugu

SEQ ID NO: 4063972 - RNA, 16 nt, Staphylococcus aureus subsp. aureus N315
aguauuaaauuugugu

SEQ ID NO: 4063973 - RNA, 23 nt, Staphylococcus aureus subsp. aureus N315
aguauuauagccuauccauucaa

SEQ ID NO: 4063974 - RNA, 15 nt, Staphylococcus aureus subsp. aureus N315
aguauuaugauugcu

SEQ ID NO: 4063975 - RNA, 14 nt, Staphylococcus aureus subsp. aureus N315
aguauucaaaaaau

SEQ ID NO: 4063976 - RNA, 15 nt, Staphylococcus aureus subsp. aureus N315
aguauucaaaaaaua

SEQ ID NO: 4063977 - RNA, 14 nt, Staphylococcus aureus subsp. aureus N315
aguauucauuuucu

SEQ ID NO: 4063978 - RNA, 18 nt, Staphylococcus aureus subsp. aureus N315
aguauuugccuuuugaau

SEQ ID NO: 4063979 - RNA, 16 nt, Staphylococcus aureus subsp. aureus N315
aguauuuuuuauguuc

SEQ ID NO: 4063980 - RNA, 16 nt, Staphylococcus aureus subsp. aureus N315
agucaacaauugcuaa

SEQ ID NO: 4063981 - RNA, 13 nt, Staphylococcus aureus subsp. aureus N315
agucaaucaaguu

SEQ ID NO: 4063982 - RNA, 16 nt, Staphylococcus aureus subsp. aureus N315
agucaauguauauuua

SEQ ID NO: 4063983 - RNA, 18 nt, Staphylococcus aureus subsp. aureus N315
agucaauguauauuuaac

SEQ ID NO: 4063984 - RNA, 22 nt, Staphylococcus aureus subsp. aureus N315
agucaauucgacuccaaccuuu

SEQ ID NO: 4063985 - RNA, 17 nt, Staphylococcus aureus subsp. aureus N315
agucaauuuaaauaagu

SEQ ID NO: 4063986 - RNA, 14 nt, Staphylococcus aureus subsp. aureus N315
agucaccauauuua

SEQ ID NO: 4063987 - RNA, 16 nt, Staphylococcus aureus subsp. aureus N315
agucaggggccccaac

SEQ ID NO: 4063988 - RNA, 19 nt, Staphylococcus aureus subsp. aureus N315
agucaggggccccaacaca

SEQ ID NO: 4063989 - RNA, 17 nt, Staphylococcus aureus subsp. aureus N315
agucauaaauauaaaau

SEQ ID NO: 4063990 - RNA, 21 nt, Staphylococcus aureus subsp. aureus N315
agucauaaauugauuucuaau

SEQ ID NO: 4063991 - RNA, 18 nt, Staphylococcus aureus subsp. aureus N315
agucauaggcuugccaau

SEQ ID NO: 4063992 - RNA, 14 nt, Staphylococcus aureus subsp. aureus N315
agucauaugcauac

SEQ ID NO: 4063993 - RNA, 14 nt, Staphylococcus aureus subsp. aureus N315
agucaugucccaua

SEQ ID NO: 4063994 - RNA, 17 nt, Staphylococcus aureus subsp. aureus N315
agucauuugauuuaaaa

SEQ ID NO: 4063995 - RNA, 15 nt, Staphylococcus aureus subsp. aureus N315
aguccauuuucuuuu

SEQ ID NO: 4063996 - RNA, 14 nt, Staphylococcus aureus subsp. aureus N315
agucccgcuuaaaa

SEQ ID NO: 4063997 - RNA, 20 nt, Staphylococcus aureus subsp. aureus N315
aguccuucuuugaaaucaau

SEQ ID NO: 4063998 - RNA, 15 nt, Staphylococcus aureus subsp. aureus N315
agucgacaugauucu

SEQ ID NO: 4063999 - RNA, 18 nt, Staphylococcus aureus subsp. aureus N315
agucgauaaauaugaugu

SEQ ID NO: 4064000 - RNA, 15 nt, Staphylococcus aureus subsp. aureus N315
agucgauaaguuuuu

SEQ ID NO: 4064001 - RNA, 19 nt, Staphylococcus aureus subsp. aureus N315
agucgcaauggcaauugau

SEQ ID NO: 4064002 - RNA, 17 nt, Staphylococcus aureus subsp. aureus N315
agucggggccccaacac

SEQ ID NO: 4064003 - RNA, 16 nt, Staphylococcus aureus subsp. aureus N315
agucgguguuuucuua

SEQ ID NO: 4064004 - RNA, 19 nt, Staphylococcus aureus subsp. aureus N315
agucguuguugaaauuaaa

SEQ ID NO: 4064005 - RNA, 18 nt, Staphylococcus aureus subsp. aureus N315
agucguuuguacuucacu

SEQ ID NO: 4064006 - RNA, 22 nt, Staphylococcus aureus subsp. aureus N315
agucuaacaguuaauaugaauu

SEQ ID NO: 4064007 - RNA, 16 nt, Staphylococcus aureus subsp. aureus N315
agucuaugaauaaugu

SEQ ID NO: 4064008 - RNA, 17 nt, Staphylococcus aureus subsp. aureus N315
agucucuaaaacuuuuu

SEQ ID NO: 4064009 - RNA, 22 nt, Staphylococcus aureus subsp. aureus N315
agucugcucuuuuuguaugagu

SEQ ID NO: 4064010 - RNA, 16 nt, Staphylococcus aureus subsp. aureus N315
agucuuaaacauaaca

SEQ ID NO: 4064011 - RNA, 22 nt, Staphylococcus aureus subsp. aureus N315
agucuucuuacugcaauuauuu

SEQ ID NO: 4064012 - RNA, 12 nt, Staphylococcus aureus subsp. aureus N315
agucuucuucaa

SEQ ID NO: 4064013 - RNA, 19 nt, Staphylococcus aureus subsp. aureus N315
agucuucuuuuuuuaacuu

SEQ ID NO: 4064014 - RNA, 22 nt, Staphylococcus aureus subsp. aureus N315
agucuuggacauuguaaaaugc

SEQ ID NO: 4064015 - RNA, 20 nt, Staphylococcus aureus subsp. aureus N315
agucuugugauaauucuuca

SEQ ID NO: 4064016 - RNA, 13 nt, Staphylococcus aureus subsp. aureus N315
agucuuuuuuaag

SEQ ID NO: 4064017 - RNA, 19 nt, Staphylococcus aureus subsp. aureus N315
agugaaaaaguuucggaaa

SEQ ID NO: 4064018 - RNA, 14 nt, Staphylococcus aureus subsp. aureus N315
agugaaaagaacac

SEQ ID NO: 4064019 - RNA, 17 nt, Staphylococcus aureus subsp. aureus N315
agugaaaguauuagaua

SEQ ID NO: 4064020 - RNA, 19 nt, Staphylococcus aureus subsp. aureus N315
agugaaagucguuguugaa

SEQ ID NO: 4064021 - RNA, 13 nt, Staphylococcus aureus subsp. aureus N315
agugaaauaccuc

SEQ ID NO: 4064022 - RNA, 14 nt, Staphylococcus aureus subsp. aureus N315
agugaaauaccucc

SEQ ID NO: 4064023 - RNA, 16 nt, Staphylococcus aureus subsp. aureus N315
agugaaaucauuuaaa

SEQ ID NO: 4064024 - RNA, 19 nt, Staphylococcus aureus subsp. aureus N315
agugaacuauuaaaaccaa

SEQ ID NO: 4064025 - RNA, 22 nt, Staphylococcus aureus subsp. aureus N315
agugaaucuaaacuauaauaau

SEQ ID NO: 4064026 - RNA, 16 nt, Staphylococcus aureus subsp. aureus N315
agugaauuaucuauau

SEQ ID NO: 4064027 - RNA, 13 nt, Staphylococcus aureus subsp. aureus N315
agugaccucaggu

SEQ ID NO: 4064028 - RNA, 14 nt, Staphylococcus aureus subsp. aureus N315
agugaccucagguu

SEQ ID NO: 4064029 - RNA, 17 nt, Staphylococcus aureus subsp. aureus N315
agugaccucagguuguu

SEQ ID NO: 4064030 - RNA, 16 nt, Staphylococcus aureus subsp. aureus N315
agugagcguauuauua

SEQ ID NO: 4064031 - RNA, 20 nt, Staphylococcus aureus subsp. aureus N315
agugaguuuuauuuauaaac

SEQ ID NO: 4064032 - RNA, 15 nt, Staphylococcus aureus subsp. aureus N315
agugaugaccaauau

SEQ ID NO: 4064033 - RNA, 14 nt, Staphylococcus aureus subsp. aureus N315
agugauuuaaaaaa

SEQ ID NO: 4064034 - RNA, 15 nt, Staphylococcus aureus subsp. aureus N315
agugauuuaaaaaau

SEQ ID NO: 4064035 - RNA, 20 nt, Staphylococcus aureus subsp. aureus N315
agugauuucuucauuaucaa

SEQ ID NO: 4064036 - RNA, 14 nt, Staphylococcus aureus subsp. aureus N315
agugauuugccaaa

SEQ ID NO: 4064037 - RNA, 21 nt, Staphylococcus aureus subsp. aureus N315
agugcaaguaauuuaauuggu

SEQ ID NO: 4064038 - RNA, 18 nt, Staphylococcus aureus subsp. aureus N315
agugcaaguccaaauaau

SEQ ID NO: 4064039 - RNA, 20 nt, Staphylococcus aureus subsp. aureus N315
agugcauuuuuuauuuuacu

SEQ ID NO: 4064040 - RNA, 22 nt, Staphylococcus aureus subsp. aureus N315
agugccuugccaugauuuaagg

SEQ ID NO: 4064041 - RNA, 19 nt, Staphylococcus aureus subsp. aureus N315
agugcgguuauuuauacag

SEQ ID NO: 4064042 - RNA, 13 nt, Staphylococcus aureus subsp. aureus N315
agugcuaagaggu

SEQ ID NO: 4064043 - RNA, 22 nt, Staphylococcus aureus subsp. aureus N315
agugcuuccacuucaucuaaau

SEQ ID NO: 4064044 - RNA, 19 nt, Staphylococcus aureus subsp. aureus N315
agugcuugauuaacauuuu

SEQ ID NO: 4064045 - RNA, 20 nt, Staphylococcus aureus subsp. aureus N315
agugcuuuuuuaccagcaug

SEQ ID NO: 4064046 - RNA, 13 nt, Staphylococcus aureus subsp. aureus N315
aguggauuacaga

SEQ ID NO: 4064047 - RNA, 17 nt, Staphylococcus aureus subsp. aureus N315
agugguaaaaaguuuaa

SEQ ID NO: 4064048 - RNA, 20 nt, Staphylococcus aureus subsp. aureus N315
agugguaaaaaguuuaaagu

SEQ ID NO: 4064049 - RNA, 18 nt, Staphylococcus aureus subsp. aureus N315
agugguuuucuuuauuuu

SEQ ID NO: 4064050 - RNA, 22 nt, Staphylococcus aureus subsp. aureus N315
aguguaauguuccccugaaaag

SEQ ID NO: 4064051 - RNA, 24 nt, Staphylococcus aureus subsp. aureus N315
aguguagcacaagauucaacuugu

SEQ ID NO: 4064052 - RNA, 17 nt, Staphylococcus aureus subsp. aureus N315
aguguagccaaauaaau

SEQ ID NO: 4064053 - RNA, 19 nt, Staphylococcus aureus subsp. aureus N315
aguguagccaaauaaauuu

SEQ ID NO: 4064054 - RNA, 17 nt, Staphylococcus aureus subsp. aureus N315
aguguauucauuuuaaa

SEQ ID NO: 4064055 - RNA, 14 nt, Staphylococcus aureus subsp. aureus N315
agugucacaaagaa

SEQ ID NO: 4064056 - RNA, 20 nt, Staphylococcus aureus subsp. aureus N315
agugucgagauuuuauaagu

SEQ ID NO: 4064057 - RNA, 22 nt, Staphylococcus aureus subsp. aureus N315
aguguuauaauggcgggccccc

SEQ ID NO: 4064058 - RNA, 18 nt, Staphylococcus aureus subsp. aureus N315
aguguugacuuuaucaau

SEQ ID NO: 4064059 - RNA, 20 nt, Staphylococcus aureus subsp. aureus N315
aguuuguuucuaaauucuuu

SEQ ID NO: 4064060 - RNA, 16 nt, Staphylococcus aureus subsp. aureus N315
aguuuguuuucuuucg

SEQ ID NO: 4064061 - RNA, 15 nt, Staphylococcus aureus subsp. aureus N315
aguuuuaaaugaaac

SEQ ID NO: 4064062 - RNA, 16 nt, Staphylococcus aureus subsp. aureus N315
aguuuuacugagggau

SEQ ID NO: 4064063 - RNA, 22 nt, Staphylococcus aureus subsp. aureus N315
aguuuucauuuuuucaaugucu

SEQ ID NO: 4064064 - RNA, 16 nt, Staphylococcus aureus subsp. aureus N315
aguuuucuucacugcu

SEQ ID NO: 4064065 - RNA, 21 nt, Staphylococcus aureus subsp. aureus N315
aguuuugauugcaaaaaaaca

SEQ ID NO: 4064066 - RNA, 16 nt, Staphylococcus aureus subsp. aureus N315
aguuuuuaaaauuauc

SEQ ID NO: 4064067 - RNA, 14 nt, Staphylococcus aureus subsp. aureus N315
aguuuuuaaaucaa

SEQ ID NO: 4064068 - RNA, 20 nt, Staphylococcus aureus subsp. aureus N315
aguuuuucaggguuuaagau

SEQ ID NO: 4064069 - RNA, 21 nt, Staphylococcus aureus subsp. aureus N315
aguuuuuuaaaauaaugauau

SEQ ID NO: 4064070 - RNA, 16 nt, Staphylococcus aureus subsp. aureus N315
aguuuuuuuaaaguuu

SEQ ID NO: 4064071 - RNA, 19 nt, Staphylococcus aureus subsp. aureus N315
aguuuuuuuaaaguuuaaa

SEQ ID NO: 4064072 - RNA, 15 nt, Staphylococcus aureus subsp. aureus N315
aguuuuuuuucauag

SEQ ID NO: 4064073 - RNA, 15 nt, Staphylococcus aureus subsp. aureus N315
auaaaaaaauuaacu

SEQ ID NO: 4064074 - RNA, 13 nt, Staphylococcus aureus subsp. aureus N315
auaaaaaacaaua

SEQ ID NO: 4064075 - RNA, 17 nt, Staphylococcus aureus subsp. aureus N315
auaaaaaaccaagugca

SEQ ID NO: 4064076 - RNA, 14 nt, Staphylococcus aureus subsp. aureus N315
auaaaaaaucuuuu

SEQ ID NO: 4064077 - RNA, 13 nt, Staphylococcus aureus subsp. aureus N315
auaaaaaauuauu

SEQ ID NO: 4064078 - RNA, 19 nt, Staphylococcus aureus subsp. aureus N315
auaaaaacagcagugaagu

SEQ ID NO: 4064079 - RNA, 19 nt, Staphylococcus aureus subsp. aureus N315
auaaaaagaauaugauauu

SEQ ID NO: 4064080 - RNA, 18 nt, Staphylococcus aureus subsp. aureus N315
auaaaaagaucauuaaaa

SEQ ID NO: 4064081 - RNA, 16 nt, Staphylococcus aureus subsp. aureus N315
auaaaaagugaaagua

SEQ ID NO: 4064082 - RNA, 16 nt, Staphylococcus aureus subsp. aureus N315
auaaaaauacauaauu

SEQ ID NO: 4064083 - RNA, 13 nt, Staphylococcus aureus subsp. aureus N315
auaaaaaucuuau

SEQ ID NO: 4064084 - RNA, 19 nt, Staphylococcus aureus subsp. aureus N315
auaaaaaucuuaugauguc

SEQ ID NO: 4064085 - RNA, 17 nt, Staphylococcus aureus subsp. aureus N315
auaaaaaucuuggugau

SEQ ID NO: 4064086 - RNA, 17 nt, Staphylococcus aureus subsp. aureus N315
auaaaaauuauauaaau

SEQ ID NO: 4064087 - RNA, 15 nt, Staphylococcus aureus subsp. aureus N315
auaaaaauuuauuca

SEQ ID NO: 4064088 - RNA, 17 nt, Staphylococcus aureus subsp. aureus N315
auaaaacuaauuaggua

SEQ ID NO: 4064089 - RNA, 15 nt, Staphylococcus aureus subsp. aureus N315
auaaaacuaucuaca

SEQ ID NO: 4064090 - RNA, 22 nt, Staphylococcus aureus subsp. aureus N315
auaaaacuauguguauaugugg

SEQ ID NO: 4064091 - RNA, 20 nt, Staphylococcus aureus subsp. aureus N315
auaaaacuuacauuacauau

SEQ ID NO: 4064092 - RNA, 23 nt, Staphylococcus aureus subsp. aureus N315
auaaaacuuacauuacauauauc

SEQ ID NO: 4064093 - RNA, 14 nt, Staphylococcus aureus subsp. aureus N315
auaaaagagaagcu

SEQ ID NO: 4064094 - RNA, 20 nt, Staphylococcus aureus subsp. aureus N315
auaaaagccaugauacgaug

SEQ ID NO: 4064095 - RNA, 22 nt, Staphylococcus aureus subsp. aureus N315
auaaaaggcuuuguuaaacaca

SEQ ID NO: 4064096 - RNA, 23 nt, Staphylococcus aureus subsp. aureus N315
auaaaaguacuuuaaaauuguau

SEQ ID NO: 4064097 - RNA, 16 nt, Staphylococcus aureus subsp. aureus N315
auaaaagucgauaaau

SEQ ID NO: 4064098 - RNA, 22 nt, Staphylococcus aureus subsp. aureus N315
auaaaagucgauaaauaugaug

SEQ ID NO: 4064099 - RNA, 23 nt, Staphylococcus aureus subsp. aureus N315
auaaaaguuaccuacuacauucu

SEQ ID NO: 4064100 - RNA, 13 nt, Staphylococcus aureus subsp. aureus N315
auaaaauaaaaaa

SEQ ID NO: 4064101 - RNA, 17 nt, Staphylococcus aureus subsp. aureus N315
auaaaauaaaaaaauga

SEQ ID NO: 4064102 - RNA, 23 nt, Staphylococcus aureus subsp. aureus N315
auaaaauaccagaugaaccaaaa

SEQ ID NO: 4064103 - RNA, 20 nt, Staphylococcus aureus subsp. aureus N315
auaaaauauaucuuaugaua

SEQ ID NO: 4064104 - RNA, 12 nt, Staphylococcus aureus subsp. aureus N315
auaaaauauauu

SEQ ID NO: 4064105 - RNA, 16 nt, Staphylococcus aureus subsp. aureus N315
auaaaauauauuuaau

SEQ ID NO: 4064106 - RNA, 20 nt, Staphylococcus aureus subsp. aureus N315
auaaaauauauuuaauuaca

SEQ ID NO: 4064107 - RNA, 13 nt, Staphylococcus aureus subsp. aureus N315
auaaaaucauaac

SEQ ID NO: 4064108 - RNA, 15 nt, Staphylococcus aureus subsp. aureus N315
auaaaaugaauaauu

SEQ ID NO: 4064109 - RNA, 13 nt, Staphylococcus aureus subsp. aureus N315
auaaaaugcaauu

SEQ ID NO: 4064110 - RNA, 17 nt, Staphylococcus aureus subsp. aureus N315
auaaaaugcauagcucu

SEQ ID NO: 4064111 - RNA, 21 nt, Staphylococcus aureus subsp. aureus N315
auaaaaugcauagcucuucuu

SEQ ID NO: 4064112 - RNA, 20 nt, Staphylococcus aureus subsp. aureus N315
auaaaauggugcgaauaaua

SEQ ID NO: 4064113 - RNA, 16 nt, Staphylococcus aureus subsp. aureus N315
auaaaauuaaaacagc

SEQ ID NO: 4064114 - RNA, 17 nt, Staphylococcus aureus subsp. aureus N315
auaaaauuagccuaauu

SEQ ID NO: 4064115 - RNA, 14 nt, Staphylococcus aureus subsp. aureus N315
auaaaauucaccaa

SEQ ID NO: 4064116 - RNA, 19 nt, Staphylococcus aureus subsp. aureus N315
auaaaauuuaaaacaauga

SEQ ID NO: 4064117 - RNA, 14 nt, Staphylococcus aureus subsp. aureus N315
auaaaauuucugcu

SEQ ID NO: 4064118 - RNA, 22 nt, Staphylococcus aureus subsp. aureus N315
auaaaauuucugcuucuuuuaa

SEQ ID NO: 4064119 - RNA, 16 nt, Staphylococcus aureus subsp. aureus N315
auaaaauuuuuuucau

SEQ ID NO: 4064120 - RNA, 20 nt, Staphylococcus aureus subsp. aureus N315
auaaacaacugcaauagcua

SEQ ID NO: 4064121 - RNA, 12 nt, Staphylococcus aureus subsp. aureus N315
auaaacaauaaa

SEQ ID NO: 4064122 - RNA, 14 nt, Staphylococcus aureus subsp. aureus N315
auaaacagggagug

SEQ ID NO: 4064123 - RNA, 21 nt, Staphylococcus aureus subsp. aureus N315
auaaaccgauuguuucaccag

SEQ ID NO: 4064124 - RNA, 23 nt, Staphylococcus aureus subsp. aureus N315
auaaaccgauuguuucaccagcu

SEQ ID NO: 4064125 - RNA, 19 nt, Staphylococcus aureus subsp. aureus N315
auaaaccuaaugcuuuaau

SEQ ID NO: 4064126 - RNA, 20 nt, Staphylococcus aureus subsp. aureus N315
auaaacgacgcaagugacuu

SEQ ID NO: 4064127 - RNA, 12 nt, Staphylococcus aureus subsp. aureus N315
auaaacguccaa

SEQ ID NO: 4064128 - RNA, 12 nt, Staphylococcus aureus subsp. aureus N315
auaaacuacaca

SEQ ID NO: 4064129 - RNA, 15 nt, Staphylococcus aureus subsp. aureus N315
auaaacuuuaugaaa

SEQ ID NO: 4064130 - RNA, 17 nt, Staphylococcus aureus subsp. aureus N315
auaaacuuuaugaaauu

SEQ ID NO: 4064131 - RNA, 22 nt, Staphylococcus aureus subsp. aureus N315
auaaagaaugauuuauaaaaaa

SEQ ID NO: 4064132 - RNA, 21 nt, Staphylococcus aureus subsp. aureus N315
auaaagacaccuucaauaucu

SEQ ID NO: 4064133 - RNA, 18 nt, Staphylococcus aureus subsp. aureus N315
auaaagauagaaugaaua

SEQ ID NO: 4064134 - RNA, 17 nt, Staphylococcus aureus subsp. aureus N315
auaaagauuauaucuuu

SEQ ID NO: 4064135 - RNA, 21 nt, Staphylococcus aureus subsp. aureus N315
auaaagccaucuaggucacuu

SEQ ID NO: 4064136 - RNA, 15 nt, Staphylococcus aureus subsp. aureus N315
auaaagcguucucua

SEQ ID NO: 4064137 - RNA, 20 nt, Staphylococcus aureus subsp. aureus N315
auaaagcugcgauauaacua

SEQ ID NO: 4064138 - RNA, 20 nt, Staphylococcus aureus subsp. aureus N315
auaaaggcaacaaauauaau

SEQ ID NO: 4064139 - RNA, 15 nt, Staphylococcus aureus subsp. aureus N315
auaaagucauacuua

SEQ ID NO: 4064140 - RNA, 16 nt, Staphylococcus aureus subsp. aureus N315
auaaagucauacuuau

SEQ ID NO: 4064141 - RNA, 22 nt, Staphylococcus aureus subsp. aureus N315
auaaauaaaaauacauaauuaa

SEQ ID NO: 4064142 - RNA, 23 nt, Staphylococcus aureus subsp. aureus N315
auaaauaaaaggcauucuuccaa

SEQ ID NO: 4064143 - RNA, 14 nt, Staphylococcus aureus subsp. aureus N315
auaaauaaaaugcu

SEQ ID NO: 4064144 - RNA, 12 nt, Staphylococcus aureus subsp. aureus N315
auaaauaaacaa

SEQ ID NO: 4064145 - RNA, 18 nt, Staphylococcus aureus subsp. aureus N315
auaaauaaacaacugcaa

SEQ ID NO: 4064146 - RNA, 17 nt, Staphylococcus aureus subsp. aureus N315
auaaccauuuuuucaaa

SEQ ID NO: 4064147 - RNA, 16 nt, Staphylococcus aureus subsp. aureus N315
auaacccauuuucaaa

SEQ ID NO: 4064148 - RNA, 18 nt, Staphylococcus aureus subsp. aureus N315
auaacccauuuucaaaac

SEQ ID NO: 4064149 - RNA, 16 nt, Staphylococcus aureus subsp. aureus N315
auaaccgcuacaauua

SEQ ID NO: 4064150 - RNA, 14 nt, Staphylococcus aureus subsp. aureus N315
auaaccuguaauug

SEQ ID NO: 4064151 - RNA, 23 nt, Staphylococcus aureus subsp. aureus N315
auaaccuuguucuuuacuccaaa

SEQ ID NO: 4064152 - RNA, 13 nt, Staphylococcus aureus subsp. aureus N315
auaaccuuuaaaa

SEQ ID NO: 4064153 - RNA, 15 nt, Staphylococcus aureus subsp. aureus N315
auaaccuuuaaaaca

SEQ ID NO: 4064154 - RNA, 19 nt, Staphylococcus aureus subsp. aureus N315
auaaccuuuaaaacaucau

SEQ ID NO: 4064155 - RNA, 22 nt, Staphylococcus aureus subsp. aureus N315
auaaccuuuaaaacaucauuca

SEQ ID NO: 4064156 - RNA, 13 nt, Staphylococcus aureus subsp. aureus N315
auaacgugcuuuu

SEQ ID NO: 4064157 - RNA, 14 nt, Staphylococcus aureus subsp. aureus N315
auaacgugcuuuuu

SEQ ID NO: 4064158 - RNA, 15 nt, Staphylococcus aureus subsp. aureus N315
auaacgugcuuuuuu

SEQ ID NO: 4064159 - RNA, 16 nt, Staphylococcus aureus subsp. aureus N315
auaacguucuguuuug

SEQ ID NO: 4064160 - RNA, 20 nt, Staphylococcus aureus subsp. aureus N315
auaacuagaacaagaauuau

SEQ ID NO: 4064161 - RNA, 15 nt, Staphylococcus aureus subsp. aureus N315
auaacucaaauaucu

SEQ ID NO: 4064162 - RNA, 14 nt, Staphylococcus aureus subsp. aureus N315
auaacuccuccaaa

SEQ ID NO: 4064163 - RNA, 15 nt, Staphylococcus aureus subsp. aureus N315
auaacugauaauacu

SEQ ID NO: 4064164 - RNA, 20 nt, Staphylococcus aureus subsp. aureus N315
auaacugcauguacaucuuu

SEQ ID NO: 4064165 - RNA, 13 nt, Staphylococcus aureus subsp. aureus N315
auaacuguaaaac

SEQ ID NO: 4064166 - RNA, 15 nt, Staphylococcus aureus subsp. aureus N315
auaacuucguuuuaa

SEQ ID NO: 4064167 - RNA, 13 nt, Staphylococcus aureus subsp. aureus N315
auaacuuguaaua

SEQ ID NO: 4064168 - RNA, 15 nt, Staphylococcus aureus subsp. aureus N315
auaacuuuaaaaauu

SEQ ID NO: 4064169 - RNA, 16 nt, Staphylococcus aureus subsp. aureus N315
auaacuuuaaaaauua

SEQ ID NO: 4064170 - RNA, 21 nt, Staphylococcus aureus subsp. aureus N315
auaacuuuauauauaaagaaa

SEQ ID NO: 4064171 - RNA, 14 nt, Staphylococcus aureus subsp. aureus N315
auaagaaaauacua

SEQ ID NO: 4064172 - RNA, 12 nt, Staphylococcus aureus subsp. aureus N315
auaagaauguga

SEQ ID NO: 4064173 - RNA, 15 nt, Staphylococcus aureus subsp. aureus N315
auaagaauuuaaaag

SEQ ID NO: 4064174 - RNA, 17 nt, Staphylococcus aureus subsp. aureus N315
auaagaauuuaaaagag

SEQ ID NO: 4064175 - RNA, 18 nt, Staphylococcus aureus subsp. aureus N315
auaagaauuuaaaagaga

SEQ ID NO: 4064176 - RNA, 19 nt, Staphylococcus aureus subsp. aureus N315
auaagacuucccuauaugu

SEQ ID NO: 4064177 - RNA, 21 nt, Staphylococcus aureus subsp. aureus N315
auaagacuucccuauauguag

SEQ ID NO: 4064178 - RNA, 18 nt, Staphylococcus aureus subsp. aureus N315
auaagagaacuuuucaaa

SEQ ID NO: 4064179 - RNA, 16 nt, Staphylococcus aureus subsp. aureus N315
auaagaggagaaagcu

SEQ ID NO: 4064180 - RNA, 18 nt, Staphylococcus aureus subsp. aureus N315
auaagcacgauaaaaaua

SEQ ID NO: 4064181 - RNA, 18 nt, Staphylococcus aureus subsp. aureus N315
auaagccuuuucaaacau

SEQ ID NO: 4064182 - RNA, 12 nt, Staphylococcus aureus subsp. aureus N315
auaagcugaaaa

SEQ ID NO: 4064183 - RNA, 17 nt, Staphylococcus aureus subsp. aureus N315
auaagcuuguaacaagc

SEQ ID NO: 4064184 - RNA, 21 nt, Staphylococcus aureus subsp. aureus N315
auaagcuuguaacaagcauuu

SEQ ID NO: 4064185 - RNA, 20 nt, Staphylococcus aureus subsp. aureus N315
auaagcuuuuucuuucucua

SEQ ID NO: 4064186 - RNA, 15 nt, Staphylococcus aureus subsp. aureus N315
auaaggauaucugaa

SEQ ID NO: 4064187 - RNA, 22 nt, Staphylococcus aureus subsp. aureus N315
auaaggaugauuuauuaacuca

SEQ ID NO: 4064188 - RNA, 19 nt, Staphylococcus aureus subsp. aureus N315
auaaggcaauuuuccgugu

SEQ ID NO: 4064189 - RNA, 21 nt, Staphylococcus aureus subsp. aureus N315
auaagggguauauuaaaaauu

SEQ ID NO: 4064190 - RNA, 13 nt, Staphylococcus aureus subsp. aureus N315
auaaguaaauaau

SEQ ID NO: 4064191 - RNA, 16 nt, Staphylococcus aureus subsp. aureus N315
auaaguaauaauauaa

SEQ ID NO: 4064192 - RNA, 17 nt, Staphylococcus aureus subsp. aureus N315
auaaguaauaauuuauu

SEQ ID NO: 4064193 - RNA, 15 nt, Staphylococcus aureus subsp. aureus N315
auaaguacaaauaau

SEQ ID NO: 4064194 - RNA, 18 nt, Staphylococcus aureus subsp. aureus N315
auaaguacaaauaauaca

SEQ ID NO: 4064195 - RNA, 22 nt, Staphylococcus aureus subsp. aureus N315
auaaguagcucaaaacaauuua

SEQ ID NO: 4064196 - RNA, 13 nt, Staphylococcus aureus subsp. aureus N315
auaaguaguucag

SEQ ID NO: 4064197 - RNA, 24 nt, Staphylococcus aureus subsp. aureus N315
auaagucugaugucgaaaauagcu

SEQ ID NO: 4064198 - RNA, 13 nt, Staphylococcus aureus subsp. aureus N315
auaagugauaaau

SEQ ID NO: 4064199 - RNA, 22 nt, Staphylococcus aureus subsp. aureus N315
auaagugauuucuucauuauca

SEQ ID NO: 4064200 - RNA, 23 nt, Staphylococcus aureus subsp. aureus N315
auaagugauuucuucauuaucaa

SEQ ID NO: 4064201 - RNA, 13 nt, Staphylococcus aureus subsp. aureus N315
auaaguuaaaaau

SEQ ID NO: 4064202 - RNA, 17 nt, Staphylococcus aureus subsp. aureus N315
auaaguuaaaaauguaa

SEQ ID NO: 4064203 - RNA, 13 nt, Staphylococcus aureus subsp. aureus N315
auaaguuaaaauu

SEQ ID NO: 4064204 - RNA, 15 nt, Staphylococcus aureus subsp. aureus N315
auaaguugaauauaa

SEQ ID NO: 4064205 - RNA, 17 nt, Staphylococcus aureus subsp. aureus N315
auaaguugaauauaaaa

SEQ ID NO: 4064206 - RNA, 17 nt, Staphylococcus aureus subsp. aureus N315
auaaguugcauauaaaa

SEQ ID NO: 4064207 - RNA, 14 nt, Staphylococcus aureus subsp. aureus N315
auaauaaaaaggag

SEQ ID NO: 4064208 - RNA, 17 nt, Staphylococcus aureus subsp. aureus N315
auaauaaaacuugugau

SEQ ID NO: 4064209 - RNA, 14 nt, Staphylococcus aureus subsp. aureus N315
auaauaaauaggau

SEQ ID NO: 4064210 - RNA, 21 nt, Staphylococcus aureus subsp. aureus N315
auaauaagagaacuuuucaaa

SEQ ID NO: 4064211 - RNA, 18 nt, Staphylococcus aureus subsp. aureus N315
auaauaaguugaauauaa

SEQ ID NO: 4064212 - RNA, 20 nt, Staphylococcus aureus subsp. aureus N315
auaauaauucauaaaugcuu

SEQ ID NO: 4064213 - RNA, 19 nt, Staphylococcus aureus subsp. aureus N315
auaauaccuucaauugaca

SEQ ID NO: 4064214 - RNA, 23 nt, Staphylococcus aureus subsp. aureus N315
auaauaccuucaauugacauuaa

SEQ ID NO: 4064215 - RNA, 19 nt, Staphylococcus aureus subsp. aureus N315
auaauacgcuugauaaaag

SEQ ID NO: 4064216 - RNA, 16 nt, Staphylococcus aureus subsp. aureus N315
auaauacguuuugcua

SEQ ID NO: 4064217 - RNA, 19 nt, Staphylococcus aureus subsp. aureus N315
auaauacuacauauaaugc

SEQ ID NO: 4064218 - RNA, 15 nt, Staphylococcus aureus subsp. aureus N315
auaauacuguuuaaa

SEQ ID NO: 4064219 - RNA, 16 nt, Staphylococcus aureus subsp. aureus N315
auaauagcaaaauuau

SEQ ID NO: 4064220 - RNA, 13 nt, Staphylococcus aureus subsp. aureus N315
auaauauaaaaac

SEQ ID NO: 4064221 - RNA, 15 nt, Staphylococcus aureus subsp. aureus N315
auaauauaaaacgau

SEQ ID NO: 4064222 - RNA, 21 nt, Staphylococcus aureus subsp. aureus N315
auaauauaaaacgauaagaau

SEQ ID NO: 4064223 - RNA, 14 nt, Staphylococcus aureus subsp. aureus N315
auaauauaaauaaa

SEQ ID NO: 4064224 - RNA, 16 nt, Staphylococcus aureus subsp. aureus N315
auaauauaaauaaaag

SEQ ID NO: 4064225 - RNA, 13 nt, Staphylococcus aureus subsp. aureus N315
auaauauacacaa

SEQ ID NO: 4064226 - RNA, 13 nt, Staphylococcus aureus subsp. aureus N315
auaauauauccug

SEQ ID NO: 4064227 - RNA, 22 nt, Staphylococcus aureus subsp. aureus N315
auaauauauccugccaauauau

SEQ ID NO: 4064228 - RNA, 18 nt, Staphylococcus aureus subsp. aureus N315
auaauaugugcaugagac

SEQ ID NO: 4064229 - RNA, 15 nt, Staphylococcus aureus subsp. aureus N315
auaauauuggacuuu

SEQ ID NO: 4064230 - RNA, 17 nt, Staphylococcus aureus subsp. aureus N315
auaaucaaaccaccaaa

SEQ ID NO: 4064231 - RNA, 14 nt, Staphylococcus aureus subsp. aureus N315
auaaucaagaauau

SEQ ID NO: 4064232 - RNA, 15 nt, Staphylococcus aureus subsp. aureus N315
auaaucaagaauaua

SEQ ID NO: 4064233 - RNA, 22 nt, Staphylococcus aureus subsp. aureus N315
auaaucaagaauauaagugauu

SEQ ID NO: 4064234 - RNA, 20 nt, Staphylococcus aureus subsp. aureus N315
auaauuuucuguccaaaaag

SEQ ID NO: 4064235 - RNA, 14 nt, Staphylococcus aureus subsp. aureus N315
auaauuuuggauuu

SEQ ID NO: 4064236 - RNA, 18 nt, Staphylococcus aureus subsp. aureus N315
auaauuuuguucagauag

SEQ ID NO: 4064237 - RNA, 22 nt, Staphylococcus aureus subsp. aureus N315
auaauuuuuauuuacacacaug

SEQ ID NO: 4064238 - RNA, 21 nt, Staphylococcus aureus subsp. aureus N315
auaauuuuucuucuuuuuuau

SEQ ID NO: 4064239 - RNA, 18 nt, Staphylococcus aureus subsp. aureus N315
auacaaaacaaauccauu

SEQ ID NO: 4064240 - RNA, 19 nt, Staphylococcus aureus subsp. aureus N315
auacaaaacaaauccauua

SEQ ID NO: 4064241 - RNA, 19 nt, Staphylococcus aureus subsp. aureus N315
auacaaacccauauaaaug

SEQ ID NO: 4064242 - RNA, 15 nt, Staphylococcus aureus subsp. aureus N315
auacaaagaauuaug

SEQ ID NO: 4064243 - RNA, 12 nt, Staphylococcus aureus subsp. aureus N315
auacaaaggauu

SEQ ID NO: 4064244 - RNA, 18 nt, Staphylococcus aureus subsp. aureus N315
auacaaaucguaaacaua

SEQ ID NO: 4064245 - RNA, 12 nt, Staphylococcus aureus subsp. aureus N315
auacaaauugau

SEQ ID NO: 4064246 - RNA, 15 nt, Staphylococcus aureus subsp. aureus N315
auacaagucuuuacu

SEQ ID NO: 4064247 - RNA, 15 nt, Staphylococcus aureus subsp. aureus N315
auacaauagaaauga

SEQ ID NO: 4064248 - RNA, 22 nt, Staphylococcus aureus subsp. aureus N315
auacaauuauggauaaaauuua

SEQ ID NO: 4064249 - RNA, 22 nt, Staphylococcus aureus subsp. aureus N315
auacacugcacaucauaauaaa

SEQ ID NO: 4064250 - RNA, 18 nt, Staphylococcus aureus subsp. aureus N315
auacacuugauaaaacua

SEQ ID NO: 4064251 - RNA, 19 nt, Staphylococcus aureus subsp. aureus N315
auacacuugauaaaacuaa

SEQ ID NO: 4064252 - RNA, 23 nt, Staphylococcus aureus subsp. aureus N315
auacacuuuuugacauauuuuuu

SEQ ID NO: 4064253 - RNA, 18 nt, Staphylococcus aureus subsp. aureus N315
auacagaaccaacaauaa

SEQ ID NO: 4064254 - RNA, 19 nt, Staphylococcus aureus subsp. aureus N315
auacagaaccaacaauaaa

SEQ ID NO: 4064255 - RNA, 22 nt, Staphylococcus aureus subsp. aureus N315
auacagaaccaacaauaaaucu

SEQ ID NO: 4064256 - RNA, 20 nt, Staphylococcus aureus subsp. aureus N315
auacagaacuuuaauaauga

SEQ ID NO: 4064257 - RNA, 15 nt, Staphylococcus aureus subsp. aureus N315
auacaggaaauugaa

SEQ ID NO: 4064258 - RNA, 20 nt, Staphylococcus aureus subsp. aureus N315
auacaggaaauugaagcguu

SEQ ID NO: 4064259 - RNA, 13 nt, Staphylococcus aureus subsp. aureus N315
auacauaaauauu

SEQ ID NO: 4064260 - RNA, 12 nt, Staphylococcus aureus subsp. aureus N315
auacauacugau

SEQ ID NO: 4064261 - RNA, 22 nt, Staphylococcus aureus subsp. aureus N315
auacauagguucaucuuuaugc

SEQ ID NO: 4064262 - RNA, 12 nt, Staphylococcus aureus subsp. aureus N315
auacauaucuuu

SEQ ID NO: 4064263 - RNA, 13 nt, Staphylococcus aureus subsp. aureus N315
auacaucaauauc

SEQ ID NO: 4064264 - RNA, 14 nt, Staphylococcus aureus subsp. aureus N315
auacaucaauaucu

SEQ ID NO: 4064265 - RNA, 16 nt, Staphylococcus aureus subsp. aureus N315
auacaucaucgccagc

SEQ ID NO: 4064266 - RNA, 17 nt, Staphylococcus aureus subsp. aureus N315
auacaugacauucauuu

SEQ ID NO: 4064267 - RNA, 17 nt, Staphylococcus aureus subsp. aureus N315
auacaugccaauggaag

SEQ ID NO: 4064268 - RNA, 16 nt, Staphylococcus aureus subsp. aureus N315
auacauguacauuauc

SEQ ID NO: 4064269 - RNA, 19 nt, Staphylococcus aureus subsp. aureus N315
auacaugugggauaucuuc

SEQ ID NO: 4064270 - RNA, 15 nt, Staphylococcus aureus subsp. aureus N315
auacauuaauauaaa

SEQ ID NO: 4064271 - RNA, 18 nt, Staphylococcus aureus subsp. aureus N315
auacauuaauauaaauau

SEQ ID NO: 4064272 - RNA, 12 nt, Staphylococcus aureus subsp. aureus N315
auacauuauuaa

SEQ ID NO: 4064273 - RNA, 21 nt, Staphylococcus aureus subsp. aureus N315
auacauuccaaaguaccaucu

SEQ ID NO: 4064274 - RNA, 12 nt, Staphylococcus aureus subsp. aureus N315
auacauugauaa

SEQ ID NO: 4064275 - RNA, 13 nt, Staphylococcus aureus subsp. aureus N315
auacauuucaaaa

SEQ ID NO: 4064276 - RNA, 15 nt, Staphylococcus aureus subsp. aureus N315
auacauuucaaaaaa

SEQ ID NO: 4064277 - RNA, 15 nt, Staphylococcus aureus subsp. aureus N315
auacauuuugcucua

SEQ ID NO: 4064278 - RNA, 20 nt, Staphylococcus aureus subsp. aureus N315
auacauuuugcucuaaacuu

SEQ ID NO: 4064279 - RNA, 12 nt, Staphylococcus aureus subsp. aureus N315
auaccaaacugc

SEQ ID NO: 4064280 - RNA, 15 nt, Staphylococcus aureus subsp. aureus N315
auaccaaauauauuu

SEQ ID NO: 4064281 - RNA, 18 nt, Staphylococcus aureus subsp. aureus N315
auaccacacuuuaaacaa

SEQ ID NO: 4064282 - RNA, 23 nt, Staphylococcus aureus subsp. aureus N315
auaccacaucgcauaauaucuua

SEQ ID NO: 4064283 - RNA, 13 nt, Staphylococcus aureus subsp. aureus N315
auaccacuaagug

SEQ ID NO: 4064284 - RNA, 14 nt, Staphylococcus aureus subsp. aureus N315
auaccacuuaaucg

SEQ ID NO: 4064285 - RNA, 19 nt, Staphylococcus aureus subsp. aureus N315
auaccacuugaauacuuuu

SEQ ID NO: 4064286 - RNA, 17 nt, Staphylococcus aureus subsp. aureus N315
auacccuacuauauauc

SEQ ID NO: 4064287 - RNA, 18 nt, Staphylococcus aureus subsp. aureus N315
auaccgaauaauuuugau

SEQ ID NO: 4064288 - RNA, 21 nt, Staphylococcus aureus subsp. aureus N315
auaccgaauaauuuugauaua

SEQ ID NO: 4064289 - RNA, 20 nt, Staphylococcus aureus subsp. aureus N315
auaccguuaguacggcugcu

SEQ ID NO: 4064290 - RNA, 17 nt, Staphylococcus aureus subsp. aureus N315
auaccuaaaauacccau

SEQ ID NO: 4064291 - RNA, 16 nt, Staphylococcus aureus subsp. aureus N315
auaccuaccacaauaa

SEQ ID NO: 4064292 - RNA, 22 nt, Staphylococcus aureus subsp. aureus N315
auaccuaucccuguaaaaccau

SEQ ID NO: 4064293 - RNA, 15 nt, Staphylococcus aureus subsp. aureus N315
auaccuauuccuauu

SEQ ID NO: 4064294 - RNA, 20 nt, Staphylococcus aureus subsp. aureus N315
auaccucauccgccaauuaa

SEQ ID NO: 4064295 - RNA, 16 nt, Staphylococcus aureus subsp. aureus N315
auaccucuacauuaua

SEQ ID NO: 4064296 - RNA, 17 nt, Staphylococcus aureus subsp. aureus N315
auaccuugauuauaugc

SEQ ID NO: 4064297 - RNA, 12 nt, Staphylococcus aureus subsp. aureus N315
auaccuuuaaua

SEQ ID NO: 4064298 - RNA, 14 nt, Staphylococcus aureus subsp. aureus N315
auaccuuuaauauc

SEQ ID NO: 4064299 - RNA, 21 nt, Staphylococcus aureus subsp. aureus N315
auaccuuuaauaucuaauucu

SEQ ID NO: 4064300 - RNA, 23 nt, Staphylococcus aureus subsp. aureus N315
auaccuuuaauuguuaaaucacc

SEQ ID NO: 4064301 - RNA, 19 nt, Staphylococcus aureus subsp. aureus N315
auaccuuugccguauuuca

SEQ ID NO: 4064302 - RNA, 21 nt, Staphylococcus aureus subsp. aureus N315
auaccuuuuaauuuaguuaua

SEQ ID NO: 4064303 - RNA, 16 nt, Staphylococcus aureus subsp. aureus N315
auaccuuuuucuacca

SEQ ID NO: 4064304 - RNA, 16 nt, Staphylococcus aureus subsp. aureus N315
auacgaauuaaaauaa

SEQ ID NO: 4064305 - RNA, 20 nt, Staphylococcus aureus subsp. aureus N315
auacgacauuuuuagacauu

SEQ ID NO: 4064306 - RNA, 17 nt, Staphylococcus aureus subsp. aureus N315
auacgagcuuugcucau

SEQ ID NO: 4064307 - RNA, 19 nt, Staphylococcus aureus subsp. aureus N315
auacgauaauaacuagaac

SEQ ID NO: 4064308 - RNA, 16 nt, Staphylococcus aureus subsp. aureus N315
auacgauuuguucaau

SEQ ID NO: 4064309 - RNA, 14 nt, Staphylococcus aureus subsp. aureus N315
auacgcaaaccaau

SEQ ID NO: 4064310 - RNA, 22 nt, Staphylococcus aureus subsp. aureus N315
auacgcaaucauuguaaaugau

SEQ ID NO: 4064311 - RNA, 14 nt, Staphylococcus aureus subsp. aureus N315
auacgccuaaauau

SEQ ID NO: 4064312 - RNA, 20 nt, Staphylococcus aureus subsp. aureus N315
auacgcgcuucaucaaugga

SEQ ID NO: 4064313 - RNA, 19 nt, Staphylococcus aureus subsp. aureus N315
auacgcuuuuuaaaaaauu

SEQ ID NO: 4064314 - RNA, 17 nt, Staphylococcus aureus subsp. aureus N315
auacguaucaaaauuuu

SEQ ID NO: 4064315 - RNA, 16 nt, Staphylococcus aureus subsp. aureus N315
auacguguguuuucuu

SEQ ID NO: 4064316 - RNA, 19 nt, Staphylococcus aureus subsp. aureus N315
auacguugauguaauucug

SEQ ID NO: 4064317 - RNA, 17 nt, Staphylococcus aureus subsp. aureus N315
auacguuuaauaauggu

SEQ ID NO: 4064318 - RNA, 16 nt, Staphylococcus aureus subsp. aureus N315
auacguuuauaucuua

SEQ ID NO: 4064319 - RNA, 12 nt, Staphylococcus aureus subsp. aureus N315
auacuaaaacau

SEQ ID NO: 4064320 - RNA, 12 nt, Staphylococcus aureus subsp. aureus N315
auacuaaagcac

SEQ ID NO: 4064321 - RNA, 13 nt, Staphylococcus aureus subsp. aureus N315
auacuaaauugag

SEQ ID NO: 4064322 - RNA, 15 nt, Staphylococcus aureus subsp. aureus N315
auagcuaaacauuuu

SEQ ID NO: 4064323 - RNA, 13 nt, Staphylococcus aureus subsp. aureus N315
auagcuaaauaaa

SEQ ID NO: 4064324 - RNA, 16 nt, Staphylococcus aureus subsp. aureus N315
auagcuaaugcauuau

SEQ ID NO: 4064325 - RNA, 13 nt, Staphylococcus aureus subsp. aureus N315
auagcucaauuga

SEQ ID NO: 4064326 - RNA, 21 nt, Staphylococcus aureus subsp. aureus N315
auagcucaauugaaucuuugu

SEQ ID NO: 4064327 - RNA, 18 nt, Staphylococcus aureus subsp. aureus N315
auagcucuucuuuuucuu

SEQ ID NO: 4064328 - RNA, 21 nt, Staphylococcus aureus subsp. aureus N315
auagcucuucuuuuucuugca

SEQ ID NO: 4064329 - RNA, 22 nt, Staphylococcus aureus subsp. aureus N315
auagcucuucuuuuucuugcau

SEQ ID NO: 4064330 - RNA, 22 nt, Staphylococcus aureus subsp. aureus N315
auagcuuucguuucuuuuauau

SEQ ID NO: 4064331 - RNA, 14 nt, Staphylococcus aureus subsp. aureus N315
auaggaaacuuaaa

SEQ ID NO: 4064332 - RNA, 20 nt, Staphylococcus aureus subsp. aureus N315
auaggaucaccuauuaggau

SEQ ID NO: 4064333 - RNA, 19 nt, Staphylococcus aureus subsp. aureus N315
auagguaaccuuaaauaua

SEQ ID NO: 4064334 - RNA, 14 nt, Staphylococcus aureus subsp. aureus N315
auagguaacuaaaa

SEQ ID NO: 4064335 - RNA, 14 nt, Staphylococcus aureus subsp. aureus N315
auagguauaagaau

SEQ ID NO: 4064336 - RNA, 15 nt, Staphylococcus aureus subsp. aureus N315
auagguauaaucauu

SEQ ID NO: 4064337 - RNA, 13 nt, Staphylococcus aureus subsp. aureus N315
auagguaucuuaa

SEQ ID NO: 4064338 - RNA, 22 nt, Staphylococcus aureus subsp. aureus N315
auaggugauuauauauauuaaa

SEQ ID NO: 4064339 - RNA, 14 nt, Staphylococcus aureus subsp. aureus N315
auaguaaaaccugu

SEQ ID NO: 4064340 - RNA, 19 nt, Staphylococcus aureus subsp. aureus N315
auaguaaaauaaauacaau

SEQ ID NO: 4064341 - RNA, 16 nt, Staphylococcus aureus subsp. aureus N315
auaguaaccuuuauuu

SEQ ID NO: 4064342 - RNA, 23 nt, Staphylococcus aureus subsp. aureus N315
auaguaaccuuuauuuucaguua

SEQ ID NO: 4064343 - RNA, 16 nt, Staphylococcus aureus subsp. aureus N315
auaguaauaaaagucg

SEQ ID NO: 4064344 - RNA, 13 nt, Staphylococcus aureus subsp. aureus N315
auaguaauaaaau

SEQ ID NO: 4064345 - RNA, 13 nt, Staphylococcus aureus subsp. aureus N315
auaguacagucau

SEQ ID NO: 4064346 - RNA, 17 nt, Staphylococcus aureus subsp. aureus N315
auaguauuaacuauaaa

SEQ ID NO: 4064347 - RNA, 19 nt, Staphylococcus aureus subsp. aureus N315
auaguauuaacuauaaaua

SEQ ID NO: 4064348 - RNA, 23 nt, Staphylococcus aureus subsp. aureus N315
auaguauuaacuauaaauagaag

SEQ ID NO: 4064349 - RNA, 16 nt, Staphylococcus aureus subsp. aureus N315
auagucauuacauuuu

SEQ ID NO: 4064350 - RNA, 22 nt, Staphylococcus aureus subsp. aureus N315
auagucauucauaauuuguuga

SEQ ID NO: 4064351 - RNA, 22 nt, Staphylococcus aureus subsp. aureus N315
auaguccgcguguacuuuacca

SEQ ID NO: 4064352 - RNA, 23 nt, Staphylococcus aureus subsp. aureus N315
auaguccggggccccaacaaaga

SEQ ID NO: 4064353 - RNA, 14 nt, Staphylococcus aureus subsp. aureus N315
auaguccuucccac

SEQ ID NO: 4064354 - RNA, 22 nt, Staphylococcus aureus subsp. aureus N315
auagucuuaaacauaacaugac

SEQ ID NO: 4064355 - RNA, 19 nt, Staphylococcus aureus subsp. aureus N315
auagucuucggcuuuguaa

SEQ ID NO: 4064356 - RNA, 16 nt, Staphylococcus aureus subsp. aureus N315
auagugguaaaaaguu

SEQ ID NO: 4064357 - RNA, 23 nt, Staphylococcus aureus subsp. aureus N315
auagugguaaaaaguuuaaagua

SEQ ID NO: 4064358 - RNA, 17 nt, Staphylococcus aureus subsp. aureus N315
auagugucgagauuuua

SEQ ID NO: 4064359 - RNA, 18 nt, Staphylococcus aureus subsp. aureus N315
auagugugucauaaugaa

SEQ ID NO: 4064360 - RNA, 16 nt, Staphylococcus aureus subsp. aureus N315
auaguuaagauuuuaa

SEQ ID NO: 4064361 - RNA, 14 nt, Staphylococcus aureus subsp. aureus N315
auaguuaccaaaau

SEQ ID NO: 4064362 - RNA, 14 nt, Staphylococcus aureus subsp. aureus N315
auaguucuuuaaau

SEQ ID NO: 4064363 - RNA, 16 nt, Staphylococcus aureus subsp. aureus N315
auaguucuuuaaauua

SEQ ID NO: 4064364 - RNA, 21 nt, Staphylococcus aureus subsp. aureus N315
auaguuuauuaauauuaguga

SEQ ID NO: 4064365 - RNA, 19 nt, Staphylococcus aureus subsp. aureus N315
auaguuucgucuacuauuu

SEQ ID NO: 4064366 - RNA, 15 nt, Staphylococcus aureus subsp. aureus N315
auaguuuucuucacu

SEQ ID NO: 4064367 - RNA, 18 nt, Staphylococcus aureus subsp. aureus N315
auaguuuuucauauucac

SEQ ID NO: 4064368 - RNA, 20 nt, Staphylococcus aureus subsp. aureus N315
auauaaaaaauuauuaaaaa

SEQ ID NO: 4064369 - RNA, 13 nt, Staphylococcus aureus subsp. aureus N315
auauaaaaacugu

SEQ ID NO: 4064370 - RNA, 11 nt, Staphylococcus aureus subsp. aureus N315
auauaaaaagu

SEQ ID NO: 4064371 - RNA, 15 nt, Staphylococcus aureus subsp. aureus N315
auauaaaaagugaaa

SEQ ID NO: 4064372 - RNA, 19 nt, Staphylococcus aureus subsp. aureus N315
auauaaaacggacaaguuu

SEQ ID NO: 4064373 - RNA, 20 nt, Staphylococcus aureus subsp. aureus N315
auauaaagcuagggugaauu

SEQ ID NO: 4064374 - RNA, 17 nt, Staphylococcus aureus subsp. aureus N315
auauaaaggaauagcua

SEQ ID NO: 4064375 - RNA, 18 nt, Staphylococcus aureus subsp. aureus N315
auauaaaggaauagcuac

SEQ ID NO: 4064376 - RNA, 20 nt, Staphylococcus aureus subsp. aureus N315
auauaaagucguaucauaua

SEQ ID NO: 4064377 - RNA, 14 nt, Staphylococcus aureus subsp. aureus N315
auauaaauaucaau

SEQ ID NO: 4064378 - RNA, 15 nt, Staphylococcus aureus subsp. aureus N315
auauaaaucaaauau

SEQ ID NO: 4064379 - RNA, 13 nt, Staphylococcus aureus subsp. aureus N315
auauaaaucauuu

SEQ ID NO: 4064380 - RNA, 14 nt, Staphylococcus aureus subsp. aureus N315
auauaaaucauuuc

SEQ ID NO: 4064381 - RNA, 18 nt, Staphylococcus aureus subsp. aureus N315
auauaaauuaucagaauc

SEQ ID NO: 4064382 - RNA, 17 nt, Staphylococcus aureus subsp. aureus N315
auauaacauuaaaauga

SEQ ID NO: 4064383 - RNA, 13 nt, Staphylococcus aureus subsp. aureus N315
auauaacauugca

SEQ ID NO: 4064384 - RNA, 20 nt, Staphylococcus aureus subsp. aureus N315
auauaacuauggucaucaau

SEQ ID NO: 4064385 - RNA, 20 nt, Staphylococcus aureus subsp. aureus N315
auauaagaauuguugaucau

SEQ ID NO: 4064386 - RNA, 17 nt, Staphylococcus aureus subsp. aureus N315
auauaauauacacaaaa

SEQ ID NO: 4064387 - RNA, 14 nt, Staphylococcus aureus subsp. aureus N315
auauaaugguugaa

SEQ ID NO: 4064388 - RNA, 21 nt, Staphylococcus aureus subsp. aureus N315
auauaaugguugaauaacacu

SEQ ID NO: 4064389 - RNA, 17 nt, Staphylococcus aureus subsp. aureus N315
auauaauguauaaaaca

SEQ ID NO: 4064390 - RNA, 22 nt, Staphylococcus aureus subsp. aureus N315
auauaauguauaaaacagaauu

SEQ ID NO: 4064391 - RNA, 15 nt, Staphylococcus aureus subsp. aureus N315
auauaauuauuaaac

SEQ ID NO: 4064392 - RNA, 23 nt, Staphylococcus aureus subsp. aureus N315
auauaauucgucuguuucauaua

SEQ ID NO: 4064393 - RNA, 19 nt, Staphylococcus aureus subsp. aureus N315
auauaauucuuguuugauu

SEQ ID NO: 4064394 - RNA, 13 nt, Staphylococcus aureus subsp. aureus N315
auauaauuuaaag

SEQ ID NO: 4064395 - RNA, 14 nt, Staphylococcus aureus subsp. aureus N315
auauaauuuauuua

SEQ ID NO: 4064396 - RNA, 23 nt, Staphylococcus aureus subsp. aureus N315
auauaauuucaauuuauguugcg

SEQ ID NO: 4064397 - RNA, 24 nt, Staphylococcus aureus subsp. aureus N315
auauaauuuccuaaaaacugugau

SEQ ID NO: 4064398 - RNA, 14 nt, Staphylococcus aureus subsp. aureus N315
auauaccaaccaaa

SEQ ID NO: 4064399 - RNA, 19 nt, Staphylococcus aureus subsp. aureus N315
auauaccuugauucauuuc

SEQ ID NO: 4064400 - RNA, 16 nt, Staphylococcus aureus subsp. aureus N315
auauacgaauccucau

SEQ ID NO: 4064401 - RNA, 20 nt, Staphylococcus aureus subsp. aureus N315
auauacgacauuuuuagaca

SEQ ID NO: 4064402 - RNA, 17 nt, Staphylococcus aureus subsp. aureus N315
auauacuaaauuugaaa

SEQ ID NO: 4064403 - RNA, 16 nt, Staphylococcus aureus subsp. aureus N315
auauacuuaauuuaaa

SEQ ID NO: 4064404 - RNA, 19 nt, Staphylococcus aureus subsp. aureus N315
auauacuuuuuaaaugauu

SEQ ID NO: 4064405 - RNA, 22 nt, Staphylococcus aureus subsp. aureus N315
auauagaaaacuagaacuuagu

SEQ ID NO: 4064406 - RNA, 18 nt, Staphylococcus aureus subsp. aureus N315
auauagagccaugaaaag

SEQ ID NO: 4064407 - RNA, 22 nt, Staphylococcus aureus subsp. aureus N315
auauagaguaguucggaugaga

SEQ ID NO: 4064408 - RNA, 22 nt, Staphylococcus aureus subsp. aureus N315
auauagauggcuuuuuuugcug

SEQ ID NO: 4064409 - RNA, 13 nt, Staphylococcus aureus subsp. aureus N315
auaugauuacaac

SEQ ID NO: 4064410 - RNA, 15 nt, Staphylococcus aureus subsp. aureus N315
auaugauugaaugaa

SEQ ID NO: 4064411 - RNA, 17 nt, Staphylococcus aureus subsp. aureus N315
auaugauugcaaauuau

SEQ ID NO: 4064412 - RNA, 12 nt, Staphylococcus aureus subsp. aureus N315
auaugauuuaaa

SEQ ID NO: 4064413 - RNA, 13 nt, Staphylococcus aureus subsp. aureus N315
auaugcaucaaca

SEQ ID NO: 4064414 - RNA, 19 nt, Staphylococcus aureus subsp. aureus N315
auaugcguagcaacauuau

SEQ ID NO: 4064415 - RNA, 20 nt, Staphylococcus aureus subsp. aureus N315
auaugcuauauuuaguuaau

SEQ ID NO: 4064416 - RNA, 23 nt, Staphylococcus aureus subsp. aureus N315
auaugcuguuggcaaaacaauau

SEQ ID NO: 4064417 - RNA, 21 nt, Staphylococcus aureus subsp. aureus N315
auaugcuuguugugaauaaaa

SEQ ID NO: 4064418 - RNA, 16 nt, Staphylococcus aureus subsp. aureus N315
auauggaauacuacac

SEQ ID NO: 4064419 - RNA, 23 nt, Staphylococcus aureus subsp. aureus N315
auauggcaucaucaccauacuaa

SEQ ID NO: 4064420 - RNA, 16 nt, Staphylococcus aureus subsp. aureus N315
auaugguuagagaaaa

SEQ ID NO: 4064421 - RNA, 12 nt, Staphylococcus aureus subsp. aureus N315
auauguaaauga

SEQ ID NO: 4064422 - RNA, 15 nt, Staphylococcus aureus subsp. aureus N315
auauguaaaugaaau

SEQ ID NO: 4064423 - RNA, 16 nt, Staphylococcus aureus subsp. aureus N315
auauguaaaugaaaua

SEQ ID NO: 4064424 - RNA, 13 nt, Staphylococcus aureus subsp. aureus N315
auauguaaucaga

SEQ ID NO: 4064425 - RNA, 23 nt, Staphylococcus aureus subsp. aureus N315
auauguauagaggauauuuauuc

SEQ ID NO: 4064426 - RNA, 21 nt, Staphylococcus aureus subsp. aureus N315
auaugucucucuuucuuauuc

SEQ ID NO: 4064427 - RNA, 12 nt, Staphylococcus aureus subsp. aureus N315
auaugugagcaa

SEQ ID NO: 4064428 - RNA, 22 nt, Staphylococcus aureus subsp. aureus N315
auaugugcuuuuguaaauuaca

SEQ ID NO: 4064429 - RNA, 20 nt, Staphylococcus aureus subsp. aureus N315
auauguggcacucauaaccg

SEQ ID NO: 4064430 - RNA, 19 nt, Staphylococcus aureus subsp. aureus N315
auaugugguggcuauauaa

SEQ ID NO: 4064431 - RNA, 19 nt, Staphylococcus aureus subsp. aureus N315
auauguguaugauagaaua

SEQ ID NO: 4064432 - RNA, 22 nt, Staphylococcus aureus subsp. aureus N315
auauguuuauauugcaaaaaua

SEQ ID NO: 4064433 - RNA, 19 nt, Staphylococcus aureus subsp. aureus N315
auauguuuggauaucuuug

SEQ ID NO: 4064434 - RNA, 15 nt, Staphylococcus aureus subsp. aureus N315
auauguuuuauaaua

SEQ ID NO: 4064435 - RNA, 21 nt, Staphylococcus aureus subsp. aureus N315
auauguuuuaugauuuucuuu

SEQ ID NO: 4064436 - RNA, 16 nt, Staphylococcus aureus subsp. aureus N315
auauuaaaaauuucaa

SEQ ID NO: 4064437 - RNA, 13 nt, Staphylococcus aureus subsp. aureus N315
auauuaaaacaau

SEQ ID NO: 4064438 - RNA, 21 nt, Staphylococcus aureus subsp. aureus N315
auauuaaaauuaaaacuuuca

SEQ ID NO: 4064439 - RNA, 15 nt, Staphylococcus aureus subsp. aureus N315
auauuaaacuuauaa

SEQ ID NO: 4064440 - RNA, 13 nt, Staphylococcus aureus subsp. aureus N315
auauuaaaguaaa

SEQ ID NO: 4064441 - RNA, 12 nt, Staphylococcus aureus subsp. aureus N315
auauuaaauuca

SEQ ID NO: 4064442 - RNA, 13 nt, Staphylococcus aureus subsp. aureus N315
auauuaaauuucu

SEQ ID NO: 4064443 - RNA, 14 nt, Staphylococcus aureus subsp. aureus N315
auauuaacaccaga

SEQ ID NO: 4064444 - RNA, 19 nt, Staphylococcus aureus subsp. aureus N315
auauuaacguuaguauaaa

SEQ ID NO: 4064445 - RNA, 18 nt, Staphylococcus aureus subsp. aureus N315
auauuaacuguuagacuu

SEQ ID NO: 4064446 - RNA, 18 nt, Staphylococcus aureus subsp. aureus N315
auauuaagcgucuaucuc

SEQ ID NO: 4064447 - RNA, 15 nt, Staphylococcus aureus subsp. aureus N315
auauuaauagaaagu

SEQ ID NO: 4064448 - RNA, 13 nt, Staphylococcus aureus subsp. aureus N315
auauuaauuuuac

SEQ ID NO: 4064449 - RNA, 21 nt, Staphylococcus aureus subsp. aureus N315
auauuaauuuuacguuuauuu

SEQ ID NO: 4064450 - RNA, 13 nt, Staphylococcus aureus subsp. aureus N315
auauuacauauaa

SEQ ID NO: 4064451 - RNA, 19 nt, Staphylococcus aureus subsp. aureus N315
auauuacuaaccuauuaaa

SEQ ID NO: 4064452 - RNA, 18 nt, Staphylococcus aureus subsp. aureus N315
auauuacuucucaucgaa

SEQ ID NO: 4064453 - RNA, 19 nt, Staphylococcus aureus subsp. aureus N315
auauuacuucucaucgaau

SEQ ID NO: 4064454 - RNA, 16 nt, Staphylococcus aureus subsp. aureus N315
auauuagaacauuuau

SEQ ID NO: 4064455 - RNA, 23 nt, Staphylococcus aureus subsp. aureus N315
auauuagugacauuugcaugcuu

SEQ ID NO: 4064456 - RNA, 14 nt, Staphylococcus aureus subsp. aureus N315
auauuauaaaaaca

SEQ ID NO: 4064457 - RNA, 20 nt, Staphylococcus aureus subsp. aureus N315
auauuauaaaaacagcagug

SEQ ID NO: 4064458 - RNA, 20 nt, Staphylococcus aureus subsp. aureus N315
auauuaucguaauuguuaaa

SEQ ID NO: 4064459 - RNA, 22 nt, Staphylococcus aureus subsp. aureus N315
auauuaugauacgcuuuuuaaa

SEQ ID NO: 4064460 - RNA, 19 nt, Staphylococcus aureus subsp. aureus N315
auauuaugccauucauuaa

SEQ ID NO: 4064461 - RNA, 14 nt, Staphylococcus aureus subsp. aureus N315
auauuauuaaauca

SEQ ID NO: 4064462 - RNA, 20 nt, Staphylococcus aureus subsp. aureus N315
auauuauugugaaaucuauu

SEQ ID NO: 4064463 - RNA, 24 nt, Staphylococcus aureus subsp. aureus N315
auauuauuuugcaauugcaaugaa

SEQ ID NO: 4064464 - RNA, 18 nt, Staphylococcus aureus subsp. aureus N315
auauuauuuugcuuuaau

SEQ ID NO: 4064465 - RNA, 14 nt, Staphylococcus aureus subsp. aureus N315
auauuauuuuuaag

SEQ ID NO: 4064466 - RNA, 14 nt, Staphylococcus aureus subsp. aureus N315
auauucaaaauaac

SEQ ID NO: 4064467 - RNA, 15 nt, Staphylococcus aureus subsp. aureus N315
auauucaaaauaacu

SEQ ID NO: 4064468 - RNA, 14 nt, Staphylococcus aureus subsp. aureus N315
auauucaacuuauu

SEQ ID NO: 4064469 - RNA, 19 nt, Staphylococcus aureus subsp. aureus N315
auauucaacuuauuauuua

SEQ ID NO: 4064470 - RNA, 14 nt, Staphylococcus aureus subsp. aureus N315
auauucacaucuuu

SEQ ID NO: 4064471 - RNA, 20 nt, Staphylococcus aureus subsp. aureus N315
auauucaccuacaacaccaa

SEQ ID NO: 4064472 - RNA, 22 nt, Staphylococcus aureus subsp. aureus N315
auauucaccuacaacaccaauu

SEQ ID NO: 4064473 - RNA, 15 nt, Staphylococcus aureus subsp. aureus N315
auauucauauuacuu

SEQ ID NO: 4064474 - RNA, 16 nt, Staphylococcus aureus subsp. aureus N315
auauucauucuagcau

SEQ ID NO: 4064475 - RNA, 16 nt, Staphylococcus aureus subsp. aureus N315
auauucgcuuaaaaac

SEQ ID NO: 4064476 - RNA, 15 nt, Staphylococcus aureus subsp. aureus N315
auauucguaaauccu

SEQ ID NO: 4064477 - RNA, 13 nt, Staphylococcus aureus subsp. aureus N315
auauucguuacaa

SEQ ID NO: 4064478 - RNA, 21 nt, Staphylococcus aureus subsp. aureus N315
auauucuagauucauauuuau

SEQ ID NO: 4064479 - RNA, 22 nt, Staphylococcus aureus subsp. aureus N315
auauucuagauucauauuuaua

SEQ ID NO: 4064480 - RNA, 13 nt, Staphylococcus aureus subsp. aureus N315
auauucucugcuu

SEQ ID NO: 4064481 - RNA, 15 nt, Staphylococcus aureus subsp. aureus N315
auauucucugcuucu

SEQ ID NO: 4064482 - RNA, 12 nt, Staphylococcus aureus subsp. aureus N315
auauucuuaucu

SEQ ID NO: 4064483 - RNA, 19 nt, Staphylococcus aureus subsp. aureus N315
auauugaaaguguaugcau

SEQ ID NO: 4064484 - RNA, 15 nt, Staphylococcus aureus subsp. aureus N315
auauugaaauuaaau

SEQ ID NO: 4064485 - RNA, 19 nt, Staphylococcus aureus subsp. aureus N315
auauugaaauuaaauuugu

SEQ ID NO: 4064486 - RNA, 16 nt, Staphylococcus aureus subsp. aureus N315
auauugaauugaaaaa

SEQ ID NO: 4064487 - RNA, 17 nt, Staphylococcus aureus subsp. aureus N315
auauugaauugaaaaau

SEQ ID NO: 4064488 - RNA, 14 nt, Staphylococcus aureus subsp. aureus N315
auauugacauuuac

SEQ ID NO: 4064489 - RNA, 15 nt, Staphylococcus aureus subsp. aureus N315
auauugacauuuaca

SEQ ID NO: 4064490 - RNA, 23 nt, Staphylococcus aureus subsp. aureus N315
auauugagaauauuaagauguau

SEQ ID NO: 4064491 - RNA, 15 nt, Staphylococcus aureus subsp. aureus N315
auauugauagcaccg

SEQ ID NO: 4064492 - RNA, 16 nt, Staphylococcus aureus subsp. aureus N315
auauugaugaauaaau

SEQ ID NO: 4064493 - RNA, 20 nt, Staphylococcus aureus subsp. aureus N315
auauugauucuagugaaaua

SEQ ID NO: 4064494 - RNA, 23 nt, Staphylococcus aureus subsp. aureus N315
auauuggcuugcuucauuauaua

SEQ ID NO: 4064495 - RNA, 13 nt, Staphylococcus aureus subsp. aureus N315
auauuguauuuua

SEQ ID NO: 4064496 - RNA, 22 nt, Staphylococcus aureus subsp. aureus N315
auauuguuuaggaucuucuugu

SEQ ID NO: 4064497 - RNA, 23 nt, Staphylococcus aureus subsp. aureus N315
aucaauccucuaacgguauauca

SEQ ID NO: 4064498 - RNA, 23 nt, Staphylococcus aureus subsp. aureus N315
aucaaucgcuuuagcaauugaau

SEQ ID NO: 4064499 - RNA, 13 nt, Staphylococcus aureus subsp. aureus N315
aucaauuaaacuu

SEQ ID NO: 4064500 - RNA, 19 nt, Staphylococcus aureus subsp. aureus N315
aucaauuauugaaaacaaa

SEQ ID NO: 4064501 - RNA, 17 nt, Staphylococcus aureus subsp. aureus N315
aucaauugcgauauacg

SEQ ID NO: 4064502 - RNA, 15 nt, Staphylococcus aureus subsp. aureus N315
aucaauuuaauuaag

SEQ ID NO: 4064503 - RNA, 22 nt, Staphylococcus aureus subsp. aureus N315
aucaauuuauuauuaacuguac

SEQ ID NO: 4064504 - RNA, 23 nt, Staphylococcus aureus subsp. aureus N315
aucaauuucaacuuauaaaauga

SEQ ID NO: 4064505 - RNA, 16 nt, Staphylococcus aureus subsp. aureus N315
aucaauuucuauuuca

SEQ ID NO: 4064506 - RNA, 18 nt, Staphylococcus aureus subsp. aureus N315
aucaauuucuauuucacu

SEQ ID NO: 4064507 - RNA, 17 nt, Staphylococcus aureus subsp. aureus N315
aucaauuucuguaauaa

SEQ ID NO: 4064508 - RNA, 19 nt, Staphylococcus aureus subsp. aureus N315
aucaauuucuguaauaaua

SEQ ID NO: 4064509 - RNA, 15 nt, Staphylococcus aureus subsp. aureus N315
aucacaacacauaaa

SEQ ID NO: 4064510 - RNA, 22 nt, Staphylococcus aureus subsp. aureus N315
aucacaauacgaaaucaaaaau

SEQ ID NO: 4064511 - RNA, 23 nt, Staphylococcus aureus subsp. aureus N315
aucacaauacgaaaucaaaaaua

SEQ ID NO: 4064512 - RNA, 15 nt, Staphylococcus aureus subsp. aureus N315
aucacacucuccccg

SEQ ID NO: 4064513 - RNA, 15 nt, Staphylococcus aureus subsp. aureus N315
aucacagcaauaaua

SEQ ID NO: 4064514 - RNA, 16 nt, Staphylococcus aureus subsp. aureus N315
aucacagcaauaauaa

SEQ ID NO: 4064515 - RNA, 17 nt, Staphylococcus aureus subsp. aureus N315
aucacaggaaaaucgua

SEQ ID NO: 4064516 - RNA, 22 nt, Staphylococcus aureus subsp. aureus N315
aucacaguguugaauuucaaaa

SEQ ID NO: 4064517 - RNA, 16 nt, Staphylococcus aureus subsp. aureus N315
aucacaguuauauauu

SEQ ID NO: 4064518 - RNA, 13 nt, Staphylococcus aureus subsp. aureus N315
aucacauaaaaua

SEQ ID NO: 4064519 - RNA, 15 nt, Staphylococcus aureus subsp. aureus N315
aucacauaaaauaca

SEQ ID NO: 4064520 - RNA, 13 nt, Staphylococcus aureus subsp. aureus N315
aucacaucauacc

SEQ ID NO: 4064521 - RNA, 23 nt, Staphylococcus aureus subsp. aureus N315
aucaccaacaacuuuguuuucag

SEQ ID NO: 4064522 - RNA, 14 nt, Staphylococcus aureus subsp. aureus N315
aucaccagauuuua

SEQ ID NO: 4064523 - RNA, 15 nt, Staphylococcus aureus subsp. aureus N315
aucaccagauuuuaa

SEQ ID NO: 4064524 - RNA, 17 nt, Staphylococcus aureus subsp. aureus N315
aucaccauacuaaaaca

SEQ ID NO: 4064525 - RNA, 21 nt, Staphylococcus aureus subsp. aureus N315
aucaccuauuaggauccaauu

SEQ ID NO: 4064526 - RNA, 17 nt, Staphylococcus aureus subsp. aureus N315
aucaccuuuuauccccu

SEQ ID NO: 4064527 - RNA, 23 nt, Staphylococcus aureus subsp. aureus N315
aucacgauauguugugcugccaa

SEQ ID NO: 4064528 - RNA, 15 nt, Staphylococcus aureus subsp. aureus N315
aucacgaucuuuaaa

SEQ ID NO: 4064529 - RNA, 14 nt, Staphylococcus aureus subsp. aureus N315
aucacgauuuucaa

SEQ ID NO: 4064530 - RNA, 23 nt, Staphylococcus aureus subsp. aureus N315
aucacgauuuucaaguaaugaua

SEQ ID NO: 4064531 - RNA, 15 nt, Staphylococcus aureus subsp. aureus N315
aucacgccauaaucu

SEQ ID NO: 4064532 - RNA, 19 nt, Staphylococcus aureus subsp. aureus N315
aucacuauauuucacacag

SEQ ID NO: 4064533 - RNA, 23 nt, Staphylococcus aureus subsp. aureus N315
aucacuauguagaaugaaacuuu

SEQ ID NO: 4064534 - RNA, 20 nt, Staphylococcus aureus subsp. aureus N315
aucacucuuacucauuuuuc

SEQ ID NO: 4064535 - RNA, 21 nt, Staphylococcus aureus subsp. aureus N315
aucacucuuacucauuuuucu

SEQ ID NO: 4064536 - RNA, 13 nt, Staphylococcus aureus subsp. aureus N315
aucacugcuuuca

SEQ ID NO: 4064537 - RNA, 21 nt, Staphylococcus aureus subsp. aureus N315
aucacuugcuguugcaauaaa

SEQ ID NO: 4064538 - RNA, 13 nt, Staphylococcus aureus subsp. aureus N315
aucacuuuuuaaa

SEQ ID NO: 4064539 - RNA, 14 nt, Staphylococcus aureus subsp. aureus N315
aucagaaucaagua

SEQ ID NO: 4064540 - RNA, 13 nt, Staphylococcus aureus subsp. aureus N315
aucagacuaaaau

SEQ ID NO: 4064541 - RNA, 16 nt, Staphylococcus aureus subsp. aureus N315
aucagacuaaaaugaa

SEQ ID NO: 4064542 - RNA, 23 nt, Staphylococcus aureus subsp. aureus N315
aucagcauuuaagcuaucuaaac

SEQ ID NO: 4064543 - RNA, 15 nt, Staphylococcus aureus subsp. aureus N315
aucagcuaaauauuu

SEQ ID NO: 4064544 - RNA, 18 nt, Staphylococcus aureus subsp. aureus N315
aucagcuaaguuaaauau

SEQ ID NO: 4064545 - RNA, 16 nt, Staphylococcus aureus subsp. aureus N315
aucagguccaauucuc

SEQ ID NO: 4064546 - RNA, 16 nt, Staphylococcus aureus subsp. aureus N315
aucaguauaaucagca

SEQ ID NO: 4064547 - RNA, 13 nt, Staphylococcus aureus subsp. aureus N315
aucagucauucac

SEQ ID NO: 4064548 - RNA, 17 nt, Staphylococcus aureus subsp. aureus N315
aucaguccgcuuuuuca

SEQ ID NO: 4064549 - RNA, 18 nt, Staphylococcus aureus subsp. aureus N315
aucaguccgcuuuuucau

SEQ ID NO: 4064550 - RNA, 23 nt, Staphylococcus aureus subsp. aureus N315
aucagucucuaaaacuuuuucaa

SEQ ID NO: 4064551 - RNA, 15 nt, Staphylococcus aureus subsp. aureus N315
aucaguuauuuuaau

SEQ ID NO: 4064552 - RNA, 16 nt, Staphylococcus aureus subsp. aureus N315
aucaguuauuuuaaua

SEQ ID NO: 4064553 - RNA, 16 nt, Staphylococcus aureus subsp. aureus N315
aucaguugagucaauu

SEQ ID NO: 4064554 - RNA, 18 nt, Staphylococcus aureus subsp. aureus N315
aucaguugagugauuuua

SEQ ID NO: 4064555 - RNA, 20 nt, Staphylococcus aureus subsp. aureus N315
aucaguuguguaauaaagca

SEQ ID NO: 4064556 - RNA, 21 nt, Staphylococcus aureus subsp. aureus N315
aucaguuguguaauaaagcaa

SEQ ID NO: 4064557 - RNA, 13 nt, Staphylococcus aureus subsp. aureus N315
aucauaaagauaa

SEQ ID NO: 4064558 - RNA, 13 nt, Staphylococcus aureus subsp. aureus N315
aucauaaaguaaa

SEQ ID NO: 4064559 - RNA, 12 nt, Staphylococcus aureus subsp. aureus N315
aucauaaauauu

SEQ ID NO: 4064560 - RNA, 13 nt, Staphylococcus aureus subsp. aureus N315
aucauaaaugacg

SEQ ID NO: 4064561 - RNA, 19 nt, Staphylococcus aureus subsp. aureus N315
aucauaauaagauuuuuua

SEQ ID NO: 4064562 - RNA, 16 nt, Staphylococcus aureus subsp. aureus N315
aucauaaucugcugcu

SEQ ID NO: 4064563 - RNA, 22 nt, Staphylococcus aureus subsp. aureus N315
aucauaaugaauaauuaaaaaa

SEQ ID NO: 4064564 - RNA, 19 nt, Staphylococcus aureus subsp. aureus N315
aucauaauucccuguuaug

SEQ ID NO: 4064565 - RNA, 19 nt, Staphylococcus aureus subsp. aureus N315
aucauaccagcaaguguau

SEQ ID NO: 4064566 - RNA, 13 nt, Staphylococcus aureus subsp. aureus N315
aucauacgagaaa

SEQ ID NO: 4064567 - RNA, 15 nt, Staphylococcus aureus subsp. aureus N315
aucauacgagaaauu

SEQ ID NO: 4064568 - RNA, 16 nt, Staphylococcus aureus subsp. aureus N315
aucauacgagaaauua

SEQ ID NO: 4064569 - RNA, 14 nt, Staphylococcus aureus subsp. aureus N315
aucauagaggcaca

SEQ ID NO: 4064570 - RNA, 16 nt, Staphylococcus aureus subsp. aureus N315
aucauagauauaagaa

SEQ ID NO: 4064571 - RNA, 11 nt, Staphylococcus aureus subsp. aureus N315
aucauauauuu

SEQ ID NO: 4064572 - RNA, 12 nt, Staphylococcus aureus subsp. aureus N315
aucauaucauac

SEQ ID NO: 4064573 - RNA, 12 nt, Staphylococcus aureus subsp. aureus N315
aucauaucgauu

SEQ ID NO: 4064574 - RNA, 15 nt, Staphylococcus aureus subsp. aureus N315
aucauaugucuuaac

SEQ ID NO: 4064575 - RNA, 21 nt, Staphylococcus aureus subsp. aureus N315
aucauauuugaauacuuuauu

SEQ ID NO: 4064576 - RNA, 16 nt, Staphylococcus aureus subsp. aureus N315
aucaucaaaguuuaau

SEQ ID NO: 4064577 - RNA, 22 nt, Staphylococcus aureus subsp. aureus N315
aucaucaaguucaccguaaucu

SEQ ID NO: 4064578 - RNA, 21 nt, Staphylococcus aureus subsp. aureus N315
aucaucaccauacuaaaacau

SEQ ID NO: 4064579 - RNA, 14 nt, Staphylococcus aureus subsp. aureus N315
aucauccacaauca

SEQ ID NO: 4064580 - RNA, 14 nt, Staphylococcus aureus subsp. aureus N315
aucaucgaacauga

SEQ ID NO: 4064581 - RNA, 20 nt, Staphylococcus aureus subsp. aureus N315
aucaucgcaaauacauaauc

SEQ ID NO: 4064582 - RNA, 17 nt, Staphylococcus aureus subsp. aureus N315
aucaucgccagcauuac

SEQ ID NO: 4064583 - RNA, 19 nt, Staphylococcus aureus subsp. aureus N315
aucaucgccaucccauuca

SEQ ID NO: 4064584 - RNA, 20 nt, Staphylococcus aureus subsp. aureus N315
aucaucucugcuuuaauaua

SEQ ID NO: 4064585 - RNA, 17 nt, Staphylococcus aureus subsp. aureus N315
aucgaaagaugauauau

SEQ ID NO: 4064586 - RNA, 14 nt, Staphylococcus aureus subsp. aureus N315
aucgaacuagacaa

SEQ ID NO: 4064587 - RNA, 23 nt, Staphylococcus aureus subsp. aureus N315
aucgaacuaguacgaaaugcaau

SEQ ID NO: 4064588 - RNA, 20 nt, Staphylococcus aureus subsp. aureus N315
aucgaauaacuguuuaucau

SEQ ID NO: 4064589 - RNA, 14 nt, Staphylococcus aureus subsp. aureus N315
aucgaauucauuug

SEQ ID NO: 4064590 - RNA, 14 nt, Staphylococcus aureus subsp. aureus N315
aucgaauuuucaaa

SEQ ID NO: 4064591 - RNA, 23 nt, Staphylococcus aureus subsp. aureus N315
aucgacuaauuuuucuuucaggc

SEQ ID NO: 4064592 - RNA, 21 nt, Staphylococcus aureus subsp. aureus N315
aucgacuuuuacaaucaucac

SEQ ID NO: 4064593 - RNA, 21 nt, Staphylococcus aureus subsp. aureus N315
aucgauaaauguauuaaacau

SEQ ID NO: 4064594 - RNA, 13 nt, Staphylococcus aureus subsp. aureus N315
aucgauacuuuuu

SEQ ID NO: 4064595 - RNA, 18 nt, Staphylococcus aureus subsp. aureus N315
aucgauauagcauaaaau

SEQ ID NO: 4064596 - RNA, 19 nt, Staphylococcus aureus subsp. aureus N315
aucgauauugagaauauua

SEQ ID NO: 4064597 - RNA, 20 nt, Staphylococcus aureus subsp. aureus N315
aucgauuaagaaugcaccaa

SEQ ID NO: 4064598 - RNA, 14 nt, Staphylococcus aureus subsp. aureus N315
aucgauuaguuuuu

SEQ ID NO: 4064599 - RNA, 22 nt, Staphylococcus aureus subsp. aureus N315
aucgauuuuggcacauaaauca

SEQ ID NO: 4064600 - RNA, 17 nt, Staphylococcus aureus subsp. aureus N315
aucgcaccgucaaacuu

SEQ ID NO: 4064601 - RNA, 17 nt, Staphylococcus aureus subsp. aureus N315
aucgcauguuuguaaau

SEQ ID NO: 4064602 - RNA, 15 nt, Staphylococcus aureus subsp. aureus N315
aucgcauuuaaauau

SEQ ID NO: 4064603 - RNA, 23 nt, Staphylococcus aureus subsp. aureus N315
aucgcauuuuguuucaacauuuc

SEQ ID NO: 4064604 - RNA, 13 nt, Staphylococcus aureus subsp. aureus N315
aucgcccauacca

SEQ ID NO: 4064605 - RNA, 16 nt, Staphylococcus aureus subsp. aureus N315
aucgccuaaaaauaaa

SEQ ID NO: 4064606 - RNA, 18 nt, Staphylococcus aureus subsp. aureus N315
aucgccuaaaaauaaaau

SEQ ID NO: 4064607 - RNA, 24 nt, Staphylococcus aureus subsp. aureus N315
aucgccuuggccaggugauugacg

SEQ ID NO: 4064608 - RNA, 14 nt, Staphylococcus aureus subsp. aureus N315
aucgcgauuauuac

SEQ ID NO: 4064609 - RNA, 14 nt, Staphylococcus aureus subsp. aureus N315
aucgcuugcuucuu

SEQ ID NO: 4064610 - RNA, 16 nt, Staphylococcus aureus subsp. aureus N315
aucgcuugcuucuuuc

SEQ ID NO: 4064611 - RNA, 15 nt, Staphylococcus aureus subsp. aureus N315
aucggaauaaaauaa

SEQ ID NO: 4064612 - RNA, 17 nt, Staphylococcus aureus subsp. aureus N315
aucggcaccaguagcua

SEQ ID NO: 4064613 - RNA, 14 nt, Staphylococcus aureus subsp. aureus N315
aucguaaaaaacaa

SEQ ID NO: 4064614 - RNA, 15 nt, Staphylococcus aureus subsp. aureus N315
aucguaaaaaacaaa

SEQ ID NO: 4064615 - RNA, 19 nt, Staphylococcus aureus subsp. aureus N315
aucguaaacacuauaaaag

SEQ ID NO: 4064616 - RNA, 13 nt, Staphylococcus aureus subsp. aureus N315
aucguaaacauaa

SEQ ID NO: 4064617 - RNA, 18 nt, Staphylococcus aureus subsp. aureus N315
aucgucaucacuuuuuaa

SEQ ID NO: 4064618 - RNA, 19 nt, Staphylococcus aureus subsp. aureus N315
aucgugaagaaaaaaugau

SEQ ID NO: 4064619 - RNA, 16 nt, Staphylococcus aureus subsp. aureus N315
aucgugcccauaugau

SEQ ID NO: 4064620 - RNA, 23 nt, Staphylococcus aureus subsp. aureus N315
aucguggggugccuuuuacauuu

SEQ ID NO: 4064621 - RNA, 22 nt, Staphylococcus aureus subsp. aureus N315
aucguuaauaaaccuacaauau

SEQ ID NO: 4064622 - RNA, 20 nt, Staphylococcus aureus subsp. aureus N315
aucguuaauuuccaauaucu

SEQ ID NO: 4064623 - RNA, 18 nt, Staphylococcus aureus subsp. aureus N315
aucguuaucuuuaaguaa

SEQ ID NO: 4064624 - RNA, 14 nt, Staphylococcus aureus subsp. aureus N315
aucguucccauucu

SEQ ID NO: 4064625 - RNA, 14 nt, Staphylococcus aureus subsp. aureus N315
aucguugaaaaaua

SEQ ID NO: 4064626 - RNA, 12 nt, Staphylococcus aureus subsp. aureus N315
aucguuucuucc

SEQ ID NO: 4064627 - RNA, 16 nt, Staphylococcus aureus subsp. aureus N315
aucuaaaauaucauca

SEQ ID NO: 4064628 - RNA, 19 nt, Staphylococcus aureus subsp. aureus N315
aucuaaccuuuucaucagu

SEQ ID NO: 4064629 - RNA, 13 nt, Staphylococcus aureus subsp. aureus N315
aucuaacuggaaa

SEQ ID NO: 4064630 - RNA, 16 nt, Staphylococcus aureus subsp. aureus N315
aucuaacuggaaauga

SEQ ID NO: 4064631 - RNA, 18 nt, Staphylococcus aureus subsp. aureus N315
aucuaacuggaaaugaua

SEQ ID NO: 4064632 - RNA, 13 nt, Staphylococcus aureus subsp. aureus N315
aucuaauaaauau

SEQ ID NO: 4064633 - RNA, 23 nt, Staphylococcus aureus subsp. aureus N315
aucuaaugcaacuugaucauuau

SEQ ID NO: 4064634 - RNA, 14 nt, Staphylococcus aureus subsp. aureus N315
aucuaauucguaau

SEQ ID NO: 4064635 - RNA, 16 nt, Staphylococcus aureus subsp. aureus N315
aucuaauucguaauuu

SEQ ID NO: 4064636 - RNA, 19 nt, Staphylococcus aureus subsp. aureus N315
aucuacaauauuaaaauua

SEQ ID NO: 4064637 - RNA, 19 nt, Staphylococcus aureus subsp. aureus N315
aucuacagagaaucaauua

SEQ ID NO: 4064638 - RNA, 14 nt, Staphylococcus aureus subsp. aureus N315
aucuacuaagugcc

SEQ ID NO: 4064639 - RNA, 15 nt, Staphylococcus aureus subsp. aureus N315
aucuacuauuuaauc

SEQ ID NO: 4064640 - RNA, 15 nt, Staphylococcus aureus subsp. aureus N315
aucuacucaaauaua

SEQ ID NO: 4064641 - RNA, 21 nt, Staphylococcus aureus subsp. aureus N315
aucuacucaaauauaaauaaa

SEQ ID NO: 4064642 - RNA, 21 nt, Staphylococcus aureus subsp. aureus N315
aucuagccugaaauagaaaug

SEQ ID NO: 4064643 - RNA, 15 nt, Staphylococcus aureus subsp. aureus N315
aucuaguuguuuuau

SEQ ID NO: 4064644 - RNA, 14 nt, Staphylococcus aureus subsp. aureus N315
aucuauaaaaagaa

SEQ ID NO: 4064645 - RNA, 15 nt, Staphylococcus aureus subsp. aureus N315
aucuauaaaaagaau

SEQ ID NO: 4064646 - RNA, 23 nt, Staphylococcus aureus subsp. aureus N315
aucuauaaaaagaauaugauauu

SEQ ID NO: 4064647 - RNA, 15 nt, Staphylococcus aureus subsp. aureus N315
aucuauaaauacuuu

SEQ ID NO: 4064648 - RNA, 13 nt, Staphylococcus aureus subsp. aureus N315
aucuauaaauggc

SEQ ID NO: 4064649 - RNA, 19 nt, Staphylococcus aureus subsp. aureus N315
aucuauacaauuauggaua

SEQ ID NO: 4064650 - RNA, 16 nt, Staphylococcus aureus subsp. aureus N315
aucuauauaaauguuu

SEQ ID NO: 4064651 - RNA, 12 nt, Staphylococcus aureus subsp. aureus N315
aucuauaugcau

SEQ ID NO: 4064652 - RNA, 18 nt, Staphylococcus aureus subsp. aureus N315
aucuaucgguaauuuuug

SEQ ID NO: 4064653 - RNA, 15 nt, Staphylococcus aureus subsp. aureus N315
aucuaugaaauuuuu

SEQ ID NO: 4064654 - RNA, 20 nt, Staphylococcus aureus subsp. aureus N315
aucuaugcccgugaugggua

SEQ ID NO: 4064655 - RNA, 19 nt, Staphylococcus aureus subsp. aureus N315
aucuauggaaaauguuauc

SEQ ID NO: 4064656 - RNA, 18 nt, Staphylococcus aureus subsp. aureus N315
aucuauuauuauguuaua

SEQ ID NO: 4064657 - RNA, 19 nt, Staphylococcus aureus subsp. aureus N315
aucuauuuaauaauguauc

SEQ ID NO: 4064658 - RNA, 12 nt, Staphylococcus aureus subsp. aureus N315
aucuauuuagcu

SEQ ID NO: 4064659 - RNA, 14 nt, Staphylococcus aureus subsp. aureus N315
aucuauuuaucaua

SEQ ID NO: 4064660 - RNA, 19 nt, Staphylococcus aureus subsp. aureus N315
aucuauuuuaaacucaucc

SEQ ID NO: 4064661 - RNA, 15 nt, Staphylococcus aureus subsp. aureus N315
aucuauuuuuaacua

SEQ ID NO: 4064662 - RNA, 12 nt, Staphylococcus aureus subsp. aureus N315
aucuauuuuucg

SEQ ID NO: 4064663 - RNA, 14 nt, Staphylococcus aureus subsp. aureus N315
aucucaaaauuucg

SEQ ID NO: 4064664 - RNA, 15 nt, Staphylococcus aureus subsp. aureus N315
aucucaacagcaaaa

SEQ ID NO: 4064665 - RNA, 19 nt, Staphylococcus aureus subsp. aureus N315
aucucaacagcaaaaaaua

SEQ ID NO: 4064666 - RNA, 20 nt, Staphylococcus aureus subsp. aureus N315
aucucaacagcaaaaaauaa

SEQ ID NO: 4064667 - RNA, 22 nt, Staphylococcus aureus subsp. aureus N315
aucucaacagcaaaaaauaaau

SEQ ID NO: 4064668 - RNA, 14 nt, Staphylococcus aureus subsp. aureus N315
aucucaauccaauu

SEQ ID NO: 4064669 - RNA, 20 nt, Staphylococcus aureus subsp. aureus N315
aucucaauccaauuaaauau

SEQ ID NO: 4064670 - RNA, 20 nt, Staphylococcus aureus subsp. aureus N315
aucucauucuuuaauauaaa

SEQ ID NO: 4064671 - RNA, 22 nt, Staphylococcus aureus subsp. aureus N315
aucucauuuuuucgagaugaua

SEQ ID NO: 4064672 - RNA, 16 nt, Staphylococcus aureus subsp. aureus N315
aucuccauuagaacua

SEQ ID NO: 4064673 - RNA, 23 nt, Staphylococcus aureus subsp. aureus N315
aucuuuuccauucauaaaagcaa

SEQ ID NO: 4064674 - RNA, 19 nt, Staphylococcus aureus subsp. aureus N315
aucuuuugcuguaucuuca

SEQ ID NO: 4064675 - RNA, 14 nt, Staphylococcus aureus subsp. aureus N315
aucuuuuuaaaagg

SEQ ID NO: 4064676 - RNA, 22 nt, Staphylococcus aureus subsp. aureus N315
aucuuuuucaaugugauuuucu

SEQ ID NO: 4064677 - RNA, 13 nt, Staphylococcus aureus subsp. aureus N315
aucuuuuugaaau

SEQ ID NO: 4064678 - RNA, 14 nt, Staphylococcus aureus subsp. aureus N315
aucuuuuugaaauu

SEQ ID NO: 4064679 - RNA, 14 nt, Staphylococcus aureus subsp. aureus N315
aucuuuuuuuuuau

SEQ ID NO: 4064680 - RNA, 13 nt, Staphylococcus aureus subsp. aureus N315
augaaaaaguaaa

SEQ ID NO: 4064681 - RNA, 23 nt, Staphylococcus aureus subsp. aureus N315
augaaaauaccucuacauuauau

SEQ ID NO: 4064682 - RNA, 19 nt, Staphylococcus aureus subsp. aureus N315
augaaaauauagugguggu

SEQ ID NO: 4064683 - RNA, 19 nt, Staphylococcus aureus subsp. aureus N315
augaaacuuugugugcuuu

SEQ ID NO: 4064684 - RNA, 16 nt, Staphylococcus aureus subsp. aureus N315
augaaaguaccuaaaa

SEQ ID NO: 4064685 - RNA, 17 nt, Staphylococcus aureus subsp. aureus N315
augaaaguaccuaaaau

SEQ ID NO: 4064686 - RNA, 20 nt, Staphylococcus aureus subsp. aureus N315
augaaaguaccuaaaauaga

SEQ ID NO: 4064687 - RNA, 22 nt, Staphylococcus aureus subsp. aureus N315
augaaaguaccuaaaauagaaa

SEQ ID NO: 4064688 - RNA, 22 nt, Staphylococcus aureus subsp. aureus N315
augaaauaacaauagugacuuu

SEQ ID NO: 4064689 - RNA, 22 nt, Staphylococcus aureus subsp. aureus N315
augaaaugucugccaaaccuuu

SEQ ID NO: 4064690 - RNA, 16 nt, Staphylococcus aureus subsp. aureus N315
augaaauuagauuuua

SEQ ID NO: 4064691 - RNA, 14 nt, Staphylococcus aureus subsp. aureus N315
augaaauucuuuug

SEQ ID NO: 4064692 - RNA, 22 nt, Staphylococcus aureus subsp. aureus N315
augaaauuggaauagauguuga

SEQ ID NO: 4064693 - RNA, 21 nt, Staphylococcus aureus subsp. aureus N315
augaaauuguguugaaucaac

SEQ ID NO: 4064694 - RNA, 18 nt, Staphylococcus aureus subsp. aureus N315
augaaauuucaguaucau

SEQ ID NO: 4064695 - RNA, 19 nt, Staphylococcus aureus subsp. aureus N315
augaacaaaaaauaaaaac

SEQ ID NO: 4064696 - RNA, 18 nt, Staphylococcus aureus subsp. aureus N315
augaacaaaauaacaugu

SEQ ID NO: 4064697 - RNA, 13 nt, Staphylococcus aureus subsp. aureus N315
augaaccaaaaaa

SEQ ID NO: 4064698 - RNA, 23 nt, Staphylococcus aureus subsp. aureus N315
augaaccauuuaacucaccuuua

SEQ ID NO: 4064699 - RNA, 20 nt, Staphylococcus aureus subsp. aureus N315
augaacuuaaugcuucaaau

SEQ ID NO: 4064700 - RNA, 22 nt, Staphylococcus aureus subsp. aureus N315
augaacuucuacaguuggaggu

SEQ ID NO: 4064701 - RNA, 14 nt, Staphylococcus aureus subsp. aureus N315
augaagaauacaaa

SEQ ID NO: 4064702 - RNA, 19 nt, Staphylococcus aureus subsp. aureus N315
augaagaggucuccaauac

SEQ ID NO: 4064703 - RNA, 21 nt, Staphylococcus aureus subsp. aureus N315
augaagaggucuccaauacuu

SEQ ID NO: 4064704 - RNA, 13 nt, Staphylococcus aureus subsp. aureus N315
augaagauuuugu

SEQ ID NO: 4064705 - RNA, 21 nt, Staphylococcus aureus subsp. aureus N315
augaagcaguuguugguuuug

SEQ ID NO: 4064706 - RNA, 13 nt, Staphylococcus aureus subsp. aureus N315
augaaggcuuuga

SEQ ID NO: 4064707 - RNA, 21 nt, Staphylococcus aureus subsp. aureus N315
augaaggcuuuuuguuuugaa

SEQ ID NO: 4064708 - RNA, 22 nt, Staphylococcus aureus subsp. aureus N315
augaaguaauauauaaaagucg

SEQ ID NO: 4064709 - RNA, 19 nt, Staphylococcus aureus subsp. aureus N315
augaaguaguuucauugcu

SEQ ID NO: 4064710 - RNA, 16 nt, Staphylococcus aureus subsp. aureus N315
augaaguugguuuaga

SEQ ID NO: 4064711 - RNA, 15 nt, Staphylococcus aureus subsp. aureus N315
augaaguuuuuagca

SEQ ID NO: 4064712 - RNA, 13 nt, Staphylococcus aureus subsp. aureus N315
augaauaacaaga

SEQ ID NO: 4064713 - RNA, 12 nt, Staphylococcus aureus subsp. aureus N315
augaauauauug

SEQ ID NO: 4064714 - RNA, 16 nt, Staphylococcus aureus subsp. aureus N315
augaaucaacaauuua

SEQ ID NO: 4064715 - RNA, 18 nt, Staphylococcus aureus subsp. aureus N315
augaaucgauauaaugaa

SEQ ID NO: 4064716 - RNA, 20 nt, Staphylococcus aureus subsp. aureus N315
augaaucgauauaaugaagu

SEQ ID NO: 4064717 - RNA, 19 nt, Staphylococcus aureus subsp. aureus N315
augaaugccuaauuuugug

SEQ ID NO: 4064718 - RNA, 15 nt, Staphylococcus aureus subsp. aureus N315
augaauuauuuaaaa

SEQ ID NO: 4064719 - RNA, 19 nt, Staphylococcus aureus subsp. aureus N315
augaauucauuuuaucuau

SEQ ID NO: 4064720 - RNA, 20 nt, Staphylococcus aureus subsp. aureus N315
augaauugaguauuaaauuu

SEQ ID NO: 4064721 - RNA, 21 nt, Staphylococcus aureus subsp. aureus N315
augaauugaguauuaaauuug

SEQ ID NO: 4064722 - RNA, 19 nt, Staphylococcus aureus subsp. aureus N315
augaauugucuuaauaugc

SEQ ID NO: 4064723 - RNA, 20 nt, Staphylococcus aureus subsp. aureus N315
augaauuuacuccuuacaau

SEQ ID NO: 4064724 - RNA, 22 nt, Staphylococcus aureus subsp. aureus N315
augaauuuagaugcauaaaaaa

SEQ ID NO: 4064725 - RNA, 22 nt, Staphylococcus aureus subsp. aureus N315
augaauuuuaauauauuuggag

SEQ ID NO: 4064726 - RNA, 16 nt, Staphylococcus aureus subsp. aureus N315
augacaucaauaucuu

SEQ ID NO: 4064727 - RNA, 21 nt, Staphylococcus aureus subsp. aureus N315
augacauuuaauacuuuucuc

SEQ ID NO: 4064728 - RNA, 19 nt, Staphylococcus aureus subsp. aureus N315
augaccaauagcaauugaa

SEQ ID NO: 4064729 - RNA, 15 nt, Staphylococcus aureus subsp. aureus N315
augaccauugucaug

SEQ ID NO: 4064730 - RNA, 22 nt, Staphylococcus aureus subsp. aureus N315
augaccauugucaugccuucau

SEQ ID NO: 4064731 - RNA, 20 nt, Staphylococcus aureus subsp. aureus N315
augacgagaauuaaagucug

SEQ ID NO: 4064732 - RNA, 14 nt, Staphylococcus aureus subsp. aureus N315
augacgugcuuuua

SEQ ID NO: 4064733 - RNA, 16 nt, Staphylococcus aureus subsp. aureus N315
augacgugcuuuuaaa

SEQ ID NO: 4064734 - RNA, 13 nt, Staphylococcus aureus subsp. aureus N315
augacuaacgaaa

SEQ ID NO: 4064735 - RNA, 17 nt, Staphylococcus aureus subsp. aureus N315
augacuaagauaucugg

SEQ ID NO: 4064736 - RNA, 19 nt, Staphylococcus aureus subsp. aureus N315
augacuacaacuuaagagu

SEQ ID NO: 4064737 - RNA, 14 nt, Staphylococcus aureus subsp. aureus N315
augacuauuuucca

SEQ ID NO: 4064738 - RNA, 15 nt, Staphylococcus aureus subsp. aureus N315
augacuauuuuccau

SEQ ID NO: 4064739 - RNA, 13 nt, Staphylococcus aureus subsp. aureus N315
augacucacuaau

SEQ ID NO: 4064740 - RNA, 18 nt, Staphylococcus aureus subsp. aureus N315
augacugagaaaaauauu

SEQ ID NO: 4064741 - RNA, 14 nt, Staphylococcus aureus subsp. aureus N315
augacugcaaauac

SEQ ID NO: 4064742 - RNA, 20 nt, Staphylococcus aureus subsp. aureus N315
augacuguugguuugaucau

SEQ ID NO: 4064743 - RNA, 21 nt, Staphylococcus aureus subsp. aureus N315
augacuguugguuugaucauu

SEQ ID NO: 4064744 - RNA, 22 nt, Staphylococcus aureus subsp. aureus N315
augacuguugguuugaucauuu

SEQ ID NO: 4064745 - RNA, 19 nt, Staphylococcus aureus subsp. aureus N315
augacuuauuuuucaucau

SEQ ID NO: 4064746 - RNA, 20 nt, Staphylococcus aureus subsp. aureus N315
augacuuauuuuucaucauu

SEQ ID NO: 4064747 - RNA, 23 nt, Staphylococcus aureus subsp. aureus N315
augacuuuuuauuaguauucaaa

SEQ ID NO: 4064748 - RNA, 21 nt, Staphylococcus aureus subsp. aureus N315
augagacgcauugcaagacuu

SEQ ID NO: 4064749 - RNA, 20 nt, Staphylococcus aureus subsp. aureus N315
augagauuauuuuuuuaaau

SEQ ID NO: 4064750 - RNA, 16 nt, Staphylococcus aureus subsp. aureus N315
augagcccguuaaaaa

SEQ ID NO: 4064751 - RNA, 11 nt, Staphylococcus aureus subsp. aureus N315
augaguacaac

SEQ ID NO: 4064752 - RNA, 14 nt, Staphylococcus aureus subsp. aureus N315
augaguuuaaaaau

SEQ ID NO: 4064753 - RNA, 15 nt, Staphylococcus aureus subsp. aureus N315
augaguuuaaaaaua

SEQ ID NO: 4064754 - RNA, 18 nt, Staphylococcus aureus subsp. aureus N315
augaguuuacuaaacuuu

SEQ ID NO: 4064755 - RNA, 17 nt, Staphylococcus aureus subsp. aureus N315
augaguuucucaucuac

SEQ ID NO: 4064756 - RNA, 12 nt, Staphylococcus aureus subsp. aureus N315
augauaaccauu

SEQ ID NO: 4064757 - RNA, 22 nt, Staphylococcus aureus subsp. aureus N315
augauaacucguaaucauagca

SEQ ID NO: 4064758 - RNA, 14 nt, Staphylococcus aureus subsp. aureus N315
augauaagaaucau

SEQ ID NO: 4064759 - RNA, 14 nt, Staphylococcus aureus subsp. aureus N315
augauaauaagaau

SEQ ID NO: 4064760 - RNA, 20 nt, Staphylococcus aureus subsp. aureus N315
augcccuagguuuauauauc

SEQ ID NO: 4064761 - RNA, 20 nt, Staphylococcus aureus subsp. aureus N315
augccgcuucuaauuuuuca

SEQ ID NO: 4064762 - RNA, 22 nt, Staphylococcus aureus subsp. aureus N315
augccggucaaagcgaauagaa

SEQ ID NO: 4064763 - RNA, 19 nt, Staphylococcus aureus subsp. aureus N315
augccuugucuauuguaaa

SEQ ID NO: 4064764 - RNA, 22 nt, Staphylococcus aureus subsp. aureus N315
augccuuuuauuuaucuuuuaa

SEQ ID NO: 4064765 - RNA, 15 nt, Staphylococcus aureus subsp. aureus N315
augcgauugaugcgu

SEQ ID NO: 4064766 - RNA, 13 nt, Staphylococcus aureus subsp. aureus N315
augcgcaaaagcg

SEQ ID NO: 4064767 - RNA, 16 nt, Staphylococcus aureus subsp. aureus N315
augcgcaaaagcgcag

SEQ ID NO: 4064768 - RNA, 18 nt, Staphylococcus aureus subsp. aureus N315
augcgcaaaagcgcaggc

SEQ ID NO: 4064769 - RNA, 19 nt, Staphylococcus aureus subsp. aureus N315
augcgcaaaagcgcaggcg

SEQ ID NO: 4064770 - RNA, 17 nt, Staphylococcus aureus subsp. aureus N315
augcgcuuguaacaagc

SEQ ID NO: 4064771 - RNA, 21 nt, Staphylococcus aureus subsp. aureus N315
augcuacacgaguauuaucac

SEQ ID NO: 4064772 - RNA, 23 nt, Staphylococcus aureus subsp. aureus N315
augcuagcuuucuuuuucaucuu

SEQ ID NO: 4064773 - RNA, 16 nt, Staphylococcus aureus subsp. aureus N315
augcuauauuucggua

SEQ ID NO: 4064774 - RNA, 22 nt, Staphylococcus aureus subsp. aureus N315
augcuauauuucgguauuuuaa

SEQ ID NO: 4064775 - RNA, 20 nt, Staphylococcus aureus subsp. aureus N315
augcucacuuuuuaaaguaa

SEQ ID NO: 4064776 - RNA, 15 nt, Staphylococcus aureus subsp. aureus N315
augcucguauagaaa

SEQ ID NO: 4064777 - RNA, 19 nt, Staphylococcus aureus subsp. aureus N315
augcucucuucaaaguaga

SEQ ID NO: 4064778 - RNA, 20 nt, Staphylococcus aureus subsp. aureus N315
augcugcaagucucauaucu

SEQ ID NO: 4064779 - RNA, 17 nt, Staphylococcus aureus subsp. aureus N315
augcugcacauuccauc

SEQ ID NO: 4064780 - RNA, 15 nt, Staphylococcus aureus subsp. aureus N315
augcuuaaaaacaau

SEQ ID NO: 4064781 - RNA, 21 nt, Staphylococcus aureus subsp. aureus N315
augcuuagcgaacgcuagcau

SEQ ID NO: 4064782 - RNA, 14 nt, Staphylococcus aureus subsp. aureus N315
augcuuaucuguaa

SEQ ID NO: 4064783 - RNA, 22 nt, Staphylococcus aureus subsp. aureus N315
augcuucaaaaauuaaucaccu

SEQ ID NO: 4064784 - RNA, 13 nt, Staphylococcus aureus subsp. aureus N315
augcuucaauauu

SEQ ID NO: 4064785 - RNA, 18 nt, Staphylococcus aureus subsp. aureus N315
augcuucaauauucuuau

SEQ ID NO: 4064786 - RNA, 19 nt, Staphylococcus aureus subsp. aureus N315
augcuucaauauucuuauc

SEQ ID NO: 4064787 - RNA, 22 nt, Staphylococcus aureus subsp. aureus N315
augcuuccuuuuuguuauaucu

SEQ ID NO: 4064788 - RNA, 15 nt, Staphylococcus aureus subsp. aureus N315
augcuucuaacugaa

SEQ ID NO: 4064789 - RNA, 19 nt, Staphylococcus aureus subsp. aureus N315
augcuucucacaacugcau

SEQ ID NO: 4064790 - RNA, 22 nt, Staphylococcus aureus subsp. aureus N315
augcuuguacaaaaaauuguaa

SEQ ID NO: 4064791 - RNA, 17 nt, Staphylococcus aureus subsp. aureus N315
augcuuuaauuaaaguu

SEQ ID NO: 4064792 - RNA, 20 nt, Staphylococcus aureus subsp. aureus N315
augcuuuaugugcagcuuga

SEQ ID NO: 4064793 - RNA, 17 nt, Staphylococcus aureus subsp. aureus N315
augcuuuuaauauuaua

SEQ ID NO: 4064794 - RNA, 20 nt, Staphylococcus aureus subsp. aureus N315
augcuuuuuuuacaauauga

SEQ ID NO: 4064795 - RNA, 13 nt, Staphylococcus aureus subsp. aureus N315
auggaaaaguuuu

SEQ ID NO: 4064796 - RNA, 15 nt, Staphylococcus aureus subsp. aureus N315
auggaaaaguuuuuu

SEQ ID NO: 4064797 - RNA, 20 nt, Staphylococcus aureus subsp. aureus N315
auggaaaguugguuuuauua

SEQ ID NO: 4064798 - RNA, 21 nt, Staphylococcus aureus subsp. aureus N315
auggaaguuguugcuuuggua

SEQ ID NO: 4064799 - RNA, 16 nt, Staphylococcus aureus subsp. aureus N315
auggaauagucccuuu

SEQ ID NO: 4064800 - RNA, 16 nt, Staphylococcus aureus subsp. aureus N315
auggacaguuuuuaua

SEQ ID NO: 4064801 - RNA, 22 nt, Staphylococcus aureus subsp. aureus N315
auggacuaagauauaaggaaaa

SEQ ID NO: 4064802 - RNA, 15 nt, Staphylococcus aureus subsp. aureus N315
auggagcggaagaua

SEQ ID NO: 4064803 - RNA, 18 nt, Staphylococcus aureus subsp. aureus N315
auggagcggaagauagga

SEQ ID NO: 4064804 - RNA, 13 nt, Staphylococcus aureus subsp. aureus N315
auggauauucaau

SEQ ID NO: 4064805 - RNA, 14 nt, Staphylococcus aureus subsp. aureus N315
auggauuucuuauu

SEQ ID NO: 4064806 - RNA, 20 nt, Staphylococcus aureus subsp. aureus N315
auggauuuggucaaguuuug

SEQ ID NO: 4064807 - RNA, 15 nt, Staphylococcus aureus subsp. aureus N315
auggcagcgaucuuu

SEQ ID NO: 4064808 - RNA, 23 nt, Staphylococcus aureus subsp. aureus N315
auggcaguaguugacugaacgaa

SEQ ID NO: 4064809 - RNA, 20 nt, Staphylococcus aureus subsp. aureus N315
auggcaucaucaccauacua

SEQ ID NO: 4064810 - RNA, 19 nt, Staphylococcus aureus subsp. aureus N315
auggcaucuggcaaauugc

SEQ ID NO: 4064811 - RNA, 20 nt, Staphylococcus aureus subsp. aureus N315
auggcaucuggcaaauugcc

SEQ ID NO: 4064812 - RNA, 18 nt, Staphylococcus aureus subsp. aureus N315
auggcgcaauuuuuaaca

SEQ ID NO: 4064813 - RNA, 21 nt, Staphylococcus aureus subsp. aureus N315
auggcgcaauuuuuaacaaaa

SEQ ID NO: 4064814 - RNA, 13 nt, Staphylococcus aureus subsp. aureus N315
auggcuaauacaa

SEQ ID NO: 4064815 - RNA, 20 nt, Staphylococcus aureus subsp. aureus N315
auggcuagucuuuaacuuua

SEQ ID NO: 4064816 - RNA, 20 nt, Staphylococcus aureus subsp. aureus N315
auggcuauguuuuacgccaa

SEQ ID NO: 4064817 - RNA, 14 nt, Staphylococcus aureus subsp. aureus N315
auggcugcaacaau

SEQ ID NO: 4064818 - RNA, 21 nt, Staphylococcus aureus subsp. aureus N315
auggcugcaacaauuugcaua

SEQ ID NO: 4064819 - RNA, 17 nt, Staphylococcus aureus subsp. aureus N315
auggcugcaucaauaug

SEQ ID NO: 4064820 - RNA, 22 nt, Staphylococcus aureus subsp. aureus N315
auggcuuagguuuaauuuuaaa

SEQ ID NO: 4064821 - RNA, 23 nt, Staphylococcus aureus subsp. aureus N315
auggcuuuuuuugcuguuuaguu

SEQ ID NO: 4064822 - RNA, 19 nt, Staphylococcus aureus subsp. aureus N315
augggagugggacagaaau

SEQ ID NO: 4064823 - RNA, 21 nt, Staphylococcus aureus subsp. aureus N315
augggauuucacuugaccacu

SEQ ID NO: 4064824 - RNA, 21 nt, Staphylococcus aureus subsp. aureus N315
augggccccaacacagagaau

SEQ ID NO: 4064825 - RNA, 19 nt, Staphylococcus aureus subsp. aureus N315
augggggauuuuuuuaugu

SEQ ID NO: 4064826 - RNA, 17 nt, Staphylococcus aureus subsp. aureus N315
auggguaaucuuuagga

SEQ ID NO: 4064827 - RNA, 22 nt, Staphylococcus aureus subsp. aureus N315
auggguauuuuguucaguuaaa

SEQ ID NO: 4064828 - RNA, 20 nt, Staphylococcus aureus subsp. aureus N315
augguaaguauaauuaaacu

SEQ ID NO: 4064829 - RNA, 14 nt, Staphylococcus aureus subsp. aureus N315
augguaucuuuaau

SEQ ID NO: 4064830 - RNA, 22 nt, Staphylococcus aureus subsp. aureus N315
augguaucuuuaauuucauuua

SEQ ID NO: 4064831 - RNA, 22 nt, Staphylococcus aureus subsp. aureus N315
augguauuuacccaacauauca

SEQ ID NO: 4064832 - RNA, 20 nt, Staphylococcus aureus subsp. aureus N315
auggucaacuuuuuuaacuu

SEQ ID NO: 4064833 - RNA, 15 nt, Staphylococcus aureus subsp. aureus N315
auggucuggaauaaa

SEQ ID NO: 4064834 - RNA, 19 nt, Staphylococcus aureus subsp. aureus N315
auggugguaccacauacau

SEQ ID NO: 4064835 - RNA, 16 nt, Staphylococcus aureus subsp. aureus N315
augguuagagaaaaau

SEQ ID NO: 4064836 - RNA, 15 nt, Staphylococcus aureus subsp. aureus N315
augguucguccauuc

SEQ ID NO: 4064837 - RNA, 17 nt, Staphylococcus aureus subsp. aureus N315
augguucuauaauaaau

SEQ ID NO: 4064838 - RNA, 20 nt, Staphylococcus aureus subsp. aureus N315
augguugaauaacacuagaa

SEQ ID NO: 4064839 - RNA, 19 nt, Staphylococcus aureus subsp. aureus N315
augguugauucgauaugaa

SEQ ID NO: 4064840 - RNA, 15 nt, Staphylococcus aureus subsp. aureus N315
augguuucauaaacu

SEQ ID NO: 4064841 - RNA, 13 nt, Staphylococcus aureus subsp. aureus N315
auguaaaaaauau

SEQ ID NO: 4064842 - RNA, 20 nt, Staphylococcus aureus subsp. aureus N315
auguaaaaaauaucuuguca

SEQ ID NO: 4064843 - RNA, 14 nt, Staphylococcus aureus subsp. aureus N315
auguaaaauuaaau

SEQ ID NO: 4064844 - RNA, 19 nt, Staphylococcus aureus subsp. aureus N315
auguaaagaguacagcggu

SEQ ID NO: 4064845 - RNA, 19 nt, Staphylococcus aureus subsp. aureus N315
auguaaagccaccuaaauc

SEQ ID NO: 4064846 - RNA, 15 nt, Staphylococcus aureus subsp. aureus N315
auguaaauaaaaauu

SEQ ID NO: 4064847 - RNA, 20 nt, Staphylococcus aureus subsp. aureus N315
auguuccauauaaccuauuu

SEQ ID NO: 4064848 - RNA, 18 nt, Staphylococcus aureus subsp. aureus N315
auguuccccauuaauuaa

SEQ ID NO: 4064849 - RNA, 21 nt, Staphylococcus aureus subsp. aureus N315
auguuccccauuaauuaacaa

SEQ ID NO: 4064850 - RNA, 22 nt, Staphylococcus aureus subsp. aureus N315
auguucccuuaccauuucuuca

SEQ ID NO: 4064851 - RNA, 18 nt, Staphylococcus aureus subsp. aureus N315
auguucuuauaaaaaaca

SEQ ID NO: 4064852 - RNA, 21 nt, Staphylococcus aureus subsp. aureus N315
auguugaauguggaacaugau

SEQ ID NO: 4064853 - RNA, 21 nt, Staphylococcus aureus subsp. aureus N315
auguugcauccccagccauuu

SEQ ID NO: 4064854 - RNA, 15 nt, Staphylococcus aureus subsp. aureus N315
auguugcguuaaaua

SEQ ID NO: 4064855 - RNA, 17 nt, Staphylococcus aureus subsp. aureus N315
auguuggaucggcauug

SEQ ID NO: 4064856 - RNA, 18 nt, Staphylococcus aureus subsp. aureus N315
auguugguucaucaaaca

SEQ ID NO: 4064857 - RNA, 20 nt, Staphylococcus aureus subsp. aureus N315
auguugguucaucaaacaac

SEQ ID NO: 4064858 - RNA, 16 nt, Staphylococcus aureus subsp. aureus N315
auguuguuauaaagga

SEQ ID NO: 4064859 - RNA, 21 nt, Staphylococcus aureus subsp. aureus N315
auguuguuugcggcuuccucu

SEQ ID NO: 4064860 - RNA, 16 nt, Staphylococcus aureus subsp. aureus N315
auguuuaaaaaacuac

SEQ ID NO: 4064861 - RNA, 14 nt, Staphylococcus aureus subsp. aureus N315
auguuuaaacauuu

SEQ ID NO: 4064862 - RNA, 15 nt, Staphylococcus aureus subsp. aureus N315
auguuuaaacauuuu

SEQ ID NO: 4064863 - RNA, 17 nt, Staphylococcus aureus subsp. aureus N315
auguuuaauuuucuaaa

SEQ ID NO: 4064864 - RNA, 19 nt, Staphylococcus aureus subsp. aureus N315
auguuuauauugcaaaaau

SEQ ID NO: 4064865 - RNA, 17 nt, Staphylococcus aureus subsp. aureus N315
auguuucagaacugcca

SEQ ID NO: 4064866 - RNA, 12 nt, Staphylococcus aureus subsp. aureus N315
auguuuccauuu

SEQ ID NO: 4064867 - RNA, 13 nt, Staphylococcus aureus subsp. aureus N315
auguuuccauuua

SEQ ID NO: 4064868 - RNA, 18 nt, Staphylococcus aureus subsp. aureus N315
auguuucuucaauugucu

SEQ ID NO: 4064869 - RNA, 22 nt, Staphylococcus aureus subsp. aureus N315
auguuucuucaauuuaauguau

SEQ ID NO: 4064870 - RNA, 22 nt, Staphylococcus aureus subsp. aureus N315
auguuugaugauucguauucaa

SEQ ID NO: 4064871 - RNA, 19 nt, Staphylococcus aureus subsp. aureus N315
auguuugauucuaaauaau

SEQ ID NO: 4064872 - RNA, 18 nt, Staphylococcus aureus subsp. aureus N315
auguuugcaacauauuuu

SEQ ID NO: 4064873 - RNA, 20 nt, Staphylococcus aureus subsp. aureus N315
auguuugcaacauauuuuca

SEQ ID NO: 4064874 - RNA, 16 nt, Staphylococcus aureus subsp. aureus N315
auguuuggaugaacaa

SEQ ID NO: 4064875 - RNA, 17 nt, Staphylococcus aureus subsp. aureus N315
auguuuggcauaauaau

SEQ ID NO: 4064876 - RNA, 18 nt, Staphylococcus aureus subsp. aureus N315
auguuuguaaaucaagug

SEQ ID NO: 4064877 - RNA, 22 nt, Staphylococcus aureus subsp. aureus N315
auguuugucguuacuaccuauu

SEQ ID NO: 4064878 - RNA, 22 nt, Staphylococcus aureus subsp. aureus N315
auguuuucguuugcaaucaucu

SEQ ID NO: 4064879 - RNA, 16 nt, Staphylococcus aureus subsp. aureus N315
auguuuuuauuauaca

SEQ ID NO: 4064880 - RNA, 14 nt, Staphylococcus aureus subsp. aureus N315
auuaaaaaacaaaa

SEQ ID NO: 4064881 - RNA, 15 nt, Staphylococcus aureus subsp. aureus N315
auuaaaaaacaaaac

SEQ ID NO: 4064882 - RNA, 15 nt, Staphylococcus aureus subsp. aureus N315
auuaaaaaucaaaga

SEQ ID NO: 4064883 - RNA, 17 nt, Staphylococcus aureus subsp. aureus N315
auuaaaaauuucaauaa

SEQ ID NO: 4064884 - RNA, 23 nt, Staphylococcus aureus subsp. aureus N315
auuaaaacgaaguuauuuauuca

SEQ ID NO: 4064885 - RNA, 22 nt, Staphylococcus aureus subsp. aureus N315
auuaaaaggaugugacaaauac

SEQ ID NO: 4064886 - RNA, 12 nt, Staphylococcus aureus subsp. aureus N315
auuaaaauagag

SEQ ID NO: 4064887 - RNA, 15 nt, Staphylococcus aureus subsp. aureus N315
auuaaaaucugcuuu

SEQ ID NO: 4064888 - RNA, 21 nt, Staphylococcus aureus subsp. aureus N315
auuaaaaugauaucugacauu

SEQ ID NO: 4064889 - RNA, 18 nt, Staphylococcus aureus subsp. aureus N315
auuaaaauguuaauaaug

SEQ ID NO: 4064890 - RNA, 22 nt, Staphylococcus aureus subsp. aureus N315
auuaaacacgcgguaaaacgaa

SEQ ID NO: 4064891 - RNA, 23 nt, Staphylococcus aureus subsp. aureus N315
auuaaaccuacaacgaagaaucc

SEQ ID NO: 4064892 - RNA, 19 nt, Staphylococcus aureus subsp. aureus N315
auuaaacgcucaacuauau

SEQ ID NO: 4064893 - RNA, 20 nt, Staphylococcus aureus subsp. aureus N315
auuaaacuuaagaauacaug

SEQ ID NO: 4064894 - RNA, 12 nt, Staphylococcus aureus subsp. aureus N315
auuaaacuuaua

SEQ ID NO: 4064895 - RNA, 15 nt, Staphylococcus aureus subsp. aureus N315
auuaaacuuauaacu

SEQ ID NO: 4064896 - RNA, 17 nt, Staphylococcus aureus subsp. aureus N315
auuaaacuuauaacuuu

SEQ ID NO: 4064897 - RNA, 23 nt, Staphylococcus aureus subsp. aureus N315
auuaaagcgauaauagauaccau

SEQ ID NO: 4064898 - RNA, 22 nt, Staphylococcus aureus subsp. aureus N315
auuaaagcuccagucauuuguu

SEQ ID NO: 4064899 - RNA, 21 nt, Staphylococcus aureus subsp. aureus N315
auuaaaguguuucaacauauu

SEQ ID NO: 4064900 - RNA, 17 nt, Staphylococcus aureus subsp. aureus N315
auuaaauaacacaugca

SEQ ID NO: 4064901 - RNA, 21 nt, Staphylococcus aureus subsp. aureus N315
auuaaauacuuguuuaccuaa

SEQ ID NO: 4064902 - RNA, 11 nt, Staphylococcus aureus subsp. aureus N315
auuaaauagau

SEQ ID NO: 4064903 - RNA, 23 nt, Staphylococcus aureus subsp. aureus N315
auuaaauccgcuuguucaacuaa

SEQ ID NO: 4064904 - RNA, 20 nt, Staphylococcus aureus subsp. aureus N315
auuaaaucuucuaguaauuc

SEQ ID NO: 4064905 - RNA, 19 nt, Staphylococcus aureus subsp. aureus N315
auuaaaugaugcaguaaaa

SEQ ID NO: 4064906 - RNA, 22 nt, Staphylococcus aureus subsp. aureus N315
auuaaaugaugcaguaaaacca

SEQ ID NO: 4064907 - RNA, 21 nt, Staphylococcus aureus subsp. aureus N315
auuaaaugcucgauuagauca

SEQ ID NO: 4064908 - RNA, 23 nt, Staphylococcus aureus subsp. aureus N315
auuaaaugcucgauuagaucaca

SEQ ID NO: 4064909 - RNA, 19 nt, Staphylococcus aureus subsp. aureus N315
auuaaauguacauuguaaa

SEQ ID NO: 4064910 - RNA, 19 nt, Staphylococcus aureus subsp. aureus N315
auuaaauuauauguuuuua

SEQ ID NO: 4064911 - RNA, 22 nt, Staphylococcus aureus subsp. aureus N315
auuaaauuauauguuuuuauua

SEQ ID NO: 4064912 - RNA, 20 nt, Staphylococcus aureus subsp. aureus N315
auuaaauuauggagcggaag

SEQ ID NO: 4064913 - RNA, 21 nt, Staphylococcus aureus subsp. aureus N315
auuaaauucaucuugcaagua

SEQ ID NO: 4064914 - RNA, 18 nt, Staphylococcus aureus subsp. aureus N315
auuaaauuuguuauaccu

SEQ ID NO: 4064915 - RNA, 20 nt, Staphylococcus aureus subsp. aureus N315
auuaaauuuguuauaccugg

SEQ ID NO: 4064916 - RNA, 17 nt, Staphylococcus aureus subsp. aureus N315
auuaacaacaaauauaa

SEQ ID NO: 4064917 - RNA, 13 nt, Staphylococcus aureus subsp. aureus N315
auuaacacauuca

SEQ ID NO: 4064918 - RNA, 19 nt, Staphylococcus aureus subsp. aureus N315
auuaacacauucaaauaaa

SEQ ID NO: 4064919 - RNA, 22 nt, Staphylococcus aureus subsp. aureus N315
auuaacacauucuuauuugaaa

SEQ ID NO: 4064920 - RNA, 21 nt, Staphylococcus aureus subsp. aureus N315
auuaacaccagauaucauaau

SEQ ID NO: 4064921 - RNA, 18 nt, Staphylococcus aureus subsp. aureus N315
auuaacgucaacagcaua

SEQ ID NO: 4064922 - RNA, 20 nt, Staphylococcus aureus subsp. aureus N315
auuaacuguguauggcauaa

SEQ ID NO: 4064923 - RNA, 19 nt, Staphylococcus aureus subsp. aureus N315
auuaagaagaaauacuuga

SEQ ID NO: 4064924 - RNA, 21 nt, Staphylococcus aureus subsp. aureus N315
auuaagaauaaucgaacauaa

SEQ ID NO: 4064925 - RNA, 17 nt, Staphylococcus aureus subsp. aureus N315
auuaagauguauaugaa

SEQ ID NO: 4064926 - RNA, 19 nt, Staphylococcus aureus subsp. aureus N315
auuaagauguauaugaauu

SEQ ID NO: 4064927 - RNA, 15 nt, Staphylococcus aureus subsp. aureus N315
auuaagcuaugcuuu

SEQ ID NO: 4064928 - RNA, 16 nt, Staphylococcus aureus subsp. aureus N315
auuaaggcuuuaguag

SEQ ID NO: 4064929 - RNA, 17 nt, Staphylococcus aureus subsp. aureus N315
auuaaguaauagcaacc

SEQ ID NO: 4064930 - RNA, 16 nt, Staphylococcus aureus subsp. aureus N315
auuaaguacuuuuaca

SEQ ID NO: 4064931 - RNA, 17 nt, Staphylococcus aureus subsp. aureus N315
auuaaguacuuuuacaa

SEQ ID NO: 4064932 - RNA, 20 nt, Staphylococcus aureus subsp. aureus N315
auuaauaagcauuaauguuc

SEQ ID NO: 4064933 - RNA, 14 nt, Staphylococcus aureus subsp. aureus N315
auuagauuuuaugc

SEQ ID NO: 4064934 - RNA, 22 nt, Staphylococcus aureus subsp. aureus N315
auuagauuuuaugcuuuacuug

SEQ ID NO: 4064935 - RNA, 15 nt, Staphylococcus aureus subsp. aureus N315
auuagcaaauauuau

SEQ ID NO: 4064936 - RNA, 21 nt, Staphylococcus aureus subsp. aureus N315
auuagcaaauauuauuaaauc

SEQ ID NO: 4064937 - RNA, 15 nt, Staphylococcus aureus subsp. aureus N315
auuagcgaaaaccuc

SEQ ID NO: 4064938 - RNA, 22 nt, Staphylococcus aureus subsp. aureus N315
auuagcgaaaaccucuguuuug

SEQ ID NO: 4064939 - RNA, 14 nt, Staphylococcus aureus subsp. aureus N315
auuagcgaaaacua

SEQ ID NO: 4064940 - RNA, 17 nt, Staphylococcus aureus subsp. aureus N315
auuagcgcaagagauaa

SEQ ID NO: 4064941 - RNA, 19 nt, Staphylococcus aureus subsp. aureus N315
auuagcguuagauaccucu

SEQ ID NO: 4064942 - RNA, 23 nt, Staphylococcus aureus subsp. aureus N315
auuaggaauccaauuucucuaug

SEQ ID NO: 4064943 - RNA, 15 nt, Staphylococcus aureus subsp. aureus N315
auuaguaaauauagu

SEQ ID NO: 4064944 - RNA, 14 nt, Staphylococcus aureus subsp. aureus N315
auuaguaaugauua

SEQ ID NO: 4064945 - RNA, 18 nt, Staphylococcus aureus subsp. aureus N315
auuaguaaugauuaacuu

SEQ ID NO: 4064946 - RNA, 19 nt, Staphylococcus aureus subsp. aureus N315
auuaguaauuuuuaaaucu

SEQ ID NO: 4064947 - RNA, 13 nt, Staphylococcus aureus subsp. aureus N315
auuaguaugacuu

SEQ ID NO: 4064948 - RNA, 19 nt, Staphylococcus aureus subsp. aureus N315
auuaguauucaaaaaauau

SEQ ID NO: 4064949 - RNA, 17 nt, Staphylococcus aureus subsp. aureus N315
auuagugucacaaagaa

SEQ ID NO: 4064950 - RNA, 20 nt, Staphylococcus aureus subsp. aureus N315
auuagugucacaaagaaauu

SEQ ID NO: 4064951 - RNA, 17 nt, Staphylococcus aureus subsp. aureus N315
auuaguucuggcaaaga

SEQ ID NO: 4064952 - RNA, 21 nt, Staphylococcus aureus subsp. aureus N315
auuaguucuggcaaagaaucc

SEQ ID NO: 4064953 - RNA, 20 nt, Staphylococcus aureus subsp. aureus N315
auuaguucuguugauauuuc

SEQ ID NO: 4064954 - RNA, 15 nt, Staphylococcus aureus subsp. aureus N315
auuaguuuuuaaaau

SEQ ID NO: 4064955 - RNA, 16 nt, Staphylococcus aureus subsp. aureus N315
auuaguuuuuaaaauu

SEQ ID NO: 4064956 - RNA, 21 nt, Staphylococcus aureus subsp. aureus N315
auuaguuuuuaaaauuaucaa

SEQ ID NO: 4064957 - RNA, 17 nt, Staphylococcus aureus subsp. aureus N315
auuauaaaaacagcagu

SEQ ID NO: 4064958 - RNA, 14 nt, Staphylococcus aureus subsp. aureus N315
auuauaaaauaaau

SEQ ID NO: 4064959 - RNA, 14 nt, Staphylococcus aureus subsp. aureus N315
auuauaaauauuuu

SEQ ID NO: 4064960 - RNA, 13 nt, Staphylococcus aureus subsp. aureus N315
auuauaaaugauu

SEQ ID NO: 4064961 - RNA, 14 nt, Staphylococcus aureus subsp. aureus N315
auuauaacgugcuu

SEQ ID NO: 4064962 - RNA, 18 nt, Staphylococcus aureus subsp. aureus N315
auuauaacgugcuuuuuu

SEQ ID NO: 4064963 - RNA, 20 nt, Staphylococcus aureus subsp. aureus N315
auuauaaguagugauuuuuu

SEQ ID NO: 4064964 - RNA, 16 nt, Staphylococcus aureus subsp. aureus N315
auuauaauaaauagac

SEQ ID NO: 4064965 - RNA, 18 nt, Staphylococcus aureus subsp. aureus N315
auuauaauaaauagacug

SEQ ID NO: 4064966 - RNA, 15 nt, Staphylococcus aureus subsp. aureus N315
auuauaauagcuuuc

SEQ ID NO: 4064967 - RNA, 22 nt, Staphylococcus aureus subsp. aureus N315
auuauaauagcuuucguuucuu

SEQ ID NO: 4064968 - RNA, 14 nt, Staphylococcus aureus subsp. aureus N315
auuauaauuguuca

SEQ ID NO: 4064969 - RNA, 17 nt, Staphylococcus aureus subsp. aureus N315
auuauaauuuuguuuca

SEQ ID NO: 4064970 - RNA, 13 nt, Staphylococcus aureus subsp. aureus N315
auuauacacuuuu

SEQ ID NO: 4064971 - RNA, 18 nt, Staphylococcus aureus subsp. aureus N315
auuauacgugcuuuaaag

SEQ ID NO: 4064972 - RNA, 15 nt, Staphylococcus aureus subsp. aureus N315
auuauacuuuacauu

SEQ ID NO: 4064973 - RNA, 21 nt, Staphylococcus aureus subsp. aureus N315
auuauacuuuacauuucucgu

SEQ ID NO: 4064974 - RNA, 21 nt, Staphylococcus aureus subsp. aureus N315
auuauagaugacuguagaaaa

SEQ ID NO: 4064975 - RNA, 17 nt, Staphylococcus aureus subsp. aureus N315
auuauagccuauccauu

SEQ ID NO: 4064976 - RNA, 18 nt, Staphylococcus aureus subsp. aureus N315
auuauagucuuaaacaua

SEQ ID NO: 4064977 - RNA, 19 nt, Staphylococcus aureus subsp. aureus N315
auuauagucuuaaacauaa

SEQ ID NO: 4064978 - RNA, 19 nt, Staphylococcus aureus subsp. aureus N315
auuauauacccaccacauu

SEQ ID NO: 4064979 - RNA, 20 nt, Staphylococcus aureus subsp. aureus N315
auuauaucgucguaacucuu

SEQ ID NO: 4064980 - RNA, 15 nt, Staphylococcus aureus subsp. aureus N315
auuaucaauagauga

SEQ ID NO: 4064981 - RNA, 21 nt, Staphylococcus aureus subsp. aureus N315
auuaucaccuucaaacuuuca

SEQ ID NO: 4064982 - RNA, 19 nt, Staphylococcus aureus subsp. aureus N315
auuaucauaugugauuuaa

SEQ ID NO: 4064983 - RNA, 17 nt, Staphylococcus aureus subsp. aureus N315
auuaucauuaaauugcu

SEQ ID NO: 4064984 - RNA, 22 nt, Staphylococcus aureus subsp. aureus N315
auuaucauuacagauaauuauu

SEQ ID NO: 4064985 - RNA, 23 nt, Staphylococcus aureus subsp. aureus N315
auuauccaaggauguuauaaaau

SEQ ID NO: 4064986 - RNA, 17 nt, Staphylococcus aureus subsp. aureus N315
auuauccauucuuuguu

SEQ ID NO: 4064987 - RNA, 13 nt, Staphylococcus aureus subsp. aureus N315
auuauccuacugc

SEQ ID NO: 4064988 - RNA, 18 nt, Staphylococcus aureus subsp. aureus N315
auuauccucaaauauauu

SEQ ID NO: 4064989 - RNA, 22 nt, Staphylococcus aureus subsp. aureus N315
auuaucgaagaaacauuauaua

SEQ ID NO: 4064990 - RNA, 18 nt, Staphylococcus aureus subsp. aureus N315
auuaucgaauuagauuua

SEQ ID NO: 4064991 - RNA, 14 nt, Staphylococcus aureus subsp. aureus N315
auuaucuaaagaaa

SEQ ID NO: 4064992 - RNA, 22 nt, Staphylococcus aureus subsp. aureus N315
auuaucuaaagaaaucucuauc

SEQ ID NO: 4064993 - RNA, 17 nt, Staphylococcus aureus subsp. aureus N315
auuaucuacuauuuguu

SEQ ID NO: 4064994 - RNA, 13 nt, Staphylococcus aureus subsp. aureus N315
auuaucuauauau

SEQ ID NO: 4064995 - RNA, 14 nt, Staphylococcus aureus subsp. aureus N315
auuaucuauccauu

SEQ ID NO: 4064996 - RNA, 14 nt, Staphylococcus aureus subsp. aureus N315
auuaucuguaauua

SEQ ID NO: 4064997 - RNA, 16 nt, Staphylococcus aureus subsp. aureus N315
auuaucuguaauuaau

SEQ ID NO: 4064998 - RNA, 18 nt, Staphylococcus aureus subsp. aureus N315
auuaucuuaagucaucaa

SEQ ID NO: 4064999 - RNA, 22 nt, Staphylococcus aureus subsp. aureus N315
auuaucuuuaauuuacaauuaa

SEQ ID NO: 4065000 - RNA, 12 nt, Staphylococcus aureus subsp. aureus N315
auuaucuuuacg

SEQ ID NO: 4065001 - RNA, 17 nt, Staphylococcus aureus subsp. aureus N315
auuaucuuuaguauuuc

SEQ ID NO: 4065002 - RNA, 15 nt, Staphylococcus aureus subsp. aureus N315
auuaugaaaaguaaa

SEQ ID NO: 4065003 - RNA, 16 nt, Staphylococcus aureus subsp. aureus N315
auuaugacaacauaac

SEQ ID NO: 4065004 - RNA, 21 nt, Staphylococcus aureus subsp. aureus N315
auuaugacaacauaacaaaga

SEQ ID NO: 4065005 - RNA, 12 nt, Staphylococcus aureus subsp. aureus N315
auuaugauauac

SEQ ID NO: 4065006 - RNA, 15 nt, Staphylococcus aureus subsp. aureus N315
auuaugauuaauccu

SEQ ID NO: 4065007 - RNA, 17 nt, Staphylococcus aureus subsp. aureus N315
auuaugauuauauuuuc

SEQ ID NO: 4065008 - RNA, 21 nt, Staphylococcus aureus subsp. aureus N315
auuaugccuauuugacacauu

SEQ ID NO: 4065009 - RNA, 15 nt, Staphylococcus aureus subsp. aureus N315
auuaugcuucaaagu

SEQ ID NO: 4065010 - RNA, 19 nt, Staphylococcus aureus subsp. aureus N315
auuauggagcggaagauag

SEQ ID NO: 4065011 - RNA, 22 nt, Staphylococcus aureus subsp. aureus N315
auuauggagcggaagauaggau

SEQ ID NO: 4065012 - RNA, 16 nt, Staphylococcus aureus subsp. aureus N315
auuauguaaaaaauau

SEQ ID NO: 4065013 - RNA, 23 nt, Staphylococcus aureus subsp. aureus N315
auuauguaucuauacaacaguaa

SEQ ID NO: 4065014 - RNA, 13 nt, Staphylococcus aureus subsp. aureus N315
auuauguauuuuu

SEQ ID NO: 4065015 - RNA, 19 nt, Staphylococcus aureus subsp. aureus N315
auuauguauuuuuauuuau

SEQ ID NO: 4065016 - RNA, 14 nt, Staphylococcus aureus subsp. aureus N315
auuauguguauauu

SEQ ID NO: 4065017 - RNA, 20 nt, Staphylococcus aureus subsp. aureus N315
auuauguuaaugucuuaaaa

SEQ ID NO: 4065018 - RNA, 18 nt, Staphylococcus aureus subsp. aureus N315
auuauuaacuguaccugc

SEQ ID NO: 4065019 - RNA, 22 nt, Staphylococcus aureus subsp. aureus N315
auuauuaacuguaccugcuaca

SEQ ID NO: 4065020 - RNA, 13 nt, Staphylococcus aureus subsp. aureus N315
auucauuuaaaaa

SEQ ID NO: 4065021 - RNA, 17 nt, Staphylococcus aureus subsp. aureus N315
auucauuuaaaaaucaa

SEQ ID NO: 4065022 - RNA, 19 nt, Staphylococcus aureus subsp. aureus N315
auucauuuaaaaaucaaag

SEQ ID NO: 4065023 - RNA, 20 nt, Staphylococcus aureus subsp. aureus N315
auucauuucgauuaauuuaa

SEQ ID NO: 4065024 - RNA, 20 nt, Staphylococcus aureus subsp. aureus N315
auucauuuuauaaaucaaag

SEQ ID NO: 4065025 - RNA, 21 nt, Staphylococcus aureus subsp. aureus N315
auuccaaaaauuguaaaaccu

SEQ ID NO: 4065026 - RNA, 17 nt, Staphylococcus aureus subsp. aureus N315
auuccaagagaauuaau

SEQ ID NO: 4065027 - RNA, 12 nt, Staphylococcus aureus subsp. aureus N315
auuccaaucuau

SEQ ID NO: 4065028 - RNA, 15 nt, Staphylococcus aureus subsp. aureus N315
auucccguuaauauc

SEQ ID NO: 4065029 - RNA, 23 nt, Staphylococcus aureus subsp. aureus N315
auuccucuggaacuuuaauacca

SEQ ID NO: 4065030 - RNA, 14 nt, Staphylococcus aureus subsp. aureus N315
auuccugauacaau

SEQ ID NO: 4065031 - RNA, 19 nt, Staphylococcus aureus subsp. aureus N315
auuccugcaaaauguuaca

SEQ ID NO: 4065032 - RNA, 18 nt, Staphylococcus aureus subsp. aureus N315
auuccuuggugucgaaau

SEQ ID NO: 4065033 - RNA, 22 nt, Staphylococcus aureus subsp. aureus N315
auuccuuggugucgaaauuguu

SEQ ID NO: 4065034 - RNA, 13 nt, Staphylococcus aureus subsp. aureus N315
auucgaaaagaaa

SEQ ID NO: 4065035 - RNA, 16 nt, Staphylococcus aureus subsp. aureus N315
auucgaaaagaaauuc

SEQ ID NO: 4065036 - RNA, 15 nt, Staphylococcus aureus subsp. aureus N315
auucgaaagccaauu

SEQ ID NO: 4065037 - RNA, 18 nt, Staphylococcus aureus subsp. aureus N315
auucgaacuaucaauaua

SEQ ID NO: 4065038 - RNA, 20 nt, Staphylococcus aureus subsp. aureus N315
auucgaacuaucaauauaau

SEQ ID NO: 4065039 - RNA, 21 nt, Staphylococcus aureus subsp. aureus N315
auucgaugcuaaaaauauuga

SEQ ID NO: 4065040 - RNA, 17 nt, Staphylococcus aureus subsp. aureus N315
auucgcgucauuuguuc

SEQ ID NO: 4065041 - RNA, 22 nt, Staphylococcus aureus subsp. aureus N315
auucgcgucauuuguucaucug

SEQ ID NO: 4065042 - RNA, 17 nt, Staphylococcus aureus subsp. aureus N315
auucgcuuguaacaagc

SEQ ID NO: 4065043 - RNA, 13 nt, Staphylococcus aureus subsp. aureus N315
auucgcuuguuca

SEQ ID NO: 4065044 - RNA, 17 nt, Staphylococcus aureus subsp. aureus N315
auucgcuuguucaguaa

SEQ ID NO: 4065045 - RNA, 13 nt, Staphylococcus aureus subsp. aureus N315
auucggauuauau

SEQ ID NO: 4065046 - RNA, 22 nt, Staphylococcus aureus subsp. aureus N315
auucggcucguccaauaaugaa

SEQ ID NO: 4065047 - RNA, 24 nt, Staphylococcus aureus subsp. aureus N315
auucguaaauccuuuauauucuaa

SEQ ID NO: 4065048 - RNA, 23 nt, Staphylococcus aureus subsp. aureus N315
auucguugauuuagcauacauua

SEQ ID NO: 4065049 - RNA, 18 nt, Staphylococcus aureus subsp. aureus N315
auucuaaaaaauuaaaaa

SEQ ID NO: 4065050 - RNA, 15 nt, Staphylococcus aureus subsp. aureus N315
auucuaaaagaauua

SEQ ID NO: 4065051 - RNA, 20 nt, Staphylococcus aureus subsp. aureus N315
auucuaaauauauuuuaugu

SEQ ID NO: 4065052 - RNA, 18 nt, Staphylococcus aureus subsp. aureus N315
auucuaauacaaaccuau

SEQ ID NO: 4065053 - RNA, 23 nt, Staphylococcus aureus subsp. aureus N315
auucuaaucgcauuuuuuauucc

SEQ ID NO: 4065054 - RNA, 12 nt, Staphylococcus aureus subsp. aureus N315
auucuacaggua

SEQ ID NO: 4065055 - RNA, 14 nt, Staphylococcus aureus subsp. aureus N315
auucuacagguaau

SEQ ID NO: 4065056 - RNA, 17 nt, Staphylococcus aureus subsp. aureus N315
auucuacagguaaugca

SEQ ID NO: 4065057 - RNA, 18 nt, Staphylococcus aureus subsp. aureus N315
auucuacagguaaugcaa

SEQ ID NO: 4065058 - RNA, 19 nt, Staphylococcus aureus subsp. aureus N315
auucuaccaguugauuuaa

SEQ ID NO: 4065059 - RNA, 16 nt, Staphylococcus aureus subsp. aureus N315
auucuagugaaauacc

SEQ ID NO: 4065060 - RNA, 15 nt, Staphylococcus aureus subsp. aureus N315
auucuauaaauagaa

SEQ ID NO: 4065061 - RNA, 15 nt, Staphylococcus aureus subsp. aureus N315
auucuauaauuuuaa

SEQ ID NO: 4065062 - RNA, 17 nt, Staphylococcus aureus subsp. aureus N315
auucuauaauuuuaauu

SEQ ID NO: 4065063 - RNA, 13 nt, Staphylococcus aureus subsp. aureus N315
auucuauacuuuu

SEQ ID NO: 4065064 - RNA, 11 nt, Staphylococcus aureus subsp. aureus N315
auucuauuuuu

SEQ ID NO: 4065065 - RNA, 13 nt, Staphylococcus aureus subsp. aureus N315
auucuauuuuuga

SEQ ID NO: 4065066 - RNA, 15 nt, Staphylococcus aureus subsp. aureus N315
auucucagucucuuu

SEQ ID NO: 4065067 - RNA, 14 nt, Staphylococcus aureus subsp. aureus N315
auucucauuuacuu

SEQ ID NO: 4065068 - RNA, 20 nt, Staphylococcus aureus subsp. aureus N315
auucuccaguggaaaugaua

SEQ ID NO: 4065069 - RNA, 17 nt, Staphylococcus aureus subsp. aureus N315
auucucgauuuuuuuau

SEQ ID NO: 4065070 - RNA, 22 nt, Staphylococcus aureus subsp. aureus N315
auucucuaacuuuaccaauauc

SEQ ID NO: 4065071 - RNA, 23 nt, Staphylococcus aureus subsp. aureus N315
auucucuaacuuuaccaauauca

SEQ ID NO: 4065072 - RNA, 21 nt, Staphylococcus aureus subsp. aureus N315
auucucuuaucuugauuuaaa

SEQ ID NO: 4065073 - RNA, 16 nt, Staphylococcus aureus subsp. aureus N315
auucugaaacuuuaau

SEQ ID NO: 4065074 - RNA, 14 nt, Staphylococcus aureus subsp. aureus N315
auucugaaaucagu

SEQ ID NO: 4065075 - RNA, 14 nt, Staphylococcus aureus subsp. aureus N315
auucugauacagaa

SEQ ID NO: 4065076 - RNA, 19 nt, Staphylococcus aureus subsp. aureus N315
auucugcagcgacaucuuu

SEQ ID NO: 4065077 - RNA, 19 nt, Staphylococcus aureus subsp. aureus N315
auucugcccugcaaugcaa

SEQ ID NO: 4065078 - RNA, 14 nt, Staphylococcus aureus subsp. aureus N315
auucuggaugguua

SEQ ID NO: 4065079 - RNA, 16 nt, Staphylococcus aureus subsp. aureus N315
auucuguguaaauaua

SEQ ID NO: 4065080 - RNA, 21 nt, Staphylococcus aureus subsp. aureus N315
auucuuaaaaagcagcaguaa

SEQ ID NO: 4065081 - RNA, 14 nt, Staphylococcus aureus subsp. aureus N315
auucuuagauauua

SEQ ID NO: 4065082 - RNA, 22 nt, Staphylococcus aureus subsp. aureus N315
auucuuaucauuucaaauaaga

SEQ ID NO: 4065083 - RNA, 12 nt, Staphylococcus aureus subsp. aureus N315
auucuucaaaaa

SEQ ID NO: 4065084 - RNA, 20 nt, Staphylococcus aureus subsp. aureus N315
auucuucaaccauuuguucu

SEQ ID NO: 4065085 - RNA, 22 nt, Staphylococcus aureus subsp. aureus N315
auucuucaauuucauuuuugau

SEQ ID NO: 4065086 - RNA, 22 nt, Staphylococcus aureus subsp. aureus N315
auucuucaccaacuuuuuuaac

SEQ ID NO: 4065087 - RNA, 22 nt, Staphylococcus aureus subsp. aureus N315
auucuucacuaaaaauauauuu

SEQ ID NO: 4065088 - RNA, 17 nt, Staphylococcus aureus subsp. aureus N315
auucuucaguuuguugg

SEQ ID NO: 4065089 - RNA, 16 nt, Staphylococcus aureus subsp. aureus N315
auucuucaucaugacu

SEQ ID NO: 4065090 - RNA, 12 nt, Staphylococcus aureus subsp. aureus N315
auucuucauuua

SEQ ID NO: 4065091 - RNA, 21 nt, Staphylococcus aureus subsp. aureus N315
auucuucccaaaaauuguuca

SEQ ID NO: 4065092 - RNA, 14 nt, Staphylococcus aureus subsp. aureus N315
auucuugaauaaau

SEQ ID NO: 4065093 - RNA, 18 nt, Staphylococcus aureus subsp. aureus N315
auucuugaauaaauuuua

SEQ ID NO: 4065094 - RNA, 19 nt, Staphylococcus aureus subsp. aureus N315
auucuugaauaaauuuuau

SEQ ID NO: 4065095 - RNA, 18 nt, Staphylococcus aureus subsp. aureus N315
auucuugguuuuuuagau

SEQ ID NO: 4065096 - RNA, 15 nt, Staphylococcus aureus subsp. aureus N315
auucuuuaauauaaa

SEQ ID NO: 4065097 - RNA, 21 nt, Staphylococcus aureus subsp. aureus N315
auucuuuauaagcuuuuucuu

SEQ ID NO: 4065098 - RNA, 19 nt, Staphylococcus aureus subsp. aureus N315
auucuuuguauuuauacua

SEQ ID NO: 4065099 - RNA, 17 nt, Staphylococcus aureus subsp. aureus N315
auucuuuuguaauaauu

SEQ ID NO: 4065100 - RNA, 15 nt, Staphylococcus aureus subsp. aureus N315
auucuuuuguaauug

SEQ ID NO: 4065101 - RNA, 14 nt, Staphylococcus aureus subsp. aureus N315
auucuuuuuaacua

SEQ ID NO: 4065102 - RNA, 14 nt, Staphylococcus aureus subsp. aureus N315
auugaaaauagaaa

SEQ ID NO: 4065103 - RNA, 16 nt, Staphylococcus aureus subsp. aureus N315
auugaaauaauauaaa

SEQ ID NO: 4065104 - RNA, 18 nt, Staphylococcus aureus subsp. aureus N315
auugaaauaauauaaaaa

SEQ ID NO: 4065105 - RNA, 21 nt, Staphylococcus aureus subsp. aureus N315
auugaaaucgucuuacugcug

SEQ ID NO: 4065106 - RNA, 14 nt, Staphylococcus aureus subsp. aureus N315
auugaaaugagcuu

SEQ ID NO: 4065107 - RNA, 22 nt, Staphylococcus aureus subsp. aureus N315
auugaaauuauccuacugcugu

SEQ ID NO: 4065108 - RNA, 16 nt, Staphylococcus aureus subsp. aureus N315
auuguaaucuauuuuc

SEQ ID NO: 4065109 - RNA, 19 nt, Staphylococcus aureus subsp. aureus N315
auuguaccaguaacaauaa

SEQ ID NO: 4065110 - RNA, 21 nt, Staphylococcus aureus subsp. aureus N315
auuguacgcuucaauuauuuc

SEQ ID NO: 4065111 - RNA, 22 nt, Staphylococcus aureus subsp. aureus N315
auuguacgcuucaauuauuuca

SEQ ID NO: 4065112 - RNA, 16 nt, Staphylococcus aureus subsp. aureus N315
auuguaucuugucauu

SEQ ID NO: 4065113 - RNA, 17 nt, Staphylococcus aureus subsp. aureus N315
auuguauuauccucaaa

SEQ ID NO: 4065114 - RNA, 23 nt, Staphylococcus aureus subsp. aureus N315
auuguauuauccucaaauauauu

SEQ ID NO: 4065115 - RNA, 22 nt, Staphylococcus aureus subsp. aureus N315
auuguauuguuuucaucaugca

SEQ ID NO: 4065116 - RNA, 19 nt, Staphylococcus aureus subsp. aureus N315
auuguauuuuucaagcauu

SEQ ID NO: 4065117 - RNA, 15 nt, Staphylococcus aureus subsp. aureus N315
auugucaucauguuc

SEQ ID NO: 4065118 - RNA, 16 nt, Staphylococcus aureus subsp. aureus N315
auugucaugccuucau

SEQ ID NO: 4065119 - RNA, 22 nt, Staphylococcus aureus subsp. aureus N315
auuguccguuuauagauaggua

SEQ ID NO: 4065120 - RNA, 18 nt, Staphylococcus aureus subsp. aureus N315
auugucgacuuuuagauu

SEQ ID NO: 4065121 - RNA, 23 nt, Staphylococcus aureus subsp. aureus N315
auugucucaucauuuaaaauuug

SEQ ID NO: 4065122 - RNA, 11 nt, Staphylococcus aureus subsp. aureus N315
auugucuuaau

SEQ ID NO: 4065123 - RNA, 19 nt, Staphylococcus aureus subsp. aureus N315
auugucuuuauaaaaaaau

SEQ ID NO: 4065124 - RNA, 23 nt, Staphylococcus aureus subsp. aureus N315
auugugaaaguuuuugucuuaau

SEQ ID NO: 4065125 - RNA, 20 nt, Staphylococcus aureus subsp. aureus N315
auuguguaaugagauuauuc

SEQ ID NO: 4065126 - RNA, 19 nt, Staphylococcus aureus subsp. aureus N315
auuguuaaacccucauuuu

SEQ ID NO: 4065127 - RNA, 16 nt, Staphylococcus aureus subsp. aureus N315
auuguuaaaucaccaa

SEQ ID NO: 4065128 - RNA, 21 nt, Staphylococcus aureus subsp. aureus N315
auuguuagauaaucucauucu

SEQ ID NO: 4065129 - RNA, 19 nt, Staphylococcus aureus subsp. aureus N315
auuguuauccaaaacauuu

SEQ ID NO: 4065130 - RNA, 14 nt, Staphylococcus aureus subsp. aureus N315
auuguugauaaaug

SEQ ID NO: 4065131 - RNA, 13 nt, Staphylococcus aureus subsp. aureus N315
auuguugcaaaau

SEQ ID NO: 4065132 - RNA, 19 nt, Staphylococcus aureus subsp. aureus N315
auuguugcaaaauacgauu

SEQ ID NO: 4065133 - RNA, 18 nt, Staphylococcus aureus subsp. aureus N315
auuguugcaaugauuaau

SEQ ID NO: 4065134 - RNA, 21 nt, Staphylococcus aureus subsp. aureus N315
auuguugcuaaucucagauuu

SEQ ID NO: 4065135 - RNA, 12 nt, Staphylococcus aureus subsp. aureus N315
auuguuuaaaca

SEQ ID NO: 4065136 - RNA, 17 nt, Staphylococcus aureus subsp. aureus N315
auuguuuaauaacaaaa

SEQ ID NO: 4065137 - RNA, 18 nt, Staphylococcus aureus subsp. aureus N315
auuguuuaauaacaaaau

SEQ ID NO: 4065138 - RNA, 20 nt, Staphylococcus aureus subsp. aureus N315
auuguuuaauaacaaaauua

SEQ ID NO: 4065139 - RNA, 17 nt, Staphylococcus aureus subsp. aureus N315
auuguuuagucuucuuu

SEQ ID NO: 4065140 - RNA, 17 nt, Staphylococcus aureus subsp. aureus N315
auuguuucaccagcuug

SEQ ID NO: 4065141 - RNA, 18 nt, Staphylococcus aureus subsp. aureus N315
auuguuucaccagcuugu

SEQ ID NO: 4065142 - RNA, 15 nt, Staphylococcus aureus subsp. aureus N315
auuguuuguagaaau

SEQ ID NO: 4065143 - RNA, 15 nt, Staphylococcus aureus subsp. aureus N315
auuguuuguuuuuau

SEQ ID NO: 4065144 - RNA, 19 nt, Staphylococcus aureus subsp. aureus N315
auuguuuugagauauuugu

SEQ ID NO: 4065145 - RNA, 13 nt, Staphylococcus aureus subsp. aureus N315
auuguuuuuaaaa

SEQ ID NO: 4065146 - RNA, 13 nt, Staphylococcus aureus subsp. aureus N315
auuuaaaaaaugc

SEQ ID NO: 4065147 - RNA, 16 nt, Staphylococcus aureus subsp. aureus N315
auuuaaaaauagccuu

SEQ ID NO: 4065148 - RNA, 14 nt, Staphylococcus aureus subsp. aureus N315
auuuaaaaaucaaa

SEQ ID NO: 4065149 - RNA, 16 nt, Staphylococcus aureus subsp. aureus N315
auuuaaaaaucaaaga

SEQ ID NO: 4065150 - RNA, 19 nt, Staphylococcus aureus subsp. aureus N315
auuuaaaaaucgaauuuuc

SEQ ID NO: 4065151 - RNA, 18 nt, Staphylococcus aureus subsp. aureus N315
auuuaaaaauugaaggaa

SEQ ID NO: 4065152 - RNA, 22 nt, Staphylococcus aureus subsp. aureus N315
auuuaaaacaaugauuaaaauu

SEQ ID NO: 4065153 - RNA, 12 nt, Staphylococcus aureus subsp. aureus N315
auuuaaaagaga

SEQ ID NO: 4065154 - RNA, 13 nt, Staphylococcus aureus subsp. aureus N315
auuuaaaagauua

SEQ ID NO: 4065155 - RNA, 13 nt, Staphylococcus aureus subsp. aureus N315
auuuaaaaguuua

SEQ ID NO: 4065156 - RNA, 19 nt, Staphylococcus aureus subsp. aureus N315
auuuaaaauaauagauaau

SEQ ID NO: 4065157 - RNA, 22 nt, Staphylococcus aureus subsp. aureus N315
auuuaaaauaguucuuuaaauu

SEQ ID NO: 4065158 - RNA, 14 nt, Staphylococcus aureus subsp. aureus N315
auuuaaaauauaaa

SEQ ID NO: 4065159 - RNA, 21 nt, Staphylococcus aureus subsp. aureus N315
auuuaaaaucggacaacugag

SEQ ID NO: 4065160 - RNA, 13 nt, Staphylococcus aureus subsp. aureus N315
auuuaaaaugauu

SEQ ID NO: 4065161 - RNA, 19 nt, Staphylococcus aureus subsp. aureus N315
auuuaaaaugcuuguucaa

SEQ ID NO: 4065162 - RNA, 16 nt, Staphylococcus aureus subsp. aureus N315
auuuaaacauccaauu

SEQ ID NO: 4065163 - RNA, 20 nt, Staphylococcus aureus subsp. aureus N315
auuuaaacauccaauuaugu

SEQ ID NO: 4065164 - RNA, 17 nt, Staphylococcus aureus subsp. aureus N315
auuuaaagaacuauuuu

SEQ ID NO: 4065165 - RNA, 20 nt, Staphylococcus aureus subsp. aureus N315
auuuaaaggcauaauaacca

SEQ ID NO: 4065166 - RNA, 17 nt, Staphylococcus aureus subsp. aureus N315
auuuaaagucuucaucu

SEQ ID NO: 4065167 - RNA, 20 nt, Staphylococcus aureus subsp. aureus N315
auuuaaaugucuuucaaaua

SEQ ID NO: 4065168 - RNA, 21 nt, Staphylococcus aureus subsp. aureus N315
auuuaaaugucuuucaaauac

SEQ ID NO: 4065169 - RNA, 14 nt, Staphylococcus aureus subsp. aureus N315
auuuaacaaaauua

SEQ ID NO: 4065170 - RNA, 19 nt, Staphylococcus aureus subsp. aureus N315
auuuaacauguauuuagua

SEQ ID NO: 4065171 - RNA, 23 nt, Staphylococcus aureus subsp. aureus N315
auuuaacggaaauacaaugaauu

SEQ ID NO: 4065172 - RNA, 21 nt, Staphylococcus aureus subsp. aureus N315
auuuaacuuucccuacugcuu

SEQ ID NO: 4065173 - RNA, 23 nt, Staphylococcus aureus subsp. aureus N315
auuuaagaaugcgaagauuuuua

SEQ ID NO: 4065174 - RNA, 14 nt, Staphylococcus aureus subsp. aureus N315
auuuaagauuuaau

SEQ ID NO: 4065175 - RNA, 22 nt, Staphylococcus aureus subsp. aureus N315
auuuaagggucacacccauacu

SEQ ID NO: 4065176 - RNA, 13 nt, Staphylococcus aureus subsp. aureus N315
auuuaauaacgaa

SEQ ID NO: 4065177 - RNA, 15 nt, Staphylococcus aureus subsp. aureus N315
auuuaauaaguuaau

SEQ ID NO: 4065178 - RNA, 21 nt, Staphylococcus aureus subsp. aureus N315
auuuaauacaauucaagacca

SEQ ID NO: 4065179 - RNA, 16 nt, Staphylococcus aureus subsp. aureus N315
auuuaauacuuuucuc

SEQ ID NO: 4065180 - RNA, 15 nt, Staphylococcus aureus subsp. aureus N315
auuuaauauuguuaa

SEQ ID NO: 4065181 - RNA, 19 nt, Staphylococcus aureus subsp. aureus N315
auuuaaucguaacauauca

SEQ ID NO: 4065182 - RNA, 14 nt, Staphylococcus aureus subsp. aureus N315
auuuaaucguagga

SEQ ID NO: 4065183 - RNA, 12 nt, Staphylococcus aureus subsp. aureus N315
auuuaaucuauu

SEQ ID NO: 4065184 - RNA, 23 nt, Staphylococcus aureus subsp. aureus N315
auuuaaucuauuaacugaccuaa

SEQ ID NO: 4065185 - RNA, 20 nt, Staphylococcus aureus subsp. aureus N315
auuuaauggucuaauaucaa

SEQ ID NO: 4065186 - RNA, 22 nt, Staphylococcus aureus subsp. aureus N315
auuuaauggucuaauaucaauu

SEQ ID NO: 4065187 - RNA, 16 nt, Staphylococcus aureus subsp. aureus N315
auuuaauuacagguuu

SEQ ID NO: 4065188 - RNA, 14 nt, Staphylococcus aureus subsp. aureus N315
auuuaauugaaaua

SEQ ID NO: 4065189 - RNA, 15 nt, Staphylococcus aureus subsp. aureus N315
auuuaauuuuucuaa

SEQ ID NO: 4065190 - RNA, 19 nt, Staphylococcus aureus subsp. aureus N315
auuuacaaauguauaaaua

SEQ ID NO: 4065191 - RNA, 20 nt, Staphylococcus aureus subsp. aureus N315
auuuacaaauguauaaauaa

SEQ ID NO: 4065192 - RNA, 21 nt, Staphylococcus aureus subsp. aureus N315
auuuacaauguuaucuugcuu

SEQ ID NO: 4065193 - RNA, 16 nt, Staphylococcus aureus subsp. aureus N315
auuuacacacaugaua

SEQ ID NO: 4065194 - RNA, 21 nt, Staphylococcus aureus subsp. aureus N315
auuuacacagaaugauauaac

SEQ ID NO: 4065195 - RNA, 13 nt, Staphylococcus aureus subsp. aureus N315
auuucaucaaauc

SEQ ID NO: 4065196 - RNA, 21 nt, Staphylococcus aureus subsp. aureus N315
auuucaucaaauccaaaaucu

SEQ ID NO: 4065197 - RNA, 15 nt, Staphylococcus aureus subsp. aureus N315
auuucaucaauaauu

SEQ ID NO: 4065198 - RNA, 15 nt, Staphylococcus aureus subsp. aureus N315
auuucaugauguuaa

SEQ ID NO: 4065199 - RNA, 17 nt, Staphylococcus aureus subsp. aureus N315
auuucauuuaugcgauu

SEQ ID NO: 4065200 - RNA, 23 nt, Staphylococcus aureus subsp. aureus N315
auuuccaucauuuguguaaauga

SEQ ID NO: 4065201 - RNA, 17 nt, Staphylococcus aureus subsp. aureus N315
auuucccauuuaucuaa

SEQ ID NO: 4065202 - RNA, 15 nt, Staphylococcus aureus subsp. aureus N315
auuuccuauuaggau

SEQ ID NO: 4065203 - RNA, 21 nt, Staphylococcus aureus subsp. aureus N315
auuuccuauuaggauccaauu

SEQ ID NO: 4065204 - RNA, 21 nt, Staphylococcus aureus subsp. aureus N315
auuuccucaccuucauuuuca

SEQ ID NO: 4065205 - RNA, 16 nt, Staphylococcus aureus subsp. aureus N315
auuuccucgguuuuau

SEQ ID NO: 4065206 - RNA, 21 nt, Staphylococcus aureus subsp. aureus N315
auuuccucgguuuuauuuuua

SEQ ID NO: 4065207 - RNA, 14 nt, Staphylococcus aureus subsp. aureus N315
auuucgaaaagaaa

SEQ ID NO: 4065208 - RNA, 17 nt, Staphylococcus aureus subsp. aureus N315
auuucgaaaagaaauuc

SEQ ID NO: 4065209 - RNA, 16 nt, Staphylococcus aureus subsp. aureus N315
auuucgcuuuuuuuau

SEQ ID NO: 4065210 - RNA, 22 nt, Staphylococcus aureus subsp. aureus N315
auuucgcuuuuuuuauuuuucu

SEQ ID NO: 4065211 - RNA, 17 nt, Staphylococcus aureus subsp. aureus N315
auuucgguauuuuaaau

SEQ ID NO: 4065212 - RNA, 18 nt, Staphylococcus aureus subsp. aureus N315
auuucgguauuuuaaauu

SEQ ID NO: 4065213 - RNA, 20 nt, Staphylococcus aureus subsp. aureus N315
auuucguggaccuauuguau

SEQ ID NO: 4065214 - RNA, 18 nt, Staphylococcus aureus subsp. aureus N315
auuucuaaaccauuuuca

SEQ ID NO: 4065215 - RNA, 20 nt, Staphylococcus aureus subsp. aureus N315
auuucuaaauuauuuauuca

SEQ ID NO: 4065216 - RNA, 15 nt, Staphylococcus aureus subsp. aureus N315
auuucuacucgaaac

SEQ ID NO: 4065217 - RNA, 17 nt, Staphylococcus aureus subsp. aureus N315
auuucuauacaaucauu

SEQ ID NO: 4065218 - RNA, 15 nt, Staphylococcus aureus subsp. aureus N315
auuucuauaucuauu

SEQ ID NO: 4065219 - RNA, 23 nt, Staphylococcus aureus subsp. aureus N315
auuucuauaucuauuuaucauac

SEQ ID NO: 4065220 - RNA, 15 nt, Staphylococcus aureus subsp. aureus N315
auuucuaucaaauaa

SEQ ID NO: 4065221 - RNA, 21 nt, Staphylococcus aureus subsp. aureus N315
auuucugaaaugauacauuau

SEQ ID NO: 4065222 - RNA, 22 nt, Staphylococcus aureus subsp. aureus N315
auuucugaaaugauacauuauu

SEQ ID NO: 4065223 - RNA, 16 nt, Staphylococcus aureus subsp. aureus N315
auuucugacaacuuaa

SEQ ID NO: 4065224 - RNA, 19 nt, Staphylococcus aureus subsp. aureus N315
auuucuggcguacauauaa

SEQ ID NO: 4065225 - RNA, 14 nt, Staphylococcus aureus subsp. aureus N315
auuucuguaccaaa

SEQ ID NO: 4065226 - RNA, 18 nt, Staphylococcus aureus subsp. aureus N315
auuucuguaccaaauuug

SEQ ID NO: 4065227 - RNA, 14 nt, Staphylococcus aureus subsp. aureus N315
auuucuuaccauuu

SEQ ID NO: 4065228 - RNA, 13 nt, Staphylococcus aureus subsp. aureus N315
auuucuuuucauu

SEQ ID NO: 4065229 - RNA, 15 nt, Staphylococcus aureus subsp. aureus N315
auuucuuuugaaucu

SEQ ID NO: 4065230 - RNA, 10 nt, Staphylococcus aureus subsp. aureus N315
auuucuuuuu

SEQ ID NO: 4065231 - RNA, 14 nt, Staphylococcus aureus subsp. aureus N315
auuugaaaauauua

SEQ ID NO: 4065232 - RNA, 22 nt, Staphylococcus aureus subsp. aureus N315
auuugaaaauauuacuaacaac

SEQ ID NO: 4065233 - RNA, 21 nt, Staphylococcus aureus subsp. aureus N315
auuugaauaagugguuguucc

SEQ ID NO: 4065234 - RNA, 20 nt, Staphylococcus aureus subsp. aureus N315
auuugaaugcaaaucaaaua

SEQ ID NO: 4065235 - RNA, 18 nt, Staphylococcus aureus subsp. aureus N315
auuugaaugccuacagau

SEQ ID NO: 4065236 - RNA, 21 nt, Staphylococcus aureus subsp. aureus N315
auuugacacauuauugaaauu

SEQ ID NO: 4065237 - RNA, 19 nt, Staphylococcus aureus subsp. aureus N315
auuugacauaauccagcca

SEQ ID NO: 4065238 - RNA, 18 nt, Staphylococcus aureus subsp. aureus N315
auuugaggauacauaaau

SEQ ID NO: 4065239 - RNA, 21 nt, Staphylococcus aureus subsp. aureus N315
auuugaggauacauaaaucua

SEQ ID NO: 4065240 - RNA, 16 nt, Staphylococcus aureus subsp. aureus N315
auuugauaaauaaaau

SEQ ID NO: 4065241 - RNA, 17 nt, Staphylococcus aureus subsp. aureus N315
auuugaugaucccaaaa

SEQ ID NO: 4065242 - RNA, 19 nt, Staphylococcus aureus subsp. aureus N315
auuugaugaucccaaaauc

SEQ ID NO: 4065243 - RNA, 19 nt, Staphylococcus aureus subsp. aureus N315
auuugauucauuacauguu

SEQ ID NO: 4065244 - RNA, 20 nt, Staphylococcus aureus subsp. aureus N315
auuugauuuaaaaaguuaau

SEQ ID NO: 4065245 - RNA, 21 nt, Staphylococcus aureus subsp. aureus N315
auuugcaaaaucaacccauca

SEQ ID NO: 4065246 - RNA, 17 nt, Staphylococcus aureus subsp. aureus N315
auuugcaccuauaccuc

SEQ ID NO: 4065247 - RNA, 18 nt, Staphylococcus aureus subsp. aureus N315
auuugcaccuauaccucg

SEQ ID NO: 4065248 - RNA, 21 nt, Staphylococcus aureus subsp. aureus N315
auuugcagaacguucuaaggu

SEQ ID NO: 4065249 - RNA, 16 nt, Staphylococcus aureus subsp. aureus N315
auuugcgauuucuucu

SEQ ID NO: 4065250 - RNA, 21 nt, Staphylococcus aureus subsp. aureus N315
auuugcgauuucuucugcuaa

SEQ ID NO: 4065251 - RNA, 20 nt, Staphylococcus aureus subsp. aureus N315
auuugcucgugaaaagcagu

SEQ ID NO: 4065252 - RNA, 23 nt, Staphylococcus aureus subsp. aureus N315
auuugcugcuaauugauauggau

SEQ ID NO: 4065253 - RNA, 21 nt, Staphylococcus aureus subsp. aureus N315
auuuggauaauuuuuaacagc

SEQ ID NO: 4065254 - RNA, 21 nt, Staphylococcus aureus subsp. aureus N315
auuuggauauuuauuuuaaua

SEQ ID NO: 4065255 - RNA, 21 nt, Staphylococcus aureus subsp. aureus N315
auuuggaugguaaguauaauu

SEQ ID NO: 4065256 - RNA, 16 nt, Staphylococcus aureus subsp. aureus N315
auuuggguaauguuuu

SEQ ID NO: 4065257 - RNA, 21 nt, Staphylococcus aureus subsp. aureus N315
auuuggguaauguuuuuacaa

SEQ ID NO: 4065258 - RNA, 20 nt, Staphylococcus aureus subsp. aureus N315
auuugggucguuagaugaau

SEQ ID NO: 4065259 - RNA, 16 nt, Staphylococcus aureus subsp. aureus N315
auuugguuaauacguu

SEQ ID NO: 4065260 - RNA, 16 nt, Staphylococcus aureus subsp. aureus N315
auuuguaaacaguaug

SEQ ID NO: 4065261 - RNA, 15 nt, Staphylococcus aureus subsp. aureus N315
auuuguaaauauuuu

SEQ ID NO: 4065262 - RNA, 23 nt, Staphylococcus aureus subsp. aureus N315
auuuguaaauauuuuuuaaaaug

SEQ ID NO: 4065263 - RNA, 13 nt, Staphylococcus aureus subsp. aureus N315
auuuguaauacaa

SEQ ID NO: 4065264 - RNA, 20 nt, Staphylococcus aureus subsp. aureus N315
auuuguaaucccauuuuaaa

SEQ ID NO: 4065265 - RNA, 21 nt, Staphylococcus aureus subsp. aureus N315
auuuguaaucccauuuuaaag

SEQ ID NO: 4065266 - RNA, 24 nt, Staphylococcus aureus subsp. aureus N315
auuuguaauuccucuggaacuuua

SEQ ID NO: 4065267 - RNA, 17 nt, Staphylococcus aureus subsp. aureus N315
auuuguaccaaauaaau

SEQ ID NO: 4065268 - RNA, 19 nt, Staphylococcus aureus subsp. aureus N315
auuuguagcuugaauaaua

SEQ ID NO: 4065269 - RNA, 21 nt, Staphylococcus aureus subsp. aureus N315
auuuguagcuugaauaauaua

SEQ ID NO: 4065270 - RNA, 22 nt, Staphylococcus aureus subsp. aureus N315
auuuguagcuugaauaauauau

SEQ ID NO: 4065271 - RNA, 17 nt, Staphylococcus aureus subsp. aureus N315
auuuguaguaaguagaa

SEQ ID NO: 4065272 - RNA, 17 nt, Staphylococcus aureus subsp. aureus N315
auuuguauagauuguau

SEQ ID NO: 4065273 - RNA, 14 nt, Staphylococcus aureus subsp. aureus N315
auuuguauuuaaaa

SEQ ID NO: 4065274 - RNA, 16 nt, Staphylococcus aureus subsp. aureus N315
auuuguccauccauuu

SEQ ID NO: 4065275 - RNA, 19 nt, Staphylococcus aureus subsp. aureus N315
auuugugguaaucauguaa

SEQ ID NO: 4065276 - RNA, 15 nt, Staphylococcus aureus subsp. aureus N315
auuuguguauaaaug

SEQ ID NO: 4065277 - RNA, 19 nt, Staphylococcus aureus subsp. aureus N315
auuuguguauaaaugucau

SEQ ID NO: 4065278 - RNA, 23 nt, Staphylococcus aureus subsp. aureus N315
auuuguguuuuuaauguuugcuu

SEQ ID NO: 4065279 - RNA, 14 nt, Staphylococcus aureus subsp. aureus N315
auuuguuaaauuca

SEQ ID NO: 4065280 - RNA, 19 nt, Staphylococcus aureus subsp. aureus N315
auuuguuaauuuaauaauu

SEQ ID NO: 4065281 - RNA, 14 nt, Staphylococcus aureus subsp. aureus N315
auuuguuauaccug

SEQ ID NO: 4065282 - RNA, 17 nt, Staphylococcus aureus subsp. aureus N315
auuuuggauaggauauu

SEQ ID NO: 4065283 - RNA, 17 nt, Staphylococcus aureus subsp. aureus N315
auuuuggcacauaaauc

SEQ ID NO: 4065284 - RNA, 20 nt, Staphylococcus aureus subsp. aureus N315
auuuuguaagcucaugaauc

SEQ ID NO: 4065285 - RNA, 22 nt, Staphylococcus aureus subsp. aureus N315
auuuuguaauggcuauucgauu

SEQ ID NO: 4065286 - RNA, 14 nt, Staphylococcus aureus subsp. aureus N315
auuuuguacauuuc

SEQ ID NO: 4065287 - RNA, 15 nt, Staphylococcus aureus subsp. aureus N315
auuuuguacauuucu

SEQ ID NO: 4065288 - RNA, 16 nt, Staphylococcus aureus subsp. aureus N315
auuuuguauuagcauc

SEQ ID NO: 4065289 - RNA, 14 nt, Staphylococcus aureus subsp. aureus N315
auuuuguauuuuuc

SEQ ID NO: 4065290 - RNA, 15 nt, Staphylococcus aureus subsp. aureus N315
auuuuguauuuuuca

SEQ ID NO: 4065291 - RNA, 23 nt, Staphylococcus aureus subsp. aureus N315
auuuuguauuuuucaaauaaaga

SEQ ID NO: 4065292 - RNA, 17 nt, Staphylococcus aureus subsp. aureus N315
auuuugucuuuuauauu

SEQ ID NO: 4065293 - RNA, 19 nt, Staphylococcus aureus subsp. aureus N315
auuuugucuuuuauauuuu

SEQ ID NO: 4065294 - RNA, 23 nt, Staphylococcus aureus subsp. aureus N315
auuuuguuaauaagcgcaucccu

SEQ ID NO: 4065295 - RNA, 14 nt, Staphylococcus aureus subsp. aureus N315
auuuuguucaguua

SEQ ID NO: 4065296 - RNA, 23 nt, Staphylococcus aureus subsp. aureus N315
auuuuguucaguuaaaucuguau

SEQ ID NO: 4065297 - RNA, 23 nt, Staphylococcus aureus subsp. aureus N315
auuuuguugaaacgguaucaaca

SEQ ID NO: 4065298 - RNA, 12 nt, Staphylococcus aureus subsp. aureus N315
auuuuguuuuaa

SEQ ID NO: 4065299 - RNA, 14 nt, Staphylococcus aureus subsp. aureus N315
auuuuguuuuaaaa

SEQ ID NO: 4065300 - RNA, 15 nt, Staphylococcus aureus subsp. aureus N315
auuuuguuuuaaaaa

SEQ ID NO: 4065301 - RNA, 21 nt, Staphylococcus aureus subsp. aureus N315
auuuuuaaaaaccuagggaua

SEQ ID NO: 4065302 - RNA, 11 nt, Staphylococcus aureus subsp. aureus N315
auuuuuaaaau

SEQ ID NO: 4065303 - RNA, 15 nt, Staphylococcus aureus subsp. aureus N315
auuuuuaaaauuaug

SEQ ID NO: 4065304 - RNA, 15 nt, Staphylococcus aureus subsp. aureus N315
auuuuuaaauuacua

SEQ ID NO: 4065305 - RNA, 14 nt, Staphylococcus aureus subsp. aureus N315
auuuuuaauuauuu

SEQ ID NO: 4065306 - RNA, 15 nt, Staphylococcus aureus subsp. aureus N315
auuuuuaauuauuuu

SEQ ID NO: 4065307 - RNA, 15 nt, Staphylococcus aureus subsp. aureus N315
auuuuuagacauuaa

SEQ ID NO: 4065308 - RNA, 17 nt, Staphylococcus aureus subsp. aureus N315
auuuuuagacauuaaaa

SEQ ID NO: 4065309 - RNA, 22 nt, Staphylococcus aureus subsp. aureus N315
auuuuuauagugucgagauuuu

SEQ ID NO: 4065310 - RNA, 13 nt, Staphylococcus aureus subsp. aureus N315
auuuuuauuuaua

SEQ ID NO: 4065311 - RNA, 22 nt, Staphylococcus aureus subsp. aureus N315
auuuuuccauaguggaauacuu

SEQ ID NO: 4065312 - RNA, 19 nt, Staphylococcus aureus subsp. aureus N315
auuuuucuaaaugauuuau

SEQ ID NO: 4065313 - RNA, 21 nt, Staphylococcus aureus subsp. aureus N315
auuuuucuucaguuaaaucuu

SEQ ID NO: 4065314 - RNA, 15 nt, Staphylococcus aureus subsp. aureus N315
auuuuugaguaauuu

SEQ ID NO: 4065315 - RNA, 19 nt, Staphylococcus aureus subsp. aureus N315
auuuuugaguaauuuaauc

SEQ ID NO: 4065316 - RNA, 17 nt, Staphylococcus aureus subsp. aureus N315
auuuuugauaacuguaa

SEQ ID NO: 4065317 - RNA, 20 nt, Staphylococcus aureus subsp. aureus N315
auuuuuggauucaccaauua

SEQ ID NO: 4065318 - RNA, 13 nt, Staphylococcus aureus subsp. aureus N315
auuuuuucaaugu

SEQ ID NO: 4065319 - RNA, 17 nt, Staphylococcus aureus subsp. aureus N315
auuuuuucguuuuaaua

SEQ ID NO: 4065320 - RNA, 21 nt, Staphylococcus aureus subsp. aureus N315
auuuuuucuauggcacaaaug

SEQ ID NO: 4065321 - RNA, 12 nt, Staphylococcus aureus subsp. aureus N315
auuuuuugauau

SEQ ID NO: 4065322 - RNA, 14 nt, Staphylococcus aureus subsp. aureus N315
auuuuuugauaugg

SEQ ID NO: 4065323 - RNA, 21 nt, Staphylococcus aureus subsp. aureus N315
auuuuuuggagcguaaaguuu

SEQ ID NO: 4065324 - RNA, 17 nt, Staphylococcus aureus subsp. aureus N315
auuuuuuggucaccaaa

SEQ ID NO: 4065325 - RNA, 12 nt, Staphylococcus aureus subsp. aureus N315
auuuuuuuaaau

SEQ ID NO: 4065326 - RNA, 21 nt, Staphylococcus aureus subsp. aureus N315
auuuuuuuaaaucuauauaaa

SEQ ID NO: 4065327 - RNA, 12 nt, Staphylococcus aureus subsp. aureus N315
auuuuuuuaugc

SEQ ID NO: 4065328 - RNA, 14 nt, Staphylococcus aureus subsp. aureus N315
auuuuuuuccuuuc

SEQ ID NO: 4065329 - RNA, 21 nt, Staphylococcus aureus subsp. aureus N315
auuuuuuucguaacauuuaaa

SEQ ID NO: 4065330 - RNA, 15 nt, Staphylococcus aureus subsp. aureus N315
auuuuuuucuuucuu

SEQ ID NO: 4065331 - RNA, 19 nt, Staphylococcus aureus subsp. aureus N315
auuuuuuuguacuuucuga

SEQ ID NO: 4065332 - RNA, 14 nt, Staphylococcus aureus subsp. aureus N315
caaaaaaacaaaua

SEQ ID NO: 4065333 - RNA, 15 nt, Staphylococcus aureus subsp. aureus N315
caaaaaaacaaauau

SEQ ID NO: 4065334 - RNA, 23 nt, Staphylococcus aureus subsp. aureus N315
caaaaaaggaugaugugaauguu

SEQ ID NO: 4065335 - RNA, 15 nt, Staphylococcus aureus subsp. aureus N315
caaaaaauaaaucuc

SEQ ID NO: 4065336 - RNA, 22 nt, Staphylococcus aureus subsp. aureus N315
caaaaaauaaaucuccauuaau

SEQ ID NO: 4065337 - RNA, 11 nt, Staphylococcus aureus subsp. aureus N315
caaaaaauauc

SEQ ID NO: 4065338 - RNA, 19 nt, Staphylococcus aureus subsp. aureus N315
caaaaaaucgaacaaauga

SEQ ID NO: 4065339 - RNA, 12 nt, Staphylococcus aureus subsp. aureus N315
caaaaaauugua

SEQ ID NO: 4065340 - RNA, 19 nt, Staphylococcus aureus subsp. aureus N315
caaaaaauuguaagucgaa

SEQ ID NO: 4065341 - RNA, 16 nt, Staphylococcus aureus subsp. aureus N315
caaaaacgguaauuuc

SEQ ID NO: 4065342 - RNA, 11 nt, Staphylococcus aureus subsp. aureus N315
caaaaagaauu

SEQ ID NO: 4065343 - RNA, 13 nt, Staphylococcus aureus subsp. aureus N315
caaaaagaauuuc

SEQ ID NO: 4065344 - RNA, 18 nt, Staphylococcus aureus subsp. aureus N315
caaaaagcccuauuguuu

SEQ ID NO: 4065345 - RNA, 14 nt, Staphylococcus aureus subsp. aureus N315
caaaaauaaaaaug

SEQ ID NO: 4065346 - RNA, 20 nt, Staphylococcus aureus subsp. aureus N315
caaaaauacuccuuucauac

SEQ ID NO: 4065347 - RNA, 21 nt, Staphylococcus aureus subsp. aureus N315
caaaaauagauugaaaaaaua

SEQ ID NO: 4065348 - RNA, 15 nt, Staphylococcus aureus subsp. aureus N315
caaaaauaguaaaac

SEQ ID NO: 4065349 - RNA, 17 nt, Staphylococcus aureus subsp. aureus N315
caaaaaucauccauaaa

SEQ ID NO: 4065350 - RNA, 14 nt, Staphylococcus aureus subsp. aureus N315
caaaaaugaagaau

SEQ ID NO: 4065351 - RNA, 21 nt, Staphylococcus aureus subsp. aureus N315
caaaaaugaagaauacaaaua

SEQ ID NO: 4065352 - RNA, 20 nt, Staphylococcus aureus subsp. aureus N315
caaaaauugcuauauuagua

SEQ ID NO: 4065353 - RNA, 13 nt, Staphylococcus aureus subsp. aureus N315
caaaaauuguaaa

SEQ ID NO: 4065354 - RNA, 13 nt, Staphylococcus aureus subsp. aureus N315
caaaacaaaaaau

SEQ ID NO: 4065355 - RNA, 14 nt, Staphylococcus aureus subsp. aureus N315
caaaacaaaaaaua

SEQ ID NO: 4065356 - RNA, 15 nt, Staphylococcus aureus subsp. aureus N315
caaaacaaaaaauau

SEQ ID NO: 4065357 - RNA, 19 nt, Staphylococcus aureus subsp. aureus N315
caaaacaaaaaauaucuuu

SEQ ID NO: 4065358 - RNA, 16 nt, Staphylococcus aureus subsp. aureus N315
caaaacaauaugaauu

SEQ ID NO: 4065359 - RNA, 19 nt, Staphylococcus aureus subsp. aureus N315
caaaacauauucaguauau

SEQ ID NO: 4065360 - RNA, 13 nt, Staphylococcus aureus subsp. aureus N315
caaaacauuuugu

SEQ ID NO: 4065361 - RNA, 15 nt, Staphylococcus aureus subsp. aureus N315
caaaaccaaaugaac

SEQ ID NO: 4065362 - RNA, 21 nt, Staphylococcus aureus subsp. aureus N315
caaaaccaauuaauuguaaag

SEQ ID NO: 4065363 - RNA, 17 nt, Staphylococcus aureus subsp. aureus N315
caaaaccgcuauaaaau

SEQ ID NO: 4065364 - RNA, 20 nt, Staphylococcus aureus subsp. aureus N315
caaaaccgcuauaaaauuuu

SEQ ID NO: 4065365 - RNA, 18 nt, Staphylococcus aureus subsp. aureus N315
caaaacgcauuucaugug

SEQ ID NO: 4065366 - RNA, 16 nt, Staphylococcus aureus subsp. aureus N315
caaaacuugcgcaugc

SEQ ID NO: 4065367 - RNA, 21 nt, Staphylococcus aureus subsp. aureus N315
caaaacuuguaaucauaccag

SEQ ID NO: 4065368 - RNA, 20 nt, Staphylococcus aureus subsp. aureus N315
caaaagcgcaggcgaaccga

SEQ ID NO: 4065369 - RNA, 21 nt, Staphylococcus aureus subsp. aureus N315
caaaaguaugauuuguuugau

SEQ ID NO: 4065370 - RNA, 15 nt, Staphylococcus aureus subsp. aureus N315
caaaugaaccagcua

SEQ ID NO: 4065371 - RNA, 20 nt, Staphylococcus aureus subsp. aureus N315
caaaugaauggagcaugauu

SEQ ID NO: 4065372 - RNA, 14 nt, Staphylococcus aureus subsp. aureus N315
caaaugacauuuua

SEQ ID NO: 4065373 - RNA, 17 nt, Staphylococcus aureus subsp. aureus N315
caaaugacauuuuaaau

SEQ ID NO: 4065374 - RNA, 23 nt, Staphylococcus aureus subsp. aureus N315
caaaugccgcuucuaauuuuuca

SEQ ID NO: 4065375 - RNA, 10 nt, Staphylococcus aureus subsp. aureus N315
caaaugcuua

SEQ ID NO: 4065376 - RNA, 15 nt, Staphylococcus aureus subsp. aureus N315
caaauguaacauuaa

SEQ ID NO: 4065377 - RNA, 16 nt, Staphylococcus aureus subsp. aureus N315
caaauguauaaauaau

SEQ ID NO: 4065378 - RNA, 23 nt, Staphylococcus aureus subsp. aureus N315
caaaugugguggguauauaauuu

SEQ ID NO: 4065379 - RNA, 19 nt, Staphylococcus aureus subsp. aureus N315
caaauguucagguucaaaa

SEQ ID NO: 4065380 - RNA, 18 nt, Staphylococcus aureus subsp. aureus N315
caaauguugaauguggaa

SEQ ID NO: 4065381 - RNA, 20 nt, Staphylococcus aureus subsp. aureus N315
caaauguugaauguggaaca

SEQ ID NO: 4065382 - RNA, 16 nt, Staphylococcus aureus subsp. aureus N315
caaauuacaaauuauc

SEQ ID NO: 4065383 - RNA, 15 nt, Staphylococcus aureus subsp. aureus N315
caaauuaucauuaaa

SEQ ID NO: 4065384 - RNA, 15 nt, Staphylococcus aureus subsp. aureus N315
caaauucaacuuuaa

SEQ ID NO: 4065385 - RNA, 16 nt, Staphylococcus aureus subsp. aureus N315
caaauucauauuaacu

SEQ ID NO: 4065386 - RNA, 13 nt, Staphylococcus aureus subsp. aureus N315
caaauucauuugu

SEQ ID NO: 4065387 - RNA, 15 nt, Staphylococcus aureus subsp. aureus N315
caaauucauuuguau

SEQ ID NO: 4065388 - RNA, 19 nt, Staphylococcus aureus subsp. aureus N315
caaauucgacucaaacaau

SEQ ID NO: 4065389 - RNA, 19 nt, Staphylococcus aureus subsp. aureus N315
caaauucuuuuacagcaag

SEQ ID NO: 4065390 - RNA, 15 nt, Staphylococcus aureus subsp. aureus N315
caaauugaacuucuu

SEQ ID NO: 4065391 - RNA, 18 nt, Staphylococcus aureus subsp. aureus N315
caaauugaccgacaaaac

SEQ ID NO: 4065392 - RNA, 15 nt, Staphylococcus aureus subsp. aureus N315
caaauugcaaaguaa

SEQ ID NO: 4065393 - RNA, 19 nt, Staphylococcus aureus subsp. aureus N315
caaauugcaaaguaacaau

SEQ ID NO: 4065394 - RNA, 21 nt, Staphylococcus aureus subsp. aureus N315
caaauugcaauggcaaccuuu

SEQ ID NO: 4065395 - RNA, 17 nt, Staphylococcus aureus subsp. aureus N315
caaauugccuuucauuu

SEQ ID NO: 4065396 - RNA, 21 nt, Staphylococcus aureus subsp. aureus N315
caaauuggauaauuucuucuu

SEQ ID NO: 4065397 - RNA, 14 nt, Staphylococcus aureus subsp. aureus N315
caaauugugauuua

SEQ ID NO: 4065398 - RNA, 17 nt, Staphylococcus aureus subsp. aureus N315
caaauuuaggcauguca

SEQ ID NO: 4065399 - RNA, 19 nt, Staphylococcus aureus subsp. aureus N315
caaauuuaggcaugucaaa

SEQ ID NO: 4065400 - RNA, 20 nt, Staphylococcus aureus subsp. aureus N315
caaauuugugauuaugcaua

SEQ ID NO: 4065401 - RNA, 14 nt, Staphylococcus aureus subsp. aureus N315
caaauuuugaguau

SEQ ID NO: 4065402 - RNA, 22 nt, Staphylococcus aureus subsp. aureus N315
caaauuuugaguauuugccuuu

SEQ ID NO: 4065403 - RNA, 12 nt, Staphylococcus aureus subsp. aureus N315
caacaaaaagaa

SEQ ID NO: 4065404 - RNA, 13 nt, Staphylococcus aureus subsp. aureus N315
caacaaaaagaau

SEQ ID NO: 4065405 - RNA, 16 nt, Staphylococcus aureus subsp. aureus N315
caacaaaaagaauuuc

SEQ ID NO: 4065406 - RNA, 13 nt, Staphylococcus aureus subsp. aureus N315
caacaaaagaugu

SEQ ID NO: 4065407 - RNA, 12 nt, Staphylococcus aureus subsp. aureus N315
caacaaacauaa

SEQ ID NO: 4065408 - RNA, 13 nt, Staphylococcus aureus subsp. aureus N315
caacaaauauaau

SEQ ID NO: 4065409 - RNA, 17 nt, Staphylococcus aureus subsp. aureus N315
caacaaauugugauuua

SEQ ID NO: 4065410 - RNA, 12 nt, Staphylococcus aureus subsp. aureus N315
caacaaauuuaa

SEQ ID NO: 4065411 - RNA, 15 nt, Staphylococcus aureus subsp. aureus N315
caacaacaaguucuu

SEQ ID NO: 4065412 - RNA, 14 nt, Staphylococcus aureus subsp. aureus N315
caacaagguuucaa

SEQ ID NO: 4065413 - RNA, 23 nt, Staphylococcus aureus subsp. aureus N315
caacaaguaaaacgcauugcgaa

SEQ ID NO: 4065414 - RNA, 15 nt, Staphylococcus aureus subsp. aureus N315
caacaauaaaucuuu

SEQ ID NO: 4065415 - RNA, 12 nt, Staphylococcus aureus subsp. aureus N315
caacaauuugca

SEQ ID NO: 4065416 - RNA, 12 nt, Staphylococcus aureus subsp. aureus N315
caacacaaagaa

SEQ ID NO: 4065417 - RNA, 13 nt, Staphylococcus aureus subsp. aureus N315
caacacaaagaau

SEQ ID NO: 4065418 - RNA, 16 nt, Staphylococcus aureus subsp. aureus N315
caacacaaagaauuuc

SEQ ID NO: 4065419 - RNA, 10 nt, Staphylococcus aureus subsp. aureus N315
caacacagaa

SEQ ID NO: 4065420 - RNA, 13 nt, Staphylococcus aureus subsp. aureus N315
caacacagagaau

SEQ ID NO: 4065421 - RNA, 16 nt, Staphylococcus aureus subsp. aureus N315
caacacagagaauuuc

SEQ ID NO: 4065422 - RNA, 19 nt, Staphylococcus aureus subsp. aureus N315
caacacccauauaauuugg

SEQ ID NO: 4065423 - RNA, 17 nt, Staphylococcus aureus subsp. aureus N315
caacacguuuuaagcca

SEQ ID NO: 4065424 - RNA, 14 nt, Staphylococcus aureus subsp. aureus N315
caacagcaaaaaau

SEQ ID NO: 4065425 - RNA, 16 nt, Staphylococcus aureus subsp. aureus N315
caacagggguuuuuau

SEQ ID NO: 4065426 - RNA, 18 nt, Staphylococcus aureus subsp. aureus N315
caacagggguuuuuauau

SEQ ID NO: 4065427 - RNA, 11 nt, Staphylococcus aureus subsp. aureus N315
caacaguaauu

SEQ ID NO: 4065428 - RNA, 21 nt, Staphylococcus aureus subsp. aureus N315
caacaguuucuuggucugcug

SEQ ID NO: 4065429 - RNA, 14 nt, Staphylococcus aureus subsp. aureus N315
caacaguuuuaaag

SEQ ID NO: 4065430 - RNA, 15 nt, Staphylococcus aureus subsp. aureus N315
caacaguuuuaaaga

SEQ ID NO: 4065431 - RNA, 13 nt, Staphylococcus aureus subsp. aureus N315
caacauacaugcc

SEQ ID NO: 4065432 - RNA, 15 nt, Staphylococcus aureus subsp. aureus N315
caacauauaaaucau

SEQ ID NO: 4065433 - RNA, 13 nt, Staphylococcus aureus subsp. aureus N315
caacauauuuuca

SEQ ID NO: 4065434 - RNA, 22 nt, Staphylococcus aureus subsp. aureus N315
caacaucuuuuguugcucagug

SEQ ID NO: 4065435 - RNA, 18 nt, Staphylococcus aureus subsp. aureus N315
caacaucuuuuguuguuu

SEQ ID NO: 4065436 - RNA, 22 nt, Staphylococcus aureus subsp. aureus N315
caacaugauacguacguugaug

SEQ ID NO: 4065437 - RNA, 22 nt, Staphylococcus aureus subsp. aureus N315
caacauguuccgcuacaaaaca

SEQ ID NO: 4065438 - RNA, 14 nt, Staphylococcus aureus subsp. aureus N315
caacauguucguua

SEQ ID NO: 4065439 - RNA, 12 nt, Staphylococcus aureus subsp. aureus N315
caacauguuugg

SEQ ID NO: 4065440 - RNA, 14 nt, Staphylococcus aureus subsp. aureus N315
caacauguuuggau

SEQ ID NO: 4065441 - RNA, 22 nt, Staphylococcus aureus subsp. aureus N315
caacauguuuggaugaacaaaa

SEQ ID NO: 4065442 - RNA, 15 nt, Staphylococcus aureus subsp. aureus N315
caacauuaauaaaua

SEQ ID NO: 4065443 - RNA, 12 nt, Staphylococcus aureus subsp. aureus N315
caacauuacgua

SEQ ID NO: 4065444 - RNA, 18 nt, Staphylococcus aureus subsp. aureus N315
caacauuacuaauugauc

SEQ ID NO: 4065445 - RNA, 15 nt, Staphylococcus aureus subsp. aureus N315
caacauuauuuauau

SEQ ID NO: 4065446 - RNA, 14 nt, Staphylococcus aureus subsp. aureus N315
caacauuuuuucua

SEQ ID NO: 4065447 - RNA, 13 nt, Staphylococcus aureus subsp. aureus N315
caaccaaaaccaa

SEQ ID NO: 4065448 - RNA, 18 nt, Staphylococcus aureus subsp. aureus N315
caaccagucagaaagaau

SEQ ID NO: 4065449 - RNA, 18 nt, Staphylococcus aureus subsp. aureus N315
caaccugugauaaaaauc

SEQ ID NO: 4065450 - RNA, 17 nt, Staphylococcus aureus subsp. aureus N315
caaccuuugcuaaauca

SEQ ID NO: 4065451 - RNA, 17 nt, Staphylococcus aureus subsp. aureus N315
caacgagucauaaauau

SEQ ID NO: 4065452 - RNA, 14 nt, Staphylococcus aureus subsp. aureus N315
caacgaugaaacuc

SEQ ID NO: 4065453 - RNA, 21 nt, Staphylococcus aureus subsp. aureus N315
caacguauauaaguuaaaauu

SEQ ID NO: 4065454 - RNA, 15 nt, Staphylococcus aureus subsp. aureus N315
caacguucuacucua

SEQ ID NO: 4065455 - RNA, 14 nt, Staphylococcus aureus subsp. aureus N315
caacuaaauuuucu

SEQ ID NO: 4065456 - RNA, 12 nt, Staphylococcus aureus subsp. aureus N315
caacuaagauau

SEQ ID NO: 4065457 - RNA, 18 nt, Staphylococcus aureus subsp. aureus N315
caacuaauguuaaaauaa

SEQ ID NO: 4065458 - RNA, 17 nt, Staphylococcus aureus subsp. aureus N315
caacuaauuuaaagcau

SEQ ID NO: 4065459 - RNA, 19 nt, Staphylococcus aureus subsp. aureus N315
caaguuuauaaauuucgau

SEQ ID NO: 4065460 - RNA, 16 nt, Staphylococcus aureus subsp. aureus N315
caaguuuauaaucuuu

SEQ ID NO: 4065461 - RNA, 19 nt, Staphylococcus aureus subsp. aureus N315
caaguuuauaaucuuuuuu

SEQ ID NO: 4065462 - RNA, 19 nt, Staphylococcus aureus subsp. aureus N315
caaguuuucggcuagauuu

SEQ ID NO: 4065463 - RNA, 11 nt, Staphylococcus aureus subsp. aureus N315
caauaaaaaug

SEQ ID NO: 4065464 - RNA, 13 nt, Staphylococcus aureus subsp. aureus N315
caauaaaaugcaa

SEQ ID NO: 4065465 - RNA, 19 nt, Staphylococcus aureus subsp. aureus N315
caauaaaucaguaguuuua

SEQ ID NO: 4065466 - RNA, 14 nt, Staphylococcus aureus subsp. aureus N315
caauaaaucuuucc

SEQ ID NO: 4065467 - RNA, 17 nt, Staphylococcus aureus subsp. aureus N315
caauaacaaugcagcug

SEQ ID NO: 4065468 - RNA, 23 nt, Staphylococcus aureus subsp. aureus N315
caauaacaccuguuacuugagaa

SEQ ID NO: 4065469 - RNA, 15 nt, Staphylococcus aureus subsp. aureus N315
caauaacaggugcuu

SEQ ID NO: 4065470 - RNA, 17 nt, Staphylococcus aureus subsp. aureus N315
caauaagcgcaauuaaa

SEQ ID NO: 4065471 - RNA, 14 nt, Staphylococcus aureus subsp. aureus N315
caauaauaaaucac

SEQ ID NO: 4065472 - RNA, 19 nt, Staphylococcus aureus subsp. aureus N315
caauaauccgagucauacu

SEQ ID NO: 4065473 - RNA, 12 nt, Staphylococcus aureus subsp. aureus N315
caauaaugaaau

SEQ ID NO: 4065474 - RNA, 16 nt, Staphylococcus aureus subsp. aureus N315
caauaaugaaaugaag

SEQ ID NO: 4065475 - RNA, 11 nt, Staphylococcus aureus subsp. aureus N315
caauaauguua

SEQ ID NO: 4065476 - RNA, 12 nt, Staphylococcus aureus subsp. aureus N315
caauaauuuuau

SEQ ID NO: 4065477 - RNA, 15 nt, Staphylococcus aureus subsp. aureus N315
caauacaaagaauua

SEQ ID NO: 4065478 - RNA, 20 nt, Staphylococcus aureus subsp. aureus N315
caauacaaagaauuauguau

SEQ ID NO: 4065479 - RNA, 17 nt, Staphylococcus aureus subsp. aureus N315
caauacagaacuuuaau

SEQ ID NO: 4065480 - RNA, 17 nt, Staphylococcus aureus subsp. aureus N315
caauacauaaugguuca

SEQ ID NO: 4065481 - RNA, 17 nt, Staphylococcus aureus subsp. aureus N315
caauacauuaauauaaa

SEQ ID NO: 4065482 - RNA, 18 nt, Staphylococcus aureus subsp. aureus N315
caauacauuaauauaaau

SEQ ID NO: 4065483 - RNA, 17 nt, Staphylococcus aureus subsp. aureus N315
caauaccauaauuaaau

SEQ ID NO: 4065484 - RNA, 20 nt, Staphylococcus aureus subsp. aureus N315
caauaccgaauaauuuugau

SEQ ID NO: 4065485 - RNA, 20 nt, Staphylococcus aureus subsp. aureus N315
caauaccuguccaaauaaau

SEQ ID NO: 4065486 - RNA, 14 nt, Staphylococcus aureus subsp. aureus N315
caauacgaaaucaa

SEQ ID NO: 4065487 - RNA, 21 nt, Staphylococcus aureus subsp. aureus N315
caauacgaaaucaaaaauaau

SEQ ID NO: 4065488 - RNA, 19 nt, Staphylococcus aureus subsp. aureus N315
caauacgaaguuucauguu

SEQ ID NO: 4065489 - RNA, 13 nt, Staphylococcus aureus subsp. aureus N315
caauacgcaaugu

SEQ ID NO: 4065490 - RNA, 15 nt, Staphylococcus aureus subsp. aureus N315
caauacguuuccaau

SEQ ID NO: 4065491 - RNA, 22 nt, Staphylococcus aureus subsp. aureus N315
caauacuuuuuauauaauucgu

SEQ ID NO: 4065492 - RNA, 15 nt, Staphylococcus aureus subsp. aureus N315
caauaggaugaaacu

SEQ ID NO: 4065493 - RNA, 17 nt, Staphylococcus aureus subsp. aureus N315
caauagguacaacuaaa

SEQ ID NO: 4065494 - RNA, 18 nt, Staphylococcus aureus subsp. aureus N315
caauagguacaacuaaau

SEQ ID NO: 4065495 - RNA, 16 nt, Staphylococcus aureus subsp. aureus N315
caauaguauaaauauc

SEQ ID NO: 4065496 - RNA, 17 nt, Staphylococcus aureus subsp. aureus N315
caauauaauuuccuaaa

SEQ ID NO: 4065497 - RNA, 16 nt, Staphylococcus aureus subsp. aureus N315
caauauacaaugcuga

SEQ ID NO: 4065498 - RNA, 14 nt, Staphylococcus aureus subsp. aureus N315
caauauacuuuuua

SEQ ID NO: 4065499 - RNA, 17 nt, Staphylococcus aureus subsp. aureus N315
caauauacuuuuuaaau

SEQ ID NO: 4065500 - RNA, 21 nt, Staphylococcus aureus subsp. aureus N315
caauauagaaaaugaguacaa

SEQ ID NO: 4065501 - RNA, 14 nt, Staphylococcus aureus subsp. aureus N315
caauauaguaccaa

SEQ ID NO: 4065502 - RNA, 15 nt, Staphylococcus aureus subsp. aureus N315
caauauauucaccua

SEQ ID NO: 4065503 - RNA, 19 nt, Staphylococcus aureus subsp. aureus N315
caauaucaucauuuaaaua

SEQ ID NO: 4065504 - RNA, 19 nt, Staphylococcus aureus subsp. aureus N315
caauaucuucuaauuccau

SEQ ID NO: 4065505 - RNA, 22 nt, Staphylococcus aureus subsp. aureus N315
caauaucuucuuuuaauauuug

SEQ ID NO: 4065506 - RNA, 20 nt, Staphylococcus aureus subsp. aureus N315
caauaugaccuuuaugugca

SEQ ID NO: 4065507 - RNA, 21 nt, Staphylococcus aureus subsp. aureus N315
caauauguggcgcucuuauaa

SEQ ID NO: 4065508 - RNA, 13 nt, Staphylococcus aureus subsp. aureus N315
caauauuaaaauc

SEQ ID NO: 4065509 - RNA, 19 nt, Staphylococcus aureus subsp. aureus N315
caauauuaaucauaaugaa

SEQ ID NO: 4065510 - RNA, 23 nt, Staphylococcus aureus subsp. aureus N315
caauauuaaucauaaugaauaau

SEQ ID NO: 4065511 - RNA, 15 nt, Staphylococcus aureus subsp. aureus N315
caauauuaaugaaua

SEQ ID NO: 4065512 - RNA, 16 nt, Staphylococcus aureus subsp. aureus N315
caauauucaauaauuc

SEQ ID NO: 4065513 - RNA, 18 nt, Staphylococcus aureus subsp. aureus N315
caauauucguaaauccuu

SEQ ID NO: 4065514 - RNA, 18 nt, Staphylococcus aureus subsp. aureus N315
caauauucuuaucauuca

SEQ ID NO: 4065515 - RNA, 14 nt, Staphylococcus aureus subsp. aureus N315
caauauugaacaau

SEQ ID NO: 4065516 - RNA, 19 nt, Staphylococcus aureus subsp. aureus N315
caauauuuaccacaaauau

SEQ ID NO: 4065517 - RNA, 20 nt, Staphylococcus aureus subsp. aureus N315
caauauuuauauuaaauacu

SEQ ID NO: 4065518 - RNA, 17 nt, Staphylococcus aureus subsp. aureus N315
caauauuuaucaauaaa

SEQ ID NO: 4065519 - RNA, 22 nt, Staphylococcus aureus subsp. aureus N315
caauauuugauaaguagaaaau

SEQ ID NO: 4065520 - RNA, 18 nt, Staphylococcus aureus subsp. aureus N315
caauauuuucauguccau

SEQ ID NO: 4065521 - RNA, 15 nt, Staphylococcus aureus subsp. aureus N315
caauauuuuuacaua

SEQ ID NO: 4065522 - RNA, 20 nt, Staphylococcus aureus subsp. aureus N315
caauauuuuuacauauuuau

SEQ ID NO: 4065523 - RNA, 19 nt, Staphylococcus aureus subsp. aureus N315
caaucaacuuagaauuuac

SEQ ID NO: 4065524 - RNA, 15 nt, Staphylococcus aureus subsp. aureus N315
caaucaacuucauau

SEQ ID NO: 4065525 - RNA, 14 nt, Staphylococcus aureus subsp. aureus N315
caaucacagcaaua

SEQ ID NO: 4065526 - RNA, 17 nt, Staphylococcus aureus subsp. aureus N315
caaucacagcaauaaua

SEQ ID NO: 4065527 - RNA, 17 nt, Staphylococcus aureus subsp. aureus N315
caaucaguaauaaugua

SEQ ID NO: 4065528 - RNA, 21 nt, Staphylococcus aureus subsp. aureus N315
caaucaucgcaaauacauaau

SEQ ID NO: 4065529 - RNA, 15 nt, Staphylococcus aureus subsp. aureus N315
caaucauucacuuca

SEQ ID NO: 4065530 - RNA, 18 nt, Staphylococcus aureus subsp. aureus N315
caaucauuguaaaugauc

SEQ ID NO: 4065531 - RNA, 19 nt, Staphylococcus aureus subsp. aureus N315
caaucgcuuuagcaauuga

SEQ ID NO: 4065532 - RNA, 18 nt, Staphylococcus aureus subsp. aureus N315
caaucguugaaaaauauc

SEQ ID NO: 4065533 - RNA, 21 nt, Staphylococcus aureus subsp. aureus N315
caaucguugaaaaauauccug

SEQ ID NO: 4065534 - RNA, 13 nt, Staphylococcus aureus subsp. aureus N315
caaucuauauaaa

SEQ ID NO: 4065535 - RNA, 12 nt, Staphylococcus aureus subsp. aureus N315
caaucuuuuuaa

SEQ ID NO: 4065536 - RNA, 16 nt, Staphylococcus aureus subsp. aureus N315
caaugaauaaauugau

SEQ ID NO: 4065537 - RNA, 17 nt, Staphylococcus aureus subsp. aureus N315
caaugaauucauuuuau

SEQ ID NO: 4065538 - RNA, 18 nt, Staphylococcus aureus subsp. aureus N315
caaugacauccauacaaa

SEQ ID NO: 4065539 - RNA, 15 nt, Staphylococcus aureus subsp. aureus N315
caaugacugagaaaa

SEQ ID NO: 4065540 - RNA, 20 nt, Staphylococcus aureus subsp. aureus N315
caaugagcaagucuucuaaa

SEQ ID NO: 4065541 - RNA, 13 nt, Staphylococcus aureus subsp. aureus N315
caaugagcaucuu

SEQ ID NO: 4065542 - RNA, 17 nt, Staphylococcus aureus subsp. aureus N315
caaugaggauuguguaa

SEQ ID NO: 4065543 - RNA, 20 nt, Staphylococcus aureus subsp. aureus N315
caaugaggauuguguaauga

SEQ ID NO: 4065544 - RNA, 17 nt, Staphylococcus aureus subsp. aureus N315
caaugauaccuuuaaau

SEQ ID NO: 4065545 - RNA, 22 nt, Staphylococcus aureus subsp. aureus N315
caaugaugggaaaucaguaaua

SEQ ID NO: 4065546 - RNA, 18 nt, Staphylococcus aureus subsp. aureus N315
caaugauuaaaucuucua

SEQ ID NO: 4065547 - RNA, 21 nt, Staphylococcus aureus subsp. aureus N315
cacagagaaauucgaaaagaa

SEQ ID NO: 4065548 - RNA, 18 nt, Staphylococcus aureus subsp. aureus N315
cacagcgauuaaaugaug

SEQ ID NO: 4065549 - RNA, 12 nt, Staphylococcus aureus subsp. aureus N315
cacauaaaucaa

SEQ ID NO: 4065550 - RNA, 13 nt, Staphylococcus aureus subsp. aureus N315
cacauacauuuug

SEQ ID NO: 4065551 - RNA, 14 nt, Staphylococcus aureus subsp. aureus N315
cacauauguccaua

SEQ ID NO: 4065552 - RNA, 16 nt, Staphylococcus aureus subsp. aureus N315
cacauccccuuugaua

SEQ ID NO: 4065553 - RNA, 15 nt, Staphylococcus aureus subsp. aureus N315
cacaucgcauaauau

SEQ ID NO: 4065554 - RNA, 13 nt, Staphylococcus aureus subsp. aureus N315
cacaucuaugugg

SEQ ID NO: 4065555 - RNA, 23 nt, Staphylococcus aureus subsp. aureus N315
cacauguacguuuuuuuaaauac

SEQ ID NO: 4065556 - RNA, 12 nt, Staphylococcus aureus subsp. aureus N315
cacaugugaaau

SEQ ID NO: 4065557 - RNA, 14 nt, Staphylococcus aureus subsp. aureus N315
cacauuaacaaggc

SEQ ID NO: 4065558 - RNA, 16 nt, Staphylococcus aureus subsp. aureus N315
cacauuacuguaaaau

SEQ ID NO: 4065559 - RNA, 22 nt, Staphylococcus aureus subsp. aureus N315
cacauucugcccugcaaugcaa

SEQ ID NO: 4065560 - RNA, 18 nt, Staphylococcus aureus subsp. aureus N315
cacauuguuuacaaaguu

SEQ ID NO: 4065561 - RNA, 23 nt, Staphylococcus aureus subsp. aureus N315
cacauuuuuaguuagaaaguauu

SEQ ID NO: 4065562 - RNA, 15 nt, Staphylococcus aureus subsp. aureus N315
caccaaaaaucaucc

SEQ ID NO: 4065563 - RNA, 22 nt, Staphylococcus aureus subsp. aureus N315
caccaaauccaucuaauucaau

SEQ ID NO: 4065564 - RNA, 13 nt, Staphylococcus aureus subsp. aureus N315
caccaacaacuuu

SEQ ID NO: 4065565 - RNA, 23 nt, Staphylococcus aureus subsp. aureus N315
caccaacaauagguacaacuaaa

SEQ ID NO: 4065566 - RNA, 23 nt, Staphylococcus aureus subsp. aureus N315
caccaacuuuuuuaacagcugca

SEQ ID NO: 4065567 - RNA, 19 nt, Staphylococcus aureus subsp. aureus N315
caccaaguucacuaaauuc

SEQ ID NO: 4065568 - RNA, 16 nt, Staphylococcus aureus subsp. aureus N315
caccaccugcaauuug

SEQ ID NO: 4065569 - RNA, 18 nt, Staphylococcus aureus subsp. aureus N315
caccacuuucaguaauug

SEQ ID NO: 4065570 - RNA, 16 nt, Staphylococcus aureus subsp. aureus N315
caccagaacaauucaa

SEQ ID NO: 4065571 - RNA, 18 nt, Staphylococcus aureus subsp. aureus N315
caccagauaucauaauau

SEQ ID NO: 4065572 - RNA, 12 nt, Staphylococcus aureus subsp. aureus N315
caccagccucug

SEQ ID NO: 4065573 - RNA, 13 nt, Staphylococcus aureus subsp. aureus N315
caccagccucugu

SEQ ID NO: 4065574 - RNA, 23 nt, Staphylococcus aureus subsp. aureus N315
caccagccucuguguuggggccc

SEQ ID NO: 4065575 - RNA, 12 nt, Staphylococcus aureus subsp. aureus N315
caccaguuucaa

SEQ ID NO: 4065576 - RNA, 14 nt, Staphylococcus aureus subsp. aureus N315
caccaguuucaagu

SEQ ID NO: 4065577 - RNA, 21 nt, Staphylococcus aureus subsp. aureus N315
caccaguuugugguaaugauu

SEQ ID NO: 4065578 - RNA, 17 nt, Staphylococcus aureus subsp. aureus N315
caccauacuaaaacaug

SEQ ID NO: 4065579 - RNA, 12 nt, Staphylococcus aureus subsp. aureus N315
caccauaugugg

SEQ ID NO: 4065580 - RNA, 15 nt, Staphylococcus aureus subsp. aureus N315
caccaucccauuaaa

SEQ ID NO: 4065581 - RNA, 20 nt, Staphylococcus aureus subsp. aureus N315
caccaugcugcacauuccau

SEQ ID NO: 4065582 - RNA, 21 nt, Staphylococcus aureus subsp. aureus N315
caccauguacauugguuuuua

SEQ ID NO: 4065583 - RNA, 18 nt, Staphylococcus aureus subsp. aureus N315
caccauuuacuucauaag

SEQ ID NO: 4065584 - RNA, 15 nt, Staphylococcus aureus subsp. aureus N315
cacccauuugucuua

SEQ ID NO: 4065585 - RNA, 14 nt, Staphylococcus aureus subsp. aureus N315
caccccaacuugca

SEQ ID NO: 4065586 - RNA, 18 nt, Staphylococcus aureus subsp. aureus N315
caccguaaucuuuuaacu

SEQ ID NO: 4065587 - RNA, 13 nt, Staphylococcus aureus subsp. aureus N315
caccuaaaaagaa

SEQ ID NO: 4065588 - RNA, 13 nt, Staphylococcus aureus subsp. aureus N315
caccuaaaugauu

SEQ ID NO: 4065589 - RNA, 13 nt, Staphylococcus aureus subsp. aureus N315
caccuaauaccau

SEQ ID NO: 4065590 - RNA, 19 nt, Staphylococcus aureus subsp. aureus N315
caccuacaaauauuucuaa

SEQ ID NO: 4065591 - RNA, 17 nt, Staphylococcus aureus subsp. aureus N315
caccuauacauaacccu

SEQ ID NO: 4065592 - RNA, 16 nt, Staphylococcus aureus subsp. aureus N315
caccuauauuuuuagc

SEQ ID NO: 4065593 - RNA, 17 nt, Staphylococcus aureus subsp. aureus N315
caccucuaaguucaccu

SEQ ID NO: 4065594 - RNA, 19 nt, Staphylococcus aureus subsp. aureus N315
caccucuaaguucaccuaa

SEQ ID NO: 4065595 - RNA, 17 nt, Staphylococcus aureus subsp. aureus N315
caccugauugacaaugu

SEQ ID NO: 4065596 - RNA, 20 nt, Staphylococcus aureus subsp. aureus N315
caccugcuaguucagcuucu

SEQ ID NO: 4065597 - RNA, 21 nt, Staphylococcus aureus subsp. aureus N315
caccuggucguacuuucaaau

SEQ ID NO: 4065598 - RNA, 23 nt, Staphylococcus aureus subsp. aureus N315
caccuggucguacuuucaaauaa

SEQ ID NO: 4065599 - RNA, 21 nt, Staphylococcus aureus subsp. aureus N315
caccuguuacuugagaaccau

SEQ ID NO: 4065600 - RNA, 17 nt, Staphylococcus aureus subsp. aureus N315
caccuuaccuacuuuuu

SEQ ID NO: 4065601 - RNA, 23 nt, Staphylococcus aureus subsp. aureus N315
caccuuaucacuuggaauaauac

SEQ ID NO: 4065602 - RNA, 21 nt, Staphylococcus aureus subsp. aureus N315
caccuuauugaugaaaacaaa

SEQ ID NO: 4065603 - RNA, 16 nt, Staphylococcus aureus subsp. aureus N315
caccuuuacaacauac

SEQ ID NO: 4065604 - RNA, 17 nt, Staphylococcus aureus subsp. aureus N315
caccuuuagacaauauu

SEQ ID NO: 4065605 - RNA, 16 nt, Staphylococcus aureus subsp. aureus N315
caccuuuaucuguaac

SEQ ID NO: 4065606 - RNA, 22 nt, Staphylococcus aureus subsp. aureus N315
cacgaaauggugaacuaaauug

SEQ ID NO: 4065607 - RNA, 17 nt, Staphylococcus aureus subsp. aureus N315
cacgaacaagucuugca

SEQ ID NO: 4065608 - RNA, 14 nt, Staphylococcus aureus subsp. aureus N315
cacgacauguaggu

SEQ ID NO: 4065609 - RNA, 14 nt, Staphylococcus aureus subsp. aureus N315
cacgagcugcuuca

SEQ ID NO: 4065610 - RNA, 17 nt, Staphylococcus aureus subsp. aureus N315
cacgagcugcuucaacu

SEQ ID NO: 4065611 - RNA, 17 nt, Staphylococcus aureus subsp. aureus N315
cacgauaucuagcugcu

SEQ ID NO: 4065612 - RNA, 18 nt, Staphylococcus aureus subsp. aureus N315
cacgauaucuagcugcuu

SEQ ID NO: 4065613 - RNA, 20 nt, Staphylococcus aureus subsp. aureus N315
cacgauaucuagcugcuucu

SEQ ID NO: 4065614 - RNA, 21 nt, Staphylococcus aureus subsp. aureus N315
cacgauaucuagcugcuucug

SEQ ID NO: 4065615 - RNA, 23 nt, Staphylococcus aureus subsp. aureus N315
cacgauuacgcucauaugucugu

SEQ ID NO: 4065616 - RNA, 14 nt, Staphylococcus aureus subsp. aureus N315
cacgcaauaucaua

SEQ ID NO: 4065617 - RNA, 14 nt, Staphylococcus aureus subsp. aureus N315
cacgcugaaauuuu

SEQ ID NO: 4065618 - RNA, 13 nt, Staphylococcus aureus subsp. aureus N315
cacggucccaaga

SEQ ID NO: 4065619 - RNA, 20 nt, Staphylococcus aureus subsp. aureus N315
cacguaauugaguuguugca

SEQ ID NO: 4065620 - RNA, 23 nt, Staphylococcus aureus subsp. aureus N315
cacgugcuucguuuuuaguguua

SEQ ID NO: 4065621 - RNA, 18 nt, Staphylococcus aureus subsp. aureus N315
cacguguauuguauuuua

SEQ ID NO: 4065622 - RNA, 20 nt, Staphylococcus aureus subsp. aureus N315
cacguucuugguauuuuuua

SEQ ID NO: 4065623 - RNA, 23 nt, Staphylococcus aureus subsp. aureus N315
cacguugugcaauaccuguucca

SEQ ID NO: 4065624 - RNA, 16 nt, Staphylococcus aureus subsp. aureus N315
cacuaaaaauauauuu

SEQ ID NO: 4065625 - RNA, 14 nt, Staphylococcus aureus subsp. aureus N315
cacuaaauucaaua

SEQ ID NO: 4065626 - RNA, 16 nt, Staphylococcus aureus subsp. aureus N315
cacuaaauucaauaau

SEQ ID NO: 4065627 - RNA, 15 nt, Staphylococcus aureus subsp. aureus N315
cacuaacucaauaug

SEQ ID NO: 4065628 - RNA, 16 nt, Staphylococcus aureus subsp. aureus N315
cacuaaugcauaauua

SEQ ID NO: 4065629 - RNA, 22 nt, Staphylococcus aureus subsp. aureus N315
cacuacaguguaugaugaacuu

SEQ ID NO: 4065630 - RNA, 18 nt, Staphylococcus aureus subsp. aureus N315
cacuagucuuuuuauuuu

SEQ ID NO: 4065631 - RNA, 15 nt, Staphylococcus aureus subsp. aureus N315
cacuauaaaauucac

SEQ ID NO: 4065632 - RNA, 16 nt, Staphylococcus aureus subsp. aureus N315
cacuauauccuuuuug

SEQ ID NO: 4065633 - RNA, 13 nt, Staphylococcus aureus subsp. aureus N315
cacuaucauuauc

SEQ ID NO: 4065634 - RNA, 11 nt, Staphylococcus aureus subsp. aureus N315
cacuaucuuuu

SEQ ID NO: 4065635 - RNA, 14 nt, Staphylococcus aureus subsp. aureus N315
cagcacauuuuuag

SEQ ID NO: 4065636 - RNA, 22 nt, Staphylococcus aureus subsp. aureus N315
cagcaccgacaauuauaauaaa

SEQ ID NO: 4065637 - RNA, 17 nt, Staphylococcus aureus subsp. aureus N315
cagcaguaagauuauuu

SEQ ID NO: 4065638 - RNA, 14 nt, Staphylococcus aureus subsp. aureus N315
cagcaguaggauaa

SEQ ID NO: 4065639 - RNA, 19 nt, Staphylococcus aureus subsp. aureus N315
cagcagugaaguuaacuau

SEQ ID NO: 4065640 - RNA, 22 nt, Staphylococcus aureus subsp. aureus N315
cagcaguugacuguaaaacaau

SEQ ID NO: 4065641 - RNA, 19 nt, Staphylococcus aureus subsp. aureus N315
cagcauuaaucguauuuuu

SEQ ID NO: 4065642 - RNA, 22 nt, Staphylococcus aureus subsp. aureus N315
cagcauuaccagcaauuucgau

SEQ ID NO: 4065643 - RNA, 20 nt, Staphylococcus aureus subsp. aureus N315
cagccgaggcaauauugaac

SEQ ID NO: 4065644 - RNA, 12 nt, Staphylococcus aureus subsp. aureus N315
cagcgaaauuug

SEQ ID NO: 4065645 - RNA, 14 nt, Staphylococcus aureus subsp. aureus N315
cagcgacauuuuua

SEQ ID NO: 4065646 - RNA, 16 nt, Staphylococcus aureus subsp. aureus N315
cagcgauuaaaugaug

SEQ ID NO: 4065647 - RNA, 17 nt, Staphylococcus aureus subsp. aureus N315
cagcggaauacagauga

SEQ ID NO: 4065648 - RNA, 19 nt, Staphylococcus aureus subsp. aureus N315
cagcggaauacagaugaug

SEQ ID NO: 4065649 - RNA, 21 nt, Staphylococcus aureus subsp. aureus N315
cagcuaaaaaguauacuaaac

SEQ ID NO: 4065650 - RNA, 19 nt, Staphylococcus aureus subsp. aureus N315
cagcuaaaaguuucccaag

SEQ ID NO: 4065651 - RNA, 12 nt, Staphylococcus aureus subsp. aureus N315
cagcuaacaaaa

SEQ ID NO: 4065652 - RNA, 21 nt, Staphylococcus aureus subsp. aureus N315
cagcuaaugucaugaaaauaa

SEQ ID NO: 4065653 - RNA, 13 nt, Staphylococcus aureus subsp. aureus N315
cagcuaauugucg

SEQ ID NO: 4065654 - RNA, 16 nt, Staphylococcus aureus subsp. aureus N315
cagcuacaaauaauga

SEQ ID NO: 4065655 - RNA, 17 nt, Staphylococcus aureus subsp. aureus N315
cagcuacaaauaaugag

SEQ ID NO: 4065656 - RNA, 17 nt, Staphylococcus aureus subsp. aureus N315
cagcuguauuuaauaaa

SEQ ID NO: 4065657 - RNA, 15 nt, Staphylococcus aureus subsp. aureus N315
cagcuucaaaaucaa

SEQ ID NO: 4065658 - RNA, 12 nt, Staphylococcus aureus subsp. aureus N315
cagcuucauuaa

SEQ ID NO: 4065659 - RNA, 19 nt, Staphylococcus aureus subsp. aureus N315
cagcuucuaaguaauauaa

SEQ ID NO: 4065660 - RNA, 14 nt, Staphylococcus aureus subsp. aureus N315
cagcuucuuuaaca

SEQ ID NO: 4065661 - RNA, 14 nt, Staphylococcus aureus subsp. aureus N315
cagcuuuaauaaua

SEQ ID NO: 4065662 - RNA, 17 nt, Staphylococcus aureus subsp. aureus N315
cagcuuuaauaauauga

SEQ ID NO: 4065663 - RNA, 12 nt, Staphylococcus aureus subsp. aureus N315
cagcuuuuucua

SEQ ID NO: 4065664 - RNA, 13 nt, Staphylococcus aureus subsp. aureus N315
caggaauagaugu

SEQ ID NO: 4065665 - RNA, 14 nt, Staphylococcus aureus subsp. aureus N315
caggaauuguuaaa

SEQ ID NO: 4065666 - RNA, 20 nt, Staphylococcus aureus subsp. aureus N315
caggaccacucaauucucua

SEQ ID NO: 4065667 - RNA, 14 nt, Staphylococcus aureus subsp. aureus N315
caggcaaugcaagu

SEQ ID NO: 4065668 - RNA, 18 nt, Staphylococcus aureus subsp. aureus N315
caggcaaugcgaguuggg

SEQ ID NO: 4065669 - RNA, 17 nt, Staphylococcus aureus subsp. aureus N315
caggcgaaccgaagcgc

SEQ ID NO: 4065670 - RNA, 17 nt, Staphylococcus aureus subsp. aureus N315
caggcgcuccuacuuuu

SEQ ID NO: 4065671 - RNA, 19 nt, Staphylococcus aureus subsp. aureus N315
cagguaaugcaaguuggcg

SEQ ID NO: 4065672 - RNA, 21 nt, Staphylococcus aureus subsp. aureus N315
caggucgcccuugccugugcu

SEQ ID NO: 4065673 - RNA, 12 nt, Staphylococcus aureus subsp. aureus N315
cagguucaaaau

SEQ ID NO: 4065674 - RNA, 17 nt, Staphylococcus aureus subsp. aureus N315
cagguuguuaggggcuu

SEQ ID NO: 4065675 - RNA, 21 nt, Staphylococcus aureus subsp. aureus N315
cagguuuaaacaucuauaaca

SEQ ID NO: 4065676 - RNA, 22 nt, Staphylococcus aureus subsp. aureus N315
cagguuuaaacaucuauaacaa

SEQ ID NO: 4065677 - RNA, 16 nt, Staphylococcus aureus subsp. aureus N315
cagguuuaauaaauuu

SEQ ID NO: 4065678 - RNA, 20 nt, Staphylococcus aureus subsp. aureus N315
caguaagacgauuucaauga

SEQ ID NO: 4065679 - RNA, 15 nt, Staphylococcus aureus subsp. aureus N315
caguaauauguugcu

SEQ ID NO: 4065680 - RNA, 16 nt, Staphylococcus aureus subsp. aureus N315
caguaaucaaaguauc

SEQ ID NO: 4065681 - RNA, 19 nt, Staphylococcus aureus subsp. aureus N315
caguaaucaaaguaucagu

SEQ ID NO: 4065682 - RNA, 22 nt, Staphylococcus aureus subsp. aureus N315
caguaaucaugcauucuaugau

SEQ ID NO: 4065683 - RNA, 21 nt, Staphylococcus aureus subsp. aureus N315
caguaauugugacgaccgugu

SEQ ID NO: 4065684 - RNA, 14 nt, Staphylococcus aureus subsp. aureus N315
caguacgaacaacu

SEQ ID NO: 4065685 - RNA, 18 nt, Staphylococcus aureus subsp. aureus N315
caguaguuaauugaauga

SEQ ID NO: 4065686 - RNA, 21 nt, Staphylococcus aureus subsp. aureus N315
caguaguuaauugaaugaaaa

SEQ ID NO: 4065687 - RNA, 23 nt, Staphylococcus aureus subsp. aureus N315
caguauaaguuucuggcauaucg

SEQ ID NO: 4065688 - RNA, 15 nt, Staphylococcus aureus subsp. aureus N315
caguauaauuuucug

SEQ ID NO: 4065689 - RNA, 17 nt, Staphylococcus aureus subsp. aureus N315
caguauguggauacaaa

SEQ ID NO: 4065690 - RNA, 18 nt, Staphylococcus aureus subsp. aureus N315
caguauguggauacaaac

SEQ ID NO: 4065691 - RNA, 14 nt, Staphylococcus aureus subsp. aureus N315
caguauuuacuuuu

SEQ ID NO: 4065692 - RNA, 14 nt, Staphylococcus aureus subsp. aureus N315
caguauuuuuugug

SEQ ID NO: 4065693 - RNA, 13 nt, Staphylococcus aureus subsp. aureus N315
cagucaacuacug

SEQ ID NO: 4065694 - RNA, 23 nt, Staphylococcus aureus subsp. aureus N315
cagucaacuacugucaauauaac

SEQ ID NO: 4065695 - RNA, 14 nt, Staphylococcus aureus subsp. aureus N315
cagucaacugcugc

SEQ ID NO: 4065696 - RNA, 15 nt, Staphylococcus aureus subsp. aureus N315
cagucaacugcugcu

SEQ ID NO: 4065697 - RNA, 23 nt, Staphylococcus aureus subsp. aureus N315
cagucaacugcugcuaaaauaaa

SEQ ID NO: 4065698 - RNA, 18 nt, Staphylococcus aureus subsp. aureus N315
cagucaauuuuuucaucu

SEQ ID NO: 4065699 - RNA, 15 nt, Staphylococcus aureus subsp. aureus N315
cagucaguaaaaaua

SEQ ID NO: 4065700 - RNA, 17 nt, Staphylococcus aureus subsp. aureus N315
cagucauuugauuuaaa

SEQ ID NO: 4065701 - RNA, 17 nt, Staphylococcus aureus subsp. aureus N315
caguccauuauugggcu

SEQ ID NO: 4065702 - RNA, 15 nt, Staphylococcus aureus subsp. aureus N315
cagucucuaaaacuu

SEQ ID NO: 4065703 - RNA, 20 nt, Staphylococcus aureus subsp. aureus N315
cagucucuaaaacuuuuuca

SEQ ID NO: 4065704 - RNA, 15 nt, Staphylococcus aureus subsp. aureus N315
cagugaaguuaacua

SEQ ID NO: 4065705 - RNA, 18 nt, Staphylococcus aureus subsp. aureus N315
cagugaaguuaacuauaa

SEQ ID NO: 4065706 - RNA, 18 nt, Staphylococcus aureus subsp. aureus N315
cagugaucuuuuuuauau

SEQ ID NO: 4065707 - RNA, 23 nt, Staphylococcus aureus subsp. aureus N315
cagugcuauguauuuuucuuaau

SEQ ID NO: 4065708 - RNA, 19 nt, Staphylococcus aureus subsp. aureus N315
caguggauuacagaugaug

SEQ ID NO: 4065709 - RNA, 19 nt, Staphylococcus aureus subsp. aureus N315
caguguuauaauggcgggc

SEQ ID NO: 4065710 - RNA, 21 nt, Staphylococcus aureus subsp. aureus N315
caguuaaaauaaccauuuuuu

SEQ ID NO: 4065711 - RNA, 22 nt, Staphylococcus aureus subsp. aureus N315
caguuaaaauaaccauuuuuuc

SEQ ID NO: 4065712 - RNA, 12 nt, Staphylococcus aureus subsp. aureus N315
caguuaauaauu

SEQ ID NO: 4065713 - RNA, 19 nt, Staphylococcus aureus subsp. aureus N315
caguuacugcgcuuuuaau

SEQ ID NO: 4065714 - RNA, 15 nt, Staphylococcus aureus subsp. aureus N315
caguuacuucaguuu

SEQ ID NO: 4065715 - RNA, 21 nt, Staphylococcus aureus subsp. aureus N315
caguuacuuucgcuugcaaag

SEQ ID NO: 4065716 - RNA, 12 nt, Staphylococcus aureus subsp. aureus N315
caguuagugcuu

SEQ ID NO: 4065717 - RNA, 23 nt, Staphylococcus aureus subsp. aureus N315
caguuagugcuuguuacacauga

SEQ ID NO: 4065718 - RNA, 22 nt, Staphylococcus aureus subsp. aureus N315
caguucuauagguuuauaaaaa

SEQ ID NO: 4065719 - RNA, 21 nt, Staphylococcus aureus subsp. aureus N315
caguugcacaaauugcaaugg

SEQ ID NO: 4065720 - RNA, 22 nt, Staphylococcus aureus subsp. aureus N315
caguuggagguccauaaucuuu

SEQ ID NO: 4065721 - RNA, 18 nt, Staphylococcus aureus subsp. aureus N315
caguuguuauuuuugcua

SEQ ID NO: 4065722 - RNA, 14 nt, Staphylococcus aureus subsp. aureus N315
cauaguaaucgauu

SEQ ID NO: 4065723 - RNA, 20 nt, Staphylococcus aureus subsp. aureus N315
cauaguauacauaauucaau

SEQ ID NO: 4065724 - RNA, 16 nt, Staphylococcus aureus subsp. aureus N315
cauagugguguuuaua

SEQ ID NO: 4065725 - RNA, 17 nt, Staphylococcus aureus subsp. aureus N315
cauauaaaaaauuauua

SEQ ID NO: 4065726 - RNA, 12 nt, Staphylococcus aureus subsp. aureus N315
cauauaaaaacc

SEQ ID NO: 4065727 - RNA, 19 nt, Staphylococcus aureus subsp. aureus N315
cauauaaagcugcgauaua

SEQ ID NO: 4065728 - RNA, 17 nt, Staphylococcus aureus subsp. aureus N315
cauauaaagucguauca

SEQ ID NO: 4065729 - RNA, 14 nt, Staphylococcus aureus subsp. aureus N315
cauauaaauauuuu

SEQ ID NO: 4065730 - RNA, 12 nt, Staphylococcus aureus subsp. aureus N315
cauauaaaucaa

SEQ ID NO: 4065731 - RNA, 22 nt, Staphylococcus aureus subsp. aureus N315
cauauaaaucaaauauacuuuu

SEQ ID NO: 4065732 - RNA, 23 nt, Staphylococcus aureus subsp. aureus N315
cauauaaaucguaauaauuuugu

SEQ ID NO: 4065733 - RNA, 15 nt, Staphylococcus aureus subsp. aureus N315
cauauaauaugugca

SEQ ID NO: 4065734 - RNA, 18 nt, Staphylococcus aureus subsp. aureus N315
cauauaaugguugaauaa

SEQ ID NO: 4065735 - RNA, 21 nt, Staphylococcus aureus subsp. aureus N315
cauauacacacuaaggaaaau

SEQ ID NO: 4065736 - RNA, 15 nt, Staphylococcus aureus subsp. aureus N315
cauauacgacauuuu

SEQ ID NO: 4065737 - RNA, 17 nt, Staphylococcus aureus subsp. aureus N315
cauauacgacauuuuua

SEQ ID NO: 4065738 - RNA, 18 nt, Staphylococcus aureus subsp. aureus N315
cauauacgacauuuuuag

SEQ ID NO: 4065739 - RNA, 19 nt, Staphylococcus aureus subsp. aureus N315
cauauacgacauuuuuaga

SEQ ID NO: 4065740 - RNA, 17 nt, Staphylococcus aureus subsp. aureus N315
cauauacucuaaaaaag

SEQ ID NO: 4065741 - RNA, 19 nt, Staphylococcus aureus subsp. aureus N315
cauauauauucguuacaaa

SEQ ID NO: 4065742 - RNA, 18 nt, Staphylococcus aureus subsp. aureus N315
cauauaugauaaauauug

SEQ ID NO: 4065743 - RNA, 16 nt, Staphylococcus aureus subsp. aureus N315
cauauaugucucucuu

SEQ ID NO: 4065744 - RNA, 13 nt, Staphylococcus aureus subsp. aureus N315
cauauauuuuguu

SEQ ID NO: 4065745 - RNA, 17 nt, Staphylococcus aureus subsp. aureus N315
cauaucagcuuuuucau

SEQ ID NO: 4065746 - RNA, 21 nt, Staphylococcus aureus subsp. aureus N315
cauaucaugaaugucagucgu

SEQ ID NO: 4065747 - RNA, 15 nt, Staphylococcus aureus subsp. aureus N315
cauaucuuuugcugu

SEQ ID NO: 4065748 - RNA, 13 nt, Staphylococcus aureus subsp. aureus N315
cauaugauuacaa

SEQ ID NO: 4065749 - RNA, 16 nt, Staphylococcus aureus subsp. aureus N315
cauauguaauacaaaa

SEQ ID NO: 4065750 - RNA, 15 nt, Staphylococcus aureus subsp. aureus N315
cauauguacuauuau

SEQ ID NO: 4065751 - RNA, 14 nt, Staphylococcus aureus subsp. aureus N315
cauaugugguggcu

SEQ ID NO: 4065752 - RNA, 19 nt, Staphylococcus aureus subsp. aureus N315
cauauguguaugauagaau

SEQ ID NO: 4065753 - RNA, 22 nt, Staphylococcus aureus subsp. aureus N315
cauauguuguuucuaaugcuca

SEQ ID NO: 4065754 - RNA, 22 nt, Staphylococcus aureus subsp. aureus N315
cauauuacuucucaucgaauuc

SEQ ID NO: 4065755 - RNA, 15 nt, Staphylococcus aureus subsp. aureus N315
cauauucaaaauaac

SEQ ID NO: 4065756 - RNA, 19 nt, Staphylococcus aureus subsp. aureus N315
cauauucaauguuuuaaau

SEQ ID NO: 4065757 - RNA, 15 nt, Staphylococcus aureus subsp. aureus N315
cauauucaguauaug

SEQ ID NO: 4065758 - RNA, 20 nt, Staphylococcus aureus subsp. aureus N315
cauauugugccgcuucuaca

SEQ ID NO: 4065759 - RNA, 11 nt, Staphylococcus aureus subsp. aureus N315
cauauuuauau

SEQ ID NO: 4065760 - RNA, 17 nt, Staphylococcus aureus subsp. aureus N315
cauauuuauauuuacac

SEQ ID NO: 4065761 - RNA, 20 nt, Staphylococcus aureus subsp. aureus N315
cauauuuaucgcgauuauua

SEQ ID NO: 4065762 - RNA, 23 nt, Staphylococcus aureus subsp. aureus N315
cauauuuaucgcgauuauuacca

SEQ ID NO: 4065763 - RNA, 13 nt, Staphylococcus aureus subsp. aureus N315
cauauuuauggug

SEQ ID NO: 4065764 - RNA, 13 nt, Staphylococcus aureus subsp. aureus N315
cauauuucuaaau

SEQ ID NO: 4065765 - RNA, 16 nt, Staphylococcus aureus subsp. aureus N315
cauauuucuaaauuau

SEQ ID NO: 4065766 - RNA, 19 nt, Staphylococcus aureus subsp. aureus N315
cauauuucuaaauuauuua

SEQ ID NO: 4065767 - RNA, 20 nt, Staphylococcus aureus subsp. aureus N315
cauauuuguagccuacaacc

SEQ ID NO: 4065768 - RNA, 15 nt, Staphylococcus aureus subsp. aureus N315
cauauuuugauuuac

SEQ ID NO: 4065769 - RNA, 16 nt, Staphylococcus aureus subsp. aureus N315
cauauuuugccucaau

SEQ ID NO: 4065770 - RNA, 23 nt, Staphylococcus aureus subsp. aureus N315
cauauuuugccucaauaucuuua

SEQ ID NO: 4065771 - RNA, 13 nt, Staphylococcus aureus subsp. aureus N315
cauauuuuuuaaa

SEQ ID NO: 4065772 - RNA, 17 nt, Staphylococcus aureus subsp. aureus N315
cauauuuuuuaaauuua

SEQ ID NO: 4065773 - RNA, 13 nt, Staphylococcus aureus subsp. aureus N315
caucaaaaaugag

SEQ ID NO: 4065774 - RNA, 13 nt, Staphylococcus aureus subsp. aureus N315
caucaaacaacau

SEQ ID NO: 4065775 - RNA, 14 nt, Staphylococcus aureus subsp. aureus N315
caucaaacaacauc

SEQ ID NO: 4065776 - RNA, 19 nt, Staphylococcus aureus subsp. aureus N315
caucaaauagacaccaaaa

SEQ ID NO: 4065777 - RNA, 18 nt, Staphylococcus aureus subsp. aureus N315
caucaacgccauauuuau

SEQ ID NO: 4065778 - RNA, 22 nt, Staphylococcus aureus subsp. aureus N315
caucaaguauaaauguuauugc

SEQ ID NO: 4065779 - RNA, 14 nt, Staphylococcus aureus subsp. aureus N315
caucaauaucaaau

SEQ ID NO: 4065780 - RNA, 21 nt, Staphylococcus aureus subsp. aureus N315
caucaaucgcuuuagcaauug

SEQ ID NO: 4065781 - RNA, 22 nt, Staphylococcus aureus subsp. aureus N315
caucaaucgcuuuagcaauuga

SEQ ID NO: 4065782 - RNA, 19 nt, Staphylococcus aureus subsp. aureus N315
caucaauuuaguccuucuu

SEQ ID NO: 4065783 - RNA, 15 nt, Staphylococcus aureus subsp. aureus N315
caucacauaaaauac

SEQ ID NO: 4065784 - RNA, 23 nt, Staphylococcus aureus subsp. aureus N315
caucacucuuacucauuuuucuu

SEQ ID NO: 4065785 - RNA, 14 nt, Staphylococcus aureus subsp. aureus N315
caucacugcauaua

SEQ ID NO: 4065786 - RNA, 19 nt, Staphylococcus aureus subsp. aureus N315
caucacuguagauucaaau

SEQ ID NO: 4065787 - RNA, 12 nt, Staphylococcus aureus subsp. aureus N315
caucaguaccaa

SEQ ID NO: 4065788 - RNA, 22 nt, Staphylococcus aureus subsp. aureus N315
caucaguaccaaagaaaucacc

SEQ ID NO: 4065789 - RNA, 14 nt, Staphylococcus aureus subsp. aureus N315
caucaguuaauaau

SEQ ID NO: 4065790 - RNA, 23 nt, Staphylococcus aureus subsp. aureus N315
caucauaaaugacgucucuaaca

SEQ ID NO: 4065791 - RNA, 15 nt, Staphylococcus aureus subsp. aureus N315
caucauaauaaaucu

SEQ ID NO: 4065792 - RNA, 20 nt, Staphylococcus aureus subsp. aureus N315
caucauaaucaagaauauaa

SEQ ID NO: 4065793 - RNA, 14 nt, Staphylococcus aureus subsp. aureus N315
caucaucaaguuca

SEQ ID NO: 4065794 - RNA, 16 nt, Staphylococcus aureus subsp. aureus N315
caucaucaaguucacc

SEQ ID NO: 4065795 - RNA, 19 nt, Staphylococcus aureus subsp. aureus N315
caucaucacuguagauuca

SEQ ID NO: 4065796 - RNA, 12 nt, Staphylococcus aureus subsp. aureus N315
caucaucuauuu

SEQ ID NO: 4065797 - RNA, 16 nt, Staphylococcus aureus subsp. aureus N315
caucaugaaauuagau

SEQ ID NO: 4065798 - RNA, 24 nt, Staphylococcus aureus subsp. aureus N315
caucaugaacuuuuauugccauaa

SEQ ID NO: 4065799 - RNA, 15 nt, Staphylococcus aureus subsp. aureus N315
caucaugacuauuuc

SEQ ID NO: 4065800 - RNA, 20 nt, Staphylococcus aureus subsp. aureus N315
caucaugacuauuucgcuuu

SEQ ID NO: 4065801 - RNA, 13 nt, Staphylococcus aureus subsp. aureus N315
caucaugcauaau

SEQ ID NO: 4065802 - RNA, 16 nt, Staphylococcus aureus subsp. aureus N315
caucauguuuaucuac

SEQ ID NO: 4065803 - RNA, 15 nt, Staphylococcus aureus subsp. aureus N315
caucauuaaauauuu

SEQ ID NO: 4065804 - RNA, 23 nt, Staphylococcus aureus subsp. aureus N315
caucauuauacgugcuuuaaagu

SEQ ID NO: 4065805 - RNA, 16 nt, Staphylococcus aureus subsp. aureus N315
caucauucaaacuccu

SEQ ID NO: 4065806 - RNA, 22 nt, Staphylococcus aureus subsp. aureus N315
caucauuuaaauauuucacgau

SEQ ID NO: 4065807 - RNA, 21 nt, Staphylococcus aureus subsp. aureus N315
caucauuuaauugaugucaca

SEQ ID NO: 4065808 - RNA, 22 nt, Staphylococcus aureus subsp. aureus N315
caucauuuauaugauguucaau

SEQ ID NO: 4065809 - RNA, 20 nt, Staphylococcus aureus subsp. aureus N315
caucauuuguguaaaugaau

SEQ ID NO: 4065810 - RNA, 15 nt, Staphylococcus aureus subsp. aureus N315
cauguuuuuuaagua

SEQ ID NO: 4065811 - RNA, 12 nt, Staphylococcus aureus subsp. aureus N315
cauuaaaaaauc

SEQ ID NO: 4065812 - RNA, 23 nt, Staphylococcus aureus subsp. aureus N315
cauuaaaaaaucgaacuagacaa

SEQ ID NO: 4065813 - RNA, 17 nt, Staphylococcus aureus subsp. aureus N315
cauuaaaaacgauucau

SEQ ID NO: 4065814 - RNA, 18 nt, Staphylococcus aureus subsp. aureus N315
cauuaaaaauaaaagcaa

SEQ ID NO: 4065815 - RNA, 23 nt, Staphylococcus aureus subsp. aureus N315
cauuaaaaggaugugacaaauac

SEQ ID NO: 4065816 - RNA, 13 nt, Staphylococcus aureus subsp. aureus N315
cauuaaaauaauu

SEQ ID NO: 4065817 - RNA, 21 nt, Staphylococcus aureus subsp. aureus N315
cauuaaaauaauuaaauaaaa

SEQ ID NO: 4065818 - RNA, 14 nt, Staphylococcus aureus subsp. aureus N315
cauuaaaaugauau

SEQ ID NO: 4065819 - RNA, 19 nt, Staphylococcus aureus subsp. aureus N315
cauuaaaauguguuuucaa

SEQ ID NO: 4065820 - RNA, 20 nt, Staphylococcus aureus subsp. aureus N315
cauuaaauauuauuuugcaa

SEQ ID NO: 4065821 - RNA, 15 nt, Staphylococcus aureus subsp. aureus N315
cauuaaaucugauuc

SEQ ID NO: 4065822 - RNA, 14 nt, Staphylococcus aureus subsp. aureus N315
cauuaaauguacau

SEQ ID NO: 4065823 - RNA, 15 nt, Staphylococcus aureus subsp. aureus N315
cauuaaggcuuuagu

SEQ ID NO: 4065824 - RNA, 19 nt, Staphylococcus aureus subsp. aureus N315
cauuaaguaaucugcaaau

SEQ ID NO: 4065825 - RNA, 18 nt, Staphylococcus aureus subsp. aureus N315
cauuaaguacuuuuacaa

SEQ ID NO: 4065826 - RNA, 15 nt, Staphylococcus aureus subsp. aureus N315
cauuaauaaauaaua

SEQ ID NO: 4065827 - RNA, 20 nt, Staphylococcus aureus subsp. aureus N315
cauuaauacaagucuuuacu

SEQ ID NO: 4065828 - RNA, 14 nt, Staphylococcus aureus subsp. aureus N315
cauuaauauaaaua

SEQ ID NO: 4065829 - RNA, 16 nt, Staphylococcus aureus subsp. aureus N315
cauuaaucauuuaucu

SEQ ID NO: 4065830 - RNA, 20 nt, Staphylococcus aureus subsp. aureus N315
cauuaaucuauauaaaaacu

SEQ ID NO: 4065831 - RNA, 21 nt, Staphylococcus aureus subsp. aureus N315
cauuaauuggauuaaauacgc

SEQ ID NO: 4065832 - RNA, 17 nt, Staphylococcus aureus subsp. aureus N315
cauuacaaaucaugaca

SEQ ID NO: 4065833 - RNA, 19 nt, Staphylococcus aureus subsp. aureus N315
cauuacauauaucaacaug

SEQ ID NO: 4065834 - RNA, 20 nt, Staphylococcus aureus subsp. aureus N315
cauuacauuuggcguaauga

SEQ ID NO: 4065835 - RNA, 22 nt, Staphylococcus aureus subsp. aureus N315
cauuacauuuggcguaaugaua

SEQ ID NO: 4065836 - RNA, 23 nt, Staphylococcus aureus subsp. aureus N315
cauuacauuuggcguaaugauau

SEQ ID NO: 4065837 - RNA, 14 nt, Staphylococcus aureus subsp. aureus N315
cauuaccagcaauu

SEQ ID NO: 4065838 - RNA, 14 nt, Staphylococcus aureus subsp. aureus N315
cauuacccuuuaaa

SEQ ID NO: 4065839 - RNA, 16 nt, Staphylococcus aureus subsp. aureus N315
cauuacccuuuaaacu

SEQ ID NO: 4065840 - RNA, 22 nt, Staphylococcus aureus subsp. aureus N315
cauuacguaacaucacauaaaa

SEQ ID NO: 4065841 - RNA, 19 nt, Staphylococcus aureus subsp. aureus N315
cauuacuaaaacaaauuca

SEQ ID NO: 4065842 - RNA, 20 nt, Staphylococcus aureus subsp. aureus N315
cauuacuacuuuauaaauau

SEQ ID NO: 4065843 - RNA, 17 nt, Staphylococcus aureus subsp. aureus N315
cauuacuaucuucauca

SEQ ID NO: 4065844 - RNA, 19 nt, Staphylococcus aureus subsp. aureus N315
cauuacuaucuucaucaua

SEQ ID NO: 4065845 - RNA, 15 nt, Staphylococcus aureus subsp. aureus N315
cauuagcaaauauua

SEQ ID NO: 4065846 - RNA, 16 nt, Staphylococcus aureus subsp. aureus N315
cauuagcaugauaaag

SEQ ID NO: 4065847 - RNA, 15 nt, Staphylococcus aureus subsp. aureus N315
cauuagcauuaaauu

SEQ ID NO: 4065848 - RNA, 17 nt, Staphylococcus aureus subsp. aureus N315
cauuaggauguucagcu

SEQ ID NO: 4065849 - RNA, 16 nt, Staphylococcus aureus subsp. aureus N315
cauuaguuaugugcua

SEQ ID NO: 4065850 - RNA, 17 nt, Staphylococcus aureus subsp. aureus N315
cauuaguuaugugcuaa

SEQ ID NO: 4065851 - RNA, 22 nt, Staphylococcus aureus subsp. aureus N315
cauuaguugcauaaucaauuuc

SEQ ID NO: 4065852 - RNA, 20 nt, Staphylococcus aureus subsp. aureus N315
cauuaguuguaucagugaca

SEQ ID NO: 4065853 - RNA, 17 nt, Staphylococcus aureus subsp. aureus N315
cauuaguuuuuaaaauu

SEQ ID NO: 4065854 - RNA, 18 nt, Staphylococcus aureus subsp. aureus N315
cauuauauaauucuucaa

SEQ ID NO: 4065855 - RNA, 15 nt, Staphylococcus aureus subsp. aureus N315
cauuaucaagaacuu

SEQ ID NO: 4065856 - RNA, 20 nt, Staphylococcus aureus subsp. aureus N315
cauuaucaagaacuuuaaaa

SEQ ID NO: 4065857 - RNA, 13 nt, Staphylococcus aureus subsp. aureus N315
cauuaucauuaag

SEQ ID NO: 4065858 - RNA, 15 nt, Staphylococcus aureus subsp. aureus N315
cauuauguucuucac

SEQ ID NO: 4065859 - RNA, 21 nt, Staphylococcus aureus subsp. aureus N315
cauuauuaaauagaugagaaa

SEQ ID NO: 4065860 - RNA, 12 nt, Staphylococcus aureus subsp. aureus N315
cauuauuaagug

SEQ ID NO: 4065861 - RNA, 20 nt, Staphylococcus aureus subsp. aureus N315
cauuauuacugauuguuaac

SEQ ID NO: 4065862 - RNA, 16 nt, Staphylococcus aureus subsp. aureus N315
cauuauugccuaaccu

SEQ ID NO: 4065863 - RNA, 15 nt, Staphylococcus aureus subsp. aureus N315
cauuauuuagaauuc

SEQ ID NO: 4065864 - RNA, 13 nt, Staphylococcus aureus subsp. aureus N315
cauuauuugauaa

SEQ ID NO: 4065865 - RNA, 20 nt, Staphylococcus aureus subsp. aureus N315
cauuauuugcugcuaauuga

SEQ ID NO: 4065866 - RNA, 14 nt, Staphylococcus aureus subsp. aureus N315
cauucaauguuuaa

SEQ ID NO: 4065867 - RNA, 24 nt, Staphylococcus aureus subsp. aureus N315
cauucaauguuuaauuuucuaaau

SEQ ID NO: 4065868 - RNA, 15 nt, Staphylococcus aureus subsp. aureus N315
cauucaccuaaaaag

SEQ ID NO: 4065869 - RNA, 20 nt, Staphylococcus aureus subsp. aureus N315
cauucaccuaaaaagaaaau

SEQ ID NO: 4065870 - RNA, 19 nt, Staphylococcus aureus subsp. aureus N315
cauucauaauuuguugaua

SEQ ID NO: 4065871 - RNA, 21 nt, Staphylococcus aureus subsp. aureus N315
cauucauaccgaagaaacuaa

SEQ ID NO: 4065872 - RNA, 21 nt, Staphylococcus aureus subsp. aureus N315
cauucauuuaguuaaauacaa

SEQ ID NO: 4065873 - RNA, 22 nt, Staphylococcus aureus subsp. aureus N315
cauuccaaaguaccaucucuau

SEQ ID NO: 4065874 - RNA, 12 nt, Staphylococcus aureus subsp. aureus N315
cauucguuuaau

SEQ ID NO: 4065875 - RNA, 17 nt, Staphylococcus aureus subsp. aureus N315
cauucuaguagcuagaa

SEQ ID NO: 4065876 - RNA, 17 nt, Staphylococcus aureus subsp. aureus N315
cauucuauacuuuuaau

SEQ ID NO: 4065877 - RNA, 18 nt, Staphylococcus aureus subsp. aureus N315
cauucuguguaaauauaa

SEQ ID NO: 4065878 - RNA, 20 nt, Staphylococcus aureus subsp. aureus N315
cauucuguguaaauauaaau

SEQ ID NO: 4065879 - RNA, 13 nt, Staphylococcus aureus subsp. aureus N315
cauucuuauuuga

SEQ ID NO: 4065880 - RNA, 21 nt, Staphylococcus aureus subsp. aureus N315
cauucuuuuucucaaugugag

SEQ ID NO: 4065881 - RNA, 19 nt, Staphylococcus aureus subsp. aureus N315
cauugaaaggaacauuuca

SEQ ID NO: 4065882 - RNA, 18 nt, Staphylococcus aureus subsp. aureus N315
cauugaccaccuuuaucu

SEQ ID NO: 4065883 - RNA, 21 nt, Staphylococcus aureus subsp. aureus N315
cauugagauuaucuuuagaca

SEQ ID NO: 4065884 - RNA, 21 nt, Staphylococcus aureus subsp. aureus N315
cauugauaaauuuuuaguuaa

SEQ ID NO: 4065885 - RNA, 22 nt, Staphylococcus aureus subsp. aureus N315
cauugauaaauuuuuaguuaaa

SEQ ID NO: 4065886 - RNA, 15 nt, Staphylococcus aureus subsp. aureus N315
cauugauaagucuug

SEQ ID NO: 4065887 - RNA, 19 nt, Staphylococcus aureus subsp. aureus N315
cauugaucaacauuacgua

SEQ ID NO: 4065888 - RNA, 22 nt, Staphylococcus aureus subsp. aureus N315
cauugauuugggcgcuuuuuaa

SEQ ID NO: 4065889 - RNA, 17 nt, Staphylococcus aureus subsp. aureus N315
cauugcacuaugcauaa

SEQ ID NO: 4065890 - RNA, 23 nt, Staphylococcus aureus subsp. aureus N315
cauugcacuugucucaaauuaaa

SEQ ID NO: 4065891 - RNA, 23 nt, Staphylococcus aureus subsp. aureus N315
cauugcuagugcucuugcaauag

SEQ ID NO: 4065892 - RNA, 22 nt, Staphylococcus aureus subsp. aureus N315
cauugcuuaacuuccuuuuuau

SEQ ID NO: 4065893 - RNA, 22 nt, Staphylococcus aureus subsp. aureus N315
cauuggcaauauacuuuuuaaa

SEQ ID NO: 4065894 - RNA, 17 nt, Staphylococcus aureus subsp. aureus N315
cauugguaccuuuuuau

SEQ ID NO: 4065895 - RNA, 23 nt, Staphylococcus aureus subsp. aureus N315
cauugguaccuuuuuauuaucuu

SEQ ID NO: 4065896 - RNA, 15 nt, Staphylococcus aureus subsp. aureus N315
cauugguuucaucau

SEQ ID NO: 4065897 - RNA, 21 nt, Staphylococcus aureus subsp. aureus N315
ccaacaauagguacaacuaaa

SEQ ID NO: 4065898 - RNA, 22 nt, Staphylococcus aureus subsp. aureus N315
ccaacacaaagaauuucgaaaa

SEQ ID NO: 4065899 - RNA, 22 nt, Staphylococcus aureus subsp. aureus N315
ccaacacagagaaauucgaaaa

SEQ ID NO: 4065900 - RNA, 18 nt, Staphylococcus aureus subsp. aureus N315
ccaacacccauauaauuu

SEQ ID NO: 4065901 - RNA, 18 nt, Staphylococcus aureus subsp. aureus N315
ccaacauaucacgagcuu

SEQ ID NO: 4065902 - RNA, 17 nt, Staphylococcus aureus subsp. aureus N315
ccaacauguaacaaaau

SEQ ID NO: 4065903 - RNA, 14 nt, Staphylococcus aureus subsp. aureus N315
ccaacuugcacauu

SEQ ID NO: 4065904 - RNA, 16 nt, Staphylococcus aureus subsp. aureus N315
ccaacuugcacauuau

SEQ ID NO: 4065905 - RNA, 14 nt, Staphylococcus aureus subsp. aureus N315
ccaagaacguguuu

SEQ ID NO: 4065906 - RNA, 19 nt, Staphylococcus aureus subsp. aureus N315
ccaagauaaaucaucauuc

SEQ ID NO: 4065907 - RNA, 15 nt, Staphylococcus aureus subsp. aureus N315
ccaagauauauaacu

SEQ ID NO: 4065908 - RNA, 16 nt, Staphylococcus aureus subsp. aureus N315
ccaagaugguauugcu

SEQ ID NO: 4065909 - RNA, 17 nt, Staphylococcus aureus subsp. aureus N315
ccaagcucguuaaauca

SEQ ID NO: 4065910 - RNA, 22 nt, Staphylococcus aureus subsp. aureus N315
ccaaggauguuauaaaaugaau

SEQ ID NO: 4065911 - RNA, 19 nt, Staphylococcus aureus subsp. aureus N315
ccaaguacgcaauuuaaua

SEQ ID NO: 4065912 - RNA, 13 nt, Staphylococcus aureus subsp. aureus N315
ccaaguauuuucu

SEQ ID NO: 4065913 - RNA, 17 nt, Staphylococcus aureus subsp. aureus N315
ccaaguccaauuccaau

SEQ ID NO: 4065914 - RNA, 18 nt, Staphylococcus aureus subsp. aureus N315
ccaaguccaauuccaaua

SEQ ID NO: 4065915 - RNA, 12 nt, Staphylococcus aureus subsp. aureus N315
ccaaguuaaugc

SEQ ID NO: 4065916 - RNA, 19 nt, Staphylococcus aureus subsp. aureus N315
ccaaguuuugcacgcauac

SEQ ID NO: 4065917 - RNA, 17 nt, Staphylococcus aureus subsp. aureus N315
ccaauaaaacuaugugu

SEQ ID NO: 4065918 - RNA, 19 nt, Staphylococcus aureus subsp. aureus N315
ccaauaaaaugcaauuuuu

SEQ ID NO: 4065919 - RNA, 23 nt, Staphylococcus aureus subsp. aureus N315
ccaauaaaaugucagcaacuucu

SEQ ID NO: 4065920 - RNA, 21 nt, Staphylococcus aureus subsp. aureus N315
ccaauaccgaauaauuuugau

SEQ ID NO: 4065921 - RNA, 15 nt, Staphylococcus aureus subsp. aureus N315
ccaauacuuuuuaua

SEQ ID NO: 4065922 - RNA, 20 nt, Staphylococcus aureus subsp. aureus N315
ccaauacuuuuuauauaauu

SEQ ID NO: 4065923 - RNA, 17 nt, Staphylococcus aureus subsp. aureus N315
ccaauaucauauuugaa

SEQ ID NO: 4065924 - RNA, 13 nt, Staphylococcus aureus subsp. aureus N315
ccaaucaauaguu

SEQ ID NO: 4065925 - RNA, 18 nt, Staphylococcus aureus subsp. aureus N315
ccaaucaucauuaaaucu

SEQ ID NO: 4065926 - RNA, 19 nt, Staphylococcus aureus subsp. aureus N315
ccaaucuauuuuaaacuca

SEQ ID NO: 4065927 - RNA, 10 nt, Staphylococcus aureus subsp. aureus N315
ccaaugaauc

SEQ ID NO: 4065928 - RNA, 19 nt, Staphylococcus aureus subsp. aureus N315
ccaauggaaguuuuuuagu

SEQ ID NO: 4065929 - RNA, 21 nt, Staphylococcus aureus subsp. aureus N315
ccaauuaauuguaaagcauga

SEQ ID NO: 4065930 - RNA, 21 nt, Staphylococcus aureus subsp. aureus N315
ccaauuaucaacauaauauuu

SEQ ID NO: 4065931 - RNA, 17 nt, Staphylococcus aureus subsp. aureus N315
ccaauuccaauaaacaa

SEQ ID NO: 4065932 - RNA, 16 nt, Staphylococcus aureus subsp. aureus N315
ccaauugauuuugcug

SEQ ID NO: 4065933 - RNA, 22 nt, Staphylococcus aureus subsp. aureus N315
ccaauuguuucagcuuguccau

SEQ ID NO: 4065934 - RNA, 20 nt, Staphylococcus aureus subsp. aureus N315
ccaauuuaauagcuuguaca

SEQ ID NO: 4065935 - RNA, 17 nt, Staphylococcus aureus subsp. aureus N315
ccaauuugauuaguaau

SEQ ID NO: 4065936 - RNA, 14 nt, Staphylococcus aureus subsp. aureus N315
ccacaaauaucaau

SEQ ID NO: 4065937 - RNA, 13 nt, Staphylococcus aureus subsp. aureus N315
ccacaacauguuu

SEQ ID NO: 4065938 - RNA, 23 nt, Staphylococcus aureus subsp. aureus N315
ccacaaguggaacgggauuuuga

SEQ ID NO: 4065939 - RNA, 17 nt, Staphylococcus aureus subsp. aureus N315
ccacaaucacaguauga

SEQ ID NO: 4065940 - RNA, 22 nt, Staphylococcus aureus subsp. aureus N315
ccacagcuaauguguacuuaaa

SEQ ID NO: 4065941 - RNA, 12 nt, Staphylococcus aureus subsp. aureus N315
ccacauuuuccu

SEQ ID NO: 4065942 - RNA, 20 nt, Staphylococcus aureus subsp. aureus N315
ccaccaccugcaauuuguaa

SEQ ID NO: 4065943 - RNA, 16 nt, Staphylococcus aureus subsp. aureus N315
ccaccagucguaauga

SEQ ID NO: 4065944 - RNA, 21 nt, Staphylococcus aureus subsp. aureus N315
ccaccguuaaaauauaugaau

SEQ ID NO: 4065945 - RNA, 20 nt, Staphylococcus aureus subsp. aureus N315
ccaccuacgcccaucaucac

SEQ ID NO: 4065946 - RNA, 11 nt, Staphylococcus aureus subsp. aureus N315
ccaccugauaa

SEQ ID NO: 4065947 - RNA, 21 nt, Staphylococcus aureus subsp. aureus N315
ccaccuuguuuaaguuuuuca

SEQ ID NO: 4065948 - RNA, 14 nt, Staphylococcus aureus subsp. aureus N315
ccaccuuuaucugu

SEQ ID NO: 4065949 - RNA, 14 nt, Staphylococcus aureus subsp. aureus N315
ccacgguuuaccac

SEQ ID NO: 4065950 - RNA, 19 nt, Staphylococcus aureus subsp. aureus N315
ccacguuugaccacaacuu

SEQ ID NO: 4065951 - RNA, 16 nt, Staphylococcus aureus subsp. aureus N315
ccacuccuuaaacaaa

SEQ ID NO: 4065952 - RNA, 19 nt, Staphylococcus aureus subsp. aureus N315
ccacuucuucaccugcguc

SEQ ID NO: 4065953 - RNA, 20 nt, Staphylococcus aureus subsp. aureus N315
ccacuuuuucuguaauaauu

SEQ ID NO: 4065954 - RNA, 11 nt, Staphylococcus aureus subsp. aureus N315
ccagaauaaau

SEQ ID NO: 4065955 - RNA, 12 nt, Staphylococcus aureus subsp. aureus N315
ccagacuccuaa

SEQ ID NO: 4065956 - RNA, 14 nt, Staphylococcus aureus subsp. aureus N315
ccagauaucauaau

SEQ ID NO: 4065957 - RNA, 20 nt, Staphylococcus aureus subsp. aureus N315
ccagaugcaaugauaccuuu

SEQ ID NO: 4065958 - RNA, 22 nt, Staphylococcus aureus subsp. aureus N315
ccagcaugaaucgcauuuaaau

SEQ ID NO: 4065959 - RNA, 13 nt, Staphylococcus aureus subsp. aureus N315
ccagccacaccaa

SEQ ID NO: 4065960 - RNA, 15 nt, Staphylococcus aureus subsp. aureus N315
ccagccucuguguug

SEQ ID NO: 4065961 - RNA, 23 nt, Staphylococcus aureus subsp. aureus N315
ccaguacuuucgaguaauacuuu

SEQ ID NO: 4065962 - RNA, 23 nt, Staphylococcus aureus subsp. aureus N315
ccaguauacgaguuauaucuuuu

SEQ ID NO: 4065963 - RNA, 15 nt, Staphylococcus aureus subsp. aureus N315
ccagucaauuuuuuc

SEQ ID NO: 4065964 - RNA, 18 nt, Staphylococcus aureus subsp. aureus N315
ccagucguaaugaugaca

SEQ ID NO: 4065965 - RNA, 15 nt, Staphylococcus aureus subsp. aureus N315
ccaguggaaaugaua

SEQ ID NO: 4065966 - RNA, 18 nt, Staphylococcus aureus subsp. aureus N315
ccaguugauuuaagauuu

SEQ ID NO: 4065967 - RNA, 15 nt, Staphylococcus aureus subsp. aureus N315
ccaguuuucaauuua

SEQ ID NO: 4065968 - RNA, 15 nt, Staphylococcus aureus subsp. aureus N315
ccauaaauauuaaau

SEQ ID NO: 4065969 - RNA, 19 nt, Staphylococcus aureus subsp. aureus N315
ccauaacuuuauauauaaa

SEQ ID NO: 4065970 - RNA, 17 nt, Staphylococcus aureus subsp. aureus N315
ccauaagguacauaaau

SEQ ID NO: 4065971 - RNA, 19 nt, Staphylococcus aureus subsp. aureus N315
ccauaaguaaaacugcaau

SEQ ID NO: 4065972 - RNA, 20 nt, Staphylococcus aureus subsp. aureus N315
ccauaaugacuauaacacca

SEQ ID NO: 4065973 - RNA, 23 nt, Staphylococcus aureus subsp. aureus N315
ccauacauaugcuauauuuaguu

SEQ ID NO: 4065974 - RNA, 19 nt, Staphylococcus aureus subsp. aureus N315
ccauacuaaaacaugauac

SEQ ID NO: 4065975 - RNA, 14 nt, Staphylococcus aureus subsp. aureus N315
ccauacucuaacuu

SEQ ID NO: 4065976 - RNA, 20 nt, Staphylococcus aureus subsp. aureus N315
ccauacucugggcauuuuga

SEQ ID NO: 4065977 - RNA, 14 nt, Staphylococcus aureus subsp. aureus N315
ccauacuucuauuu

SEQ ID NO: 4065978 - RNA, 22 nt, Staphylococcus aureus subsp. aureus N315
ccauacuucuauuuuauaauaa

SEQ ID NO: 4065979 - RNA, 24 nt, Staphylococcus aureus subsp. aureus N315
ccauacuucuauuuuauaauaaau

SEQ ID NO: 4065980 - RNA, 17 nt, Staphylococcus aureus subsp. aureus N315
ccauaguaauaaaauga

SEQ ID NO: 4065981 - RNA, 18 nt, Staphylococcus aureus subsp. aureus N315
ccauaguaauaaaaugau

SEQ ID NO: 4065982 - RNA, 19 nt, Staphylococcus aureus subsp. aureus N315
ccauaguaauaaaaugaug

SEQ ID NO: 4065983 - RNA, 17 nt, Staphylococcus aureus subsp. aureus N315
ccauauagauauuagcu

SEQ ID NO: 4065984 - RNA, 22 nt, Staphylococcus aureus subsp. aureus N315
ccguuuuuuauaaaucauucuu

SEQ ID NO: 4065985 - RNA, 21 nt, Staphylococcus aureus subsp. aureus N315
ccuaaaccucuaaauaaaauu

SEQ ID NO: 4065986 - RNA, 15 nt, Staphylococcus aureus subsp. aureus N315
ccuaaacgaucaacu

SEQ ID NO: 4065987 - RNA, 18 nt, Staphylococcus aureus subsp. aureus N315
ccuaaagcuaaugcaagc

SEQ ID NO: 4065988 - RNA, 12 nt, Staphylococcus aureus subsp. aureus N315
ccuaaaucuccu

SEQ ID NO: 4065989 - RNA, 14 nt, Staphylococcus aureus subsp. aureus N315
ccuaaaugauuaau

SEQ ID NO: 4065990 - RNA, 19 nt, Staphylococcus aureus subsp. aureus N315
ccuaaccuguuugagauau

SEQ ID NO: 4065991 - RNA, 13 nt, Staphylococcus aureus subsp. aureus N315
ccuaacuuuuauu

SEQ ID NO: 4065992 - RNA, 19 nt, Staphylococcus aureus subsp. aureus N315
ccuaacuuuuauuaucagc

SEQ ID NO: 4065993 - RNA, 21 nt, Staphylococcus aureus subsp. aureus N315
ccuaagcauaauucaacuuaa

SEQ ID NO: 4065994 - RNA, 18 nt, Staphylococcus aureus subsp. aureus N315
ccuaaguuaauuuaucgu

SEQ ID NO: 4065995 - RNA, 17 nt, Staphylococcus aureus subsp. aureus N315
ccuaaguuaugacuaac

SEQ ID NO: 4065996 - RNA, 13 nt, Staphylococcus aureus subsp. aureus N315
ccuaauaauaaaa

SEQ ID NO: 4065997 - RNA, 18 nt, Staphylococcus aureus subsp. aureus N315
ccuaauaauaaaauagcu

SEQ ID NO: 4065998 - RNA, 20 nt, Staphylococcus aureus subsp. aureus N315
ccuaauacacuugauaaaac

SEQ ID NO: 4065999 - RNA, 17 nt, Staphylococcus aureus subsp. aureus N315
ccuaaucuaccauguuu

SEQ ID NO: 4066000 - RNA, 16 nt, Staphylococcus aureus subsp. aureus N315
ccuaauuauauuaaug

SEQ ID NO: 4066001 - RNA, 24 nt, Staphylococcus aureus subsp. aureus N315
ccuaauucuugagcaaugucuuua

SEQ ID NO: 4066002 - RNA, 18 nt, Staphylococcus aureus subsp. aureus N315
ccuacaaauauguaauca

SEQ ID NO: 4066003 - RNA, 18 nt, Staphylococcus aureus subsp. aureus N315
ccuacaaauauuucuaaa

SEQ ID NO: 4066004 - RNA, 20 nt, Staphylococcus aureus subsp. aureus N315
ccuacaacaccaauugaaau

SEQ ID NO: 4066005 - RNA, 22 nt, Staphylococcus aureus subsp. aureus N315
ccuacagauuuuaaaaauucau

SEQ ID NO: 4066006 - RNA, 19 nt, Staphylococcus aureus subsp. aureus N315
ccuaccauuacugcagcau

SEQ ID NO: 4066007 - RNA, 21 nt, Staphylococcus aureus subsp. aureus N315
ccuaccgcuaaaauucuuuca

SEQ ID NO: 4066008 - RNA, 16 nt, Staphylococcus aureus subsp. aureus N315
ccuacguguguaguag

SEQ ID NO: 4066009 - RNA, 19 nt, Staphylococcus aureus subsp. aureus N315
ccuacugcugucuuuuuga

SEQ ID NO: 4066010 - RNA, 23 nt, Staphylococcus aureus subsp. aureus N315
ccuacuuugauauguuuccucuu

SEQ ID NO: 4066011 - RNA, 22 nt, Staphylococcus aureus subsp. aureus N315
ccuagaacauugauuauuguuc

SEQ ID NO: 4066012 - RNA, 21 nt, Staphylococcus aureus subsp. aureus N315
ccuagcaaaaauacuuuuuga

SEQ ID NO: 4066013 - RNA, 17 nt, Staphylococcus aureus subsp. aureus N315
ccuaggaaauaaaaaau

SEQ ID NO: 4066014 - RNA, 11 nt, Staphylococcus aureus subsp. aureus N315
ccuauaauagc

SEQ ID NO: 4066015 - RNA, 13 nt, Staphylococcus aureus subsp. aureus N315
ccuauauguaggg

SEQ ID NO: 4066016 - RNA, 18 nt, Staphylococcus aureus subsp. aureus N315
ccuaugauauaugcugca

SEQ ID NO: 4066017 - RNA, 16 nt, Staphylococcus aureus subsp. aureus N315
ccuaugccaaauaacg

SEQ ID NO: 4066018 - RNA, 20 nt, Staphylococcus aureus subsp. aureus N315
ccuaugccaaauaacguuaa

SEQ ID NO: 4066019 - RNA, 20 nt, Staphylococcus aureus subsp. aureus N315
ccuauggcgcaauuuuuaac

SEQ ID NO: 4066020 - RNA, 19 nt, Staphylococcus aureus subsp. aureus N315
ccuauuaaaucugcuugug

SEQ ID NO: 4066021 - RNA, 18 nt, Staphylococcus aureus subsp. aureus N315
ccuauuacacuaaaaccu

SEQ ID NO: 4066022 - RNA, 12 nt, Staphylococcus aureus subsp. aureus N315
ccuauuaggauc

SEQ ID NO: 4066023 - RNA, 11 nt, Staphylococcus aureus subsp. aureus N315
ccuauucccaa

SEQ ID NO: 4066024 - RNA, 17 nt, Staphylococcus aureus subsp. aureus N315
ccuauucccaaaaugau

SEQ ID NO: 4066025 - RNA, 16 nt, Staphylococcus aureus subsp. aureus N315
ccuauuguuuuuuaua

SEQ ID NO: 4066026 - RNA, 11 nt, Staphylococcus aureus subsp. aureus N315
ccuauuuuuua

SEQ ID NO: 4066027 - RNA, 14 nt, Staphylococcus aureus subsp. aureus N315
ccucaauaucuuua

SEQ ID NO: 4066028 - RNA, 18 nt, Staphylococcus aureus subsp. aureus N315
ccucaauuaguucuggca

SEQ ID NO: 4066029 - RNA, 19 nt, Staphylococcus aureus subsp. aureus N315
ccucacuagauaguuuaua

SEQ ID NO: 4066030 - RNA, 14 nt, Staphylococcus aureus subsp. aureus N315
ccucauaauuauca

SEQ ID NO: 4066031 - RNA, 18 nt, Staphylococcus aureus subsp. aureus N315
ccucauaauuaucauaua

SEQ ID NO: 4066032 - RNA, 11 nt, Staphylococcus aureus subsp. aureus N315
ccucauucaca

SEQ ID NO: 4066033 - RNA, 12 nt, Staphylococcus aureus subsp. aureus N315
ccuccaaagcua

SEQ ID NO: 4066034 - RNA, 19 nt, Staphylococcus aureus subsp. aureus N315
ccucguaggcauaggcuua

SEQ ID NO: 4066035 - RNA, 17 nt, Staphylococcus aureus subsp. aureus N315
ccucguuccgggaagga

SEQ ID NO: 4066036 - RNA, 14 nt, Staphylococcus aureus subsp. aureus N315
ccucuaaauaaaau

SEQ ID NO: 4066037 - RNA, 21 nt, Staphylococcus aureus subsp. aureus N315
ccucuaacgguauaucaucca

SEQ ID NO: 4066038 - RNA, 14 nt, Staphylococcus aureus subsp. aureus N315
ccucuccuucggcu

SEQ ID NO: 4066039 - RNA, 15 nt, Staphylococcus aureus subsp. aureus N315
ccucugauaaaugaa

SEQ ID NO: 4066040 - RNA, 12 nt, Staphylococcus aureus subsp. aureus N315
ccucuugccuug

SEQ ID NO: 4066041 - RNA, 19 nt, Staphylococcus aureus subsp. aureus N315
ccucuuguaccgucuuauc

SEQ ID NO: 4066042 - RNA, 21 nt, Staphylococcus aureus subsp. aureus N315
ccugaaauuaacgucaacagc

SEQ ID NO: 4066043 - RNA, 15 nt, Staphylococcus aureus subsp. aureus N315
ccugauaaugcaugu

SEQ ID NO: 4066044 - RNA, 21 nt, Staphylococcus aureus subsp. aureus N315
ccugauauuucaacuuuuuaa

SEQ ID NO: 4066045 - RNA, 15 nt, Staphylococcus aureus subsp. aureus N315
ccugcuuuuuuuaua

SEQ ID NO: 4066046 - RNA, 14 nt, Staphylococcus aureus subsp. aureus N315
ccuggaauauuaac

SEQ ID NO: 4066047 - RNA, 21 nt, Staphylococcus aureus subsp. aureus N315
ccuggaauauuaacaccagau

SEQ ID NO: 4066048 - RNA, 23 nt, Staphylococcus aureus subsp. aureus N315
ccuggaaucgaaaauaucaauuu

SEQ ID NO: 4066049 - RNA, 19 nt, Staphylococcus aureus subsp. aureus N315
ccuguaaaaccauagauaa

SEQ ID NO: 4066050 - RNA, 15 nt, Staphylococcus aureus subsp. aureus N315
ccuguacauccacuu

SEQ ID NO: 4066051 - RNA, 15 nt, Staphylococcus aureus subsp. aureus N315
ccuguagaauuucuu

SEQ ID NO: 4066052 - RNA, 23 nt, Staphylococcus aureus subsp. aureus N315
ccuguauagcgguguuuugagag

SEQ ID NO: 4066053 - RNA, 13 nt, Staphylococcus aureus subsp. aureus N315
ccugugauaaaaa

SEQ ID NO: 4066054 - RNA, 19 nt, Staphylococcus aureus subsp. aureus N315
ccuguucuuuauuuaaagg

SEQ ID NO: 4066055 - RNA, 16 nt, Staphylococcus aureus subsp. aureus N315
ccuuaauaauaaguau

SEQ ID NO: 4066056 - RNA, 17 nt, Staphylococcus aureus subsp. aureus N315
ccuuaauaucaugcaca

SEQ ID NO: 4066057 - RNA, 12 nt, Staphylococcus aureus subsp. aureus N315
ccuucaaaaugc

SEQ ID NO: 4066058 - RNA, 16 nt, Staphylococcus aureus subsp. aureus N315
ccuucaauccaagcaa

SEQ ID NO: 4066059 - RNA, 20 nt, Staphylococcus aureus subsp. aureus N315
ccuucaauguucaauucacg

SEQ ID NO: 4066060 - RNA, 20 nt, Staphylococcus aureus subsp. aureus N315
ccuucaguuucuacuguaua

SEQ ID NO: 4066061 - RNA, 13 nt, Staphylococcus aureus subsp. aureus N315
ccuucauauuuug

SEQ ID NO: 4066062 - RNA, 17 nt, Staphylococcus aureus subsp. aureus N315
ccuucgcauacuuuuuc

SEQ ID NO: 4066063 - RNA, 19 nt, Staphylococcus aureus subsp. aureus N315
ccuucgcauacuuuuucag

SEQ ID NO: 4066064 - RNA, 12 nt, Staphylococcus aureus subsp. aureus N315
ccuucuaacaua

SEQ ID NO: 4066065 - RNA, 16 nt, Staphylococcus aureus subsp. aureus N315
ccuucuauauaguaaa

SEQ ID NO: 4066066 - RNA, 15 nt, Staphylococcus aureus subsp. aureus N315
ccuucucaucauuuu

SEQ ID NO: 4066067 - RNA, 17 nt, Staphylococcus aureus subsp. aureus N315
ccuucuugagcaucacu

SEQ ID NO: 4066068 - RNA, 16 nt, Staphylococcus aureus subsp. aureus N315
ccuugaaugauauuaa

SEQ ID NO: 4066069 - RNA, 21 nt, Staphylococcus aureus subsp. aureus N315
ccuugaccuacuuuuucaaua

SEQ ID NO: 4066070 - RNA, 15 nt, Staphylococcus aureus subsp. aureus N315
ccuugcuaucaaacu

SEQ ID NO: 4066071 - RNA, 20 nt, Staphylococcus aureus subsp. aureus N315
ccuuguucuccgaucaugcc

SEQ ID NO: 4066072 - RNA, 16 nt, Staphylococcus aureus subsp. aureus N315
cgauaucuaagucgau

SEQ ID NO: 4066073 - RNA, 21 nt, Staphylococcus aureus subsp. aureus N315
cgauauguuuggauaucuuug

SEQ ID NO: 4066074 - RNA, 17 nt, Staphylococcus aureus subsp. aureus N315
cgauauuucuaguugca

SEQ ID NO: 4066075 - RNA, 23 nt, Staphylococcus aureus subsp. aureus N315
cgaucaaauuuaauaauaccauc

SEQ ID NO: 4066076 - RNA, 18 nt, Staphylococcus aureus subsp. aureus N315
cgaucauaaauauuuucu

SEQ ID NO: 4066077 - RNA, 16 nt, Staphylococcus aureus subsp. aureus N315
cgaucuaacaauugca

SEQ ID NO: 4066078 - RNA, 18 nt, Staphylococcus aureus subsp. aureus N315
cgaucuaacaauugcaga

SEQ ID NO: 4066079 - RNA, 22 nt, Staphylococcus aureus subsp. aureus N315
cgaucuucaugaacagcaucuu

SEQ ID NO: 4066080 - RNA, 18 nt, Staphylococcus aureus subsp. aureus N315
cgaucuuuuucaauguga

SEQ ID NO: 4066081 - RNA, 14 nt, Staphylococcus aureus subsp. aureus N315
cgaugacuuuuuaa

SEQ ID NO: 4066082 - RNA, 14 nt, Staphylococcus aureus subsp. aureus N315
cgaugucagacgaa

SEQ ID NO: 4066083 - RNA, 14 nt, Staphylococcus aureus subsp. aureus N315
cgauuaaaugaugc

SEQ ID NO: 4066084 - RNA, 17 nt, Staphylococcus aureus subsp. aureus N315
cgauuaauaaaauucua

SEQ ID NO: 4066085 - RNA, 17 nt, Staphylococcus aureus subsp. aureus N315
cgauucaauuuaacguu

SEQ ID NO: 4066086 - RNA, 12 nt, Staphylococcus aureus subsp. aureus N315
cgauugcaauug

SEQ ID NO: 4066087 - RNA, 15 nt, Staphylococcus aureus subsp. aureus N315
cgauuguuucaccag

SEQ ID NO: 4066088 - RNA, 16 nt, Staphylococcus aureus subsp. aureus N315
cgauuuaauuaaaaca

SEQ ID NO: 4066089 - RNA, 16 nt, Staphylococcus aureus subsp. aureus N315
cgauuuauuauuacca

SEQ ID NO: 4066090 - RNA, 21 nt, Staphylococcus aureus subsp. aureus N315
cgauuuauuuauaaaauaaaa

SEQ ID NO: 4066091 - RNA, 22 nt, Staphylococcus aureus subsp. aureus N315
cgauuucuuuaugauaauaaga

SEQ ID NO: 4066092 - RNA, 20 nt, Staphylococcus aureus subsp. aureus N315
cgauuuuaaaagauaaauaa

SEQ ID NO: 4066093 - RNA, 12 nt, Staphylococcus aureus subsp. aureus N315
cgauuuuaaaga

SEQ ID NO: 4066094 - RNA, 15 nt, Staphylococcus aureus subsp. aureus N315
cgauuuuaaagaaaa

SEQ ID NO: 4066095 - RNA, 13 nt, Staphylococcus aureus subsp. aureus N315
cgcaagagauaag

SEQ ID NO: 4066096 - RNA, 21 nt, Staphylococcus aureus subsp. aureus N315
cgcaaucauuagcgaaaaccu

SEQ ID NO: 4066097 - RNA, 14 nt, Staphylococcus aureus subsp. aureus N315
cgcaaugaaaacag

SEQ ID NO: 4066098 - RNA, 22 nt, Staphylococcus aureus subsp. aureus N315
cgcaaugauaucuuuuccaaaa

SEQ ID NO: 4066099 - RNA, 14 nt, Staphylococcus aureus subsp. aureus N315
cgcaaugucuugug

SEQ ID NO: 4066100 - RNA, 12 nt, Staphylococcus aureus subsp. aureus N315
cgcaauuuuuaa

SEQ ID NO: 4066101 - RNA, 18 nt, Staphylococcus aureus subsp. aureus N315
cgcacaucuaagugauau

SEQ ID NO: 4066102 - RNA, 13 nt, Staphylococcus aureus subsp. aureus N315
cgcauacaggaaa

SEQ ID NO: 4066103 - RNA, 18 nt, Staphylococcus aureus subsp. aureus N315
cgcauacuuuuucagaau

SEQ ID NO: 4066104 - RNA, 14 nt, Staphylococcus aureus subsp. aureus N315
cgcauuuaaauaua

SEQ ID NO: 4066105 - RNA, 23 nt, Staphylococcus aureus subsp. aureus N315
cgccaauacagaacuuuaauaau

SEQ ID NO: 4066106 - RNA, 14 nt, Staphylococcus aureus subsp. aureus N315
cgccacuaugugaa

SEQ ID NO: 4066107 - RNA, 18 nt, Staphylococcus aureus subsp. aureus N315
cgccauuguccaacugcu

SEQ ID NO: 4066108 - RNA, 23 nt, Staphylococcus aureus subsp. aureus N315
cgccucaaacggagcaacgauac

SEQ ID NO: 4066109 - RNA, 20 nt, Staphylococcus aureus subsp. aureus N315
cgcgacguuuaaaugcccac

SEQ ID NO: 4066110 - RNA, 19 nt, Staphylococcus aureus subsp. aureus N315
cgcgugccaacaucuucaa

SEQ ID NO: 4066111 - RNA, 14 nt, Staphylococcus aureus subsp. aureus N315
cgcuacaaaacaua

SEQ ID NO: 4066112 - RNA, 22 nt, Staphylococcus aureus subsp. aureus N315
cgcuauauguaaagcuaauuuu

SEQ ID NO: 4066113 - RNA, 16 nt, Staphylococcus aureus subsp. aureus N315
cgcuccaagauuauga

SEQ ID NO: 4066114 - RNA, 14 nt, Staphylococcus aureus subsp. aureus N315
cgcuccuacuuuuc

SEQ ID NO: 4066115 - RNA, 13 nt, Staphylococcus aureus subsp. aureus N315
cgcucucuuuuua

SEQ ID NO: 4066116 - RNA, 14 nt, Staphylococcus aureus subsp. aureus N315
cgcucuuuucaaaa

SEQ ID NO: 4066117 - RNA, 14 nt, Staphylococcus aureus subsp. aureus N315
cgcugcuacaccac

SEQ ID NO: 4066118 - RNA, 18 nt, Staphylococcus aureus subsp. aureus N315
cgcugguaauauuuuugu

SEQ ID NO: 4066119 - RNA, 17 nt, Staphylococcus aureus subsp. aureus N315
cgcuguuucaagcguuu

SEQ ID NO: 4066120 - RNA, 11 nt, Staphylococcus aureus subsp. aureus N315
cgcuuaauucu

SEQ ID NO: 4066121 - RNA, 14 nt, Staphylococcus aureus subsp. aureus N315
cgcuuaauucuuca

SEQ ID NO: 4066122 - RNA, 21 nt, Staphylococcus aureus subsp. aureus N315
cgcuuagauaaauuaauauga

SEQ ID NO: 4066123 - RNA, 14 nt, Staphylococcus aureus subsp. aureus N315
cgcuucaauuauuu

SEQ ID NO: 4066124 - RNA, 14 nt, Staphylococcus aureus subsp. aureus N315
cgcuucuaacucac

SEQ ID NO: 4066125 - RNA, 15 nt, Staphylococcus aureus subsp. aureus N315
cgcuuggauuuuuug

SEQ ID NO: 4066126 - RNA, 11 nt, Staphylococcus aureus subsp. aureus N315
cgcuuuauuac

SEQ ID NO: 4066127 - RNA, 15 nt, Staphylococcus aureus subsp. aureus N315
cgcuuuuaauuuuuu

SEQ ID NO: 4066128 - RNA, 13 nt, Staphylococcus aureus subsp. aureus N315
cgcuuuugaaguu

SEQ ID NO: 4066129 - RNA, 22 nt, Staphylococcus aureus subsp. aureus N315
cgcuuuugaaguugguccaaau

SEQ ID NO: 4066130 - RNA, 11 nt, Staphylococcus aureus subsp. aureus N315
cgcuuuuuaau

SEQ ID NO: 4066131 - RNA, 17 nt, Staphylococcus aureus subsp. aureus N315
cgcuuuuuccauuuuuu

SEQ ID NO: 4066132 - RNA, 17 nt, Staphylococcus aureus subsp. aureus N315
cggaaaaagaugaaaaa

SEQ ID NO: 4066133 - RNA, 21 nt, Staphylococcus aureus subsp. aureus N315
cggaagauaggauuuacaccu

SEQ ID NO: 4066134 - RNA, 21 nt, Staphylococcus aureus subsp. aureus N315
cggaagauaggauuugcaccu

SEQ ID NO: 4066135 - RNA, 21 nt, Staphylococcus aureus subsp. aureus N315
cggaagcauauuucuaaauua

SEQ ID NO: 4066136 - RNA, 14 nt, Staphylococcus aureus subsp. aureus N315
cggaauaaaauaaa

SEQ ID NO: 4066137 - RNA, 15 nt, Staphylococcus aureus subsp. aureus N315
cggaauacagaugau

SEQ ID NO: 4066138 - RNA, 13 nt, Staphylococcus aureus subsp. aureus N315
cggacugaaagaa

SEQ ID NO: 4066139 - RNA, 22 nt, Staphylococcus aureus subsp. aureus N315
cggaucauuauuuagaauucua

SEQ ID NO: 4066140 - RNA, 14 nt, Staphylococcus aureus subsp. aureus N315
cggcacauucauac

SEQ ID NO: 4066141 - RNA, 14 nt, Staphylococcus aureus subsp. aureus N315
cggcauuuuuauau

SEQ ID NO: 4066142 - RNA, 15 nt, Staphylococcus aureus subsp. aureus N315
cgggaacaucauaau

SEQ ID NO: 4066143 - RNA, 16 nt, Staphylococcus aureus subsp. aureus N315
cgggcuauauuugaua

SEQ ID NO: 4066144 - RNA, 17 nt, Staphylococcus aureus subsp. aureus N315
cggggccccaacacaga

SEQ ID NO: 4066145 - RNA, 18 nt, Staphylococcus aureus subsp. aureus N315
cggggccccaacacagag

SEQ ID NO: 4066146 - RNA, 20 nt, Staphylococcus aureus subsp. aureus N315
cggggccccaacacagagaa

SEQ ID NO: 4066147 - RNA, 23 nt, Staphylococcus aureus subsp. aureus N315
cgggggacauagguauaaucauu

SEQ ID NO: 4066148 - RNA, 20 nt, Staphylococcus aureus subsp. aureus N315
cgggggauuauuuauauuuu

SEQ ID NO: 4066149 - RNA, 18 nt, Staphylococcus aureus subsp. aureus N315
cgguaggaccucuuauuu

SEQ ID NO: 4066150 - RNA, 15 nt, Staphylococcus aureus subsp. aureus N315
cgguauuuaauguuu

SEQ ID NO: 4066151 - RNA, 15 nt, Staphylococcus aureus subsp. aureus N315
cgguauuuucauuuu

SEQ ID NO: 4066152 - RNA, 21 nt, Staphylococcus aureus subsp. aureus N315
cggucaaagcgaauagaaggu

SEQ ID NO: 4066153 - RNA, 16 nt, Staphylococcus aureus subsp. aureus N315
cggucucaacuugccu

SEQ ID NO: 4066154 - RNA, 17 nt, Staphylococcus aureus subsp. aureus N315
cggugaccuuauauuuu

SEQ ID NO: 4066155 - RNA, 15 nt, Staphylococcus aureus subsp. aureus N315
cgguuaaauuauuua

SEQ ID NO: 4066156 - RNA, 14 nt, Staphylococcus aureus subsp. aureus N315
cgguucaucuaaaa

SEQ ID NO: 4066157 - RNA, 17 nt, Staphylococcus aureus subsp. aureus N315
cgguucaucuaaaauga

SEQ ID NO: 4066158 - RNA, 17 nt, Staphylococcus aureus subsp. aureus N315
cgguuugaaaaauggug

SEQ ID NO: 4066159 - RNA, 13 nt, Staphylococcus aureus subsp. aureus N315
cguaaacaacauc

SEQ ID NO: 4066160 - RNA, 17 nt, Staphylococcus aureus subsp. aureus N315
cuaaaacggaaauaacc

SEQ ID NO: 4066161 - RNA, 21 nt, Staphylococcus aureus subsp. aureus N315
cuaaaaguuguaauuuaaaau

SEQ ID NO: 4066162 - RNA, 22 nt, Staphylococcus aureus subsp. aureus N315
cuaaaaguuguaauuuaaaaua

SEQ ID NO: 4066163 - RNA, 13 nt, Staphylococcus aureus subsp. aureus N315
cuaaaauaacaac

SEQ ID NO: 4066164 - RNA, 18 nt, Staphylococcus aureus subsp. aureus N315
cuaaaauacccauuuuuu

SEQ ID NO: 4066165 - RNA, 19 nt, Staphylococcus aureus subsp. aureus N315
cuaaaauagaaaaauuuca

SEQ ID NO: 4066166 - RNA, 21 nt, Staphylococcus aureus subsp. aureus N315
cuaaaauagaaaaauuucaaa

SEQ ID NO: 4066167 - RNA, 18 nt, Staphylococcus aureus subsp. aureus N315
cuaaaauaucaaaauaua

SEQ ID NO: 4066168 - RNA, 15 nt, Staphylococcus aureus subsp. aureus N315
cuaaaaugucuuuga

SEQ ID NO: 4066169 - RNA, 16 nt, Staphylococcus aureus subsp. aureus N315
cuaaaauucuuucagc

SEQ ID NO: 4066170 - RNA, 17 nt, Staphylococcus aureus subsp. aureus N315
cuaaaauucuuucagcu

SEQ ID NO: 4066171 - RNA, 17 nt, Staphylococcus aureus subsp. aureus N315
cuaaacauuuuauacuc

SEQ ID NO: 4066172 - RNA, 20 nt, Staphylococcus aureus subsp. aureus N315
cuaaacauuuuugugcaaaa

SEQ ID NO: 4066173 - RNA, 23 nt, Staphylococcus aureus subsp. aureus N315
cuaaaccaaugauuguuaauaca

SEQ ID NO: 4066174 - RNA, 15 nt, Staphylococcus aureus subsp. aureus N315
cuaaaccauugaaug

SEQ ID NO: 4066175 - RNA, 19 nt, Staphylococcus aureus subsp. aureus N315
cuaaaccgauuaauauaau

SEQ ID NO: 4066176 - RNA, 15 nt, Staphylococcus aureus subsp. aureus N315
cuaaaccucaacauu

SEQ ID NO: 4066177 - RNA, 15 nt, Staphylococcus aureus subsp. aureus N315
cuaaaccucuaaaua

SEQ ID NO: 4066178 - RNA, 16 nt, Staphylococcus aureus subsp. aureus N315
cuaaaccucuaaauaa

SEQ ID NO: 4066179 - RNA, 18 nt, Staphylococcus aureus subsp. aureus N315
cuaaaccucuaaauaaaa

SEQ ID NO: 4066180 - RNA, 17 nt, Staphylococcus aureus subsp. aureus N315
cuaaacgauaaauuaac

SEQ ID NO: 4066181 - RNA, 20 nt, Staphylococcus aureus subsp. aureus N315
cuaaacucguugcacucuuu

SEQ ID NO: 4066182 - RNA, 20 nt, Staphylococcus aureus subsp. aureus N315
cuaaagaaugacguuaucau

SEQ ID NO: 4066183 - RNA, 14 nt, Staphylococcus aureus subsp. aureus N315
cuaaagauauagaa

SEQ ID NO: 4066184 - RNA, 14 nt, Staphylococcus aureus subsp. aureus N315
cuaaagcuaaugca

SEQ ID NO: 4066185 - RNA, 17 nt, Staphylococcus aureus subsp. aureus N315
cuaaagcuauaaaaaau

SEQ ID NO: 4066186 - RNA, 19 nt, Staphylococcus aureus subsp. aureus N315
cuaaagguauucuauuuuu

SEQ ID NO: 4066187 - RNA, 13 nt, Staphylococcus aureus subsp. aureus N315
cuaaaguaaauaa

SEQ ID NO: 4066188 - RNA, 15 nt, Staphylococcus aureus subsp. aureus N315
cuaaaguaaauaaca

SEQ ID NO: 4066189 - RNA, 16 nt, Staphylococcus aureus subsp. aureus N315
cuaaauaaaauuaaaa

SEQ ID NO: 4066190 - RNA, 22 nt, Staphylococcus aureus subsp. aureus N315
cuaaauaaaauuaaaacagcaa

SEQ ID NO: 4066191 - RNA, 17 nt, Staphylococcus aureus subsp. aureus N315
cuaaaugauuuauucua

SEQ ID NO: 4066192 - RNA, 23 nt, Staphylococcus aureus subsp. aureus N315
cuaaaugauuuauucuaaauaua

SEQ ID NO: 4066193 - RNA, 23 nt, Staphylococcus aureus subsp. aureus N315
cuaaaugcacgagcaacaucuuu

SEQ ID NO: 4066194 - RNA, 15 nt, Staphylococcus aureus subsp. aureus N315
cuaaauuauuguuua

SEQ ID NO: 4066195 - RNA, 22 nt, Staphylococcus aureus subsp. aureus N315
cuaaauuauuuauucauuauag

SEQ ID NO: 4066196 - RNA, 18 nt, Staphylococcus aureus subsp. aureus N315
cuaaauucaauaaucuua

SEQ ID NO: 4066197 - RNA, 19 nt, Staphylococcus aureus subsp. aureus N315
cuaaauucaauaaucuuag

SEQ ID NO: 4066198 - RNA, 22 nt, Staphylococcus aureus subsp. aureus N315
cuaaauucaguucaaacagaaa

SEQ ID NO: 4066199 - RNA, 16 nt, Staphylococcus aureus subsp. aureus N315
cuaaauucuuuuuguu

SEQ ID NO: 4066200 - RNA, 14 nt, Staphylococcus aureus subsp. aureus N315
cuaaauuuacgaaa

SEQ ID NO: 4066201 - RNA, 15 nt, Staphylococcus aureus subsp. aureus N315
cuaaauuuacgaaag

SEQ ID NO: 4066202 - RNA, 13 nt, Staphylococcus aureus subsp. aureus N315
cuaaauuuauaua

SEQ ID NO: 4066203 - RNA, 21 nt, Staphylococcus aureus subsp. aureus N315
cuaaauuuauauagucuauga

SEQ ID NO: 4066204 - RNA, 18 nt, Staphylococcus aureus subsp. aureus N315
cuaaauuuucuaaaugug

SEQ ID NO: 4066205 - RNA, 21 nt, Staphylococcus aureus subsp. aureus N315
cuaacaauuugaggauacaua

SEQ ID NO: 4066206 - RNA, 18 nt, Staphylococcus aureus subsp. aureus N315
cuaacagcauuuccuaug

SEQ ID NO: 4066207 - RNA, 18 nt, Staphylococcus aureus subsp. aureus N315
cuaacagcuuaauuuuau

SEQ ID NO: 4066208 - RNA, 15 nt, Staphylococcus aureus subsp. aureus N315
cuaacaguuaauaug

SEQ ID NO: 4066209 - RNA, 14 nt, Staphylococcus aureus subsp. aureus N315
cuaacauaacugua

SEQ ID NO: 4066210 - RNA, 18 nt, Staphylococcus aureus subsp. aureus N315
cuaacauaauuuuuauuu

SEQ ID NO: 4066211 - RNA, 13 nt, Staphylococcus aureus subsp. aureus N315
cuaacauugguac

SEQ ID NO: 4066212 - RNA, 23 nt, Staphylococcus aureus subsp. aureus N315
cuaacauugguaccuuuuuauua

SEQ ID NO: 4066213 - RNA, 12 nt, Staphylococcus aureus subsp. aureus N315
cuaaccaaauaa

SEQ ID NO: 4066214 - RNA, 14 nt, Staphylococcus aureus subsp. aureus N315
cuaaccaaauaauu

SEQ ID NO: 4066215 - RNA, 15 nt, Staphylococcus aureus subsp. aureus N315
cuaaccacuucuuca

SEQ ID NO: 4066216 - RNA, 16 nt, Staphylococcus aureus subsp. aureus N315
cuaaccacuucuucac

SEQ ID NO: 4066217 - RNA, 19 nt, Staphylococcus aureus subsp. aureus N315
cuaaccaucauaaauguua

SEQ ID NO: 4066218 - RNA, 16 nt, Staphylococcus aureus subsp. aureus N315
cuaaccuauuaaaaua

SEQ ID NO: 4066219 - RNA, 22 nt, Staphylococcus aureus subsp. aureus N315
cuaaccuguuugagauauauua

SEQ ID NO: 4066220 - RNA, 15 nt, Staphylococcus aureus subsp. aureus N315
cuaaccuuuucauca

SEQ ID NO: 4066221 - RNA, 19 nt, Staphylococcus aureus subsp. aureus N315
cuaacggcguuuguuucuu

SEQ ID NO: 4066222 - RNA, 13 nt, Staphylococcus aureus subsp. aureus N315
cuaacguuuuaaa

SEQ ID NO: 4066223 - RNA, 22 nt, Staphylococcus aureus subsp. aureus N315
cuaacguuuuaaagguuaaaua

SEQ ID NO: 4066224 - RNA, 17 nt, Staphylococcus aureus subsp. aureus N315
cuaacuaaguauagugu

SEQ ID NO: 4066225 - RNA, 18 nt, Staphylococcus aureus subsp. aureus N315
cuaacuaaguauaguguu

SEQ ID NO: 4066226 - RNA, 12 nt, Staphylococcus aureus subsp. aureus N315
cuaacuauauug

SEQ ID NO: 4066227 - RNA, 14 nt, Staphylococcus aureus subsp. aureus N315
cuaacuauauugug

SEQ ID NO: 4066228 - RNA, 14 nt, Staphylococcus aureus subsp. aureus N315
cuaacucaccugca

SEQ ID NO: 4066229 - RNA, 12 nt, Staphylococcus aureus subsp. aureus N315
cuaagaaccuuu

SEQ ID NO: 4066230 - RNA, 12 nt, Staphylococcus aureus subsp. aureus N315
cuaagcagucug

SEQ ID NO: 4066231 - RNA, 21 nt, Staphylococcus aureus subsp. aureus N315
cuaagcaucguaaaaaacaaa

SEQ ID NO: 4066232 - RNA, 20 nt, Staphylococcus aureus subsp. aureus N315
cuaagcucguuaauuuuauu

SEQ ID NO: 4066233 - RNA, 18 nt, Staphylococcus aureus subsp. aureus N315
cuaaggacuuuaugcccu

SEQ ID NO: 4066234 - RNA, 15 nt, Staphylococcus aureus subsp. aureus N315
cuaaggcuaaugaua

SEQ ID NO: 4066235 - RNA, 22 nt, Staphylococcus aureus subsp. aureus N315
cuaagguaagaccccgaaaaga

SEQ ID NO: 4066236 - RNA, 18 nt, Staphylococcus aureus subsp. aureus N315
cuaagguuguucuauaca

SEQ ID NO: 4066237 - RNA, 17 nt, Staphylococcus aureus subsp. aureus N315
cuaaguaaccaagucua

SEQ ID NO: 4066238 - RNA, 19 nt, Staphylococcus aureus subsp. aureus N315
cuaagucuuuuaaaugaug

SEQ ID NO: 4066239 - RNA, 16 nt, Staphylococcus aureus subsp. aureus N315
cuaagugaauuaucua

SEQ ID NO: 4066240 - RNA, 13 nt, Staphylococcus aureus subsp. aureus N315
cuaaguguuuuau

SEQ ID NO: 4066241 - RNA, 14 nt, Staphylococcus aureus subsp. aureus N315
cuaaguuaaaaccu

SEQ ID NO: 4066242 - RNA, 15 nt, Staphylococcus aureus subsp. aureus N315
cuaaguuaauuuauc

SEQ ID NO: 4066243 - RNA, 16 nt, Staphylococcus aureus subsp. aureus N315
cuaaguuaauuuaucg

SEQ ID NO: 4066244 - RNA, 13 nt, Staphylococcus aureus subsp. aureus N315
cuaaguuugaauc

SEQ ID NO: 4066245 - RNA, 13 nt, Staphylococcus aureus subsp. aureus N315
cuaauacaaaaca

SEQ ID NO: 4066246 - RNA, 22 nt, Staphylococcus aureus subsp. aureus N315
cuaauacacuugauaaaacuaa

SEQ ID NO: 4066247 - RNA, 18 nt, Staphylococcus aureus subsp. aureus N315
cuaauacuuucacuuuuu

SEQ ID NO: 4066248 - RNA, 20 nt, Staphylococcus aureus subsp. aureus N315
cuacuuaauuaauaauuuaa

SEQ ID NO: 4066249 - RNA, 19 nt, Staphylococcus aureus subsp. aureus N315
cuacuuccuuacagacaaa

SEQ ID NO: 4066250 - RNA, 14 nt, Staphylococcus aureus subsp. aureus N315
cuacuuguucaaua

SEQ ID NO: 4066251 - RNA, 22 nt, Staphylococcus aureus subsp. aureus N315
cuacuuugaagggagcauuuca

SEQ ID NO: 4066252 - RNA, 19 nt, Staphylococcus aureus subsp. aureus N315
cuacuuugauauguuuccu

SEQ ID NO: 4066253 - RNA, 15 nt, Staphylococcus aureus subsp. aureus N315
cuacuuugucugcaa

SEQ ID NO: 4066254 - RNA, 23 nt, Staphylococcus aureus subsp. aureus N315
cuacuuugucugcaauuucauag

SEQ ID NO: 4066255 - RNA, 14 nt, Staphylococcus aureus subsp. aureus N315
cuagaaaacauaaa

SEQ ID NO: 4066256 - RNA, 18 nt, Staphylococcus aureus subsp. aureus N315
cuagaaagaccauuguau

SEQ ID NO: 4066257 - RNA, 16 nt, Staphylococcus aureus subsp. aureus N315
cuagaacauugauuau

SEQ ID NO: 4066258 - RNA, 12 nt, Staphylococcus aureus subsp. aureus N315
cuagaauauaac

SEQ ID NO: 4066259 - RNA, 17 nt, Staphylococcus aureus subsp. aureus N315
cuagaauauaacaacua

SEQ ID NO: 4066260 - RNA, 17 nt, Staphylococcus aureus subsp. aureus N315
cuagagauaacuagaau

SEQ ID NO: 4066261 - RNA, 18 nt, Staphylococcus aureus subsp. aureus N315
cuagauaccaaacugccu

SEQ ID NO: 4066262 - RNA, 15 nt, Staphylococcus aureus subsp. aureus N315
cuagauuuuaaauca

SEQ ID NO: 4066263 - RNA, 11 nt, Staphylococcus aureus subsp. aureus N315
cuagcaaaaau

SEQ ID NO: 4066264 - RNA, 17 nt, Staphylococcus aureus subsp. aureus N315
cuagcaaaaauacuuuu

SEQ ID NO: 4066265 - RNA, 21 nt, Staphylococcus aureus subsp. aureus N315
cuagcaaaaauacuuuuugau

SEQ ID NO: 4066266 - RNA, 19 nt, Staphylococcus aureus subsp. aureus N315
cuagcaagaauagauugau

SEQ ID NO: 4066267 - RNA, 14 nt, Staphylococcus aureus subsp. aureus N315
cuagcauaucuuua

SEQ ID NO: 4066268 - RNA, 22 nt, Staphylococcus aureus subsp. aureus N315
cuagcauguuuugagcaauaau

SEQ ID NO: 4066269 - RNA, 18 nt, Staphylococcus aureus subsp. aureus N315
cuagccguuauuuuuuug

SEQ ID NO: 4066270 - RNA, 22 nt, Staphylococcus aureus subsp. aureus N315
cuagcuaaugcacgugagaaac

SEQ ID NO: 4066271 - RNA, 18 nt, Staphylococcus aureus subsp. aureus N315
cuaggaauauaaaacugu

SEQ ID NO: 4066272 - RNA, 23 nt, Staphylococcus aureus subsp. aureus N315
cuaggauguucaucaacaugaua

SEQ ID NO: 4066273 - RNA, 17 nt, Staphylococcus aureus subsp. aureus N315
cuaggauuaaaagcauc

SEQ ID NO: 4066274 - RNA, 23 nt, Staphylococcus aureus subsp. aureus N315
cuaguaaaucaaagaugacuugg

SEQ ID NO: 4066275 - RNA, 23 nt, Staphylococcus aureus subsp. aureus N315
cuaguaacucaacauuuuuucua

SEQ ID NO: 4066276 - RNA, 16 nt, Staphylococcus aureus subsp. aureus N315
cuaguaauucuucauc

SEQ ID NO: 4066277 - RNA, 18 nt, Staphylococcus aureus subsp. aureus N315
cuaguagcuagaacagau

SEQ ID NO: 4066278 - RNA, 17 nt, Staphylococcus aureus subsp. aureus N315
cuagucaggggccccaa

SEQ ID NO: 4066279 - RNA, 18 nt, Staphylococcus aureus subsp. aureus N315
cuagucaggggccccaac

SEQ ID NO: 4066280 - RNA, 23 nt, Staphylococcus aureus subsp. aureus N315
cuagucaggggccccaacacaga

SEQ ID NO: 4066281 - RNA, 22 nt, Staphylococcus aureus subsp. aureus N315
cuagucuuuaacuuuaauuaaa

SEQ ID NO: 4066282 - RNA, 18 nt, Staphylococcus aureus subsp. aureus N315
cuagugcgcgauaaauaa

SEQ ID NO: 4066283 - RNA, 12 nt, Staphylococcus aureus subsp. aureus N315
cuaguucaacuc

SEQ ID NO: 4066284 - RNA, 14 nt, Staphylococcus aureus subsp. aureus N315
cuaguucagcuucu

SEQ ID NO: 4066285 - RNA, 18 nt, Staphylococcus aureus subsp. aureus N315
cuaguucagcuucuaagu

SEQ ID NO: 4066286 - RNA, 21 nt, Staphylococcus aureus subsp. aureus N315
cuaguuuaacaauacuacuua

SEQ ID NO: 4066287 - RNA, 16 nt, Staphylococcus aureus subsp. aureus N315
cuaguuuguaauaauu

SEQ ID NO: 4066288 - RNA, 20 nt, Staphylococcus aureus subsp. aureus N315
cuauaaaaauuuauucaaaa

SEQ ID NO: 4066289 - RNA, 19 nt, Staphylococcus aureus subsp. aureus N315
cuauaaaaguacuuuaaaa

SEQ ID NO: 4066290 - RNA, 23 nt, Staphylococcus aureus subsp. aureus N315
cuauaaaaguacuuuaaaauugu

SEQ ID NO: 4066291 - RNA, 23 nt, Staphylococcus aureus subsp. aureus N315
cuauaaaaucaucguauuucaua

SEQ ID NO: 4066292 - RNA, 14 nt, Staphylococcus aureus subsp. aureus N315
cuauaaaauucacc

SEQ ID NO: 4066293 - RNA, 16 nt, Staphylococcus aureus subsp. aureus N315
cuauaaaauucaccaa

SEQ ID NO: 4066294 - RNA, 15 nt, Staphylococcus aureus subsp. aureus N315
cuauaaaauuuugaa

SEQ ID NO: 4066295 - RNA, 17 nt, Staphylococcus aureus subsp. aureus N315
cuauaaauacuuuugca

SEQ ID NO: 4066296 - RNA, 20 nt, Staphylococcus aureus subsp. aureus N315
cuauaaauacuuuugcauca

SEQ ID NO: 4066297 - RNA, 14 nt, Staphylococcus aureus subsp. aureus N315
cuauaacaaaaucu

SEQ ID NO: 4066298 - RNA, 16 nt, Staphylococcus aureus subsp. aureus N315
cuauaacaaaaucuca

SEQ ID NO: 4066299 - RNA, 17 nt, Staphylococcus aureus subsp. aureus N315
cuauaacaaaaucucaa

SEQ ID NO: 4066300 - RNA, 18 nt, Staphylococcus aureus subsp. aureus N315
cuauaacucuaaauauaa

SEQ ID NO: 4066301 - RNA, 13 nt, Staphylococcus aureus subsp. aureus N315
cuauaauaauuaa

SEQ ID NO: 4066302 - RNA, 15 nt, Staphylococcus aureus subsp. aureus N315
cuauaauagcgucau

SEQ ID NO: 4066303 - RNA, 17 nt, Staphylococcus aureus subsp. aureus N315
cuauaauuucuuaauua

SEQ ID NO: 4066304 - RNA, 16 nt, Staphylococcus aureus subsp. aureus N315
cuauacaacaguaauc

SEQ ID NO: 4066305 - RNA, 18 nt, Staphylococcus aureus subsp. aureus N315
cuauacaacaguaaucau

SEQ ID NO: 4066306 - RNA, 16 nt, Staphylococcus aureus subsp. aureus N315
cuauacaaucauuuau

SEQ ID NO: 4066307 - RNA, 17 nt, Staphylococcus aureus subsp. aureus N315
cuauacaaucauuuaug

SEQ ID NO: 4066308 - RNA, 22 nt, Staphylococcus aureus subsp. aureus N315
cuauacaauuauggauaaaauu

SEQ ID NO: 4066309 - RNA, 18 nt, Staphylococcus aureus subsp. aureus N315
cuauacugaugaaaacuu

SEQ ID NO: 4066310 - RNA, 14 nt, Staphylococcus aureus subsp. aureus N315
cuauagaaaaagua

SEQ ID NO: 4066311 - RNA, 21 nt, Staphylococcus aureus subsp. aureus N315
cuauagauaggauauuuuuua

SEQ ID NO: 4066312 - RNA, 21 nt, Staphylococcus aureus subsp. aureus N315
cuauagccaaaggcaaaaugu

SEQ ID NO: 4066313 - RNA, 14 nt, Staphylococcus aureus subsp. aureus N315
cuauaguaagaaaa

SEQ ID NO: 4066314 - RNA, 13 nt, Staphylococcus aureus subsp. aureus N315
cuauauaaaaacu

SEQ ID NO: 4066315 - RNA, 14 nt, Staphylococcus aureus subsp. aureus N315
cuauauaaaguuga

SEQ ID NO: 4066316 - RNA, 13 nt, Staphylococcus aureus subsp. aureus N315
cuauauaauuuau

SEQ ID NO: 4066317 - RNA, 18 nt, Staphylococcus aureus subsp. aureus N315
cuauauaauuuauaaaaa

SEQ ID NO: 4066318 - RNA, 13 nt, Staphylococcus aureus subsp. aureus N315
cuauauaguaaaa

SEQ ID NO: 4066319 - RNA, 14 nt, Staphylococcus aureus subsp. aureus N315
cuauauaguaaaau

SEQ ID NO: 4066320 - RNA, 18 nt, Staphylococcus aureus subsp. aureus N315
cuauauauauaugcaucc

SEQ ID NO: 4066321 - RNA, 20 nt, Staphylococcus aureus subsp. aureus N315
cuauauaugaauugaguauu

SEQ ID NO: 4066322 - RNA, 16 nt, Staphylococcus aureus subsp. aureus N315
cuauauucaauuuaau

SEQ ID NO: 4066323 - RNA, 17 nt, Staphylococcus aureus subsp. aureus N315
cuauauugugcuaaguu

SEQ ID NO: 4066324 - RNA, 24 nt, Staphylococcus aureus subsp. aureus N315
cuauauuugauauaguuauaugug

SEQ ID NO: 4066325 - RNA, 23 nt, Staphylococcus aureus subsp. aureus N315
cuauauuuuuagcuuuauuauuu

SEQ ID NO: 4066326 - RNA, 18 nt, Staphylococcus aureus subsp. aureus N315
cuauauuuuuguauuuau

SEQ ID NO: 4066327 - RNA, 13 nt, Staphylococcus aureus subsp. aureus N315
cuaucaauauaau

SEQ ID NO: 4066328 - RNA, 14 nt, Staphylococcus aureus subsp. aureus N315
cuaucaaugacauc

SEQ ID NO: 4066329 - RNA, 17 nt, Staphylococcus aureus subsp. aureus N315
cuaucaaugacauccau

SEQ ID NO: 4066330 - RNA, 23 nt, Staphylococcus aureus subsp. aureus N315
cuauccaaagacauacagucaau

SEQ ID NO: 4066331 - RNA, 16 nt, Staphylococcus aureus subsp. aureus N315
cuauccgauuuaaguu

SEQ ID NO: 4066332 - RNA, 15 nt, Staphylococcus aureus subsp. aureus N315
cuauccuucaaaagu

SEQ ID NO: 4066333 - RNA, 15 nt, Staphylococcus aureus subsp. aureus N315
cuaucgauacuaaac

SEQ ID NO: 4066334 - RNA, 17 nt, Staphylococcus aureus subsp. aureus N315
cuaucgccuaaaaauaa

SEQ ID NO: 4066335 - RNA, 20 nt, Staphylococcus aureus subsp. aureus N315
cucauuccaggaaggaaugu

SEQ ID NO: 4066336 - RNA, 17 nt, Staphylococcus aureus subsp. aureus N315
cucauuuagcucuacua

SEQ ID NO: 4066337 - RNA, 16 nt, Staphylococcus aureus subsp. aureus N315
cucauuucaauauuaa

SEQ ID NO: 4066338 - RNA, 21 nt, Staphylococcus aureus subsp. aureus N315
cucauuuguauagauuguauu

SEQ ID NO: 4066339 - RNA, 20 nt, Staphylococcus aureus subsp. aureus N315
cucauuuuuauaaauuuugg

SEQ ID NO: 4066340 - RNA, 20 nt, Staphylococcus aureus subsp. aureus N315
cuccaagauuaugacaacau

SEQ ID NO: 4066341 - RNA, 14 nt, Staphylococcus aureus subsp. aureus N315
cuccaauacuuuuu

SEQ ID NO: 4066342 - RNA, 19 nt, Staphylococcus aureus subsp. aureus N315
cuccaauacuuuuuauaua

SEQ ID NO: 4066343 - RNA, 15 nt, Staphylococcus aureus subsp. aureus N315
cuccaaucaucauua

SEQ ID NO: 4066344 - RNA, 16 nt, Staphylococcus aureus subsp. aureus N315
cuccaguggaaaugau

SEQ ID NO: 4066345 - RNA, 18 nt, Staphylococcus aureus subsp. aureus N315
cuccaguggaaaugauaa

SEQ ID NO: 4066346 - RNA, 23 nt, Staphylococcus aureus subsp. aureus N315
cuccaguggaaaugauaauuuaa

SEQ ID NO: 4066347 - RNA, 14 nt, Staphylococcus aureus subsp. aureus N315
cuccccaacuuaau

SEQ ID NO: 4066348 - RNA, 18 nt, Staphylococcus aureus subsp. aureus N315
cucccuuaaauacaauuu

SEQ ID NO: 4066349 - RNA, 22 nt, Staphylococcus aureus subsp. aureus N315
cucccuuaaauacaauuucuuc

SEQ ID NO: 4066350 - RNA, 18 nt, Staphylococcus aureus subsp. aureus N315
cucccuucaaaguuuuca

SEQ ID NO: 4066351 - RNA, 15 nt, Staphylococcus aureus subsp. aureus N315
cucccuuuuaucuuu

SEQ ID NO: 4066352 - RNA, 15 nt, Staphylococcus aureus subsp. aureus N315
cuccguugaauucaa

SEQ ID NO: 4066353 - RNA, 17 nt, Staphylococcus aureus subsp. aureus N315
cuccuaaagcugcaauu

SEQ ID NO: 4066354 - RNA, 22 nt, Staphylococcus aureus subsp. aureus N315
cuccuaaagguaacuuuuuaac

SEQ ID NO: 4066355 - RNA, 16 nt, Staphylococcus aureus subsp. aureus N315
cuccuaaauuauuguu

SEQ ID NO: 4066356 - RNA, 23 nt, Staphylococcus aureus subsp. aureus N315
cuccuaaauuauuguuuaugcca

SEQ ID NO: 4066357 - RNA, 18 nt, Staphylococcus aureus subsp. aureus N315
cuccucaaaagcuguagu

SEQ ID NO: 4066358 - RNA, 23 nt, Staphylococcus aureus subsp. aureus N315
cuccucuauuuuaugauuugauu

SEQ ID NO: 4066359 - RNA, 20 nt, Staphylococcus aureus subsp. aureus N315
cuccucuuuuauuuaugagu

SEQ ID NO: 4066360 - RNA, 13 nt, Staphylococcus aureus subsp. aureus N315
cuccuuacaauaa

SEQ ID NO: 4066361 - RNA, 20 nt, Staphylococcus aureus subsp. aureus N315
cuccuucaauguucaauuca

SEQ ID NO: 4066362 - RNA, 14 nt, Staphylococcus aureus subsp. aureus N315
cucgaccuuuauau

SEQ ID NO: 4066363 - RNA, 20 nt, Staphylococcus aureus subsp. aureus N315
cucgauuagaucacaguaca

SEQ ID NO: 4066364 - RNA, 18 nt, Staphylococcus aureus subsp. aureus N315
cucgauuuuuuuauauuu

SEQ ID NO: 4066365 - RNA, 12 nt, Staphylococcus aureus subsp. aureus N315
cucgguuuuuuc

SEQ ID NO: 4066366 - RNA, 14 nt, Staphylococcus aureus subsp. aureus N315
cucgugaaaagcag

SEQ ID NO: 4066367 - RNA, 13 nt, Staphylococcus aureus subsp. aureus N315
cucguuaauuuua

SEQ ID NO: 4066368 - RNA, 17 nt, Staphylococcus aureus subsp. aureus N315
cucuaaaagccaucuua

SEQ ID NO: 4066369 - RNA, 22 nt, Staphylococcus aureus subsp. aureus N315
cucuaaacuucuauuaauaauu

SEQ ID NO: 4066370 - RNA, 12 nt, Staphylococcus aureus subsp. aureus N315
cucuaaauaaaa

SEQ ID NO: 4066371 - RNA, 16 nt, Staphylococcus aureus subsp. aureus N315
cucuaaauaaaauuaa

SEQ ID NO: 4066372 - RNA, 12 nt, Staphylococcus aureus subsp. aureus N315
cucuaacauuuu

SEQ ID NO: 4066373 - RNA, 13 nt, Staphylococcus aureus subsp. aureus N315
cucuaacauuuuc

SEQ ID NO: 4066374 - RNA, 14 nt, Staphylococcus aureus subsp. aureus N315
cucuaacauuuucu

SEQ ID NO: 4066375 - RNA, 22 nt, Staphylococcus aureus subsp. aureus N315
cucuaacgguauaucauccaca

SEQ ID NO: 4066376 - RNA, 18 nt, Staphylococcus aureus subsp. aureus N315
cucuaacuuuaccaauau

SEQ ID NO: 4066377 - RNA, 20 nt, Staphylococcus aureus subsp. aureus N315
cucuaacuuuaccaauauca

SEQ ID NO: 4066378 - RNA, 14 nt, Staphylococcus aureus subsp. aureus N315
cucuaagguuaaau

SEQ ID NO: 4066379 - RNA, 16 nt, Staphylococcus aureus subsp. aureus N315
cucuaauccaaaauaa

SEQ ID NO: 4066380 - RNA, 13 nt, Staphylococcus aureus subsp. aureus N315
cucuaauuucaca

SEQ ID NO: 4066381 - RNA, 17 nt, Staphylococcus aureus subsp. aureus N315
cucuaccaguucaacau

SEQ ID NO: 4066382 - RNA, 15 nt, Staphylococcus aureus subsp. aureus N315
cucuagugcuuuguc

SEQ ID NO: 4066383 - RNA, 19 nt, Staphylococcus aureus subsp. aureus N315
cucuauauauccauucaau

SEQ ID NO: 4066384 - RNA, 17 nt, Staphylococcus aureus subsp. aureus N315
cucuaucaguccgcuuu

SEQ ID NO: 4066385 - RNA, 19 nt, Staphylococcus aureus subsp. aureus N315
cucuauuuacggcauaauu

SEQ ID NO: 4066386 - RNA, 15 nt, Staphylococcus aureus subsp. aureus N315
cucuauuuuaugauu

SEQ ID NO: 4066387 - RNA, 20 nt, Staphylococcus aureus subsp. aureus N315
cucuauuuuaugauuugauu

SEQ ID NO: 4066388 - RNA, 17 nt, Staphylococcus aureus subsp. aureus N315
cucuccuuuuuuaaaga

SEQ ID NO: 4066389 - RNA, 15 nt, Staphylococcus aureus subsp. aureus N315
cucugaaaaacuucu

SEQ ID NO: 4066390 - RNA, 17 nt, Staphylococcus aureus subsp. aureus N315
cucugaaaaacuucuua

SEQ ID NO: 4066391 - RNA, 19 nt, Staphylococcus aureus subsp. aureus N315
cucugaaaagccuacuuug

SEQ ID NO: 4066392 - RNA, 14 nt, Staphylococcus aureus subsp. aureus N315
cucugauauugauc

SEQ ID NO: 4066393 - RNA, 17 nt, Staphylococcus aureus subsp. aureus N315
cucugauauugaucuga

SEQ ID NO: 4066394 - RNA, 23 nt, Staphylococcus aureus subsp. aureus N315
cucugauuacauauacgacauuu

SEQ ID NO: 4066395 - RNA, 15 nt, Staphylococcus aureus subsp. aureus N315
cucuggaacuuuaau

SEQ ID NO: 4066396 - RNA, 15 nt, Staphylococcus aureus subsp. aureus N315
cucuggauuuuucuu

SEQ ID NO: 4066397 - RNA, 22 nt, Staphylococcus aureus subsp. aureus N315
cucuggauuuuucuuauaaaaa

SEQ ID NO: 4066398 - RNA, 14 nt, Staphylococcus aureus subsp. aureus N315
cucuuaaauaugaa

SEQ ID NO: 4066399 - RNA, 21 nt, Staphylococcus aureus subsp. aureus N315
cucuuauaaagacaccuucaa

SEQ ID NO: 4066400 - RNA, 22 nt, Staphylococcus aureus subsp. aureus N315
cucuuauaaagacaccuucaau

SEQ ID NO: 4066401 - RNA, 11 nt, Staphylococcus aureus subsp. aureus N315
cucuucaaucu

SEQ ID NO: 4066402 - RNA, 19 nt, Staphylococcus aureus subsp. aureus N315
cucuuccuccgccaucaau

SEQ ID NO: 4066403 - RNA, 16 nt, Staphylococcus aureus subsp. aureus N315
cucuugauaaaauaaa

SEQ ID NO: 4066404 - RNA, 14 nt, Staphylococcus aureus subsp. aureus N315
cucuugcaauagca

SEQ ID NO: 4066405 - RNA, 22 nt, Staphylococcus aureus subsp. aureus N315
cucuuuaaacucguaaauuuua

SEQ ID NO: 4066406 - RNA, 20 nt, Staphylococcus aureus subsp. aureus N315
cucuuuaaagcuaaauguua

SEQ ID NO: 4066407 - RNA, 17 nt, Staphylococcus aureus subsp. aureus N315
cucuuuacaccauugca

SEQ ID NO: 4066408 - RNA, 23 nt, Staphylococcus aureus subsp. aureus N315
cucuuugaagggguuuuuucuua

SEQ ID NO: 4066409 - RNA, 23 nt, Staphylococcus aureus subsp. aureus N315
cucuuuguuggggcccacacccc

SEQ ID NO: 4066410 - RNA, 20 nt, Staphylococcus aureus subsp. aureus N315
cucuuuucacgaauaucuua

SEQ ID NO: 4066411 - RNA, 13 nt, Staphylococcus aureus subsp. aureus N315
cugaaaaaauuaa

SEQ ID NO: 4066412 - RNA, 13 nt, Staphylococcus aureus subsp. aureus N315
cugaaaaacuucu

SEQ ID NO: 4066413 - RNA, 16 nt, Staphylococcus aureus subsp. aureus N315
cugaaaagccuacuuu

SEQ ID NO: 4066414 - RNA, 15 nt, Staphylococcus aureus subsp. aureus N315
cugaaacaaauuagu

SEQ ID NO: 4066415 - RNA, 20 nt, Staphylococcus aureus subsp. aureus N315
cugaaacgccucaacacuuu

SEQ ID NO: 4066416 - RNA, 15 nt, Staphylococcus aureus subsp. aureus N315
cugaaacuaaauuaa

SEQ ID NO: 4066417 - RNA, 18 nt, Staphylococcus aureus subsp. aureus N315
cugaaaucaguuuuugaa

SEQ ID NO: 4066418 - RNA, 12 nt, Staphylococcus aureus subsp. aureus N315
cugaaauuuuuu

SEQ ID NO: 4066419 - RNA, 15 nt, Staphylococcus aureus subsp. aureus N315
cugaaauuuuuuagu

SEQ ID NO: 4066420 - RNA, 21 nt, Staphylococcus aureus subsp. aureus N315
cugaauaaauaacuucguuuu

SEQ ID NO: 4066421 - RNA, 18 nt, Staphylococcus aureus subsp. aureus N315
cugaaugugguacaagau

SEQ ID NO: 4066422 - RNA, 19 nt, Staphylococcus aureus subsp. aureus N315
cugaauuaauauccaaaau

SEQ ID NO: 4066423 - RNA, 12 nt, Staphylococcus aureus subsp. aureus N315
cugucccaagcu

SEQ ID NO: 4066424 - RNA, 15 nt, Staphylococcus aureus subsp. aureus N315
cugucgcucauccuc

SEQ ID NO: 4066425 - RNA, 16 nt, Staphylococcus aureus subsp. aureus N315
cugucuaaaaacauaa

SEQ ID NO: 4066426 - RNA, 16 nt, Staphylococcus aureus subsp. aureus N315
cugucucauuaaugua

SEQ ID NO: 4066427 - RNA, 15 nt, Staphylococcus aureus subsp. aureus N315
cugugauaaaaaucu

SEQ ID NO: 4066428 - RNA, 17 nt, Staphylococcus aureus subsp. aureus N315
cugugauucauucguac

SEQ ID NO: 4066429 - RNA, 22 nt, Staphylococcus aureus subsp. aureus N315
cugugcaugacgauaaugaaau

SEQ ID NO: 4066430 - RNA, 17 nt, Staphylococcus aureus subsp. aureus N315
cuguguaaaauaaauca

SEQ ID NO: 4066431 - RNA, 18 nt, Staphylococcus aureus subsp. aureus N315
cuguguaaaauaaaucau

SEQ ID NO: 4066432 - RNA, 21 nt, Staphylococcus aureus subsp. aureus N315
cuguguaaauauaaauaugaa

SEQ ID NO: 4066433 - RNA, 15 nt, Staphylococcus aureus subsp. aureus N315
cugugucagcauuca

SEQ ID NO: 4066434 - RNA, 14 nt, Staphylococcus aureus subsp. aureus N315
cugugugcuguucu

SEQ ID NO: 4066435 - RNA, 21 nt, Staphylococcus aureus subsp. aureus N315
cuguguuggggcccacacccc

SEQ ID NO: 4066436 - RNA, 22 nt, Staphylococcus aureus subsp. aureus N315
cuguguuggggcccacacccca

SEQ ID NO: 4066437 - RNA, 22 nt, Staphylococcus aureus subsp. aureus N315
cuguuaaacgcugauuuuauaa

SEQ ID NO: 4066438 - RNA, 22 nt, Staphylococcus aureus subsp. aureus N315
cuguuaaacucauacaaauuuu

SEQ ID NO: 4066439 - RNA, 23 nt, Staphylococcus aureus subsp. aureus N315
cuguuaugaaguauccuuauuug

SEQ ID NO: 4066440 - RNA, 13 nt, Staphylococcus aureus subsp. aureus N315
cuguucuauucca

SEQ ID NO: 4066441 - RNA, 16 nt, Staphylococcus aureus subsp. aureus N315
cuguugcauuaagugc

SEQ ID NO: 4066442 - RNA, 16 nt, Staphylococcus aureus subsp. aureus N315
cuguuggcaaaacaau

SEQ ID NO: 4066443 - RNA, 21 nt, Staphylococcus aureus subsp. aureus N315
cuguugguuugaucauuugac

SEQ ID NO: 4066444 - RNA, 20 nt, Staphylococcus aureus subsp. aureus N315
cuguuuaaauuuaaaagaaa

SEQ ID NO: 4066445 - RNA, 16 nt, Staphylococcus aureus subsp. aureus N315
cuguuuauauaaguga

SEQ ID NO: 4066446 - RNA, 13 nt, Staphylococcus aureus subsp. aureus N315
cuguuuuuuuaug

SEQ ID NO: 4066447 - RNA, 11 nt, Staphylococcus aureus subsp. aureus N315
cuuaaaaacaa

SEQ ID NO: 4066448 - RNA, 12 nt, Staphylococcus aureus subsp. aureus N315
cuuaaaaacaau

SEQ ID NO: 4066449 - RNA, 16 nt, Staphylococcus aureus subsp. aureus N315
cuuaaaaacaauauug

SEQ ID NO: 4066450 - RNA, 19 nt, Staphylococcus aureus subsp. aureus N315
cuuaaaaacgcuuuuaaac

SEQ ID NO: 4066451 - RNA, 17 nt, Staphylococcus aureus subsp. aureus N315
cuuaaaagacauccaca

SEQ ID NO: 4066452 - RNA, 18 nt, Staphylococcus aureus subsp. aureus N315
cuuaaaauaugauuuaaa

SEQ ID NO: 4066453 - RNA, 16 nt, Staphylococcus aureus subsp. aureus N315
cuuaaaauugaauauc

SEQ ID NO: 4066454 - RNA, 14 nt, Staphylococcus aureus subsp. aureus N315
cuuaaaauuuaaau

SEQ ID NO: 4066455 - RNA, 18 nt, Staphylococcus aureus subsp. aureus N315
cuuaaaccuaacauaacu

SEQ ID NO: 4066456 - RNA, 16 nt, Staphylococcus aureus subsp. aureus N315
cuuaaagaauuaagua

SEQ ID NO: 4066457 - RNA, 21 nt, Staphylococcus aureus subsp. aureus N315
cuuaaauacaauuucuucauu

SEQ ID NO: 4066458 - RNA, 23 nt, Staphylococcus aureus subsp. aureus N315
cuuaaauacaauuucuucauuuu

SEQ ID NO: 4066459 - RNA, 16 nt, Staphylococcus aureus subsp. aureus N315
cuuaaauagugcuuuu

SEQ ID NO: 4066460 - RNA, 18 nt, Staphylococcus aureus subsp. aureus N315
cuuaaauagugcuuuuuc

SEQ ID NO: 4066461 - RNA, 15 nt, Staphylococcus aureus subsp. aureus N315
cuuaaauauaaugau

SEQ ID NO: 4066462 - RNA, 15 nt, Staphylococcus aureus subsp. aureus N315
cuuaaauuacuuaau

SEQ ID NO: 4066463 - RNA, 20 nt, Staphylococcus aureus subsp. aureus N315
cuuaacaacaugauuucuuc

SEQ ID NO: 4066464 - RNA, 14 nt, Staphylococcus aureus subsp. aureus N315
cuuaacauaaaaug

SEQ ID NO: 4066465 - RNA, 18 nt, Staphylococcus aureus subsp. aureus N315
cuuaaccauuuaaaaauu

SEQ ID NO: 4066466 - RNA, 16 nt, Staphylococcus aureus subsp. aureus N315
cuuaacguugcagaga

SEQ ID NO: 4066467 - RNA, 13 nt, Staphylococcus aureus subsp. aureus N315
cuuaacuugaaau

SEQ ID NO: 4066468 - RNA, 18 nt, Staphylococcus aureus subsp. aureus N315
cuuaagaaauuuuuucua

SEQ ID NO: 4066469 - RNA, 23 nt, Staphylococcus aureus subsp. aureus N315
cuuaagcucauuucaauauuaaa

SEQ ID NO: 4066470 - RNA, 17 nt, Staphylococcus aureus subsp. aureus N315
cuuaauaagcugaaaua

SEQ ID NO: 4066471 - RNA, 22 nt, Staphylococcus aureus subsp. aureus N315
cuuaauaauuaauaagcauuaa

SEQ ID NO: 4066472 - RNA, 20 nt, Staphylococcus aureus subsp. aureus N315
cuuaauacgauaauaacuag

SEQ ID NO: 4066473 - RNA, 14 nt, Staphylococcus aureus subsp. aureus N315
cuuaauaguaacau

SEQ ID NO: 4066474 - RNA, 18 nt, Staphylococcus aureus subsp. aureus N315
cuuaauaucauauucaaa

SEQ ID NO: 4066475 - RNA, 18 nt, Staphylococcus aureus subsp. aureus N315
cuuaauauugaauauaaa

SEQ ID NO: 4066476 - RNA, 22 nt, Staphylococcus aureus subsp. aureus N315
cuuaauauugaauauaaaaaac

SEQ ID NO: 4066477 - RNA, 17 nt, Staphylococcus aureus subsp. aureus N315
cuuaaucgcucuaaaua

SEQ ID NO: 4066478 - RNA, 21 nt, Staphylococcus aureus subsp. aureus N315
cuuaaugacuucuuuauauuu

SEQ ID NO: 4066479 - RNA, 14 nt, Staphylococcus aureus subsp. aureus N315
cuuaaugcuucaaa

SEQ ID NO: 4066480 - RNA, 15 nt, Staphylococcus aureus subsp. aureus N315
cuuaaugcuucaaau

SEQ ID NO: 4066481 - RNA, 14 nt, Staphylococcus aureus subsp. aureus N315
cuuaauuaauaauu

SEQ ID NO: 4066482 - RNA, 19 nt, Staphylococcus aureus subsp. aureus N315
cuuaauuaauaauuuaacu

SEQ ID NO: 4066483 - RNA, 18 nt, Staphylococcus aureus subsp. aureus N315
cuuaauucuucaucaaua

SEQ ID NO: 4066484 - RNA, 21 nt, Staphylococcus aureus subsp. aureus N315
cuuaauucuucaucaauaacu

SEQ ID NO: 4066485 - RNA, 13 nt, Staphylococcus aureus subsp. aureus N315
cuuaauuuaaauc

SEQ ID NO: 4066486 - RNA, 14 nt, Staphylococcus aureus subsp. aureus N315
cuuaauuuaaaucu

SEQ ID NO: 4066487 - RNA, 23 nt, Staphylococcus aureus subsp. aureus N315
cuuaauuuaaaucuguacuucua

SEQ ID NO: 4066488 - RNA, 15 nt, Staphylococcus aureus subsp. aureus N315
cuuaauuuguuuuaa

SEQ ID NO: 4066489 - RNA, 17 nt, Staphylococcus aureus subsp. aureus N315
cuuaauuuguuuuaaau

SEQ ID NO: 4066490 - RNA, 14 nt, Staphylococcus aureus subsp. aureus N315
cuuacaauaaagac

SEQ ID NO: 4066491 - RNA, 15 nt, Staphylococcus aureus subsp. aureus N315
cuuacaauaaagaca

SEQ ID NO: 4066492 - RNA, 16 nt, Staphylococcus aureus subsp. aureus N315
cuuacagacaaacauu

SEQ ID NO: 4066493 - RNA, 17 nt, Staphylococcus aureus subsp. aureus N315
cuuacauaggauaucua

SEQ ID NO: 4066494 - RNA, 16 nt, Staphylococcus aureus subsp. aureus N315
cuuacauuacauauau

SEQ ID NO: 4066495 - RNA, 18 nt, Staphylococcus aureus subsp. aureus N315
cuuacauugauaaaauaa

SEQ ID NO: 4066496 - RNA, 19 nt, Staphylococcus aureus subsp. aureus N315
cuuacauuuuaauaaaauc

SEQ ID NO: 4066497 - RNA, 17 nt, Staphylococcus aureus subsp. aureus N315
cuuacccaaaaaauugu

SEQ ID NO: 4066498 - RNA, 21 nt, Staphylococcus aureus subsp. aureus N315
cuuaccuuuauguucaaaugu

SEQ ID NO: 4066499 - RNA, 18 nt, Staphylococcus aureus subsp. aureus N315
cuuacuacgcauuauuaa

SEQ ID NO: 4066500 - RNA, 15 nt, Staphylococcus aureus subsp. aureus N315
cuuacuacuuaauua

SEQ ID NO: 4066501 - RNA, 16 nt, Staphylococcus aureus subsp. aureus N315
cuuacuacuuaauuaa

SEQ ID NO: 4066502 - RNA, 15 nt, Staphylococcus aureus subsp. aureus N315
cuuacucauuuuucu

SEQ ID NO: 4066503 - RNA, 16 nt, Staphylococcus aureus subsp. aureus N315
cuuacugaaacuaaau

SEQ ID NO: 4066504 - RNA, 16 nt, Staphylococcus aureus subsp. aureus N315
cuuacugcaauuauuu

SEQ ID NO: 4066505 - RNA, 22 nt, Staphylococcus aureus subsp. aureus N315
cuuacugcuguuuuuagguuau

SEQ ID NO: 4066506 - RNA, 15 nt, Staphylococcus aureus subsp. aureus N315
cuuacuuuuaaauua

SEQ ID NO: 4066507 - RNA, 14 nt, Staphylococcus aureus subsp. aureus N315
cuuagaauuuacaa

SEQ ID NO: 4066508 - RNA, 14 nt, Staphylococcus aureus subsp. aureus N315
cuuagauaaauuaa

SEQ ID NO: 4066509 - RNA, 19 nt, Staphylococcus aureus subsp. aureus N315
cuuagauaaauuaauauga

SEQ ID NO: 4066510 - RNA, 16 nt, Staphylococcus aureus subsp. aureus N315
cuuagcaaucucuuua

SEQ ID NO: 4066511 - RNA, 19 nt, Staphylococcus aureus subsp. aureus N315
cuuccucucguaaauuguu

SEQ ID NO: 4066512 - RNA, 22 nt, Staphylococcus aureus subsp. aureus N315
cuuccuuacagacaaacauuac

SEQ ID NO: 4066513 - RNA, 23 nt, Staphylococcus aureus subsp. aureus N315
cuuccuuuuuuuaugucuuuuuu

SEQ ID NO: 4066514 - RNA, 15 nt, Staphylococcus aureus subsp. aureus N315
cuucgcacaacugca

SEQ ID NO: 4066515 - RNA, 18 nt, Staphylococcus aureus subsp. aureus N315
cuucgcuaauaucaucuu

SEQ ID NO: 4066516 - RNA, 19 nt, Staphylococcus aureus subsp. aureus N315
cuucgucaaugacuaagau

SEQ ID NO: 4066517 - RNA, 23 nt, Staphylococcus aureus subsp. aureus N315
cuucgucgcuaagaaccuuucuu

SEQ ID NO: 4066518 - RNA, 12 nt, Staphylococcus aureus subsp. aureus N315
cuucguuuuaau

SEQ ID NO: 4066519 - RNA, 22 nt, Staphylococcus aureus subsp. aureus N315
cuucguuuuuaguguuaauuga

SEQ ID NO: 4066520 - RNA, 19 nt, Staphylococcus aureus subsp. aureus N315
cuucuaaaacuaaagguau

SEQ ID NO: 4066521 - RNA, 13 nt, Staphylococcus aureus subsp. aureus N315
cuucuaaaucaau

SEQ ID NO: 4066522 - RNA, 17 nt, Staphylococcus aureus subsp. aureus N315
cuucuaacucaccugca

SEQ ID NO: 4066523 - RNA, 14 nt, Staphylococcus aureus subsp. aureus N315
cuucuaacugaauu

SEQ ID NO: 4066524 - RNA, 15 nt, Staphylococcus aureus subsp. aureus N315
cuucuaaguaauaua

SEQ ID NO: 4066525 - RNA, 17 nt, Staphylococcus aureus subsp. aureus N315
cuucuaaucguuaauaa

SEQ ID NO: 4066526 - RNA, 21 nt, Staphylococcus aureus subsp. aureus N315
cuucuaauuugcaaaaucaac

SEQ ID NO: 4066527 - RNA, 21 nt, Staphylococcus aureus subsp. aureus N315
cuucuacccauaauuuaaaug

SEQ ID NO: 4066528 - RNA, 13 nt, Staphylococcus aureus subsp. aureus N315
cuucuauauuaau

SEQ ID NO: 4066529 - RNA, 14 nt, Staphylococcus aureus subsp. aureus N315
cuucuaucucuuua

SEQ ID NO: 4066530 - RNA, 19 nt, Staphylococcus aureus subsp. aureus N315
cuucuaucuucacacuuuu

SEQ ID NO: 4066531 - RNA, 14 nt, Staphylococcus aureus subsp. aureus N315
cuucuaucuuuauu

SEQ ID NO: 4066532 - RNA, 16 nt, Staphylococcus aureus subsp. aureus N315
cuucuauuaauaauuu

SEQ ID NO: 4066533 - RNA, 16 nt, Staphylococcus aureus subsp. aureus N315
cuucuauuuuauaaua

SEQ ID NO: 4066534 - RNA, 17 nt, Staphylococcus aureus subsp. aureus N315
cuucuauuuuauaauaa

SEQ ID NO: 4066535 - RNA, 22 nt, Staphylococcus aureus subsp. aureus N315
cuucucaauuuaguauaaauaa

SEQ ID NO: 4066536 - RNA, 13 nt, Staphylococcus aureus subsp. aureus N315
cuucucaucauuu

SEQ ID NO: 4066537 - RNA, 18 nt, Staphylococcus aureus subsp. aureus N315
cuucucaucauuuucaau

SEQ ID NO: 4066538 - RNA, 20 nt, Staphylococcus aureus subsp. aureus N315
cuucucaucgaauucauuug

SEQ ID NO: 4066539 - RNA, 15 nt, Staphylococcus aureus subsp. aureus N315
cuucucauugaaauc

SEQ ID NO: 4066540 - RNA, 18 nt, Staphylococcus aureus subsp. aureus N315
cuucucccuuaaauacaa

SEQ ID NO: 4066541 - RNA, 23 nt, Staphylococcus aureus subsp. aureus N315
cuucuccguauuuaccuucuucu

SEQ ID NO: 4066542 - RNA, 12 nt, Staphylococcus aureus subsp. aureus N315
cuucucuaucag

SEQ ID NO: 4066543 - RNA, 17 nt, Staphylococcus aureus subsp. aureus N315
cuucugcuacuuguugu

SEQ ID NO: 4066544 - RNA, 20 nt, Staphylococcus aureus subsp. aureus N315
cuucuggauagguaucacua

SEQ ID NO: 4066545 - RNA, 18 nt, Staphylococcus aureus subsp. aureus N315
cuucuguguuggggccca

SEQ ID NO: 4066546 - RNA, 14 nt, Staphylococcus aureus subsp. aureus N315
cuucuguuuauaua

SEQ ID NO: 4066547 - RNA, 21 nt, Staphylococcus aureus subsp. aureus N315
cuucuuaaaauaugauuuaaa

SEQ ID NO: 4066548 - RNA, 20 nt, Staphylococcus aureus subsp. aureus N315
cuucuuaacuugaaauguug

SEQ ID NO: 4066549 - RNA, 13 nt, Staphylococcus aureus subsp. aureus N315
cuucuuacugcaa

SEQ ID NO: 4066550 - RNA, 16 nt, Staphylococcus aureus subsp. aureus N315
cuucuuacugcaauua

SEQ ID NO: 4066551 - RNA, 22 nt, Staphylococcus aureus subsp. aureus N315
cuucuucuaaccacuucuucac

SEQ ID NO: 4066552 - RNA, 22 nt, Staphylococcus aureus subsp. aureus N315
cuucuugagguuuugguucuga

SEQ ID NO: 4066553 - RNA, 13 nt, Staphylococcus aureus subsp. aureus N315
cuucuuguuuuaa

SEQ ID NO: 4066554 - RNA, 16 nt, Staphylococcus aureus subsp. aureus N315
cuucuuugaaaucaau

SEQ ID NO: 4066555 - RNA, 22 nt, Staphylococcus aureus subsp. aureus N315
cuucuuuguuuuuaauuuuuaa

SEQ ID NO: 4066556 - RNA, 13 nt, Staphylococcus aureus subsp. aureus N315
cuucuuuucuuug

SEQ ID NO: 4066557 - RNA, 18 nt, Staphylococcus aureus subsp. aureus N315
cuucuuuuucuugcauac

SEQ ID NO: 4066558 - RNA, 20 nt, Staphylococcus aureus subsp. aureus N315
cuucuuuuuguccccagccc

SEQ ID NO: 4066559 - RNA, 17 nt, Staphylococcus aureus subsp. aureus N315
cuucuuuuuuaucuaca

SEQ ID NO: 4066560 - RNA, 16 nt, Staphylococcus aureus subsp. aureus N315
cuucuuuuuuuaacuu

SEQ ID NO: 4066561 - RNA, 22 nt, Staphylococcus aureus subsp. aureus N315
cuugaaaauagccauauucaua

SEQ ID NO: 4066562 - RNA, 22 nt, Staphylococcus aureus subsp. aureus N315
cuugaaacaucuugauauucau

SEQ ID NO: 4066563 - RNA, 17 nt, Staphylococcus aureus subsp. aureus N315
cuugaaauuauuauuua

SEQ ID NO: 4066564 - RNA, 16 nt, Staphylococcus aureus subsp. aureus N315
cuugaaccccauucac

SEQ ID NO: 4066565 - RNA, 23 nt, Staphylococcus aureus subsp. aureus N315
cuugaagaaaaguauaaauauaa

SEQ ID NO: 4066566 - RNA, 16 nt, Staphylococcus aureus subsp. aureus N315
cuugaagcaucgauuu

SEQ ID NO: 4066567 - RNA, 16 nt, Staphylococcus aureus subsp. aureus N315
cuugaauaauauauuu

SEQ ID NO: 4066568 - RNA, 22 nt, Staphylococcus aureus subsp. aureus N315
cuugaauaccuuuuauuauuuu

SEQ ID NO: 4066569 - RNA, 14 nt, Staphylococcus aureus subsp. aureus N315
cuugaauguuugaa

SEQ ID NO: 4066570 - RNA, 15 nt, Staphylococcus aureus subsp. aureus N315
cuugaauuuaauaag

SEQ ID NO: 4066571 - RNA, 16 nt, Staphylococcus aureus subsp. aureus N315
cuugaauuuaauaagu

SEQ ID NO: 4066572 - RNA, 18 nt, Staphylococcus aureus subsp. aureus N315
cuugaccacuuuuguuaa

SEQ ID NO: 4066573 - RNA, 20 nt, Staphylococcus aureus subsp. aureus N315
cuugaccuacuuuuucaaua

SEQ ID NO: 4066574 - RNA, 15 nt, Staphylococcus aureus subsp. aureus N315
cuugaccuucaguuu

SEQ ID NO: 4066575 - RNA, 14 nt, Staphylococcus aureus subsp. aureus N315
cuugagcaucuuuu

SEQ ID NO: 4066576 - RNA, 19 nt, Staphylococcus aureus subsp. aureus N315
cuugagcuguuacacuuuu

SEQ ID NO: 4066577 - RNA, 22 nt, Staphylococcus aureus subsp. aureus N315
cuugagcuuuguuagcaucugc

SEQ ID NO: 4066578 - RNA, 14 nt, Staphylococcus aureus subsp. aureus N315
cuugauaaaaaaug

SEQ ID NO: 4066579 - RNA, 16 nt, Staphylococcus aureus subsp. aureus N315
cuugauaaaaaaugaa

SEQ ID NO: 4066580 - RNA, 18 nt, Staphylococcus aureus subsp. aureus N315
cuugaucauuauaaaaug

SEQ ID NO: 4066581 - RNA, 16 nt, Staphylococcus aureus subsp. aureus N315
cuugaugaaacugauu

SEQ ID NO: 4066582 - RNA, 17 nt, Staphylococcus aureus subsp. aureus N315
cuugauuguaaauaaaa

SEQ ID NO: 4066583 - RNA, 19 nt, Staphylococcus aureus subsp. aureus N315
cuugauuuaaaccaucaau

SEQ ID NO: 4066584 - RNA, 21 nt, Staphylococcus aureus subsp. aureus N315
cuugauuuaaaccaucaauuc

SEQ ID NO: 4066585 - RNA, 18 nt, Staphylococcus aureus subsp. aureus N315
cuugcaaauauaucaucu

SEQ ID NO: 4066586 - RNA, 21 nt, Staphylococcus aureus subsp. aureus N315
cuugcaaauauaucaucucua

SEQ ID NO: 4066587 - RNA, 17 nt, Staphylococcus aureus subsp. aureus N315
cuugcaauaccucccca

SEQ ID NO: 4066588 - RNA, 20 nt, Staphylococcus aureus subsp. aureus N315
cuugcauacgaauuaaaaua

SEQ ID NO: 4066589 - RNA, 21 nt, Staphylococcus aureus subsp. aureus N315
cuugcauacgaauuaaaauaa

SEQ ID NO: 4066590 - RNA, 22 nt, Staphylococcus aureus subsp. aureus N315
cuugccuggcaacguucuacuc

SEQ ID NO: 4066591 - RNA, 14 nt, Staphylococcus aureus subsp. aureus N315
cuugccuuuuuagg

SEQ ID NO: 4066592 - RNA, 16 nt, Staphylococcus aureus subsp. aureus N315
cuugcucaugagcaca

SEQ ID NO: 4066593 - RNA, 20 nt, Staphylococcus aureus subsp. aureus N315
cuugcuggauuacaccuuug

SEQ ID NO: 4066594 - RNA, 20 nt, Staphylococcus aureus subsp. aureus N315
cuugcuuacaauaaucacuu

SEQ ID NO: 4066595 - RNA, 21 nt, Staphylococcus aureus subsp. aureus N315
cuuggaaguaucugugaauau

SEQ ID NO: 4066596 - RNA, 14 nt, Staphylococcus aureus subsp. aureus N315
cuuggacauuguaa

SEQ ID NO: 4066597 - RNA, 16 nt, Staphylococcus aureus subsp. aureus N315
cuuggacuaauaauug

SEQ ID NO: 4066598 - RNA, 20 nt, Staphylococcus aureus subsp. aureus N315
cuuuauuuacaauguuaucu

SEQ ID NO: 4066599 - RNA, 20 nt, Staphylococcus aureus subsp. aureus N315
cuuuauuugauucuucacca

SEQ ID NO: 4066600 - RNA, 16 nt, Staphylococcus aureus subsp. aureus N315
cuuuauuuuaaacaug

SEQ ID NO: 4066601 - RNA, 12 nt, Staphylococcus aureus subsp. aureus N315
cuuuauuuucuu

SEQ ID NO: 4066602 - RNA, 22 nt, Staphylococcus aureus subsp. aureus N315
cuuuauuuucuuguguauuuuu

SEQ ID NO: 4066603 - RNA, 12 nt, Staphylococcus aureus subsp. aureus N315
cuuuauuuuuug

SEQ ID NO: 4066604 - RNA, 18 nt, Staphylococcus aureus subsp. aureus N315
cuuucaaauauaucuaau

SEQ ID NO: 4066605 - RNA, 23 nt, Staphylococcus aureus subsp. aureus N315
cuuucaaauauaucuaauacuuu

SEQ ID NO: 4066606 - RNA, 19 nt, Staphylococcus aureus subsp. aureus N315
cuuucaaaugcuuaauaaa

SEQ ID NO: 4066607 - RNA, 15 nt, Staphylococcus aureus subsp. aureus N315
cuuucaauuaauuua

SEQ ID NO: 4066608 - RNA, 20 nt, Staphylococcus aureus subsp. aureus N315
cuuucaccauuuacuucaua

SEQ ID NO: 4066609 - RNA, 22 nt, Staphylococcus aureus subsp. aureus N315
cuuucagcaccagaacaauuca

SEQ ID NO: 4066610 - RNA, 13 nt, Staphylococcus aureus subsp. aureus N315
cuuucaguuuuug

SEQ ID NO: 4066611 - RNA, 15 nt, Staphylococcus aureus subsp. aureus N315
cuuucauaaauuguu

SEQ ID NO: 4066612 - RNA, 17 nt, Staphylococcus aureus subsp. aureus N315
cuuucauaauuaacaca

SEQ ID NO: 4066613 - RNA, 20 nt, Staphylococcus aureus subsp. aureus N315
cuuucauaguuauuaaaucu

SEQ ID NO: 4066614 - RNA, 15 nt, Staphylococcus aureus subsp. aureus N315
cuuucauuguaaauu

SEQ ID NO: 4066615 - RNA, 13 nt, Staphylococcus aureus subsp. aureus N315
cuuucauuuuagc

SEQ ID NO: 4066616 - RNA, 16 nt, Staphylococcus aureus subsp. aureus N315
cuuuccauuguugaua

SEQ ID NO: 4066617 - RNA, 14 nt, Staphylococcus aureus subsp. aureus N315
cuuuccucguauuu

SEQ ID NO: 4066618 - RNA, 23 nt, Staphylococcus aureus subsp. aureus N315
cuuucguuucuuuuauaucgcuu

SEQ ID NO: 4066619 - RNA, 21 nt, Staphylococcus aureus subsp. aureus N315
cuuucuaagauguguugaaac

SEQ ID NO: 4066620 - RNA, 23 nt, Staphylococcus aureus subsp. aureus N315
cuuucugaucgacuaauuuuucu

SEQ ID NO: 4066621 - RNA, 11 nt, Staphylococcus aureus subsp. aureus N315
cuuucuuuucu

SEQ ID NO: 4066622 - RNA, 16 nt, Staphylococcus aureus subsp. aureus N315
cuuucuuuucugaaug

SEQ ID NO: 4066623 - RNA, 13 nt, Staphylococcus aureus subsp. aureus N315
cuuucuuuuucau

SEQ ID NO: 4066624 - RNA, 18 nt, Staphylococcus aureus subsp. aureus N315
cuuugaaagaaggaauaa

SEQ ID NO: 4066625 - RNA, 21 nt, Staphylococcus aureus subsp. aureus N315
cuuugaaagaaggaauaauuu

SEQ ID NO: 4066626 - RNA, 22 nt, Staphylococcus aureus subsp. aureus N315
cuuugaaaggaauguuuaaaaa

SEQ ID NO: 4066627 - RNA, 19 nt, Staphylococcus aureus subsp. aureus N315
cuuugaacauauuauaaaa

SEQ ID NO: 4066628 - RNA, 18 nt, Staphylococcus aureus subsp. aureus N315
cuuugaagggguuuuuuc

SEQ ID NO: 4066629 - RNA, 20 nt, Staphylococcus aureus subsp. aureus N315
cuuugaauggcucguuuuuu

SEQ ID NO: 4066630 - RNA, 16 nt, Staphylococcus aureus subsp. aureus N315
cuuugacauguguuaa

SEQ ID NO: 4066631 - RNA, 22 nt, Staphylococcus aureus subsp. aureus N315
cuuugacguuuugguuguucuu

SEQ ID NO: 4066632 - RNA, 20 nt, Staphylococcus aureus subsp. aureus N315
cuuugcauacauaucuuuug

SEQ ID NO: 4066633 - RNA, 21 nt, Staphylococcus aureus subsp. aureus N315
cuuugcuuaaaccuuaauaau

SEQ ID NO: 4066634 - RNA, 23 nt, Staphylococcus aureus subsp. aureus N315
cuuuggaaauuuauuauaaaaua

SEQ ID NO: 4066635 - RNA, 16 nt, Staphylococcus aureus subsp. aureus N315
cuuuggacuuuaaagu

SEQ ID NO: 4066636 - RNA, 18 nt, Staphylococcus aureus subsp. aureus N315
cuuuggacuuuaaaguua

SEQ ID NO: 4066637 - RNA, 14 nt, Staphylococcus aureus subsp. aureus N315
cuuuggcaccagua

SEQ ID NO: 4066638 - RNA, 20 nt, Staphylococcus aureus subsp. aureus N315
cuuuguaaccuaaaaacaaa

SEQ ID NO: 4066639 - RNA, 18 nt, Staphylococcus aureus subsp. aureus N315
cuuuguagccuucaacua

SEQ ID NO: 4066640 - RNA, 21 nt, Staphylococcus aureus subsp. aureus N315
cuuugucauuuugauuaagug

SEQ ID NO: 4066641 - RNA, 19 nt, Staphylococcus aureus subsp. aureus N315
cuuuguguuugcuuuuuac

SEQ ID NO: 4066642 - RNA, 18 nt, Staphylococcus aureus subsp. aureus N315
cuuuguuauauuuuuagg

SEQ ID NO: 4066643 - RNA, 13 nt, Staphylococcus aureus subsp. aureus N315
cuuuguucugcuu

SEQ ID NO: 4066644 - RNA, 18 nt, Staphylococcus aureus subsp. aureus N315
cuuuguucugcuuuuucu

SEQ ID NO: 4066645 - RNA, 23 nt, Staphylococcus aureus subsp. aureus N315
cuuuguucugcuuuuucuuuauc

SEQ ID NO: 4066646 - RNA, 15 nt, Staphylococcus aureus subsp. aureus N315
cuuuguuggggccca

SEQ ID NO: 4066647 - RNA, 21 nt, Staphylococcus aureus subsp. aureus N315
cuuuguuggggcccacacccc

SEQ ID NO: 4066648 - RNA, 19 nt, Staphylococcus aureus subsp. aureus N315
cuuuguuugcuucuguauc

SEQ ID NO: 4066649 - RNA, 14 nt, Staphylococcus aureus subsp. aureus N315
cuuuguuuucagua

SEQ ID NO: 4066650 - RNA, 17 nt, Staphylococcus aureus subsp. aureus N315
cuuuuaaaccguguucu

SEQ ID NO: 4066651 - RNA, 12 nt, Staphylococcus aureus subsp. aureus N315
cuuuuaaacgau

SEQ ID NO: 4066652 - RNA, 22 nt, Staphylococcus aureus subsp. aureus N315
cuuuuaacccacauuaaauauu

SEQ ID NO: 4066653 - RNA, 16 nt, Staphylococcus aureus subsp. aureus N315
cuuuuaauaguguuau

SEQ ID NO: 4066654 - RNA, 16 nt, Staphylococcus aureus subsp. aureus N315
cuuuuaauaucuucua

SEQ ID NO: 4066655 - RNA, 21 nt, Staphylococcus aureus subsp. aureus N315
cuuuuaauauuugauaacaaa

SEQ ID NO: 4066656 - RNA, 18 nt, Staphylococcus aureus subsp. aureus N315
cuuuuaauuguauuuucu

SEQ ID NO: 4066657 - RNA, 18 nt, Staphylococcus aureus subsp. aureus N315
cuuuuaauuuuuuuagcu

SEQ ID NO: 4066658 - RNA, 15 nt, Staphylococcus aureus subsp. aureus N315
cuuuuacaaacuuca

SEQ ID NO: 4066659 - RNA, 17 nt, Staphylococcus aureus subsp. aureus N315
cuuuuacaaacuucaca

SEQ ID NO: 4066660 - RNA, 23 nt, Staphylococcus aureus subsp. aureus N315
cuuuuacaaacuucacaucaugu

SEQ ID NO: 4066661 - RNA, 21 nt, Staphylococcus aureus subsp. aureus N315
cuuuuacagaacguucauaua

SEQ ID NO: 4066662 - RNA, 17 nt, Staphylococcus aureus subsp. aureus N315
cuuuuacgccuucuuua

SEQ ID NO: 4066663 - RNA, 21 nt, Staphylococcus aureus subsp. aureus N315
cuuuuacuuucucaucuauuu

SEQ ID NO: 4066664 - RNA, 16 nt, Staphylococcus aureus subsp. aureus N315
cuuuuagaguuuuuau

SEQ ID NO: 4066665 - RNA, 12 nt, Staphylococcus aureus subsp. aureus N315
cuuuuagauuau

SEQ ID NO: 4066666 - RNA, 12 nt, Staphylococcus aureus subsp. aureus N315
cuuuuauagaaa

SEQ ID NO: 4066667 - RNA, 13 nt, Staphylococcus aureus subsp. aureus N315
cuuuuauauuuuu

SEQ ID NO: 4066668 - RNA, 21 nt, Staphylococcus aureus subsp. aureus N315
cuuuuauccaauguauaaaac

SEQ ID NO: 4066669 - RNA, 10 nt, Staphylococcus aureus subsp. aureus N315
cuuuuaugca

SEQ ID NO: 4066670 - RNA, 14 nt, Staphylococcus aureus subsp. aureus N315
cuuuuaugcaugcg

SEQ ID NO: 4066671 - RNA, 16 nt, Staphylococcus aureus subsp. aureus N315
cuuuuaugcaugcgca

SEQ ID NO: 4066672 - RNA, 17 nt, Staphylococcus aureus subsp. aureus N315
cuuuuauggagugauau

SEQ ID NO: 4066673 - RNA, 14 nt, Staphylococcus aureus subsp. aureus N315
cuuuuauuacuuau

SEQ ID NO: 4066674 - RNA, 13 nt, Staphylococcus aureus subsp. aureus N315
cuuuuauuauuuu

SEQ ID NO: 4066675 - RNA, 16 nt, Staphylococcus aureus subsp. aureus N315
cuuuuauuauuuuaug

SEQ ID NO: 4066676 - RNA, 17 nt, Staphylococcus aureus subsp. aureus N315
cuuuuauuuaucuuuua

SEQ ID NO: 4066677 - RNA, 15 nt, Staphylococcus aureus subsp. aureus N315
cuuuuauuuucauaa

SEQ ID NO: 4066678 - RNA, 18 nt, Staphylococcus aureus subsp. aureus N315
cuuuucaucguucauaua

SEQ ID NO: 4066679 - RNA, 20 nt, Staphylococcus aureus subsp. aureus N315
cuuuucgcaaaucccuucuc

SEQ ID NO: 4066680 - RNA, 20 nt, Staphylococcus aureus subsp. aureus N315
cuuuucuagcuauauccagu

SEQ ID NO: 4066681 - RNA, 21 nt, Staphylococcus aureus subsp. aureus N315
cuuuucucgauuaauuuucuu

SEQ ID NO: 4066682 - RNA, 18 nt, Staphylococcus aureus subsp. aureus N315
cuuuucugucuguaaauu

SEQ ID NO: 4066683 - RNA, 13 nt, Staphylococcus aureus subsp. aureus N315
cuuuugauagcua

SEQ ID NO: 4066684 - RNA, 15 nt, Staphylococcus aureus subsp. aureus N315
cuuuugauagcuaau

SEQ ID NO: 4066685 - RNA, 18 nt, Staphylococcus aureus subsp. aureus N315
gaaaauucgcuuguaaca

SEQ ID NO: 4066686 - RNA, 22 nt, Staphylococcus aureus subsp. aureus N315
gaaaauuucucacugcuguucu

SEQ ID NO: 4066687 - RNA, 19 nt, Staphylococcus aureus subsp. aureus N315
gaaacaaaacaaaaaauau

SEQ ID NO: 4066688 - RNA, 21 nt, Staphylococcus aureus subsp. aureus N315
gaaacaagaaguuuccaacgu

SEQ ID NO: 4066689 - RNA, 22 nt, Staphylococcus aureus subsp. aureus N315
gaaacaauucauuaauaggauu

SEQ ID NO: 4066690 - RNA, 16 nt, Staphylococcus aureus subsp. aureus N315
gaaacacacuaaaagc

SEQ ID NO: 4066691 - RNA, 15 nt, Staphylococcus aureus subsp. aureus N315
gaaacaucuugauau

SEQ ID NO: 4066692 - RNA, 17 nt, Staphylococcus aureus subsp. aureus N315
gaaacauuauauaacac

SEQ ID NO: 4066693 - RNA, 19 nt, Staphylococcus aureus subsp. aureus N315
gaaacgucuuaauucuucu

SEQ ID NO: 4066694 - RNA, 14 nt, Staphylococcus aureus subsp. aureus N315
gaaacuaauaauuu

SEQ ID NO: 4066695 - RNA, 14 nt, Staphylococcus aureus subsp. aureus N315
gaaacuuaaauauu

SEQ ID NO: 4066696 - RNA, 15 nt, Staphylococcus aureus subsp. aureus N315
gaaacuuuaauacua

SEQ ID NO: 4066697 - RNA, 21 nt, Staphylococcus aureus subsp. aureus N315
gaaagacguuuuuuuauaaau

SEQ ID NO: 4066698 - RNA, 17 nt, Staphylococcus aureus subsp. aureus N315
gaaagaugauauauuca

SEQ ID NO: 4066699 - RNA, 21 nt, Staphylococcus aureus subsp. aureus N315
gaaagcuaauaucaauaaugc

SEQ ID NO: 4066700 - RNA, 22 nt, Staphylococcus aureus subsp. aureus N315
gaaaggcuagcuaaaauuugcu

SEQ ID NO: 4066701 - RNA, 20 nt, Staphylococcus aureus subsp. aureus N315
gaaaguaauaaguaauaauu

SEQ ID NO: 4066702 - RNA, 23 nt, Staphylococcus aureus subsp. aureus N315
gaaaguaauaaguaauaauuuau

SEQ ID NO: 4066703 - RNA, 18 nt, Staphylococcus aureus subsp. aureus N315
gaaaguaccuaaaauaga

SEQ ID NO: 4066704 - RNA, 20 nt, Staphylococcus aureus subsp. aureus N315
gaaaguaucuaugaaauuuu

SEQ ID NO: 4066705 - RNA, 20 nt, Staphylococcus aureus subsp. aureus N315
gaaagucaacaauugcuaau

SEQ ID NO: 4066706 - RNA, 16 nt, Staphylococcus aureus subsp. aureus N315
gaaagugauucccaaa

SEQ ID NO: 4066707 - RNA, 15 nt, Staphylococcus aureus subsp. aureus N315
gaaaguguaugcaug

SEQ ID NO: 4066708 - RNA, 19 nt, Staphylococcus aureus subsp. aureus N315
gaaaguugcuuagcuucuc

SEQ ID NO: 4066709 - RNA, 19 nt, Staphylococcus aureus subsp. aureus N315
gaaaguuucgacguaccaa

SEQ ID NO: 4066710 - RNA, 14 nt, Staphylococcus aureus subsp. aureus N315
gaaauaaaaaauaa

SEQ ID NO: 4066711 - RNA, 21 nt, Staphylococcus aureus subsp. aureus N315
gaaauaaucuaguaucuauca

SEQ ID NO: 4066712 - RNA, 19 nt, Staphylococcus aureus subsp. aureus N315
gaaauaccuccugauugcu

SEQ ID NO: 4066713 - RNA, 14 nt, Staphylococcus aureus subsp. aureus N315
gaaauagaaauguc

SEQ ID NO: 4066714 - RNA, 21 nt, Staphylococcus aureus subsp. aureus N315
gaaauaggcgcuuguaaaauu

SEQ ID NO: 4066715 - RNA, 21 nt, Staphylococcus aureus subsp. aureus N315
gaaauagguaucuuaaagcau

SEQ ID NO: 4066716 - RNA, 16 nt, Staphylococcus aureus subsp. aureus N315
gaaauauauugucgac

SEQ ID NO: 4066717 - RNA, 15 nt, Staphylococcus aureus subsp. aureus N315
gaaauaucaagaugu

SEQ ID NO: 4066718 - RNA, 13 nt, Staphylococcus aureus subsp. aureus N315
gaaauauuuaucu

SEQ ID NO: 4066719 - RNA, 17 nt, Staphylococcus aureus subsp. aureus N315
gaaaucaaaaauaauua

SEQ ID NO: 4066720 - RNA, 21 nt, Staphylococcus aureus subsp. aureus N315
gaaaucaaaaauaauuaugaa

SEQ ID NO: 4066721 - RNA, 12 nt, Staphylococcus aureus subsp. aureus N315
gaaaucaaauau

SEQ ID NO: 4066722 - RNA, 14 nt, Staphylococcus aureus subsp. aureus N315
gaaaucauauauuu

SEQ ID NO: 4066723 - RNA, 15 nt, Staphylococcus aureus subsp. aureus N315
gaaaucauauauuuc

SEQ ID NO: 4066724 - RNA, 17 nt, Staphylococcus aureus subsp. aureus N315
gaaaucauauauuucua

SEQ ID NO: 4066725 - RNA, 20 nt, Staphylococcus aureus subsp. aureus N315
gaaauccgcauaaauuagau

SEQ ID NO: 4066726 - RNA, 12 nt, Staphylococcus aureus subsp. aureus N315
gaaaugaaugag

SEQ ID NO: 4066727 - RNA, 13 nt, Staphylococcus aureus subsp. aureus N315
gaaaugauaauuu

SEQ ID NO: 4066728 - RNA, 13 nt, Staphylococcus aureus subsp. aureus N315
gaaauggaaagua

SEQ ID NO: 4066729 - RNA, 17 nt, Staphylococcus aureus subsp. aureus N315
gaaauguagauuacuuu

SEQ ID NO: 4066730 - RNA, 18 nt, Staphylococcus aureus subsp. aureus N315
gaaauguuuuggaaaaau

SEQ ID NO: 4066731 - RNA, 16 nt, Staphylococcus aureus subsp. aureus N315
gaaauuaaaucgacaa

SEQ ID NO: 4066732 - RNA, 18 nt, Staphylococcus aureus subsp. aureus N315
gaaauuacuuuaacaguu

SEQ ID NO: 4066733 - RNA, 11 nt, Staphylococcus aureus subsp. aureus N315
gaaauuagaaa

SEQ ID NO: 4066734 - RNA, 14 nt, Staphylococcus aureus subsp. aureus N315
gaaauuagauuuua

SEQ ID NO: 4066735 - RNA, 17 nt, Staphylococcus aureus subsp. aureus N315
gaaauuaggaauccaau

SEQ ID NO: 4066736 - RNA, 16 nt, Staphylococcus aureus subsp. aureus N315
gaaauucuacaggcaa

SEQ ID NO: 4066737 - RNA, 23 nt, Staphylococcus aureus subsp. aureus N315
gaaauucuacaggcaaugcaagu

SEQ ID NO: 4066738 - RNA, 16 nt, Staphylococcus aureus subsp. aureus N315
gaaauucuacagguaa

SEQ ID NO: 4066739 - RNA, 20 nt, Staphylococcus aureus subsp. aureus N315
gaaauucucuuuguuggggc

SEQ ID NO: 4066740 - RNA, 21 nt, Staphylococcus aureus subsp. aureus N315
gaaauucucuuuguuggggcc

SEQ ID NO: 4066741 - RNA, 21 nt, Staphylococcus aureus subsp. aureus N315
gaaauuguguugaaucaacag

SEQ ID NO: 4066742 - RNA, 19 nt, Staphylococcus aureus subsp. aureus N315
gaaauuguucuaauacacc

SEQ ID NO: 4066743 - RNA, 21 nt, Staphylococcus aureus subsp. aureus N315
gaaauuuauuauaaaauagaa

SEQ ID NO: 4066744 - RNA, 16 nt, Staphylococcus aureus subsp. aureus N315
gaaauuuauuauaauu

SEQ ID NO: 4066745 - RNA, 20 nt, Staphylococcus aureus subsp. aureus N315
gaaauuuuaaaauaaaucuu

SEQ ID NO: 4066746 - RNA, 18 nt, Staphylococcus aureus subsp. aureus N315
gaaauuuuuaauauaccc

SEQ ID NO: 4066747 - RNA, 18 nt, Staphylococcus aureus subsp. aureus N315
gaaauuuuuuagugaaaa

SEQ ID NO: 4066748 - RNA, 14 nt, Staphylococcus aureus subsp. aureus N315
gaacaaaauguagg

SEQ ID NO: 4066749 - RNA, 16 nt, Staphylococcus aureus subsp. aureus N315
gaacaacauuaggaug

SEQ ID NO: 4066750 - RNA, 13 nt, Staphylococcus aureus subsp. aureus N315
gaacaauaauaug

SEQ ID NO: 4066751 - RNA, 23 nt, Staphylococcus aureus subsp. aureus N315
gaacaaucaauacagagucuaca

SEQ ID NO: 4066752 - RNA, 23 nt, Staphylococcus aureus subsp. aureus N315
gaacaaucggaagcauauuucua

SEQ ID NO: 4066753 - RNA, 19 nt, Staphylococcus aureus subsp. aureus N315
gaacagcggaauacagaug

SEQ ID NO: 4066754 - RNA, 17 nt, Staphylococcus aureus subsp. aureus N315
gaacauaaauaaacuuu

SEQ ID NO: 4066755 - RNA, 18 nt, Staphylococcus aureus subsp. aureus N315
gaacauauucauaauauc

SEQ ID NO: 4066756 - RNA, 11 nt, Staphylococcus aureus subsp. aureus N315
gaacaucuaau

SEQ ID NO: 4066757 - RNA, 14 nt, Staphylococcus aureus subsp. aureus N315
gaacaucuaguuau

SEQ ID NO: 4066758 - RNA, 19 nt, Staphylococcus aureus subsp. aureus N315
gaacaucuaguuauuucau

SEQ ID NO: 4066759 - RNA, 16 nt, Staphylococcus aureus subsp. aureus N315
gaacaugaaugauauu

SEQ ID NO: 4066760 - RNA, 15 nt, Staphylococcus aureus subsp. aureus N315
gaacauguuucuaga

SEQ ID NO: 4066761 - RNA, 20 nt, Staphylococcus aureus subsp. aureus N315
gaacauuuaucgugaagaaa

SEQ ID NO: 4066762 - RNA, 22 nt, Staphylococcus aureus subsp. aureus N315
gaacauuuaucgugaagaaaaa

SEQ ID NO: 4066763 - RNA, 14 nt, Staphylococcus aureus subsp. aureus N315
gaaccaacaauaaa

SEQ ID NO: 4066764 - RNA, 15 nt, Staphylococcus aureus subsp. aureus N315
gaaccacgcaucaug

SEQ ID NO: 4066765 - RNA, 17 nt, Staphylococcus aureus subsp. aureus N315
gaaccauacucuaacuu

SEQ ID NO: 4066766 - RNA, 14 nt, Staphylococcus aureus subsp. aureus N315
gaaccccauucacu

SEQ ID NO: 4066767 - RNA, 18 nt, Staphylococcus aureus subsp. aureus N315
gaaccguaacuauaugaa

SEQ ID NO: 4066768 - RNA, 17 nt, Staphylococcus aureus subsp. aureus N315
gaaccuauauuaagcau

SEQ ID NO: 4066769 - RNA, 13 nt, Staphylococcus aureus subsp. aureus N315
gaaccuauuuuuu

SEQ ID NO: 4066770 - RNA, 21 nt, Staphylococcus aureus subsp. aureus N315
gaaccuauuuuuuauaugaug

SEQ ID NO: 4066771 - RNA, 20 nt, Staphylococcus aureus subsp. aureus N315
gaacgauauuuuaaaaagua

SEQ ID NO: 4066772 - RNA, 20 nt, Staphylococcus aureus subsp. aureus N315
gaauuaucuauauaugaaga

SEQ ID NO: 4066773 - RNA, 17 nt, Staphylococcus aureus subsp. aureus N315
gaauuaucuuuacgaua

SEQ ID NO: 4066774 - RNA, 18 nt, Staphylococcus aureus subsp. aureus N315
gaauuauucaaguaauau

SEQ ID NO: 4066775 - RNA, 15 nt, Staphylococcus aureus subsp. aureus N315
gaauuauuuaaaaug

SEQ ID NO: 4066776 - RNA, 16 nt, Staphylococcus aureus subsp. aureus N315
gaauuauuuagaaacu

SEQ ID NO: 4066777 - RNA, 22 nt, Staphylococcus aureus subsp. aureus N315
gaauucaaccaauuauuaaagc

SEQ ID NO: 4066778 - RNA, 13 nt, Staphylococcus aureus subsp. aureus N315
gaauucauucaau

SEQ ID NO: 4066779 - RNA, 11 nt, Staphylococcus aureus subsp. aureus N315
gaauugaguau

SEQ ID NO: 4066780 - RNA, 13 nt, Staphylococcus aureus subsp. aureus N315
gaauugaguauua

SEQ ID NO: 4066781 - RNA, 16 nt, Staphylococcus aureus subsp. aureus N315
gaauugaguauuaaau

SEQ ID NO: 4066782 - RNA, 19 nt, Staphylococcus aureus subsp. aureus N315
gaauugccagaauucccaa

SEQ ID NO: 4066783 - RNA, 18 nt, Staphylococcus aureus subsp. aureus N315
gaauugcuuuaaacuuau

SEQ ID NO: 4066784 - RNA, 23 nt, Staphylococcus aureus subsp. aureus N315
gaauugguuuuuagugaaaagaa

SEQ ID NO: 4066785 - RNA, 16 nt, Staphylococcus aureus subsp. aureus N315
gaauuguauuagcaau

SEQ ID NO: 4066786 - RNA, 19 nt, Staphylococcus aureus subsp. aureus N315
gaauuuacuccuuacaaua

SEQ ID NO: 4066787 - RNA, 23 nt, Staphylococcus aureus subsp. aureus N315
gaauuuacuccuuacaauaaaga

SEQ ID NO: 4066788 - RNA, 15 nt, Staphylococcus aureus subsp. aureus N315
gaauuucgaaaagaa

SEQ ID NO: 4066789 - RNA, 21 nt, Staphylococcus aureus subsp. aureus N315
gacaaaguucacaacaaagug

SEQ ID NO: 4066790 - RNA, 19 nt, Staphylococcus aureus subsp. aureus N315
gacaacauaacaaagaacc

SEQ ID NO: 4066791 - RNA, 14 nt, Staphylococcus aureus subsp. aureus N315
gacaacugauuuaa

SEQ ID NO: 4066792 - RNA, 15 nt, Staphylococcus aureus subsp. aureus N315
gacaacugauuuaau

SEQ ID NO: 4066793 - RNA, 15 nt, Staphylococcus aureus subsp. aureus N315
gacaaggauugaaaa

SEQ ID NO: 4066794 - RNA, 23 nt, Staphylococcus aureus subsp. aureus N315
gacaaguauacuugaagaaucag

SEQ ID NO: 4066795 - RNA, 20 nt, Staphylococcus aureus subsp. aureus N315
gacaaucgcuugcuucuuuc

SEQ ID NO: 4066796 - RNA, 12 nt, Staphylococcus aureus subsp. aureus N315
gacaauuauaau

SEQ ID NO: 4066797 - RNA, 14 nt, Staphylococcus aureus subsp. aureus N315
gacaauuauaauaa

SEQ ID NO: 4066798 - RNA, 19 nt, Staphylococcus aureus subsp. aureus N315
gacaauuauaauaaaacuu

SEQ ID NO: 4066799 - RNA, 17 nt, Staphylococcus aureus subsp. aureus N315
gacaauucaucuaaccu

SEQ ID NO: 4066800 - RNA, 19 nt, Staphylococcus aureus subsp. aureus N315
gacacauuuacuuaagaac

SEQ ID NO: 4066801 - RNA, 18 nt, Staphylococcus aureus subsp. aureus N315
gacaccaacauauuuuaa

SEQ ID NO: 4066802 - RNA, 13 nt, Staphylococcus aureus subsp. aureus N315
gacaccuauauuu

SEQ ID NO: 4066803 - RNA, 17 nt, Staphylococcus aureus subsp. aureus N315
gacacguguaaaaauga

SEQ ID NO: 4066804 - RNA, 13 nt, Staphylococcus aureus subsp. aureus N315
gacagcuacaauu

SEQ ID NO: 4066805 - RNA, 15 nt, Staphylococcus aureus subsp. aureus N315
gacaguaaucaaagu

SEQ ID NO: 4066806 - RNA, 17 nt, Staphylococcus aureus subsp. aureus N315
gacaguuuuaaaugaaa

SEQ ID NO: 4066807 - RNA, 18 nt, Staphylococcus aureus subsp. aureus N315
gacaguuuuaaaugaaac

SEQ ID NO: 4066808 - RNA, 23 nt, Staphylococcus aureus subsp. aureus N315
gacauaaaauuaacuuaaaauuu

SEQ ID NO: 4066809 - RNA, 13 nt, Staphylococcus aureus subsp. aureus N315
gacauaaauaugg

SEQ ID NO: 4066810 - RNA, 22 nt, Staphylococcus aureus subsp. aureus N315
gacauacucacaaaaaacacua

SEQ ID NO: 4066811 - RNA, 22 nt, Staphylococcus aureus subsp. aureus N315
gacauacuugucguauucuuca

SEQ ID NO: 4066812 - RNA, 15 nt, Staphylococcus aureus subsp. aureus N315
gacauauaaauguug

SEQ ID NO: 4066813 - RNA, 18 nt, Staphylococcus aureus subsp. aureus N315
gacaucaauaucuucuuc

SEQ ID NO: 4066814 - RNA, 22 nt, Staphylococcus aureus subsp. aureus N315
gacaucgucuucuuuuuguccc

SEQ ID NO: 4066815 - RNA, 12 nt, Staphylococcus aureus subsp. aureus N315
gacaucuagaug

SEQ ID NO: 4066816 - RNA, 17 nt, Staphylococcus aureus subsp. aureus N315
gacauguccauaauauc

SEQ ID NO: 4066817 - RNA, 23 nt, Staphylococcus aureus subsp. aureus N315
gacauuaaugauagcaaugaauu

SEQ ID NO: 4066818 - RNA, 20 nt, Staphylococcus aureus subsp. aureus N315
gacauucauuuaguuaaaua

SEQ ID NO: 4066819 - RNA, 16 nt, Staphylococcus aureus subsp. aureus N315
gacauugugaaaguuu

SEQ ID NO: 4066820 - RNA, 19 nt, Staphylococcus aureus subsp. aureus N315
gacauuuaaauauaaccua

SEQ ID NO: 4066821 - RNA, 19 nt, Staphylococcus aureus subsp. aureus N315
gacauuuaauacuuuucuc

SEQ ID NO: 4066822 - RNA, 15 nt, Staphylococcus aureus subsp. aureus N315
gacauuucaucaaua

SEQ ID NO: 4066823 - RNA, 16 nt, Staphylococcus aureus subsp. aureus N315
gacauuuguaaauauu

SEQ ID NO: 4066824 - RNA, 15 nt, Staphylococcus aureus subsp. aureus N315
gacauuuuuggcuua

SEQ ID NO: 4066825 - RNA, 13 nt, Staphylococcus aureus subsp. aureus N315
gaccaaguaugag

SEQ ID NO: 4066826 - RNA, 17 nt, Staphylococcus aureus subsp. aureus N315
gaccaccuuuaucugua

SEQ ID NO: 4066827 - RNA, 21 nt, Staphylococcus aureus subsp. aureus N315
gaccacucaauucucuaacuu

SEQ ID NO: 4066828 - RNA, 22 nt, Staphylococcus aureus subsp. aureus N315
gaccacuuuuguuaaaaaaugg

SEQ ID NO: 4066829 - RNA, 15 nt, Staphylococcus aureus subsp. aureus N315
gaccaugcaaacuca

SEQ ID NO: 4066830 - RNA, 23 nt, Staphylococcus aureus subsp. aureus N315
gaccaugcaaacucauuuauaaa

SEQ ID NO: 4066831 - RNA, 19 nt, Staphylococcus aureus subsp. aureus N315
gaccauugucaugccuuca

SEQ ID NO: 4066832 - RNA, 21 nt, Staphylococcus aureus subsp. aureus N315
gaccauugucaugccuucauu

SEQ ID NO: 4066833 - RNA, 23 nt, Staphylococcus aureus subsp. aureus N315
gacccuugucaguuuuuuuauaa

SEQ ID NO: 4066834 - RNA, 15 nt, Staphylococcus aureus subsp. aureus N315
gaccuacuuuuucaa

SEQ ID NO: 4066835 - RNA, 14 nt, Staphylococcus aureus subsp. aureus N315
gaccuuauauuuua

SEQ ID NO: 4066836 - RNA, 20 nt, Staphylococcus aureus subsp. aureus N315
gaccuucaauaucuucagcu

SEQ ID NO: 4066837 - RNA, 21 nt, Staphylococcus aureus subsp. aureus N315
gacgauaccuuuaauaauauu

SEQ ID NO: 4066838 - RNA, 20 nt, Staphylococcus aureus subsp. aureus N315
gacgauuuauuaguuuuuac

SEQ ID NO: 4066839 - RNA, 20 nt, Staphylococcus aureus subsp. aureus N315
gacgguauaaaaaaauuaac

SEQ ID NO: 4066840 - RNA, 13 nt, Staphylococcus aureus subsp. aureus N315
gacguaucaucaa

SEQ ID NO: 4066841 - RNA, 15 nt, Staphylococcus aureus subsp. aureus N315
gacguucauggauuc

SEQ ID NO: 4066842 - RNA, 17 nt, Staphylococcus aureus subsp. aureus N315
gacguugugucaugcug

SEQ ID NO: 4066843 - RNA, 12 nt, Staphylococcus aureus subsp. aureus N315
gacguuuuccau

SEQ ID NO: 4066844 - RNA, 17 nt, Staphylococcus aureus subsp. aureus N315
gacguuuugguuguucu

SEQ ID NO: 4066845 - RNA, 19 nt, Staphylococcus aureus subsp. aureus N315
gacuaaaaugaaugaagac

SEQ ID NO: 4066846 - RNA, 14 nt, Staphylococcus aureus subsp. aureus N315
gacuaauaauuguc

SEQ ID NO: 4066847 - RNA, 17 nt, Staphylococcus aureus subsp. aureus N315
gacuacaaguuuauaau

SEQ ID NO: 4066848 - RNA, 11 nt, Staphylococcus aureus subsp. aureus N315
gacuacucaau

SEQ ID NO: 4066849 - RNA, 20 nt, Staphylococcus aureus subsp. aureus N315
gacuaguguaccuuguuuca

SEQ ID NO: 4066850 - RNA, 20 nt, Staphylococcus aureus subsp. aureus N315
gacuauaacaccaauuaaau

SEQ ID NO: 4066851 - RNA, 11 nt, Staphylococcus aureus subsp. aureus N315
gacuauuuuug

SEQ ID NO: 4066852 - RNA, 14 nt, Staphylococcus aureus subsp. aureus N315
gacucacuucuuaa

SEQ ID NO: 4066853 - RNA, 16 nt, Staphylococcus aureus subsp. aureus N315
gacucuccaaauauug

SEQ ID NO: 4066854 - RNA, 15 nt, Staphylococcus aureus subsp. aureus N315
gacugaacgaaaaug

SEQ ID NO: 4066855 - RNA, 20 nt, Staphylococcus aureus subsp. aureus N315
gacugaaugagaaugugcuu

SEQ ID NO: 4066856 - RNA, 15 nt, Staphylococcus aureus subsp. aureus N315
gacugacuaauaaaa

SEQ ID NO: 4066857 - RNA, 20 nt, Staphylococcus aureus subsp. aureus N315
gacugcaaauacgaguguuu

SEQ ID NO: 4066858 - RNA, 23 nt, Staphylococcus aureus subsp. aureus N315
gacuuaauaucauauucaaaaua

SEQ ID NO: 4066859 - RNA, 18 nt, Staphylococcus aureus subsp. aureus N315
gacuuauuugaaugcaaa

SEQ ID NO: 4066860 - RNA, 15 nt, Staphylococcus aureus subsp. aureus N315
gauaauuuuuaacag

SEQ ID NO: 4066861 - RNA, 14 nt, Staphylococcus aureus subsp. aureus N315
gauacauaaaacau

SEQ ID NO: 4066862 - RNA, 14 nt, Staphylococcus aureus subsp. aureus N315
gauacauaaaucua

SEQ ID NO: 4066863 - RNA, 23 nt, Staphylococcus aureus subsp. aureus N315
gauacauauucucugcuucuaaa

SEQ ID NO: 4066864 - RNA, 15 nt, Staphylococcus aureus subsp. aureus N315
gauacauucuauuaa

SEQ ID NO: 4066865 - RNA, 16 nt, Staphylococcus aureus subsp. aureus N315
gauaccaaacugccua

SEQ ID NO: 4066866 - RNA, 19 nt, Staphylococcus aureus subsp. aureus N315
gauaccaaauauauuuuua

SEQ ID NO: 4066867 - RNA, 23 nt, Staphylococcus aureus subsp. aureus N315
gauaccucauccgccaauuaaaa

SEQ ID NO: 4066868 - RNA, 21 nt, Staphylococcus aureus subsp. aureus N315
gauaccuuuaauaauauugaa

SEQ ID NO: 4066869 - RNA, 19 nt, Staphylococcus aureus subsp. aureus N315
gauaccuuuuucuaccaau

SEQ ID NO: 4066870 - RNA, 13 nt, Staphylococcus aureus subsp. aureus N315
gauacugaaauuu

SEQ ID NO: 4066871 - RNA, 23 nt, Staphylococcus aureus subsp. aureus N315
gauacugaaauuucauaaaguuu

SEQ ID NO: 4066872 - RNA, 13 nt, Staphylococcus aureus subsp. aureus N315
gauacugauauuu

SEQ ID NO: 4066873 - RNA, 18 nt, Staphylococcus aureus subsp. aureus N315
gauacugauauuuagaau

SEQ ID NO: 4066874 - RNA, 14 nt, Staphylococcus aureus subsp. aureus N315
gauacuuugaaaga

SEQ ID NO: 4066875 - RNA, 15 nt, Staphylococcus aureus subsp. aureus N315
gauagaaguuuuuug

SEQ ID NO: 4066876 - RNA, 15 nt, Staphylococcus aureus subsp. aureus N315
gauagaauacuaaaa

SEQ ID NO: 4066877 - RNA, 19 nt, Staphylococcus aureus subsp. aureus N315
gauagaauacuaaaagugu

SEQ ID NO: 4066878 - RNA, 20 nt, Staphylococcus aureus subsp. aureus N315
gauagaauacuaaaaguguu

SEQ ID NO: 4066879 - RNA, 21 nt, Staphylococcus aureus subsp. aureus N315
gauagaauacuaaaaguguua

SEQ ID NO: 4066880 - RNA, 21 nt, Staphylococcus aureus subsp. aureus N315
gauagaaugucgauauuucua

SEQ ID NO: 4066881 - RNA, 22 nt, Staphylococcus aureus subsp. aureus N315
gauagaugcuggcuuaguaguu

SEQ ID NO: 4066882 - RNA, 21 nt, Staphylococcus aureus subsp. aureus N315
gauagcaccguaacauaugua

SEQ ID NO: 4066883 - RNA, 18 nt, Staphylococcus aureus subsp. aureus N315
gauagccguuaacaucag

SEQ ID NO: 4066884 - RNA, 14 nt, Staphylococcus aureus subsp. aureus N315
gauagccuuuucua

SEQ ID NO: 4066885 - RNA, 19 nt, Staphylococcus aureus subsp. aureus N315
gauagcggauuuauuuuuu

SEQ ID NO: 4066886 - RNA, 14 nt, Staphylococcus aureus subsp. aureus N315
gauagcuaaacauu

SEQ ID NO: 4066887 - RNA, 16 nt, Staphylococcus aureus subsp. aureus N315
gauagcugcuauccuu

SEQ ID NO: 4066888 - RNA, 16 nt, Staphylococcus aureus subsp. aureus N315
gauaggaaacuuaaau

SEQ ID NO: 4066889 - RNA, 15 nt, Staphylococcus aureus subsp. aureus N315
gauaggauauuuuuu

SEQ ID NO: 4066890 - RNA, 15 nt, Staphylococcus aureus subsp. aureus N315
gauaggauuuacacc

SEQ ID NO: 4066891 - RNA, 13 nt, Staphylococcus aureus subsp. aureus N315
gauagugaauaau

SEQ ID NO: 4066892 - RNA, 14 nt, Staphylococcus aureus subsp. aureus N315
gauagugaauaaug

SEQ ID NO: 4066893 - RNA, 16 nt, Staphylococcus aureus subsp. aureus N315
gauauaaugaaguuau

SEQ ID NO: 4066894 - RNA, 17 nt, Staphylococcus aureus subsp. aureus N315
gauauaaugaaguuaug

SEQ ID NO: 4066895 - RNA, 18 nt, Staphylococcus aureus subsp. aureus N315
gauauaaugaaguuauga

SEQ ID NO: 4066896 - RNA, 15 nt, Staphylococcus aureus subsp. aureus N315
gauauacgaauccuc

SEQ ID NO: 4066897 - RNA, 18 nt, Staphylococcus aureus subsp. aureus N315
gauauacuugaagaaaag

SEQ ID NO: 4066898 - RNA, 20 nt, Staphylococcus aureus subsp. aureus N315
gauauagaccguugaaaugu

SEQ ID NO: 4066899 - RNA, 22 nt, Staphylococcus aureus subsp. aureus N315
gauauagugcuuguuuauuaca

SEQ ID NO: 4066900 - RNA, 21 nt, Staphylococcus aureus subsp. aureus N315
gauaucaaaguacuaacguuu

SEQ ID NO: 4066901 - RNA, 19 nt, Staphylococcus aureus subsp. aureus N315
gauaucagcuaaguuaaau

SEQ ID NO: 4066902 - RNA, 15 nt, Staphylococcus aureus subsp. aureus N315
gauaucugaaguaga

SEQ ID NO: 4066903 - RNA, 17 nt, Staphylococcus aureus subsp. aureus N315
gauaucuggauuaacug

SEQ ID NO: 4066904 - RNA, 19 nt, Staphylococcus aureus subsp. aureus N315
gauaucuuaaucuaaaaau

SEQ ID NO: 4066905 - RNA, 13 nt, Staphylococcus aureus subsp. aureus N315
gauauguuuauau

SEQ ID NO: 4066906 - RNA, 20 nt, Staphylococcus aureus subsp. aureus N315
gauauguuuggauaucuuug

SEQ ID NO: 4066907 - RNA, 13 nt, Staphylococcus aureus subsp. aureus N315
gauauuacauaua

SEQ ID NO: 4066908 - RNA, 17 nt, Staphylococcus aureus subsp. aureus N315
gauauuaggcuuaaaua

SEQ ID NO: 4066909 - RNA, 21 nt, Staphylococcus aureus subsp. aureus N315
gauauuauaaaaacagcagug

SEQ ID NO: 4066910 - RNA, 17 nt, Staphylococcus aureus subsp. aureus N315
gauauucaacuugauua

SEQ ID NO: 4066911 - RNA, 20 nt, Staphylococcus aureus subsp. aureus N315
gauauucauguucuuguaau

SEQ ID NO: 4066912 - RNA, 18 nt, Staphylococcus aureus subsp. aureus N315
gauauucgcgaacguuau

SEQ ID NO: 4066913 - RNA, 19 nt, Staphylococcus aureus subsp. aureus N315
gauauucuaaaaaauuaaa

SEQ ID NO: 4066914 - RNA, 16 nt, Staphylococcus aureus subsp. aureus N315
gauauugcaucauuca

SEQ ID NO: 4066915 - RNA, 18 nt, Staphylococcus aureus subsp. aureus N315
gauauuucaucugacuga

SEQ ID NO: 4066916 - RNA, 15 nt, Staphylococcus aureus subsp. aureus N315
gauauuuccaaauug

SEQ ID NO: 4066917 - RNA, 20 nt, Staphylococcus aureus subsp. aureus N315
gauauuuuuuaauaaucaaa

SEQ ID NO: 4066918 - RNA, 17 nt, Staphylococcus aureus subsp. aureus N315
gaucaacugaaauuuuu

SEQ ID NO: 4066919 - RNA, 24 nt, Staphylococcus aureus subsp. aureus N315
gaucaauuaaacuuaagaauacau

SEQ ID NO: 4066920 - RNA, 21 nt, Staphylococcus aureus subsp. aureus N315
gaucacuuacugugaaaauac

SEQ ID NO: 4066921 - RNA, 18 nt, Staphylococcus aureus subsp. aureus N315
gaucauaaauauuuucug

SEQ ID NO: 4066922 - RNA, 14 nt, Staphylococcus aureus subsp. aureus N315
gaucaucguauaga

SEQ ID NO: 4066923 - RNA, 13 nt, Staphylococcus aureus subsp. aureus N315
gaucaugccuuca

SEQ ID NO: 4066924 - RNA, 17 nt, Staphylococcus aureus subsp. aureus N315
gaucaugccuucaugaa

SEQ ID NO: 4066925 - RNA, 14 nt, Staphylococcus aureus subsp. aureus N315
gaucauuauuuaga

SEQ ID NO: 4066926 - RNA, 17 nt, Staphylococcus aureus subsp. aureus N315
gaucauuauuuagaauu

SEQ ID NO: 4066927 - RNA, 17 nt, Staphylococcus aureus subsp. aureus N315
gauccaaaguacucaag

SEQ ID NO: 4066928 - RNA, 12 nt, Staphylococcus aureus subsp. aureus N315
gaucgauacuuu

SEQ ID NO: 4066929 - RNA, 14 nt, Staphylococcus aureus subsp. aureus N315
gaucgauacuuuuu

SEQ ID NO: 4066930 - RNA, 15 nt, Staphylococcus aureus subsp. aureus N315
gaucgauacuuuuug

SEQ ID NO: 4066931 - RNA, 13 nt, Staphylococcus aureus subsp. aureus N315
gaucgguauuuuc

SEQ ID NO: 4066932 - RNA, 18 nt, Staphylococcus aureus subsp. aureus N315
gaucguaacauuagcaug

SEQ ID NO: 4066933 - RNA, 16 nt, Staphylococcus aureus subsp. aureus N315
gaucuuuuccauucau

SEQ ID NO: 4066934 - RNA, 17 nt, Staphylococcus aureus subsp. aureus N315
gaucuuuuuuauauuca

SEQ ID NO: 4066935 - RNA, 22 nt, Staphylococcus aureus subsp. aureus N315
gaugaaaacuuaaaaaugaaau

SEQ ID NO: 4066936 - RNA, 19 nt, Staphylococcus aureus subsp. aureus N315
gaugaaaaucuuuaacucu

SEQ ID NO: 4066937 - RNA, 21 nt, Staphylococcus aureus subsp. aureus N315
gaugaaauuguguugaaucaa

SEQ ID NO: 4066938 - RNA, 23 nt, Staphylococcus aureus subsp. aureus N315
gaugaacaaaauaacauguuugu

SEQ ID NO: 4066939 - RNA, 19 nt, Staphylococcus aureus subsp. aureus N315
gaugaacauaccugcauau

SEQ ID NO: 4066940 - RNA, 14 nt, Staphylococcus aureus subsp. aureus N315
gaugaaccaaaaaa

SEQ ID NO: 4066941 - RNA, 21 nt, Staphylococcus aureus subsp. aureus N315
gaugaacuuaaugcuucaaau

SEQ ID NO: 4066942 - RNA, 14 nt, Staphylococcus aureus subsp. aureus N315
gaugaauaaauaga

SEQ ID NO: 4066943 - RNA, 16 nt, Staphylococcus aureus subsp. aureus N315
gaugaaugauugcauu

SEQ ID NO: 4066944 - RNA, 22 nt, Staphylococcus aureus subsp. aureus N315
gaugaauggauuuucuucacca

SEQ ID NO: 4066945 - RNA, 14 nt, Staphylococcus aureus subsp. aureus N315
gaugaauuaaacug

SEQ ID NO: 4066946 - RNA, 21 nt, Staphylococcus aureus subsp. aureus N315
gaugaauuuuuauuuuuagua

SEQ ID NO: 4066947 - RNA, 14 nt, Staphylococcus aureus subsp. aureus N315
gaugacuguagaaa

SEQ ID NO: 4066948 - RNA, 22 nt, Staphylococcus aureus subsp. aureus N315
gauuuaaaaaauuuaauguuuu

SEQ ID NO: 4066949 - RNA, 21 nt, Staphylococcus aureus subsp. aureus N315
gauuuaaaauauaaauuucuu

SEQ ID NO: 4066950 - RNA, 13 nt, Staphylococcus aureus subsp. aureus N315
gauuuaaaccauc

SEQ ID NO: 4066951 - RNA, 22 nt, Staphylococcus aureus subsp. aureus N315
gauuuaacaaccucugauacuu

SEQ ID NO: 4066952 - RNA, 15 nt, Staphylococcus aureus subsp. aureus N315
gauuuaauuaaaaca

SEQ ID NO: 4066953 - RNA, 14 nt, Staphylococcus aureus subsp. aureus N315
gauuuacaccuaua

SEQ ID NO: 4066954 - RNA, 21 nt, Staphylococcus aureus subsp. aureus N315
gauuuaccucuugauaaaaua

SEQ ID NO: 4066955 - RNA, 21 nt, Staphylococcus aureus subsp. aureus N315
gauuuaguuuuuuuaaaguuu

SEQ ID NO: 4066956 - RNA, 15 nt, Staphylococcus aureus subsp. aureus N315
gauuuauaaauguuu

SEQ ID NO: 4066957 - RNA, 15 nt, Staphylococcus aureus subsp. aureus N315
gauuuauuaacucau

SEQ ID NO: 4066958 - RNA, 16 nt, Staphylococcus aureus subsp. aureus N315
gauuuauuaacucaug

SEQ ID NO: 4066959 - RNA, 19 nt, Staphylococcus aureus subsp. aureus N315
gauuuauuucauauucaau

SEQ ID NO: 4066960 - RNA, 20 nt, Staphylococcus aureus subsp. aureus N315
gauuucuaauugaaaucauc

SEQ ID NO: 4066961 - RNA, 14 nt, Staphylococcus aureus subsp. aureus N315
gauuugaaauuuau

SEQ ID NO: 4066962 - RNA, 15 nt, Staphylococcus aureus subsp. aureus N315
gauuuuaacaagaua

SEQ ID NO: 4066963 - RNA, 19 nt, Staphylococcus aureus subsp. aureus N315
gauuuuaagugguuaucac

SEQ ID NO: 4066964 - RNA, 20 nt, Staphylococcus aureus subsp. aureus N315
gauuuuaauauugacauuua

SEQ ID NO: 4066965 - RNA, 23 nt, Staphylococcus aureus subsp. aureus N315
gauuuuaaucuauccuucaaaag

SEQ ID NO: 4066966 - RNA, 13 nt, Staphylococcus aureus subsp. aureus N315
gauuuuagauuua

SEQ ID NO: 4066967 - RNA, 15 nt, Staphylococcus aureus subsp. aureus N315
gauuuuauaaaguuu

SEQ ID NO: 4066968 - RNA, 22 nt, Staphylococcus aureus subsp. aureus N315
gauuuucgagugugucaacuua

SEQ ID NO: 4066969 - RNA, 12 nt, Staphylococcus aureus subsp. aureus N315
gauuuucuucau

SEQ ID NO: 4066970 - RNA, 20 nt, Staphylococcus aureus subsp. aureus N315
gauuuucuuuaauaacuaaa

SEQ ID NO: 4066971 - RNA, 13 nt, Staphylococcus aureus subsp. aureus N315
gauuuuuaaaaug

SEQ ID NO: 4066972 - RNA, 13 nt, Staphylococcus aureus subsp. aureus N315
gcaaaaaaacaaa

SEQ ID NO: 4066973 - RNA, 15 nt, Staphylococcus aureus subsp. aureus N315
gcaaaaaaacaaaua

SEQ ID NO: 4066974 - RNA, 22 nt, Staphylococcus aureus subsp. aureus N315
gcaaaaaaacaaauauuagaac

SEQ ID NO: 4066975 - RNA, 12 nt, Staphylococcus aureus subsp. aureus N315
gcaaaacaauau

SEQ ID NO: 4066976 - RNA, 16 nt, Staphylococcus aureus subsp. aureus N315
gcaaaacgcauuucau

SEQ ID NO: 4066977 - RNA, 20 nt, Staphylococcus aureus subsp. aureus N315
gcaaaacuugcgcaugcuuu

SEQ ID NO: 4066978 - RNA, 11 nt, Staphylococcus aureus subsp. aureus N315
gcaaaaucaac

SEQ ID NO: 4066979 - RNA, 21 nt, Staphylococcus aureus subsp. aureus N315
gcaaaauuauguaaaaaauau

SEQ ID NO: 4066980 - RNA, 15 nt, Staphylococcus aureus subsp. aureus N315
gcaaacacaguacaa

SEQ ID NO: 4066981 - RNA, 18 nt, Staphylococcus aureus subsp. aureus N315
gcaaacggcccaacugga

SEQ ID NO: 4066982 - RNA, 21 nt, Staphylococcus aureus subsp. aureus N315
gcaaacucauuuauaaacauu

SEQ ID NO: 4066983 - RNA, 16 nt, Staphylococcus aureus subsp. aureus N315
gcaaacuugauucaau

SEQ ID NO: 4066984 - RNA, 18 nt, Staphylococcus aureus subsp. aureus N315
gcaaagacucaauuucau

SEQ ID NO: 4066985 - RNA, 14 nt, Staphylococcus aureus subsp. aureus N315
gcaaaguaacaaua

SEQ ID NO: 4066986 - RNA, 19 nt, Staphylococcus aureus subsp. aureus N315
gcaaagucauuaaauguac

SEQ ID NO: 4066987 - RNA, 12 nt, Staphylococcus aureus subsp. aureus N315
gcaaauaaaaaa

SEQ ID NO: 4066988 - RNA, 13 nt, Staphylococcus aureus subsp. aureus N315
gcaaauauaucau

SEQ ID NO: 4066989 - RNA, 14 nt, Staphylococcus aureus subsp. aureus N315
gcaaauauuaaauu

SEQ ID NO: 4066990 - RNA, 13 nt, Staphylococcus aureus subsp. aureus N315
gcaaaucaaacaa

SEQ ID NO: 4066991 - RNA, 22 nt, Staphylococcus aureus subsp. aureus N315
gcaaaucccuucucaacgauaa

SEQ ID NO: 4066992 - RNA, 17 nt, Staphylococcus aureus subsp. aureus N315
gcaaaucucgucacaua

SEQ ID NO: 4066993 - RNA, 18 nt, Staphylococcus aureus subsp. aureus N315
gcaaauuaguaugacuua

SEQ ID NO: 4066994 - RNA, 15 nt, Staphylococcus aureus subsp. aureus N315
gcaaauuauauagaa

SEQ ID NO: 4066995 - RNA, 19 nt, Staphylococcus aureus subsp. aureus N315
gcaaauuauauagaaaacu

SEQ ID NO: 4066996 - RNA, 14 nt, Staphylococcus aureus subsp. aureus N315
gcaaauuaucauua

SEQ ID NO: 4066997 - RNA, 17 nt, Staphylococcus aureus subsp. aureus N315
gcaaauuaucauuaaau

SEQ ID NO: 4066998 - RNA, 17 nt, Staphylococcus aureus subsp. aureus N315
gcaaauuggaaaaauaa

SEQ ID NO: 4066999 - RNA, 16 nt, Staphylococcus aureus subsp. aureus N315
gcaacaaaagauguug

SEQ ID NO: 4067000 - RNA, 13 nt, Staphylococcus aureus subsp. aureus N315
gcaacaauuugca

SEQ ID NO: 4067001 - RNA, 12 nt, Staphylococcus aureus subsp. aureus N315
gcaacauauuuu

SEQ ID NO: 4067002 - RNA, 21 nt, Staphylococcus aureus subsp. aureus N315
gcaacuaaaacuaucugauua

SEQ ID NO: 4067003 - RNA, 12 nt, Staphylococcus aureus subsp. aureus N315
gcaacuaagaug

SEQ ID NO: 4067004 - RNA, 18 nt, Staphylococcus aureus subsp. aureus N315
gcaacuaagaugacugaa

SEQ ID NO: 4067005 - RNA, 18 nt, Staphylococcus aureus subsp. aureus N315
gcaacugaucauuuucau

SEQ ID NO: 4067006 - RNA, 18 nt, Staphylococcus aureus subsp. aureus N315
gcaagccuucuauauagu

SEQ ID NO: 4067007 - RNA, 19 nt, Staphylococcus aureus subsp. aureus N315
gcaagguuuucgccaauaa

SEQ ID NO: 4067008 - RNA, 22 nt, Staphylococcus aureus subsp. aureus N315
gcaagucucauaucuauuuuuc

SEQ ID NO: 4067009 - RNA, 19 nt, Staphylococcus aureus subsp. aureus N315
gcaaguguaucgcccauac

SEQ ID NO: 4067010 - RNA, 14 nt, Staphylococcus aureus subsp. aureus N315
gcaauaaaauuagc

SEQ ID NO: 4067011 - RNA, 19 nt, Staphylococcus aureus subsp. aureus N315
gcaauaacaccaauugaau

SEQ ID NO: 4067012 - RNA, 15 nt, Staphylococcus aureus subsp. aureus N315
gcaauacuaacugaa

SEQ ID NO: 4067013 - RNA, 16 nt, Staphylococcus aureus subsp. aureus N315
gcaauagcaacacguu

SEQ ID NO: 4067014 - RNA, 18 nt, Staphylococcus aureus subsp. aureus N315
gcaauagcuauaacucua

SEQ ID NO: 4067015 - RNA, 16 nt, Staphylococcus aureus subsp. aureus N315
gcaauaucaucauuua

SEQ ID NO: 4067016 - RNA, 11 nt, Staphylococcus aureus subsp. aureus N315
gcaaucaucug

SEQ ID NO: 4067017 - RNA, 18 nt, Staphylococcus aureus subsp. aureus N315
gcaaucguugaaaaauau

SEQ ID NO: 4067018 - RNA, 13 nt, Staphylococcus aureus subsp. aureus N315
gcaaugaaauuac

SEQ ID NO: 4067019 - RNA, 14 nt, Staphylococcus aureus subsp. aureus N315
gcaaugaaauuacc

SEQ ID NO: 4067020 - RNA, 20 nt, Staphylococcus aureus subsp. aureus N315
gcaaugauaucuuuuccaaa

SEQ ID NO: 4067021 - RNA, 18 nt, Staphylococcus aureus subsp. aureus N315
gcaaugauuauaaauaca

SEQ ID NO: 4067022 - RNA, 15 nt, Staphylococcus aureus subsp. aureus N315
gcaaugcaugcuucu

SEQ ID NO: 4067023 - RNA, 16 nt, Staphylococcus aureus subsp. aureus N315
gcaaugcgaguugggg

SEQ ID NO: 4067024 - RNA, 15 nt, Staphylococcus aureus subsp. aureus N315
gcaauguaaugguua

SEQ ID NO: 4067025 - RNA, 22 nt, Staphylococcus aureus subsp. aureus N315
gcaauuaaaacuauaauaaaga

SEQ ID NO: 4067026 - RNA, 14 nt, Staphylococcus aureus subsp. aureus N315
gcaauuaaaaguac

SEQ ID NO: 4067027 - RNA, 19 nt, Staphylococcus aureus subsp. aureus N315
gcaauuaaccuugauuuaa

SEQ ID NO: 4067028 - RNA, 14 nt, Staphylococcus aureus subsp. aureus N315
gcaauuagaauaua

SEQ ID NO: 4067029 - RNA, 18 nt, Staphylococcus aureus subsp. aureus N315
gcaauuauuuuucaaaua

SEQ ID NO: 4067030 - RNA, 16 nt, Staphylococcus aureus subsp. aureus N315
gcaauugcaaugaaua

SEQ ID NO: 4067031 - RNA, 13 nt, Staphylococcus aureus subsp. aureus N315
gcaauuuguaaua

SEQ ID NO: 4067032 - RNA, 14 nt, Staphylococcus aureus subsp. aureus N315
gcacaacugcauaa

SEQ ID NO: 4067033 - RNA, 20 nt, Staphylococcus aureus subsp. aureus N315
gcacaacugcauaaaagccu

SEQ ID NO: 4067034 - RNA, 14 nt, Staphylococcus aureus subsp. aureus N315
gcacaagcaucuac

SEQ ID NO: 4067035 - RNA, 15 nt, Staphylococcus aureus subsp. aureus N315
gcacaauauuuacca

SEQ ID NO: 4067036 - RNA, 14 nt, Staphylococcus aureus subsp. aureus N315
gccaggugauugac

SEQ ID NO: 4067037 - RNA, 23 nt, Staphylococcus aureus subsp. aureus N315
gccauauguuuuagaauaguuac

SEQ ID NO: 4067038 - RNA, 19 nt, Staphylococcus aureus subsp. aureus N315
gccauauucauauuacuuc

SEQ ID NO: 4067039 - RNA, 12 nt, Staphylococcus aureus subsp. aureus N315
gccaucaauauu

SEQ ID NO: 4067040 - RNA, 16 nt, Staphylococcus aureus subsp. aureus N315
gccaucaauauugaua

SEQ ID NO: 4067041 - RNA, 21 nt, Staphylococcus aureus subsp. aureus N315
gccaucuaggucacuuuuaug

SEQ ID NO: 4067042 - RNA, 22 nt, Staphylococcus aureus subsp. aureus N315
gccaucuuuuuuagcugaacca

SEQ ID NO: 4067043 - RNA, 17 nt, Staphylococcus aureus subsp. aureus N315
gccaugaaaaggaaaaa

SEQ ID NO: 4067044 - RNA, 13 nt, Staphylococcus aureus subsp. aureus N315
gccaugauuuaag

SEQ ID NO: 4067045 - RNA, 15 nt, Staphylococcus aureus subsp. aureus N315
gccauuaaaauuacg

SEQ ID NO: 4067046 - RNA, 23 nt, Staphylococcus aureus subsp. aureus N315
gccauuuuuauuuaacacuucag

SEQ ID NO: 4067047 - RNA, 13 nt, Staphylococcus aureus subsp. aureus N315
gcccacaccccaa

SEQ ID NO: 4067048 - RNA, 13 nt, Staphylococcus aureus subsp. aureus N315
gccccaacaaaga

SEQ ID NO: 4067049 - RNA, 15 nt, Staphylococcus aureus subsp. aureus N315
gccccaacacagaag

SEQ ID NO: 4067050 - RNA, 14 nt, Staphylococcus aureus subsp. aureus N315
gccccaacacagag

SEQ ID NO: 4067051 - RNA, 15 nt, Staphylococcus aureus subsp. aureus N315
gccccaacacagaga

SEQ ID NO: 4067052 - RNA, 17 nt, Staphylococcus aureus subsp. aureus N315
gccccaacacagagaau

SEQ ID NO: 4067053 - RNA, 17 nt, Staphylococcus aureus subsp. aureus N315
gccccaucuauuagaaa

SEQ ID NO: 4067054 - RNA, 15 nt, Staphylococcus aureus subsp. aureus N315
gcccgagacuauauu

SEQ ID NO: 4067055 - RNA, 21 nt, Staphylococcus aureus subsp. aureus N315
gcccgagacuauauucaauuu

SEQ ID NO: 4067056 - RNA, 21 nt, Staphylococcus aureus subsp. aureus N315
gcccuagguuuauauaucaca

SEQ ID NO: 4067057 - RNA, 12 nt, Staphylococcus aureus subsp. aureus N315
gcccugacaauu

SEQ ID NO: 4067058 - RNA, 17 nt, Staphylococcus aureus subsp. aureus N315
gccuaauaauaaaauag

SEQ ID NO: 4067059 - RNA, 19 nt, Staphylococcus aureus subsp. aureus N315
gccuaauaauaaaauagcu

SEQ ID NO: 4067060 - RNA, 20 nt, Staphylococcus aureus subsp. aureus N315
gccuacuguuucacguaaug

SEQ ID NO: 4067061 - RNA, 18 nt, Staphylococcus aureus subsp. aureus N315
gccuaggaguaucuguuu

SEQ ID NO: 4067062 - RNA, 16 nt, Staphylococcus aureus subsp. aureus N315
gccuauucguuugaau

SEQ ID NO: 4067063 - RNA, 12 nt, Staphylococcus aureus subsp. aureus N315
gccucguccauu

SEQ ID NO: 4067064 - RNA, 23 nt, Staphylococcus aureus subsp. aureus N315
gccucuaaugauuaaaaaucaaa

SEQ ID NO: 4067065 - RNA, 23 nt, Staphylococcus aureus subsp. aureus N315
gccugcaucaccugaugaauaga

SEQ ID NO: 4067066 - RNA, 21 nt, Staphylococcus aureus subsp. aureus N315
gccugcccuuuagucauguuu

SEQ ID NO: 4067067 - RNA, 11 nt, Staphylococcus aureus subsp. aureus N315
gccuggcaacg

SEQ ID NO: 4067068 - RNA, 16 nt, Staphylococcus aureus subsp. aureus N315
gccuguagaauuucuu

SEQ ID NO: 4067069 - RNA, 18 nt, Staphylococcus aureus subsp. aureus N315
gccuuaacuucauaauau

SEQ ID NO: 4067070 - RNA, 21 nt, Staphylococcus aureus subsp. aureus N315
gccuucuauauaguaaaauaa

SEQ ID NO: 4067071 - RNA, 22 nt, Staphylococcus aureus subsp. aureus N315
gccuucuguacguuuuaaauaa

SEQ ID NO: 4067072 - RNA, 23 nt, Staphylococcus aureus subsp. aureus N315
gccuugaccuacuuuuucaauau

SEQ ID NO: 4067073 - RNA, 19 nt, Staphylococcus aureus subsp. aureus N315
gccuugauuuuuugaaaug

SEQ ID NO: 4067074 - RNA, 20 nt, Staphylococcus aureus subsp. aureus N315
gccuuuccauuguugauaaa

SEQ ID NO: 4067075 - RNA, 14 nt, Staphylococcus aureus subsp. aureus N315
gccuuuugaauaau

SEQ ID NO: 4067076 - RNA, 15 nt, Staphylococcus aureus subsp. aureus N315
gcgaaaguaucuaug

SEQ ID NO: 4067077 - RNA, 19 nt, Staphylococcus aureus subsp. aureus N315
gcgaaccgaagcgcaguga

SEQ ID NO: 4067078 - RNA, 14 nt, Staphylococcus aureus subsp. aureus N315
gcgaacguuauuuu

SEQ ID NO: 4067079 - RNA, 22 nt, Staphylococcus aureus subsp. aureus N315
gcgaauagaagguuauuuuuua

SEQ ID NO: 4067080 - RNA, 19 nt, Staphylococcus aureus subsp. aureus N315
gcgacauguccauaauauc

SEQ ID NO: 4067081 - RNA, 18 nt, Staphylococcus aureus subsp. aureus N315
gcgacauuuguaaauauu

SEQ ID NO: 4067082 - RNA, 15 nt, Staphylococcus aureus subsp. aureus N315
gcgauaaaaguugua

SEQ ID NO: 4067083 - RNA, 15 nt, Staphylococcus aureus subsp. aureus N315
gcgauacguuuauau

SEQ ID NO: 4067084 - RNA, 19 nt, Staphylococcus aureus subsp. aureus N315
gcgcaaaagcgcaggcgaa

SEQ ID NO: 4067085 - RNA, 17 nt, Staphylococcus aureus subsp. aureus N315
gcgcaagagauaagaaa

SEQ ID NO: 4067086 - RNA, 15 nt, Staphylococcus aureus subsp. aureus N315
gcgcagcaaaugcuu

SEQ ID NO: 4067087 - RNA, 14 nt, Staphylococcus aureus subsp. aureus N315
gcgcgacguuuaaa

SEQ ID NO: 4067088 - RNA, 17 nt, Staphylococcus aureus subsp. aureus N315
gcgcuucuaacucaccu

SEQ ID NO: 4067089 - RNA, 19 nt, Staphylococcus aureus subsp. aureus N315
gcggggccccaacacagag

SEQ ID NO: 4067090 - RNA, 23 nt, Staphylococcus aureus subsp. aureus N315
gcguacuuggcucaaaacuuuua

SEQ ID NO: 4067091 - RNA, 11 nt, Staphylococcus aureus subsp. aureus N315
gcguauuuuuu

SEQ ID NO: 4067092 - RNA, 17 nt, Staphylococcus aureus subsp. aureus N315
gcgucauuuguucaucu

SEQ ID NO: 4067093 - RNA, 19 nt, Staphylococcus aureus subsp. aureus N315
gcgugcuuaauuacaauau

SEQ ID NO: 4067094 - RNA, 19 nt, Staphylococcus aureus subsp. aureus N315
gcguggucuauuuuauaaa

SEQ ID NO: 4067095 - RNA, 20 nt, Staphylococcus aureus subsp. aureus N315
gcguuagauaccucuuguac

SEQ ID NO: 4067096 - RNA, 14 nt, Staphylococcus aureus subsp. aureus N315
gcguucaacauuac

SEQ ID NO: 4067097 - RNA, 21 nt, Staphylococcus aureus subsp. aureus N315
gcguuuaauaacauugaacga

SEQ ID NO: 4067098 - RNA, 14 nt, Staphylococcus aureus subsp. aureus N315
gcuaaaaguauaaa

SEQ ID NO: 4067099 - RNA, 16 nt, Staphylococcus aureus subsp. aureus N315
gcuaaaauaaaauuaa

SEQ ID NO: 4067100 - RNA, 14 nt, Staphylococcus aureus subsp. aureus N315
gcuaaaauuuccuc

SEQ ID NO: 4067101 - RNA, 18 nt, Staphylococcus aureus subsp. aureus N315
gcuaaacaaugaugggaa

SEQ ID NO: 4067102 - RNA, 23 nt, Staphylococcus aureus subsp. aureus N315
gcuaaauguuaaugcuucguaau

SEQ ID NO: 4067103 - RNA, 16 nt, Staphylococcus aureus subsp. aureus N315
gcuaacauaccuaaua

SEQ ID NO: 4067104 - RNA, 22 nt, Staphylococcus aureus subsp. aureus N315
gcuaacgaaucgccuacuauaa

SEQ ID NO: 4067105 - RNA, 18 nt, Staphylococcus aureus subsp. aureus N315
gcuaauaacgcugcaccu

SEQ ID NO: 4067106 - RNA, 18 nt, Staphylococcus aureus subsp. aureus N315
gcuaauacaaaacaaauc

SEQ ID NO: 4067107 - RNA, 16 nt, Staphylococcus aureus subsp. aureus N315
gcuaauccauacguau

SEQ ID NO: 4067108 - RNA, 12 nt, Staphylococcus aureus subsp. aureus N315
gcuaaucuauuu

SEQ ID NO: 4067109 - RNA, 16 nt, Staphylococcus aureus subsp. aureus N315
gcuaaucuauuuagcu

SEQ ID NO: 4067110 - RNA, 15 nt, Staphylococcus aureus subsp. aureus N315
gcuaaugauaaucca

SEQ ID NO: 4067111 - RNA, 20 nt, Staphylococcus aureus subsp. aureus N315
gcuaaugcaacuaaaacuau

SEQ ID NO: 4067112 - RNA, 23 nt, Staphylococcus aureus subsp. aureus N315
gcuaaugcaacuaaaacuaucug

SEQ ID NO: 4067113 - RNA, 23 nt, Staphylococcus aureus subsp. aureus N315
gcuaaugcauuauuauaauagcu

SEQ ID NO: 4067114 - RNA, 17 nt, Staphylococcus aureus subsp. aureus N315
gcuaauuucuaauacau

SEQ ID NO: 4067115 - RNA, 21 nt, Staphylococcus aureus subsp. aureus N315
gcuaauuuuuucaucauucaa

SEQ ID NO: 4067116 - RNA, 19 nt, Staphylococcus aureus subsp. aureus N315
gcuacaaagucauuuucau

SEQ ID NO: 4067117 - RNA, 23 nt, Staphylococcus aureus subsp. aureus N315
gcuacaaagucauuuucauucag

SEQ ID NO: 4067118 - RNA, 23 nt, Staphylococcus aureus subsp. aureus N315
gcuaccuacuuguucaauacuuc

SEQ ID NO: 4067119 - RNA, 19 nt, Staphylococcus aureus subsp. aureus N315
gcuacuugaauaccuuuua

SEQ ID NO: 4067120 - RNA, 22 nt, Staphylococcus aureus subsp. aureus N315
gcuagauuuuaaacgcucauca

SEQ ID NO: 4067121 - RNA, 22 nt, Staphylococcus aureus subsp. aureus N315
gcuagcauaucuuuaucauuau

SEQ ID NO: 4067122 - RNA, 18 nt, Staphylococcus aureus subsp. aureus N315
gcuagggugaauuaguaa

SEQ ID NO: 4067123 - RNA, 15 nt, Staphylococcus aureus subsp. aureus N315
gcuuguaaaauuuuc

SEQ ID NO: 4067124 - RNA, 21 nt, Staphylococcus aureus subsp. aureus N315
gcuuguaacaagcuuuucauu

SEQ ID NO: 4067125 - RNA, 22 nt, Staphylococcus aureus subsp. aureus N315
gcuuguacaaaaaauuguaagu

SEQ ID NO: 4067126 - RNA, 15 nt, Staphylococcus aureus subsp. aureus N315
gcuugugugaaauua

SEQ ID NO: 4067127 - RNA, 13 nt, Staphylococcus aureus subsp. aureus N315
gcuuguucaacua

SEQ ID NO: 4067128 - RNA, 19 nt, Staphylococcus aureus subsp. aureus N315
gcuuguucaacuaaauuuu

SEQ ID NO: 4067129 - RNA, 17 nt, Staphylococcus aureus subsp. aureus N315
gcuuguugucacgauca

SEQ ID NO: 4067130 - RNA, 15 nt, Staphylococcus aureus subsp. aureus N315
gcuuuaauaaaucgu

SEQ ID NO: 4067131 - RNA, 13 nt, Staphylococcus aureus subsp. aureus N315
gcuuuaauauaau

SEQ ID NO: 4067132 - RNA, 13 nt, Staphylococcus aureus subsp. aureus N315
gcuuuaauuaaag

SEQ ID NO: 4067133 - RNA, 16 nt, Staphylococcus aureus subsp. aureus N315
gcuuuagcaauugaau

SEQ ID NO: 4067134 - RNA, 16 nt, Staphylococcus aureus subsp. aureus N315
gcuuuagcucuuuuuu

SEQ ID NO: 4067135 - RNA, 20 nt, Staphylococcus aureus subsp. aureus N315
gcuuuaguaguguauucauu

SEQ ID NO: 4067136 - RNA, 19 nt, Staphylococcus aureus subsp. aureus N315
gcuuuagucgguguuuucu

SEQ ID NO: 4067137 - RNA, 15 nt, Staphylococcus aureus subsp. aureus N315
gcuuuauuuuaucau

SEQ ID NO: 4067138 - RNA, 23 nt, Staphylococcus aureus subsp. aureus N315
gcuuuauuuucuuguguauuuuu

SEQ ID NO: 4067139 - RNA, 16 nt, Staphylococcus aureus subsp. aureus N315
gcuuucguuucuuuua

SEQ ID NO: 4067140 - RNA, 20 nt, Staphylococcus aureus subsp. aureus N315
gcuuucuuuuucaucuuuca

SEQ ID NO: 4067141 - RNA, 23 nt, Staphylococcus aureus subsp. aureus N315
gcuuucuuuuuugcuguauauau

SEQ ID NO: 4067142 - RNA, 19 nt, Staphylococcus aureus subsp. aureus N315
gcuuugaagggagcauuuc

SEQ ID NO: 4067143 - RNA, 21 nt, Staphylococcus aureus subsp. aureus N315
gcuuugcauacauaucuuuug

SEQ ID NO: 4067144 - RNA, 17 nt, Staphylococcus aureus subsp. aureus N315
gcuuuggauuucuuuuu

SEQ ID NO: 4067145 - RNA, 20 nt, Staphylococcus aureus subsp. aureus N315
gcuuuguuuuucacuguuaa

SEQ ID NO: 4067146 - RNA, 20 nt, Staphylococcus aureus subsp. aureus N315
gcuuuuaauauuauaaaccu

SEQ ID NO: 4067147 - RNA, 18 nt, Staphylococcus aureus subsp. aureus N315
gcuuuuaugcaugcgcaa

SEQ ID NO: 4067148 - RNA, 18 nt, Staphylococcus aureus subsp. aureus N315
gcuuuuccauaaauauuu

SEQ ID NO: 4067149 - RNA, 13 nt, Staphylococcus aureus subsp. aureus N315
gcuuuuuaaaaaa

SEQ ID NO: 4067150 - RNA, 15 nt, Staphylococcus aureus subsp. aureus N315
gcuuuuuauuuuguu

SEQ ID NO: 4067151 - RNA, 20 nt, Staphylococcus aureus subsp. aureus N315
gcuuuuuauuuuguuuaucu

SEQ ID NO: 4067152 - RNA, 15 nt, Staphylococcus aureus subsp. aureus N315
gcuuuuucaaauaau

SEQ ID NO: 4067153 - RNA, 18 nt, Staphylococcus aureus subsp. aureus N315
gcuuuuucuacaccuaca

SEQ ID NO: 4067154 - RNA, 14 nt, Staphylococcus aureus subsp. aureus N315
gcuuuuucuuucuc

SEQ ID NO: 4067155 - RNA, 16 nt, Staphylococcus aureus subsp. aureus N315
gcuuuuucuuucucua

SEQ ID NO: 4067156 - RNA, 12 nt, Staphylococcus aureus subsp. aureus N315
gcuuuuuguuuu

SEQ ID NO: 4067157 - RNA, 21 nt, Staphylococcus aureus subsp. aureus N315
gcuuuuuuaaauuuaauuucg

SEQ ID NO: 4067158 - RNA, 16 nt, Staphylococcus aureus subsp. aureus N315
gcuuuuuuaccagcau

SEQ ID NO: 4067159 - RNA, 15 nt, Staphylococcus aureus subsp. aureus N315
gcuuuuuuuacaaua

SEQ ID NO: 4067160 - RNA, 17 nt, Staphylococcus aureus subsp. aureus N315
gcuuuuuuuauggugug

SEQ ID NO: 4067161 - RNA, 22 nt, Staphylococcus aureus subsp. aureus N315
ggaaaauuauuugauauuucau

SEQ ID NO: 4067162 - RNA, 13 nt, Staphylococcus aureus subsp. aureus N315
ggaaagaugggau

SEQ ID NO: 4067163 - RNA, 17 nt, Staphylococcus aureus subsp. aureus N315
ggaaaguaauaaguaau

SEQ ID NO: 4067164 - RNA, 15 nt, Staphylococcus aureus subsp. aureus N315
ggaaauaaaaaauaa

SEQ ID NO: 4067165 - RNA, 16 nt, Staphylococcus aureus subsp. aureus N315
ggaaauaucuuacugc

SEQ ID NO: 4067166 - RNA, 17 nt, Staphylococcus aureus subsp. aureus N315
ggaaauauuccuuacua

SEQ ID NO: 4067167 - RNA, 16 nt, Staphylococcus aureus subsp. aureus N315
ggaaaucaguaauauc

SEQ ID NO: 4067168 - RNA, 15 nt, Staphylococcus aureus subsp. aureus N315
ggaaauuuauuauaa

SEQ ID NO: 4067169 - RNA, 22 nt, Staphylococcus aureus subsp. aureus N315
ggaacuacuacauuauuacuga

SEQ ID NO: 4067170 - RNA, 12 nt, Staphylococcus aureus subsp. aureus N315
ggaagaacagca

SEQ ID NO: 4067171 - RNA, 17 nt, Staphylococcus aureus subsp. aureus N315
ggaagauaggauuuaca

SEQ ID NO: 4067172 - RNA, 14 nt, Staphylococcus aureus subsp. aureus N315
ggaagcgucuuuuu

SEQ ID NO: 4067173 - RNA, 16 nt, Staphylococcus aureus subsp. aureus N315
ggaauaccuuuuucua

SEQ ID NO: 4067174 - RNA, 21 nt, Staphylococcus aureus subsp. aureus N315
ggaauagauguugaugaagua

SEQ ID NO: 4067175 - RNA, 19 nt, Staphylococcus aureus subsp. aureus N315
ggaauauuaacaccagaua

SEQ ID NO: 4067176 - RNA, 20 nt, Staphylococcus aureus subsp. aureus N315
ggaauauuucccuaugaaau

SEQ ID NO: 4067177 - RNA, 21 nt, Staphylococcus aureus subsp. aureus N315
ggaauuguuaauuucaacauu

SEQ ID NO: 4067178 - RNA, 20 nt, Staphylococcus aureus subsp. aureus N315
ggaauuuuuaugcauuauag

SEQ ID NO: 4067179 - RNA, 11 nt, Staphylococcus aureus subsp. aureus N315
ggacaauguag

SEQ ID NO: 4067180 - RNA, 18 nt, Staphylococcus aureus subsp. aureus N315
ggacuaacgucauuauau

SEQ ID NO: 4067181 - RNA, 14 nt, Staphylococcus aureus subsp. aureus N315
ggagauuagagaag

SEQ ID NO: 4067182 - RNA, 16 nt, Staphylococcus aureus subsp. aureus N315
ggagauuagagaagaa

SEQ ID NO: 4067183 - RNA, 17 nt, Staphylococcus aureus subsp. aureus N315
ggagcacuaucuuuugc

SEQ ID NO: 4067184 - RNA, 15 nt, Staphylococcus aureus subsp. aureus N315
ggagcauuucauuag

SEQ ID NO: 4067185 - RNA, 15 nt, Staphylococcus aureus subsp. aureus N315
ggaguaucuguuucu

SEQ ID NO: 4067186 - RNA, 23 nt, Staphylococcus aureus subsp. aureus N315
ggaguauuuuugcguuaauaauu

SEQ ID NO: 4067187 - RNA, 13 nt, Staphylococcus aureus subsp. aureus N315
ggauaaaaauuua

SEQ ID NO: 4067188 - RNA, 13 nt, Staphylococcus aureus subsp. aureus N315
ggauaagaacgag

SEQ ID NO: 4067189 - RNA, 14 nt, Staphylococcus aureus subsp. aureus N315
ggauaauuuuauug

SEQ ID NO: 4067190 - RNA, 13 nt, Staphylococcus aureus subsp. aureus N315
ggauaucuuuguu

SEQ ID NO: 4067191 - RNA, 23 nt, Staphylococcus aureus subsp. aureus N315
ggauauuuuuuaauaaucaaacc

SEQ ID NO: 4067192 - RNA, 19 nt, Staphylococcus aureus subsp. aureus N315
ggaucacguuuuucuuuaa

SEQ ID NO: 4067193 - RNA, 19 nt, Staphylococcus aureus subsp. aureus N315
ggaucauuauuuagaauuc

SEQ ID NO: 4067194 - RNA, 16 nt, Staphylococcus aureus subsp. aureus N315
ggauguaauagagaag

SEQ ID NO: 4067195 - RNA, 16 nt, Staphylococcus aureus subsp. aureus N315
ggaugugacaaauacu

SEQ ID NO: 4067196 - RNA, 16 nt, Staphylococcus aureus subsp. aureus N315
ggauguuuucguuugc

SEQ ID NO: 4067197 - RNA, 19 nt, Staphylococcus aureus subsp. aureus N315
ggauuaaaagcaucuuuaa

SEQ ID NO: 4067198 - RNA, 15 nt, Staphylococcus aureus subsp. aureus N315
ggauuaucuguaauu

SEQ ID NO: 4067199 - RNA, 17 nt, Staphylococcus aureus subsp. aureus N315
ggauugaaaaaagcuag

SEQ ID NO: 4067200 - RNA, 19 nt, Staphylococcus aureus subsp. aureus N315
ggauuucuuauuuguaauu

SEQ ID NO: 4067201 - RNA, 17 nt, Staphylococcus aureus subsp. aureus N315
ggauuuuuacaaaguga

SEQ ID NO: 4067202 - RNA, 23 nt, Staphylococcus aureus subsp. aureus N315
ggcaaaaaaggaugaugugaaug

SEQ ID NO: 4067203 - RNA, 15 nt, Staphylococcus aureus subsp. aureus N315
ggcaaagucauuaaa

SEQ ID NO: 4067204 - RNA, 13 nt, Staphylococcus aureus subsp. aureus N315
ggcaaaucaaaca

SEQ ID NO: 4067205 - RNA, 14 nt, Staphylococcus aureus subsp. aureus N315
ggcaaauucaacuu

SEQ ID NO: 4067206 - RNA, 21 nt, Staphylococcus aureus subsp. aureus N315
ggcaacaacuuuucauauaaa

SEQ ID NO: 4067207 - RNA, 16 nt, Staphylococcus aureus subsp. aureus N315
ggcaauagcaccauac

SEQ ID NO: 4067208 - RNA, 14 nt, Staphylococcus aureus subsp. aureus N315
ggcaauauacuuuu

SEQ ID NO: 4067209 - RNA, 17 nt, Staphylococcus aureus subsp. aureus N315
ggcaaucuauauaaaug

SEQ ID NO: 4067210 - RNA, 15 nt, Staphylococcus aureus subsp. aureus N315
ggcaaugaaauuacc

SEQ ID NO: 4067211 - RNA, 15 nt, Staphylococcus aureus subsp. aureus N315
guaaaacugcaauaa

SEQ ID NO: 4067212 - RNA, 14 nt, Staphylococcus aureus subsp. aureus N315
guaaaauaaaucau

SEQ ID NO: 4067213 - RNA, 21 nt, Staphylococcus aureus subsp. aureus N315
guaaaaugcucccuucaaagu

SEQ ID NO: 4067214 - RNA, 14 nt, Staphylococcus aureus subsp. aureus N315
guaaaauuaaaugc

SEQ ID NO: 4067215 - RNA, 14 nt, Staphylococcus aureus subsp. aureus N315
guaaaauucuauaa

SEQ ID NO: 4067216 - RNA, 21 nt, Staphylococcus aureus subsp. aureus N315
guaaaauucuauaaauagaau

SEQ ID NO: 4067217 - RNA, 23 nt, Staphylococcus aureus subsp. aureus N315
guaaaauuuucguguuaauaacc

SEQ ID NO: 4067218 - RNA, 23 nt, Staphylococcus aureus subsp. aureus N315
guaaacaacaucgauuuaucauu

SEQ ID NO: 4067219 - RNA, 17 nt, Staphylococcus aureus subsp. aureus N315
guaaacauaaugacauc

SEQ ID NO: 4067220 - RNA, 23 nt, Staphylococcus aureus subsp. aureus N315
guaaaccgaggugucaauaaauu

SEQ ID NO: 4067221 - RNA, 19 nt, Staphylococcus aureus subsp. aureus N315
guaaacggaauaacuuuuu

SEQ ID NO: 4067222 - RNA, 22 nt, Staphylococcus aureus subsp. aureus N315
guaaagaguacagcgguuugua

SEQ ID NO: 4067223 - RNA, 14 nt, Staphylococcus aureus subsp. aureus N315
guaaaggugauauu

SEQ ID NO: 4067224 - RNA, 13 nt, Staphylococcus aureus subsp. aureus N315
guaaaucaucaua

SEQ ID NO: 4067225 - RNA, 14 nt, Staphylococcus aureus subsp. aureus N315
guaaaucaugacau

SEQ ID NO: 4067226 - RNA, 21 nt, Staphylococcus aureus subsp. aureus N315
guaaauccuuuauauucuaau

SEQ ID NO: 4067227 - RNA, 21 nt, Staphylococcus aureus subsp. aureus N315
guaaaucgugcuguuaucaug

SEQ ID NO: 4067228 - RNA, 20 nt, Staphylococcus aureus subsp. aureus N315
guaaaucuuguuggauuuua

SEQ ID NO: 4067229 - RNA, 17 nt, Staphylococcus aureus subsp. aureus N315
guaaauuuaaaauaaua

SEQ ID NO: 4067230 - RNA, 12 nt, Staphylococcus aureus subsp. aureus N315
guaaauuuaaau

SEQ ID NO: 4067231 - RNA, 17 nt, Staphylococcus aureus subsp. aureus N315
guaaauuuaucauuuua

SEQ ID NO: 4067232 - RNA, 19 nt, Staphylococcus aureus subsp. aureus N315
guaaauuuuaucuaaacau

SEQ ID NO: 4067233 - RNA, 22 nt, Staphylococcus aureus subsp. aureus N315
guaacaagcauuuuucaauuau

SEQ ID NO: 4067234 - RNA, 18 nt, Staphylococcus aureus subsp. aureus N315
guaacaauuuagcaaaua

SEQ ID NO: 4067235 - RNA, 23 nt, Staphylococcus aureus subsp. aureus N315
guaacauaaagcuguuuauuggu

SEQ ID NO: 4067236 - RNA, 15 nt, Staphylococcus aureus subsp. aureus N315
guaacauaucagcuu

SEQ ID NO: 4067237 - RNA, 17 nt, Staphylococcus aureus subsp. aureus N315
guaacauaucagcuuuu

SEQ ID NO: 4067238 - RNA, 16 nt, Staphylococcus aureus subsp. aureus N315
guaacauuaaaaauaa

SEQ ID NO: 4067239 - RNA, 18 nt, Staphylococcus aureus subsp. aureus N315
guaacauuuaaaaaaugc

SEQ ID NO: 4067240 - RNA, 15 nt, Staphylococcus aureus subsp. aureus N315
guaaccuuaaauaua

SEQ ID NO: 4067241 - RNA, 15 nt, Staphylococcus aureus subsp. aureus N315
guaacgcgcaaugag

SEQ ID NO: 4067242 - RNA, 14 nt, Staphylococcus aureus subsp. aureus N315
guaacuaaaauguc

SEQ ID NO: 4067243 - RNA, 15 nt, Staphylococcus aureus subsp. aureus N315
guaacuaaaaugucu

SEQ ID NO: 4067244 - RNA, 13 nt, Staphylococcus aureus subsp. aureus N315
guaacugauuuug

SEQ ID NO: 4067245 - RNA, 19 nt, Staphylococcus aureus subsp. aureus N315
guaagaccccgaaaagagg

SEQ ID NO: 4067246 - RNA, 16 nt, Staphylococcus aureus subsp. aureus N315
guaagauaauuuucaa

SEQ ID NO: 4067247 - RNA, 21 nt, Staphylococcus aureus subsp. aureus N315
guaagcuucuguguuggggcc

SEQ ID NO: 4067248 - RNA, 20 nt, Staphylococcus aureus subsp. aureus N315
guaagguggacuucuaucuu

SEQ ID NO: 4067249 - RNA, 21 nt, Staphylococcus aureus subsp. aureus N315
guaaguaaaauaaaaaaugca

SEQ ID NO: 4067250 - RNA, 16 nt, Staphylococcus aureus subsp. aureus N315
guaaguagaagcaaaa

SEQ ID NO: 4067251 - RNA, 17 nt, Staphylococcus aureus subsp. aureus N315
guaaguagaagcaaaag

SEQ ID NO: 4067252 - RNA, 16 nt, Staphylococcus aureus subsp. aureus N315
guaauaaguaauaauu

SEQ ID NO: 4067253 - RNA, 16 nt, Staphylococcus aureus subsp. aureus N315
guaauaauauaaauaa

SEQ ID NO: 4067254 - RNA, 14 nt, Staphylococcus aureus subsp. aureus N315
guaauaauuauuaa

SEQ ID NO: 4067255 - RNA, 14 nt, Staphylococcus aureus subsp. aureus N315
guaauaauuuacag

SEQ ID NO: 4067256 - RNA, 21 nt, Staphylococcus aureus subsp. aureus N315
guaauacaagcaauacgauug

SEQ ID NO: 4067257 - RNA, 19 nt, Staphylococcus aureus subsp. aureus N315
guaauaccuuuacuuucau

SEQ ID NO: 4067258 - RNA, 21 nt, Staphylococcus aureus subsp. aureus N315
guaauacuauaugaaaagaga

SEQ ID NO: 4067259 - RNA, 21 nt, Staphylococcus aureus subsp. aureus N315
guaauagaacgaaauaguuca

SEQ ID NO: 4067260 - RNA, 15 nt, Staphylococcus aureus subsp. aureus N315
guaauauauaaaagu

SEQ ID NO: 4067261 - RNA, 19 nt, Staphylococcus aureus subsp. aureus N315
guaauauguugcuuaucaa

SEQ ID NO: 4067262 - RNA, 19 nt, Staphylococcus aureus subsp. aureus N315
guaauauuuuuguugcaau

SEQ ID NO: 4067263 - RNA, 20 nt, Staphylococcus aureus subsp. aureus N315
guaauauuuuuguugcaauu

SEQ ID NO: 4067264 - RNA, 16 nt, Staphylococcus aureus subsp. aureus N315
guaaucauaccagcaa

SEQ ID NO: 4067265 - RNA, 23 nt, Staphylococcus aureus subsp. aureus N315
guaaucauuauagcagguggcau

SEQ ID NO: 4067266 - RNA, 23 nt, Staphylococcus aureus subsp. aureus N315
guaaucgauugguaaaucuacua

SEQ ID NO: 4067267 - RNA, 11 nt, Staphylococcus aureus subsp. aureus N315
guaaucuauuu

SEQ ID NO: 4067268 - RNA, 14 nt, Staphylococcus aureus subsp. aureus N315
guaaucuauuuucu

SEQ ID NO: 4067269 - RNA, 18 nt, Staphylococcus aureus subsp. aureus N315
guaaugaagauuuuguug

SEQ ID NO: 4067270 - RNA, 13 nt, Staphylococcus aureus subsp. aureus N315
guaaugauacgca

SEQ ID NO: 4067271 - RNA, 16 nt, Staphylococcus aureus subsp. aureus N315
guaaugauuuugcuuu

SEQ ID NO: 4067272 - RNA, 17 nt, Staphylococcus aureus subsp. aureus N315
guaaugccauuaauggu

SEQ ID NO: 4067273 - RNA, 16 nt, Staphylococcus aureus subsp. aureus N315
guaaugcuuaaaaaca

SEQ ID NO: 4067274 - RNA, 23 nt, Staphylococcus aureus subsp. aureus N315
guaaugcuuaaaaacaauauuga

SEQ ID NO: 4067275 - RNA, 16 nt, Staphylococcus aureus subsp. aureus N315
guaaugcuugagcuuu

SEQ ID NO: 4067276 - RNA, 13 nt, Staphylococcus aureus subsp. aureus N315
guaauuaaauacu

SEQ ID NO: 4067277 - RNA, 13 nt, Staphylococcus aureus subsp. aureus N315
guaauuaauacau

SEQ ID NO: 4067278 - RNA, 14 nt, Staphylococcus aureus subsp. aureus N315
guaauuauuauaau

SEQ ID NO: 4067279 - RNA, 23 nt, Staphylococcus aureus subsp. aureus N315
guaauuauuuuucucaacaguuu

SEQ ID NO: 4067280 - RNA, 21 nt, Staphylococcus aureus subsp. aureus N315
guaauucaccaucauauucaa

SEQ ID NO: 4067281 - RNA, 12 nt, Staphylococcus aureus subsp. aureus N315
guaauuguuaua

SEQ ID NO: 4067282 - RNA, 22 nt, Staphylococcus aureus subsp. aureus N315
guaauuguuauaaguaaauaau

SEQ ID NO: 4067283 - RNA, 16 nt, Staphylococcus aureus subsp. aureus N315
guaauuuaaaauaguu

SEQ ID NO: 4067284 - RNA, 12 nt, Staphylococcus aureus subsp. aureus N315
guaauuuuaaug

SEQ ID NO: 4067285 - RNA, 17 nt, Staphylococcus aureus subsp. aureus N315
guaauuuuuaaaucuac

SEQ ID NO: 4067286 - RNA, 19 nt, Staphylococcus aureus subsp. aureus N315
guacaauuuuuaaaaaccu

SEQ ID NO: 4067287 - RNA, 18 nt, Staphylococcus aureus subsp. aureus N315
guacaguuacuuucgcuu

SEQ ID NO: 4067288 - RNA, 17 nt, Staphylococcus aureus subsp. aureus N315
guacauaaaugcuaaaa

SEQ ID NO: 4067289 - RNA, 14 nt, Staphylococcus aureus subsp. aureus N315
guacauauaauaug

SEQ ID NO: 4067290 - RNA, 17 nt, Staphylococcus aureus subsp. aureus N315
guacauauguuguuucu

SEQ ID NO: 4067291 - RNA, 18 nt, Staphylococcus aureus subsp. aureus N315
guacauccacuuuauaau

SEQ ID NO: 4067292 - RNA, 11 nt, Staphylococcus aureus subsp. aureus N315
guacauguauu

SEQ ID NO: 4067293 - RNA, 16 nt, Staphylococcus aureus subsp. aureus N315
guacauguauuggcca

SEQ ID NO: 4067294 - RNA, 24 nt, Staphylococcus aureus subsp. aureus N315
guacauuuaauggucuaauaucaa

SEQ ID NO: 4067295 - RNA, 16 nt, Staphylococcus aureus subsp. aureus N315
guacauuuauuuucaa

SEQ ID NO: 4067296 - RNA, 22 nt, Staphylococcus aureus subsp. aureus N315
guacauuuauuuucaauaaaua

SEQ ID NO: 4067297 - RNA, 13 nt, Staphylococcus aureus subsp. aureus N315
guaccaagcuuca

SEQ ID NO: 4067298 - RNA, 15 nt, Staphylococcus aureus subsp. aureus N315
guaccaauuagcaug

SEQ ID NO: 4067299 - RNA, 13 nt, Staphylococcus aureus subsp. aureus N315
guauggauguauu

SEQ ID NO: 4067300 - RNA, 22 nt, Staphylococcus aureus subsp. aureus N315
guauuacacgcauuacuuuaga

SEQ ID NO: 4067301 - RNA, 21 nt, Staphylococcus aureus subsp. aureus N315
guauuagccaauaaaauguca

SEQ ID NO: 4067302 - RNA, 20 nt, Staphylococcus aureus subsp. aureus N315
guauuauuauaauuuuguuu

SEQ ID NO: 4067303 - RNA, 15 nt, Staphylococcus aureus subsp. aureus N315
guauucaaaaaauau

SEQ ID NO: 4067304 - RNA, 22 nt, Staphylococcus aureus subsp. aureus N315
guauucaaauaaacacaucuau

SEQ ID NO: 4067305 - RNA, 19 nt, Staphylococcus aureus subsp. aureus N315
guauucuuggcguauuuuu

SEQ ID NO: 4067306 - RNA, 12 nt, Staphylococcus aureus subsp. aureus N315
guauugauucaa

SEQ ID NO: 4067307 - RNA, 21 nt, Staphylococcus aureus subsp. aureus N315
guauugcauguuuaaauauca

SEQ ID NO: 4067308 - RNA, 19 nt, Staphylococcus aureus subsp. aureus N315
guauugccguuauuuucaa

SEQ ID NO: 4067309 - RNA, 18 nt, Staphylococcus aureus subsp. aureus N315
guauuguccauagauaca

SEQ ID NO: 4067310 - RNA, 14 nt, Staphylococcus aureus subsp. aureus N315
guauuuaauguuuu

SEQ ID NO: 4067311 - RNA, 16 nt, Staphylococcus aureus subsp. aureus N315
guauuuaccuucuucu

SEQ ID NO: 4067312 - RNA, 13 nt, Staphylococcus aureus subsp. aureus N315
guauuuacuuuuc

SEQ ID NO: 4067313 - RNA, 18 nt, Staphylococcus aureus subsp. aureus N315
guauuuauacuauaaaua

SEQ ID NO: 4067314 - RNA, 22 nt, Staphylococcus aureus subsp. aureus N315
guauuucugaaaugauacauua

SEQ ID NO: 4067315 - RNA, 20 nt, Staphylococcus aureus subsp. aureus N315
guauuuuaaugauuuuucau

SEQ ID NO: 4067316 - RNA, 14 nt, Staphylococcus aureus subsp. aureus N315
guauuuuauuuauu

SEQ ID NO: 4067317 - RNA, 20 nt, Staphylococcus aureus subsp. aureus N315
guauuuugcgcuucuaguag

SEQ ID NO: 4067318 - RNA, 15 nt, Staphylococcus aureus subsp. aureus N315
guauuuuuauuuaua

SEQ ID NO: 4067319 - RNA, 23 nt, Staphylococcus aureus subsp. aureus N315
guauuuuucuuaauuaucauuac

SEQ ID NO: 4067320 - RNA, 19 nt, Staphylococcus aureus subsp. aureus N315
gucaacuacugucaauaua

SEQ ID NO: 4067321 - RNA, 12 nt, Staphylococcus aureus subsp. aureus N315
gucaacugcugc

SEQ ID NO: 4067322 - RNA, 21 nt, Staphylococcus aureus subsp. aureus N315
gucaacuuuuuuaacuuuaac

SEQ ID NO: 4067323 - RNA, 17 nt, Staphylococcus aureus subsp. aureus N315
gucaauaauuuuaucua

SEQ ID NO: 4067324 - RNA, 19 nt, Staphylococcus aureus subsp. aureus N315
gucaauuucuuuaaagucu

SEQ ID NO: 4067325 - RNA, 22 nt, Staphylococcus aureus subsp. aureus N315
gucaauuuuaccauguuuuaca

SEQ ID NO: 4067326 - RNA, 20 nt, Staphylococcus aureus subsp. aureus N315
gucaauuuuuucaugauuua

SEQ ID NO: 4067327 - RNA, 18 nt, Staphylococcus aureus subsp. aureus N315
gucacauguaccacauuu

SEQ ID NO: 4067328 - RNA, 20 nt, Staphylococcus aureus subsp. aureus N315
gucaccuucuauauugggac

SEQ ID NO: 4067329 - RNA, 22 nt, Staphylococcus aureus subsp. aureus N315
gucacgaucaaauuuaauaaua

SEQ ID NO: 4067330 - RNA, 20 nt, Staphylococcus aureus subsp. aureus N315
gucagcauucauagcugcuu

SEQ ID NO: 4067331 - RNA, 15 nt, Staphylococcus aureus subsp. aureus N315
gucagcuuacaauaa

SEQ ID NO: 4067332 - RNA, 16 nt, Staphylococcus aureus subsp. aureus N315
gucaggggccccaaca

SEQ ID NO: 4067333 - RNA, 20 nt, Staphylococcus aureus subsp. aureus N315
gucaggggccccaacacaga

SEQ ID NO: 4067334 - RNA, 23 nt, Staphylococcus aureus subsp. aureus N315
gucaggggccccaacacagagaa

SEQ ID NO: 4067335 - RNA, 14 nt, Staphylococcus aureus subsp. aureus N315
gucaguaaaaauac

SEQ ID NO: 4067336 - RNA, 13 nt, Staphylococcus aureus subsp. aureus N315
gucauaaaauacc

SEQ ID NO: 4067337 - RNA, 15 nt, Staphylococcus aureus subsp. aureus N315
gucauaaaauaccag

SEQ ID NO: 4067338 - RNA, 17 nt, Staphylococcus aureus subsp. aureus N315
gucauaaugaacgauau

SEQ ID NO: 4067339 - RNA, 14 nt, Staphylococcus aureus subsp. aureus N315
gucauaauuuaaaa

SEQ ID NO: 4067340 - RNA, 22 nt, Staphylococcus aureus subsp. aureus N315
gucauaauuuaaaagauuagau

SEQ ID NO: 4067341 - RNA, 21 nt, Staphylococcus aureus subsp. aureus N315
gucauacgcaaugauuauaaa

SEQ ID NO: 4067342 - RNA, 15 nt, Staphylococcus aureus subsp. aureus N315
gucauacuaacuaua

SEQ ID NO: 4067343 - RNA, 23 nt, Staphylococcus aureus subsp. aureus N315
gucaucaaaaguuuguauauucu

SEQ ID NO: 4067344 - RNA, 11 nt, Staphylococcus aureus subsp. aureus N315
gucaucaacac

SEQ ID NO: 4067345 - RNA, 14 nt, Staphylococcus aureus subsp. aureus N315
gucaucaacacaca

SEQ ID NO: 4067346 - RNA, 18 nt, Staphylococcus aureus subsp. aureus N315
gucaucaccuuguuaaaa

SEQ ID NO: 4067347 - RNA, 21 nt, Staphylococcus aureus subsp. aureus N315
gucaucaccuuguuaaaauaa

SEQ ID NO: 4067348 - RNA, 17 nt, Staphylococcus aureus subsp. aureus N315
gucaucuggaauaccua

SEQ ID NO: 4067349 - RNA, 16 nt, Staphylococcus aureus subsp. aureus N315
gucaucuguuaauuca

SEQ ID NO: 4067350 - RNA, 22 nt, Staphylococcus aureus subsp. aureus N315
gucaucuucaauucuuacaccu

SEQ ID NO: 4067351 - RNA, 19 nt, Staphylococcus aureus subsp. aureus N315
gucaucuugagauuuucaa

SEQ ID NO: 4067352 - RNA, 16 nt, Staphylococcus aureus subsp. aureus N315
gucaucuuucaacgca

SEQ ID NO: 4067353 - RNA, 20 nt, Staphylococcus aureus subsp. aureus N315
gucauguguucaaauaacgc

SEQ ID NO: 4067354 - RNA, 14 nt, Staphylococcus aureus subsp. aureus N315
gucauuucaaucau

SEQ ID NO: 4067355 - RNA, 20 nt, Staphylococcus aureus subsp. aureus N315
gucauuuguuguuauuauaa

SEQ ID NO: 4067356 - RNA, 14 nt, Staphylococcus aureus subsp. aureus N315
guccaauaaugaaa

SEQ ID NO: 4067357 - RNA, 15 nt, Staphylococcus aureus subsp. aureus N315
guccaauaaugaaau

SEQ ID NO: 4067358 - RNA, 13 nt, Staphylococcus aureus subsp. aureus N315
guccaccaacuuu

SEQ ID NO: 4067359 - RNA, 23 nt, Staphylococcus aureus subsp. aureus N315
guccagcuaauaacgcugcaccu

SEQ ID NO: 4067360 - RNA, 20 nt, Staphylococcus aureus subsp. aureus N315
guccauaaucuuuauuaaua

SEQ ID NO: 4067361 - RNA, 17 nt, Staphylococcus aureus subsp. aureus N315
guccauuuccaugaaua

SEQ ID NO: 4067362 - RNA, 22 nt, Staphylococcus aureus subsp. aureus N315
gucccagauucauaucuuucaa

SEQ ID NO: 4067363 - RNA, 19 nt, Staphylococcus aureus subsp. aureus N315
gucccauaaggaaccuguc

SEQ ID NO: 4067364 - RNA, 15 nt, Staphylococcus aureus subsp. aureus N315
guccgacuugauaaa

SEQ ID NO: 4067365 - RNA, 19 nt, Staphylococcus aureus subsp. aureus N315
guccgacuugauaaaaaau

SEQ ID NO: 4067366 - RNA, 17 nt, Staphylococcus aureus subsp. aureus N315
guccgcuuuuucauaga

SEQ ID NO: 4067367 - RNA, 14 nt, Staphylococcus aureus subsp. aureus N315
guccucuaaaacau

SEQ ID NO: 4067368 - RNA, 15 nt, Staphylococcus aureus subsp. aureus N315
guccuguacauccac

SEQ ID NO: 4067369 - RNA, 11 nt, Staphylococcus aureus subsp. aureus N315
guccuucccac

SEQ ID NO: 4067370 - RNA, 16 nt, Staphylococcus aureus subsp. aureus N315
gucgaaaauagcuauu

SEQ ID NO: 4067371 - RNA, 20 nt, Staphylococcus aureus subsp. aureus N315
gucgaaaauagcuauuaaaa

SEQ ID NO: 4067372 - RNA, 22 nt, Staphylococcus aureus subsp. aureus N315
gucgaaaauagcuauuaaaaua

SEQ ID NO: 4067373 - RNA, 19 nt, Staphylococcus aureus subsp. aureus N315
gucgaagaagauuaugaaa

SEQ ID NO: 4067374 - RNA, 17 nt, Staphylococcus aureus subsp. aureus N315
gucgaauauaauuuuuu

SEQ ID NO: 4067375 - RNA, 15 nt, Staphylococcus aureus subsp. aureus N315
gucgaauguuucuuc

SEQ ID NO: 4067376 - RNA, 22 nt, Staphylococcus aureus subsp. aureus N315
gucgauaaauaugauguuaaaa

SEQ ID NO: 4067377 - RNA, 15 nt, Staphylococcus aureus subsp. aureus N315
gucguacuuucaaau

SEQ ID NO: 4067378 - RNA, 16 nt, Staphylococcus aureus subsp. aureus N315
gucguuguaaaacuaa

SEQ ID NO: 4067379 - RNA, 22 nt, Staphylococcus aureus subsp. aureus N315
gucguuuagacucaguugugcg

SEQ ID NO: 4067380 - RNA, 17 nt, Staphylococcus aureus subsp. aureus N315
gucuaaagcuuauuaaa

SEQ ID NO: 4067381 - RNA, 13 nt, Staphylococcus aureus subsp. aureus N315
gucuaacaguuaa

SEQ ID NO: 4067382 - RNA, 19 nt, Staphylococcus aureus subsp. aureus N315
gucuaauguuggaaaaggu

SEQ ID NO: 4067383 - RNA, 16 nt, Staphylococcus aureus subsp. aureus N315
gucuacuauuuuuucu

SEQ ID NO: 4067384 - RNA, 18 nt, Staphylococcus aureus subsp. aureus N315
gucuagauuuuaaaucaa

SEQ ID NO: 4067385 - RNA, 19 nt, Staphylococcus aureus subsp. aureus N315
gucuaucgccuaaaaauaa

SEQ ID NO: 4067386 - RNA, 20 nt, Staphylococcus aureus subsp. aureus N315
gugugcaggauaacguucac

SEQ ID NO: 4067387 - RNA, 16 nt, Staphylococcus aureus subsp. aureus N315
gugugccggcuuuuuc

SEQ ID NO: 4067388 - RNA, 19 nt, Staphylococcus aureus subsp. aureus N315
guguuaccgauuuagggau

SEQ ID NO: 4067389 - RNA, 17 nt, Staphylococcus aureus subsp. aureus N315
guguuauauuguauuuu

SEQ ID NO: 4067390 - RNA, 24 nt, Staphylococcus aureus subsp. aureus N315
guguucaaauaacgcaaugucuug

SEQ ID NO: 4067391 - RNA, 18 nt, Staphylococcus aureus subsp. aureus N315
guguucgggaauuuuuua

SEQ ID NO: 4067392 - RNA, 19 nt, Staphylococcus aureus subsp. aureus N315
guguuggggcccacacccc

SEQ ID NO: 4067393 - RNA, 13 nt, Staphylococcus aureus subsp. aureus N315
guguuuauuuuua

SEQ ID NO: 4067394 - RNA, 14 nt, Staphylococcus aureus subsp. aureus N315
guguuucuuuuauu

SEQ ID NO: 4067395 - RNA, 19 nt, Staphylococcus aureus subsp. aureus N315
guguuucuuuuauuuucau

SEQ ID NO: 4067396 - RNA, 11 nt, Staphylococcus aureus subsp. aureus N315
guguuugcuuu

SEQ ID NO: 4067397 - RNA, 21 nt, Staphylococcus aureus subsp. aureus N315
guguuuuaauaauaucuuuug

SEQ ID NO: 4067398 - RNA, 20 nt, Staphylococcus aureus subsp. aureus N315
guguuuuuaauguuugcuuu

SEQ ID NO: 4067399 - RNA, 15 nt, Staphylococcus aureus subsp. aureus N315
guguuuuuauuuuua

SEQ ID NO: 4067400 - RNA, 14 nt, Staphylococcus aureus subsp. aureus N315
guuaaaaaauaugu

SEQ ID NO: 4067401 - RNA, 16 nt, Staphylococcus aureus subsp. aureus N315
guuaaaaaauauguau

SEQ ID NO: 4067402 - RNA, 11 nt, Staphylococcus aureus subsp. aureus N315
guuaaaaagac

SEQ ID NO: 4067403 - RNA, 23 nt, Staphylococcus aureus subsp. aureus N315
guuaaaacacccugcuuaucauu

SEQ ID NO: 4067404 - RNA, 16 nt, Staphylococcus aureus subsp. aureus N315
guuaaaaccuuuucaa

SEQ ID NO: 4067405 - RNA, 17 nt, Staphylococcus aureus subsp. aureus N315
guuaaaauaaccauuuu

SEQ ID NO: 4067406 - RNA, 22 nt, Staphylococcus aureus subsp. aureus N315
guuaaaauaaccauuuuuucaa

SEQ ID NO: 4067407 - RNA, 23 nt, Staphylococcus aureus subsp. aureus N315
guuaaaaucgcagcaaugacacu

SEQ ID NO: 4067408 - RNA, 19 nt, Staphylococcus aureus subsp. aureus N315
guuaaacuagaaaacauaa

SEQ ID NO: 4067409 - RNA, 13 nt, Staphylococcus aureus subsp. aureus N315
guuaaauauggau

SEQ ID NO: 4067410 - RNA, 21 nt, Staphylococcus aureus subsp. aureus N315
guuaaauauggaugauauuca

SEQ ID NO: 4067411 - RNA, 22 nt, Staphylococcus aureus subsp. aureus N315
guuaaauauggaugauauucaa

SEQ ID NO: 4067412 - RNA, 21 nt, Staphylococcus aureus subsp. aureus N315
guuaaaucuuuaacuucugau

SEQ ID NO: 4067413 - RNA, 13 nt, Staphylococcus aureus subsp. aureus N315
guuaaauucaucu

SEQ ID NO: 4067414 - RNA, 14 nt, Staphylococcus aureus subsp. aureus N315
guuaaauucuaaaa

SEQ ID NO: 4067415 - RNA, 14 nt, Staphylococcus aureus subsp. aureus N315
guuaacaucuucau

SEQ ID NO: 4067416 - RNA, 19 nt, Staphylococcus aureus subsp. aureus N315
guuaacauuugucauaaua

SEQ ID NO: 4067417 - RNA, 21 nt, Staphylococcus aureus subsp. aureus N315
guuaacauuugucauaauaga

SEQ ID NO: 4067418 - RNA, 14 nt, Staphylococcus aureus subsp. aureus N315
guuaaccauacaua

SEQ ID NO: 4067419 - RNA, 18 nt, Staphylococcus aureus subsp. aureus N315
guuaaguauuuaaauaac

SEQ ID NO: 4067420 - RNA, 19 nt, Staphylococcus aureus subsp. aureus N315
guuaauaacccauuuucaa

SEQ ID NO: 4067421 - RNA, 20 nt, Staphylococcus aureus subsp. aureus N315
guuaauaacccauuuucaaa

SEQ ID NO: 4067422 - RNA, 13 nt, Staphylococcus aureus subsp. aureus N315
guuaauauaauua

SEQ ID NO: 4067423 - RNA, 18 nt, Staphylococcus aureus subsp. aureus N315
guuaauauaauuaaacau

SEQ ID NO: 4067424 - RNA, 21 nt, Staphylococcus aureus subsp. aureus N315
guuaauauaauuaaacauuua

SEQ ID NO: 4067425 - RNA, 19 nt, Staphylococcus aureus subsp. aureus N315
guuaauaucaugcuuaucu

SEQ ID NO: 4067426 - RNA, 14 nt, Staphylococcus aureus subsp. aureus N315
guuaaucaaaauua

SEQ ID NO: 4067427 - RNA, 14 nt, Staphylococcus aureus subsp. aureus N315
guuaaucaacguau

SEQ ID NO: 4067428 - RNA, 23 nt, Staphylococcus aureus subsp. aureus N315
guuaauccgauuuugauauaaaa

SEQ ID NO: 4067429 - RNA, 14 nt, Staphylococcus aureus subsp. aureus N315
guuaauguaaaguu

SEQ ID NO: 4067430 - RNA, 17 nt, Staphylococcus aureus subsp. aureus N315
guuaaugucuuaaaauu

SEQ ID NO: 4067431 - RNA, 12 nt, Staphylococcus aureus subsp. aureus N315
guuaauuauaau

SEQ ID NO: 4067432 - RNA, 23 nt, Staphylococcus aureus subsp. aureus N315
guuaauuuaauaauuaaauauaa

SEQ ID NO: 4067433 - RNA, 12 nt, Staphylococcus aureus subsp. aureus N315
guuaauuuaucg

SEQ ID NO: 4067434 - RNA, 16 nt, Staphylococcus aureus subsp. aureus N315
guuaauuucaacauua

SEQ ID NO: 4067435 - RNA, 18 nt, Staphylococcus aureus subsp. aureus N315
guuacagguuuuaaaauu

SEQ ID NO: 4067436 - RNA, 16 nt, Staphylococcus aureus subsp. aureus N315
guuacauauugcauuu

SEQ ID NO: 4067437 - RNA, 19 nt, Staphylococcus aureus subsp. aureus N315
guuaccaaaauuugaaaua

SEQ ID NO: 4067438 - RNA, 18 nt, Staphylococcus aureus subsp. aureus N315
guuaccaaguaaugauac

SEQ ID NO: 4067439 - RNA, 20 nt, Staphylococcus aureus subsp. aureus N315
guuacucugcgauuucuaaa

SEQ ID NO: 4067440 - RNA, 16 nt, Staphylococcus aureus subsp. aureus N315
guuacuuauauauuca

SEQ ID NO: 4067441 - RNA, 19 nt, Staphylococcus aureus subsp. aureus N315
guuacuuucacauuuucaa

SEQ ID NO: 4067442 - RNA, 20 nt, Staphylococcus aureus subsp. aureus N315
guuagacucacuucuuaaaa

SEQ ID NO: 4067443 - RNA, 19 nt, Staphylococcus aureus subsp. aureus N315
guuaggcgacuuaacuuaa

SEQ ID NO: 4067444 - RNA, 15 nt, Staphylococcus aureus subsp. aureus N315
guuagggaaauguag

SEQ ID NO: 4067445 - RNA, 20 nt, Staphylococcus aureus subsp. aureus N315
guuaggggcuuuuaugcaug

SEQ ID NO: 4067446 - RNA, 22 nt, Staphylococcus aureus subsp. aureus N315
guuaggggcuuuuaugcaugcg

SEQ ID NO: 4067447 - RNA, 23 nt, Staphylococcus aureus subsp. aureus N315
guuaguacggcugcuuuaacugu

SEQ ID NO: 4067448 - RNA, 13 nt, Staphylococcus aureus subsp. aureus N315
guuauaaaaugaa

SEQ ID NO: 4067449 - RNA, 22 nt, Staphylococcus aureus subsp. aureus N315
guuauaaaggaagacauacuca

SEQ ID NO: 4067450 - RNA, 16 nt, Staphylococcus aureus subsp. aureus N315
guuauaaauucuaucu

SEQ ID NO: 4067451 - RNA, 16 nt, Staphylococcus aureus subsp. aureus N315
guuauaaguacaaaua

SEQ ID NO: 4067452 - RNA, 14 nt, Staphylococcus aureus subsp. aureus N315
guuauaccauauuu

SEQ ID NO: 4067453 - RNA, 15 nt, Staphylococcus aureus subsp. aureus N315
guuauauaaauaggc

SEQ ID NO: 4067454 - RNA, 14 nt, Staphylococcus aureus subsp. aureus N315
guuauauauuccuu

SEQ ID NO: 4067455 - RNA, 12 nt, Staphylococcus aureus subsp. aureus N315
guuauauuaaac

SEQ ID NO: 4067456 - RNA, 22 nt, Staphylococcus aureus subsp. aureus N315
guuauauuguauuuuauuuauu

SEQ ID NO: 4067457 - RNA, 14 nt, Staphylococcus aureus subsp. aureus N315
guuaucuaaugauc

SEQ ID NO: 4067458 - RNA, 22 nt, Staphylococcus aureus subsp. aureus N315
guuaucuugcuuauugauauaa

SEQ ID NO: 4067459 - RNA, 13 nt, Staphylococcus aureus subsp. aureus N315
guuaugguguguu

SEQ ID NO: 4067460 - RNA, 17 nt, Staphylococcus aureus subsp. aureus N315
guuaugguguguuggug

SEQ ID NO: 4067461 - RNA, 18 nt, Staphylococcus aureus subsp. aureus N315
guuauguaaauaacaguu

SEQ ID NO: 4067462 - RNA, 23 nt, Staphylococcus aureus subsp. aureus N315
guuauguacacgagucauuaaau

SEQ ID NO: 4067463 - RNA, 14 nt, Staphylococcus aureus subsp. aureus N315
guuauguaugaaag

SEQ ID NO: 4067464 - RNA, 21 nt, Staphylococcus aureus subsp. aureus N315
guuauuaaaucuuuuacuaaa

SEQ ID NO: 4067465 - RNA, 23 nt, Staphylococcus aureus subsp. aureus N315
guuauuagauacuucuuuugcaa

SEQ ID NO: 4067466 - RNA, 16 nt, Staphylococcus aureus subsp. aureus N315
guuauuauaaaauaaa

SEQ ID NO: 4067467 - RNA, 17 nt, Staphylococcus aureus subsp. aureus N315
guuauugcuuauuuuug

SEQ ID NO: 4067468 - RNA, 17 nt, Staphylococcus aureus subsp. aureus N315
guuauuguuccaaucuu

SEQ ID NO: 4067469 - RNA, 18 nt, Staphylococcus aureus subsp. aureus N315
guuauuuauacagugaau

SEQ ID NO: 4067470 - RNA, 22 nt, Staphylococcus aureus subsp. aureus N315
guuauuuuaauaacgauaagca

SEQ ID NO: 4067471 - RNA, 15 nt, Staphylococcus aureus subsp. aureus N315
guuauuuuugcuauu

SEQ ID NO: 4067472 - RNA, 21 nt, Staphylococcus aureus subsp. aureus N315
guuauuuuugcuauuucaaca

SEQ ID NO: 4067473 - RNA, 15 nt, Staphylococcus aureus subsp. aureus N315
guuucaagugcuugg

SEQ ID NO: 4067474 - RNA, 20 nt, Staphylococcus aureus subsp. aureus N315
guuucaaucgcauuuuguuu

SEQ ID NO: 4067475 - RNA, 22 nt, Staphylococcus aureus subsp. aureus N315
guuucaaugaguucuaguuuuu

SEQ ID NO: 4067476 - RNA, 19 nt, Staphylococcus aureus subsp. aureus N315
guuucacaaauucuuuuac

SEQ ID NO: 4067477 - RNA, 15 nt, Staphylococcus aureus subsp. aureus N315
guuucacguaaugaa

SEQ ID NO: 4067478 - RNA, 14 nt, Staphylococcus aureus subsp. aureus N315
guuuccauaaauaa

SEQ ID NO: 4067479 - RNA, 19 nt, Staphylococcus aureus subsp. aureus N315
guuucgaacgcuugaaaaa

SEQ ID NO: 4067480 - RNA, 20 nt, Staphylococcus aureus subsp. aureus N315
guuucggaaaaagaugaaaa

SEQ ID NO: 4067481 - RNA, 21 nt, Staphylococcus aureus subsp. aureus N315
guuucggaaaaagaugaaaaa

SEQ ID NO: 4067482 - RNA, 13 nt, Staphylococcus aureus subsp. aureus N315
guuucgucagauu

SEQ ID NO: 4067483 - RNA, 19 nt, Staphylococcus aureus subsp. aureus N315
guuucgucuacuauuuuuu

SEQ ID NO: 4067484 - RNA, 14 nt, Staphylococcus aureus subsp. aureus N315
guuucuaaauucuu

SEQ ID NO: 4067485 - RNA, 17 nt, Staphylococcus aureus subsp. aureus N315
guuucuaaauucuuuuu

SEQ ID NO: 4067486 - RNA, 20 nt, Staphylococcus aureus subsp. aureus N315
guuucuauaaagaaugauuu

SEQ ID NO: 4067487 - RNA, 20 nt, Staphylococcus aureus subsp. aureus N315
guuucuccuacuauaaaauc

SEQ ID NO: 4067488 - RNA, 14 nt, Staphylococcus aureus subsp. aureus N315
guuucugacuuuua

SEQ ID NO: 4067489 - RNA, 19 nt, Staphylococcus aureus subsp. aureus N315
guuucugacuuuuaaaaaa

SEQ ID NO: 4067490 - RNA, 14 nt, Staphylococcus aureus subsp. aureus N315
guuucuuaacauaa

SEQ ID NO: 4067491 - RNA, 16 nt, Staphylococcus aureus subsp. aureus N315
guuucuucaauugucu

SEQ ID NO: 4067492 - RNA, 19 nt, Staphylococcus aureus subsp. aureus N315
guuugaacaacaucuuuug

SEQ ID NO: 4067493 - RNA, 20 nt, Staphylococcus aureus subsp. aureus N315
guuugaaggugauaauguac

SEQ ID NO: 4067494 - RNA, 15 nt, Staphylococcus aureus subsp. aureus N315
guuugaaucauuuga

SEQ ID NO: 4067495 - RNA, 16 nt, Staphylococcus aureus subsp. aureus N315
guuugauagaugauac

SEQ ID NO: 4067496 - RNA, 14 nt, Staphylococcus aureus subsp. aureus N315
guuugauuaaaauc

SEQ ID NO: 4067497 - RNA, 15 nt, Staphylococcus aureus subsp. aureus N315
guuugauuaaaaucu

SEQ ID NO: 4067498 - RNA, 15 nt, Staphylococcus aureus subsp. aureus N315
guuugcaacauauuu

SEQ ID NO: 4067499 - RNA, 15 nt, Staphylococcus aureus subsp. aureus N315
guuugcguuuuaauu

SEQ ID NO: 4067500 - RNA, 13 nt, Staphylococcus aureus subsp. aureus N315
guuugcuuuaaaa

SEQ ID NO: 4067501 - RNA, 15 nt, Staphylococcus aureus subsp. aureus N315
guuuggauaaaauga

SEQ ID NO: 4067502 - RNA, 18 nt, Staphylococcus aureus subsp. aureus N315
guuuggauaaaaugauau

SEQ ID NO: 4067503 - RNA, 17 nt, Staphylococcus aureus subsp. aureus N315
guuuggcauaauaauau

SEQ ID NO: 4067504 - RNA, 19 nt, Staphylococcus aureus subsp. aureus N315
guuuguuacauauugcauu

SEQ ID NO: 4067505 - RNA, 16 nt, Staphylococcus aureus subsp. aureus N315
guuuguuucuaaauuc

SEQ ID NO: 4067506 - RNA, 14 nt, Staphylococcus aureus subsp. aureus N315
guuuguuuucuuuc

SEQ ID NO: 4067507 - RNA, 18 nt, Staphylococcus aureus subsp. aureus N315
guuuuaaacuuauuaauu

SEQ ID NO: 4067508 - RNA, 14 nt, Staphylococcus aureus subsp. aureus N315
guuuuaaaugaaac

SEQ ID NO: 4067509 - RNA, 20 nt, Staphylococcus aureus subsp. aureus N315
guuuuaauuucacuuuaacu

SEQ ID NO: 4067510 - RNA, 23 nt, Staphylococcus aureus subsp. aureus N315
guuuuacaugauuaaugaugcga

SEQ ID NO: 4067511 - RNA, 22 nt, Staphylococcus aureus subsp. aureus N315
guuuuaccccuguugaauauac

SEQ ID NO: 4067512 - RNA, 22 nt, Staphylococcus aureus subsp. aureus N315
guuuuacuacugucucaucuuc

SEQ ID NO: 4067513 - RNA, 19 nt, Staphylococcus aureus subsp. aureus N315
guuuuacuauaaugaugua

SEQ ID NO: 4067514 - RNA, 15 nt, Staphylococcus aureus subsp. aureus N315
guuuuauagcauuuc

SEQ ID NO: 4067515 - RNA, 16 nt, Staphylococcus aureus subsp. aureus N315
guuuuauguauuuauu

SEQ ID NO: 4067516 - RNA, 22 nt, Staphylococcus aureus subsp. aureus N315
guuuuauuaauucugauuaugu

SEQ ID NO: 4067517 - RNA, 12 nt, Staphylococcus aureus subsp. aureus N315
guuuuauucaau

SEQ ID NO: 4067518 - RNA, 19 nt, Staphylococcus aureus subsp. aureus N315
guuuuauucgauaauauaa

SEQ ID NO: 4067519 - RNA, 22 nt, Staphylococcus aureus subsp. aureus N315
guuuucacuucgccaagccauc

SEQ ID NO: 4067520 - RNA, 15 nt, Staphylococcus aureus subsp. aureus N315
guuuuccaugaguuu

SEQ ID NO: 4067521 - RNA, 16 nt, Staphylococcus aureus subsp. aureus N315
guuuucuaauuguuuu

SEQ ID NO: 4067522 - RNA, 15 nt, Staphylococcus aureus subsp. aureus N315
guuuucuuaaaagag

SEQ ID NO: 4067523 - RNA, 21 nt, Staphylococcus aureus subsp. aureus N315
guuuucuuuauuuuaaacaug

SEQ ID NO: 4067524 - RNA, 12 nt, Staphylococcus aureus subsp. aureus N315
guuuucuuuuca

SEQ ID NO: 4067525 - RNA, 14 nt, Staphylococcus aureus subsp. aureus N315
guuuugaaccuaaa

SEQ ID NO: 4067526 - RNA, 19 nt, Staphylococcus aureus subsp. aureus N315
guuuugauugcaaaaaaac

SEQ ID NO: 4067527 - RNA, 14 nt, Staphylococcus aureus subsp. aureus N315
guuuugcaacauuu

SEQ ID NO: 4067528 - RNA, 12 nt, Staphylococcus aureus subsp. aureus N315
guuuugcuaacc

SEQ ID NO: 4067529 - RNA, 17 nt, Staphylococcus aureus subsp. aureus N315
guuuugcuaaccaucau

SEQ ID NO: 4067530 - RNA, 22 nt, Staphylococcus aureus subsp. aureus N315
guuuugguuguucuuuuuguug

SEQ ID NO: 4067531 - RNA, 14 nt, Staphylococcus aureus subsp. aureus N315
guuuuguagauaua

SEQ ID NO: 4067532 - RNA, 20 nt, Staphylococcus aureus subsp. aureus N315
guuuuguagauauagcaucu

SEQ ID NO: 4067533 - RNA, 13 nt, Staphylococcus aureus subsp. aureus N315
guuuuuaaaauua

SEQ ID NO: 4067534 - RNA, 12 nt, Staphylococcus aureus subsp. aureus N315
guuuuuacuaua

SEQ ID NO: 4067535 - RNA, 16 nt, Staphylococcus aureus subsp. aureus N315
guuuuuagcauuauca

SEQ ID NO: 4067536 - RNA, 12 nt, Staphylococcus aureus subsp. aureus N315
guuuuuauuauu

SEQ ID NO: 4067537 - RNA, 20 nt, Staphylococcus aureus subsp. aureus N315
guuuuucaucauuaaaauca

SEQ ID NO: 4067538 - RNA, 14 nt, Staphylococcus aureus subsp. aureus N315
guuuuucuuuaaac

SEQ ID NO: 4067539 - RNA, 22 nt, Staphylococcus aureus subsp. aureus N315
guuuuuuuagcuauagaaauga

SEQ ID NO: 4067540 - RNA, 21 nt, Staphylococcus aureus subsp. aureus N315
uaaaaaaaucacgcuaacauu

SEQ ID NO: 4067541 - RNA, 14 nt, Staphylococcus aureus subsp. aureus N315
uaaaaaacaauagg

SEQ ID NO: 4067542 - RNA, 17 nt, Staphylococcus aureus subsp. aureus N315
uaaaaaaccaauaaucc

SEQ ID NO: 4067543 - RNA, 16 nt, Staphylococcus aureus subsp. aureus N315
uaaaaaaccugaaaca

SEQ ID NO: 4067544 - RNA, 17 nt, Staphylococcus aureus subsp. aureus N315
uaaaaaacgauaguagu

SEQ ID NO: 4067545 - RNA, 16 nt, Staphylococcus aureus subsp. aureus N315
uaaaaaacgguacaga

SEQ ID NO: 4067546 - RNA, 13 nt, Staphylococcus aureus subsp. aureus N315
uaaaaaaguuauc

SEQ ID NO: 4067547 - RNA, 18 nt, Staphylococcus aureus subsp. aureus N315
uaaaaaaguugauuaaaa

SEQ ID NO: 4067548 - RNA, 19 nt, Staphylococcus aureus subsp. aureus N315
uaaaaaaguugauuaaaag

SEQ ID NO: 4067549 - RNA, 19 nt, Staphylococcus aureus subsp. aureus N315
uaaaaaauacucccuucaa

SEQ ID NO: 4067550 - RNA, 18 nt, Staphylococcus aureus subsp. aureus N315
uaaaaaaucaguuuuuaa

SEQ ID NO: 4067551 - RNA, 22 nt, Staphylococcus aureus subsp. aureus N315
uaaaaaaugcacugagcaacaa

SEQ ID NO: 4067552 - RNA, 13 nt, Staphylococcus aureus subsp. aureus N315
uaaaaaauuaaaa

SEQ ID NO: 4067553 - RNA, 12 nt, Staphylococcus aureus subsp. aureus N315
uaaaaaauuauu

SEQ ID NO: 4067554 - RNA, 13 nt, Staphylococcus aureus subsp. aureus N315
uaaaaaauuauua

SEQ ID NO: 4067555 - RNA, 21 nt, Staphylococcus aureus subsp. aureus N315
uaaaaaauuccuagcuuuuau

SEQ ID NO: 4067556 - RNA, 14 nt, Staphylococcus aureus subsp. aureus N315
uaaaaaauuuaaug

SEQ ID NO: 4067557 - RNA, 15 nt, Staphylococcus aureus subsp. aureus N315
uaaaaacaaaagaaa

SEQ ID NO: 4067558 - RNA, 23 nt, Staphylococcus aureus subsp. aureus N315
uaaaaacaaagguuuguaagaca

SEQ ID NO: 4067559 - RNA, 19 nt, Staphylococcus aureus subsp. aureus N315
uaaaaacaauauugacuuu

SEQ ID NO: 4067560 - RNA, 23 nt, Staphylococcus aureus subsp. aureus N315
uaaaaacgauucauuauaugguu

SEQ ID NO: 4067561 - RNA, 18 nt, Staphylococcus aureus subsp. aureus N315
uaaaauaauagauaauag

SEQ ID NO: 4067562 - RNA, 15 nt, Staphylococcus aureus subsp. aureus N315
uaaaauaaucgguaa

SEQ ID NO: 4067563 - RNA, 16 nt, Staphylococcus aureus subsp. aureus N315
uaaaauaaucgguaau

SEQ ID NO: 4067564 - RNA, 20 nt, Staphylococcus aureus subsp. aureus N315
uaaaauaaucgguaauuacu

SEQ ID NO: 4067565 - RNA, 13 nt, Staphylococcus aureus subsp. aureus N315
uaaaauaauuaaa

SEQ ID NO: 4067566 - RNA, 16 nt, Staphylococcus aureus subsp. aureus N315
uaaaauaauuaaauaa

SEQ ID NO: 4067567 - RNA, 22 nt, Staphylococcus aureus subsp. aureus N315
uaaaauacauuucuauacuauu

SEQ ID NO: 4067568 - RNA, 13 nt, Staphylococcus aureus subsp. aureus N315
uaaaauaccagau

SEQ ID NO: 4067569 - RNA, 20 nt, Staphylococcus aureus subsp. aureus N315
uaaaauacccauuuuuuucc

SEQ ID NO: 4067570 - RNA, 21 nt, Staphylococcus aureus subsp. aureus N315
uaaaauacgguacagauagga

SEQ ID NO: 4067571 - RNA, 13 nt, Staphylococcus aureus subsp. aureus N315
uaaaauagaaaaa

SEQ ID NO: 4067572 - RNA, 15 nt, Staphylococcus aureus subsp. aureus N315
uaaaauagaaaaauu

SEQ ID NO: 4067573 - RNA, 17 nt, Staphylococcus aureus subsp. aureus N315
uaaaauagaaaaauuuc

SEQ ID NO: 4067574 - RNA, 19 nt, Staphylococcus aureus subsp. aureus N315
uaaaauagaaaaauuucaa

SEQ ID NO: 4067575 - RNA, 22 nt, Staphylococcus aureus subsp. aureus N315
uaaaauaguucuuuaaauuaua

SEQ ID NO: 4067576 - RNA, 14 nt, Staphylococcus aureus subsp. aureus N315
uaaaauauaucuua

SEQ ID NO: 4067577 - RNA, 19 nt, Staphylococcus aureus subsp. aureus N315
uaaaauauaugaauaaguc

SEQ ID NO: 4067578 - RNA, 16 nt, Staphylococcus aureus subsp. aureus N315
uaaaauauauuuaauu

SEQ ID NO: 4067579 - RNA, 16 nt, Staphylococcus aureus subsp. aureus N315
uaaaauaugacacaua

SEQ ID NO: 4067580 - RNA, 19 nt, Staphylococcus aureus subsp. aureus N315
uaaaaucauaugucuuaac

SEQ ID NO: 4067581 - RNA, 15 nt, Staphylococcus aureus subsp. aureus N315
uaaaaucaucguauu

SEQ ID NO: 4067582 - RNA, 19 nt, Staphylococcus aureus subsp. aureus N315
uaaaauccaagugcuaaga

SEQ ID NO: 4067583 - RNA, 20 nt, Staphylococcus aureus subsp. aureus N315
uaaaauccaagugcuaagag

SEQ ID NO: 4067584 - RNA, 23 nt, Staphylococcus aureus subsp. aureus N315
uaaaauccuaagcaucguaaaaa

SEQ ID NO: 4067585 - RNA, 15 nt, Staphylococcus aureus subsp. aureus N315
uaaaaucgcagcaau

SEQ ID NO: 4067586 - RNA, 17 nt, Staphylococcus aureus subsp. aureus N315
uaaaaucucauaauaau

SEQ ID NO: 4067587 - RNA, 17 nt, Staphylococcus aureus subsp. aureus N315
uaaaaucugcuuuauuu

SEQ ID NO: 4067588 - RNA, 15 nt, Staphylococcus aureus subsp. aureus N315
uaaaaugaauaguag

SEQ ID NO: 4067589 - RNA, 20 nt, Staphylococcus aureus subsp. aureus N315
uaaaaugauagcuaaacauu

SEQ ID NO: 4067590 - RNA, 15 nt, Staphylococcus aureus subsp. aureus N315
uaaaaugauaucuau

SEQ ID NO: 4067591 - RNA, 20 nt, Staphylococcus aureus subsp. aureus N315
uaaaaugauaucugacauuu

SEQ ID NO: 4067592 - RNA, 17 nt, Staphylococcus aureus subsp. aureus N315
uaaaaugauuguuuuaa

SEQ ID NO: 4067593 - RNA, 13 nt, Staphylococcus aureus subsp. aureus N315
uaaaaugcauagc

SEQ ID NO: 4067594 - RNA, 14 nt, Staphylococcus aureus subsp. aureus N315
uaaaaugcauagcu

SEQ ID NO: 4067595 - RNA, 20 nt, Staphylococcus aureus subsp. aureus N315
uaaaaugcuacaauuuccua

SEQ ID NO: 4067596 - RNA, 20 nt, Staphylococcus aureus subsp. aureus N315
uaaaauggugcgaauaauaa

SEQ ID NO: 4067597 - RNA, 17 nt, Staphylococcus aureus subsp. aureus N315
uaaaauguuaauaauga

SEQ ID NO: 4067598 - RNA, 23 nt, Staphylococcus aureus subsp. aureus N315
uaaaauguuaggugaaaccauac

SEQ ID NO: 4067599 - RNA, 14 nt, Staphylococcus aureus subsp. aureus N315
uaaaauuaaaacag

SEQ ID NO: 4067600 - RNA, 21 nt, Staphylococcus aureus subsp. aureus N315
uaaaauuaaaccuacaacgaa

SEQ ID NO: 4067601 - RNA, 14 nt, Staphylococcus aureus subsp. aureus N315
uaaaauuaaauaau

SEQ ID NO: 4067602 - RNA, 14 nt, Staphylococcus aureus subsp. aureus N315
uaaaauuaaaugcu

SEQ ID NO: 4067603 - RNA, 17 nt, Staphylococcus aureus subsp. aureus N315
uaaaauuaacuuaaaau

SEQ ID NO: 4067604 - RNA, 21 nt, Staphylococcus aureus subsp. aureus N315
uaaaauuaacuuaaaauuuaa

SEQ ID NO: 4067605 - RNA, 22 nt, Staphylococcus aureus subsp. aureus N315
uaaaauuaacuuaaaauuuaaa

SEQ ID NO: 4067606 - RNA, 12 nt, Staphylococcus aureus subsp. aureus N315
uaaaauuaucaa

SEQ ID NO: 4067607 - RNA, 18 nt, Staphylococcus aureus subsp. aureus N315
uaaaauuaugauuauauu

SEQ ID NO: 4067608 - RNA, 16 nt, Staphylococcus aureus subsp. aureus N315
uaaaauucuauaaaua

SEQ ID NO: 4067609 - RNA, 14 nt, Staphylococcus aureus subsp. aureus N315
uaaaauucucuuuu

SEQ ID NO: 4067610 - RNA, 14 nt, Staphylococcus aureus subsp. aureus N315
uaaaauucuuucag

SEQ ID NO: 4067611 - RNA, 23 nt, Staphylococcus aureus subsp. aureus N315
uaaaauugaauaucacuuuagau

SEQ ID NO: 4067612 - RNA, 15 nt, Staphylococcus aureus subsp. aureus N315
uaaaauuguauagaa

SEQ ID NO: 4067613 - RNA, 16 nt, Staphylococcus aureus subsp. aureus N315
uaaaauuguauagaau

SEQ ID NO: 4067614 - RNA, 18 nt, Staphylococcus aureus subsp. aureus N315
uaaaauuuaaauauugaa

SEQ ID NO: 4067615 - RNA, 18 nt, Staphylococcus aureus subsp. aureus N315
uaaaauuuacaaauguau

SEQ ID NO: 4067616 - RNA, 20 nt, Staphylococcus aureus subsp. aureus N315
uaaaauuuacaaauguauaa

SEQ ID NO: 4067617 - RNA, 14 nt, Staphylococcus aureus subsp. aureus N315
uaaaauuugugcau

SEQ ID NO: 4067618 - RNA, 18 nt, Staphylococcus aureus subsp. aureus N315
uaaaauuuguuaauuuaa

SEQ ID NO: 4067619 - RNA, 14 nt, Staphylococcus aureus subsp. aureus N315
uaaaauuuuaauua

SEQ ID NO: 4067620 - RNA, 21 nt, Staphylococcus aureus subsp. aureus N315
uaaaauuuucguguuaauaac

SEQ ID NO: 4067621 - RNA, 22 nt, Staphylococcus aureus subsp. aureus N315
uaaaauuuugaagaagugccgu

SEQ ID NO: 4067622 - RNA, 18 nt, Staphylococcus aureus subsp. aureus N315
uaaaauuuuuaaaaaaau

SEQ ID NO: 4067623 - RNA, 23 nt, Staphylococcus aureus subsp. aureus N315
uaaaauuuuuugggcuuuuucac

SEQ ID NO: 4067624 - RNA, 22 nt, Staphylococcus aureus subsp. aureus N315
uaaaauuuuuuucauaauuaau

SEQ ID NO: 4067625 - RNA, 22 nt, Staphylococcus aureus subsp. aureus N315
uaaacaacaucgauuuaucauu

SEQ ID NO: 4067626 - RNA, 15 nt, Staphylococcus aureus subsp. aureus N315
uaaacaacuucugaa

SEQ ID NO: 4067627 - RNA, 14 nt, Staphylococcus aureus subsp. aureus N315
uaaacaagcaucau

SEQ ID NO: 4067628 - RNA, 19 nt, Staphylococcus aureus subsp. aureus N315
uaaacaagcaucaugaaau

SEQ ID NO: 4067629 - RNA, 19 nt, Staphylococcus aureus subsp. aureus N315
uaaacaauuccccaaagcc

SEQ ID NO: 4067630 - RNA, 15 nt, Staphylococcus aureus subsp. aureus N315
uaaacacaucuaugu

SEQ ID NO: 4067631 - RNA, 18 nt, Staphylococcus aureus subsp. aureus N315
uaaacacuuuaguauuau

SEQ ID NO: 4067632 - RNA, 18 nt, Staphylococcus aureus subsp. aureus N315
uaaacaucuauaacaaaa

SEQ ID NO: 4067633 - RNA, 19 nt, Staphylococcus aureus subsp. aureus N315
uaaacaucuauaacaaaau

SEQ ID NO: 4067634 - RNA, 14 nt, Staphylococcus aureus subsp. aureus N315
uaaacaugaacaau

SEQ ID NO: 4067635 - RNA, 18 nt, Staphylococcus aureus subsp. aureus N315
uaaacaugaacaaucaga

SEQ ID NO: 4067636 - RNA, 21 nt, Staphylococcus aureus subsp. aureus N315
uaaacaugggcaaucacuccu

SEQ ID NO: 4067637 - RNA, 13 nt, Staphylococcus aureus subsp. aureus N315
uaaacauuuagau

SEQ ID NO: 4067638 - RNA, 17 nt, Staphylococcus aureus subsp. aureus N315
uaaacauuuauauagau

SEQ ID NO: 4067639 - RNA, 11 nt, Staphylococcus aureus subsp. aureus N315
uaaacauuuuu

SEQ ID NO: 4067640 - RNA, 19 nt, Staphylococcus aureus subsp. aureus N315
uaaacauuuuugaauuuaa

SEQ ID NO: 4067641 - RNA, 22 nt, Staphylococcus aureus subsp. aureus N315
uaaaccaaaucggaauaaaaua

SEQ ID NO: 4067642 - RNA, 18 nt, Staphylococcus aureus subsp. aureus N315
uaaaccaacuuucucaag

SEQ ID NO: 4067643 - RNA, 15 nt, Staphylococcus aureus subsp. aureus N315
uaaaccaaugauugu

SEQ ID NO: 4067644 - RNA, 18 nt, Staphylococcus aureus subsp. aureus N315
uaaaccagcuaaaccauc

SEQ ID NO: 4067645 - RNA, 20 nt, Staphylococcus aureus subsp. aureus N315
uaaaccaucugugucagcau

SEQ ID NO: 4067646 - RNA, 19 nt, Staphylococcus aureus subsp. aureus N315
uaaaccauuuucaagagga

SEQ ID NO: 4067647 - RNA, 21 nt, Staphylococcus aureus subsp. aureus N315
uaaaccgauuguuucaccagc

SEQ ID NO: 4067648 - RNA, 15 nt, Staphylococcus aureus subsp. aureus N315
uaaauauaaauauga

SEQ ID NO: 4067649 - RNA, 15 nt, Staphylococcus aureus subsp. aureus N315
uaaauauaguaauaa

SEQ ID NO: 4067650 - RNA, 22 nt, Staphylococcus aureus subsp. aureus N315
uaaauauauaaggcgcucucuu

SEQ ID NO: 4067651 - RNA, 17 nt, Staphylococcus aureus subsp. aureus N315
uaaauaucaauaauucg

SEQ ID NO: 4067652 - RNA, 12 nt, Staphylococcus aureus subsp. aureus N315
uaaauaucaauu

SEQ ID NO: 4067653 - RNA, 20 nt, Staphylococcus aureus subsp. aureus N315
uaaauaucuuaguauguuca

SEQ ID NO: 4067654 - RNA, 18 nt, Staphylococcus aureus subsp. aureus N315
uaaauaugaaucuagaau

SEQ ID NO: 4067655 - RNA, 22 nt, Staphylococcus aureus subsp. aureus N315
uaaauaugacgcgugaauuaaa

SEQ ID NO: 4067656 - RNA, 20 nt, Staphylococcus aureus subsp. aureus N315
uaaauauggaugauauucaa

SEQ ID NO: 4067657 - RNA, 16 nt, Staphylococcus aureus subsp. aureus N315
uaaauauuaaauucau

SEQ ID NO: 4067658 - RNA, 22 nt, Staphylococcus aureus subsp. aureus N315
uaaauauuauuuugcaauugca

SEQ ID NO: 4067659 - RNA, 14 nt, Staphylococcus aureus subsp. aureus N315
uaaauauucuuauc

SEQ ID NO: 4067660 - RNA, 14 nt, Staphylococcus aureus subsp. aureus N315
uaaauauugauaua

SEQ ID NO: 4067661 - RNA, 15 nt, Staphylococcus aureus subsp. aureus N315
uaaauauugauauaa

SEQ ID NO: 4067662 - RNA, 21 nt, Staphylococcus aureus subsp. aureus N315
uaaauauuuaaaauauuauuu

SEQ ID NO: 4067663 - RNA, 14 nt, Staphylococcus aureus subsp. aureus N315
uaaauauuuagauu

SEQ ID NO: 4067664 - RNA, 15 nt, Staphylococcus aureus subsp. aureus N315
uaaauauuuuuuaaa

SEQ ID NO: 4067665 - RNA, 16 nt, Staphylococcus aureus subsp. aureus N315
uaaaucaaacuuuuca

SEQ ID NO: 4067666 - RNA, 16 nt, Staphylococcus aureus subsp. aureus N315
uaaaucaaagaggaac

SEQ ID NO: 4067667 - RNA, 21 nt, Staphylococcus aureus subsp. aureus N315
uaaaucaaagaugacuuggcc

SEQ ID NO: 4067668 - RNA, 17 nt, Staphylococcus aureus subsp. aureus N315
uaaaucaacaagaacuu

SEQ ID NO: 4067669 - RNA, 13 nt, Staphylococcus aureus subsp. aureus N315
uaaaucaagaaau

SEQ ID NO: 4067670 - RNA, 16 nt, Staphylococcus aureus subsp. aureus N315
uaaaucaagaaauguu

SEQ ID NO: 4067671 - RNA, 20 nt, Staphylococcus aureus subsp. aureus N315
uaaaucacuagcuaaugcac

SEQ ID NO: 4067672 - RNA, 16 nt, Staphylococcus aureus subsp. aureus N315
uaaaucauacgagaaa

SEQ ID NO: 4067673 - RNA, 19 nt, Staphylococcus aureus subsp. aureus N315
uaaaucauacgagaaauua

SEQ ID NO: 4067674 - RNA, 14 nt, Staphylococcus aureus subsp. aureus N315
uaaaucauagaggc

SEQ ID NO: 4067675 - RNA, 16 nt, Staphylococcus aureus subsp. aureus N315
uaaaucauagaggcac

SEQ ID NO: 4067676 - RNA, 17 nt, Staphylococcus aureus subsp. aureus N315
uaaaucauagaggcaca

SEQ ID NO: 4067677 - RNA, 22 nt, Staphylococcus aureus subsp. aureus N315
uaaaucaugaaauaaaaaaaca

SEQ ID NO: 4067678 - RNA, 16 nt, Staphylococcus aureus subsp. aureus N315
uaaaucccuaaaaaaa

SEQ ID NO: 4067679 - RNA, 16 nt, Staphylococcus aureus subsp. aureus N315
uaaauccgcuuguuca

SEQ ID NO: 4067680 - RNA, 14 nt, Staphylococcus aureus subsp. aureus N315
uaaauccuuuauau

SEQ ID NO: 4067681 - RNA, 20 nt, Staphylococcus aureus subsp. aureus N315
uaaaucgugcuguuaucaug

SEQ ID NO: 4067682 - RNA, 18 nt, Staphylococcus aureus subsp. aureus N315
uaaaucuccauuaaucau

SEQ ID NO: 4067683 - RNA, 19 nt, Staphylococcus aureus subsp. aureus N315
uaaaucuccauuaaucauu

SEQ ID NO: 4067684 - RNA, 16 nt, Staphylococcus aureus subsp. aureus N315
uaaaucugauucauua

SEQ ID NO: 4067685 - RNA, 20 nt, Staphylococcus aureus subsp. aureus N315
uaaaucuguacuucuaauuu

SEQ ID NO: 4067686 - RNA, 21 nt, Staphylococcus aureus subsp. aureus N315
uaaaucuguuuaaauuuaaaa

SEQ ID NO: 4067687 - RNA, 15 nt, Staphylococcus aureus subsp. aureus N315
uaaaucuucaucauc

SEQ ID NO: 4067688 - RNA, 19 nt, Staphylococcus aureus subsp. aureus N315
uaaaucuucuaguaauucu

SEQ ID NO: 4067689 - RNA, 18 nt, Staphylococcus aureus subsp. aureus N315
uaaaucuucuauuuucau

SEQ ID NO: 4067690 - RNA, 23 nt, Staphylococcus aureus subsp. aureus N315
uaaaucuuguuggauuuuaacaa

SEQ ID NO: 4067691 - RNA, 23 nt, Staphylococcus aureus subsp. aureus N315
uaaaucuuuuagcuuuuguaaag

SEQ ID NO: 4067692 - RNA, 23 nt, Staphylococcus aureus subsp. aureus N315
uaaaugaaacuuugugugcuuua

SEQ ID NO: 4067693 - RNA, 21 nt, Staphylococcus aureus subsp. aureus N315
uaaaugaaaguaccuaaaaua

SEQ ID NO: 4067694 - RNA, 22 nt, Staphylococcus aureus subsp. aureus N315
uaaaugaaaguaccuaaaauag

SEQ ID NO: 4067695 - RNA, 17 nt, Staphylococcus aureus subsp. aureus N315
uaaaugaauuauuuaaa

SEQ ID NO: 4067696 - RNA, 20 nt, Staphylococcus aureus subsp. aureus N315
uaaaugaauugucuuaauau

SEQ ID NO: 4067697 - RNA, 18 nt, Staphylococcus aureus subsp. aureus N315
uaaaugacugaauuaaua

SEQ ID NO: 4067698 - RNA, 20 nt, Staphylococcus aureus subsp. aureus N315
uaaaugaucaucguauagau

SEQ ID NO: 4067699 - RNA, 17 nt, Staphylococcus aureus subsp. aureus N315
uaaaugaugcaguaaaa

SEQ ID NO: 4067700 - RNA, 18 nt, Staphylococcus aureus subsp. aureus N315
uaaaugaugcaguaaaac

SEQ ID NO: 4067701 - RNA, 20 nt, Staphylococcus aureus subsp. aureus N315
uaaaugaugcaguaaaacca

SEQ ID NO: 4067702 - RNA, 14 nt, Staphylococcus aureus subsp. aureus N315
uaaaugauuaauaa

SEQ ID NO: 4067703 - RNA, 18 nt, Staphylococcus aureus subsp. aureus N315
uaaaugauuaauaacaua

SEQ ID NO: 4067704 - RNA, 14 nt, Staphylococcus aureus subsp. aureus N315
uaaaugauucuuua

SEQ ID NO: 4067705 - RNA, 17 nt, Staphylococcus aureus subsp. aureus N315
uaaaugauucuuuauaa

SEQ ID NO: 4067706 - RNA, 14 nt, Staphylococcus aureus subsp. aureus N315
uaaaugauuuaaua

SEQ ID NO: 4067707 - RNA, 16 nt, Staphylococcus aureus subsp. aureus N315
uaaaugauuuaauaaa

SEQ ID NO: 4067708 - RNA, 15 nt, Staphylococcus aureus subsp. aureus N315
uaaaugauuucacuu

SEQ ID NO: 4067709 - RNA, 16 nt, Staphylococcus aureus subsp. aureus N315
uaaaugcaauacauua

SEQ ID NO: 4067710 - RNA, 18 nt, Staphylococcus aureus subsp. aureus N315
uaaaugcagcuguauaac

SEQ ID NO: 4067711 - RNA, 15 nt, Staphylococcus aureus subsp. aureus N315
uaaaugcuaaaagua

SEQ ID NO: 4067712 - RNA, 22 nt, Staphylococcus aureus subsp. aureus N315
uaaaugcucaagccaugauuua

SEQ ID NO: 4067713 - RNA, 16 nt, Staphylococcus aureus subsp. aureus N315
uaaauguacauuguaa

SEQ ID NO: 4067714 - RNA, 16 nt, Staphylococcus aureus subsp. aureus N315
uaaauguauuaaacau

SEQ ID NO: 4067715 - RNA, 16 nt, Staphylococcus aureus subsp. aureus N315
uaaaugucacugcaaa

SEQ ID NO: 4067716 - RNA, 21 nt, Staphylococcus aureus subsp. aureus N315
uaaaugucacugcaaacacag

SEQ ID NO: 4067717 - RNA, 14 nt, Staphylococcus aureus subsp. aureus N315
uaaaugucuuucaa

SEQ ID NO: 4067718 - RNA, 14 nt, Staphylococcus aureus subsp. aureus N315
uaaaugugcaauua

SEQ ID NO: 4067719 - RNA, 17 nt, Staphylococcus aureus subsp. aureus N315
uaaaugugcaauuagaa

SEQ ID NO: 4067720 - RNA, 19 nt, Staphylococcus aureus subsp. aureus N315
uaaaugugcaauuagaaua

SEQ ID NO: 4067721 - RNA, 15 nt, Staphylococcus aureus subsp. aureus N315
uaaauguuaaagauu

SEQ ID NO: 4067722 - RNA, 17 nt, Staphylococcus aureus subsp. aureus N315
uaaauguuaaauucuaa

SEQ ID NO: 4067723 - RNA, 13 nt, Staphylococcus aureus subsp. aureus N315
uaaauguuauuaa

SEQ ID NO: 4067724 - RNA, 17 nt, Staphylococcus aureus subsp. aureus N315
uaaauguuauuaaccau

SEQ ID NO: 4067725 - RNA, 18 nt, Staphylococcus aureus subsp. aureus N315
uaaauguuauuaaccauc

SEQ ID NO: 4067726 - RNA, 20 nt, Staphylococcus aureus subsp. aureus N315
uaaauguuauuaaccaucau

SEQ ID NO: 4067727 - RNA, 16 nt, Staphylococcus aureus subsp. aureus N315
uaaauguuauugcuua

SEQ ID NO: 4067728 - RNA, 22 nt, Staphylococcus aureus subsp. aureus N315
uaaauguugacucguuauucaa

SEQ ID NO: 4067729 - RNA, 17 nt, Staphylococcus aureus subsp. aureus N315
uaaauguuuuauguauu

SEQ ID NO: 4067730 - RNA, 18 nt, Staphylococcus aureus subsp. aureus N315
uaaauguuuuauguauuu

SEQ ID NO: 4067731 - RNA, 14 nt, Staphylococcus aureus subsp. aureus N315
uaaauuaaaucgau

SEQ ID NO: 4067732 - RNA, 19 nt, Staphylococcus aureus subsp. aureus N315
uaaauuaauagagaaagaa

SEQ ID NO: 4067733 - RNA, 12 nt, Staphylococcus aureus subsp. aureus N315
uaaauuaauaug

SEQ ID NO: 4067734 - RNA, 13 nt, Staphylococcus aureus subsp. aureus N315
uaaauuaauauga

SEQ ID NO: 4067735 - RNA, 19 nt, Staphylococcus aureus subsp. aureus N315
uaaauuacaaaaguaugau

SEQ ID NO: 4067736 - RNA, 15 nt, Staphylococcus aureus subsp. aureus N315
uaacauuuaaaaaau

SEQ ID NO: 4067737 - RNA, 19 nt, Staphylococcus aureus subsp. aureus N315
uaacauuuauucuuucucu

SEQ ID NO: 4067738 - RNA, 22 nt, Staphylococcus aureus subsp. aureus N315
uaacauuucugaugcuagcuuu

SEQ ID NO: 4067739 - RNA, 20 nt, Staphylococcus aureus subsp. aureus N315
uaacauuugcuaguagaguu

SEQ ID NO: 4067740 - RNA, 20 nt, Staphylococcus aureus subsp. aureus N315
uaacauuugucauaauagau

SEQ ID NO: 4067741 - RNA, 20 nt, Staphylococcus aureus subsp. aureus N315
uaacauuuguccgauuuauu

SEQ ID NO: 4067742 - RNA, 15 nt, Staphylococcus aureus subsp. aureus N315
uaacauuuucuuauu

SEQ ID NO: 4067743 - RNA, 12 nt, Staphylococcus aureus subsp. aureus N315
uaacauuuugaa

SEQ ID NO: 4067744 - RNA, 14 nt, Staphylococcus aureus subsp. aureus N315
uaaccaaucaucgc

SEQ ID NO: 4067745 - RNA, 22 nt, Staphylococcus aureus subsp. aureus N315
uaaccaccaucccauuaaacca

SEQ ID NO: 4067746 - RNA, 23 nt, Staphylococcus aureus subsp. aureus N315
uaaccaccaucccauuaaaccac

SEQ ID NO: 4067747 - RNA, 19 nt, Staphylococcus aureus subsp. aureus N315
uaaccaguauaauuuucug

SEQ ID NO: 4067748 - RNA, 14 nt, Staphylococcus aureus subsp. aureus N315
uaaccauaaugaac

SEQ ID NO: 4067749 - RNA, 12 nt, Staphylococcus aureus subsp. aureus N315
uaaccauaguaa

SEQ ID NO: 4067750 - RNA, 13 nt, Staphylococcus aureus subsp. aureus N315
uaaccauuaugau

SEQ ID NO: 4067751 - RNA, 14 nt, Staphylococcus aureus subsp. aureus N315
uaaccauuaugauu

SEQ ID NO: 4067752 - RNA, 15 nt, Staphylococcus aureus subsp. aureus N315
uaaccauuuaaaaau

SEQ ID NO: 4067753 - RNA, 15 nt, Staphylococcus aureus subsp. aureus N315
uaaccauuuuuucaa

SEQ ID NO: 4067754 - RNA, 18 nt, Staphylococcus aureus subsp. aureus N315
uaacccaacgaugaaacu

SEQ ID NO: 4067755 - RNA, 13 nt, Staphylococcus aureus subsp. aureus N315
uaacccacauuaa

SEQ ID NO: 4067756 - RNA, 15 nt, Staphylococcus aureus subsp. aureus N315
uaaccccuccuggug

SEQ ID NO: 4067757 - RNA, 20 nt, Staphylococcus aureus subsp. aureus N315
uaacccuaaagcuaaugcaa

SEQ ID NO: 4067758 - RNA, 21 nt, Staphylococcus aureus subsp. aureus N315
uaacccuaaagcuaaugcaag

SEQ ID NO: 4067759 - RNA, 14 nt, Staphylococcus aureus subsp. aureus N315
uaaccgaaauauug

SEQ ID NO: 4067760 - RNA, 18 nt, Staphylococcus aureus subsp. aureus N315
uaaccuaaguuaauuuau

SEQ ID NO: 4067761 - RNA, 21 nt, Staphylococcus aureus subsp. aureus N315
uaaccuaauucgccaucuuuu

SEQ ID NO: 4067762 - RNA, 16 nt, Staphylococcus aureus subsp. aureus N315
uaaccuauuaaaucug

SEQ ID NO: 4067763 - RNA, 15 nt, Staphylococcus aureus subsp. aureus N315
uaaccuuuaaaacau

SEQ ID NO: 4067764 - RNA, 16 nt, Staphylococcus aureus subsp. aureus N315
uaaccuuuaaaacauc

SEQ ID NO: 4067765 - RNA, 17 nt, Staphylococcus aureus subsp. aureus N315
uaaccuuuaaaacauca

SEQ ID NO: 4067766 - RNA, 22 nt, Staphylococcus aureus subsp. aureus N315
uaacgaaaaagaugguuuuguu

SEQ ID NO: 4067767 - RNA, 17 nt, Staphylococcus aureus subsp. aureus N315
uaacgacccaaauuaua

SEQ ID NO: 4067768 - RNA, 20 nt, Staphylococcus aureus subsp. aureus N315
uaacgagugcuuucaccuuu

SEQ ID NO: 4067769 - RNA, 14 nt, Staphylococcus aureus subsp. aureus N315
uaacgauagacauu

SEQ ID NO: 4067770 - RNA, 20 nt, Staphylococcus aureus subsp. aureus N315
uaacgaugguugcuucacug

SEQ ID NO: 4067771 - RNA, 23 nt, Staphylococcus aureus subsp. aureus N315
uaacgaugguugcuucacuguuu

SEQ ID NO: 4067772 - RNA, 15 nt, Staphylococcus aureus subsp. aureus N315
uaacgcaaugucuug

SEQ ID NO: 4067773 - RNA, 17 nt, Staphylococcus aureus subsp. aureus N315
uaacgcaguugaaaaag

SEQ ID NO: 4067774 - RNA, 22 nt, Staphylococcus aureus subsp. aureus N315
uaacggaaauacaaugaauugu

SEQ ID NO: 4067775 - RNA, 20 nt, Staphylococcus aureus subsp. aureus N315
uaacguacauuuaugauugu

SEQ ID NO: 4067776 - RNA, 20 nt, Staphylococcus aureus subsp. aureus N315
uaacgucauuuuuaauaaug

SEQ ID NO: 4067777 - RNA, 19 nt, Staphylococcus aureus subsp. aureus N315
uaacgugaggcccauaaau

SEQ ID NO: 4067778 - RNA, 21 nt, Staphylococcus aureus subsp. aureus N315
uaacguguuugcucaaaaaug

SEQ ID NO: 4067779 - RNA, 16 nt, Staphylococcus aureus subsp. aureus N315
uaacguugcagagaau

SEQ ID NO: 4067780 - RNA, 15 nt, Staphylococcus aureus subsp. aureus N315
uaacguuucuuugua

SEQ ID NO: 4067781 - RNA, 14 nt, Staphylococcus aureus subsp. aureus N315
uaacuaaaaugucu

SEQ ID NO: 4067782 - RNA, 23 nt, Staphylococcus aureus subsp. aureus N315
uaacuaaaaugucuuugaaaaac

SEQ ID NO: 4067783 - RNA, 15 nt, Staphylococcus aureus subsp. aureus N315
uaacuacacuuaaua

SEQ ID NO: 4067784 - RNA, 16 nt, Staphylococcus aureus subsp. aureus N315
uaacuagaaugauuaa

SEQ ID NO: 4067785 - RNA, 22 nt, Staphylococcus aureus subsp. aureus N315
uaacuagauguucacauucuug

SEQ ID NO: 4067786 - RNA, 17 nt, Staphylococcus aureus subsp. aureus N315
uaacuagugccucuuuu

SEQ ID NO: 4067787 - RNA, 17 nt, Staphylococcus aureus subsp. aureus N315
uaacuaguguaaugucu

SEQ ID NO: 4067788 - RNA, 22 nt, Staphylococcus aureus subsp. aureus N315
uaacuauaacaauaguuuucuu

SEQ ID NO: 4067789 - RNA, 23 nt, Staphylococcus aureus subsp. aureus N315
uaacuauauugugcuaaguuagg

SEQ ID NO: 4067790 - RNA, 17 nt, Staphylococcus aureus subsp. aureus N315
uaacuaugaaugcugug

SEQ ID NO: 4067791 - RNA, 21 nt, Staphylococcus aureus subsp. aureus N315
uaacuauguuacuuauauauu

SEQ ID NO: 4067792 - RNA, 16 nt, Staphylococcus aureus subsp. aureus N315
uaacuauugaaaauag

SEQ ID NO: 4067793 - RNA, 17 nt, Staphylococcus aureus subsp. aureus N315
uaacucaaagaaacuau

SEQ ID NO: 4067794 - RNA, 18 nt, Staphylococcus aureus subsp. aureus N315
uaacucaaagaaacuaua

SEQ ID NO: 4067795 - RNA, 20 nt, Staphylococcus aureus subsp. aureus N315
uaacucaaauaucuaaacaa

SEQ ID NO: 4067796 - RNA, 14 nt, Staphylococcus aureus subsp. aureus N315
uaacucaagugauu

SEQ ID NO: 4067797 - RNA, 14 nt, Staphylococcus aureus subsp. aureus N315
uaacuccuccaaag

SEQ ID NO: 4067798 - RNA, 16 nt, Staphylococcus aureus subsp. aureus N315
uaacucguaaucauag

SEQ ID NO: 4067799 - RNA, 20 nt, Staphylococcus aureus subsp. aureus N315
uaacucugaucuaaaaccau

SEQ ID NO: 4067800 - RNA, 14 nt, Staphylococcus aureus subsp. aureus N315
uaacucuucaguac

SEQ ID NO: 4067801 - RNA, 15 nt, Staphylococcus aureus subsp. aureus N315
uaacucuuuaauuuu

SEQ ID NO: 4067802 - RNA, 17 nt, Staphylococcus aureus subsp. aureus N315
uaacugaauuaaagcau

SEQ ID NO: 4067803 - RNA, 13 nt, Staphylococcus aureus subsp. aureus N315
uaacugauaaaag

SEQ ID NO: 4067804 - RNA, 19 nt, Staphylococcus aureus subsp. aureus N315
uaacugcaaacuugauuca

SEQ ID NO: 4067805 - RNA, 19 nt, Staphylococcus aureus subsp. aureus N315
uaacugcuaauuuuuucau

SEQ ID NO: 4067806 - RNA, 14 nt, Staphylococcus aureus subsp. aureus N315
uaacugggauauag

SEQ ID NO: 4067807 - RNA, 23 nt, Staphylococcus aureus subsp. aureus N315
uaacugguugauaaauaaacuca

SEQ ID NO: 4067808 - RNA, 17 nt, Staphylococcus aureus subsp. aureus N315
uaacuguagcuccuaaa

SEQ ID NO: 4067809 - RNA, 16 nt, Staphylococcus aureus subsp. aureus N315
uaacuguucuuucguc

SEQ ID NO: 4067810 - RNA, 16 nt, Staphylococcus aureus subsp. aureus N315
uaacuguuuauccaua

SEQ ID NO: 4067811 - RNA, 13 nt, Staphylococcus aureus subsp. aureus N315
uaacuuaaaauuu

SEQ ID NO: 4067812 - RNA, 18 nt, Staphylococcus aureus subsp. aureus N315
uaacuuaaaauuuaaaua

SEQ ID NO: 4067813 - RNA, 21 nt, Staphylococcus aureus subsp. aureus N315
uaacuuaaaauuuaaauauug

SEQ ID NO: 4067814 - RNA, 19 nt, Staphylococcus aureus subsp. aureus N315
uaacuuaagcucauuucaa

SEQ ID NO: 4067815 - RNA, 13 nt, Staphylococcus aureus subsp. aureus N315
uaacuuaccauga

SEQ ID NO: 4067816 - RNA, 19 nt, Staphylococcus aureus subsp. aureus N315
uaacuucauaauauauccu

SEQ ID NO: 4067817 - RNA, 10 nt, Staphylococcus aureus subsp. aureus N315
uaacuuccua

SEQ ID NO: 4067818 - RNA, 21 nt, Staphylococcus aureus subsp. aureus N315
uaacuuccuaaaauuuacaaa

SEQ ID NO: 4067819 - RNA, 16 nt, Staphylococcus aureus subsp. aureus N315
uaacuucguuuuaaua

SEQ ID NO: 4067820 - RNA, 17 nt, Staphylococcus aureus subsp. aureus N315
uaacuucugauucuuca

SEQ ID NO: 4067821 - RNA, 18 nt, Staphylococcus aureus subsp. aureus N315
uaacuucugauucuucac

SEQ ID NO: 4067822 - RNA, 14 nt, Staphylococcus aureus subsp. aureus N315
uaacuugauaucau

SEQ ID NO: 4067823 - RNA, 16 nt, Staphylococcus aureus subsp. aureus N315
uaacuugauaucaucu

SEQ ID NO: 4067824 - RNA, 14 nt, Staphylococcus aureus subsp. aureus N315
uaaguuaugacuaa

SEQ ID NO: 4067825 - RNA, 21 nt, Staphylococcus aureus subsp. aureus N315
uaaguuauuuggauauuuauu

SEQ ID NO: 4067826 - RNA, 14 nt, Staphylococcus aureus subsp. aureus N315
uaaguugauuucua

SEQ ID NO: 4067827 - RNA, 15 nt, Staphylococcus aureus subsp. aureus N315
uaaguuugucuuuga

SEQ ID NO: 4067828 - RNA, 20 nt, Staphylococcus aureus subsp. aureus N315
uaaguuugucuuugaacaua

SEQ ID NO: 4067829 - RNA, 19 nt, Staphylococcus aureus subsp. aureus N315
uaaguuuuugaauaucuaa

SEQ ID NO: 4067830 - RNA, 21 nt, Staphylococcus aureus subsp. aureus N315
uaauaaaaccaccuguuugca

SEQ ID NO: 4067831 - RNA, 13 nt, Staphylococcus aureus subsp. aureus N315
uaauaaaccuaaa

SEQ ID NO: 4067832 - RNA, 19 nt, Staphylococcus aureus subsp. aureus N315
uaauaaagcugauuuuuca

SEQ ID NO: 4067833 - RNA, 21 nt, Staphylococcus aureus subsp. aureus N315
uaauaaauaggaugaaaaaga

SEQ ID NO: 4067834 - RNA, 22 nt, Staphylococcus aureus subsp. aureus N315
uaauaaauaggaugaaaaagau

SEQ ID NO: 4067835 - RNA, 11 nt, Staphylococcus aureus subsp. aureus N315
uaauaaauauc

SEQ ID NO: 4067836 - RNA, 22 nt, Staphylococcus aureus subsp. aureus N315
uaauaaaucacgccauaaucuu

SEQ ID NO: 4067837 - RNA, 22 nt, Staphylococcus aureus subsp. aureus N315
uaauaaaucauuaguuguauca

SEQ ID NO: 4067838 - RNA, 23 nt, Staphylococcus aureus subsp. aureus N315
uaauaaaucgaauugauggaaaa

SEQ ID NO: 4067839 - RNA, 11 nt, Staphylococcus aureus subsp. aureus N315
uaauaaauugu

SEQ ID NO: 4067840 - RNA, 21 nt, Staphylococcus aureus subsp. aureus N315
uaauaaauuuccaaaguaaua

SEQ ID NO: 4067841 - RNA, 20 nt, Staphylococcus aureus subsp. aureus N315
uaauaacauccccaaaaaua

SEQ ID NO: 4067842 - RNA, 21 nt, Staphylococcus aureus subsp. aureus N315
uaauaacauccccaaaaauag

SEQ ID NO: 4067843 - RNA, 14 nt, Staphylococcus aureus subsp. aureus N315
uaauaacaucuaaa

SEQ ID NO: 4067844 - RNA, 19 nt, Staphylococcus aureus subsp. aureus N315
uaauaaccauguaaaauua

SEQ ID NO: 4067845 - RNA, 18 nt, Staphylococcus aureus subsp. aureus N315
uaauaaccuuuaaaacau

SEQ ID NO: 4067846 - RNA, 17 nt, Staphylococcus aureus subsp. aureus N315
uaauaacgcauauaagc

SEQ ID NO: 4067847 - RNA, 22 nt, Staphylococcus aureus subsp. aureus N315
uaauaagagaacuuuucaaaca

SEQ ID NO: 4067848 - RNA, 15 nt, Staphylococcus aureus subsp. aureus N315
uaauaagagguauag

SEQ ID NO: 4067849 - RNA, 15 nt, Staphylococcus aureus subsp. aureus N315
uaauaaguugaauau

SEQ ID NO: 4067850 - RNA, 17 nt, Staphylococcus aureus subsp. aureus N315
uaauaaguugaauauaa

SEQ ID NO: 4067851 - RNA, 20 nt, Staphylococcus aureus subsp. aureus N315
uaauaaguugaauauaaaaa

SEQ ID NO: 4067852 - RNA, 21 nt, Staphylococcus aureus subsp. aureus N315
uaauaaguugaauauaaaaaa

SEQ ID NO: 4067853 - RNA, 13 nt, Staphylococcus aureus subsp. aureus N315
uaauaauaaucuu

SEQ ID NO: 4067854 - RNA, 15 nt, Staphylococcus aureus subsp. aureus N315
uaauaauauaaauaa

SEQ ID NO: 4067855 - RNA, 16 nt, Staphylococcus aureus subsp. aureus N315
uaauaaucuuuaacau

SEQ ID NO: 4067856 - RNA, 18 nt, Staphylococcus aureus subsp. aureus N315
uaauaaucuuuaacauuu

SEQ ID NO: 4067857 - RNA, 16 nt, Staphylococcus aureus subsp. aureus N315
uaauaaugaauucuau

SEQ ID NO: 4067858 - RNA, 19 nt, Staphylococcus aureus subsp. aureus N315
uaauaaugaauucuauccu

SEQ ID NO: 4067859 - RNA, 13 nt, Staphylococcus aureus subsp. aureus N315
uaauaaugacuga

SEQ ID NO: 4067860 - RNA, 14 nt, Staphylococcus aureus subsp. aureus N315
uaauaauguaucau

SEQ ID NO: 4067861 - RNA, 15 nt, Staphylococcus aureus subsp. aureus N315
uaauaauuauuaaua

SEQ ID NO: 4067862 - RNA, 18 nt, Staphylococcus aureus subsp. aureus N315
uaauaauucauaaaugcu

SEQ ID NO: 4067863 - RNA, 19 nt, Staphylococcus aureus subsp. aureus N315
uaauaauucauaaaugcuu

SEQ ID NO: 4067864 - RNA, 22 nt, Staphylococcus aureus subsp. aureus N315
uaauaauugcauguaaaauuaa

SEQ ID NO: 4067865 - RNA, 16 nt, Staphylococcus aureus subsp. aureus N315
uaauaauuggaaucau

SEQ ID NO: 4067866 - RNA, 18 nt, Staphylococcus aureus subsp. aureus N315
uaauaauuggaaucaucu

SEQ ID NO: 4067867 - RNA, 15 nt, Staphylococcus aureus subsp. aureus N315
uaauaauuuaacuaa

SEQ ID NO: 4067868 - RNA, 12 nt, Staphylococcus aureus subsp. aureus N315
uaauaauuuaca

SEQ ID NO: 4067869 - RNA, 21 nt, Staphylococcus aureus subsp. aureus N315
uaauaauuugguuaacauccu

SEQ ID NO: 4067870 - RNA, 13 nt, Staphylococcus aureus subsp. aureus N315
uaauaauuuuuuu

SEQ ID NO: 4067871 - RNA, 18 nt, Staphylococcus aureus subsp. aureus N315
uaauaauuuuuuuccuuu

SEQ ID NO: 4067872 - RNA, 14 nt, Staphylococcus aureus subsp. aureus N315
uaauacaaaacaaa

SEQ ID NO: 4067873 - RNA, 14 nt, Staphylococcus aureus subsp. aureus N315
uaauacaagcaaua

SEQ ID NO: 4067874 - RNA, 19 nt, Staphylococcus aureus subsp. aureus N315
uaauacaagucuuuacucu

SEQ ID NO: 4067875 - RNA, 16 nt, Staphylococcus aureus subsp. aureus N315
uaauacaucuaauaaa

SEQ ID NO: 4067876 - RNA, 18 nt, Staphylococcus aureus subsp. aureus N315
uaauacaucuaauaaaua

SEQ ID NO: 4067877 - RNA, 15 nt, Staphylococcus aureus subsp. aureus N315
uaauaccauugugau

SEQ ID NO: 4067878 - RNA, 23 nt, Staphylococcus aureus subsp. aureus N315
uaauaccuucaauugacauuaau

SEQ ID NO: 4067879 - RNA, 19 nt, Staphylococcus aureus subsp. aureus N315
uaauaccuuuacuuucauu

SEQ ID NO: 4067880 - RNA, 18 nt, Staphylococcus aureus subsp. aureus N315
uaauacguguguuuucuu

SEQ ID NO: 4067881 - RNA, 20 nt, Staphylococcus aureus subsp. aureus N315
uaauacguuuaauaaugguu

SEQ ID NO: 4067882 - RNA, 20 nt, Staphylococcus aureus subsp. aureus N315
uaauacuaccguuuuuauau

SEQ ID NO: 4067883 - RNA, 16 nt, Staphylococcus aureus subsp. aureus N315
uaauacuauaugaaaa

SEQ ID NO: 4067884 - RNA, 22 nt, Staphylococcus aureus subsp. aureus N315
uaauacuguauuuuaacgucau

SEQ ID NO: 4067885 - RNA, 17 nt, Staphylococcus aureus subsp. aureus N315
uaauacuguuuaaauaa

SEQ ID NO: 4067886 - RNA, 20 nt, Staphylococcus aureus subsp. aureus N315
uaauacuguuuaaauaaaau

SEQ ID NO: 4067887 - RNA, 21 nt, Staphylococcus aureus subsp. aureus N315
uaauacuguuuaaauaaaauu

SEQ ID NO: 4067888 - RNA, 20 nt, Staphylococcus aureus subsp. aureus N315
uaauacuuucacuuuuuaua

SEQ ID NO: 4067889 - RNA, 15 nt, Staphylococcus aureus subsp. aureus N315
uaauacuuuucucga

SEQ ID NO: 4067890 - RNA, 17 nt, Staphylococcus aureus subsp. aureus N315
uaauacuuuuugaguau

SEQ ID NO: 4067891 - RNA, 13 nt, Staphylococcus aureus subsp. aureus N315
uaauagaaauaau

SEQ ID NO: 4067892 - RNA, 15 nt, Staphylococcus aureus subsp. aureus N315
uaauagaaauaauca

SEQ ID NO: 4067893 - RNA, 14 nt, Staphylococcus aureus subsp. aureus N315
uaauagacauuaac

SEQ ID NO: 4067894 - RNA, 17 nt, Staphylococcus aureus subsp. aureus N315
uaauagcaaaauuaugu

SEQ ID NO: 4067895 - RNA, 20 nt, Staphylococcus aureus subsp. aureus N315
uaauagcauuccuaauuaua

SEQ ID NO: 4067896 - RNA, 18 nt, Staphylococcus aureus subsp. aureus N315
uaauagccauucgaugcu

SEQ ID NO: 4067897 - RNA, 17 nt, Staphylococcus aureus subsp. aureus N315
uaauagcuuguacacau

SEQ ID NO: 4067898 - RNA, 18 nt, Staphylococcus aureus subsp. aureus N315
uaauaggauuauuaucaa

SEQ ID NO: 4067899 - RNA, 21 nt, Staphylococcus aureus subsp. aureus N315
uaauagguuauguuauguaaa

SEQ ID NO: 4067900 - RNA, 16 nt, Staphylococcus aureus subsp. aureus N315
uaauaguaaugaugug

SEQ ID NO: 4067901 - RNA, 15 nt, Staphylococcus aureus subsp. aureus N315
uaauaguguuauauu

SEQ ID NO: 4067902 - RNA, 12 nt, Staphylococcus aureus subsp. aureus N315
uaauauaaaaac

SEQ ID NO: 4067903 - RNA, 15 nt, Staphylococcus aureus subsp. aureus N315
uaauauaaaaacaaa

SEQ ID NO: 4067904 - RNA, 16 nt, Staphylococcus aureus subsp. aureus N315
uaauauaaauuuugaa

SEQ ID NO: 4067905 - RNA, 15 nt, Staphylococcus aureus subsp. aureus N315
uaauauaaguauaau

SEQ ID NO: 4067906 - RNA, 12 nt, Staphylococcus aureus subsp. aureus N315
uaauauaauacc

SEQ ID NO: 4067907 - RNA, 17 nt, Staphylococcus aureus subsp. aureus N315
uaauauaauuaaacauu

SEQ ID NO: 4067908 - RNA, 14 nt, Staphylococcus aureus subsp. aureus N315
uaauauaauuaauu

SEQ ID NO: 4067909 - RNA, 14 nt, Staphylococcus aureus subsp. aureus N315
uaauauaauuauua

SEQ ID NO: 4067910 - RNA, 15 nt, Staphylococcus aureus subsp. aureus N315
uaauauauaaaaguc

SEQ ID NO: 4067911 - RNA, 13 nt, Staphylococcus aureus subsp. aureus N315
uaauauauuaauu

SEQ ID NO: 4067912 - RNA, 22 nt, Staphylococcus aureus subsp. aureus N315
uaaugauuuuuauuauugucau

SEQ ID NO: 4067913 - RNA, 23 nt, Staphylococcus aureus subsp. aureus N315
uaaugcaagcgacgauuggaaag

SEQ ID NO: 4067914 - RNA, 21 nt, Staphylococcus aureus subsp. aureus N315
uaaugcagauucuucaccaac

SEQ ID NO: 4067915 - RNA, 14 nt, Staphylococcus aureus subsp. aureus N315
uaaugccaaauaua

SEQ ID NO: 4067916 - RNA, 23 nt, Staphylococcus aureus subsp. aureus N315
uaaugccaaauauaguaauuguu

SEQ ID NO: 4067917 - RNA, 23 nt, Staphylococcus aureus subsp. aureus N315
uaaugccaccguggaauuuacca

SEQ ID NO: 4067918 - RNA, 19 nt, Staphylococcus aureus subsp. aureus N315
uaaugccguaguuuucucu

SEQ ID NO: 4067919 - RNA, 21 nt, Staphylococcus aureus subsp. aureus N315
uaaugccugcccuuuagucau

SEQ ID NO: 4067920 - RNA, 14 nt, Staphylococcus aureus subsp. aureus N315
uaaugcuaauuuaa

SEQ ID NO: 4067921 - RNA, 17 nt, Staphylococcus aureus subsp. aureus N315
uaaugcuaauuuaacug

SEQ ID NO: 4067922 - RNA, 13 nt, Staphylococcus aureus subsp. aureus N315
uaaugcuauauuu

SEQ ID NO: 4067923 - RNA, 17 nt, Staphylococcus aureus subsp. aureus N315
uaaugcucuauauaucc

SEQ ID NO: 4067924 - RNA, 20 nt, Staphylococcus aureus subsp. aureus N315
uaaugcuguacuauauucaa

SEQ ID NO: 4067925 - RNA, 18 nt, Staphylococcus aureus subsp. aureus N315
uaauggagcacuaucuuu

SEQ ID NO: 4067926 - RNA, 14 nt, Staphylococcus aureus subsp. aureus N315
uaauggcaacuaag

SEQ ID NO: 4067927 - RNA, 16 nt, Staphylococcus aureus subsp. aureus N315
uaauggcaacuaagau

SEQ ID NO: 4067928 - RNA, 16 nt, Staphylococcus aureus subsp. aureus N315
uaaugguauugauuau

SEQ ID NO: 4067929 - RNA, 22 nt, Staphylococcus aureus subsp. aureus N315
uaaugguugaauaacacuagaa

SEQ ID NO: 4067930 - RNA, 17 nt, Staphylococcus aureus subsp. aureus N315
uaauguacauguauaaa

SEQ ID NO: 4067931 - RNA, 23 nt, Staphylococcus aureus subsp. aureus N315
uaauguacauguauaaaagauau

SEQ ID NO: 4067932 - RNA, 15 nt, Staphylococcus aureus subsp. aureus N315
uaauguauaaaacag

SEQ ID NO: 4067933 - RNA, 21 nt, Staphylococcus aureus subsp. aureus N315
uaauguaucauuucagaaaua

SEQ ID NO: 4067934 - RNA, 14 nt, Staphylococcus aureus subsp. aureus N315
uaauguauuaauug

SEQ ID NO: 4067935 - RNA, 13 nt, Staphylococcus aureus subsp. aureus N315
uaauguauucuuc

SEQ ID NO: 4067936 - RNA, 15 nt, Staphylococcus aureus subsp. aureus N315
uaaugucauaucuuu

SEQ ID NO: 4067937 - RNA, 17 nt, Staphylococcus aureus subsp. aureus N315
uaaugugcgucacucac

SEQ ID NO: 4067938 - RNA, 17 nt, Staphylococcus aureus subsp. aureus N315
uaauguguuaauacuuc

SEQ ID NO: 4067939 - RNA, 20 nt, Staphylococcus aureus subsp. aureus N315
uaauguuaaaauaacugcua

SEQ ID NO: 4067940 - RNA, 13 nt, Staphylococcus aureus subsp. aureus N315
uaauguuaaacac

SEQ ID NO: 4067941 - RNA, 16 nt, Staphylococcus aureus subsp. aureus N315
uaauguuaaacacuca

SEQ ID NO: 4067942 - RNA, 15 nt, Staphylococcus aureus subsp. aureus N315
uaauguuacgcugug

SEQ ID NO: 4067943 - RNA, 19 nt, Staphylococcus aureus subsp. aureus N315
uaauguuccccugaaaaga

SEQ ID NO: 4067944 - RNA, 13 nt, Staphylococcus aureus subsp. aureus N315
uaauguuuccauu

SEQ ID NO: 4067945 - RNA, 15 nt, Staphylococcus aureus subsp. aureus N315
uaauguuugcuuuuu

SEQ ID NO: 4067946 - RNA, 17 nt, Staphylococcus aureus subsp. aureus N315
uaauguuuucauuggau

SEQ ID NO: 4067947 - RNA, 17 nt, Staphylococcus aureus subsp. aureus N315
uaauuaaaaaauuccua

SEQ ID NO: 4067948 - RNA, 23 nt, Staphylococcus aureus subsp. aureus N315
uaauuaaaagugcaaguccaaau

SEQ ID NO: 4067949 - RNA, 12 nt, Staphylococcus aureus subsp. aureus N315
uaauuaaaauaa

SEQ ID NO: 4067950 - RNA, 22 nt, Staphylococcus aureus subsp. aureus N315
uaauuaaaauaagauauauaau

SEQ ID NO: 4067951 - RNA, 14 nt, Staphylococcus aureus subsp. aureus N315
uaauuaaaauacaa

SEQ ID NO: 4067952 - RNA, 16 nt, Staphylococcus aureus subsp. aureus N315
uaauuaaaauacaaau

SEQ ID NO: 4067953 - RNA, 16 nt, Staphylococcus aureus subsp. aureus N315
uaauuaaaauucucuu

SEQ ID NO: 4067954 - RNA, 14 nt, Staphylococcus aureus subsp. aureus N315
uaauuaaagauuaa

SEQ ID NO: 4067955 - RNA, 17 nt, Staphylococcus aureus subsp. aureus N315
uaauuaaagauuaaaau

SEQ ID NO: 4067956 - RNA, 14 nt, Staphylococcus aureus subsp. aureus N315
uaauuaaauaacuu

SEQ ID NO: 4067957 - RNA, 18 nt, Staphylococcus aureus subsp. aureus N315
uaauuaacacauucaaau

SEQ ID NO: 4067958 - RNA, 20 nt, Staphylococcus aureus subsp. aureus N315
uaauuaacacauucaaauaa

SEQ ID NO: 4067959 - RNA, 22 nt, Staphylococcus aureus subsp. aureus N315
uaauuaacuuacuuuuguaaaa

SEQ ID NO: 4067960 - RNA, 20 nt, Staphylococcus aureus subsp. aureus N315
uaauuaagaaaaucauucau

SEQ ID NO: 4067961 - RNA, 14 nt, Staphylococcus aureus subsp. aureus N315
uaauuaauacauca

SEQ ID NO: 4067962 - RNA, 14 nt, Staphylococcus aureus subsp. aureus N315
uaauuaaugccauu

SEQ ID NO: 4067963 - RNA, 14 nt, Staphylococcus aureus subsp. aureus N315
uaauuaauuaaaau

SEQ ID NO: 4067964 - RNA, 16 nt, Staphylococcus aureus subsp. aureus N315
uaauuaauuuguccau

SEQ ID NO: 4067965 - RNA, 21 nt, Staphylococcus aureus subsp. aureus N315
uaauuacaauauaauuuccua

SEQ ID NO: 4067966 - RNA, 23 nt, Staphylococcus aureus subsp. aureus N315
uaauuacaggaauugcuuuaaac

SEQ ID NO: 4067967 - RNA, 19 nt, Staphylococcus aureus subsp. aureus N315
uaauuacagguuuaaacau

SEQ ID NO: 4067968 - RNA, 20 nt, Staphylococcus aureus subsp. aureus N315
uaauuacagguuuaaacauc

SEQ ID NO: 4067969 - RNA, 18 nt, Staphylococcus aureus subsp. aureus N315
uaauuacagguuuaauug

SEQ ID NO: 4067970 - RNA, 19 nt, Staphylococcus aureus subsp. aureus N315
uaauuacagguuuaauuga

SEQ ID NO: 4067971 - RNA, 19 nt, Staphylococcus aureus subsp. aureus N315
uaauuacgucauaaaauac

SEQ ID NO: 4067972 - RNA, 14 nt, Staphylococcus aureus subsp. aureus N315
uaauuacuuucauu

SEQ ID NO: 4067973 - RNA, 22 nt, Staphylococcus aureus subsp. aureus N315
uaauuacuuucauuguaaauuu

SEQ ID NO: 4067974 - RNA, 22 nt, Staphylococcus aureus subsp. aureus N315
uaauuagugcaaguaauuuaau

SEQ ID NO: 4067975 - RNA, 19 nt, Staphylococcus aureus subsp. aureus N315
uaauuauacguuacuaaac

SEQ ID NO: 4067976 - RNA, 17 nt, Staphylococcus aureus subsp. aureus N315
uaauuauauuaaugauu

SEQ ID NO: 4067977 - RNA, 13 nt, Staphylococcus aureus subsp. aureus N315
uaauuaucauaua

SEQ ID NO: 4067978 - RNA, 16 nt, Staphylococcus aureus subsp. aureus N315
uaauuaucauauaaau

SEQ ID NO: 4067979 - RNA, 13 nt, Staphylococcus aureus subsp. aureus N315
uaauuauguauuu

SEQ ID NO: 4067980 - RNA, 13 nt, Staphylococcus aureus subsp. aureus N315
uaauuauuaauaa

SEQ ID NO: 4067981 - RNA, 17 nt, Staphylococcus aureus subsp. aureus N315
uaauuauuaauaaaggg

SEQ ID NO: 4067982 - RNA, 16 nt, Staphylococcus aureus subsp. aureus N315
uaauuauugagaauau

SEQ ID NO: 4067983 - RNA, 20 nt, Staphylococcus aureus subsp. aureus N315
uaauuauugagaauauuuau

SEQ ID NO: 4067984 - RNA, 14 nt, Staphylococcus aureus subsp. aureus N315
uaauuauuucucuu

SEQ ID NO: 4067985 - RNA, 17 nt, Staphylococcus aureus subsp. aureus N315
uaauucaacuuaaaugg

SEQ ID NO: 4067986 - RNA, 22 nt, Staphylococcus aureus subsp. aureus N315
uaauucaacuuaaauggaugau

SEQ ID NO: 4067987 - RNA, 20 nt, Staphylococcus aureus subsp. aureus N315
uaauucaccaucauauucaa

SEQ ID NO: 4067988 - RNA, 15 nt, Staphylococcus aureus subsp. aureus N315
uaauucauauauacu

SEQ ID NO: 4067989 - RNA, 18 nt, Staphylococcus aureus subsp. aureus N315
uaauuccaguauuaacug

SEQ ID NO: 4067990 - RNA, 19 nt, Staphylococcus aureus subsp. aureus N315
uaauucccuaggaaauaaa

SEQ ID NO: 4067991 - RNA, 17 nt, Staphylococcus aureus subsp. aureus N315
uaauucccuguuaugaa

SEQ ID NO: 4067992 - RNA, 23 nt, Staphylococcus aureus subsp. aureus N315
uaauuccucuggaacuuuaauac

SEQ ID NO: 4067993 - RNA, 15 nt, Staphylococcus aureus subsp. aureus N315
uaauuccugauacaa

SEQ ID NO: 4067994 - RNA, 13 nt, Staphylococcus aureus subsp. aureus N315
uaauuccuggugc

SEQ ID NO: 4067995 - RNA, 21 nt, Staphylococcus aureus subsp. aureus N315
uaauuccuggugcaauaauaa

SEQ ID NO: 4067996 - RNA, 22 nt, Staphylococcus aureus subsp. aureus N315
uaauucgccaucuuuuuuagcu

SEQ ID NO: 4067997 - RNA, 19 nt, Staphylococcus aureus subsp. aureus N315
uaauucguaauuuaugauu

SEQ ID NO: 4067998 - RNA, 18 nt, Staphylococcus aureus subsp. aureus N315
uaauucguugauuuagca

SEQ ID NO: 4067999 - RNA, 17 nt, Staphylococcus aureus subsp. aureus N315
uacaaaggauuauuaac

SEQ ID NO: 4068000 - RNA, 20 nt, Staphylococcus aureus subsp. aureus N315
uacaaagucauuuucauuca

SEQ ID NO: 4068001 - RNA, 19 nt, Staphylococcus aureus subsp. aureus N315
uacaaaguuaaccauacau

SEQ ID NO: 4068002 - RNA, 18 nt, Staphylococcus aureus subsp. aureus N315
uacaaaguuauaauggca

SEQ ID NO: 4068003 - RNA, 14 nt, Staphylococcus aureus subsp. aureus N315
uacaaauaacaaac

SEQ ID NO: 4068004 - RNA, 14 nt, Staphylococcus aureus subsp. aureus N315
uacaaauauaucua

SEQ ID NO: 4068005 - RNA, 21 nt, Staphylococcus aureus subsp. aureus N315
uacaaaucaugacauaaaacu

SEQ ID NO: 4068006 - RNA, 18 nt, Staphylococcus aureus subsp. aureus N315
uacaaauguauaaauaau

SEQ ID NO: 4068007 - RNA, 19 nt, Staphylococcus aureus subsp. aureus N315
uacaaauguauaaauaaua

SEQ ID NO: 4068008 - RNA, 23 nt, Staphylococcus aureus subsp. aureus N315
uacaaauguauaaauaauaaaug

SEQ ID NO: 4068009 - RNA, 12 nt, Staphylococcus aureus subsp. aureus N315
uacaaauugauu

SEQ ID NO: 4068010 - RNA, 23 nt, Staphylococcus aureus subsp. aureus N315
uacaaauuuuuuuuauuaauuaa

SEQ ID NO: 4068011 - RNA, 18 nt, Staphylococcus aureus subsp. aureus N315
uacaacaccaauugaaau

SEQ ID NO: 4068012 - RNA, 21 nt, Staphylococcus aureus subsp. aureus N315
uacaacaccaauugaaauuaa

SEQ ID NO: 4068013 - RNA, 15 nt, Staphylococcus aureus subsp. aureus N315
uacaacaguugcacc

SEQ ID NO: 4068014 - RNA, 14 nt, Staphylococcus aureus subsp. aureus N315
uacaacauacaugc

SEQ ID NO: 4068015 - RNA, 14 nt, Staphylococcus aureus subsp. aureus N315
uacaacauguguau

SEQ ID NO: 4068016 - RNA, 22 nt, Staphylococcus aureus subsp. aureus N315
uacaaccuuugcuuaaaccuua

SEQ ID NO: 4068017 - RNA, 21 nt, Staphylococcus aureus subsp. aureus N315
uacaacgacacgaacaacauu

SEQ ID NO: 4068018 - RNA, 23 nt, Staphylococcus aureus subsp. aureus N315
uacaacgacacgaacaacauuag

SEQ ID NO: 4068019 - RNA, 14 nt, Staphylococcus aureus subsp. aureus N315
uacaacuaaauaug

SEQ ID NO: 4068020 - RNA, 17 nt, Staphylococcus aureus subsp. aureus N315
uacaacucguuuuucca

SEQ ID NO: 4068021 - RNA, 23 nt, Staphylococcus aureus subsp. aureus N315
uacaacugaaucuccuugcucau

SEQ ID NO: 4068022 - RNA, 12 nt, Staphylococcus aureus subsp. aureus N315
uacaacuucauu

SEQ ID NO: 4068023 - RNA, 23 nt, Staphylococcus aureus subsp. aureus N315
uacaacuuuaguuguuaggggcu

SEQ ID NO: 4068024 - RNA, 15 nt, Staphylococcus aureus subsp. aureus N315
uacaacuuuuagagu

SEQ ID NO: 4068025 - RNA, 23 nt, Staphylococcus aureus subsp. aureus N315
uacaagucuaguucgaacacaca

SEQ ID NO: 4068026 - RNA, 14 nt, Staphylococcus aureus subsp. aureus N315
uacaagucuuauuu

SEQ ID NO: 4068027 - RNA, 20 nt, Staphylococcus aureus subsp. aureus N315
uacaagucuuuacucuacac

SEQ ID NO: 4068028 - RNA, 15 nt, Staphylococcus aureus subsp. aureus N315
uacaauauagaaaau

SEQ ID NO: 4068029 - RNA, 17 nt, Staphylococcus aureus subsp. aureus N315
uacaauauagaaaauga

SEQ ID NO: 4068030 - RNA, 15 nt, Staphylococcus aureus subsp. aureus N315
uacaauaugauuaau

SEQ ID NO: 4068031 - RNA, 16 nt, Staphylococcus aureus subsp. aureus N315
uacaauaugauuaaua

SEQ ID NO: 4068032 - RNA, 17 nt, Staphylococcus aureus subsp. aureus N315
uacaauauuaaaauuaa

SEQ ID NO: 4068033 - RNA, 18 nt, Staphylococcus aureus subsp. aureus N315
uacaauauucaauaauuc

SEQ ID NO: 4068034 - RNA, 19 nt, Staphylococcus aureus subsp. aureus N315
uacaauauucaauaauuca

SEQ ID NO: 4068035 - RNA, 17 nt, Staphylococcus aureus subsp. aureus N315
uacaaucaucacacaua

SEQ ID NO: 4068036 - RNA, 13 nt, Staphylococcus aureus subsp. aureus N315
uacaaugaaaaaa

SEQ ID NO: 4068037 - RNA, 17 nt, Staphylococcus aureus subsp. aureus N315
uacaaugaauuucuaau

SEQ ID NO: 4068038 - RNA, 17 nt, Staphylococcus aureus subsp. aureus N315
uacaaugcgguauugca

SEQ ID NO: 4068039 - RNA, 23 nt, Staphylococcus aureus subsp. aureus N315
uacaauuaauuacuguaaauaug

SEQ ID NO: 4068040 - RNA, 17 nt, Staphylococcus aureus subsp. aureus N315
uacaauuauaaaugauu

SEQ ID NO: 4068041 - RNA, 16 nt, Staphylococcus aureus subsp. aureus N315
uacaauuauauguagg

SEQ ID NO: 4068042 - RNA, 15 nt, Staphylococcus aureus subsp. aureus N315
uacaauuuccuaccc

SEQ ID NO: 4068043 - RNA, 17 nt, Staphylococcus aureus subsp. aureus N315
uacaauuuucucauuaa

SEQ ID NO: 4068044 - RNA, 14 nt, Staphylococcus aureus subsp. aureus N315
uacaauuuuuaaaa

SEQ ID NO: 4068045 - RNA, 15 nt, Staphylococcus aureus subsp. aureus N315
uacaauuuuuaaaaa

SEQ ID NO: 4068046 - RNA, 21 nt, Staphylococcus aureus subsp. aureus N315
uacacaaugcccuuaaagcac

SEQ ID NO: 4068047 - RNA, 18 nt, Staphylococcus aureus subsp. aureus N315
uacacacuaaggaaaauu

SEQ ID NO: 4068048 - RNA, 15 nt, Staphylococcus aureus subsp. aureus N315
uacaccuacaaauau

SEQ ID NO: 4068049 - RNA, 14 nt, Staphylococcus aureus subsp. aureus N315
uacacgaguauuau

SEQ ID NO: 4068050 - RNA, 17 nt, Staphylococcus aureus subsp. aureus N315
uacacgaguauuaucac

SEQ ID NO: 4068051 - RNA, 20 nt, Staphylococcus aureus subsp. aureus N315
uacacgaguauuaucacaua

SEQ ID NO: 4068052 - RNA, 23 nt, Staphylococcus aureus subsp. aureus N315
uacacguaacgcaguugaaaaag

SEQ ID NO: 4068053 - RNA, 16 nt, Staphylococcus aureus subsp. aureus N315
uacacuaaguuuucuu

SEQ ID NO: 4068054 - RNA, 14 nt, Staphylococcus aureus subsp. aureus N315
uacacuagucuuuu

SEQ ID NO: 4068055 - RNA, 24 nt, Staphylococcus aureus subsp. aureus N315
uacacuaucauuaucaaauaaccu

SEQ ID NO: 4068056 - RNA, 20 nt, Staphylococcus aureus subsp. aureus N315
uacacuccccuuaucaaaac

SEQ ID NO: 4068057 - RNA, 15 nt, Staphylococcus aureus subsp. aureus N315
uacacugcacaucau

SEQ ID NO: 4068058 - RNA, 18 nt, Staphylococcus aureus subsp. aureus N315
uacacugcacaucauaau

SEQ ID NO: 4068059 - RNA, 12 nt, Staphylococcus aureus subsp. aureus N315
uacacuuaauau

SEQ ID NO: 4068060 - RNA, 16 nt, Staphylococcus aureus subsp. aureus N315
uacacuuaauauauuc

SEQ ID NO: 4068061 - RNA, 15 nt, Staphylococcus aureus subsp. aureus N315
uacacuuacaaauau

SEQ ID NO: 4068062 - RNA, 15 nt, Staphylococcus aureus subsp. aureus N315
uacacuugauaaaac

SEQ ID NO: 4068063 - RNA, 15 nt, Staphylococcus aureus subsp. aureus N315
uacacuuuucuuauc

SEQ ID NO: 4068064 - RNA, 16 nt, Staphylococcus aureus subsp. aureus N315
uacacuuuugauuguu

SEQ ID NO: 4068065 - RNA, 23 nt, Staphylococcus aureus subsp. aureus N315
uacacuuuugauuguuuaaacau

SEQ ID NO: 4068066 - RNA, 14 nt, Staphylococcus aureus subsp. aureus N315
uacagagaaucaau

SEQ ID NO: 4068067 - RNA, 17 nt, Staphylococcus aureus subsp. aureus N315
uacagagaaucaauuau

SEQ ID NO: 4068068 - RNA, 17 nt, Staphylococcus aureus subsp. aureus N315
uacagauaagaauauuu

SEQ ID NO: 4068069 - RNA, 18 nt, Staphylococcus aureus subsp. aureus N315
uacagauaggaaacuuaa

SEQ ID NO: 4068070 - RNA, 19 nt, Staphylococcus aureus subsp. aureus N315
uacagauaggaaacuuaaa

SEQ ID NO: 4068071 - RNA, 18 nt, Staphylococcus aureus subsp. aureus N315
uacagaucucaauccaau

SEQ ID NO: 4068072 - RNA, 20 nt, Staphylococcus aureus subsp. aureus N315
uacagaucucaauccaauua

SEQ ID NO: 4068073 - RNA, 12 nt, Staphylococcus aureus subsp. aureus N315
uacagaugaugc

SEQ ID NO: 4068074 - RNA, 21 nt, Staphylococcus aureus subsp. aureus N315
uacagaugaugcuucgcauca

SEQ ID NO: 4068075 - RNA, 15 nt, Staphylococcus aureus subsp. aureus N315
uacagcacugaaauc

SEQ ID NO: 4068076 - RNA, 14 nt, Staphylococcus aureus subsp. aureus N315
uacagcaucaccua

SEQ ID NO: 4068077 - RNA, 15 nt, Staphylococcus aureus subsp. aureus N315
uacagcguauuuuaa

SEQ ID NO: 4068078 - RNA, 20 nt, Staphylococcus aureus subsp. aureus N315
uacagcgugauucaucuauu

SEQ ID NO: 4068079 - RNA, 18 nt, Staphylococcus aureus subsp. aureus N315
uacagcuagcaagaauag

SEQ ID NO: 4068080 - RNA, 15 nt, Staphylococcus aureus subsp. aureus N315
uacaggcaaugcaag

SEQ ID NO: 4068081 - RNA, 14 nt, Staphylococcus aureus subsp. aureus N315
uacagguaaugcaa

SEQ ID NO: 4068082 - RNA, 14 nt, Staphylococcus aureus subsp. aureus N315
uacagguugaauaa

SEQ ID NO: 4068083 - RNA, 15 nt, Staphylococcus aureus subsp. aureus N315
uacagguuuaauaaa

SEQ ID NO: 4068084 - RNA, 18 nt, Staphylococcus aureus subsp. aureus N315
uacagguuuuaaaauuaa

SEQ ID NO: 4068085 - RNA, 15 nt, Staphylococcus aureus subsp. aureus N315
uacagucaacugcug

SEQ ID NO: 4068086 - RNA, 23 nt, Staphylococcus aureus subsp. aureus N315
uacaguucuauagguuuauaaaa

SEQ ID NO: 4068087 - RNA, 18 nt, Staphylococcus aureus subsp. aureus N315
uacgaaaguagaauuauu

SEQ ID NO: 4068088 - RNA, 18 nt, Staphylococcus aureus subsp. aureus N315
uacgaacaacuaacacgu

SEQ ID NO: 4068089 - RNA, 18 nt, Staphylococcus aureus subsp. aureus N315
uacgacgucgcaacagga

SEQ ID NO: 4068090 - RNA, 15 nt, Staphylococcus aureus subsp. aureus N315
uacgauaaauaguga

SEQ ID NO: 4068091 - RNA, 20 nt, Staphylococcus aureus subsp. aureus N315
uacgauaacuacacuuaaua

SEQ ID NO: 4068092 - RNA, 16 nt, Staphylococcus aureus subsp. aureus N315
uacgauauagugcuug

SEQ ID NO: 4068093 - RNA, 16 nt, Staphylococcus aureus subsp. aureus N315
uacgauucaauuuaac

SEQ ID NO: 4068094 - RNA, 19 nt, Staphylococcus aureus subsp. aureus N315
uacgauugaguugaaaaua

SEQ ID NO: 4068095 - RNA, 14 nt, Staphylococcus aureus subsp. aureus N315
uacgauugcaauug

SEQ ID NO: 4068096 - RNA, 12 nt, Staphylococcus aureus subsp. aureus N315
uacgauuuucaa

SEQ ID NO: 4068097 - RNA, 17 nt, Staphylococcus aureus subsp. aureus N315
uacgcaaugauuauaaa

SEQ ID NO: 4068098 - RNA, 19 nt, Staphylococcus aureus subsp. aureus N315
uacgcauuuuaaauaaaau

SEQ ID NO: 4068099 - RNA, 15 nt, Staphylococcus aureus subsp. aureus N315
uacgcccaucaucac

SEQ ID NO: 4068100 - RNA, 17 nt, Staphylococcus aureus subsp. aureus N315
uacgcccaucaucacug

SEQ ID NO: 4068101 - RNA, 16 nt, Staphylococcus aureus subsp. aureus N315
uacgccuucuuuauaa

SEQ ID NO: 4068102 - RNA, 15 nt, Staphylococcus aureus subsp. aureus N315
uacgcucauaugucu

SEQ ID NO: 4068103 - RNA, 15 nt, Staphylococcus aureus subsp. aureus N315
uacgguuauggugug

SEQ ID NO: 4068104 - RNA, 17 nt, Staphylococcus aureus subsp. aureus N315
uacguaucaagaaaaag

SEQ ID NO: 4068105 - RNA, 21 nt, Staphylococcus aureus subsp. aureus N315
uacguaucaagaaaaaguuuu

SEQ ID NO: 4068106 - RNA, 16 nt, Staphylococcus aureus subsp. aureus N315
uacgucauaaaauacc

SEQ ID NO: 4068107 - RNA, 15 nt, Staphylococcus aureus subsp. aureus N315
uacgugcuuuaaagu

SEQ ID NO: 4068108 - RNA, 21 nt, Staphylococcus aureus subsp. aureus N315
uacguguguaguagcaccgau

SEQ ID NO: 4068109 - RNA, 16 nt, Staphylococcus aureus subsp. aureus N315
uacguguguuuucuuu

SEQ ID NO: 4068110 - RNA, 16 nt, Staphylococcus aureus subsp. aureus N315
uacguuauuucaauaa

SEQ ID NO: 4068111 - RNA, 19 nt, Staphylococcus aureus subsp. aureus N315
uacguuauuucaauaauaa

SEQ ID NO: 4068112 - RNA, 22 nt, Staphylococcus aureus subsp. aureus N315
uacguuauuuuuuggucaccaa

SEQ ID NO: 4068113 - RNA, 14 nt, Staphylococcus aureus subsp. aureus N315
uacguuuauaucuu

SEQ ID NO: 4068114 - RNA, 17 nt, Staphylococcus aureus subsp. aureus N315
uacguuugcauauccuu

SEQ ID NO: 4068115 - RNA, 15 nt, Staphylococcus aureus subsp. aureus N315
uacguuuuuuuaaau

SEQ ID NO: 4068116 - RNA, 19 nt, Staphylococcus aureus subsp. aureus N315
uacguuuuuuuaaauacau

SEQ ID NO: 4068117 - RNA, 20 nt, Staphylococcus aureus subsp. aureus N315
uacuaaaaaugcuuuaacua

SEQ ID NO: 4068118 - RNA, 11 nt, Staphylococcus aureus subsp. aureus N315
uacuaaaacau

SEQ ID NO: 4068119 - RNA, 12 nt, Staphylococcus aureus subsp. aureus N315
uacuaaaacaug

SEQ ID NO: 4068120 - RNA, 20 nt, Staphylococcus aureus subsp. aureus N315
uacuaaaaucacuugguaaa

SEQ ID NO: 4068121 - RNA, 13 nt, Staphylococcus aureus subsp. aureus N315
uacuaaaccgauu

SEQ ID NO: 4068122 - RNA, 17 nt, Staphylococcus aureus subsp. aureus N315
uacuaaacgauaaauua

SEQ ID NO: 4068123 - RNA, 19 nt, Staphylococcus aureus subsp. aureus N315
uacuaaauaaguaguucag

SEQ ID NO: 4068124 - RNA, 21 nt, Staphylococcus aureus subsp. aureus N315
uacuaaauaaguaguucagca

SEQ ID NO: 4068125 - RNA, 13 nt, Staphylococcus aureus subsp. aureus N315
uacuaaaugaauu

SEQ ID NO: 4068126 - RNA, 14 nt, Staphylococcus aureus subsp. aureus N315
uacuaaauugagaa

SEQ ID NO: 4068127 - RNA, 22 nt, Staphylococcus aureus subsp. aureus N315
uacuaaauugagaaguauuaug

SEQ ID NO: 4068128 - RNA, 18 nt, Staphylococcus aureus subsp. aureus N315
uacuaacaauuacgacaa

SEQ ID NO: 4068129 - RNA, 17 nt, Staphylococcus aureus subsp. aureus N315
uacuaaccuauuaaaau

SEQ ID NO: 4068130 - RNA, 21 nt, Staphylococcus aureus subsp. aureus N315
uacuaaccuauuaaaauaaac

SEQ ID NO: 4068131 - RNA, 22 nt, Staphylococcus aureus subsp. aureus N315
uacuaacguaaaggugauauuu

SEQ ID NO: 4068132 - RNA, 19 nt, Staphylococcus aureus subsp. aureus N315
uacuaacguuuuaaagguu

SEQ ID NO: 4068133 - RNA, 16 nt, Staphylococcus aureus subsp. aureus N315
uacuaacugaagacac

SEQ ID NO: 4068134 - RNA, 22 nt, Staphylococcus aureus subsp. aureus N315
uacuaagcgcucauaaacgauu

SEQ ID NO: 4068135 - RNA, 15 nt, Staphylococcus aureus subsp. aureus N315
uacuaauauauuaau

SEQ ID NO: 4068136 - RNA, 13 nt, Staphylococcus aureus subsp. aureus N315
uacuaauaucuuc

SEQ ID NO: 4068137 - RNA, 15 nt, Staphylococcus aureus subsp. aureus N315
uacuaaucaauacua

SEQ ID NO: 4068138 - RNA, 12 nt, Staphylococcus aureus subsp. aureus N315
uacuaauuucua

SEQ ID NO: 4068139 - RNA, 14 nt, Staphylococcus aureus subsp. aureus N315
uacuaauuucuaua

SEQ ID NO: 4068140 - RNA, 21 nt, Staphylococcus aureus subsp. aureus N315
uacuacacuccccuuaucaaa

SEQ ID NO: 4068141 - RNA, 22 nt, Staphylococcus aureus subsp. aureus N315
uacuaccguuuuuauauacuug

SEQ ID NO: 4068142 - RNA, 23 nt, Staphylococcus aureus subsp. aureus N315
uacuacugucucaucuucuaaau

SEQ ID NO: 4068143 - RNA, 23 nt, Staphylococcus aureus subsp. aureus N315
uacuacuugauucuacuucaccu

SEQ ID NO: 4068144 - RNA, 19 nt, Staphylococcus aureus subsp. aureus N315
uacuagcauuagcaaauau

SEQ ID NO: 4068145 - RNA, 18 nt, Staphylococcus aureus subsp. aureus N315
uacuaggaauauaaaacu

SEQ ID NO: 4068146 - RNA, 23 nt, Staphylococcus aureus subsp. aureus N315
uacuaguuuguaauaauuaacuu

SEQ ID NO: 4068147 - RNA, 20 nt, Staphylococcus aureus subsp. aureus N315
uacuauaaaaauuuauucaa

SEQ ID NO: 4068148 - RNA, 21 nt, Staphylococcus aureus subsp. aureus N315
uacuauaaaaauuuauucaaa

SEQ ID NO: 4068149 - RNA, 22 nt, Staphylococcus aureus subsp. aureus N315
uacuauaaauacgucaucuuua

SEQ ID NO: 4068150 - RNA, 14 nt, Staphylococcus aureus subsp. aureus N315
uacuauaaauccua

SEQ ID NO: 4068151 - RNA, 15 nt, Staphylococcus aureus subsp. aureus N315
uacuauaauaauuaa

SEQ ID NO: 4068152 - RNA, 13 nt, Staphylococcus aureus subsp. aureus N315
uacuauacugaug

SEQ ID NO: 4068153 - RNA, 13 nt, Staphylococcus aureus subsp. aureus N315
uacuauaugaaaa

SEQ ID NO: 4068154 - RNA, 16 nt, Staphylococcus aureus subsp. aureus N315
uacuauauuuaaauug

SEQ ID NO: 4068155 - RNA, 19 nt, Staphylococcus aureus subsp. aureus N315
uacuaucuucaucauauuc

SEQ ID NO: 4068156 - RNA, 19 nt, Staphylococcus aureus subsp. aureus N315
uacuauuaaaggaaaucaa

SEQ ID NO: 4068157 - RNA, 13 nt, Staphylococcus aureus subsp. aureus N315
uacuauuaaauaa

SEQ ID NO: 4068158 - RNA, 14 nt, Staphylococcus aureus subsp. aureus N315
uacuauuuaaucuu

SEQ ID NO: 4068159 - RNA, 15 nt, Staphylococcus aureus subsp. aureus N315
uacucaaaccaucuu

SEQ ID NO: 4068160 - RNA, 22 nt, Staphylococcus aureus subsp. aureus N315
uacucaguuuauugaggauaau

SEQ ID NO: 4068161 - RNA, 15 nt, Staphylococcus aureus subsp. aureus N315
uacucauauugaaua

SEQ ID NO: 4068162 - RNA, 17 nt, Staphylococcus aureus subsp. aureus N315
uacucauauugaauacu

SEQ ID NO: 4068163 - RNA, 14 nt, Staphylococcus aureus subsp. aureus N315
uacuccaaaguaac

SEQ ID NO: 4068164 - RNA, 24 nt, Staphylococcus aureus subsp. aureus N315
uacuccaauuaccaaugaauaaau

SEQ ID NO: 4068165 - RNA, 21 nt, Staphylococcus aureus subsp. aureus N315
uacucuaaaaaaggaagaaca

SEQ ID NO: 4068166 - RNA, 14 nt, Staphylococcus aureus subsp. aureus N315
uacucuagcggaac

SEQ ID NO: 4068167 - RNA, 12 nt, Staphylococcus aureus subsp. aureus N315
uacucugaaaag

SEQ ID NO: 4068168 - RNA, 17 nt, Staphylococcus aureus subsp. aureus N315
uacucugauuacauaua

SEQ ID NO: 4068169 - RNA, 18 nt, Staphylococcus aureus subsp. aureus N315
uacucugggcauuuugac

SEQ ID NO: 4068170 - RNA, 19 nt, Staphylococcus aureus subsp. aureus N315
uacucugggcauuuugacg

SEQ ID NO: 4068171 - RNA, 14 nt, Staphylococcus aureus subsp. aureus N315
uacucuuuuucuuu

SEQ ID NO: 4068172 - RNA, 20 nt, Staphylococcus aureus subsp. aureus N315
uacugaaacuaaauuaaaag

SEQ ID NO: 4068173 - RNA, 23 nt, Staphylococcus aureus subsp. aureus N315
uacugcaccgauaucauauaaug

SEQ ID NO: 4068174 - RNA, 21 nt, Staphylococcus aureus subsp. aureus N315
uacugcagcaucauaaucuuu

SEQ ID NO: 4068175 - RNA, 15 nt, Staphylococcus aureus subsp. aureus N315
uagaaugaauaauuc

SEQ ID NO: 4068176 - RNA, 23 nt, Staphylococcus aureus subsp. aureus N315
uagaaugaugaguauacuuacug

SEQ ID NO: 4068177 - RNA, 18 nt, Staphylococcus aureus subsp. aureus N315
uagaaugucgauauuucu

SEQ ID NO: 4068178 - RNA, 19 nt, Staphylococcus aureus subsp. aureus N315
uagaaugucgauauuucua

SEQ ID NO: 4068179 - RNA, 17 nt, Staphylococcus aureus subsp. aureus N315
uagaauuaguacuugaa

SEQ ID NO: 4068180 - RNA, 18 nt, Staphylococcus aureus subsp. aureus N315
uagaauucuaaaagaauu

SEQ ID NO: 4068181 - RNA, 12 nt, Staphylococcus aureus subsp. aureus N315
uagaauuucuuu

SEQ ID NO: 4068182 - RNA, 17 nt, Staphylococcus aureus subsp. aureus N315
uagaauuucuuuucgaa

SEQ ID NO: 4068183 - RNA, 20 nt, Staphylococcus aureus subsp. aureus N315
uagacaauauuuuuacauau

SEQ ID NO: 4068184 - RNA, 21 nt, Staphylococcus aureus subsp. aureus N315
uagacaauauuuuuacauauu

SEQ ID NO: 4068185 - RNA, 13 nt, Staphylococcus aureus subsp. aureus N315
uagacaccaaaaa

SEQ ID NO: 4068186 - RNA, 18 nt, Staphylococcus aureus subsp. aureus N315
uagacauaaaaaaagaga

SEQ ID NO: 4068187 - RNA, 23 nt, Staphylococcus aureus subsp. aureus N315
uagacauaaauauggauuuugaa

SEQ ID NO: 4068188 - RNA, 14 nt, Staphylococcus aureus subsp. aureus N315
uagacauuaaaaaa

SEQ ID NO: 4068189 - RNA, 15 nt, Staphylococcus aureus subsp. aureus N315
uagacgguaucaucu

SEQ ID NO: 4068190 - RNA, 20 nt, Staphylococcus aureus subsp. aureus N315
uagacguaaguguaaaugaa

SEQ ID NO: 4068191 - RNA, 18 nt, Staphylococcus aureus subsp. aureus N315
uagacucaaggaaaucau

SEQ ID NO: 4068192 - RNA, 17 nt, Staphylococcus aureus subsp. aureus N315
uagacugccaauaaaau

SEQ ID NO: 4068193 - RNA, 21 nt, Staphylococcus aureus subsp. aureus N315
uagacuuauuugaaugcaaau

SEQ ID NO: 4068194 - RNA, 19 nt, Staphylococcus aureus subsp. aureus N315
uagagaaauacuauucuuu

SEQ ID NO: 4068195 - RNA, 21 nt, Staphylococcus aureus subsp. aureus N315
uagagaagggaguaccaagaa

SEQ ID NO: 4068196 - RNA, 16 nt, Staphylococcus aureus subsp. aureus N315
uagagacuuauuuuau

SEQ ID NO: 4068197 - RNA, 14 nt, Staphylococcus aureus subsp. aureus N315
uagaguaauuuuac

SEQ ID NO: 4068198 - RNA, 14 nt, Staphylococcus aureus subsp. aureus N315
uagauaaaaauuac

SEQ ID NO: 4068199 - RNA, 16 nt, Staphylococcus aureus subsp. aureus N315
uagauaaaaauuacua

SEQ ID NO: 4068200 - RNA, 19 nt, Staphylococcus aureus subsp. aureus N315
uagauaaacucuaaauaaa

SEQ ID NO: 4068201 - RNA, 18 nt, Staphylococcus aureus subsp. aureus N315
uagauaaaucgauaaaau

SEQ ID NO: 4068202 - RNA, 12 nt, Staphylococcus aureus subsp. aureus N315
uagauaauauau

SEQ ID NO: 4068203 - RNA, 13 nt, Staphylococcus aureus subsp. aureus N315
uagauaccaaacu

SEQ ID NO: 4068204 - RNA, 15 nt, Staphylococcus aureus subsp. aureus N315
uagauaccaaacugc

SEQ ID NO: 4068205 - RNA, 22 nt, Staphylococcus aureus subsp. aureus N315
uagauacucacugcacuuauga

SEQ ID NO: 4068206 - RNA, 17 nt, Staphylococcus aureus subsp. aureus N315
uagauagaaauugugcu

SEQ ID NO: 4068207 - RNA, 20 nt, Staphylococcus aureus subsp. aureus N315
uagauaggauauuuuuuaau

SEQ ID NO: 4068208 - RNA, 22 nt, Staphylococcus aureus subsp. aureus N315
uagauaucuuaaucuaaaaaua

SEQ ID NO: 4068209 - RNA, 13 nt, Staphylococcus aureus subsp. aureus N315
uagauauuauaaa

SEQ ID NO: 4068210 - RNA, 19 nt, Staphylococcus aureus subsp. aureus N315
uagaucaauauucuaugcu

SEQ ID NO: 4068211 - RNA, 15 nt, Staphylococcus aureus subsp. aureus N315
uagaugaaaauuuaa

SEQ ID NO: 4068212 - RNA, 11 nt, Staphylococcus aureus subsp. aureus N315
uagaugaaaug

SEQ ID NO: 4068213 - RNA, 23 nt, Staphylococcus aureus subsp. aureus N315
uagaugaaauuguguugaaucaa

SEQ ID NO: 4068214 - RNA, 14 nt, Staphylococcus aureus subsp. aureus N315
uagaugauauuuaa

SEQ ID NO: 4068215 - RNA, 23 nt, Staphylococcus aureus subsp. aureus N315
uagaugauuagugucacaaagaa

SEQ ID NO: 4068216 - RNA, 19 nt, Staphylococcus aureus subsp. aureus N315
uagaugcauaaaaaaagaa

SEQ ID NO: 4068217 - RNA, 20 nt, Staphylococcus aureus subsp. aureus N315
uagauguguugugauuauaa

SEQ ID NO: 4068218 - RNA, 21 nt, Staphylococcus aureus subsp. aureus N315
uagauguguugugauuauaaa

SEQ ID NO: 4068219 - RNA, 15 nt, Staphylococcus aureus subsp. aureus N315
uagauuaucuuucaa

SEQ ID NO: 4068220 - RNA, 12 nt, Staphylococcus aureus subsp. aureus N315
uagauucuuuuc

SEQ ID NO: 4068221 - RNA, 13 nt, Staphylococcus aureus subsp. aureus N315
uagauugaaaaaa

SEQ ID NO: 4068222 - RNA, 18 nt, Staphylococcus aureus subsp. aureus N315
uagauugacuaaguuugu

SEQ ID NO: 4068223 - RNA, 15 nt, Staphylococcus aureus subsp. aureus N315
uagauugaucagcuc

SEQ ID NO: 4068224 - RNA, 16 nt, Staphylococcus aureus subsp. aureus N315
uagauugauuguauuu

SEQ ID NO: 4068225 - RNA, 13 nt, Staphylococcus aureus subsp. aureus N315
uagauuuaaaaug

SEQ ID NO: 4068226 - RNA, 15 nt, Staphylococcus aureus subsp. aureus N315
uagauuuaaaauguc

SEQ ID NO: 4068227 - RNA, 13 nt, Staphylococcus aureus subsp. aureus N315
uagauuuaggaga

SEQ ID NO: 4068228 - RNA, 17 nt, Staphylococcus aureus subsp. aureus N315
uagauuuaggagagcca

SEQ ID NO: 4068229 - RNA, 14 nt, Staphylococcus aureus subsp. aureus N315
uagauuuauaacga

SEQ ID NO: 4068230 - RNA, 19 nt, Staphylococcus aureus subsp. aureus N315
uagauuuaucaccuuuagg

SEQ ID NO: 4068231 - RNA, 14 nt, Staphylococcus aureus subsp. aureus N315
uagauuuuauauaa

SEQ ID NO: 4068232 - RNA, 17 nt, Staphylococcus aureus subsp. aureus N315
uagauuuuauauaaaaa

SEQ ID NO: 4068233 - RNA, 22 nt, Staphylococcus aureus subsp. aureus N315
uagauuuuguauuagcaucuga

SEQ ID NO: 4068234 - RNA, 15 nt, Staphylococcus aureus subsp. aureus N315
uagcaaaaauacuuu

SEQ ID NO: 4068235 - RNA, 16 nt, Staphylococcus aureus subsp. aureus N315
uagcaaaauuauguaa

SEQ ID NO: 4068236 - RNA, 22 nt, Staphylococcus aureus subsp. aureus N315
uagcaaauauuauuaaaucaaa

SEQ ID NO: 4068237 - RNA, 15 nt, Staphylococcus aureus subsp. aureus N315
uagcaaauauuucug

SEQ ID NO: 4068238 - RNA, 21 nt, Staphylococcus aureus subsp. aureus N315
uagcaaccauauuuuuagaaa

SEQ ID NO: 4068239 - RNA, 22 nt, Staphylococcus aureus subsp. aureus N315
uagcaaccauauuuuuagaaaa

SEQ ID NO: 4068240 - RNA, 16 nt, Staphylococcus aureus subsp. aureus N315
uagcaacugaucauuu

SEQ ID NO: 4068241 - RNA, 20 nt, Staphylococcus aureus subsp. aureus N315
uagcaacugaucauuuucau

SEQ ID NO: 4068242 - RNA, 19 nt, Staphylococcus aureus subsp. aureus N315
uagcaagaauagauugauu

SEQ ID NO: 4068243 - RNA, 16 nt, Staphylococcus aureus subsp. aureus N315
uagcaaugaauuaaua

SEQ ID NO: 4068244 - RNA, 22 nt, Staphylococcus aureus subsp. aureus N315
uagcacuuggauuuuaauuauu

SEQ ID NO: 4068245 - RNA, 11 nt, Staphylococcus aureus subsp. aureus N315
uagcagcaguu

SEQ ID NO: 4068246 - RNA, 13 nt, Staphylococcus aureus subsp. aureus N315
uagcaguuucuga

SEQ ID NO: 4068247 - RNA, 12 nt, Staphylococcus aureus subsp. aureus N315
uagcauaaaauu

SEQ ID NO: 4068248 - RNA, 22 nt, Staphylococcus aureus subsp. aureus N315
uagcauaucuuuaucauuauuc

SEQ ID NO: 4068249 - RNA, 19 nt, Staphylococcus aureus subsp. aureus N315
uagcauauucgcuuaaaaa

SEQ ID NO: 4068250 - RNA, 17 nt, Staphylococcus aureus subsp. aureus N315
uagcaucaaaaauaaaa

SEQ ID NO: 4068251 - RNA, 17 nt, Staphylococcus aureus subsp. aureus N315
uagcauguuuugagcaa

SEQ ID NO: 4068252 - RNA, 18 nt, Staphylococcus aureus subsp. aureus N315
uagcauuauuauuuuaau

SEQ ID NO: 4068253 - RNA, 14 nt, Staphylococcus aureus subsp. aureus N315
uagcauuauuugcu

SEQ ID NO: 4068254 - RNA, 15 nt, Staphylococcus aureus subsp. aureus N315
uagcauuauuugcug

SEQ ID NO: 4068255 - RNA, 17 nt, Staphylococcus aureus subsp. aureus N315
uagcauuccuaauuaua

SEQ ID NO: 4068256 - RNA, 13 nt, Staphylococcus aureus subsp. aureus N315
uagccaaauaaau

SEQ ID NO: 4068257 - RNA, 21 nt, Staphylococcus aureus subsp. aureus N315
uagccaaauaaauuuugacgc

SEQ ID NO: 4068258 - RNA, 23 nt, Staphylococcus aureus subsp. aureus N315
uagccaaugcuuccaucacauca

SEQ ID NO: 4068259 - RNA, 16 nt, Staphylococcus aureus subsp. aureus N315
uagccauauucauauu

SEQ ID NO: 4068260 - RNA, 17 nt, Staphylococcus aureus subsp. aureus N315
uagccccaguauagaag

SEQ ID NO: 4068261 - RNA, 14 nt, Staphylococcus aureus subsp. aureus N315
uagccuauuuaaaa

SEQ ID NO: 4068262 - RNA, 15 nt, Staphylococcus aureus subsp. aureus N315
uagccugaaauagaa

SEQ ID NO: 4068263 - RNA, 15 nt, Staphylococcus aureus subsp. aureus N315
uagucgguguuuucu

SEQ ID NO: 4068264 - RNA, 17 nt, Staphylococcus aureus subsp. aureus N315
uagucgucgaaaugccu

SEQ ID NO: 4068265 - RNA, 16 nt, Staphylococcus aureus subsp. aureus N315
uagucucguaauaaug

SEQ ID NO: 4068266 - RNA, 18 nt, Staphylococcus aureus subsp. aureus N315
uagugaaaaaguuucgga

SEQ ID NO: 4068267 - RNA, 21 nt, Staphylococcus aureus subsp. aureus N315
uagugaaaaaguuucggaaaa

SEQ ID NO: 4068268 - RNA, 17 nt, Staphylococcus aureus subsp. aureus N315
uagugaaauaccuccug

SEQ ID NO: 4068269 - RNA, 12 nt, Staphylococcus aureus subsp. aureus N315
uagugaauaaug

SEQ ID NO: 4068270 - RNA, 22 nt, Staphylococcus aureus subsp. aureus N315
uagugacauuugcaugcuucaa

SEQ ID NO: 4068271 - RNA, 20 nt, Staphylococcus aureus subsp. aureus N315
uagugcgcgauaaauaauaa

SEQ ID NO: 4068272 - RNA, 19 nt, Staphylococcus aureus subsp. aureus N315
uagugcgcuuauuuuacua

SEQ ID NO: 4068273 - RNA, 12 nt, Staphylococcus aureus subsp. aureus N315
uagugcuuguuu

SEQ ID NO: 4068274 - RNA, 14 nt, Staphylococcus aureus subsp. aureus N315
uagugcuuuuucaa

SEQ ID NO: 4068275 - RNA, 18 nt, Staphylococcus aureus subsp. aureus N315
uagugucacaaagaaauu

SEQ ID NO: 4068276 - RNA, 18 nt, Staphylococcus aureus subsp. aureus N315
uaguguucucauuauaau

SEQ ID NO: 4068277 - RNA, 20 nt, Staphylococcus aureus subsp. aureus N315
uaguuaaaguacuuacaaau

SEQ ID NO: 4068278 - RNA, 16 nt, Staphylococcus aureus subsp. aureus N315
uaguuaaguauuuaaa

SEQ ID NO: 4068279 - RNA, 17 nt, Staphylococcus aureus subsp. aureus N315
uaguuaauuauuuagau

SEQ ID NO: 4068280 - RNA, 18 nt, Staphylococcus aureus subsp. aureus N315
uaguuauacuacuauuga

SEQ ID NO: 4068281 - RNA, 19 nt, Staphylococcus aureus subsp. aureus N315
uaguucaaauugaacuucu

SEQ ID NO: 4068282 - RNA, 23 nt, Staphylococcus aureus subsp. aureus N315
uaguucaaauugaacuucuuuuu

SEQ ID NO: 4068283 - RNA, 23 nt, Staphylococcus aureus subsp. aureus N315
uaguucgcgacgacguccagcua

SEQ ID NO: 4068284 - RNA, 18 nt, Staphylococcus aureus subsp. aureus N315
uaguucuggcaaagaauc

SEQ ID NO: 4068285 - RNA, 12 nt, Staphylococcus aureus subsp. aureus N315
uaguucuguuga

SEQ ID NO: 4068286 - RNA, 17 nt, Staphylococcus aureus subsp. aureus N315
uaguucuguugauauuu

SEQ ID NO: 4068287 - RNA, 23 nt, Staphylococcus aureus subsp. aureus N315
uaguugaucaaaaagacagcagu

SEQ ID NO: 4068288 - RNA, 21 nt, Staphylococcus aureus subsp. aureus N315
uaguugccccuagcaaaaaua

SEQ ID NO: 4068289 - RNA, 15 nt, Staphylococcus aureus subsp. aureus N315
uaguuguacuucuuu

SEQ ID NO: 4068290 - RNA, 16 nt, Staphylococcus aureus subsp. aureus N315
uaguuguccauuuuau

SEQ ID NO: 4068291 - RNA, 22 nt, Staphylococcus aureus subsp. aureus N315
uaguuuaacaauacuacuuaau

SEQ ID NO: 4068292 - RNA, 13 nt, Staphylococcus aureus subsp. aureus N315
uaguuuauaaauu

SEQ ID NO: 4068293 - RNA, 12 nt, Staphylococcus aureus subsp. aureus N315
uaguuuauuaau

SEQ ID NO: 4068294 - RNA, 22 nt, Staphylococcus aureus subsp. aureus N315
uaguuuauugccgguuaaauua

SEQ ID NO: 4068295 - RNA, 13 nt, Staphylococcus aureus subsp. aureus N315
uaguuucucuacu

SEQ ID NO: 4068296 - RNA, 20 nt, Staphylococcus aureus subsp. aureus N315
uaguuucucuacuaauauuc

SEQ ID NO: 4068297 - RNA, 18 nt, Staphylococcus aureus subsp. aureus N315
uaguuucugacuuuuaaa

SEQ ID NO: 4068298 - RNA, 15 nt, Staphylococcus aureus subsp. aureus N315
uaguuuguaauaauu

SEQ ID NO: 4068299 - RNA, 16 nt, Staphylococcus aureus subsp. aureus N315
uaguuuucuuaaaaga

SEQ ID NO: 4068300 - RNA, 21 nt, Staphylococcus aureus subsp. aureus N315
uaguuuucuuaaaagagcaag

SEQ ID NO: 4068301 - RNA, 15 nt, Staphylococcus aureus subsp. aureus N315
uaguuuuuuuuauau

SEQ ID NO: 4068302 - RNA, 22 nt, Staphylococcus aureus subsp. aureus N315
uauaaaaaaccguaauuuuaau

SEQ ID NO: 4068303 - RNA, 19 nt, Staphylococcus aureus subsp. aureus N315
uauaaaaaauuauuaaaaa

SEQ ID NO: 4068304 - RNA, 13 nt, Staphylococcus aureus subsp. aureus N315
uauaaaaacaaaa

SEQ ID NO: 4068305 - RNA, 14 nt, Staphylococcus aureus subsp. aureus N315
uauaaaaagaauau

SEQ ID NO: 4068306 - RNA, 23 nt, Staphylococcus aureus subsp. aureus N315
uauaaaaagaauaugauauugau

SEQ ID NO: 4068307 - RNA, 19 nt, Staphylococcus aureus subsp. aureus N315
uauaaaaagaucauuaaaa

SEQ ID NO: 4068308 - RNA, 20 nt, Staphylococcus aureus subsp. aureus N315
uauaaaaagaucauuaaaaa

SEQ ID NO: 4068309 - RNA, 18 nt, Staphylococcus aureus subsp. aureus N315
uauaaaaagugaagauau

SEQ ID NO: 4068310 - RNA, 22 nt, Staphylococcus aureus subsp. aureus N315
uauaaaaagugaagauauuuau

SEQ ID NO: 4068311 - RNA, 20 nt, Staphylococcus aureus subsp. aureus N315
uauaaaaauuuauucaaaau

SEQ ID NO: 4068312 - RNA, 21 nt, Staphylococcus aureus subsp. aureus N315
uauaaaaauuuauucaaaauu

SEQ ID NO: 4068313 - RNA, 22 nt, Staphylococcus aureus subsp. aureus N315
uauaaaacagaauuucaucaaa

SEQ ID NO: 4068314 - RNA, 17 nt, Staphylococcus aureus subsp. aureus N315
uauaaaacgauaagaau

SEQ ID NO: 4068315 - RNA, 14 nt, Staphylococcus aureus subsp. aureus N315
uauaaaauaaaaaa

SEQ ID NO: 4068316 - RNA, 14 nt, Staphylococcus aureus subsp. aureus N315
uauaaaauauauuu

SEQ ID NO: 4068317 - RNA, 21 nt, Staphylococcus aureus subsp. aureus N315
uauaaaauaugagauuaucug

SEQ ID NO: 4068318 - RNA, 12 nt, Staphylococcus aureus subsp. aureus N315
uauaaaauucac

SEQ ID NO: 4068319 - RNA, 16 nt, Staphylococcus aureus subsp. aureus N315
uauaaaauucaccaac

SEQ ID NO: 4068320 - RNA, 22 nt, Staphylococcus aureus subsp. aureus N315
uauaaaccuaaugcuuuaauaa

SEQ ID NO: 4068321 - RNA, 17 nt, Staphylococcus aureus subsp. aureus N315
uauaaacgucacuuuau

SEQ ID NO: 4068322 - RNA, 13 nt, Staphylococcus aureus subsp. aureus N315
uauaaagaaauaa

SEQ ID NO: 4068323 - RNA, 18 nt, Staphylococcus aureus subsp. aureus N315
uauaaagacgauuuauua

SEQ ID NO: 4068324 - RNA, 23 nt, Staphylococcus aureus subsp. aureus N315
uauaaagcuagggugaauuagua

SEQ ID NO: 4068325 - RNA, 18 nt, Staphylococcus aureus subsp. aureus N315
uauaaaggaauagcuaca

SEQ ID NO: 4068326 - RNA, 22 nt, Staphylococcus aureus subsp. aureus N315
uauaaaggaauagcuacaauua

SEQ ID NO: 4068327 - RNA, 18 nt, Staphylococcus aureus subsp. aureus N315
uauaaaguugacaauaca

SEQ ID NO: 4068328 - RNA, 21 nt, Staphylococcus aureus subsp. aureus N315
uauaaaguugacaauacaaau

SEQ ID NO: 4068329 - RNA, 23 nt, Staphylococcus aureus subsp. aureus N315
uauaaauaauaaaugcuauauuu

SEQ ID NO: 4068330 - RNA, 17 nt, Staphylococcus aureus subsp. aureus N315
uauaaauauuuuuaauu

SEQ ID NO: 4068331 - RNA, 18 nt, Staphylococcus aureus subsp. aureus N315
uauaaauauuuuuaauua

SEQ ID NO: 4068332 - RNA, 15 nt, Staphylococcus aureus subsp. aureus N315
uauaaaucaaauaua

SEQ ID NO: 4068333 - RNA, 19 nt, Staphylococcus aureus subsp. aureus N315
uauaaaugaaucgcuuuga

SEQ ID NO: 4068334 - RNA, 19 nt, Staphylococcus aureus subsp. aureus N315
uauaaaugcagcuguauaa

SEQ ID NO: 4068335 - RNA, 15 nt, Staphylococcus aureus subsp. aureus N315
uauaaaugucauagu

SEQ ID NO: 4068336 - RNA, 16 nt, Staphylococcus aureus subsp. aureus N315
uauaaauguuauugcu

SEQ ID NO: 4068337 - RNA, 17 nt, Staphylococcus aureus subsp. aureus N315
uauaaauuaaaugcaau

SEQ ID NO: 4068338 - RNA, 19 nt, Staphylococcus aureus subsp. aureus N315
uauaaauuuguaccaaaua

SEQ ID NO: 4068339 - RNA, 20 nt, Staphylococcus aureus subsp. aureus N315
uauaaauuuguaccaaauaa

SEQ ID NO: 4068340 - RNA, 15 nt, Staphylococcus aureus subsp. aureus N315
uauaaauuuugaauu

SEQ ID NO: 4068341 - RNA, 20 nt, Staphylococcus aureus subsp. aureus N315
uauaacaaaaauugcuauau

SEQ ID NO: 4068342 - RNA, 15 nt, Staphylococcus aureus subsp. aureus N315
uauaacaaaaucuca

SEQ ID NO: 4068343 - RNA, 19 nt, Staphylococcus aureus subsp. aureus N315
uauaacaaaaucucaacag

SEQ ID NO: 4068344 - RNA, 18 nt, Staphylococcus aureus subsp. aureus N315
uauaacaauaguuuucuu

SEQ ID NO: 4068345 - RNA, 16 nt, Staphylococcus aureus subsp. aureus N315
uauaacaccaauuaaa

SEQ ID NO: 4068346 - RNA, 18 nt, Staphylococcus aureus subsp. aureus N315
uauaacacgauaauuaua

SEQ ID NO: 4068347 - RNA, 15 nt, Staphylococcus aureus subsp. aureus N315
uauaacauucuucaa

SEQ ID NO: 4068348 - RNA, 21 nt, Staphylococcus aureus subsp. aureus N315
uauaacauucuucaaaaaaua

SEQ ID NO: 4068349 - RNA, 13 nt, Staphylococcus aureus subsp. aureus N315
uauaaccauaaug

SEQ ID NO: 4068350 - RNA, 15 nt, Staphylococcus aureus subsp. aureus N315
uauagauuaaaaaau

SEQ ID NO: 4068351 - RNA, 21 nt, Staphylococcus aureus subsp. aureus N315
uauagauucauguaaauaguu

SEQ ID NO: 4068352 - RNA, 17 nt, Staphylococcus aureus subsp. aureus N315
uauagauuguauuuaau

SEQ ID NO: 4068353 - RNA, 20 nt, Staphylococcus aureus subsp. aureus N315
uauagauuuuguauuagcau

SEQ ID NO: 4068354 - RNA, 19 nt, Staphylococcus aureus subsp. aureus N315
uauagcaucauaaaguaaa

SEQ ID NO: 4068355 - RNA, 16 nt, Staphylococcus aureus subsp. aureus N315
uauagcaucuaugauu

SEQ ID NO: 4068356 - RNA, 18 nt, Staphylococcus aureus subsp. aureus N315
uauagcaucuaugauugu

SEQ ID NO: 4068357 - RNA, 21 nt, Staphylococcus aureus subsp. aureus N315
uauagccaaaggcaaaaugua

SEQ ID NO: 4068358 - RNA, 16 nt, Staphylococcus aureus subsp. aureus N315
uauaguaaaauaaaua

SEQ ID NO: 4068359 - RNA, 18 nt, Staphylococcus aureus subsp. aureus N315
uauaguaagaaaaguuac

SEQ ID NO: 4068360 - RNA, 17 nt, Staphylococcus aureus subsp. aureus N315
uauaguaauagcuauau

SEQ ID NO: 4068361 - RNA, 16 nt, Staphylococcus aureus subsp. aureus N315
uauaguaauuguuaua

SEQ ID NO: 4068362 - RNA, 23 nt, Staphylococcus aureus subsp. aureus N315
uauaguaggguauugaaauaaua

SEQ ID NO: 4068363 - RNA, 23 nt, Staphylococcus aureus subsp. aureus N315
uauaguccuucccacuuaucauc

SEQ ID NO: 4068364 - RNA, 15 nt, Staphylococcus aureus subsp. aureus N315
uauagucuuaaacau

SEQ ID NO: 4068365 - RNA, 17 nt, Staphylococcus aureus subsp. aureus N315
uauagucuuaaacauaa

SEQ ID NO: 4068366 - RNA, 18 nt, Staphylococcus aureus subsp. aureus N315
uauagucuuaaacauaac

SEQ ID NO: 4068367 - RNA, 22 nt, Staphylococcus aureus subsp. aureus N315
uauagugcuuguuuauuacaua

SEQ ID NO: 4068368 - RNA, 14 nt, Staphylococcus aureus subsp. aureus N315
uauagugguaaaaa

SEQ ID NO: 4068369 - RNA, 20 nt, Staphylococcus aureus subsp. aureus N315
uauaguugagcguuuaauua

SEQ ID NO: 4068370 - RNA, 20 nt, Staphylococcus aureus subsp. aureus N315
uauauaaaaaagaaauaucu

SEQ ID NO: 4068371 - RNA, 14 nt, Staphylococcus aureus subsp. aureus N315
uauauaaaaacugu

SEQ ID NO: 4068372 - RNA, 20 nt, Staphylococcus aureus subsp. aureus N315
uauauaaaauuucauauugu

SEQ ID NO: 4068373 - RNA, 15 nt, Staphylococcus aureus subsp. aureus N315
uauauaaacaaaaau

SEQ ID NO: 4068374 - RNA, 18 nt, Staphylococcus aureus subsp. aureus N315
uauauaaacaaaaaucua

SEQ ID NO: 4068375 - RNA, 22 nt, Staphylococcus aureus subsp. aureus N315
uauauaaagaaauaauuuaaag

SEQ ID NO: 4068376 - RNA, 21 nt, Staphylococcus aureus subsp. aureus N315
uauauaaccauaguaauaaaa

SEQ ID NO: 4068377 - RNA, 23 nt, Staphylococcus aureus subsp. aureus N315
uauauaaugguucuauaauaaau

SEQ ID NO: 4068378 - RNA, 13 nt, Staphylococcus aureus subsp. aureus N315
uauauaauuuaaa

SEQ ID NO: 4068379 - RNA, 16 nt, Staphylococcus aureus subsp. aureus N315
uauauaauuuaaagaa

SEQ ID NO: 4068380 - RNA, 16 nt, Staphylococcus aureus subsp. aureus N315
uauauagauugccauu

SEQ ID NO: 4068381 - RNA, 15 nt, Staphylococcus aureus subsp. aureus N315
uauauaguaaaauaa

SEQ ID NO: 4068382 - RNA, 13 nt, Staphylococcus aureus subsp. aureus N315
uauauauauauua

SEQ ID NO: 4068383 - RNA, 14 nt, Staphylococcus aureus subsp. aureus N315
uauauauauuaaag

SEQ ID NO: 4068384 - RNA, 12 nt, Staphylococcus aureus subsp. aureus N315
uauauaucaaau

SEQ ID NO: 4068385 - RNA, 18 nt, Staphylococcus aureus subsp. aureus N315
uauauaucaaauacauuu

SEQ ID NO: 4068386 - RNA, 21 nt, Staphylococcus aureus subsp. aureus N315
uauauaucacaacacauaaau

SEQ ID NO: 4068387 - RNA, 18 nt, Staphylococcus aureus subsp. aureus N315
uauauauccuguuucaua

SEQ ID NO: 4068388 - RNA, 15 nt, Staphylococcus aureus subsp. aureus N315
uauauauuaaaacaa

SEQ ID NO: 4068389 - RNA, 16 nt, Staphylococcus aureus subsp. aureus N315
uauauauuaaaacaau

SEQ ID NO: 4068390 - RNA, 14 nt, Staphylococcus aureus subsp. aureus N315
uauauauucaauaa

SEQ ID NO: 4068391 - RNA, 16 nt, Staphylococcus aureus subsp. aureus N315
uauauauucaauaauu

SEQ ID NO: 4068392 - RNA, 21 nt, Staphylococcus aureus subsp. aureus N315
uauauauuccacgcucacauu

SEQ ID NO: 4068393 - RNA, 20 nt, Staphylococcus aureus subsp. aureus N315
uauauauucguuacaaauga

SEQ ID NO: 4068394 - RNA, 19 nt, Staphylococcus aureus subsp. aureus N315
uauaucaaauacauuucaa

SEQ ID NO: 4068395 - RNA, 23 nt, Staphylococcus aureus subsp. aureus N315
uauaucaaauacauuucaaaaaa

SEQ ID NO: 4068396 - RNA, 20 nt, Staphylococcus aureus subsp. aureus N315
uauaucaacguuaauauaac

SEQ ID NO: 4068397 - RNA, 23 nt, Staphylococcus aureus subsp. aureus N315
uauaucacaacacauaaauuaag

SEQ ID NO: 4068398 - RNA, 15 nt, Staphylococcus aureus subsp. aureus N315
uauaucagcuuguuu

SEQ ID NO: 4068399 - RNA, 14 nt, Staphylococcus aureus subsp. aureus N315
uauauccauucaau

SEQ ID NO: 4068400 - RNA, 15 nt, Staphylococcus aureus subsp. aureus N315
uauaucgcuuuugaa

SEQ ID NO: 4068401 - RNA, 16 nt, Staphylococcus aureus subsp. aureus N315
uauaucuaaaugauca

SEQ ID NO: 4068402 - RNA, 12 nt, Staphylococcus aureus subsp. aureus N315
uauaucuucauu

SEQ ID NO: 4068403 - RNA, 14 nt, Staphylococcus aureus subsp. aureus N315
uauaugaaaagaga

SEQ ID NO: 4068404 - RNA, 18 nt, Staphylococcus aureus subsp. aureus N315
uauaugaaauauuuaucu

SEQ ID NO: 4068405 - RNA, 16 nt, Staphylococcus aureus subsp. aureus N315
uauaugaauugaguau

SEQ ID NO: 4068406 - RNA, 17 nt, Staphylococcus aureus subsp. aureus N315
uauaugauguucaauau

SEQ ID NO: 4068407 - RNA, 18 nt, Staphylococcus aureus subsp. aureus N315
uauaugauuaauuagccu

SEQ ID NO: 4068408 - RNA, 21 nt, Staphylococcus aureus subsp. aureus N315
uauauggagcuacccuauuuu

SEQ ID NO: 4068409 - RNA, 22 nt, Staphylococcus aureus subsp. aureus N315
uauauguaaucagaguagaaag

SEQ ID NO: 4068410 - RNA, 21 nt, Staphylococcus aureus subsp. aureus N315
uauaugucucucuuucuuauu

SEQ ID NO: 4068411 - RNA, 20 nt, Staphylococcus aureus subsp. aureus N315
uauauuaaaaauuucaauaa

SEQ ID NO: 4068412 - RNA, 15 nt, Staphylococcus aureus subsp. aureus N315
uauauuaaaguaaaa

SEQ ID NO: 4068413 - RNA, 14 nt, Staphylococcus aureus subsp. aureus N315
uauauuaaauacua

SEQ ID NO: 4068414 - RNA, 20 nt, Staphylococcus aureus subsp. aureus N315
uauauuaagacguuguaaug

SEQ ID NO: 4068415 - RNA, 16 nt, Staphylococcus aureus subsp. aureus N315
uauauuaauguuugau

SEQ ID NO: 4068416 - RNA, 20 nt, Staphylococcus aureus subsp. aureus N315
uauauuacucaaaauuaaag

SEQ ID NO: 4068417 - RNA, 16 nt, Staphylococcus aureus subsp. aureus N315
uauauucaucucuuau

SEQ ID NO: 4068418 - RNA, 18 nt, Staphylococcus aureus subsp. aureus N315
uauauuccacgcucacau

SEQ ID NO: 4068419 - RNA, 17 nt, Staphylococcus aureus subsp. aureus N315
uauauucguuacaaaug

SEQ ID NO: 4068420 - RNA, 21 nt, Staphylococcus aureus subsp. aureus N315
uauauugaaauuaaauuuguu

SEQ ID NO: 4068421 - RNA, 17 nt, Staphylococcus aureus subsp. aureus N315
uauauuuaaacucucua

SEQ ID NO: 4068422 - RNA, 23 nt, Staphylococcus aureus subsp. aureus N315
uauauuuaguuagcccuauucaa

SEQ ID NO: 4068423 - RNA, 17 nt, Staphylococcus aureus subsp. aureus N315
uauauuuguauaugcaa

SEQ ID NO: 4068424 - RNA, 13 nt, Staphylococcus aureus subsp. aureus N315
uauauuugugaau

SEQ ID NO: 4068425 - RNA, 16 nt, Staphylococcus aureus subsp. aureus N315
uauauuuuaguucaca

SEQ ID NO: 4068426 - RNA, 19 nt, Staphylococcus aureus subsp. aureus N315
uauauuuuauuagaauauu

SEQ ID NO: 4068427 - RNA, 18 nt, Staphylococcus aureus subsp. aureus N315
uauauuuuauuuaaaaau

SEQ ID NO: 4068428 - RNA, 16 nt, Staphylococcus aureus subsp. aureus N315
uauauuuuguuaauaa

SEQ ID NO: 4068429 - RNA, 18 nt, Staphylococcus aureus subsp. aureus N315
uauauuuuuagcuuuauu

SEQ ID NO: 4068430 - RNA, 22 nt, Staphylococcus aureus subsp. aureus N315
uauauuuuuagcuuuauuauuu

SEQ ID NO: 4068431 - RNA, 11 nt, Staphylococcus aureus subsp. aureus N315
uauauuuuuau

SEQ ID NO: 4068432 - RNA, 14 nt, Staphylococcus aureus subsp. aureus N315
uauauuuuuauuaa

SEQ ID NO: 4068433 - RNA, 16 nt, Staphylococcus aureus subsp. aureus N315
uauauuuuuguauuua

SEQ ID NO: 4068434 - RNA, 23 nt, Staphylococcus aureus subsp. aureus N315
uaucaaaaaauacguuuaaugua

SEQ ID NO: 4068435 - RNA, 21 nt, Staphylococcus aureus subsp. aureus N315
uaucaaaaccgcuauaaaauu

SEQ ID NO: 4068436 - RNA, 16 nt, Staphylococcus aureus subsp. aureus N315
uaucaaaauauaaaau

SEQ ID NO: 4068437 - RNA, 18 nt, Staphylococcus aureus subsp. aureus N315
uaucuauaugcauauauu

SEQ ID NO: 4068438 - RNA, 20 nt, Staphylococcus aureus subsp. aureus N315
uaucucugaaaaacuucuua

SEQ ID NO: 4068439 - RNA, 13 nt, Staphylococcus aureus subsp. aureus N315
uaucugaaaauau

SEQ ID NO: 4068440 - RNA, 22 nt, Staphylococcus aureus subsp. aureus N315
uaucugaguuauagaaacuuuc

SEQ ID NO: 4068441 - RNA, 19 nt, Staphylococcus aureus subsp. aureus N315
uaucuguaaauaacuuaug

SEQ ID NO: 4068442 - RNA, 13 nt, Staphylococcus aureus subsp. aureus N315
uaucuguugucau

SEQ ID NO: 4068443 - RNA, 17 nt, Staphylococcus aureus subsp. aureus N315
uaucuguugucaucaug

SEQ ID NO: 4068444 - RNA, 18 nt, Staphylococcus aureus subsp. aureus N315
uaucuguuucuauuauua

SEQ ID NO: 4068445 - RNA, 19 nt, Staphylococcus aureus subsp. aureus N315
uaucuuaaagaauuaagua

SEQ ID NO: 4068446 - RNA, 22 nt, Staphylococcus aureus subsp. aureus N315
uaucuuaaucagcuauaaaagu

SEQ ID NO: 4068447 - RNA, 19 nt, Staphylococcus aureus subsp. aureus N315
uaucuuacuacuuaauuaa

SEQ ID NO: 4068448 - RNA, 20 nt, Staphylococcus aureus subsp. aureus N315
uaucuuacugcuguucucua

SEQ ID NO: 4068449 - RNA, 21 nt, Staphylococcus aureus subsp. aureus N315
uaucuuacugcuguucucuau

SEQ ID NO: 4068450 - RNA, 22 nt, Staphylococcus aureus subsp. aureus N315
uaucuuacugcuguucucuauu

SEQ ID NO: 4068451 - RNA, 19 nt, Staphylococcus aureus subsp. aureus N315
uaucuuaguaagacugcca

SEQ ID NO: 4068452 - RNA, 19 nt, Staphylococcus aureus subsp. aureus N315
uaucuucacacuuuuagaa

SEQ ID NO: 4068453 - RNA, 22 nt, Staphylococcus aureus subsp. aureus N315
uaucuucagauucccaaauagu

SEQ ID NO: 4068454 - RNA, 14 nt, Staphylococcus aureus subsp. aureus N315
uaucuucaguuauu

SEQ ID NO: 4068455 - RNA, 14 nt, Staphylococcus aureus subsp. aureus N315
uaucuucauuuaaa

SEQ ID NO: 4068456 - RNA, 13 nt, Staphylococcus aureus subsp. aureus N315
uaucuugauuuaa

SEQ ID NO: 4068457 - RNA, 18 nt, Staphylococcus aureus subsp. aureus N315
uaucuugauuuuauaaau

SEQ ID NO: 4068458 - RNA, 19 nt, Staphylococcus aureus subsp. aureus N315
uaucuugucauuugaacau

SEQ ID NO: 4068459 - RNA, 11 nt, Staphylococcus aureus subsp. aureus N315
uaucuuuaauu

SEQ ID NO: 4068460 - RNA, 14 nt, Staphylococcus aureus subsp. aureus N315
uaucuuuaauuggc

SEQ ID NO: 4068461 - RNA, 14 nt, Staphylococcus aureus subsp. aureus N315
uaucuuuagacaua

SEQ ID NO: 4068462 - RNA, 17 nt, Staphylococcus aureus subsp. aureus N315
uaucuuuaguauuucau

SEQ ID NO: 4068463 - RNA, 10 nt, Staphylococcus aureus subsp. aureus N315
uaucuuuaua

SEQ ID NO: 4068464 - RNA, 20 nt, Staphylococcus aureus subsp. aureus N315
uaucuuuauaacgcuuuaau

SEQ ID NO: 4068465 - RNA, 19 nt, Staphylococcus aureus subsp. aureus N315
uaucuuucaaauuaauuaa

SEQ ID NO: 4068466 - RNA, 12 nt, Staphylococcus aureus subsp. aureus N315
uaucuuuucauc

SEQ ID NO: 4068467 - RNA, 16 nt, Staphylococcus aureus subsp. aureus N315
uaucuuuuucuaaguu

SEQ ID NO: 4068468 - RNA, 18 nt, Staphylococcus aureus subsp. aureus N315
uaugaaaccuuugguuca

SEQ ID NO: 4068469 - RNA, 14 nt, Staphylococcus aureus subsp. aureus N315
uaugaaauaacaau

SEQ ID NO: 4068470 - RNA, 14 nt, Staphylococcus aureus subsp. aureus N315
uaugaaauaacuag

SEQ ID NO: 4068471 - RNA, 14 nt, Staphylococcus aureus subsp. aureus N315
uaugaaauuuuuua

SEQ ID NO: 4068472 - RNA, 14 nt, Staphylococcus aureus subsp. aureus N315
uaugaacaaaaaau

SEQ ID NO: 4068473 - RNA, 15 nt, Staphylococcus aureus subsp. aureus N315
uaugaacaauaagug

SEQ ID NO: 4068474 - RNA, 21 nt, Staphylococcus aureus subsp. aureus N315
uaugaaguaagcagagccaua

SEQ ID NO: 4068475 - RNA, 23 nt, Staphylococcus aureus subsp. aureus N315
uaugaauggcaaucuauauaaau

SEQ ID NO: 4068476 - RNA, 19 nt, Staphylococcus aureus subsp. aureus N315
uaugaauugaguauuaaau

SEQ ID NO: 4068477 - RNA, 20 nt, Staphylococcus aureus subsp. aureus N315
uaugaauugaguauuaaauu

SEQ ID NO: 4068478 - RNA, 16 nt, Staphylococcus aureus subsp. aureus N315
uaugaauugcuuguuu

SEQ ID NO: 4068479 - RNA, 22 nt, Staphylococcus aureus subsp. aureus N315
uaugaauuuagcaucaaaaaua

SEQ ID NO: 4068480 - RNA, 13 nt, Staphylococcus aureus subsp. aureus N315
uaugaauuuuaua

SEQ ID NO: 4068481 - RNA, 15 nt, Staphylococcus aureus subsp. aureus N315
uaugaauuuuauaaa

SEQ ID NO: 4068482 - RNA, 14 nt, Staphylococcus aureus subsp. aureus N315
uaugaccuuuaugu

SEQ ID NO: 4068483 - RNA, 21 nt, Staphylococcus aureus subsp. aureus N315
uaugacuuauuuuucaucauu

SEQ ID NO: 4068484 - RNA, 15 nt, Staphylococcus aureus subsp. aureus N315
uaugacuuuuuauua

SEQ ID NO: 4068485 - RNA, 16 nt, Staphylococcus aureus subsp. aureus N315
uaugagugauagaaag

SEQ ID NO: 4068486 - RNA, 23 nt, Staphylococcus aureus subsp. aureus N315
uaugauaaauauuguguuuagga

SEQ ID NO: 4068487 - RNA, 16 nt, Staphylococcus aureus subsp. aureus N315
uaugauaaccauuaug

SEQ ID NO: 4068488 - RNA, 22 nt, Staphylococcus aureus subsp. aureus N315
uaugauaaccauuaugauuaau

SEQ ID NO: 4068489 - RNA, 19 nt, Staphylococcus aureus subsp. aureus N315
uaugauacgcuuuuuaaaa

SEQ ID NO: 4068490 - RNA, 21 nt, Staphylococcus aureus subsp. aureus N315
uaugauacgcuuuuuaaaaaa

SEQ ID NO: 4068491 - RNA, 22 nt, Staphylococcus aureus subsp. aureus N315
uaugauacgcuuuuuaaaaaau

SEQ ID NO: 4068492 - RNA, 23 nt, Staphylococcus aureus subsp. aureus N315
uaugauacugauauuuagaauaa

SEQ ID NO: 4068493 - RNA, 18 nt, Staphylococcus aureus subsp. aureus N315
uaugauagaauacuaaaa

SEQ ID NO: 4068494 - RNA, 23 nt, Staphylococcus aureus subsp. aureus N315
uaugauagaauacuaaaaguguu

SEQ ID NO: 4068495 - RNA, 15 nt, Staphylococcus aureus subsp. aureus N315
uaugauccuuuaaug

SEQ ID NO: 4068496 - RNA, 23 nt, Staphylococcus aureus subsp. aureus N315
uaugauccuuuaaugcuuuagca

SEQ ID NO: 4068497 - RNA, 22 nt, Staphylococcus aureus subsp. aureus N315
uaugaugaacuuaaugcuucaa

SEQ ID NO: 4068498 - RNA, 21 nt, Staphylococcus aureus subsp. aureus N315
uaugaugaauuguuguacaug

SEQ ID NO: 4068499 - RNA, 17 nt, Staphylococcus aureus subsp. aureus N315
uaugaugucauguauug

SEQ ID NO: 4068500 - RNA, 22 nt, Staphylococcus aureus subsp. aureus N315
uaugaugucauguauuguccau

SEQ ID NO: 4068501 - RNA, 17 nt, Staphylococcus aureus subsp. aureus N315
uaugauguuaaaaaaua

SEQ ID NO: 4068502 - RNA, 19 nt, Staphylococcus aureus subsp. aureus N315
uaugauuaggauuagcguu

SEQ ID NO: 4068503 - RNA, 19 nt, Staphylococcus aureus subsp. aureus N315
uaugauugcuuauuuauuu

SEQ ID NO: 4068504 - RNA, 12 nt, Staphylococcus aureus subsp. aureus N315
uaugauuuaaaa

SEQ ID NO: 4068505 - RNA, 18 nt, Staphylococcus aureus subsp. aureus N315
uaugauuugauuugggua

SEQ ID NO: 4068506 - RNA, 16 nt, Staphylococcus aureus subsp. aureus N315
uaugcaaaauuaauga

SEQ ID NO: 4068507 - RNA, 22 nt, Staphylococcus aureus subsp. aureus N315
uaugcauacacuugauuaucau

SEQ ID NO: 4068508 - RNA, 16 nt, Staphylococcus aureus subsp. aureus N315
uaugcauagcucuugc

SEQ ID NO: 4068509 - RNA, 23 nt, Staphylococcus aureus subsp. aureus N315
uaugcauccuaaaaaggcaagca

SEQ ID NO: 4068510 - RNA, 22 nt, Staphylococcus aureus subsp. aureus N315
uaugccgauugcucuaauccaa

SEQ ID NO: 4068511 - RNA, 21 nt, Staphylococcus aureus subsp. aureus N315
uaugccgccuaauaauaaaau

SEQ ID NO: 4068512 - RNA, 19 nt, Staphylococcus aureus subsp. aureus N315
uaugcguggucuauuuuau

SEQ ID NO: 4068513 - RNA, 17 nt, Staphylococcus aureus subsp. aureus N315
uaugcuagaaaguaaug

SEQ ID NO: 4068514 - RNA, 17 nt, Staphylococcus aureus subsp. aureus N315
uaugcuguguaucauca

SEQ ID NO: 4068515 - RNA, 21 nt, Staphylococcus aureus subsp. aureus N315
uaugcuguguaucaucauaau

SEQ ID NO: 4068516 - RNA, 22 nt, Staphylococcus aureus subsp. aureus N315
uaugcuuguugugaauaaaauu

SEQ ID NO: 4068517 - RNA, 15 nt, Staphylococcus aureus subsp. aureus N315
uauggaaaauguuau

SEQ ID NO: 4068518 - RNA, 14 nt, Staphylococcus aureus subsp. aureus N315
uauggaaauggugg

SEQ ID NO: 4068519 - RNA, 13 nt, Staphylococcus aureus subsp. aureus N315
uauggagcggaag

SEQ ID NO: 4068520 - RNA, 20 nt, Staphylococcus aureus subsp. aureus N315
uauggagcuacccuauuuua

SEQ ID NO: 4068521 - RNA, 13 nt, Staphylococcus aureus subsp. aureus N315
uauggauaaaauu

SEQ ID NO: 4068522 - RNA, 16 nt, Staphylococcus aureus subsp. aureus N315
uauggauguauuucug

SEQ ID NO: 4068523 - RNA, 21 nt, Staphylococcus aureus subsp. aureus N315
uauggcgcaauuuuuaacaaa

SEQ ID NO: 4068524 - RNA, 22 nt, Staphylococcus aureus subsp. aureus N315
uauuauugaaaucgauacuaau

SEQ ID NO: 4068525 - RNA, 18 nt, Staphylococcus aureus subsp. aureus N315
uauuauuuugcuuuaauu

SEQ ID NO: 4068526 - RNA, 19 nt, Staphylococcus aureus subsp. aureus N315
uauuauuuuguauuuuuca

SEQ ID NO: 4068527 - RNA, 20 nt, Staphylococcus aureus subsp. aureus N315
uauuauuuuguauuuuucaa

SEQ ID NO: 4068528 - RNA, 12 nt, Staphylococcus aureus subsp. aureus N315
uauucaaaauaa

SEQ ID NO: 4068529 - RNA, 16 nt, Staphylococcus aureus subsp. aureus N315
uauucaaaguuuucau

SEQ ID NO: 4068530 - RNA, 18 nt, Staphylococcus aureus subsp. aureus N315
uauucaaauaaacacauc

SEQ ID NO: 4068531 - RNA, 23 nt, Staphylococcus aureus subsp. aureus N315
uauucaacuaauuuaaagcauca

SEQ ID NO: 4068532 - RNA, 15 nt, Staphylococcus aureus subsp. aureus N315
uauucaauaauucau

SEQ ID NO: 4068533 - RNA, 17 nt, Staphylococcus aureus subsp. aureus N315
uauucaauguuuuaaau

SEQ ID NO: 4068534 - RNA, 14 nt, Staphylococcus aureus subsp. aureus N315
uauucaauucugug

SEQ ID NO: 4068535 - RNA, 10 nt, Staphylococcus aureus subsp. aureus N315
uauucaauug

SEQ ID NO: 4068536 - RNA, 19 nt, Staphylococcus aureus subsp. aureus N315
uauucacgcguucaaaugu

SEQ ID NO: 4068537 - RNA, 21 nt, Staphylococcus aureus subsp. aureus N315
uauucagucaguaaaaauaca

SEQ ID NO: 4068538 - RNA, 23 nt, Staphylococcus aureus subsp. aureus N315
uauucauagaccuaugaauuuag

SEQ ID NO: 4068539 - RNA, 13 nt, Staphylococcus aureus subsp. aureus N315
uauucauuuuaaa

SEQ ID NO: 4068540 - RNA, 16 nt, Staphylococcus aureus subsp. aureus N315
uauucauuuuaaauuu

SEQ ID NO: 4068541 - RNA, 13 nt, Staphylococcus aureus subsp. aureus N315
uauucccaaaaug

SEQ ID NO: 4068542 - RNA, 20 nt, Staphylococcus aureus subsp. aureus N315
uauuccgcaacuuguauugu

SEQ ID NO: 4068543 - RNA, 14 nt, Staphylococcus aureus subsp. aureus N315
uauucgauaauaua

SEQ ID NO: 4068544 - RNA, 18 nt, Staphylococcus aureus subsp. aureus N315
uauucgcuuaaaaacgcu

SEQ ID NO: 4068545 - RNA, 12 nt, Staphylococcus aureus subsp. aureus N315
uauucggcaaaa

SEQ ID NO: 4068546 - RNA, 22 nt, Staphylococcus aureus subsp. aureus N315
uauucuaaaaaauuaaaaauuu

SEQ ID NO: 4068547 - RNA, 15 nt, Staphylococcus aureus subsp. aureus N315
uauucuaaauauauu

SEQ ID NO: 4068548 - RNA, 19 nt, Staphylococcus aureus subsp. aureus N315
uauucuaaauauauuuuau

SEQ ID NO: 4068549 - RNA, 20 nt, Staphylococcus aureus subsp. aureus N315
uauucuagauucauauuuau

SEQ ID NO: 4068550 - RNA, 12 nt, Staphylococcus aureus subsp. aureus N315
uauucuauuuuu

SEQ ID NO: 4068551 - RNA, 16 nt, Staphylococcus aureus subsp. aureus N315
uauucuauuuuucaau

SEQ ID NO: 4068552 - RNA, 21 nt, Staphylococcus aureus subsp. aureus N315
uauucuauuuuucaauucgcu

SEQ ID NO: 4068553 - RNA, 21 nt, Staphylococcus aureus subsp. aureus N315
uauucugagauugagaauuca

SEQ ID NO: 4068554 - RNA, 17 nt, Staphylococcus aureus subsp. aureus N315
uauucuuaaaagacauc

SEQ ID NO: 4068555 - RNA, 15 nt, Staphylococcus aureus subsp. aureus N315
uauucuuaucauuca

SEQ ID NO: 4068556 - RNA, 13 nt, Staphylococcus aureus subsp. aureus N315
uauucuucauuua

SEQ ID NO: 4068557 - RNA, 11 nt, Staphylococcus aureus subsp. aureus N315
uauucuuccca

SEQ ID NO: 4068558 - RNA, 17 nt, Staphylococcus aureus subsp. aureus N315
uauucuucccaaaaauu

SEQ ID NO: 4068559 - RNA, 21 nt, Staphylococcus aureus subsp. aureus N315
uauucuucuaauucugaaauc

SEQ ID NO: 4068560 - RNA, 20 nt, Staphylococcus aureus subsp. aureus N315
uauucuuggcguauuuuuug

SEQ ID NO: 4068561 - RNA, 14 nt, Staphylococcus aureus subsp. aureus N315
uauucuuuauauuu

SEQ ID NO: 4068562 - RNA, 13 nt, Staphylococcus aureus subsp. aureus N315
uauucuuucucua

SEQ ID NO: 4068563 - RNA, 18 nt, Staphylococcus aureus subsp. aureus N315
uauucuuuuaauagaucu

SEQ ID NO: 4068564 - RNA, 15 nt, Staphylococcus aureus subsp. aureus N315
uauugaaaagauaaa

SEQ ID NO: 4068565 - RNA, 16 nt, Staphylococcus aureus subsp. aureus N315
uauugaaaauagaaag

SEQ ID NO: 4068566 - RNA, 18 nt, Staphylococcus aureus subsp. aureus N315
uauugaaaguguaugcau

SEQ ID NO: 4068567 - RNA, 16 nt, Staphylococcus aureus subsp. aureus N315
uauugaaauaauauaa

SEQ ID NO: 4068568 - RNA, 17 nt, Staphylococcus aureus subsp. aureus N315
uauugaaauuaaauuug

SEQ ID NO: 4068569 - RNA, 20 nt, Staphylococcus aureus subsp. aureus N315
uauugaacaauuuuugggaa

SEQ ID NO: 4068570 - RNA, 21 nt, Staphylococcus aureus subsp. aureus N315
uauugaacaauuuuugggaag

SEQ ID NO: 4068571 - RNA, 14 nt, Staphylococcus aureus subsp. aureus N315
uauugaacuucuaa

SEQ ID NO: 4068572 - RNA, 13 nt, Staphylococcus aureus subsp. aureus N315
uauugaauaauca

SEQ ID NO: 4068573 - RNA, 15 nt, Staphylococcus aureus subsp. aureus N315
uauugaaugaauuca

SEQ ID NO: 4068574 - RNA, 14 nt, Staphylococcus aureus subsp. aureus N315
uauugaauugaaaa

SEQ ID NO: 4068575 - RNA, 22 nt, Staphylococcus aureus subsp. aureus N315
uauugaauuugaauaagugguu

SEQ ID NO: 4068576 - RNA, 18 nt, Staphylococcus aureus subsp. aureus N315
uauugaccaccuguaucu

SEQ ID NO: 4068577 - RNA, 14 nt, Staphylococcus aureus subsp. aureus N315
uauugagaauauuu

SEQ ID NO: 4068578 - RNA, 14 nt, Staphylococcus aureus subsp. aureus N315
uauugagacaacau

SEQ ID NO: 4068579 - RNA, 17 nt, Staphylococcus aureus subsp. aureus N315
uauugagauagaaauua

SEQ ID NO: 4068580 - RNA, 14 nt, Staphylococcus aureus subsp. aureus N315
uauugauauucuaa

SEQ ID NO: 4068581 - RNA, 20 nt, Staphylococcus aureus subsp. aureus N315
uauugaugaaaacaaacaag

SEQ ID NO: 4068582 - RNA, 21 nt, Staphylococcus aureus subsp. aureus N315
uauugaugaauaaauagauaa

SEQ ID NO: 4068583 - RNA, 13 nt, Staphylococcus aureus subsp. aureus N315
uauugauuauucu

SEQ ID NO: 4068584 - RNA, 22 nt, Staphylococcus aureus subsp. aureus N315
uauugauucuagugaaauaccu

SEQ ID NO: 4068585 - RNA, 14 nt, Staphylococcus aureus subsp. aureus N315
uauugauuguacca

SEQ ID NO: 4068586 - RNA, 21 nt, Staphylococcus aureus subsp. aureus N315
uauugauuguaccaguaacaa

SEQ ID NO: 4068587 - RNA, 21 nt, Staphylococcus aureus subsp. aureus N315
uauugauugugacuuguauca

SEQ ID NO: 4068588 - RNA, 14 nt, Staphylococcus aureus subsp. aureus N315
uauugcaaaaauaa

SEQ ID NO: 4068589 - RNA, 23 nt, Staphylococcus aureus subsp. aureus N315
uauugcaaaaauaauaugaauuu

SEQ ID NO: 4068590 - RNA, 15 nt, Staphylococcus aureus subsp. aureus N315
uauugcaauaaaauu

SEQ ID NO: 4068591 - RNA, 23 nt, Staphylococcus aureus subsp. aureus N315
uauugcagcaacgcgauugcuaa

SEQ ID NO: 4068592 - RNA, 18 nt, Staphylococcus aureus subsp. aureus N315
uauugcauguuuaaauau

SEQ ID NO: 4068593 - RNA, 17 nt, Staphylococcus aureus subsp. aureus N315
uauugcauuuagacuug

SEQ ID NO: 4068594 - RNA, 14 nt, Staphylococcus aureus subsp. aureus N315
uauugcuuauuuuu

SEQ ID NO: 4068595 - RNA, 17 nt, Staphylococcus aureus subsp. aureus N315
uauuggaauacucuuca

SEQ ID NO: 4068596 - RNA, 15 nt, Staphylococcus aureus subsp. aureus N315
uauugguaaauuuau

SEQ ID NO: 4068597 - RNA, 19 nt, Staphylococcus aureus subsp. aureus N315
uauugguaaauuuaucauu

SEQ ID NO: 4068598 - RNA, 17 nt, Staphylococcus aureus subsp. aureus N315
uauuguaagcugacuuu

SEQ ID NO: 4068599 - RNA, 14 nt, Staphylococcus aureus subsp. aureus N315
uauuguauuuuaau

SEQ ID NO: 4068600 - RNA, 18 nt, Staphylococcus aureus subsp. aureus N315
uauuguauuuuauuuauu

SEQ ID NO: 4068601 - RNA, 15 nt, Staphylococcus aureus subsp. aureus N315
uauugucaucauguu

SEQ ID NO: 4068602 - RNA, 19 nt, Staphylococcus aureus subsp. aureus N315
uauugucgacuuuuagauu

SEQ ID NO: 4068603 - RNA, 23 nt, Staphylococcus aureus subsp. aureus N315
uauuguuccagacuccuaaauua

SEQ ID NO: 4068604 - RNA, 15 nt, Staphylococcus aureus subsp. aureus N315
uauuguuuuauauuu

SEQ ID NO: 4068605 - RNA, 19 nt, Staphylococcus aureus subsp. aureus N315
uauuguuuucaucaugcau

SEQ ID NO: 4068606 - RNA, 14 nt, Staphylococcus aureus subsp. aureus N315
uauuuaaaaauagc

SEQ ID NO: 4068607 - RNA, 15 nt, Staphylococcus aureus subsp. aureus N315
uauuuaaaaauagcc

SEQ ID NO: 4068608 - RNA, 13 nt, Staphylococcus aureus subsp. aureus N315
uauuuaaaagaca

SEQ ID NO: 4068609 - RNA, 23 nt, Staphylococcus aureus subsp. aureus N315
uauuuaaaauauuauuuuuaagu

SEQ ID NO: 4068610 - RNA, 12 nt, Staphylococcus aureus subsp. aureus N315
uauuuaaaauca

SEQ ID NO: 4068611 - RNA, 19 nt, Staphylococcus aureus subsp. aureus N315
uauuuaaacucucuaaaaa

SEQ ID NO: 4068612 - RNA, 20 nt, Staphylococcus aureus subsp. aureus N315
uauuuuuaaaugauucuuua

SEQ ID NO: 4068613 - RNA, 16 nt, Staphylococcus aureus subsp. aureus N315
uauuuuuaagcugcuc

SEQ ID NO: 4068614 - RNA, 14 nt, Staphylococcus aureus subsp. aureus N315
uauuuuuacauauu

SEQ ID NO: 4068615 - RNA, 15 nt, Staphylococcus aureus subsp. aureus N315
uauuuuuaucaucau

SEQ ID NO: 4068616 - RNA, 16 nt, Staphylococcus aureus subsp. aureus N315
uauuuuuaugauucua

SEQ ID NO: 4068617 - RNA, 23 nt, Staphylococcus aureus subsp. aureus N315
uauuuuugauagugguagccaau

SEQ ID NO: 4068618 - RNA, 13 nt, Staphylococcus aureus subsp. aureus N315
uauuuuuuaaaau

SEQ ID NO: 4068619 - RNA, 15 nt, Staphylococcus aureus subsp. aureus N315
uauuuuuuaaaauga

SEQ ID NO: 4068620 - RNA, 14 nt, Staphylococcus aureus subsp. aureus N315
uauuuuuuaaaugc

SEQ ID NO: 4068621 - RNA, 16 nt, Staphylococcus aureus subsp. aureus N315
uauuuuuuauguuuua

SEQ ID NO: 4068622 - RNA, 19 nt, Staphylococcus aureus subsp. aureus N315
uauuuuuugagcacuuaau

SEQ ID NO: 4068623 - RNA, 21 nt, Staphylococcus aureus subsp. aureus N315
uauuuuuuggagcguaaaguu

SEQ ID NO: 4068624 - RNA, 21 nt, Staphylococcus aureus subsp. aureus N315
uauuuuuugugccuuucucua

SEQ ID NO: 4068625 - RNA, 22 nt, Staphylococcus aureus subsp. aureus N315
uauuuuuugugccuuucucuaa

SEQ ID NO: 4068626 - RNA, 14 nt, Staphylococcus aureus subsp. aureus N315
uauuuuuuuaugcu

SEQ ID NO: 4068627 - RNA, 22 nt, Staphylococcus aureus subsp. aureus N315
uauuuuuuuguccaauaaauug

SEQ ID NO: 4068628 - RNA, 13 nt, Staphylococcus aureus subsp. aureus N315
ucaaaaaauaaua

SEQ ID NO: 4068629 - RNA, 14 nt, Staphylococcus aureus subsp. aureus N315
ucaaaaaauuaauc

SEQ ID NO: 4068630 - RNA, 16 nt, Staphylococcus aureus subsp. aureus N315
ucaaaaacaguuacaa

SEQ ID NO: 4068631 - RNA, 14 nt, Staphylococcus aureus subsp. aureus N315
ucaaaaagacagca

SEQ ID NO: 4068632 - RNA, 22 nt, Staphylococcus aureus subsp. aureus N315
ucaaaaauaauuaugaaaagua

SEQ ID NO: 4068633 - RNA, 18 nt, Staphylococcus aureus subsp. aureus N315
ucaaaaaugcuuauauaa

SEQ ID NO: 4068634 - RNA, 13 nt, Staphylococcus aureus subsp. aureus N315
ucaaaaauuaauc

SEQ ID NO: 4068635 - RNA, 20 nt, Staphylococcus aureus subsp. aureus N315
ucaaaaauuaaucaccuuau

SEQ ID NO: 4068636 - RNA, 17 nt, Staphylococcus aureus subsp. aureus N315
ucaaaaccgcuauaaaa

SEQ ID NO: 4068637 - RNA, 18 nt, Staphylococcus aureus subsp. aureus N315
ucaaaaccgcuauaaaau

SEQ ID NO: 4068638 - RNA, 16 nt, Staphylococcus aureus subsp. aureus N315
ucaaaacguuuaauug

SEQ ID NO: 4068639 - RNA, 18 nt, Staphylococcus aureus subsp. aureus N315
ucaaaacguuuaauugca

SEQ ID NO: 4068640 - RNA, 11 nt, Staphylococcus aureus subsp. aureus N315
ucaaaacugcc

SEQ ID NO: 4068641 - RNA, 12 nt, Staphylococcus aureus subsp. aureus N315
ucaaaacugcca

SEQ ID NO: 4068642 - RNA, 22 nt, Staphylococcus aureus subsp. aureus N315
ucaaaaugccggucaaagcgaa

SEQ ID NO: 4068643 - RNA, 13 nt, Staphylococcus aureus subsp. aureus N315
ucaaaauguuuaa

SEQ ID NO: 4068644 - RNA, 20 nt, Staphylococcus aureus subsp. aureus N315
ucaaaauguuuaacaauaau

SEQ ID NO: 4068645 - RNA, 14 nt, Staphylococcus aureus subsp. aureus N315
ucaaaauuaugacu

SEQ ID NO: 4068646 - RNA, 13 nt, Staphylococcus aureus subsp. aureus N315
ucaaaauucaaua

SEQ ID NO: 4068647 - RNA, 13 nt, Staphylococcus aureus subsp. aureus N315
ucaaaauuuugac

SEQ ID NO: 4068648 - RNA, 11 nt, Staphylococcus aureus subsp. aureus N315
ucaaacaacau

SEQ ID NO: 4068649 - RNA, 22 nt, Staphylococcus aureus subsp. aureus N315
ucaaacaagauucauacacugc

SEQ ID NO: 4068650 - RNA, 13 nt, Staphylococcus aureus subsp. aureus N315
ucaaacaauaaag

SEQ ID NO: 4068651 - RNA, 19 nt, Staphylococcus aureus subsp. aureus N315
ucaaacaguccuuauuaua

SEQ ID NO: 4068652 - RNA, 13 nt, Staphylococcus aureus subsp. aureus N315
ucaaacugauuuc

SEQ ID NO: 4068653 - RNA, 14 nt, Staphylococcus aureus subsp. aureus N315
ucaaacuuaaaacu

SEQ ID NO: 4068654 - RNA, 15 nt, Staphylococcus aureus subsp. aureus N315
ucaaacuuaaaacua

SEQ ID NO: 4068655 - RNA, 21 nt, Staphylococcus aureus subsp. aureus N315
ucaaacuuaaaacuauaaccu

SEQ ID NO: 4068656 - RNA, 20 nt, Staphylococcus aureus subsp. aureus N315
ucaaacuuggcaaugaaauu

SEQ ID NO: 4068657 - RNA, 15 nt, Staphylococcus aureus subsp. aureus N315
ucaaagccacagcuu

SEQ ID NO: 4068658 - RNA, 18 nt, Staphylococcus aureus subsp. aureus N315
ucaaagcgauaaaguaug

SEQ ID NO: 4068659 - RNA, 18 nt, Staphylococcus aureus subsp. aureus N315
ucaaagcuauauaugaau

SEQ ID NO: 4068660 - RNA, 22 nt, Staphylococcus aureus subsp. aureus N315
ucaaagguuuacuauuaaagga

SEQ ID NO: 4068661 - RNA, 12 nt, Staphylococcus aureus subsp. aureus N315
ucaaaguagaca

SEQ ID NO: 4068662 - RNA, 17 nt, Staphylococcus aureus subsp. aureus N315
ucaaaguagacauugaa

SEQ ID NO: 4068663 - RNA, 22 nt, Staphylococcus aureus subsp. aureus N315
ucaaaguagacauugaauaaau

SEQ ID NO: 4068664 - RNA, 21 nt, Staphylococcus aureus subsp. aureus N315
ucaaaguauauacuaaucuuc

SEQ ID NO: 4068665 - RNA, 19 nt, Staphylococcus aureus subsp. aureus N315
ucaaagucauuuagauagc

SEQ ID NO: 4068666 - RNA, 13 nt, Staphylococcus aureus subsp. aureus N315
ucaaaguuuaauu

SEQ ID NO: 4068667 - RNA, 22 nt, Staphylococcus aureus subsp. aureus N315
ucaaaguuuaauugcuguaaau

SEQ ID NO: 4068668 - RNA, 21 nt, Staphylococcus aureus subsp. aureus N315
ucaaaguuuucaggaauuguu

SEQ ID NO: 4068669 - RNA, 14 nt, Staphylococcus aureus subsp. aureus N315
ucaaaguuuucauu

SEQ ID NO: 4068670 - RNA, 19 nt, Staphylococcus aureus subsp. aureus N315
ucaaaguuuucauuuaaca

SEQ ID NO: 4068671 - RNA, 21 nt, Staphylococcus aureus subsp. aureus N315
ucaaauaaaugacauuuaaua

SEQ ID NO: 4068672 - RNA, 22 nt, Staphylococcus aureus subsp. aureus N315
ucaaauaaaugacauuuaauac

SEQ ID NO: 4068673 - RNA, 17 nt, Staphylococcus aureus subsp. aureus N315
ucaaauaacugaguuaa

SEQ ID NO: 4068674 - RNA, 21 nt, Staphylococcus aureus subsp. aureus N315
ucaaauacauuucaaaaaaag

SEQ ID NO: 4068675 - RNA, 21 nt, Staphylococcus aureus subsp. aureus N315
ucaaauacguaucaagaaaaa

SEQ ID NO: 4068676 - RNA, 20 nt, Staphylococcus aureus subsp. aureus N315
ucaaauagacaccaaaaaac

SEQ ID NO: 4068677 - RNA, 22 nt, Staphylococcus aureus subsp. aureus N315
ucaaauagacaccaaaaaacag

SEQ ID NO: 4068678 - RNA, 17 nt, Staphylococcus aureus subsp. aureus N315
ucaaauaggcauaauga

SEQ ID NO: 4068679 - RNA, 19 nt, Staphylococcus aureus subsp. aureus N315
ucaaauauacuuuuaccau

SEQ ID NO: 4068680 - RNA, 17 nt, Staphylococcus aureus subsp. aureus N315
ucaaaugacauuuuaaa

SEQ ID NO: 4068681 - RNA, 20 nt, Staphylococcus aureus subsp. aureus N315
ucaaaugacauuuuaaaucu

SEQ ID NO: 4068682 - RNA, 22 nt, Staphylococcus aureus subsp. aureus N315
ucaaaugacauuuuaaaucuaa

SEQ ID NO: 4068683 - RNA, 23 nt, Staphylococcus aureus subsp. aureus N315
ucaaaugccgcuucuaauuuuuc

SEQ ID NO: 4068684 - RNA, 17 nt, Staphylococcus aureus subsp. aureus N315
ucaaauguaacauuaaa

SEQ ID NO: 4068685 - RNA, 21 nt, Staphylococcus aureus subsp. aureus N315
ucaaauguaacauuaaaaaua

SEQ ID NO: 4068686 - RNA, 22 nt, Staphylococcus aureus subsp. aureus N315
ucaaauguugaauguggaacau

SEQ ID NO: 4068687 - RNA, 15 nt, Staphylococcus aureus subsp. aureus N315
ucaaauuaaaucacc

SEQ ID NO: 4068688 - RNA, 20 nt, Staphylococcus aureus subsp. aureus N315
ucaaauuaauuaaaccaaua

SEQ ID NO: 4068689 - RNA, 20 nt, Staphylococcus aureus subsp. aureus N315
ucaaauucaacgucaucaaa

SEQ ID NO: 4068690 - RNA, 12 nt, Staphylococcus aureus subsp. aureus N315
ucaaauuuaaua

SEQ ID NO: 4068691 - RNA, 11 nt, Staphylococcus aureus subsp. aureus N315
ucaacaaacau

SEQ ID NO: 4068692 - RNA, 13 nt, Staphylococcus aureus subsp. aureus N315
ucaacaaacauaa

SEQ ID NO: 4068693 - RNA, 18 nt, Staphylococcus aureus subsp. aureus N315
ucaacaaauuuaacuuuc

SEQ ID NO: 4068694 - RNA, 18 nt, Staphylococcus aureus subsp. aureus N315
ucaacaacaaguucuuga

SEQ ID NO: 4068695 - RNA, 18 nt, Staphylococcus aureus subsp. aureus N315
ucaacaacugcgacaugu

SEQ ID NO: 4068696 - RNA, 18 nt, Staphylococcus aureus subsp. aureus N315
ucaacaauugcuaaucca

SEQ ID NO: 4068697 - RNA, 22 nt, Staphylococcus aureus subsp. aureus N315
ucaacacacacaguuuauaaua

SEQ ID NO: 4068698 - RNA, 23 nt, Staphylococcus aureus subsp. aureus N315
ucaacaccaacaccuaauauuuu

SEQ ID NO: 4068699 - RNA, 13 nt, Staphylococcus aureus subsp. aureus N315
ucaaugacaucua

SEQ ID NO: 4068700 - RNA, 19 nt, Staphylococcus aureus subsp. aureus N315
ucaaugacugagaaaaaua

SEQ ID NO: 4068701 - RNA, 23 nt, Staphylococcus aureus subsp. aureus N315
ucaaugacugagaaaaauauuuc

SEQ ID NO: 4068702 - RNA, 22 nt, Staphylococcus aureus subsp. aureus N315
ucaaugagcaagucuucuaaaa

SEQ ID NO: 4068703 - RNA, 12 nt, Staphylococcus aureus subsp. aureus N315
ucaaugauuuuu

SEQ ID NO: 4068704 - RNA, 16 nt, Staphylococcus aureus subsp. aureus N315
ucaaugauuuuuaaaa

SEQ ID NO: 4068705 - RNA, 14 nt, Staphylococcus aureus subsp. aureus N315
ucaauguaauuuuc

SEQ ID NO: 4068706 - RNA, 20 nt, Staphylococcus aureus subsp. aureus N315
ucaauguauauuuaacauca

SEQ ID NO: 4068707 - RNA, 13 nt, Staphylococcus aureus subsp. aureus N315
ucaauguaucaag

SEQ ID NO: 4068708 - RNA, 16 nt, Staphylococcus aureus subsp. aureus N315
ucaaugugagauauaa

SEQ ID NO: 4068709 - RNA, 21 nt, Staphylococcus aureus subsp. aureus N315
ucaaugugauuuucuuucaua

SEQ ID NO: 4068710 - RNA, 14 nt, Staphylococcus aureus subsp. aureus N315
ucaauguuauuaaa

SEQ ID NO: 4068711 - RNA, 15 nt, Staphylococcus aureus subsp. aureus N315
ucaauguuauuaaac

SEQ ID NO: 4068712 - RNA, 17 nt, Staphylococcus aureus subsp. aureus N315
ucaauguuauuaaacgc

SEQ ID NO: 4068713 - RNA, 16 nt, Staphylococcus aureus subsp. aureus N315
ucaauguuuaauuuuc

SEQ ID NO: 4068714 - RNA, 19 nt, Staphylococcus aureus subsp. aureus N315
ucaauuaaacuuaagaaua

SEQ ID NO: 4068715 - RNA, 14 nt, Staphylococcus aureus subsp. aureus N315
ucaauuaauuuaaa

SEQ ID NO: 4068716 - RNA, 23 nt, Staphylococcus aureus subsp. aureus N315
ucaauuaauuuagucauuacaaa

SEQ ID NO: 4068717 - RNA, 15 nt, Staphylococcus aureus subsp. aureus N315
ucaauuagaaaauau

SEQ ID NO: 4068718 - RNA, 15 nt, Staphylococcus aureus subsp. aureus N315
ucaauuagaaaauuu

SEQ ID NO: 4068719 - RNA, 13 nt, Staphylococcus aureus subsp. aureus N315
ucaauuaguucug

SEQ ID NO: 4068720 - RNA, 21 nt, Staphylococcus aureus subsp. aureus N315
ucaauucacgagcugcuucaa

SEQ ID NO: 4068721 - RNA, 17 nt, Staphylococcus aureus subsp. aureus N315
ucaauugaaucuuuguu

SEQ ID NO: 4068722 - RNA, 13 nt, Staphylococcus aureus subsp. aureus N315
ucaauuuaauuaa

SEQ ID NO: 4068723 - RNA, 22 nt, Staphylococcus aureus subsp. aureus N315
ucaauuuaguauaaauaaaaau

SEQ ID NO: 4068724 - RNA, 21 nt, Staphylococcus aureus subsp. aureus N315
ucaauuuauaugguuguuuuc

SEQ ID NO: 4068725 - RNA, 19 nt, Staphylococcus aureus subsp. aureus N315
ucaauuuauguugcguuaa

SEQ ID NO: 4068726 - RNA, 23 nt, Staphylococcus aureus subsp. aureus N315
ucaauuuauguugcguuaaauau

SEQ ID NO: 4068727 - RNA, 14 nt, Staphylococcus aureus subsp. aureus N315
ucaauuucuauuuc

SEQ ID NO: 4068728 - RNA, 16 nt, Staphylococcus aureus subsp. aureus N315
ucaauuuuuacuaaau

SEQ ID NO: 4068729 - RNA, 22 nt, Staphylococcus aureus subsp. aureus N315
ucacaaaauuaggcauucaucu

SEQ ID NO: 4068730 - RNA, 12 nt, Staphylococcus aureus subsp. aureus N315
ucacaaagaaau

SEQ ID NO: 4068731 - RNA, 18 nt, Staphylococcus aureus subsp. aureus N315
ucacaaauucaacuuuuc

SEQ ID NO: 4068732 - RNA, 19 nt, Staphylococcus aureus subsp. aureus N315
ucacaaauucaacuuuuca

SEQ ID NO: 4068733 - RNA, 22 nt, Staphylococcus aureus subsp. aureus N315
ucacaaauucuuuuacagcaag

SEQ ID NO: 4068734 - RNA, 15 nt, Staphylococcus aureus subsp. aureus N315
ucacaacacauaaau

SEQ ID NO: 4068735 - RNA, 16 nt, Staphylococcus aureus subsp. aureus N315
ucacaacugcauauaa

SEQ ID NO: 4068736 - RNA, 20 nt, Staphylococcus aureus subsp. aureus N315
ucacaacugcauauaaaguc

SEQ ID NO: 4068737 - RNA, 22 nt, Staphylococcus aureus subsp. aureus N315
ucacaauacgaaaucaaaaaua

SEQ ID NO: 4068738 - RNA, 16 nt, Staphylococcus aureus subsp. aureus N315
ucacaaucauagauau

SEQ ID NO: 4068739 - RNA, 13 nt, Staphylococcus aureus subsp. aureus N315
ucacaaugaccau

SEQ ID NO: 4068740 - RNA, 21 nt, Staphylococcus aureus subsp. aureus N315
ucacaaugaccauugucaugc

SEQ ID NO: 4068741 - RNA, 23 nt, Staphylococcus aureus subsp. aureus N315
ucacacgacauguagguaauugc

SEQ ID NO: 4068742 - RNA, 15 nt, Staphylococcus aureus subsp. aureus N315
ucacagcaauaauaa

SEQ ID NO: 4068743 - RNA, 21 nt, Staphylococcus aureus subsp. aureus N315
ucacaguacacuaaguuuucu

SEQ ID NO: 4068744 - RNA, 20 nt, Staphylococcus aureus subsp. aureus N315
ucacaguaucuucaguuauu

SEQ ID NO: 4068745 - RNA, 22 nt, Staphylococcus aureus subsp. aureus N315
ucacaguaucuucaguuauuug

SEQ ID NO: 4068746 - RNA, 17 nt, Staphylococcus aureus subsp. aureus N315
ucacauaaaauacauuu

SEQ ID NO: 4068747 - RNA, 13 nt, Staphylococcus aureus subsp. aureus N315
ucacauacauuuu

SEQ ID NO: 4068748 - RNA, 16 nt, Staphylococcus aureus subsp. aureus N315
ucacauacauuuugaa

SEQ ID NO: 4068749 - RNA, 22 nt, Staphylococcus aureus subsp. aureus N315
ucacauacauuuugaaacaucu

SEQ ID NO: 4068750 - RNA, 16 nt, Staphylococcus aureus subsp. aureus N315
ucacauauaaauauuu

SEQ ID NO: 4068751 - RNA, 23 nt, Staphylococcus aureus subsp. aureus N315
ucacaucacguugugcaauaccu

SEQ ID NO: 4068752 - RNA, 18 nt, Staphylococcus aureus subsp. aureus N315
ucacaucuuuagcuaugu

SEQ ID NO: 4068753 - RNA, 23 nt, Staphylococcus aureus subsp. aureus N315
ucacaucuuuagcuauguaaaau

SEQ ID NO: 4068754 - RNA, 18 nt, Staphylococcus aureus subsp. aureus N315
ucacaugaauuuuaauau

SEQ ID NO: 4068755 - RNA, 22 nt, Staphylococcus aureus subsp. aureus N315
ucacaugaauuuuaauauauuu

SEQ ID NO: 4068756 - RNA, 18 nt, Staphylococcus aureus subsp. aureus N315
ucacaugccaucuuugua

SEQ ID NO: 4068757 - RNA, 22 nt, Staphylococcus aureus subsp. aureus N315
ucacauguaccacauuuuccuu

SEQ ID NO: 4068758 - RNA, 16 nt, Staphylococcus aureus subsp. aureus N315
ucacaugugaaauaau

SEQ ID NO: 4068759 - RNA, 18 nt, Staphylococcus aureus subsp. aureus N315
ucacaugugaaauaaucc

SEQ ID NO: 4068760 - RNA, 18 nt, Staphylococcus aureus subsp. aureus N315
ucacauuaaguuaaacgu

SEQ ID NO: 4068761 - RNA, 18 nt, Staphylococcus aureus subsp. aureus N315
ucacauucuugaauaaau

SEQ ID NO: 4068762 - RNA, 19 nt, Staphylococcus aureus subsp. aureus N315
ucacauucuugaauaaauu

SEQ ID NO: 4068763 - RNA, 20 nt, Staphylococcus aureus subsp. aureus N315
ucacauucuugaauaaauuu

SEQ ID NO: 4068764 - RNA, 13 nt, Staphylococcus aureus subsp. aureus N315
ucacauuuauaac

SEQ ID NO: 4068765 - RNA, 20 nt, Staphylococcus aureus subsp. aureus N315
ucaccaacaacuuuguuuuc

SEQ ID NO: 4068766 - RNA, 17 nt, Staphylococcus aureus subsp. aureus N315
ucaccaacuuuuuuaac

SEQ ID NO: 4068767 - RNA, 15 nt, Staphylococcus aureus subsp. aureus N315
ucaccaauuagguuu

SEQ ID NO: 4068768 - RNA, 17 nt, Staphylococcus aureus subsp. aureus N315
ucaccagauuuuaagug

SEQ ID NO: 4068769 - RNA, 20 nt, Staphylococcus aureus subsp. aureus N315
ucaccagguuuuuuauuuuc

SEQ ID NO: 4068770 - RNA, 17 nt, Staphylococcus aureus subsp. aureus N315
ucaccauacuaaaacau

SEQ ID NO: 4068771 - RNA, 19 nt, Staphylococcus aureus subsp. aureus N315
ucaccauacuaaaacauga

SEQ ID NO: 4068772 - RNA, 18 nt, Staphylococcus aureus subsp. aureus N315
ucaccauauuuaacauuu

SEQ ID NO: 4068773 - RNA, 13 nt, Staphylococcus aureus subsp. aureus N315
ucaccaucuuuaa

SEQ ID NO: 4068774 - RNA, 16 nt, Staphylococcus aureus subsp. aureus N315
ucaccauuuacuucau

SEQ ID NO: 4068775 - RNA, 14 nt, Staphylococcus aureus subsp. aureus N315
ucaccgcuuucaau

SEQ ID NO: 4068776 - RNA, 19 nt, Staphylococcus aureus subsp. aureus N315
ucaccguaaucuuuuaacu

SEQ ID NO: 4068777 - RNA, 15 nt, Staphylococcus aureus subsp. aureus N315
ucaccuacaacacca

SEQ ID NO: 4068778 - RNA, 24 nt, Staphylococcus aureus subsp. aureus N315
ucaccuguagacaauuguaguaau

SEQ ID NO: 4068779 - RNA, 15 nt, Staphylococcus aureus subsp. aureus N315
ucaccuuaucaugac

SEQ ID NO: 4068780 - RNA, 13 nt, Staphylococcus aureus subsp. aureus N315
ucaccuucccagu

SEQ ID NO: 4068781 - RNA, 14 nt, Staphylococcus aureus subsp. aureus N315
ucaccuucccaguc

SEQ ID NO: 4068782 - RNA, 15 nt, Staphylococcus aureus subsp. aureus N315
ucaccuucuauauug

SEQ ID NO: 4068783 - RNA, 14 nt, Staphylococcus aureus subsp. aureus N315
ucaccuuuaggcaa

SEQ ID NO: 4068784 - RNA, 21 nt, Staphylococcus aureus subsp. aureus N315
ucaccuuugaauauaguccuu

SEQ ID NO: 4068785 - RNA, 14 nt, Staphylococcus aureus subsp. aureus N315
ucaccuuuuuuaac

SEQ ID NO: 4068786 - RNA, 16 nt, Staphylococcus aureus subsp. aureus N315
ucaguuuuuaaaucaa

SEQ ID NO: 4068787 - RNA, 20 nt, Staphylococcus aureus subsp. aureus N315
ucauaaaaaucauaaauaac

SEQ ID NO: 4068788 - RNA, 18 nt, Staphylococcus aureus subsp. aureus N315
ucauaaacugaaucgauu

SEQ ID NO: 4068789 - RNA, 18 nt, Staphylococcus aureus subsp. aureus N315
ucauaaaguuuauuuaug

SEQ ID NO: 4068790 - RNA, 15 nt, Staphylococcus aureus subsp. aureus N315
ucauaaauauaaaau

SEQ ID NO: 4068791 - RNA, 16 nt, Staphylococcus aureus subsp. aureus N315
ucauaaauauaaaaua

SEQ ID NO: 4068792 - RNA, 13 nt, Staphylococcus aureus subsp. aureus N315
ucauaaauauuuu

SEQ ID NO: 4068793 - RNA, 14 nt, Staphylococcus aureus subsp. aureus N315
ucauaaaugacuga

SEQ ID NO: 4068794 - RNA, 22 nt, Staphylococcus aureus subsp. aureus N315
ucauaaccgcuucuuuuaaguu

SEQ ID NO: 4068795 - RNA, 19 nt, Staphylococcus aureus subsp. aureus N315
ucauaacgacaacuugaac

SEQ ID NO: 4068796 - RNA, 22 nt, Staphylococcus aureus subsp. aureus N315
ucauaacgauuguugcaaugau

SEQ ID NO: 4068797 - RNA, 22 nt, Staphylococcus aureus subsp. aureus N315
ucauaagucuuaacaaauuaaa

SEQ ID NO: 4068798 - RNA, 15 nt, Staphylococcus aureus subsp. aureus N315
ucauaauaaucguaa

SEQ ID NO: 4068799 - RNA, 15 nt, Staphylococcus aureus subsp. aureus N315
ucauaaucaagaaua

SEQ ID NO: 4068800 - RNA, 13 nt, Staphylococcus aureus subsp. aureus N315
ucauaaucaaguc

SEQ ID NO: 4068801 - RNA, 16 nt, Staphylococcus aureus subsp. aureus N315
ucauaaucaagucugc

SEQ ID NO: 4068802 - RNA, 18 nt, Staphylococcus aureus subsp. aureus N315
ucauaaugaacgauauuc

SEQ ID NO: 4068803 - RNA, 17 nt, Staphylococcus aureus subsp. aureus N315
ucauaaugaucaaguag

SEQ ID NO: 4068804 - RNA, 20 nt, Staphylococcus aureus subsp. aureus N315
ucauaauuaacacauucaaa

SEQ ID NO: 4068805 - RNA, 21 nt, Staphylococcus aureus subsp. aureus N315
ucauaauuaacacauucaaau

SEQ ID NO: 4068806 - RNA, 14 nt, Staphylococcus aureus subsp. aureus N315
ucauaauuaauaac

SEQ ID NO: 4068807 - RNA, 15 nt, Staphylococcus aureus subsp. aureus N315
ucauaauucaguguu

SEQ ID NO: 4068808 - RNA, 21 nt, Staphylococcus aureus subsp. aureus N315
ucauacacuaucauuaucaaa

SEQ ID NO: 4068809 - RNA, 13 nt, Staphylococcus aureus subsp. aureus N315
ucauaccaaaaac

SEQ ID NO: 4068810 - RNA, 17 nt, Staphylococcus aureus subsp. aureus N315
ucauaccaaaaacauua

SEQ ID NO: 4068811 - RNA, 19 nt, Staphylococcus aureus subsp. aureus N315
ucauaccaaaaacauuaac

SEQ ID NO: 4068812 - RNA, 18 nt, Staphylococcus aureus subsp. aureus N315
ucauacgagaaauuagaa

SEQ ID NO: 4068813 - RNA, 17 nt, Staphylococcus aureus subsp. aureus N315
ucauacuucaaacguua

SEQ ID NO: 4068814 - RNA, 20 nt, Staphylococcus aureus subsp. aureus N315
ucauagaugacgaucuauaa

SEQ ID NO: 4068815 - RNA, 21 nt, Staphylococcus aureus subsp. aureus N315
ucauagcaaauaaaacgcuuc

SEQ ID NO: 4068816 - RNA, 11 nt, Staphylococcus aureus subsp. aureus N315
ucauagccuau

SEQ ID NO: 4068817 - RNA, 16 nt, Staphylococcus aureus subsp. aureus N315
ucauagccuauuuaaa

SEQ ID NO: 4068818 - RNA, 16 nt, Staphylococcus aureus subsp. aureus N315
ucauagugaaauucga

SEQ ID NO: 4068819 - RNA, 14 nt, Staphylococcus aureus subsp. aureus N315
ucauaguugucuuu

SEQ ID NO: 4068820 - RNA, 13 nt, Staphylococcus aureus subsp. aureus N315
ucauauaaaucaa

SEQ ID NO: 4068821 - RNA, 20 nt, Staphylococcus aureus subsp. aureus N315
ucauauaaaucaaauauacu

SEQ ID NO: 4068822 - RNA, 22 nt, Staphylococcus aureus subsp. aureus N315
ucauauaaaucaaauauacuuu

SEQ ID NO: 4068823 - RNA, 19 nt, Staphylococcus aureus subsp. aureus N315
ucauauaaugguugaauaa

SEQ ID NO: 4068824 - RNA, 16 nt, Staphylococcus aureus subsp. aureus N315
ucauauaugucucucu

SEQ ID NO: 4068825 - RNA, 21 nt, Staphylococcus aureus subsp. aureus N315
ucauauauugacucgaccuuu

SEQ ID NO: 4068826 - RNA, 14 nt, Staphylococcus aureus subsp. aureus N315
ucauauauuucuau

SEQ ID NO: 4068827 - RNA, 17 nt, Staphylococcus aureus subsp. aureus N315
ucauauauuuuguuaau

SEQ ID NO: 4068828 - RNA, 16 nt, Staphylococcus aureus subsp. aureus N315
ucauaucauaccaaaa

SEQ ID NO: 4068829 - RNA, 22 nt, Staphylococcus aureus subsp. aureus N315
ucauaucauaccaaaaaguauu

SEQ ID NO: 4068830 - RNA, 23 nt, Staphylococcus aureus subsp. aureus N315
ucauauccuucauuagugacaag

SEQ ID NO: 4068831 - RNA, 15 nt, Staphylococcus aureus subsp. aureus N315
ucauaucgauuaaua

SEQ ID NO: 4068832 - RNA, 11 nt, Staphylococcus aureus subsp. aureus N315
ucauaucuuua

SEQ ID NO: 4068833 - RNA, 22 nt, Staphylococcus aureus subsp. aureus N315
ucauaucuuuauuugauucuuc

SEQ ID NO: 4068834 - RNA, 14 nt, Staphylococcus aureus subsp. aureus N315
ucauaucuuucaau

SEQ ID NO: 4068835 - RNA, 20 nt, Staphylococcus aureus subsp. aureus N315
ucauauggcaauguuaacug

SEQ ID NO: 4068836 - RNA, 17 nt, Staphylococcus aureus subsp. aureus N315
ucauaugugccauaugu

SEQ ID NO: 4068837 - RNA, 20 nt, Staphylococcus aureus subsp. aureus N315
ucauauguuuuauaauaaau

SEQ ID NO: 4068838 - RNA, 19 nt, Staphylococcus aureus subsp. aureus N315
ucauauucaaaauaacuua

SEQ ID NO: 4068839 - RNA, 19 nt, Staphylococcus aureus subsp. aureus N315
ucauauucaacuaguaaau

SEQ ID NO: 4068840 - RNA, 15 nt, Staphylococcus aureus subsp. aureus N315
ucauauucacaucuu

SEQ ID NO: 4068841 - RNA, 13 nt, Staphylococcus aureus subsp. aureus N315
ucauauugaauac

SEQ ID NO: 4068842 - RNA, 20 nt, Staphylococcus aureus subsp. aureus N315
ucauauuugaauacuuuauu

SEQ ID NO: 4068843 - RNA, 23 nt, Staphylococcus aureus subsp. aureus N315
ucaucaacacacacaguuuauaa

SEQ ID NO: 4068844 - RNA, 13 nt, Staphylococcus aureus subsp. aureus N315
ucaucaaugguga

SEQ ID NO: 4068845 - RNA, 20 nt, Staphylococcus aureus subsp. aureus N315
ucaucaccauacuaaaacau

SEQ ID NO: 4068846 - RNA, 19 nt, Staphylococcus aureus subsp. aureus N315
ucaucaccuuguuaaaaua

SEQ ID NO: 4068847 - RNA, 16 nt, Staphylococcus aureus subsp. aureus N315
ucaucacuuuuuaaac

SEQ ID NO: 4068848 - RNA, 19 nt, Staphylococcus aureus subsp. aureus N315
ucaucauaaucaagaauau

SEQ ID NO: 4068849 - RNA, 21 nt, Staphylococcus aureus subsp. aureus N315
ucaucaugacuauuuuccauc

SEQ ID NO: 4068850 - RNA, 14 nt, Staphylococcus aureus subsp. aureus N315
ucaucaugcauaau

SEQ ID NO: 4068851 - RNA, 15 nt, Staphylococcus aureus subsp. aureus N315
ucaucauuaaaucug

SEQ ID NO: 4068852 - RNA, 16 nt, Staphylococcus aureus subsp. aureus N315
ucaucauuaaaucuga

SEQ ID NO: 4068853 - RNA, 13 nt, Staphylococcus aureus subsp. aureus N315
ucaucauuacgaa

SEQ ID NO: 4068854 - RNA, 17 nt, Staphylococcus aureus subsp. aureus N315
ucaucauuaguuuuuaa

SEQ ID NO: 4068855 - RNA, 20 nt, Staphylococcus aureus subsp. aureus N315
ucaucauuaguuuuuaaaau

SEQ ID NO: 4068856 - RNA, 15 nt, Staphylococcus aureus subsp. aureus N315
ucaucauuuaaaauu

SEQ ID NO: 4068857 - RNA, 20 nt, Staphylococcus aureus subsp. aureus N315
ucaucauuuaaaauuugugc

SEQ ID NO: 4068858 - RNA, 16 nt, Staphylococcus aureus subsp. aureus N315
ucaucauuuaaauauu

SEQ ID NO: 4068859 - RNA, 13 nt, Staphylococcus aureus subsp. aureus N315
ucauccauaaaaa

SEQ ID NO: 4068860 - RNA, 15 nt, Staphylococcus aureus subsp. aureus N315
ucauccauaaaaaua

SEQ ID NO: 4068861 - RNA, 15 nt, Staphylococcus aureus subsp. aureus N315
ucauccgccaauuaa

SEQ ID NO: 4068862 - RNA, 17 nt, Staphylococcus aureus subsp. aureus N315
ucaucguccacgaaucu

SEQ ID NO: 4068863 - RNA, 17 nt, Staphylococcus aureus subsp. aureus N315
ucaucguucauauauuu

SEQ ID NO: 4068864 - RNA, 21 nt, Staphylococcus aureus subsp. aureus N315
ucaucguucauauauuuuguu

SEQ ID NO: 4068865 - RNA, 23 nt, Staphylococcus aureus subsp. aureus N315
ucaucuaacgacccaaauuauau

SEQ ID NO: 4068866 - RNA, 16 nt, Staphylococcus aureus subsp. aureus N315
ucaucuacuauuuaau

SEQ ID NO: 4068867 - RNA, 23 nt, Staphylococcus aureus subsp. aureus N315
ucaucuauuauuauguuauaaau

SEQ ID NO: 4068868 - RNA, 13 nt, Staphylococcus aureus subsp. aureus N315
ucaucuauucaac

SEQ ID NO: 4068869 - RNA, 18 nt, Staphylococcus aureus subsp. aureus N315
ucaucuauuuaauaaugu

SEQ ID NO: 4068870 - RNA, 23 nt, Staphylococcus aureus subsp. aureus N315
ucaucuauuuaauaauguaucau

SEQ ID NO: 4068871 - RNA, 18 nt, Staphylococcus aureus subsp. aureus N315
ucaucugauaauucgaaa

SEQ ID NO: 4068872 - RNA, 16 nt, Staphylococcus aureus subsp. aureus N315
ucaucugcuuguaaua

SEQ ID NO: 4068873 - RNA, 15 nt, Staphylococcus aureus subsp. aureus N315
ucaucugguauuuua

SEQ ID NO: 4068874 - RNA, 22 nt, Staphylococcus aureus subsp. aureus N315
ucauuuuauccaaaccaauuuu

SEQ ID NO: 4068875 - RNA, 14 nt, Staphylococcus aureus subsp. aureus N315
ucauuuucaaauaa

SEQ ID NO: 4068876 - RNA, 20 nt, Staphylococcus aureus subsp. aureus N315
ucauuuucaacauaauauuu

SEQ ID NO: 4068877 - RNA, 12 nt, Staphylococcus aureus subsp. aureus N315
ucauuuucaaua

SEQ ID NO: 4068878 - RNA, 14 nt, Staphylococcus aureus subsp. aureus N315
ucauuuucauugua

SEQ ID NO: 4068879 - RNA, 16 nt, Staphylococcus aureus subsp. aureus N315
ucauuuucauuguaug

SEQ ID NO: 4068880 - RNA, 19 nt, Staphylococcus aureus subsp. aureus N315
ucauuuucugcuuucgcuu

SEQ ID NO: 4068881 - RNA, 17 nt, Staphylococcus aureus subsp. aureus N315
ucauuuuuaauuuugac

SEQ ID NO: 4068882 - RNA, 22 nt, Staphylococcus aureus subsp. aureus N315
ucauuuuuaauuuugacauaaa

SEQ ID NO: 4068883 - RNA, 21 nt, Staphylococcus aureus subsp. aureus N315
ucauuuuuaucccacuccuua

SEQ ID NO: 4068884 - RNA, 13 nt, Staphylococcus aureus subsp. aureus N315
ucauuuuuucaau

SEQ ID NO: 4068885 - RNA, 22 nt, Staphylococcus aureus subsp. aureus N315
ucauuuuuucgagaugauauua

SEQ ID NO: 4068886 - RNA, 13 nt, Staphylococcus aureus subsp. aureus N315
uccaaaauccuga

SEQ ID NO: 4068887 - RNA, 19 nt, Staphylococcus aureus subsp. aureus N315
uccaaacacaaauaaaggc

SEQ ID NO: 4068888 - RNA, 15 nt, Staphylococcus aureus subsp. aureus N315
uccaaagaaacggaa

SEQ ID NO: 4068889 - RNA, 22 nt, Staphylococcus aureus subsp. aureus N315
uccaaaguaacaugugcaagua

SEQ ID NO: 4068890 - RNA, 16 nt, Staphylococcus aureus subsp. aureus N315
uccaaauauuaaaaac

SEQ ID NO: 4068891 - RNA, 23 nt, Staphylococcus aureus subsp. aureus N315
uccaaauguucagguucaaaauu

SEQ ID NO: 4068892 - RNA, 21 nt, Staphylococcus aureus subsp. aureus N315
uccaacacccauauaauuugg

SEQ ID NO: 4068893 - RNA, 18 nt, Staphylococcus aureus subsp. aureus N315
uccaacauguaacaaaau

SEQ ID NO: 4068894 - RNA, 19 nt, Staphylococcus aureus subsp. aureus N315
uccaagagaauuaauaauu

SEQ ID NO: 4068895 - RNA, 16 nt, Staphylococcus aureus subsp. aureus N315
uccaagauuaugacaa

SEQ ID NO: 4068896 - RNA, 22 nt, Staphylococcus aureus subsp. aureus N315
uccaagcgcuucaggcauaacu

SEQ ID NO: 4068897 - RNA, 19 nt, Staphylococcus aureus subsp. aureus N315
uccaaggauguuauaaaau

SEQ ID NO: 4068898 - RNA, 22 nt, Staphylococcus aureus subsp. aureus N315
uccaaggauguuauaaaaugaa

SEQ ID NO: 4068899 - RNA, 15 nt, Staphylococcus aureus subsp. aureus N315
uccaagugacaacau

SEQ ID NO: 4068900 - RNA, 13 nt, Staphylococcus aureus subsp. aureus N315
uccaauaaauugu

SEQ ID NO: 4068901 - RNA, 23 nt, Staphylococcus aureus subsp. aureus N315
uccaauacuuuuuauauaauucg

SEQ ID NO: 4068902 - RNA, 18 nt, Staphylococcus aureus subsp. aureus N315
uccaaucaacuucauaua

SEQ ID NO: 4068903 - RNA, 22 nt, Staphylococcus aureus subsp. aureus N315
uccaaucaacuucauauaaugc

SEQ ID NO: 4068904 - RNA, 16 nt, Staphylococcus aureus subsp. aureus N315
uccaaucaucauuaaa

SEQ ID NO: 4068905 - RNA, 20 nt, Staphylococcus aureus subsp. aureus N315
uccaaucaucauuaaaucug

SEQ ID NO: 4068906 - RNA, 22 nt, Staphylococcus aureus subsp. aureus N315
uccaaucaucauuaaaucugau

SEQ ID NO: 4068907 - RNA, 17 nt, Staphylococcus aureus subsp. aureus N315
uccaaucuuuuuaauug

SEQ ID NO: 4068908 - RNA, 15 nt, Staphylococcus aureus subsp. aureus N315
uccaauguauaaaac

SEQ ID NO: 4068909 - RNA, 18 nt, Staphylococcus aureus subsp. aureus N315
uccaauuaccaaugaaua

SEQ ID NO: 4068910 - RNA, 23 nt, Staphylococcus aureus subsp. aureus N315
uccaauucauuuuauaaaucaaa

SEQ ID NO: 4068911 - RNA, 12 nt, Staphylococcus aureus subsp. aureus N315
uccaauuccaau

SEQ ID NO: 4068912 - RNA, 12 nt, Staphylococcus aureus subsp. aureus N315
uccaauuuaaaa

SEQ ID NO: 4068913 - RNA, 11 nt, Staphylococcus aureus subsp. aureus N315
uccaauuucuc

SEQ ID NO: 4068914 - RNA, 15 nt, Staphylococcus aureus subsp. aureus N315
uccaauuuuauugag

SEQ ID NO: 4068915 - RNA, 13 nt, Staphylococcus aureus subsp. aureus N315
uccacacauuaag

SEQ ID NO: 4068916 - RNA, 13 nt, Staphylococcus aureus subsp. aureus N315
uccacagaauuag

SEQ ID NO: 4068917 - RNA, 22 nt, Staphylococcus aureus subsp. aureus N315
uccaccugauaacgagcuaaua

SEQ ID NO: 4068918 - RNA, 15 nt, Staphylococcus aureus subsp. aureus N315
uccacuucaucuaaa

SEQ ID NO: 4068919 - RNA, 19 nt, Staphylococcus aureus subsp. aureus N315
uccacuuuuugccuggcaa

SEQ ID NO: 4068920 - RNA, 15 nt, Staphylococcus aureus subsp. aureus N315
uccagacuccuaaau

SEQ ID NO: 4068921 - RNA, 18 nt, Staphylococcus aureus subsp. aureus N315
uccagacuccuaaauuau

SEQ ID NO: 4068922 - RNA, 18 nt, Staphylococcus aureus subsp. aureus N315
uccaggcaacaacuuuuc

SEQ ID NO: 4068923 - RNA, 15 nt, Staphylococcus aureus subsp. aureus N315
uccagucauuuguug

SEQ ID NO: 4068924 - RNA, 22 nt, Staphylococcus aureus subsp. aureus N315
uccaguggaaaugauaauuuaa

SEQ ID NO: 4068925 - RNA, 16 nt, Staphylococcus aureus subsp. aureus N315
uccauaaauaaaaugc

SEQ ID NO: 4068926 - RNA, 18 nt, Staphylococcus aureus subsp. aureus N315
uccauaaauaaaaugcua

SEQ ID NO: 4068927 - RNA, 17 nt, Staphylococcus aureus subsp. aureus N315
uccauaaauauuaaauu

SEQ ID NO: 4068928 - RNA, 18 nt, Staphylococcus aureus subsp. aureus N315
uccauaacuguaguuucu

SEQ ID NO: 4068929 - RNA, 20 nt, Staphylococcus aureus subsp. aureus N315
uccauaacuguaguuucuua

SEQ ID NO: 4068930 - RNA, 22 nt, Staphylococcus aureus subsp. aureus N315
uccauaacuguaguuucuuaau

SEQ ID NO: 4068931 - RNA, 18 nt, Staphylococcus aureus subsp. aureus N315
uccauaagucacauuuau

SEQ ID NO: 4068932 - RNA, 21 nt, Staphylococcus aureus subsp. aureus N315
uccauaaucuuuauuaauaaa

SEQ ID NO: 4068933 - RNA, 22 nt, Staphylococcus aureus subsp. aureus N315
uccauacaaaucguaaacauaa

SEQ ID NO: 4068934 - RNA, 20 nt, Staphylococcus aureus subsp. aureus N315
uccauacgaucuuuuucaau

SEQ ID NO: 4068935 - RNA, 17 nt, Staphylococcus aureus subsp. aureus N315
uccauacguaucaaaau

SEQ ID NO: 4068936 - RNA, 15 nt, Staphylococcus aureus subsp. aureus N315
uccauaggauucuua

SEQ ID NO: 4068937 - RNA, 17 nt, Staphylococcus aureus subsp. aureus N315
uccauauaaccuauuuc

SEQ ID NO: 4068938 - RNA, 22 nt, Staphylococcus aureus subsp. aureus N315
uccaucgucaucacuuuuuaaa

SEQ ID NO: 4068939 - RNA, 21 nt, Staphylococcus aureus subsp. aureus N315
uccaugaguuuacuaaacuuu

SEQ ID NO: 4068940 - RNA, 14 nt, Staphylococcus aureus subsp. aureus N315
uccauuaaucauuu

SEQ ID NO: 4068941 - RNA, 11 nt, Staphylococcus aureus subsp. aureus N315
uccauuauugg

SEQ ID NO: 4068942 - RNA, 20 nt, Staphylococcus aureus subsp. aureus N315
uccauucaaaguauauacua

SEQ ID NO: 4068943 - RNA, 15 nt, Staphylococcus aureus subsp. aureus N315
uccauuuaucaacaa

SEQ ID NO: 4068944 - RNA, 13 nt, Staphylococcus aureus subsp. aureus N315
uccauuuuaugca

SEQ ID NO: 4068945 - RNA, 19 nt, Staphylococcus aureus subsp. aureus N315
uccauuuucuuuuuuuaug

SEQ ID NO: 4068946 - RNA, 14 nt, Staphylococcus aureus subsp. aureus N315
ucccaacuuaauaa

SEQ ID NO: 4068947 - RNA, 21 nt, Staphylococcus aureus subsp. aureus N315
ucccaaugcugaauaaauaac

SEQ ID NO: 4068948 - RNA, 15 nt, Staphylococcus aureus subsp. aureus N315
ucccacgugccucau

SEQ ID NO: 4068949 - RNA, 21 nt, Staphylococcus aureus subsp. aureus N315
ucccagauucauaucuuucaa

SEQ ID NO: 4068950 - RNA, 17 nt, Staphylococcus aureus subsp. aureus N315
ucccauaacaaaaacau

SEQ ID NO: 4068951 - RNA, 20 nt, Staphylococcus aureus subsp. aureus N315
ucccauaaugacuauaacac

SEQ ID NO: 4068952 - RNA, 21 nt, Staphylococcus aureus subsp. aureus N315
ucccauuaacacgaacugcau

SEQ ID NO: 4068953 - RNA, 23 nt, Staphylococcus aureus subsp. aureus N315
ucccauuaacacgaacugcauag

SEQ ID NO: 4068954 - RNA, 17 nt, Staphylococcus aureus subsp. aureus N315
ucccauucuuugaggug

SEQ ID NO: 4068955 - RNA, 17 nt, Staphylococcus aureus subsp. aureus N315
ucccauuggcauuuacg

SEQ ID NO: 4068956 - RNA, 14 nt, Staphylococcus aureus subsp. aureus N315
ucccauuuuuaaaa

SEQ ID NO: 4068957 - RNA, 19 nt, Staphylococcus aureus subsp. aureus N315
uccccauuaauuaacaaag

SEQ ID NO: 4068958 - RNA, 16 nt, Staphylococcus aureus subsp. aureus N315
uccccauuuauguguu

SEQ ID NO: 4068959 - RNA, 21 nt, Staphylococcus aureus subsp. aureus N315
ucccgaaaguuagacuaaaaa

SEQ ID NO: 4068960 - RNA, 18 nt, Staphylococcus aureus subsp. aureus N315
ucccgcauuauuauuaaa

SEQ ID NO: 4068961 - RNA, 18 nt, Staphylococcus aureus subsp. aureus N315
ucgacuucagauacauua

SEQ ID NO: 4068962 - RNA, 15 nt, Staphylococcus aureus subsp. aureus N315
ucgagaggguacacu

SEQ ID NO: 4068963 - RNA, 17 nt, Staphylococcus aureus subsp. aureus N315
ucgaguagcccuauuuu

SEQ ID NO: 4068964 - RNA, 14 nt, Staphylococcus aureus subsp. aureus N315
ucgaguuuguuucu

SEQ ID NO: 4068965 - RNA, 23 nt, Staphylococcus aureus subsp. aureus N315
ucgauaacguugccauacccaua

SEQ ID NO: 4068966 - RNA, 13 nt, Staphylococcus aureus subsp. aureus N315
ucgauaaguuuuu

SEQ ID NO: 4068967 - RNA, 23 nt, Staphylococcus aureus subsp. aureus N315
ucgauaaguuuuugaauaucuaa

SEQ ID NO: 4068968 - RNA, 14 nt, Staphylococcus aureus subsp. aureus N315
ucgauaauauaacu

SEQ ID NO: 4068969 - RNA, 21 nt, Staphylococcus aureus subsp. aureus N315
ucgauauagcauaaaauuucu

SEQ ID NO: 4068970 - RNA, 15 nt, Staphylococcus aureus subsp. aureus N315
ucgauaugaauaacc

SEQ ID NO: 4068971 - RNA, 16 nt, Staphylococcus aureus subsp. aureus N315
ucgauaugaccauagu

SEQ ID NO: 4068972 - RNA, 20 nt, Staphylococcus aureus subsp. aureus N315
ucgauauuucuaguugcaau

SEQ ID NO: 4068973 - RNA, 15 nt, Staphylococcus aureus subsp. aureus N315
ucgauauuuguuucg

SEQ ID NO: 4068974 - RNA, 17 nt, Staphylococcus aureus subsp. aureus N315
ucgauauuuguuucgua

SEQ ID NO: 4068975 - RNA, 21 nt, Staphylococcus aureus subsp. aureus N315
ucgaucgguauuuucauuuua

SEQ ID NO: 4068976 - RNA, 16 nt, Staphylococcus aureus subsp. aureus N315
ucgaugacuuugucuu

SEQ ID NO: 4068977 - RNA, 17 nt, Staphylococcus aureus subsp. aureus N315
ucgaugacuuugucuuu

SEQ ID NO: 4068978 - RNA, 16 nt, Staphylococcus aureus subsp. aureus N315
ucgaugacuuuuuaau

SEQ ID NO: 4068979 - RNA, 15 nt, Staphylococcus aureus subsp. aureus N315
ucgauuaauuuaauu

SEQ ID NO: 4068980 - RNA, 15 nt, Staphylococcus aureus subsp. aureus N315
ucgauuaauuuucuu

SEQ ID NO: 4068981 - RNA, 18 nt, Staphylococcus aureus subsp. aureus N315
ucgauucauaaaauuuaa

SEQ ID NO: 4068982 - RNA, 16 nt, Staphylococcus aureus subsp. aureus N315
ucgauugcguuuucua

SEQ ID NO: 4068983 - RNA, 22 nt, Staphylococcus aureus subsp. aureus N315
ucgauuuagaagaacaauaauu

SEQ ID NO: 4068984 - RNA, 15 nt, Staphylococcus aureus subsp. aureus N315
ucgauuuaucauuau

SEQ ID NO: 4068985 - RNA, 18 nt, Staphylococcus aureus subsp. aureus N315
ucgcaaauacauaaucau

SEQ ID NO: 4068986 - RNA, 22 nt, Staphylococcus aureus subsp. aureus N315
ucgcacaacugcauaaaagccu

SEQ ID NO: 4068987 - RNA, 21 nt, Staphylococcus aureus subsp. aureus N315
ucgcaccgucaaacuuaaaac

SEQ ID NO: 4068988 - RNA, 16 nt, Staphylococcus aureus subsp. aureus N315
ucgcauacuuuuucag

SEQ ID NO: 4068989 - RNA, 14 nt, Staphylococcus aureus subsp. aureus N315
ucgcauauuuugau

SEQ ID NO: 4068990 - RNA, 21 nt, Staphylococcus aureus subsp. aureus N315
ucgcaucguucccugcagcaa

SEQ ID NO: 4068991 - RNA, 17 nt, Staphylococcus aureus subsp. aureus N315
ucgcaucuccaaaggcc

SEQ ID NO: 4068992 - RNA, 22 nt, Staphylococcus aureus subsp. aureus N315
ucgcaucuguuaacugaauuuc

SEQ ID NO: 4068993 - RNA, 20 nt, Staphylococcus aureus subsp. aureus N315
ucgccauuguccaacugcuu

SEQ ID NO: 4068994 - RNA, 14 nt, Staphylococcus aureus subsp. aureus N315
ucgccuacuauaaa

SEQ ID NO: 4068995 - RNA, 16 nt, Staphylococcus aureus subsp. aureus N315
ucgcucacaugugaaa

SEQ ID NO: 4068996 - RNA, 21 nt, Staphylococcus aureus subsp. aureus N315
ucgcucacaugugaaauaauc

SEQ ID NO: 4068997 - RNA, 17 nt, Staphylococcus aureus subsp. aureus N315
ucgcucauccucauuaa

SEQ ID NO: 4068998 - RNA, 14 nt, Staphylococcus aureus subsp. aureus N315
ucgcucuagacauu

SEQ ID NO: 4068999 - RNA, 21 nt, Staphylococcus aureus subsp. aureus N315
ucgcuugcaaagacucaauuu

SEQ ID NO: 4069000 - RNA, 23 nt, Staphylococcus aureus subsp. aureus N315
ucgcuugcuucuuuccucuccuu

SEQ ID NO: 4069001 - RNA, 18 nt, Staphylococcus aureus subsp. aureus N315
ucgcuuuuuuuauuuuuc

SEQ ID NO: 4069002 - RNA, 17 nt, Staphylococcus aureus subsp. aureus N315
ucggaaaaagaugaaaa

SEQ ID NO: 4069003 - RNA, 18 nt, Staphylococcus aureus subsp. aureus N315
ucggaaaaagaugaaaaa

SEQ ID NO: 4069004 - RNA, 19 nt, Staphylococcus aureus subsp. aureus N315
ucggaaaaagaugaaaaag

SEQ ID NO: 4069005 - RNA, 10 nt, Staphylococcus aureus subsp. aureus N315
ucggaaacau

SEQ ID NO: 4069006 - RNA, 14 nt, Staphylococcus aureus subsp. aureus N315
ucggaauaaaauaa

SEQ ID NO: 4069007 - RNA, 13 nt, Staphylococcus aureus subsp. aureus N315
ucggacgauugaa

SEQ ID NO: 4069008 - RNA, 16 nt, Staphylococcus aureus subsp. aureus N315
ucggauuaaaaguauc

SEQ ID NO: 4069009 - RNA, 17 nt, Staphylococcus aureus subsp. aureus N315
ucggauuauauuuagau

SEQ ID NO: 4069010 - RNA, 16 nt, Staphylococcus aureus subsp. aureus N315
ucggauuaucuguaau

SEQ ID NO: 4069011 - RNA, 13 nt, Staphylococcus aureus subsp. aureus N315
ucggcuuucuaag

SEQ ID NO: 4069012 - RNA, 17 nt, Staphylococcus aureus subsp. aureus N315
ucgguauuuaauguuuu

SEQ ID NO: 4069013 - RNA, 13 nt, Staphylococcus aureus subsp. aureus N315
ucgguauuuuaaa

SEQ ID NO: 4069014 - RNA, 18 nt, Staphylococcus aureus subsp. aureus N315
ucgguucaucuaaaauga

SEQ ID NO: 4069015 - RNA, 22 nt, Staphylococcus aureus subsp. aureus N315
ucgguuuuauuuuuaucaucau

SEQ ID NO: 4069016 - RNA, 23 nt, Staphylococcus aureus subsp. aureus N315
ucgguuuuauuuuuaucaucaug

SEQ ID NO: 4069017 - RNA, 15 nt, Staphylococcus aureus subsp. aureus N315
ucguaacauuuaaaa

SEQ ID NO: 4069018 - RNA, 16 nt, Staphylococcus aureus subsp. aureus N315
ucguaacauuuaaaaa

SEQ ID NO: 4069019 - RNA, 17 nt, Staphylococcus aureus subsp. aureus N315
ucguaacauuuaaaaaa

SEQ ID NO: 4069020 - RNA, 22 nt, Staphylococcus aureus subsp. aureus N315
ucguaagcuucuguguuggggc

SEQ ID NO: 4069021 - RNA, 14 nt, Staphylococcus aureus subsp. aureus N315
ucguaaugaugaca

SEQ ID NO: 4069022 - RNA, 22 nt, Staphylococcus aureus subsp. aureus N315
ucguaaugaugacaucaauauc

SEQ ID NO: 4069023 - RNA, 13 nt, Staphylococcus aureus subsp. aureus N315
ucguacuuucaaa

SEQ ID NO: 4069024 - RNA, 22 nt, Staphylococcus aureus subsp. aureus N315
ucguagcaugacauuaaggcuu

SEQ ID NO: 4069025 - RNA, 19 nt, Staphylococcus aureus subsp. aureus N315
ucguaggaugcuuccuuuu

SEQ ID NO: 4069026 - RNA, 15 nt, Staphylococcus aureus subsp. aureus N315
ucguaguuguccauu

SEQ ID NO: 4069027 - RNA, 14 nt, Staphylococcus aureus subsp. aureus N315
ucguauaagaauca

SEQ ID NO: 4069028 - RNA, 18 nt, Staphylococcus aureus subsp. aureus N315
ucguauaauuuuaauauu

SEQ ID NO: 4069029 - RNA, 18 nt, Staphylococcus aureus subsp. aureus N315
ucguauagauuaaaaaau

SEQ ID NO: 4069030 - RNA, 19 nt, Staphylococcus aureus subsp. aureus N315
ucguauaguacuaaaagua

SEQ ID NO: 4069031 - RNA, 16 nt, Staphylococcus aureus subsp. aureus N315
ucguauucaaaguuuu

SEQ ID NO: 4069032 - RNA, 15 nt, Staphylococcus aureus subsp. aureus N315
ucguauucuuuuaau

SEQ ID NO: 4069033 - RNA, 13 nt, Staphylococcus aureus subsp. aureus N315
ucguauuucauau

SEQ ID NO: 4069034 - RNA, 13 nt, Staphylococcus aureus subsp. aureus N315
ucgucaaaaacag

SEQ ID NO: 4069035 - RNA, 13 nt, Staphylococcus aureus subsp. aureus N315
ucgucaaauucaa

SEQ ID NO: 4069036 - RNA, 19 nt, Staphylococcus aureus subsp. aureus N315
ucgucaauuuuaaugagua

SEQ ID NO: 4069037 - RNA, 15 nt, Staphylococcus aureus subsp. aureus N315
ucgucacguaaaaua

SEQ ID NO: 4069038 - RNA, 14 nt, Staphylococcus aureus subsp. aureus N315
ucgucuacuauuuu

SEQ ID NO: 4069039 - RNA, 23 nt, Staphylococcus aureus subsp. aureus N315
ucgucuucuuuuuguccccagcc

SEQ ID NO: 4069040 - RNA, 22 nt, Staphylococcus aureus subsp. aureus N315
ucgucuuuaucaacauaaaauu

SEQ ID NO: 4069041 - RNA, 19 nt, Staphylococcus aureus subsp. aureus N315
ucgugaaaagcaguuaaug

SEQ ID NO: 4069042 - RNA, 12 nt, Staphylococcus aureus subsp. aureus N315
ucgugagccccu

SEQ ID NO: 4069043 - RNA, 17 nt, Staphylococcus aureus subsp. aureus N315
ucguguuugaauguuuu

SEQ ID NO: 4069044 - RNA, 18 nt, Staphylococcus aureus subsp. aureus N315
ucguuaaaacacccugcu

SEQ ID NO: 4069045 - RNA, 16 nt, Staphylococcus aureus subsp. aureus N315
ucguuaaggaaagcuu

SEQ ID NO: 4069046 - RNA, 14 nt, Staphylococcus aureus subsp. aureus N315
ucguuaauuuccaa

SEQ ID NO: 4069047 - RNA, 20 nt, Staphylococcus aureus subsp. aureus N315
ucguuagaugaaugccuaau

SEQ ID NO: 4069048 - RNA, 22 nt, Staphylococcus aureus subsp. aureus N315
ucguuauaaguacaaauaauac

SEQ ID NO: 4069049 - RNA, 18 nt, Staphylococcus aureus subsp. aureus N315
ucuaguaccucuuuauuu

SEQ ID NO: 4069050 - RNA, 20 nt, Staphylococcus aureus subsp. aureus N315
ucuaguagcuagaacagaua

SEQ ID NO: 4069051 - RNA, 22 nt, Staphylococcus aureus subsp. aureus N315
ucuagugcuuugucuuggaugu

SEQ ID NO: 4069052 - RNA, 19 nt, Staphylococcus aureus subsp. aureus N315
ucuaguucgaacacacacu

SEQ ID NO: 4069053 - RNA, 13 nt, Staphylococcus aureus subsp. aureus N315
ucuauaaaaagaa

SEQ ID NO: 4069054 - RNA, 14 nt, Staphylococcus aureus subsp. aureus N315
ucuauaaagaauga

SEQ ID NO: 4069055 - RNA, 13 nt, Staphylococcus aureus subsp. aureus N315
ucuauaaauacuu

SEQ ID NO: 4069056 - RNA, 18 nt, Staphylococcus aureus subsp. aureus N315
ucuauaaauagaauuuuu

SEQ ID NO: 4069057 - RNA, 12 nt, Staphylococcus aureus subsp. aureus N315
ucuauaaauauc

SEQ ID NO: 4069058 - RNA, 18 nt, Staphylococcus aureus subsp. aureus N315
ucuauaacaaaaucucaa

SEQ ID NO: 4069059 - RNA, 14 nt, Staphylococcus aureus subsp. aureus N315
ucuauaauuuuaau

SEQ ID NO: 4069060 - RNA, 14 nt, Staphylococcus aureus subsp. aureus N315
ucuauacaacagua

SEQ ID NO: 4069061 - RNA, 15 nt, Staphylococcus aureus subsp. aureus N315
ucuauacaacaguaa

SEQ ID NO: 4069062 - RNA, 23 nt, Staphylococcus aureus subsp. aureus N315
ucuauacauuccaaaguaccauc

SEQ ID NO: 4069063 - RNA, 19 nt, Staphylococcus aureus subsp. aureus N315
ucuauacuuuuaauuguau

SEQ ID NO: 4069064 - RNA, 17 nt, Staphylococcus aureus subsp. aureus N315
ucuauagaauuuuucau

SEQ ID NO: 4069065 - RNA, 20 nt, Staphylococcus aureus subsp. aureus N315
ucuauagaauuuuucauaua

SEQ ID NO: 4069066 - RNA, 14 nt, Staphylococcus aureus subsp. aureus N315
ucuauagguuuaua

SEQ ID NO: 4069067 - RNA, 17 nt, Staphylococcus aureus subsp. aureus N315
ucuauagguuuauaaaa

SEQ ID NO: 4069068 - RNA, 18 nt, Staphylococcus aureus subsp. aureus N315
ucuauagguuuauaaaaa

SEQ ID NO: 4069069 - RNA, 16 nt, Staphylococcus aureus subsp. aureus N315
ucuauauaaaaacugu

SEQ ID NO: 4069070 - RNA, 22 nt, Staphylococcus aureus subsp. aureus N315
ucuauauaaaaacuguucauac

SEQ ID NO: 4069071 - RNA, 16 nt, Staphylococcus aureus subsp. aureus N315
ucuauauaaaguugac

SEQ ID NO: 4069072 - RNA, 19 nt, Staphylococcus aureus subsp. aureus N315
ucuauauaaauguuuauau

SEQ ID NO: 4069073 - RNA, 19 nt, Staphylococcus aureus subsp. aureus N315
ucuauauaguaaaauaaau

SEQ ID NO: 4069074 - RNA, 15 nt, Staphylococcus aureus subsp. aureus N315
ucuauaucuauuuau

SEQ ID NO: 4069075 - RNA, 16 nt, Staphylococcus aureus subsp. aureus N315
ucuauauuaauagaaa

SEQ ID NO: 4069076 - RNA, 18 nt, Staphylococcus aureus subsp. aureus N315
ucuauauuuaauuuugau

SEQ ID NO: 4069077 - RNA, 19 nt, Staphylococcus aureus subsp. aureus N315
ucuaucaguaugaaguugc

SEQ ID NO: 4069078 - RNA, 13 nt, Staphylococcus aureus subsp. aureus N315
ucuauccuucaaa

SEQ ID NO: 4069079 - RNA, 14 nt, Staphylococcus aureus subsp. aureus N315
ucuauccuucaaaa

SEQ ID NO: 4069080 - RNA, 14 nt, Staphylococcus aureus subsp. aureus N315
ucuaucgccuaaaa

SEQ ID NO: 4069081 - RNA, 16 nt, Staphylococcus aureus subsp. aureus N315
ucuaucgccuaaaaau

SEQ ID NO: 4069082 - RNA, 17 nt, Staphylococcus aureus subsp. aureus N315
ucuaucgguaauuuuug

SEQ ID NO: 4069083 - RNA, 21 nt, Staphylococcus aureus subsp. aureus N315
ucuaucguuguguauuguuug

SEQ ID NO: 4069084 - RNA, 21 nt, Staphylococcus aureus subsp. aureus N315
ucuaucuccgcuacaauuaua

SEQ ID NO: 4069085 - RNA, 14 nt, Staphylococcus aureus subsp. aureus N315
ucuaugaaauuuuu

SEQ ID NO: 4069086 - RNA, 13 nt, Staphylococcus aureus subsp. aureus N315
ucuaugauuguau

SEQ ID NO: 4069087 - RNA, 16 nt, Staphylococcus aureus subsp. aureus N315
ucuauggaaaauguua

SEQ ID NO: 4069088 - RNA, 16 nt, Staphylococcus aureus subsp. aureus N315
ucuaugucaaauugaa

SEQ ID NO: 4069089 - RNA, 13 nt, Staphylococcus aureus subsp. aureus N315
ucuauuaauaauu

SEQ ID NO: 4069090 - RNA, 23 nt, Staphylococcus aureus subsp. aureus N315
ucuauuaaugcucuauauaucca

SEQ ID NO: 4069091 - RNA, 13 nt, Staphylococcus aureus subsp. aureus N315
ucuauuauuagag

SEQ ID NO: 4069092 - RNA, 16 nt, Staphylococcus aureus subsp. aureus N315
ucuauuccuucuaaca

SEQ ID NO: 4069093 - RNA, 17 nt, Staphylococcus aureus subsp. aureus N315
ucuauuccuucuaacau

SEQ ID NO: 4069094 - RNA, 13 nt, Staphylococcus aureus subsp. aureus N315
ucuauuuaauaau

SEQ ID NO: 4069095 - RNA, 13 nt, Staphylococcus aureus subsp. aureus N315
ucuauuuuauaaa

SEQ ID NO: 4069096 - RNA, 16 nt, Staphylococcus aureus subsp. aureus N315
ucuauuuuauaaaaua

SEQ ID NO: 4069097 - RNA, 17 nt, Staphylococcus aureus subsp. aureus N315
ucuauuuuauaaaauau

SEQ ID NO: 4069098 - RNA, 17 nt, Staphylococcus aureus subsp. aureus N315
ucuauuuuauaauaaau

SEQ ID NO: 4069099 - RNA, 19 nt, Staphylococcus aureus subsp. aureus N315
ucuauuuuauaauaaauuu

SEQ ID NO: 4069100 - RNA, 20 nt, Staphylococcus aureus subsp. aureus N315
ucuauuuuaugauuugauuu

SEQ ID NO: 4069101 - RNA, 20 nt, Staphylococcus aureus subsp. aureus N315
ucuauuuuugauuuaauaau

SEQ ID NO: 4069102 - RNA, 18 nt, Staphylococcus aureus subsp. aureus N315
ucucaaauuaaaucaccu

SEQ ID NO: 4069103 - RNA, 14 nt, Staphylococcus aureus subsp. aureus N315
ucucaacgauaaga

SEQ ID NO: 4069104 - RNA, 23 nt, Staphylococcus aureus subsp. aureus N315
ucucaccagcucguuuuuucauu

SEQ ID NO: 4069105 - RNA, 16 nt, Staphylococcus aureus subsp. aureus N315
ucucacuuaauaaaua

SEQ ID NO: 4069106 - RNA, 17 nt, Staphylococcus aureus subsp. aureus N315
ucucauagucaucuuag

SEQ ID NO: 4069107 - RNA, 19 nt, Staphylococcus aureus subsp. aureus N315
ucucauaucuauuuuucga

SEQ ID NO: 4069108 - RNA, 19 nt, Staphylococcus aureus subsp. aureus N315
ucucaucuacuauuuaauc

SEQ ID NO: 4069109 - RNA, 20 nt, Staphylococcus aureus subsp. aureus N315
ucucaucuauuuaauaaugu

SEQ ID NO: 4069110 - RNA, 21 nt, Staphylococcus aureus subsp. aureus N315
ucucauuauaaugauuuuuau

SEQ ID NO: 4069111 - RNA, 16 nt, Staphylococcus aureus subsp. aureus N315
ucuccaccauuaauag

SEQ ID NO: 4069112 - RNA, 14 nt, Staphylococcus aureus subsp. aureus N315
ucuccaguuuucaa

SEQ ID NO: 4069113 - RNA, 13 nt, Staphylococcus aureus subsp. aureus N315
ucuccauauuugu

SEQ ID NO: 4069114 - RNA, 19 nt, Staphylococcus aureus subsp. aureus N315
ucuccauuagaacuaagau

SEQ ID NO: 4069115 - RNA, 22 nt, Staphylococcus aureus subsp. aureus N315
ucucccuuaaauacaauuucuu

SEQ ID NO: 4069116 - RNA, 13 nt, Staphylococcus aureus subsp. aureus N315
ucucccuuuuauc

SEQ ID NO: 4069117 - RNA, 15 nt, Staphylococcus aureus subsp. aureus N315
ucucccuuuuaucuu

SEQ ID NO: 4069118 - RNA, 20 nt, Staphylococcus aureus subsp. aureus N315
ucuccuugcucaugagcaca

SEQ ID NO: 4069119 - RNA, 13 nt, Staphylococcus aureus subsp. aureus N315
ucuccuuuuuuaa

SEQ ID NO: 4069120 - RNA, 19 nt, Staphylococcus aureus subsp. aureus N315
ucucgcauacugucaucuu

SEQ ID NO: 4069121 - RNA, 23 nt, Staphylococcus aureus subsp. aureus N315
ucucgcauacugucaucuuucaa

SEQ ID NO: 4069122 - RNA, 15 nt, Staphylococcus aureus subsp. aureus N315
ucucgcuuacucauu

SEQ ID NO: 4069123 - RNA, 14 nt, Staphylococcus aureus subsp. aureus N315
ucucguaauaaugu

SEQ ID NO: 4069124 - RNA, 14 nt, Staphylococcus aureus subsp. aureus N315
ucucgucuuucguc

SEQ ID NO: 4069125 - RNA, 16 nt, Staphylococcus aureus subsp. aureus N315
ucucgugaaaauaaua

SEQ ID NO: 4069126 - RNA, 15 nt, Staphylococcus aureus subsp. aureus N315
ucucguguauacaac

SEQ ID NO: 4069127 - RNA, 17 nt, Staphylococcus aureus subsp. aureus N315
ucucguugcacaacagu

SEQ ID NO: 4069128 - RNA, 14 nt, Staphylococcus aureus subsp. aureus N315
ucucuaaauaauuu

SEQ ID NO: 4069129 - RNA, 13 nt, Staphylococcus aureus subsp. aureus N315
ucucuaauuucac

SEQ ID NO: 4069130 - RNA, 13 nt, Staphylococcus aureus subsp. aureus N315
ucucuacuaauau

SEQ ID NO: 4069131 - RNA, 14 nt, Staphylococcus aureus subsp. aureus N315
ucucuacuaauauu

SEQ ID NO: 4069132 - RNA, 16 nt, Staphylococcus aureus subsp. aureus N315
ucucuacuaauauucu

SEQ ID NO: 4069133 - RNA, 22 nt, Staphylococcus aureus subsp. aureus N315
ucucuaucaguccgcuuuuuca

SEQ ID NO: 4069134 - RNA, 17 nt, Staphylococcus aureus subsp. aureus N315
ucucugaaaaacuucuu

SEQ ID NO: 4069135 - RNA, 15 nt, Staphylococcus aureus subsp. aureus N315
ucucuguagauauca

SEQ ID NO: 4069136 - RNA, 19 nt, Staphylococcus aureus subsp. aureus N315
ucucuuaaauaugaauaau

SEQ ID NO: 4069137 - RNA, 16 nt, Staphylococcus aureus subsp. aureus N315
ucuucaacaauuucaa

SEQ ID NO: 4069138 - RNA, 20 nt, Staphylococcus aureus subsp. aureus N315
ucuucaacauaacucaaaua

SEQ ID NO: 4069139 - RNA, 18 nt, Staphylococcus aureus subsp. aureus N315
ucuucaacuucgauauga

SEQ ID NO: 4069140 - RNA, 13 nt, Staphylococcus aureus subsp. aureus N315
ucuucaauauuua

SEQ ID NO: 4069141 - RNA, 18 nt, Staphylococcus aureus subsp. aureus N315
ucuucaaucuaccaauac

SEQ ID NO: 4069142 - RNA, 22 nt, Staphylococcus aureus subsp. aureus N315
ucuucaauucuuacaccugcaa

SEQ ID NO: 4069143 - RNA, 18 nt, Staphylococcus aureus subsp. aureus N315
ucuucaauuucauuuuug

SEQ ID NO: 4069144 - RNA, 9 nt, Staphylococcus aureus subsp. aureus N315
ucuucacca

SEQ ID NO: 4069145 - RNA, 14 nt, Staphylococcus aureus subsp. aureus N315
ucuucagaaccuug

SEQ ID NO: 4069146 - RNA, 17 nt, Staphylococcus aureus subsp. aureus N315
ucuucagguguuuuacc

SEQ ID NO: 4069147 - RNA, 13 nt, Staphylococcus aureus subsp. aureus N315
ucuucaguuauuu

SEQ ID NO: 4069148 - RNA, 13 nt, Staphylococcus aureus subsp. aureus N315
ucuucaucaugac

SEQ ID NO: 4069149 - RNA, 12 nt, Staphylococcus aureus subsp. aureus N315
ucuucaucuucu

SEQ ID NO: 4069150 - RNA, 16 nt, Staphylococcus aureus subsp. aureus N315
ucuucaucuucuucaa

SEQ ID NO: 4069151 - RNA, 14 nt, Staphylococcus aureus subsp. aureus N315
ucuucauuuaaaag

SEQ ID NO: 4069152 - RNA, 14 nt, Staphylococcus aureus subsp. aureus N315
ucuucauuuucauu

SEQ ID NO: 4069153 - RNA, 21 nt, Staphylococcus aureus subsp. aureus N315
ucuucggcuuuguaaaauugu

SEQ ID NO: 4069154 - RNA, 13 nt, Staphylococcus aureus subsp. aureus N315
ucuucgucaaauu

SEQ ID NO: 4069155 - RNA, 13 nt, Staphylococcus aureus subsp. aureus N315
ucuucuaauucug

SEQ ID NO: 4069156 - RNA, 17 nt, Staphylococcus aureus subsp. aureus N315
ucuucuaauucugaaau

SEQ ID NO: 4069157 - RNA, 14 nt, Staphylococcus aureus subsp. aureus N315
ucuucuaucuuuuc

SEQ ID NO: 4069158 - RNA, 20 nt, Staphylococcus aureus subsp. aureus N315
ucuucuauuaaacauuuuug

SEQ ID NO: 4069159 - RNA, 23 nt, Staphylococcus aureus subsp. aureus N315
ucuucucaacaaaucuauaaaua

SEQ ID NO: 4069160 - RNA, 15 nt, Staphylococcus aureus subsp. aureus N315
ucuucucauaaaaua

SEQ ID NO: 4069161 - RNA, 16 nt, Staphylococcus aureus subsp. aureus N315
ucuucugcuaacucug

SEQ ID NO: 4069162 - RNA, 19 nt, Staphylococcus aureus subsp. aureus N315
ucuucuugauuguaaauaa

SEQ ID NO: 4069163 - RNA, 13 nt, Staphylococcus aureus subsp. aureus N315
ucuucuuguuuua

SEQ ID NO: 4069164 - RNA, 18 nt, Staphylococcus aureus subsp. aureus N315
ucuugaaacacaaaaagg

SEQ ID NO: 4069165 - RNA, 14 nt, Staphylococcus aureus subsp. aureus N315
ucuugagcaauguc

SEQ ID NO: 4069166 - RNA, 20 nt, Staphylococcus aureus subsp. aureus N315
ucuugagcuguuacacuuuu

SEQ ID NO: 4069167 - RNA, 14 nt, Staphylococcus aureus subsp. aureus N315
ucuugauaaaauaa

SEQ ID NO: 4069168 - RNA, 15 nt, Staphylococcus aureus subsp. aureus N315
ucuugaugaauuaaa

SEQ ID NO: 4069169 - RNA, 15 nt, Staphylococcus aureus subsp. aureus N315
ucuugauuauauuuu

SEQ ID NO: 4069170 - RNA, 19 nt, Staphylococcus aureus subsp. aureus N315
ucuugauuauauuuuucuu

SEQ ID NO: 4069171 - RNA, 13 nt, Staphylococcus aureus subsp. aureus N315
ucuugauuuaaac

SEQ ID NO: 4069172 - RNA, 22 nt, Staphylococcus aureus subsp. aureus N315
ucuugauuuaaaccaucaauuc

SEQ ID NO: 4069173 - RNA, 15 nt, Staphylococcus aureus subsp. aureus N315
ucuugcaaguauuuu

SEQ ID NO: 4069174 - RNA, 22 nt, Staphylococcus aureus subsp. aureus N315
ucuugcgccuuguucaauucag

SEQ ID NO: 4069175 - RNA, 21 nt, Staphylococcus aureus subsp. aureus N315
ucuuggacuaauaauugucca

SEQ ID NO: 4069176 - RNA, 20 nt, Staphylococcus aureus subsp. aureus N315
ucuuggcauuuuuucauuau

SEQ ID NO: 4069177 - RNA, 17 nt, Staphylococcus aureus subsp. aureus N315
ucuuggccaauuaacuu

SEQ ID NO: 4069178 - RNA, 23 nt, Staphylococcus aureus subsp. aureus N315
ucuugguauuuuuuaaaugcgua

SEQ ID NO: 4069179 - RNA, 15 nt, Staphylococcus aureus subsp. aureus N315
ucuuguaaacuucuu

SEQ ID NO: 4069180 - RNA, 12 nt, Staphylococcus aureus subsp. aureus N315
ucuuguaauguu

SEQ ID NO: 4069181 - RNA, 14 nt, Staphylococcus aureus subsp. aureus N315
ucuuguauuuccuu

SEQ ID NO: 4069182 - RNA, 20 nt, Staphylococcus aureus subsp. aureus N315
ucuugucauuucaaucauuu

SEQ ID NO: 4069183 - RNA, 22 nt, Staphylococcus aureus subsp. aureus N315
ucuugucauuugaacaucauuu

SEQ ID NO: 4069184 - RNA, 18 nt, Staphylococcus aureus subsp. aureus N315
ucuugugauaauucuuca

SEQ ID NO: 4069185 - RNA, 15 nt, Staphylococcus aureus subsp. aureus N315
ucuuguguuucagcu

SEQ ID NO: 4069186 - RNA, 16 nt, Staphylococcus aureus subsp. aureus N315
ucuuguucuaauuguu

SEQ ID NO: 4069187 - RNA, 21 nt, Staphylococcus aureus subsp. aureus N315
ucuuguuuagggaaucccaua

SEQ ID NO: 4069188 - RNA, 17 nt, Staphylococcus aureus subsp. aureus N315
ucuuguuucaaacaaag

SEQ ID NO: 4069189 - RNA, 13 nt, Staphylococcus aureus subsp. aureus N315
ucuuguuuuaaau

SEQ ID NO: 4069190 - RNA, 19 nt, Staphylococcus aureus subsp. aureus N315
ucuuuaaagaaaauuucag

SEQ ID NO: 4069191 - RNA, 18 nt, Staphylococcus aureus subsp. aureus N315
ucuuuaaagcuaaauguu

SEQ ID NO: 4069192 - RNA, 19 nt, Staphylococcus aureus subsp. aureus N315
ucuuuaacucuugaaacac

SEQ ID NO: 4069193 - RNA, 17 nt, Staphylococcus aureus subsp. aureus N315
ucuuuaacuuuaauuaa

SEQ ID NO: 4069194 - RNA, 19 nt, Staphylococcus aureus subsp. aureus N315
ucuuuaagcccuuccccua

SEQ ID NO: 4069195 - RNA, 17 nt, Staphylococcus aureus subsp. aureus N315
ucuuuaauauaaauuuu

SEQ ID NO: 4069196 - RNA, 14 nt, Staphylococcus aureus subsp. aureus N315
ucuuuaaugaaagc

SEQ ID NO: 4069197 - RNA, 17 nt, Staphylococcus aureus subsp. aureus N315
ucuuuacgauaaacuaa

SEQ ID NO: 4069198 - RNA, 20 nt, Staphylococcus aureus subsp. aureus N315
ucuuuacgauaaacuaaaaa

SEQ ID NO: 4069199 - RNA, 23 nt, Staphylococcus aureus subsp. aureus N315
ucuuuacuaaagauagcugcuau

SEQ ID NO: 4069200 - RNA, 13 nt, Staphylococcus aureus subsp. aureus N315
ucuuuauaacuuu

SEQ ID NO: 4069201 - RNA, 13 nt, Staphylococcus aureus subsp. aureus N315
ucuuuauuaauaa

SEQ ID NO: 4069202 - RNA, 15 nt, Staphylococcus aureus subsp. aureus N315
ucuuuauuaauaaau

SEQ ID NO: 4069203 - RNA, 13 nt, Staphylococcus aureus subsp. aureus N315
ucuuuauuuacaa

SEQ ID NO: 4069204 - RNA, 21 nt, Staphylococcus aureus subsp. aureus N315
ucuuuauuugauucuucacca

SEQ ID NO: 4069205 - RNA, 18 nt, Staphylococcus aureus subsp. aureus N315
ucuuuauuuuuuaucauu

SEQ ID NO: 4069206 - RNA, 18 nt, Staphylococcus aureus subsp. aureus N315
ucuuucaaauacacagau

SEQ ID NO: 4069207 - RNA, 15 nt, Staphylococcus aureus subsp. aureus N315
ucuuucaaaugcuua

SEQ ID NO: 4069208 - RNA, 18 nt, Staphylococcus aureus subsp. aureus N315
ucuuucaauuaauuuaaa

SEQ ID NO: 4069209 - RNA, 23 nt, Staphylococcus aureus subsp. aureus N315
ucuuucaauuaauuuaaaugcuu

SEQ ID NO: 4069210 - RNA, 19 nt, Staphylococcus aureus subsp. aureus N315
ucuuucagcuaauucgucu

SEQ ID NO: 4069211 - RNA, 14 nt, Staphylococcus aureus subsp. aureus N315
ucuuucauaaauug

SEQ ID NO: 4069212 - RNA, 21 nt, Staphylococcus aureus subsp. aureus N315
ucuuucauaaauuguuuuaca

SEQ ID NO: 4069213 - RNA, 15 nt, Staphylococcus aureus subsp. aureus N315
ucuuuccucacuaga

SEQ ID NO: 4069214 - RNA, 21 nt, Staphylococcus aureus subsp. aureus N315
ucuuucgucuuguaaacuucu

SEQ ID NO: 4069215 - RNA, 16 nt, Staphylococcus aureus subsp. aureus N315
ucuuucucuaacauuu

SEQ ID NO: 4069216 - RNA, 15 nt, Staphylococcus aureus subsp. aureus N315
ucuuucucuauuaau

SEQ ID NO: 4069217 - RNA, 20 nt, Staphylococcus aureus subsp. aureus N315
ucuuucuuagugaaucuucu

SEQ ID NO: 4069218 - RNA, 14 nt, Staphylococcus aureus subsp. aureus N315
ucuuucuuguucua

SEQ ID NO: 4069219 - RNA, 19 nt, Staphylococcus aureus subsp. aureus N315
ucuuucuuguucuaaaaua

SEQ ID NO: 4069220 - RNA, 20 nt, Staphylococcus aureus subsp. aureus N315
ucuuucuuguucuaaaauaa

SEQ ID NO: 4069221 - RNA, 22 nt, Staphylococcus aureus subsp. aureus N315
ucuuucuuuguguuugcuuuuu

SEQ ID NO: 4069222 - RNA, 11 nt, Staphylococcus aureus subsp. aureus N315
ucuuucuuuug

SEQ ID NO: 4069223 - RNA, 13 nt, Staphylococcus aureus subsp. aureus N315
ucuuugacaugug

SEQ ID NO: 4069224 - RNA, 16 nt, Staphylococcus aureus subsp. aureus N315
ucuuugauuaaaucuu

SEQ ID NO: 4069225 - RNA, 20 nt, Staphylococcus aureus subsp. aureus N315
ugaaauauaccaaccaaaac

SEQ ID NO: 4069226 - RNA, 15 nt, Staphylococcus aureus subsp. aureus N315
ugaaauauuuaucuu

SEQ ID NO: 4069227 - RNA, 16 nt, Staphylococcus aureus subsp. aureus N315
ugaaauauuuaucuuu

SEQ ID NO: 4069228 - RNA, 14 nt, Staphylococcus aureus subsp. aureus N315
ugaaaucauuuaaa

SEQ ID NO: 4069229 - RNA, 19 nt, Staphylococcus aureus subsp. aureus N315
ugaaaucuauugugauaua

SEQ ID NO: 4069230 - RNA, 22 nt, Staphylococcus aureus subsp. aureus N315
ugaaaugaaguauggaaguugu

SEQ ID NO: 4069231 - RNA, 15 nt, Staphylococcus aureus subsp. aureus N315
ugaaaugaaguuuuu

SEQ ID NO: 4069232 - RNA, 15 nt, Staphylococcus aureus subsp. aureus N315
ugaaaugagcuuaag

SEQ ID NO: 4069233 - RNA, 16 nt, Staphylococcus aureus subsp. aureus N315
ugaaaugauacauuau

SEQ ID NO: 4069234 - RNA, 20 nt, Staphylococcus aureus subsp. aureus N315
ugaaaugauacauuauuaaa

SEQ ID NO: 4069235 - RNA, 22 nt, Staphylococcus aureus subsp. aureus N315
ugaaaugauacauuauuaaaua

SEQ ID NO: 4069236 - RNA, 17 nt, Staphylococcus aureus subsp. aureus N315
ugaaauggaaaguaaua

SEQ ID NO: 4069237 - RNA, 15 nt, Staphylococcus aureus subsp. aureus N315
ugaaaugguaucuaa

SEQ ID NO: 4069238 - RNA, 22 nt, Staphylococcus aureus subsp. aureus N315
ugaaauguagacaauaaaucuu

SEQ ID NO: 4069239 - RNA, 17 nt, Staphylococcus aureus subsp. aureus N315
ugaaauguuuaucaauu

SEQ ID NO: 4069240 - RNA, 15 nt, Staphylococcus aureus subsp. aureus N315
ugaaauuaaauuugu

SEQ ID NO: 4069241 - RNA, 21 nt, Staphylococcus aureus subsp. aureus N315
ugaaauuaacgucaacagcau

SEQ ID NO: 4069242 - RNA, 23 nt, Staphylococcus aureus subsp. aureus N315
ugaaauuaacgucaacagcauaa

SEQ ID NO: 4069243 - RNA, 19 nt, Staphylococcus aureus subsp. aureus N315
ugaaauuagauuuuaugcu

SEQ ID NO: 4069244 - RNA, 21 nt, Staphylococcus aureus subsp. aureus N315
ugaaauuauuauuuaaauuuu

SEQ ID NO: 4069245 - RNA, 15 nt, Staphylococcus aureus subsp. aureus N315
ugaaauucuuuugua

SEQ ID NO: 4069246 - RNA, 22 nt, Staphylococcus aureus subsp. aureus N315
ugaaauucuuuuguaauugaaa

SEQ ID NO: 4069247 - RNA, 20 nt, Staphylococcus aureus subsp. aureus N315
ugaaauugacaguuuccaua

SEQ ID NO: 4069248 - RNA, 21 nt, Staphylococcus aureus subsp. aureus N315
ugaaauugcgugcguuuaaca

SEQ ID NO: 4069249 - RNA, 20 nt, Staphylococcus aureus subsp. aureus N315
ugaaauuucgacaucuagau

SEQ ID NO: 4069250 - RNA, 14 nt, Staphylococcus aureus subsp. aureus N315
ugaaauuuuuaaua

SEQ ID NO: 4069251 - RNA, 14 nt, Staphylococcus aureus subsp. aureus N315
ugaaauuuuuccga

SEQ ID NO: 4069252 - RNA, 20 nt, Staphylococcus aureus subsp. aureus N315
ugaaauuuuuuagugaaaaa

SEQ ID NO: 4069253 - RNA, 21 nt, Staphylococcus aureus subsp. aureus N315
ugaaauuuuuuagugaaaaag

SEQ ID NO: 4069254 - RNA, 23 nt, Staphylococcus aureus subsp. aureus N315
ugaacaaaaaauaaaaacuucua

SEQ ID NO: 4069255 - RNA, 22 nt, Staphylococcus aureus subsp. aureus N315
ugaacaacauugagauuaucuu

SEQ ID NO: 4069256 - RNA, 13 nt, Staphylococcus aureus subsp. aureus N315
ugaacaauaauau

SEQ ID NO: 4069257 - RNA, 22 nt, Staphylococcus aureus subsp. aureus N315
ugaacaauaauaugccauagua

SEQ ID NO: 4069258 - RNA, 19 nt, Staphylococcus aureus subsp. aureus N315
ugaacaaucagauaaguua

SEQ ID NO: 4069259 - RNA, 17 nt, Staphylococcus aureus subsp. aureus N315
ugaacaguuagugcuug

SEQ ID NO: 4069260 - RNA, 21 nt, Staphylococcus aureus subsp. aureus N315
ugaacauaccugcauaugugu

SEQ ID NO: 4069261 - RNA, 16 nt, Staphylococcus aureus subsp. aureus N315
ugaacauauuauaaaa

SEQ ID NO: 4069262 - RNA, 20 nt, Staphylococcus aureus subsp. aureus N315
ugaacauauuauaaaagugu

SEQ ID NO: 4069263 - RNA, 18 nt, Staphylococcus aureus subsp. aureus N315
ugaacaucauuuaauuga

SEQ ID NO: 4069264 - RNA, 22 nt, Staphylococcus aureus subsp. aureus N315
ugaacaucuaguuauuucauag

SEQ ID NO: 4069265 - RNA, 20 nt, Staphylococcus aureus subsp. aureus N315
ugaaccagcuaaccaaauaa

SEQ ID NO: 4069266 - RNA, 17 nt, Staphylococcus aureus subsp. aureus N315
ugaaccccauucacuac

SEQ ID NO: 4069267 - RNA, 15 nt, Staphylococcus aureus subsp. aureus N315
ugaaccggaaauuaa

SEQ ID NO: 4069268 - RNA, 16 nt, Staphylococcus aureus subsp. aureus N315
ugaacgauauucuaca

SEQ ID NO: 4069269 - RNA, 11 nt, Staphylococcus aureus subsp. aureus N315
ugaacuaaaac

SEQ ID NO: 4069270 - RNA, 13 nt, Staphylococcus aureus subsp. aureus N315
ugaacuaaauuga

SEQ ID NO: 4069271 - RNA, 20 nt, Staphylococcus aureus subsp. aureus N315
ugaacuacucccgcaaauau

SEQ ID NO: 4069272 - RNA, 14 nt, Staphylococcus aureus subsp. aureus N315
ugaacuauuaaaac

SEQ ID NO: 4069273 - RNA, 16 nt, Staphylococcus aureus subsp. aureus N315
ugaacuauuaaaacca

SEQ ID NO: 4069274 - RNA, 13 nt, Staphylococcus aureus subsp. aureus N315
ugaacuuaaugcu

SEQ ID NO: 4069275 - RNA, 15 nt, Staphylococcus aureus subsp. aureus N315
ugaacuucucuuagu

SEQ ID NO: 4069276 - RNA, 18 nt, Staphylococcus aureus subsp. aureus N315
ugaagaaaaaaugauaua

SEQ ID NO: 4069277 - RNA, 18 nt, Staphylococcus aureus subsp. aureus N315
ugaagaaaaguauaaaua

SEQ ID NO: 4069278 - RNA, 20 nt, Staphylococcus aureus subsp. aureus N315
ugaagaaaaguauaaauaua

SEQ ID NO: 4069279 - RNA, 19 nt, Staphylococcus aureus subsp. aureus N315
ugaagaaggaugaguuuaa

SEQ ID NO: 4069280 - RNA, 23 nt, Staphylococcus aureus subsp. aureus N315
ugaagaaucaggaccaaauagag

SEQ ID NO: 4069281 - RNA, 22 nt, Staphylococcus aureus subsp. aureus N315
ugaagcguucgugauagaaguu

SEQ ID NO: 4069282 - RNA, 15 nt, Staphylococcus aureus subsp. aureus N315
ugaagcuaaaugcuc

SEQ ID NO: 4069283 - RNA, 18 nt, Staphylococcus aureus subsp. aureus N315
ugaaggagauauuuucuu

SEQ ID NO: 4069284 - RNA, 17 nt, Staphylococcus aureus subsp. aureus N315
ugaaggccauuuuuauu

SEQ ID NO: 4069285 - RNA, 24 nt, Staphylococcus aureus subsp. aureus N315
ugaaggccauuuuuauuuaacacu

SEQ ID NO: 4069286 - RNA, 14 nt, Staphylococcus aureus subsp. aureus N315
ugaagggagcauuu

SEQ ID NO: 4069287 - RNA, 18 nt, Staphylococcus aureus subsp. aureus N315
ugaagggagcauuucauu

SEQ ID NO: 4069288 - RNA, 19 nt, Staphylococcus aureus subsp. aureus N315
ugaagggagcauuucauua

SEQ ID NO: 4069289 - RNA, 17 nt, Staphylococcus aureus subsp. aureus N315
ugaagggguuuuuucuu

SEQ ID NO: 4069290 - RNA, 17 nt, Staphylococcus aureus subsp. aureus N315
ugaaguaauauauaaaa

SEQ ID NO: 4069291 - RNA, 22 nt, Staphylococcus aureus subsp. aureus N315
ugaaguuaacuauaacaauagu

SEQ ID NO: 4069292 - RNA, 16 nt, Staphylococcus aureus subsp. aureus N315
ugaaguuacuauauuu

SEQ ID NO: 4069293 - RNA, 21 nt, Staphylococcus aureus subsp. aureus N315
ugaaguuuuuagcauuaucau

SEQ ID NO: 4069294 - RNA, 18 nt, Staphylococcus aureus subsp. aureus N315
ugaauaaagcuaacauac

SEQ ID NO: 4069295 - RNA, 21 nt, Staphylococcus aureus subsp. aureus N315
ugaauaaagcuaacauaccua

SEQ ID NO: 4069296 - RNA, 13 nt, Staphylococcus aureus subsp. aureus N315
ugaauaaauaacu

SEQ ID NO: 4069297 - RNA, 15 nt, Staphylococcus aureus subsp. aureus N315
ugaauaaauaacuuc

SEQ ID NO: 4069298 - RNA, 13 nt, Staphylococcus aureus subsp. aureus N315
ugaauaaauacaa

SEQ ID NO: 4069299 - RNA, 21 nt, Staphylococcus aureus subsp. aureus N315
ugaauaaauuuuauucuucag

SEQ ID NO: 4069300 - RNA, 22 nt, Staphylococcus aureus subsp. aureus N315
ugaauaaucauccauauaugcc

SEQ ID NO: 4069301 - RNA, 14 nt, Staphylococcus aureus subsp. aureus N315
ugaauaauggaugu

SEQ ID NO: 4069302 - RNA, 18 nt, Staphylococcus aureus subsp. aureus N315
ugaauaauguuuucauug

SEQ ID NO: 4069303 - RNA, 13 nt, Staphylococcus aureus subsp. aureus N315
ugaauaauuaaaa

SEQ ID NO: 4069304 - RNA, 14 nt, Staphylococcus aureus subsp. aureus N315
ugaauaauuaaaaa

SEQ ID NO: 4069305 - RNA, 11 nt, Staphylococcus aureus subsp. aureus N315
ugaauaauucc

SEQ ID NO: 4069306 - RNA, 22 nt, Staphylococcus aureus subsp. aureus N315
ugaauaauugcuaaaauaucaa

SEQ ID NO: 4069307 - RNA, 19 nt, Staphylococcus aureus subsp. aureus N315
ugaauaauuucaguucuua

SEQ ID NO: 4069308 - RNA, 17 nt, Staphylococcus aureus subsp. aureus N315
ugaauacuuuauuugau

SEQ ID NO: 4069309 - RNA, 21 nt, Staphylococcus aureus subsp. aureus N315
ugaauaguaaucagcuuuuuc

SEQ ID NO: 4069310 - RNA, 20 nt, Staphylococcus aureus subsp. aureus N315
ugaauaguagugauaucgcu

SEQ ID NO: 4069311 - RNA, 22 nt, Staphylococcus aureus subsp. aureus N315
ugaauauacuuaauuuaaaucu

SEQ ID NO: 4069312 - RNA, 16 nt, Staphylococcus aureus subsp. aureus N315
ugacuucuuuauauuu

SEQ ID NO: 4069313 - RNA, 14 nt, Staphylococcus aureus subsp. aureus N315
ugacuuuaaaucuu

SEQ ID NO: 4069314 - RNA, 20 nt, Staphylococcus aureus subsp. aureus N315
ugacuuuaaaucuuguucua

SEQ ID NO: 4069315 - RNA, 14 nt, Staphylococcus aureus subsp. aureus N315
ugacuuuauuucua

SEQ ID NO: 4069316 - RNA, 19 nt, Staphylococcus aureus subsp. aureus N315
ugacuuuauuucuauaucu

SEQ ID NO: 4069317 - RNA, 15 nt, Staphylococcus aureus subsp. aureus N315
ugacuuuccuaauuc

SEQ ID NO: 4069318 - RNA, 14 nt, Staphylococcus aureus subsp. aureus N315
ugagaaaguaaaag

SEQ ID NO: 4069319 - RNA, 19 nt, Staphylococcus aureus subsp. aureus N315
ugagaauauuuauuguuuu

SEQ ID NO: 4069320 - RNA, 17 nt, Staphylococcus aureus subsp. aureus N315
ugagacguuuuccauga

SEQ ID NO: 4069321 - RNA, 15 nt, Staphylococcus aureus subsp. aureus N315
ugagauaaaaucaua

SEQ ID NO: 4069322 - RNA, 23 nt, Staphylococcus aureus subsp. aureus N315
ugagauaaaaucauaugucuuaa

SEQ ID NO: 4069323 - RNA, 13 nt, Staphylococcus aureus subsp. aureus N315
ugagauggucuuu

SEQ ID NO: 4069324 - RNA, 19 nt, Staphylococcus aureus subsp. aureus N315
ugagauuaucuuuagacau

SEQ ID NO: 4069325 - RNA, 23 nt, Staphylococcus aureus subsp. aureus N315
ugagauuauuuuuuuaaaucuau

SEQ ID NO: 4069326 - RNA, 16 nt, Staphylococcus aureus subsp. aureus N315
ugagcaaagcuuuuuu

SEQ ID NO: 4069327 - RNA, 14 nt, Staphylococcus aureus subsp. aureus N315
ugagcaacaaaaga

SEQ ID NO: 4069328 - RNA, 15 nt, Staphylococcus aureus subsp. aureus N315
ugagcacuuaauaag

SEQ ID NO: 4069329 - RNA, 21 nt, Staphylococcus aureus subsp. aureus N315
ugagcaucuugucuaguucga

SEQ ID NO: 4069330 - RNA, 13 nt, Staphylococcus aureus subsp. aureus N315
ugagcaucuuuua

SEQ ID NO: 4069331 - RNA, 14 nt, Staphylococcus aureus subsp. aureus N315
ugagcuauucauag

SEQ ID NO: 4069332 - RNA, 16 nt, Staphylococcus aureus subsp. aureus N315
ugagcuucuuuaaaua

SEQ ID NO: 4069333 - RNA, 17 nt, Staphylococcus aureus subsp. aureus N315
ugagcuucuuuaaauac

SEQ ID NO: 4069334 - RNA, 17 nt, Staphylococcus aureus subsp. aureus N315
ugagcuuuguuagcauc

SEQ ID NO: 4069335 - RNA, 19 nt, Staphylococcus aureus subsp. aureus N315
ugagcuuuguuugaaacaa

SEQ ID NO: 4069336 - RNA, 18 nt, Staphylococcus aureus subsp. aureus N315
ugagcuuuucuaaugcua

SEQ ID NO: 4069337 - RNA, 21 nt, Staphylococcus aureus subsp. aureus N315
ugaggccauaagccauaugcu

SEQ ID NO: 4069338 - RNA, 19 nt, Staphylococcus aureus subsp. aureus N315
ugaggcccauaaauuacuu

SEQ ID NO: 4069339 - RNA, 19 nt, Staphylococcus aureus subsp. aureus N315
ugaggcguuucagaaguug

SEQ ID NO: 4069340 - RNA, 15 nt, Staphylococcus aureus subsp. aureus N315
ugagggauuuuuaua

SEQ ID NO: 4069341 - RNA, 14 nt, Staphylococcus aureus subsp. aureus N315
ugagggccccaaca

SEQ ID NO: 4069342 - RNA, 19 nt, Staphylococcus aureus subsp. aureus N315
ugagggccccaacacagaa

SEQ ID NO: 4069343 - RNA, 14 nt, Staphylococcus aureus subsp. aureus N315
ugaguaaauuaaua

SEQ ID NO: 4069344 - RNA, 13 nt, Staphylococcus aureus subsp. aureus N315
ugaguacaacaua

SEQ ID NO: 4069345 - RNA, 14 nt, Staphylococcus aureus subsp. aureus N315
ugaguacaacauag

SEQ ID NO: 4069346 - RNA, 21 nt, Staphylococcus aureus subsp. aureus N315
ugaguacuaaucaauacuaaa

SEQ ID NO: 4069347 - RNA, 16 nt, Staphylococcus aureus subsp. aureus N315
ugaguaggcucuuaau

SEQ ID NO: 4069348 - RNA, 17 nt, Staphylococcus aureus subsp. aureus N315
ugaguaggcucuuaaug

SEQ ID NO: 4069349 - RNA, 14 nt, Staphylococcus aureus subsp. aureus N315
ugaguaguuucucu

SEQ ID NO: 4069350 - RNA, 20 nt, Staphylococcus aureus subsp. aureus N315
ugaguauacuuacugaaacu

SEQ ID NO: 4069351 - RNA, 15 nt, Staphylococcus aureus subsp. aureus N315
ugaguauauucaaaa

SEQ ID NO: 4069352 - RNA, 14 nt, Staphylococcus aureus subsp. aureus N315
ugaguaucaugcuu

SEQ ID NO: 4069353 - RNA, 19 nt, Staphylococcus aureus subsp. aureus N315
ugaguaucaugcuuuuaau

SEQ ID NO: 4069354 - RNA, 20 nt, Staphylococcus aureus subsp. aureus N315
ugaguaucaugcuuuuaaua

SEQ ID NO: 4069355 - RNA, 15 nt, Staphylococcus aureus subsp. aureus N315
ugaguauccaauacu

SEQ ID NO: 4069356 - RNA, 14 nt, Staphylococcus aureus subsp. aureus N315
ugaguauuaaauuu

SEQ ID NO: 4069357 - RNA, 23 nt, Staphylococcus aureus subsp. aureus N315
ugaguauuaaauuugaaaguaaa

SEQ ID NO: 4069358 - RNA, 23 nt, Staphylococcus aureus subsp. aureus N315
ugagucaauuucuuuaaagucuu

SEQ ID NO: 4069359 - RNA, 22 nt, Staphylococcus aureus subsp. aureus N315
ugagucuuggacauuguaaaau

SEQ ID NO: 4069360 - RNA, 23 nt, Staphylococcus aureus subsp. aureus N315
ugagucuuggacauuguaaaaug

SEQ ID NO: 4069361 - RNA, 19 nt, Staphylococcus aureus subsp. aureus N315
ugagugauuuuaaucuauc

SEQ ID NO: 4069362 - RNA, 22 nt, Staphylococcus aureus subsp. aureus N315
ugaguguguccaucauuugugu

SEQ ID NO: 4069363 - RNA, 17 nt, Staphylococcus aureus subsp. aureus N315
ugaguguuuaugaaagu

SEQ ID NO: 4069364 - RNA, 15 nt, Staphylococcus aureus subsp. aureus N315
ugaguugaaaauaau

SEQ ID NO: 4069365 - RNA, 23 nt, Staphylococcus aureus subsp. aureus N315
ugaguuggcaucagacuaaaaug

SEQ ID NO: 4069366 - RNA, 12 nt, Staphylococcus aureus subsp. aureus N315
ugaguuuaaaaa

SEQ ID NO: 4069367 - RNA, 18 nt, Staphylococcus aureus subsp. aureus N315
ugaguuuuuuaaaauaau

SEQ ID NO: 4069368 - RNA, 24 nt, Staphylococcus aureus subsp. aureus N315
ugauaaaagcccaccuaaaaagua

SEQ ID NO: 4069369 - RNA, 13 nt, Staphylococcus aureus subsp. aureus N315
ugauaaaauaaau

SEQ ID NO: 4069370 - RNA, 12 nt, Staphylococcus aureus subsp. aureus N315
ugauaaauuaaa

SEQ ID NO: 4069371 - RNA, 12 nt, Staphylococcus aureus subsp. aureus N315
ugauaaauugug

SEQ ID NO: 4069372 - RNA, 23 nt, Staphylococcus aureus subsp. aureus N315
ugauaacaaccgucccauaaaag

SEQ ID NO: 4069373 - RNA, 16 nt, Staphylococcus aureus subsp. aureus N315
ugauaaguagaaaaua

SEQ ID NO: 4069374 - RNA, 18 nt, Staphylococcus aureus subsp. aureus N315
ugauaagucuugauggug

SEQ ID NO: 4069375 - RNA, 14 nt, Staphylococcus aureus subsp. aureus N315
ugauaauaaaaguu

SEQ ID NO: 4069376 - RNA, 22 nt, Staphylococcus aureus subsp. aureus N315
ugauaauacuguuuaaauaaaa

SEQ ID NO: 4069377 - RNA, 18 nt, Staphylococcus aureus subsp. aureus N315
ugauaauagcuugagcau

SEQ ID NO: 4069378 - RNA, 13 nt, Staphylococcus aureus subsp. aureus N315
ugauaaugcaugu

SEQ ID NO: 4069379 - RNA, 19 nt, Staphylococcus aureus subsp. aureus N315
ugauaaugucuuacuuguc

SEQ ID NO: 4069380 - RNA, 22 nt, Staphylococcus aureus subsp. aureus N315
ugauaauuaauuaaaauucucu

SEQ ID NO: 4069381 - RNA, 16 nt, Staphylococcus aureus subsp. aureus N315
ugauaauuaauuaugc

SEQ ID NO: 4069382 - RNA, 14 nt, Staphylococcus aureus subsp. aureus N315
ugauaauucuucaa

SEQ ID NO: 4069383 - RNA, 15 nt, Staphylococcus aureus subsp. aureus N315
ugauaauuuaauaau

SEQ ID NO: 4069384 - RNA, 14 nt, Staphylococcus aureus subsp. aureus N315
ugauaauuuuucuu

SEQ ID NO: 4069385 - RNA, 19 nt, Staphylococcus aureus subsp. aureus N315
ugauacagaaccaacaaua

SEQ ID NO: 4069386 - RNA, 14 nt, Staphylococcus aureus subsp. aureus N315
ugauacauuauuaa

SEQ ID NO: 4069387 - RNA, 18 nt, Staphylococcus aureus subsp. aureus N315
ugauacauuauuaaauag

SEQ ID NO: 4069388 - RNA, 16 nt, Staphylococcus aureus subsp. aureus N315
ugauacauucuauuaa

SEQ ID NO: 4069389 - RNA, 17 nt, Staphylococcus aureus subsp. aureus N315
ugauaccuuuaaaucua

SEQ ID NO: 4069390 - RNA, 19 nt, Staphylococcus aureus subsp. aureus N315
ugauacgccuaaauauuua

SEQ ID NO: 4069391 - RNA, 15 nt, Staphylococcus aureus subsp. aureus N315
ugauacgcuuuuuaa

SEQ ID NO: 4069392 - RNA, 16 nt, Staphylococcus aureus subsp. aureus N315
ugauacgcuuuuuaaa

SEQ ID NO: 4069393 - RNA, 23 nt, Staphylococcus aureus subsp. aureus N315
ugauacguacguugauguguugc

SEQ ID NO: 4069394 - RNA, 18 nt, Staphylococcus aureus subsp. aureus N315
ugauacgugguuuuauuu

SEQ ID NO: 4069395 - RNA, 14 nt, Staphylococcus aureus subsp. aureus N315
ugauacucaauaaa

SEQ ID NO: 4069396 - RNA, 18 nt, Staphylococcus aureus subsp. aureus N315
ugauacugcuucgcuaau

SEQ ID NO: 4069397 - RNA, 17 nt, Staphylococcus aureus subsp. aureus N315
ugauagcaaugaauuaa

SEQ ID NO: 4069398 - RNA, 20 nt, Staphylococcus aureus subsp. aureus N315
ugauagcaaugaauuaauag

SEQ ID NO: 4069399 - RNA, 15 nt, Staphylococcus aureus subsp. aureus N315
ugauagcuaaugcau

SEQ ID NO: 4069400 - RNA, 21 nt, Staphylococcus aureus subsp. aureus N315
ugauuuaauaaugcuauauuu

SEQ ID NO: 4069401 - RNA, 14 nt, Staphylococcus aureus subsp. aureus N315
ugauuuaauguuaa

SEQ ID NO: 4069402 - RNA, 17 nt, Staphylococcus aureus subsp. aureus N315
ugauuuaauuuuuaaug

SEQ ID NO: 4069403 - RNA, 17 nt, Staphylococcus aureus subsp. aureus N315
ugauuuaccuuugucuu

SEQ ID NO: 4069404 - RNA, 22 nt, Staphylococcus aureus subsp. aureus N315
ugauuuauaaaaacuuauuugc

SEQ ID NO: 4069405 - RNA, 11 nt, Staphylococcus aureus subsp. aureus N315
ugauuuauuau

SEQ ID NO: 4069406 - RNA, 21 nt, Staphylococcus aureus subsp. aureus N315
ugauuugccaaaaguuauaua

SEQ ID NO: 4069407 - RNA, 20 nt, Staphylococcus aureus subsp. aureus N315
ugauuuggaaagaugggauu

SEQ ID NO: 4069408 - RNA, 16 nt, Staphylococcus aureus subsp. aureus N315
ugauuuguuacuucua

SEQ ID NO: 4069409 - RNA, 18 nt, Staphylococcus aureus subsp. aureus N315
ugauuuuaccuguuucua

SEQ ID NO: 4069410 - RNA, 21 nt, Staphylococcus aureus subsp. aureus N315
ugauuuuaccuguuucuauau

SEQ ID NO: 4069411 - RNA, 14 nt, Staphylococcus aureus subsp. aureus N315
ugauuuuacuugaa

SEQ ID NO: 4069412 - RNA, 15 nt, Staphylococcus aureus subsp. aureus N315
ugauuuuauaaaguu

SEQ ID NO: 4069413 - RNA, 15 nt, Staphylococcus aureus subsp. aureus N315
ugauuuuauaauauu

SEQ ID NO: 4069414 - RNA, 12 nt, Staphylococcus aureus subsp. aureus N315
ugauuuucuuua

SEQ ID NO: 4069415 - RNA, 20 nt, Staphylococcus aureus subsp. aureus N315
ugauuuucuuucauaaauug

SEQ ID NO: 4069416 - RNA, 14 nt, Staphylococcus aureus subsp. aureus N315
ugauuuugaaucac

SEQ ID NO: 4069417 - RNA, 18 nt, Staphylococcus aureus subsp. aureus N315
ugauuuugcugccaaaaa

SEQ ID NO: 4069418 - RNA, 24 nt, Staphylococcus aureus subsp. aureus N315
ugauuuuucaucaauaucaaauuu

SEQ ID NO: 4069419 - RNA, 14 nt, Staphylococcus aureus subsp. aureus N315
ugauuuuuuauuca

SEQ ID NO: 4069420 - RNA, 16 nt, Staphylococcus aureus subsp. aureus N315
ugcaaaaaaacaaaua

SEQ ID NO: 4069421 - RNA, 20 nt, Staphylococcus aureus subsp. aureus N315
ugcaaaaauaauaugaauuu

SEQ ID NO: 4069422 - RNA, 14 nt, Staphylococcus aureus subsp. aureus N315
ugcaaaaugcauua

SEQ ID NO: 4069423 - RNA, 20 nt, Staphylococcus aureus subsp. aureus N315
ugcaaacacaguacaaauaa

SEQ ID NO: 4069424 - RNA, 15 nt, Staphylococcus aureus subsp. aureus N315
ugcaaacgauauguu

SEQ ID NO: 4069425 - RNA, 19 nt, Staphylococcus aureus subsp. aureus N315
ugcaaacucauuuauaaac

SEQ ID NO: 4069426 - RNA, 20 nt, Staphylococcus aureus subsp. aureus N315
ugcaaagggcgaaauggauu

SEQ ID NO: 4069427 - RNA, 15 nt, Staphylococcus aureus subsp. aureus N315
ugcaaaguaacaaua

SEQ ID NO: 4069428 - RNA, 17 nt, Staphylococcus aureus subsp. aureus N315
ugcaaauaaaaaaguua

SEQ ID NO: 4069429 - RNA, 22 nt, Staphylococcus aureus subsp. aureus N315
ugcaaauacgaguguuuuaauc

SEQ ID NO: 4069430 - RNA, 19 nt, Staphylococcus aureus subsp. aureus N315
ugcaaauauaucaucucua

SEQ ID NO: 4069431 - RNA, 16 nt, Staphylococcus aureus subsp. aureus N315
ugcaaaucaaauacau

SEQ ID NO: 4069432 - RNA, 20 nt, Staphylococcus aureus subsp. aureus N315
ugcaaaucucgucacauaua

SEQ ID NO: 4069433 - RNA, 16 nt, Staphylococcus aureus subsp. aureus N315
ugcaaaugaaauucuu

SEQ ID NO: 4069434 - RNA, 16 nt, Staphylococcus aureus subsp. aureus N315
ugcaaaugccucuuuc

SEQ ID NO: 4069435 - RNA, 16 nt, Staphylococcus aureus subsp. aureus N315
ugcaaauuaucauuaa

SEQ ID NO: 4069436 - RNA, 22 nt, Staphylococcus aureus subsp. aureus N315
ugcaacauuugauaaccaaugc

SEQ ID NO: 4069437 - RNA, 21 nt, Staphylococcus aureus subsp. aureus N315
ugcaacgcaucacaaaauugu

SEQ ID NO: 4069438 - RNA, 16 nt, Staphylococcus aureus subsp. aureus N315
ugcaacuacgauaccg

SEQ ID NO: 4069439 - RNA, 15 nt, Staphylococcus aureus subsp. aureus N315
ugcaacuuauaauau

SEQ ID NO: 4069440 - RNA, 16 nt, Staphylococcus aureus subsp. aureus N315
ugcaagccaucaauau

SEQ ID NO: 4069441 - RNA, 19 nt, Staphylococcus aureus subsp. aureus N315
ugcaaguaauuuaauuggu

SEQ ID NO: 4069442 - RNA, 20 nt, Staphylococcus aureus subsp. aureus N315
ugcaaguccaaauaauaucu

SEQ ID NO: 4069443 - RNA, 17 nt, Staphylococcus aureus subsp. aureus N315
ugcaagucguucucuua

SEQ ID NO: 4069444 - RNA, 22 nt, Staphylococcus aureus subsp. aureus N315
ugcaagucguucucuuaaauau

SEQ ID NO: 4069445 - RNA, 14 nt, Staphylococcus aureus subsp. aureus N315
ugcaauaauaaaua

SEQ ID NO: 4069446 - RNA, 22 nt, Staphylococcus aureus subsp. aureus N315
ugcaauaauaaauaggaugaaa

SEQ ID NO: 4069447 - RNA, 16 nt, Staphylococcus aureus subsp. aureus N315
ugcaauaauucaucuu

SEQ ID NO: 4069448 - RNA, 18 nt, Staphylococcus aureus subsp. aureus N315
ugcaauacaccuauuaca

SEQ ID NO: 4069449 - RNA, 15 nt, Staphylococcus aureus subsp. aureus N315
ugcaauacauuaaua

SEQ ID NO: 4069450 - RNA, 17 nt, Staphylococcus aureus subsp. aureus N315
ugcaauaggaugaaacu

SEQ ID NO: 4069451 - RNA, 15 nt, Staphylococcus aureus subsp. aureus N315
ugcaaucguauguaa

SEQ ID NO: 4069452 - RNA, 20 nt, Staphylococcus aureus subsp. aureus N315
ugcaaucguauguaacaauu

SEQ ID NO: 4069453 - RNA, 15 nt, Staphylococcus aureus subsp. aureus N315
ugcaaucguugaaaa

SEQ ID NO: 4069454 - RNA, 11 nt, Staphylococcus aureus subsp. aureus N315
ugcaaugcaaa

SEQ ID NO: 4069455 - RNA, 14 nt, Staphylococcus aureus subsp. aureus N315
ugcaaugcaaaucu

SEQ ID NO: 4069456 - RNA, 19 nt, Staphylococcus aureus subsp. aureus N315
ugcaauuaauguaaugaua

SEQ ID NO: 4069457 - RNA, 23 nt, Staphylococcus aureus subsp. aureus N315
ugcaauuauuuuucaaauauauc

SEQ ID NO: 4069458 - RNA, 14 nt, Staphylococcus aureus subsp. aureus N315
ugcaauugccuuau

SEQ ID NO: 4069459 - RNA, 20 nt, Staphylococcus aureus subsp. aureus N315
ugcaauugccuuaucagcau

SEQ ID NO: 4069460 - RNA, 11 nt, Staphylococcus aureus subsp. aureus N315
ugcaauuugua

SEQ ID NO: 4069461 - RNA, 14 nt, Staphylococcus aureus subsp. aureus N315
ugcaauuuguaaua

SEQ ID NO: 4069462 - RNA, 21 nt, Staphylococcus aureus subsp. aureus N315
ugcaauuuuucacuuauaaca

SEQ ID NO: 4069463 - RNA, 12 nt, Staphylococcus aureus subsp. aureus N315
ugcacaacaguc

SEQ ID NO: 4069464 - RNA, 21 nt, Staphylococcus aureus subsp. aureus N315
ugcacauaaaaaaugugaccu

SEQ ID NO: 4069465 - RNA, 23 nt, Staphylococcus aureus subsp. aureus N315
ugcacaucauaauaaaucuaucu

SEQ ID NO: 4069466 - RNA, 14 nt, Staphylococcus aureus subsp. aureus N315
ugcacauuccaucu

SEQ ID NO: 4069467 - RNA, 18 nt, Staphylococcus aureus subsp. aureus N315
ugcaccuaaggcuaauga

SEQ ID NO: 4069468 - RNA, 14 nt, Staphylococcus aureus subsp. aureus N315
ugcaccuauaccuc

SEQ ID NO: 4069469 - RNA, 17 nt, Staphylococcus aureus subsp. aureus N315
ugcaccuuuacaacaua

SEQ ID NO: 4069470 - RNA, 14 nt, Staphylococcus aureus subsp. aureus N315
ugcacgagcaacau

SEQ ID NO: 4069471 - RNA, 23 nt, Staphylococcus aureus subsp. aureus N315
ugcacuaauggcacuuaauauaa

SEQ ID NO: 4069472 - RNA, 18 nt, Staphylococcus aureus subsp. aureus N315
ugcacugcuaauauuaga

SEQ ID NO: 4069473 - RNA, 17 nt, Staphylococcus aureus subsp. aureus N315
ugcacuugguucauaau

SEQ ID NO: 4069474 - RNA, 15 nt, Staphylococcus aureus subsp. aureus N315
ugcacuuuaacauaa

SEQ ID NO: 4069475 - RNA, 17 nt, Staphylococcus aureus subsp. aureus N315
ugcacuuuaacauaacu

SEQ ID NO: 4069476 - RNA, 15 nt, Staphylococcus aureus subsp. aureus N315
ugcagaacguucuaa

SEQ ID NO: 4069477 - RNA, 14 nt, Staphylococcus aureus subsp. aureus N315
ugcagauaauugaa

SEQ ID NO: 4069478 - RNA, 15 nt, Staphylococcus aureus subsp. aureus N315
ugcagauuagguuac

SEQ ID NO: 4069479 - RNA, 20 nt, Staphylococcus aureus subsp. aureus N315
ugcagauucuucaccaacuu

SEQ ID NO: 4069480 - RNA, 20 nt, Staphylococcus aureus subsp. aureus N315
ugcagauugauauaaauuau

SEQ ID NO: 4069481 - RNA, 23 nt, Staphylococcus aureus subsp. aureus N315
ugcagcaacugcauuacgcuguc

SEQ ID NO: 4069482 - RNA, 16 nt, Staphylococcus aureus subsp. aureus N315
ugcagcuguauaacca

SEQ ID NO: 4069483 - RNA, 21 nt, Staphylococcus aureus subsp. aureus N315
ugcaggcaucauaucauacca

SEQ ID NO: 4069484 - RNA, 22 nt, Staphylococcus aureus subsp. aureus N315
ugcaguuucaaucgcauuuugu

SEQ ID NO: 4069485 - RNA, 13 nt, Staphylococcus aureus subsp. aureus N315
ugcauaaaaaaag

SEQ ID NO: 4069486 - RNA, 16 nt, Staphylococcus aureus subsp. aureus N315
ugcauaagaaauacua

SEQ ID NO: 4069487 - RNA, 14 nt, Staphylococcus aureus subsp. aureus N315
ugcauaaucaauuu

SEQ ID NO: 4069488 - RNA, 14 nt, Staphylococcus aureus subsp. aureus N315
ugcuauuuuggaua

SEQ ID NO: 4069489 - RNA, 14 nt, Staphylococcus aureus subsp. aureus N315
ugcucagugcauuu

SEQ ID NO: 4069490 - RNA, 14 nt, Staphylococcus aureus subsp. aureus N315
ugcucguauagaaa

SEQ ID NO: 4069491 - RNA, 13 nt, Staphylococcus aureus subsp. aureus N315
ugcucuaagcauu

SEQ ID NO: 4069492 - RNA, 20 nt, Staphylococcus aureus subsp. aureus N315
ugcucuaauccaaaauaauc

SEQ ID NO: 4069493 - RNA, 17 nt, Staphylococcus aureus subsp. aureus N315
ugcucuaauucaaugau

SEQ ID NO: 4069494 - RNA, 14 nt, Staphylococcus aureus subsp. aureus N315
ugcucuacaaaguu

SEQ ID NO: 4069495 - RNA, 20 nt, Staphylococcus aureus subsp. aureus N315
ugcugaaucgaguuugaaau

SEQ ID NO: 4069496 - RNA, 23 nt, Staphylococcus aureus subsp. aureus N315
ugcugauaauuuuucuucuuuuu

SEQ ID NO: 4069497 - RNA, 19 nt, Staphylococcus aureus subsp. aureus N315
ugcugauaccuaagcugau

SEQ ID NO: 4069498 - RNA, 18 nt, Staphylococcus aureus subsp. aureus N315
ugcugccaaaaaguauuc

SEQ ID NO: 4069499 - RNA, 14 nt, Staphylococcus aureus subsp. aureus N315
ugcugccaaauaua

SEQ ID NO: 4069500 - RNA, 19 nt, Staphylococcus aureus subsp. aureus N315
ugcugccaaauauaauuuc

SEQ ID NO: 4069501 - RNA, 18 nt, Staphylococcus aureus subsp. aureus N315
ugcugcuaaaauaacaac

SEQ ID NO: 4069502 - RNA, 18 nt, Staphylococcus aureus subsp. aureus N315
ugcugcuguacaauuucg

SEQ ID NO: 4069503 - RNA, 15 nt, Staphylococcus aureus subsp. aureus N315
ugcugguaacucuuc

SEQ ID NO: 4069504 - RNA, 19 nt, Staphylococcus aureus subsp. aureus N315
ugcugguugcuucuuauca

SEQ ID NO: 4069505 - RNA, 23 nt, Staphylococcus aureus subsp. aureus N315
ugcuguacguuuaauaccuauga

SEQ ID NO: 4069506 - RNA, 18 nt, Staphylococcus aureus subsp. aureus N315
ugcuguacuauauucaau

SEQ ID NO: 4069507 - RNA, 19 nt, Staphylococcus aureus subsp. aureus N315
ugcuguauauauauguaaa

SEQ ID NO: 4069508 - RNA, 12 nt, Staphylococcus aureus subsp. aureus N315
ugcuguaucuuc

SEQ ID NO: 4069509 - RNA, 19 nt, Staphylococcus aureus subsp. aureus N315
ugcugucaaacaacaauca

SEQ ID NO: 4069510 - RNA, 19 nt, Staphylococcus aureus subsp. aureus N315
ugcuguucucuauuuauaa

SEQ ID NO: 4069511 - RNA, 13 nt, Staphylococcus aureus subsp. aureus N315
ugcuguucuuuuu

SEQ ID NO: 4069512 - RNA, 18 nt, Staphylococcus aureus subsp. aureus N315
ugcuguuuuuauuauaau

SEQ ID NO: 4069513 - RNA, 17 nt, Staphylococcus aureus subsp. aureus N315
ugcuuaauuuauguguu

SEQ ID NO: 4069514 - RNA, 19 nt, Staphylococcus aureus subsp. aureus N315
ugcuuaauuuguuuuaaau

SEQ ID NO: 4069515 - RNA, 15 nt, Staphylococcus aureus subsp. aureus N315
ugcuuacuuuuaaaa

SEQ ID NO: 4069516 - RNA, 14 nt, Staphylococcus aureus subsp. aureus N315
ugcuuaguacacgu

SEQ ID NO: 4069517 - RNA, 19 nt, Staphylococcus aureus subsp. aureus N315
ugcuuaguacacguguauu

SEQ ID NO: 4069518 - RNA, 16 nt, Staphylococcus aureus subsp. aureus N315
ugcuuauguuuuuaac

SEQ ID NO: 4069519 - RNA, 17 nt, Staphylococcus aureus subsp. aureus N315
ugcuuauuuguuuauua

SEQ ID NO: 4069520 - RNA, 19 nt, Staphylococcus aureus subsp. aureus N315
ugcuuauuuuuguauucuu

SEQ ID NO: 4069521 - RNA, 13 nt, Staphylococcus aureus subsp. aureus N315
ugcuucaaagccu

SEQ ID NO: 4069522 - RNA, 18 nt, Staphylococcus aureus subsp. aureus N315
ugcuucaaauguaacauu

SEQ ID NO: 4069523 - RNA, 22 nt, Staphylococcus aureus subsp. aureus N315
ugcuucaaauguaacauuaaaa

SEQ ID NO: 4069524 - RNA, 13 nt, Staphylococcus aureus subsp. aureus N315
ugcuucacugaaa

SEQ ID NO: 4069525 - RNA, 20 nt, Staphylococcus aureus subsp. aureus N315
ugcuucauuauauaauucuu

SEQ ID NO: 4069526 - RNA, 18 nt, Staphylococcus aureus subsp. aureus N315
ugcuuccacuucaucuaa

SEQ ID NO: 4069527 - RNA, 20 nt, Staphylococcus aureus subsp. aureus N315
ugcuucgcacaacugcauaa

SEQ ID NO: 4069528 - RNA, 15 nt, Staphylococcus aureus subsp. aureus N315
ugcuucgucauuagg

SEQ ID NO: 4069529 - RNA, 18 nt, Staphylococcus aureus subsp. aureus N315
ugcuucguuuuuaguguu

SEQ ID NO: 4069530 - RNA, 17 nt, Staphylococcus aureus subsp. aureus N315
ugcuucucacaacugca

SEQ ID NO: 4069531 - RNA, 13 nt, Staphylococcus aureus subsp. aureus N315
ugcuucugcugua

SEQ ID NO: 4069532 - RNA, 17 nt, Staphylococcus aureus subsp. aureus N315
ugcuucugguucuucaa

SEQ ID NO: 4069533 - RNA, 18 nt, Staphylococcus aureus subsp. aureus N315
ugcuucugguucuucaau

SEQ ID NO: 4069534 - RNA, 20 nt, Staphylococcus aureus subsp. aureus N315
ugcuucuguaaacgauacug

SEQ ID NO: 4069535 - RNA, 12 nt, Staphylococcus aureus subsp. aureus N315
ugcuucuuauca

SEQ ID NO: 4069536 - RNA, 15 nt, Staphylococcus aureus subsp. aureus N315
ugcuucuuuuaagua

SEQ ID NO: 4069537 - RNA, 21 nt, Staphylococcus aureus subsp. aureus N315
ugcuugaaauuauuauuuaaa

SEQ ID NO: 4069538 - RNA, 17 nt, Staphylococcus aureus subsp. aureus N315
ugcuugaccuucaguuu

SEQ ID NO: 4069539 - RNA, 14 nt, Staphylococcus aureus subsp. aureus N315
ugcuugguuugauu

SEQ ID NO: 4069540 - RNA, 13 nt, Staphylococcus aureus subsp. aureus N315
ugcuuguaacaag

SEQ ID NO: 4069541 - RNA, 12 nt, Staphylococcus aureus subsp. aureus N315
ugcuuguuacac

SEQ ID NO: 4069542 - RNA, 14 nt, Staphylococcus aureus subsp. aureus N315
ugcuuguuuuaaau

SEQ ID NO: 4069543 - RNA, 15 nt, Staphylococcus aureus subsp. aureus N315
ugcuuuaaacuuaua

SEQ ID NO: 4069544 - RNA, 18 nt, Staphylococcus aureus subsp. aureus N315
ugcuuuaaacuuauaaau

SEQ ID NO: 4069545 - RNA, 12 nt, Staphylococcus aureus subsp. aureus N315
ugcuuuaaaucg

SEQ ID NO: 4069546 - RNA, 13 nt, Staphylococcus aureus subsp. aureus N315
ugcuuuaacugua

SEQ ID NO: 4069547 - RNA, 14 nt, Staphylococcus aureus subsp. aureus N315
ugcuuuaacuguac

SEQ ID NO: 4069548 - RNA, 13 nt, Staphylococcus aureus subsp. aureus N315
ugcuuuaauaaau

SEQ ID NO: 4069549 - RNA, 14 nt, Staphylococcus aureus subsp. aureus N315
ugcuuuaauaaauc

SEQ ID NO: 4069550 - RNA, 13 nt, Staphylococcus aureus subsp. aureus N315
ugcuuuaauauaa

SEQ ID NO: 4069551 - RNA, 20 nt, Staphylococcus aureus subsp. aureus N315
ugcuuuaauauaauuauuaa

SEQ ID NO: 4069552 - RNA, 16 nt, Staphylococcus aureus subsp. aureus N315
ugcuuuaauuaaaguu

SEQ ID NO: 4069553 - RNA, 23 nt, Staphylococcus aureus subsp. aureus N315
ugcuuuaauuugauuaaauucuu

SEQ ID NO: 4069554 - RNA, 17 nt, Staphylococcus aureus subsp. aureus N315
ugcuuuagcucuuuuuu

SEQ ID NO: 4069555 - RNA, 20 nt, Staphylococcus aureus subsp. aureus N315
ugcuuucacauuguuuacaa

SEQ ID NO: 4069556 - RNA, 17 nt, Staphylococcus aureus subsp. aureus N315
ugcuuuggaguuucuuc

SEQ ID NO: 4069557 - RNA, 13 nt, Staphylococcus aureus subsp. aureus N315
ugcuuuuaaaugu

SEQ ID NO: 4069558 - RNA, 14 nt, Staphylococcus aureus subsp. aureus N315
ugcuuuuaaaugua

SEQ ID NO: 4069559 - RNA, 20 nt, Staphylococcus aureus subsp. aureus N315
ugcuuuuaaauguauuuuua

SEQ ID NO: 4069560 - RNA, 16 nt, Staphylococcus aureus subsp. aureus N315
ugcuuuuaauaguguu

SEQ ID NO: 4069561 - RNA, 13 nt, Staphylococcus aureus subsp. aureus N315
ugcuuuuaauauu

SEQ ID NO: 4069562 - RNA, 18 nt, Staphylococcus aureus subsp. aureus N315
ugcuuuuaauauuauaaa

SEQ ID NO: 4069563 - RNA, 20 nt, Staphylococcus aureus subsp. aureus N315
ugcuuuuaauauuauaaacc

SEQ ID NO: 4069564 - RNA, 17 nt, Staphylococcus aureus subsp. aureus N315
ugcuuuuccauaaauau

SEQ ID NO: 4069565 - RNA, 18 nt, Staphylococcus aureus subsp. aureus N315
ugcuuuuuauuaugcuuc

SEQ ID NO: 4069566 - RNA, 20 nt, Staphylococcus aureus subsp. aureus N315
ugcuuuuuguguaucuguaa

SEQ ID NO: 4069567 - RNA, 13 nt, Staphylococcus aureus subsp. aureus N315
ugcuuuuuuaaau

SEQ ID NO: 4069568 - RNA, 21 nt, Staphylococcus aureus subsp. aureus N315
ugcuuuuuuaaauuuaauuuc

SEQ ID NO: 4069569 - RNA, 18 nt, Staphylococcus aureus subsp. aureus N315
ugcuuuuuuauucuaaua

SEQ ID NO: 4069570 - RNA, 18 nt, Staphylococcus aureus subsp. aureus N315
uggaaaaggucaaaaaau

SEQ ID NO: 4069571 - RNA, 23 nt, Staphylococcus aureus subsp. aureus N315
uggaaagacguuuuuuuauaaau

SEQ ID NO: 4069572 - RNA, 22 nt, Staphylococcus aureus subsp. aureus N315
uggaaaguaauaaguaauaauu

SEQ ID NO: 4069573 - RNA, 13 nt, Staphylococcus aureus subsp. aureus N315
uggaaagucagcu

SEQ ID NO: 4069574 - RNA, 15 nt, Staphylococcus aureus subsp. aureus N315
uggaaagucagcuua

SEQ ID NO: 4069575 - RNA, 14 nt, Staphylococcus aureus subsp. aureus N315
uggaaauuuauuau

SEQ ID NO: 4069576 - RNA, 17 nt, Staphylococcus aureus subsp. aureus N315
uggucuauuuuauaaaa

SEQ ID NO: 4069577 - RNA, 18 nt, Staphylococcus aureus subsp. aureus N315
uggucugauuuugcauuu

SEQ ID NO: 4069578 - RNA, 13 nt, Staphylococcus aureus subsp. aureus N315
uggucuuucuuag

SEQ ID NO: 4069579 - RNA, 16 nt, Staphylococcus aureus subsp. aureus N315
uggugagaaauugaau

SEQ ID NO: 4069580 - RNA, 20 nt, Staphylococcus aureus subsp. aureus N315
ugguggagaaccuuuaaaag

SEQ ID NO: 4069581 - RNA, 15 nt, Staphylococcus aureus subsp. aureus N315
ugguuaacauccugc

SEQ ID NO: 4069582 - RNA, 19 nt, Staphylococcus aureus subsp. aureus N315
ugguuagagaaaaaucugu

SEQ ID NO: 4069583 - RNA, 14 nt, Staphylococcus aureus subsp. aureus N315
ugguucaaaaauca

SEQ ID NO: 4069584 - RNA, 14 nt, Staphylococcus aureus subsp. aureus N315
ugguucauaaugau

SEQ ID NO: 4069585 - RNA, 19 nt, Staphylococcus aureus subsp. aureus N315
ugguucaucaaacaacauc

SEQ ID NO: 4069586 - RNA, 13 nt, Staphylococcus aureus subsp. aureus N315
ugguucuucuuuc

SEQ ID NO: 4069587 - RNA, 14 nt, Staphylococcus aureus subsp. aureus N315
ugguucuuuacuaa

SEQ ID NO: 4069588 - RNA, 19 nt, Staphylococcus aureus subsp. aureus N315
ugguugauucgauaugaau

SEQ ID NO: 4069589 - RNA, 13 nt, Staphylococcus aureus subsp. aureus N315
ugguugcuucuua

SEQ ID NO: 4069590 - RNA, 15 nt, Staphylococcus aureus subsp. aureus N315
ugguugcuucuuauc

SEQ ID NO: 4069591 - RNA, 14 nt, Staphylococcus aureus subsp. aureus N315
ugguuguucuuuuu

SEQ ID NO: 4069592 - RNA, 20 nt, Staphylococcus aureus subsp. aureus N315
ugguuucuuaacauaaaaug

SEQ ID NO: 4069593 - RNA, 21 nt, Staphylococcus aureus subsp. aureus N315
ugguuucuuaacauaaaauga

SEQ ID NO: 4069594 - RNA, 22 nt, Staphylococcus aureus subsp. aureus N315
ugguuugcuuuaaaauucucua

SEQ ID NO: 4069595 - RNA, 17 nt, Staphylococcus aureus subsp. aureus N315
ugguuuggauaaaauga

SEQ ID NO: 4069596 - RNA, 12 nt, Staphylococcus aureus subsp. aureus N315
ugguuuuacugc

SEQ ID NO: 4069597 - RNA, 12 nt, Staphylococcus aureus subsp. aureus N315
ugguuuuauuaa

SEQ ID NO: 4069598 - RNA, 16 nt, Staphylococcus aureus subsp. aureus N315
ugguuuuuagugaaaa

SEQ ID NO: 4069599 - RNA, 12 nt, Staphylococcus aureus subsp. aureus N315
uguaaaaaauau

SEQ ID NO: 4069600 - RNA, 13 nt, Staphylococcus aureus subsp. aureus N315
uguaaaaaauauc

SEQ ID NO: 4069601 - RNA, 16 nt, Staphylococcus aureus subsp. aureus N315
uguaaaaaauaucuug

SEQ ID NO: 4069602 - RNA, 23 nt, Staphylococcus aureus subsp. aureus N315
uguaaaacaaugcccguguaaca

SEQ ID NO: 4069603 - RNA, 22 nt, Staphylococcus aureus subsp. aureus N315
uguaaaacauucccuuaauaau

SEQ ID NO: 4069604 - RNA, 19 nt, Staphylococcus aureus subsp. aureus N315
uguaaaacuaaguuauuua

SEQ ID NO: 4069605 - RNA, 12 nt, Staphylococcus aureus subsp. aureus N315
uguaaaaugcuc

SEQ ID NO: 4069606 - RNA, 20 nt, Staphylococcus aureus subsp. aureus N315
uguaaaaugcucccuucaaa

SEQ ID NO: 4069607 - RNA, 21 nt, Staphylococcus aureus subsp. aureus N315
uguaaaccagcuaaaccaucu

SEQ ID NO: 4069608 - RNA, 11 nt, Staphylococcus aureus subsp. aureus N315
uguaaagacac

SEQ ID NO: 4069609 - RNA, 20 nt, Staphylococcus aureus subsp. aureus N315
uguaaagcaugaauagcuug

SEQ ID NO: 4069610 - RNA, 23 nt, Staphylococcus aureus subsp. aureus N315
uguaaagcaugaauagcuuguug

SEQ ID NO: 4069611 - RNA, 21 nt, Staphylococcus aureus subsp. aureus N315
uguaaagcuaauuuuuuauuu

SEQ ID NO: 4069612 - RNA, 20 nt, Staphylococcus aureus subsp. aureus N315
uguaaagcuuuaguuaaaua

SEQ ID NO: 4069613 - RNA, 15 nt, Staphylococcus aureus subsp. aureus N315
uguaaauaacaguua

SEQ ID NO: 4069614 - RNA, 19 nt, Staphylococcus aureus subsp. aureus N315
uguaaauaacaguuaauua

SEQ ID NO: 4069615 - RNA, 14 nt, Staphylococcus aureus subsp. aureus N315
uguaaauauaaaua

SEQ ID NO: 4069616 - RNA, 14 nt, Staphylococcus aureus subsp. aureus N315
uguaaauauaguaa

SEQ ID NO: 4069617 - RNA, 14 nt, Staphylococcus aureus subsp. aureus N315
uguaaauaugaacu

SEQ ID NO: 4069618 - RNA, 23 nt, Staphylococcus aureus subsp. aureus N315
uguaaaucacgauuuucaaguaa

SEQ ID NO: 4069619 - RNA, 19 nt, Staphylococcus aureus subsp. aureus N315
uguaaauguuaaauucuaa

SEQ ID NO: 4069620 - RNA, 14 nt, Staphylococcus aureus subsp. aureus N315
uguaaauuacaaaa

SEQ ID NO: 4069621 - RNA, 20 nt, Staphylococcus aureus subsp. aureus N315
uguaaauuuauuuuuaauuu

SEQ ID NO: 4069622 - RNA, 20 nt, Staphylococcus aureus subsp. aureus N315
uguaacaaaauacccugcuu

SEQ ID NO: 4069623 - RNA, 18 nt, Staphylococcus aureus subsp. aureus N315
uguaacacacuuauaauc

SEQ ID NO: 4069624 - RNA, 23 nt, Staphylococcus aureus subsp. aureus N315
uguaacacacuuauaaucuauaa

SEQ ID NO: 4069625 - RNA, 14 nt, Staphylococcus aureus subsp. aureus N315
uguaaccaccugau

SEQ ID NO: 4069626 - RNA, 16 nt, Staphylococcus aureus subsp. aureus N315
uguaaccuaaaaacaa

SEQ ID NO: 4069627 - RNA, 14 nt, Staphylococcus aureus subsp. aureus N315
uguaacguacaauu

SEQ ID NO: 4069628 - RNA, 22 nt, Staphylococcus aureus subsp. aureus N315
uguaagcuaucguaaacaacau

SEQ ID NO: 4069629 - RNA, 22 nt, Staphylococcus aureus subsp. aureus N315
uguaaguuauuuggauauuuau

SEQ ID NO: 4069630 - RNA, 18 nt, Staphylococcus aureus subsp. aureus N315
uguaaguuugguuucuua

SEQ ID NO: 4069631 - RNA, 18 nt, Staphylococcus aureus subsp. aureus N315
uguaauaaagaauaaaca

SEQ ID NO: 4069632 - RNA, 16 nt, Staphylococcus aureus subsp. aureus N315
uguaauaauaaucuuu

SEQ ID NO: 4069633 - RNA, 18 nt, Staphylococcus aureus subsp. aureus N315
uguaauaauaaucuuuaa

SEQ ID NO: 4069634 - RNA, 18 nt, Staphylococcus aureus subsp. aureus N315
uguaauaauaucaccuuu

SEQ ID NO: 4069635 - RNA, 13 nt, Staphylococcus aureus subsp. aureus N315
uguaauaauuauu

SEQ ID NO: 4069636 - RNA, 16 nt, Staphylococcus aureus subsp. aureus N315
uguaauaauuauuaau

SEQ ID NO: 4069637 - RNA, 14 nt, Staphylococcus aureus subsp. aureus N315
uguaauacaagcaa

SEQ ID NO: 4069638 - RNA, 15 nt, Staphylococcus aureus subsp. aureus N315
uguaauacaucuaau

SEQ ID NO: 4069639 - RNA, 19 nt, Staphylococcus aureus subsp. aureus N315
uguaauacaugacauucau

SEQ ID NO: 4069640 - RNA, 21 nt, Staphylococcus aureus subsp. aureus N315
uguaauaccaauuuuuagcau

SEQ ID NO: 4069641 - RNA, 17 nt, Staphylococcus aureus subsp. aureus N315
uguaauaccuuuacuuu

SEQ ID NO: 4069642 - RNA, 19 nt, Staphylococcus aureus subsp. aureus N315
uguaauccgcagaccacau

SEQ ID NO: 4069643 - RNA, 16 nt, Staphylococcus aureus subsp. aureus N315
uguaauccuugagcuc

SEQ ID NO: 4069644 - RNA, 19 nt, Staphylococcus aureus subsp. aureus N315
uguaaucucguuuuuacau

SEQ ID NO: 4069645 - RNA, 13 nt, Staphylococcus aureus subsp. aureus N315
uguaaugauauua

SEQ ID NO: 4069646 - RNA, 15 nt, Staphylococcus aureus subsp. aureus N315
uguaaugcuuaaaaa

SEQ ID NO: 4069647 - RNA, 18 nt, Staphylococcus aureus subsp. aureus N315
uguaaugcuuaaaaacaa

SEQ ID NO: 4069648 - RNA, 21 nt, Staphylococcus aureus subsp. aureus N315
uguaauguuccccugaaaaga

SEQ ID NO: 4069649 - RNA, 13 nt, Staphylococcus aureus subsp. aureus N315
uguaauuaggauu

SEQ ID NO: 4069650 - RNA, 18 nt, Staphylococcus aureus subsp. aureus N315
uguaauuguuuuuucuua

SEQ ID NO: 4069651 - RNA, 13 nt, Staphylococcus aureus subsp. aureus N315
uguaauuuaaaau

SEQ ID NO: 4069652 - RNA, 23 nt, Staphylococcus aureus subsp. aureus N315
uguacaaccuuugcuuaaaccuu

SEQ ID NO: 4069653 - RNA, 12 nt, Staphylococcus aureus subsp. aureus N315
uguacaauaauu

SEQ ID NO: 4069654 - RNA, 17 nt, Staphylococcus aureus subsp. aureus N315
uguacaauaauuaguca

SEQ ID NO: 4069655 - RNA, 18 nt, Staphylococcus aureus subsp. aureus N315
uguacaauuuuuaaaaac

SEQ ID NO: 4069656 - RNA, 20 nt, Staphylococcus aureus subsp. aureus N315
uguacacauccucauaauua

SEQ ID NO: 4069657 - RNA, 21 nt, Staphylococcus aureus subsp. aureus N315
uguacacuaucguuuuuauua

SEQ ID NO: 4069658 - RNA, 14 nt, Staphylococcus aureus subsp. aureus N315
uguacacuuuugau

SEQ ID NO: 4069659 - RNA, 14 nt, Staphylococcus aureus subsp. aureus N315
uguacauaugugua

SEQ ID NO: 4069660 - RNA, 14 nt, Staphylococcus aureus subsp. aureus N315
uguacaucauuaaa

SEQ ID NO: 4069661 - RNA, 17 nt, Staphylococcus aureus subsp. aureus N315
uguacaucauuaaauau

SEQ ID NO: 4069662 - RNA, 19 nt, Staphylococcus aureus subsp. aureus N315
uguacauccacuuuauaau

SEQ ID NO: 4069663 - RNA, 15 nt, Staphylococcus aureus subsp. aureus N315
uguacauguauaaaa

SEQ ID NO: 4069664 - RNA, 21 nt, Staphylococcus aureus subsp. aureus N315
ugucuaaucgacuuuuacaau

SEQ ID NO: 4069665 - RNA, 16 nt, Staphylococcus aureus subsp. aureus N315
ugucuagacuuauuug

SEQ ID NO: 4069666 - RNA, 17 nt, Staphylococcus aureus subsp. aureus N315
ugucuagacuuauuuga

SEQ ID NO: 4069667 - RNA, 23 nt, Staphylococcus aureus subsp. aureus N315
ugucuagacuuauuugaaugcaa

SEQ ID NO: 4069668 - RNA, 19 nt, Staphylococcus aureus subsp. aureus N315
ugucuaguucgauuuuuua

SEQ ID NO: 4069669 - RNA, 21 nt, Staphylococcus aureus subsp. aureus N315
ugucuaguucgauuuuuuaau

SEQ ID NO: 4069670 - RNA, 14 nt, Staphylococcus aureus subsp. aureus N315
ugucuauuguaaaa

SEQ ID NO: 4069671 - RNA, 23 nt, Staphylococcus aureus subsp. aureus N315
ugucucaauaauguuacgcugug

SEQ ID NO: 4069672 - RNA, 14 nt, Staphylococcus aureus subsp. aureus N315
ugucucaucauuua

SEQ ID NO: 4069673 - RNA, 17 nt, Staphylococcus aureus subsp. aureus N315
ugucucaucauuuaaaa

SEQ ID NO: 4069674 - RNA, 18 nt, Staphylococcus aureus subsp. aureus N315
ugucucgacuucagauac

SEQ ID NO: 4069675 - RNA, 17 nt, Staphylococcus aureus subsp. aureus N315
ugucucucuuucuuauu

SEQ ID NO: 4069676 - RNA, 17 nt, Staphylococcus aureus subsp. aureus N315
ugucucuuuucacgaau

SEQ ID NO: 4069677 - RNA, 21 nt, Staphylococcus aureus subsp. aureus N315
ugucuuaggcgcuacaauguu

SEQ ID NO: 4069678 - RNA, 14 nt, Staphylococcus aureus subsp. aureus N315
ugucuuugaacaua

SEQ ID NO: 4069679 - RNA, 17 nt, Staphylococcus aureus subsp. aureus N315
ugucuuuuauuaugaua

SEQ ID NO: 4069680 - RNA, 15 nt, Staphylococcus aureus subsp. aureus N315
ugugaauaaaauugu

SEQ ID NO: 4069681 - RNA, 19 nt, Staphylococcus aureus subsp. aureus N315
ugugaauaugcuuuuaaua

SEQ ID NO: 4069682 - RNA, 18 nt, Staphylococcus aureus subsp. aureus N315
ugugaauguuuucuaaau

SEQ ID NO: 4069683 - RNA, 14 nt, Staphylococcus aureus subsp. aureus N315
ugugaauguuuugu

SEQ ID NO: 4069684 - RNA, 14 nt, Staphylococcus aureus subsp. aureus N315
ugugauaauucuuc

SEQ ID NO: 4069685 - RNA, 15 nt, Staphylococcus aureus subsp. aureus N315
ugugauacuuucuaa

SEQ ID NO: 4069686 - RNA, 17 nt, Staphylococcus aureus subsp. aureus N315
ugugauguacuacuuua

SEQ ID NO: 4069687 - RNA, 13 nt, Staphylococcus aureus subsp. aureus N315
ugugauuauaaau

SEQ ID NO: 4069688 - RNA, 15 nt, Staphylococcus aureus subsp. aureus N315
ugugauuuuuugaua

SEQ ID NO: 4069689 - RNA, 14 nt, Staphylococcus aureus subsp. aureus N315
ugugcaaaaguuug

SEQ ID NO: 4069690 - RNA, 23 nt, Staphylococcus aureus subsp. aureus N315
ugugcaauuagaauauauguaua

SEQ ID NO: 4069691 - RNA, 18 nt, Staphylococcus aureus subsp. aureus N315
ugugccggcuuuuucuuu

SEQ ID NO: 4069692 - RNA, 15 nt, Staphylococcus aureus subsp. aureus N315
ugugccuuucuaaua

SEQ ID NO: 4069693 - RNA, 14 nt, Staphylococcus aureus subsp. aureus N315
ugugccuuucucua

SEQ ID NO: 4069694 - RNA, 20 nt, Staphylococcus aureus subsp. aureus N315
ugugccuuugcuuuuuauuu

SEQ ID NO: 4069695 - RNA, 19 nt, Staphylococcus aureus subsp. aureus N315
ugugcucauuuuuuuaauu

SEQ ID NO: 4069696 - RNA, 14 nt, Staphylococcus aureus subsp. aureus N315
ugugcuguucuauu

SEQ ID NO: 4069697 - RNA, 18 nt, Staphylococcus aureus subsp. aureus N315
ugugcuguucuauuccac

SEQ ID NO: 4069698 - RNA, 13 nt, Staphylococcus aureus subsp. aureus N315
ugugcuuaagaac

SEQ ID NO: 4069699 - RNA, 14 nt, Staphylococcus aureus subsp. aureus N315
uguggauacaaacc

SEQ ID NO: 4069700 - RNA, 23 nt, Staphylococcus aureus subsp. aureus N315
uguggauguaggcuuuuuuauua

SEQ ID NO: 4069701 - RNA, 17 nt, Staphylococcus aureus subsp. aureus N315
uguggauucucuuuaua

SEQ ID NO: 4069702 - RNA, 17 nt, Staphylococcus aureus subsp. aureus N315
uguggcggugguauggu

SEQ ID NO: 4069703 - RNA, 16 nt, Staphylococcus aureus subsp. aureus N315
ugugggcguucugcua

SEQ ID NO: 4069704 - RNA, 21 nt, Staphylococcus aureus subsp. aureus N315
uguguaaauauaaauaugaau

SEQ ID NO: 4069705 - RNA, 22 nt, Staphylococcus aureus subsp. aureus N315
uguguacguuucaauguaucaa

SEQ ID NO: 4069706 - RNA, 21 nt, Staphylococcus aureus subsp. aureus N315
uguguaucaguuauuuuaaua

SEQ ID NO: 4069707 - RNA, 16 nt, Staphylococcus aureus subsp. aureus N315
uguguaugaucaagcu

SEQ ID NO: 4069708 - RNA, 16 nt, Staphylococcus aureus subsp. aureus N315
uguguauuuuuauugu

SEQ ID NO: 4069709 - RNA, 11 nt, Staphylococcus aureus subsp. aureus N315
ugugucaacuu

SEQ ID NO: 4069710 - RNA, 14 nt, Staphylococcus aureus subsp. aureus N315
uguguguuuuaaaa

SEQ ID NO: 4069711 - RNA, 14 nt, Staphylococcus aureus subsp. aureus N315
uguguuaaaauaua

SEQ ID NO: 4069712 - RNA, 13 nt, Staphylococcus aureus subsp. aureus N315
uguguugcaauug

SEQ ID NO: 4069713 - RNA, 17 nt, Staphylococcus aureus subsp. aureus N315
uguguuggugcuauuaa

SEQ ID NO: 4069714 - RNA, 22 nt, Staphylococcus aureus subsp. aureus N315
uguguuguuucaggauaaugaa

SEQ ID NO: 4069715 - RNA, 21 nt, Staphylococcus aureus subsp. aureus N315
uguguuuaggaggaauaccca

SEQ ID NO: 4069716 - RNA, 13 nt, Staphylococcus aureus subsp. aureus N315
uguguuucagcuu

SEQ ID NO: 4069717 - RNA, 16 nt, Staphylococcus aureus subsp. aureus N315
uguguuucuuuuauuu

SEQ ID NO: 4069718 - RNA, 21 nt, Staphylococcus aureus subsp. aureus N315
uguguuucuuuuauuuucaua

SEQ ID NO: 4069719 - RNA, 17 nt, Staphylococcus aureus subsp. aureus N315
uguguuugcuuuuauuu

SEQ ID NO: 4069720 - RNA, 18 nt, Staphylococcus aureus subsp. aureus N315
uguguuugcuuuuuacua

SEQ ID NO: 4069721 - RNA, 11 nt, Staphylococcus aureus subsp. aureus N315
uguguuuucaa

SEQ ID NO: 4069722 - RNA, 15 nt, Staphylococcus aureus subsp. aureus N315
uguuaaaauuugaau

SEQ ID NO: 4069723 - RNA, 18 nt, Staphylococcus aureus subsp. aureus N315
uguuaaaauuugaauuga

SEQ ID NO: 4069724 - RNA, 21 nt, Staphylococcus aureus subsp. aureus N315
uguuaaacccucauuuuuaua

SEQ ID NO: 4069725 - RNA, 22 nt, Staphylococcus aureus subsp. aureus N315
uguuaaacgcugauuuuauaaa

SEQ ID NO: 4069726 - RNA, 18 nt, Staphylococcus aureus subsp. aureus N315
uguuaaagauuauuauua

SEQ ID NO: 4069727 - RNA, 23 nt, Staphylococcus aureus subsp. aureus N315
uguuaaaggauggauacuuaaag

SEQ ID NO: 4069728 - RNA, 16 nt, Staphylococcus aureus subsp. aureus N315
uguuaaauucuaaaac

SEQ ID NO: 4069729 - RNA, 14 nt, Staphylococcus aureus subsp. aureus N315
uguuaacugaauuu

SEQ ID NO: 4069730 - RNA, 22 nt, Staphylococcus aureus subsp. aureus N315
uguuaagagguuuugcacuaau

SEQ ID NO: 4069731 - RNA, 16 nt, Staphylococcus aureus subsp. aureus N315
uguuaauaaccgaaau

SEQ ID NO: 4069732 - RNA, 13 nt, Staphylococcus aureus subsp. aureus N315
uguuaauacuuca

SEQ ID NO: 4069733 - RNA, 20 nt, Staphylococcus aureus subsp. aureus N315
uguuaaucaaaauuaugacu

SEQ ID NO: 4069734 - RNA, 20 nt, Staphylococcus aureus subsp. aureus N315
uguuaaugcuucguaaucuu

SEQ ID NO: 4069735 - RNA, 16 nt, Staphylococcus aureus subsp. aureus N315
uguuaaugucuucaua

SEQ ID NO: 4069736 - RNA, 13 nt, Staphylococcus aureus subsp. aureus N315
uguuaauuuaaua

SEQ ID NO: 4069737 - RNA, 16 nt, Staphylococcus aureus subsp. aureus N315
uguuaauuuaauaauu

SEQ ID NO: 4069738 - RNA, 18 nt, Staphylococcus aureus subsp. aureus N315
uguuaauuucaacauuac

SEQ ID NO: 4069739 - RNA, 16 nt, Staphylococcus aureus subsp. aureus N315
uguuaauuuuuuauua

SEQ ID NO: 4069740 - RNA, 23 nt, Staphylococcus aureus subsp. aureus N315
uguuacuaguuuguaauaauuaa

SEQ ID NO: 4069741 - RNA, 16 nt, Staphylococcus aureus subsp. aureus N315
uguuacugcacacaua

SEQ ID NO: 4069742 - RNA, 15 nt, Staphylococcus aureus subsp. aureus N315
uguuacuuauauauu

SEQ ID NO: 4069743 - RNA, 20 nt, Staphylococcus aureus subsp. aureus N315
uguuacuuauauauucaaua

SEQ ID NO: 4069744 - RNA, 13 nt, Staphylococcus aureus subsp. aureus N315
uguuaggggcuuu

SEQ ID NO: 4069745 - RNA, 16 nt, Staphylococcus aureus subsp. aureus N315
uguuaggggcuuuuau

SEQ ID NO: 4069746 - RNA, 14 nt, Staphylococcus aureus subsp. aureus N315
uguuagucuuuuua

SEQ ID NO: 4069747 - RNA, 18 nt, Staphylococcus aureus subsp. aureus N315
uguuagucuuuuuaagua

SEQ ID NO: 4069748 - RNA, 11 nt, Staphylococcus aureus subsp. aureus N315
uguuauaaaau

SEQ ID NO: 4069749 - RNA, 23 nt, Staphylococcus aureus subsp. aureus N315
uguuauaaauagagaacagcagu

SEQ ID NO: 4069750 - RNA, 20 nt, Staphylococcus aureus subsp. aureus N315
uguuauauuguauuuuauuu

SEQ ID NO: 4069751 - RNA, 15 nt, Staphylococcus aureus subsp. aureus N315
uguuaucuugcuuau

SEQ ID NO: 4069752 - RNA, 14 nt, Staphylococcus aureus subsp. aureus N315
uguuuuaaauacuu

SEQ ID NO: 4069753 - RNA, 15 nt, Staphylococcus aureus subsp. aureus N315
uguuuuaauaauauc

SEQ ID NO: 4069754 - RNA, 14 nt, Staphylococcus aureus subsp. aureus N315
uguuuuauagcauu

SEQ ID NO: 4069755 - RNA, 14 nt, Staphylococcus aureus subsp. aureus N315
uguuuuaucaauau

SEQ ID NO: 4069756 - RNA, 20 nt, Staphylococcus aureus subsp. aureus N315
uguuuucaacaguuuuaaag

SEQ ID NO: 4069757 - RNA, 13 nt, Staphylococcus aureus subsp. aureus N315
uguuuucaguaac

SEQ ID NO: 4069758 - RNA, 17 nt, Staphylococcus aureus subsp. aureus N315
uguuuuccaauaauaaa

SEQ ID NO: 4069759 - RNA, 15 nt, Staphylococcus aureus subsp. aureus N315
uguuuucuuuucaaa

SEQ ID NO: 4069760 - RNA, 17 nt, Staphylococcus aureus subsp. aureus N315
uguuuucuuuucaaaau

SEQ ID NO: 4069761 - RNA, 20 nt, Staphylococcus aureus subsp. aureus N315
uguuuugcgguuuuuuugau

SEQ ID NO: 4069762 - RNA, 20 nt, Staphylococcus aureus subsp. aureus N315
uguuuuggaaaaauuguggc

SEQ ID NO: 4069763 - RNA, 12 nt, Staphylococcus aureus subsp. aureus N315
uguuuuuaaaau

SEQ ID NO: 4069764 - RNA, 19 nt, Staphylococcus aureus subsp. aureus N315
uguuuuuaauguuugcuuu

SEQ ID NO: 4069765 - RNA, 15 nt, Staphylococcus aureus subsp. aureus N315
uguuuuuacaaaugu

SEQ ID NO: 4069766 - RNA, 13 nt, Staphylococcus aureus subsp. aureus N315
uguuuuuuaagua

SEQ ID NO: 4069767 - RNA, 10 nt, Staphylococcus aureus subsp. aureus N315
uuaaaaaaau

SEQ ID NO: 4069768 - RNA, 14 nt, Staphylococcus aureus subsp. aureus N315
uuaaaaaacaaaac

SEQ ID NO: 4069769 - RNA, 11 nt, Staphylococcus aureus subsp. aureus N315
uuaaaaaaccu

SEQ ID NO: 4069770 - RNA, 15 nt, Staphylococcus aureus subsp. aureus N315
uuaaaaaaccugaaa

SEQ ID NO: 4069771 - RNA, 18 nt, Staphylococcus aureus subsp. aureus N315
uuaaaaaaccugaaacaa

SEQ ID NO: 4069772 - RNA, 19 nt, Staphylococcus aureus subsp. aureus N315
uuaaaaaauauguauguuu

SEQ ID NO: 4069773 - RNA, 23 nt, Staphylococcus aureus subsp. aureus N315
uuaaaaaaucauucaccuaaaaa

SEQ ID NO: 4069774 - RNA, 16 nt, Staphylococcus aureus subsp. aureus N315
uuaaaaaauuuaaugu

SEQ ID NO: 4069775 - RNA, 19 nt, Staphylococcus aureus subsp. aureus N315
uuaaaaacaauauugacuu

SEQ ID NO: 4069776 - RNA, 12 nt, Staphylococcus aureus subsp. aureus N315
uuaaaaacagca

SEQ ID NO: 4069777 - RNA, 23 nt, Staphylococcus aureus subsp. aureus N315
uuaaaaagguacuaauguuaauc

SEQ ID NO: 4069778 - RNA, 18 nt, Staphylococcus aureus subsp. aureus N315
uuaaaaauagccuucaaa

SEQ ID NO: 4069779 - RNA, 16 nt, Staphylococcus aureus subsp. aureus N315
uuaaaaauauguguua

SEQ ID NO: 4069780 - RNA, 13 nt, Staphylococcus aureus subsp. aureus N315
uuaaaaaucaaag

SEQ ID NO: 4069781 - RNA, 15 nt, Staphylococcus aureus subsp. aureus N315
uuaaaaaucaaagag

SEQ ID NO: 4069782 - RNA, 15 nt, Staphylococcus aureus subsp. aureus N315
uuaaaaaugaaauga

SEQ ID NO: 4069783 - RNA, 19 nt, Staphylococcus aureus subsp. aureus N315
uuaaaaauugaaggaaaau

SEQ ID NO: 4069784 - RNA, 16 nt, Staphylococcus aureus subsp. aureus N315
uuaaaaauuucaauaa

SEQ ID NO: 4069785 - RNA, 15 nt, Staphylococcus aureus subsp. aureus N315
uuaaaaccaaaagaa

SEQ ID NO: 4069786 - RNA, 14 nt, Staphylococcus aureus subsp. aureus N315
uuaaaacgaaguua

SEQ ID NO: 4069787 - RNA, 17 nt, Staphylococcus aureus subsp. aureus N315
uuaaaacuauaaccuau

SEQ ID NO: 4069788 - RNA, 14 nt, Staphylococcus aureus subsp. aureus N315
uuaaaacuauaaua

SEQ ID NO: 4069789 - RNA, 15 nt, Staphylococcus aureus subsp. aureus N315
uuaaaagauaaauaa

SEQ ID NO: 4069790 - RNA, 18 nt, Staphylococcus aureus subsp. aureus N315
uuaaaaggcgaaacauua

SEQ ID NO: 4069791 - RNA, 17 nt, Staphylococcus aureus subsp. aureus N315
uuaaaaguaacauacua

SEQ ID NO: 4069792 - RNA, 21 nt, Staphylococcus aureus subsp. aureus N315
uuaaaagugcaaguccaaaua

SEQ ID NO: 4069793 - RNA, 14 nt, Staphylococcus aureus subsp. aureus N315
uuaaaauaaaccac

SEQ ID NO: 4069794 - RNA, 15 nt, Staphylococcus aureus subsp. aureus N315
uuaaaauaaaucuuu

SEQ ID NO: 4069795 - RNA, 18 nt, Staphylococcus aureus subsp. aureus N315
uuaaaauaaccauuuuuu

SEQ ID NO: 4069796 - RNA, 22 nt, Staphylococcus aureus subsp. aureus N315
uuaaaauaaccauuuuuucaaa

SEQ ID NO: 4069797 - RNA, 12 nt, Staphylococcus aureus subsp. aureus N315
uuaaaauacguu

SEQ ID NO: 4069798 - RNA, 18 nt, Staphylococcus aureus subsp. aureus N315
uuaaaauaguucuuuaaa

SEQ ID NO: 4069799 - RNA, 22 nt, Staphylococcus aureus subsp. aureus N315
uuaaaauauaaauuucuucaua

SEQ ID NO: 4069800 - RNA, 21 nt, Staphylococcus aureus subsp. aureus N315
uuaaaaucucauaauaauuca

SEQ ID NO: 4069801 - RNA, 19 nt, Staphylococcus aureus subsp. aureus N315
uuaaaaugauaucugacau

SEQ ID NO: 4069802 - RNA, 20 nt, Staphylococcus aureus subsp. aureus N315
uuaaaaugauaucugacauu

SEQ ID NO: 4069803 - RNA, 18 nt, Staphylococcus aureus subsp. aureus N315
uuaaaaugcuuuuuugaa

SEQ ID NO: 4069804 - RNA, 22 nt, Staphylococcus aureus subsp. aureus N315
uuaaaauuguauagaaugugua

SEQ ID NO: 4069805 - RNA, 15 nt, Staphylococcus aureus subsp. aureus N315
uuaaaauuuaaauau

SEQ ID NO: 4069806 - RNA, 16 nt, Staphylococcus aureus subsp. aureus N315
uuaaaauuuuaauuaa

SEQ ID NO: 4069807 - RNA, 12 nt, Staphylococcus aureus subsp. aureus N315
uuaaacaaauaa

SEQ ID NO: 4069808 - RNA, 14 nt, Staphylococcus aureus subsp. aureus N315
uuaaacaagcauca

SEQ ID NO: 4069809 - RNA, 15 nt, Staphylococcus aureus subsp. aureus N315
uuaaacaagcaucau

SEQ ID NO: 4069810 - RNA, 19 nt, Staphylococcus aureus subsp. aureus N315
uuaaacaagcaucaugaaa

SEQ ID NO: 4069811 - RNA, 21 nt, Staphylococcus aureus subsp. aureus N315
uuaaacacgcgguaaaacgaa

SEQ ID NO: 4069812 - RNA, 15 nt, Staphylococcus aureus subsp. aureus N315
uuaaacaguuuaauu

SEQ ID NO: 4069813 - RNA, 22 nt, Staphylococcus aureus subsp. aureus N315
uuaaacauaacaugaccuaaua

SEQ ID NO: 4069814 - RNA, 21 nt, Staphylococcus aureus subsp. aureus N315
uuaaacauccaauuauguuua

SEQ ID NO: 4069815 - RNA, 15 nt, Staphylococcus aureus subsp. aureus N315
uuaaacauuuuugaa

SEQ ID NO: 4069816 - RNA, 18 nt, Staphylococcus aureus subsp. aureus N315
uuaaaccguauagucauu

SEQ ID NO: 4069817 - RNA, 14 nt, Staphylococcus aureus subsp. aureus N315
uuaaaccuuaauaa

SEQ ID NO: 4069818 - RNA, 20 nt, Staphylococcus aureus subsp. aureus N315
uuaaacgcugauuuuauaaa

SEQ ID NO: 4069819 - RNA, 23 nt, Staphylococcus aureus subsp. aureus N315
uuaaacucauaccaaaaacauua

SEQ ID NO: 4069820 - RNA, 20 nt, Staphylococcus aureus subsp. aureus N315
uuaaacuuauuaauuaauag

SEQ ID NO: 4069821 - RNA, 19 nt, Staphylococcus aureus subsp. aureus N315
uuaaagaaaaguuuaaguc

SEQ ID NO: 4069822 - RNA, 21 nt, Staphylococcus aureus subsp. aureus N315
uuaaagaaaauuucaguacca

SEQ ID NO: 4069823 - RNA, 16 nt, Staphylococcus aureus subsp. aureus N315
uuaaagacuagccaua

SEQ ID NO: 4069824 - RNA, 19 nt, Staphylococcus aureus subsp. aureus N315
uuaaagaugucgaaaagua

SEQ ID NO: 4069825 - RNA, 14 nt, Staphylococcus aureus subsp. aureus N315
uuaaagauuaaaau

SEQ ID NO: 4069826 - RNA, 13 nt, Staphylococcus aureus subsp. aureus N315
uuaaagauuauua

SEQ ID NO: 4069827 - RNA, 21 nt, Staphylococcus aureus subsp. aureus N315
uuaaagcaaauuauauagaaa

SEQ ID NO: 4069828 - RNA, 13 nt, Staphylococcus aureus subsp. aureus N315
uuaaagcaucaua

SEQ ID NO: 4069829 - RNA, 14 nt, Staphylococcus aureus subsp. aureus N315
uuaaaggaaaucaa

SEQ ID NO: 4069830 - RNA, 16 nt, Staphylococcus aureus subsp. aureus N315
uuaaaggguguuuaga

SEQ ID NO: 4069831 - RNA, 14 nt, Staphylococcus aureus subsp. aureus N315
uuaaagguuaaaua

SEQ ID NO: 4069832 - RNA, 16 nt, Staphylococcus aureus subsp. aureus N315
uuaaagguuaaauauu

SEQ ID NO: 4069833 - RNA, 20 nt, Staphylococcus aureus subsp. aureus N315
uuaaagguuaaauauuuaau

SEQ ID NO: 4069834 - RNA, 22 nt, Staphylococcus aureus subsp. aureus N315
uuaaaguaaccacaacaaugca

SEQ ID NO: 4069835 - RNA, 14 nt, Staphylococcus aureus subsp. aureus N315
uuaaagucaguaua

SEQ ID NO: 4069836 - RNA, 11 nt, Staphylococcus aureus subsp. aureus N315
uuaaagucuuc

SEQ ID NO: 4069837 - RNA, 14 nt, Staphylococcus aureus subsp. aureus N315
uuaaaguguuucaa

SEQ ID NO: 4069838 - RNA, 14 nt, Staphylococcus aureus subsp. aureus N315
uuaaaguuuaaaua

SEQ ID NO: 4069839 - RNA, 13 nt, Staphylococcus aureus subsp. aureus N315
uuaaauaaaaaua

SEQ ID NO: 4069840 - RNA, 14 nt, Staphylococcus aureus subsp. aureus N315
uuaacuuuaacauc

SEQ ID NO: 4069841 - RNA, 17 nt, Staphylococcus aureus subsp. aureus N315
uuaagaaacgucuuaau

SEQ ID NO: 4069842 - RNA, 13 nt, Staphylococcus aureus subsp. aureus N315
uuaagaauguaca

SEQ ID NO: 4069843 - RNA, 21 nt, Staphylococcus aureus subsp. aureus N315
uuaagacugauuaauuauuga

SEQ ID NO: 4069844 - RNA, 12 nt, Staphylococcus aureus subsp. aureus N315
uuaagcauuugu

SEQ ID NO: 4069845 - RNA, 20 nt, Staphylococcus aureus subsp. aureus N315
uuaagcuuacgacauacuug

SEQ ID NO: 4069846 - RNA, 13 nt, Staphylococcus aureus subsp. aureus N315
uuaagcuuuaauc

SEQ ID NO: 4069847 - RNA, 14 nt, Staphylococcus aureus subsp. aureus N315
uuaaguacagcaua

SEQ ID NO: 4069848 - RNA, 13 nt, Staphylococcus aureus subsp. aureus N315
uuaaguacuuuua

SEQ ID NO: 4069849 - RNA, 19 nt, Staphylococcus aureus subsp. aureus N315
uuaaguagaugauuagugu

SEQ ID NO: 4069850 - RNA, 15 nt, Staphylococcus aureus subsp. aureus N315
uuaaguauagcuuuu

SEQ ID NO: 4069851 - RNA, 14 nt, Staphylococcus aureus subsp. aureus N315
uuaaguauaucuuu

SEQ ID NO: 4069852 - RNA, 17 nt, Staphylococcus aureus subsp. aureus N315
uuaaguauuuaaauaac

SEQ ID NO: 4069853 - RNA, 12 nt, Staphylococcus aureus subsp. aureus N315
uuaagucaucaa

SEQ ID NO: 4069854 - RNA, 21 nt, Staphylococcus aureus subsp. aureus N315
uuaagucauuacguaacauca

SEQ ID NO: 4069855 - RNA, 22 nt, Staphylococcus aureus subsp. aureus N315
uuaagucgccuaacuuuuauua

SEQ ID NO: 4069856 - RNA, 12 nt, Staphylococcus aureus subsp. aureus N315
uuaagugaguuu

SEQ ID NO: 4069857 - RNA, 17 nt, Staphylococcus aureus subsp. aureus N315
uuaagugaguuuuauuu

SEQ ID NO: 4069858 - RNA, 18 nt, Staphylococcus aureus subsp. aureus N315
uuaagugaguuuuauuua

SEQ ID NO: 4069859 - RNA, 23 nt, Staphylococcus aureus subsp. aureus N315
uuaagugaugaccaauauucugg

SEQ ID NO: 4069860 - RNA, 18 nt, Staphylococcus aureus subsp. aureus N315
uuaagugcaauaacacca

SEQ ID NO: 4069861 - RNA, 23 nt, Staphylococcus aureus subsp. aureus N315
uuaagugccuugccaugauuuaa

SEQ ID NO: 4069862 - RNA, 22 nt, Staphylococcus aureus subsp. aureus N315
uuaaguucaucuggugcaauau

SEQ ID NO: 4069863 - RNA, 13 nt, Staphylococcus aureus subsp. aureus N315
uuaaguuuuucag

SEQ ID NO: 4069864 - RNA, 13 nt, Staphylococcus aureus subsp. aureus N315
uuaauaaaguaau

SEQ ID NO: 4069865 - RNA, 20 nt, Staphylococcus aureus subsp. aureus N315
uuaauaaauuguaugaauaa

SEQ ID NO: 4069866 - RNA, 14 nt, Staphylococcus aureus subsp. aureus N315
uuaauaacaaaauu

SEQ ID NO: 4069867 - RNA, 20 nt, Staphylococcus aureus subsp. aureus N315
uuaauaacaaaauuaaauau

SEQ ID NO: 4069868 - RNA, 22 nt, Staphylococcus aureus subsp. aureus N315
uuaauaacauccccaaaaauag

SEQ ID NO: 4069869 - RNA, 19 nt, Staphylococcus aureus subsp. aureus N315
uuaauaaccauguaaaauu

SEQ ID NO: 4069870 - RNA, 19 nt, Staphylococcus aureus subsp. aureus N315
uuaauaacccauuuucaaa

SEQ ID NO: 4069871 - RNA, 17 nt, Staphylococcus aureus subsp. aureus N315
uuaauaaccgaaauauu

SEQ ID NO: 4069872 - RNA, 13 nt, Staphylococcus aureus subsp. aureus N315
uuaauaacgauaa

SEQ ID NO: 4069873 - RNA, 13 nt, Staphylococcus aureus subsp. aureus N315
uuaauaauguaca

SEQ ID NO: 4069874 - RNA, 20 nt, Staphylococcus aureus subsp. aureus N315
uuaauaauuuuuuuccuuuc

SEQ ID NO: 4069875 - RNA, 16 nt, Staphylococcus aureus subsp. aureus N315
uuaauacaagucuuua

SEQ ID NO: 4069876 - RNA, 23 nt, Staphylococcus aureus subsp. aureus N315
uuaauacaauucaagaccaugca

SEQ ID NO: 4069877 - RNA, 14 nt, Staphylococcus aureus subsp. aureus N315
uuaauacauaucgg

SEQ ID NO: 4069878 - RNA, 20 nt, Staphylococcus aureus subsp. aureus N315
uuaauacaucaauaucuucu

SEQ ID NO: 4069879 - RNA, 22 nt, Staphylococcus aureus subsp. aureus N315
uuaauaccuaucccuguaaaac

SEQ ID NO: 4069880 - RNA, 13 nt, Staphylococcus aureus subsp. aureus N315
uuaauaccuauga

SEQ ID NO: 4069881 - RNA, 15 nt, Staphylococcus aureus subsp. aureus N315
uuaauacgaauuuca

SEQ ID NO: 4069882 - RNA, 22 nt, Staphylococcus aureus subsp. aureus N315
uuaauacuaccguuuuuauaua

SEQ ID NO: 4069883 - RNA, 20 nt, Staphylococcus aureus subsp. aureus N315
uuaauacuauaguaagaaaa

SEQ ID NO: 4069884 - RNA, 16 nt, Staphylococcus aureus subsp. aureus N315
uuaauagaaagugcgg

SEQ ID NO: 4069885 - RNA, 15 nt, Staphylococcus aureus subsp. aureus N315
uuaauagagaaagaa

SEQ ID NO: 4069886 - RNA, 22 nt, Staphylococcus aureus subsp. aureus N315
uuaauagagacauuuuaucuga

SEQ ID NO: 4069887 - RNA, 13 nt, Staphylococcus aureus subsp. aureus N315
uuaauagaucuuu

SEQ ID NO: 4069888 - RNA, 19 nt, Staphylococcus aureus subsp. aureus N315
uuaauaggauuauuaucaa

SEQ ID NO: 4069889 - RNA, 21 nt, Staphylococcus aureus subsp. aureus N315
uuaauagugucaucaccuugu

SEQ ID NO: 4069890 - RNA, 13 nt, Staphylococcus aureus subsp. aureus N315
uuaauauaaauau

SEQ ID NO: 4069891 - RNA, 17 nt, Staphylococcus aureus subsp. aureus N315
uuaauauaaauaucaau

SEQ ID NO: 4069892 - RNA, 13 nt, Staphylococcus aureus subsp. aureus N315
uuaauauaaauuu

SEQ ID NO: 4069893 - RNA, 13 nt, Staphylococcus aureus subsp. aureus N315
uuaauauaaguau

SEQ ID NO: 4069894 - RNA, 15 nt, Staphylococcus aureus subsp. aureus N315
uuaauauauuuauuu

SEQ ID NO: 4069895 - RNA, 17 nt, Staphylococcus aureus subsp. aureus N315
uuaauaucacgaucuuu

SEQ ID NO: 4069896 - RNA, 19 nt, Staphylococcus aureus subsp. aureus N315
uuaauaucacgaucuuuaa

SEQ ID NO: 4069897 - RNA, 17 nt, Staphylococcus aureus subsp. aureus N315
uuaauaucauauucaaa

SEQ ID NO: 4069898 - RNA, 12 nt, Staphylococcus aureus subsp. aureus N315
uuaauauccaaa

SEQ ID NO: 4069899 - RNA, 20 nt, Staphylococcus aureus subsp. aureus N315
uuaauaugaacaaaaaauaa

SEQ ID NO: 4069900 - RNA, 22 nt, Staphylococcus aureus subsp. aureus N315
uuaauaugcaaugcaccuauaa

SEQ ID NO: 4069901 - RNA, 23 nt, Staphylococcus aureus subsp. aureus N315
uuaaucaacguauauaaguuaaa

SEQ ID NO: 4069902 - RNA, 18 nt, Staphylococcus aureus subsp. aureus N315
uuaaucagcuauaaaagu

SEQ ID NO: 4069903 - RNA, 19 nt, Staphylococcus aureus subsp. aureus N315
uuaaucagcuauaaaagua

SEQ ID NO: 4069904 - RNA, 16 nt, Staphylococcus aureus subsp. aureus N315
uuaaucauagcauuaa

SEQ ID NO: 4069905 - RNA, 14 nt, Staphylococcus aureus subsp. aureus N315
uuaaucauuuaucu

SEQ ID NO: 4069906 - RNA, 14 nt, Staphylococcus aureus subsp. aureus N315
uuaauccaauuuaa

SEQ ID NO: 4069907 - RNA, 19 nt, Staphylococcus aureus subsp. aureus N315
uuaauccgauuuugauaua

SEQ ID NO: 4069908 - RNA, 16 nt, Staphylococcus aureus subsp. aureus N315
uuaauccuucuccaaa

SEQ ID NO: 4069909 - RNA, 21 nt, Staphylococcus aureus subsp. aureus N315
uuaauccuucuccaaaaauaa

SEQ ID NO: 4069910 - RNA, 11 nt, Staphylococcus aureus subsp. aureus N315
uuaaucgcauu

SEQ ID NO: 4069911 - RNA, 18 nt, Staphylococcus aureus subsp. aureus N315
uuaaucggaucauuauuu

SEQ ID NO: 4069912 - RNA, 17 nt, Staphylococcus aureus subsp. aureus N315
uuaaucuauauaaaaac

SEQ ID NO: 4069913 - RNA, 14 nt, Staphylococcus aureus subsp. aureus N315
uuaaucuauauaua

SEQ ID NO: 4069914 - RNA, 12 nt, Staphylococcus aureus subsp. aureus N315
uuaaucuauccu

SEQ ID NO: 4069915 - RNA, 14 nt, Staphylococcus aureus subsp. aureus N315
uuaaucuuaauauu

SEQ ID NO: 4069916 - RNA, 21 nt, Staphylococcus aureus subsp. aureus N315
uuaaugacuaugcaaaugaaa

SEQ ID NO: 4069917 - RNA, 20 nt, Staphylococcus aureus subsp. aureus N315
uuaaugacuucuuuauauuu

SEQ ID NO: 4069918 - RNA, 18 nt, Staphylococcus aureus subsp. aureus N315
uuaaugaguaguuucucu

SEQ ID NO: 4069919 - RNA, 19 nt, Staphylococcus aureus subsp. aureus N315
uuaaugauucuacagcacu

SEQ ID NO: 4069920 - RNA, 23 nt, Staphylococcus aureus subsp. aureus N315
uuaaugauugacgauuuaauuaa

SEQ ID NO: 4069921 - RNA, 21 nt, Staphylococcus aureus subsp. aureus N315
uuaaugccauuguuauccaaa

SEQ ID NO: 4069922 - RNA, 16 nt, Staphylococcus aureus subsp. aureus N315
uuaaugcucuauauau

SEQ ID NO: 4069923 - RNA, 23 nt, Staphylococcus aureus subsp. aureus N315
uuaaugggcgugccauuaaaauu

SEQ ID NO: 4069924 - RNA, 18 nt, Staphylococcus aureus subsp. aureus N315
uuaauguacuuuucuguc

SEQ ID NO: 4069925 - RNA, 16 nt, Staphylococcus aureus subsp. aureus N315
uuaauguauucuucua

SEQ ID NO: 4069926 - RNA, 16 nt, Staphylococcus aureus subsp. aureus N315
uuaaugucuaaaaaug

SEQ ID NO: 4069927 - RNA, 15 nt, Staphylococcus aureus subsp. aureus N315
uuaauguguaaauuu

SEQ ID NO: 4069928 - RNA, 12 nt, Staphylococcus aureus subsp. aureus N315
uuacccaaaaaa

SEQ ID NO: 4069929 - RNA, 20 nt, Staphylococcus aureus subsp. aureus N315
uuacccacaucuuuuuaaaa

SEQ ID NO: 4069930 - RNA, 15 nt, Staphylococcus aureus subsp. aureus N315
uuaccuuuaauuaca

SEQ ID NO: 4069931 - RNA, 15 nt, Staphylococcus aureus subsp. aureus N315
uuaccuuuauguuca

SEQ ID NO: 4069932 - RNA, 14 nt, Staphylococcus aureus subsp. aureus N315
uuaccuuuccauuc

SEQ ID NO: 4069933 - RNA, 15 nt, Staphylococcus aureus subsp. aureus N315
uuaccuuuuaaaccu

SEQ ID NO: 4069934 - RNA, 14 nt, Staphylococcus aureus subsp. aureus N315
uuacgauaaacuaa

SEQ ID NO: 4069935 - RNA, 15 nt, Staphylococcus aureus subsp. aureus N315
uuacgaucauaaaua

SEQ ID NO: 4069936 - RNA, 21 nt, Staphylococcus aureus subsp. aureus N315
uuacgccaacaagguuucaag

SEQ ID NO: 4069937 - RNA, 21 nt, Staphylococcus aureus subsp. aureus N315
uuacgccaccaguuucaagug

SEQ ID NO: 4069938 - RNA, 17 nt, Staphylococcus aureus subsp. aureus N315
uuacguaaucuaauaca

SEQ ID NO: 4069939 - RNA, 20 nt, Staphylococcus aureus subsp. aureus N315
uuacuaaaugaauugcuugu

SEQ ID NO: 4069940 - RNA, 16 nt, Staphylococcus aureus subsp. aureus N315
uuacuacgcauuauua

SEQ ID NO: 4069941 - RNA, 16 nt, Staphylococcus aureus subsp. aureus N315
uuacuaguuuguaaua

SEQ ID NO: 4069942 - RNA, 13 nt, Staphylococcus aureus subsp. aureus N315
uuacuauaaaaaa

SEQ ID NO: 4069943 - RNA, 20 nt, Staphylococcus aureus subsp. aureus N315
uuacuauggcauuauugccu

SEQ ID NO: 4069944 - RNA, 17 nt, Staphylococcus aureus subsp. aureus N315
uuacucaaaccaucuua

SEQ ID NO: 4069945 - RNA, 14 nt, Staphylococcus aureus subsp. aureus N315
uuacucauuuuucu

SEQ ID NO: 4069946 - RNA, 23 nt, Staphylococcus aureus subsp. aureus N315
uuacuccaaaguaacaugugcaa

SEQ ID NO: 4069947 - RNA, 16 nt, Staphylococcus aureus subsp. aureus N315
uuacuccuuacaauaa

SEQ ID NO: 4069948 - RNA, 22 nt, Staphylococcus aureus subsp. aureus N315
uuacugaaacuaaauuaaaagu

SEQ ID NO: 4069949 - RNA, 16 nt, Staphylococcus aureus subsp. aureus N315
uuacugaugaacauac

SEQ ID NO: 4069950 - RNA, 19 nt, Staphylococcus aureus subsp. aureus N315
uuacugcaauuauuuuuca

SEQ ID NO: 4069951 - RNA, 18 nt, Staphylococcus aureus subsp. aureus N315
uuacugcgcuuuuaauuu

SEQ ID NO: 4069952 - RNA, 21 nt, Staphylococcus aureus subsp. aureus N315
uuacugcuuuuuuaaauuuaa

SEQ ID NO: 4069953 - RNA, 20 nt, Staphylococcus aureus subsp. aureus N315
uuacuguaaucaauccucua

SEQ ID NO: 4069954 - RNA, 14 nt, Staphylococcus aureus subsp. aureus N315
uuacuguaguacua

SEQ ID NO: 4069955 - RNA, 13 nt, Staphylococcus aureus subsp. aureus N315
uuacuuaauagua

SEQ ID NO: 4069956 - RNA, 12 nt, Staphylococcus aureus subsp. aureus N315
uuacuuaaucug

SEQ ID NO: 4069957 - RNA, 23 nt, Staphylococcus aureus subsp. aureus N315
uuacuuaaucuggguuguaaucu

SEQ ID NO: 4069958 - RNA, 15 nt, Staphylococcus aureus subsp. aureus N315
uuacuucauaaguca

SEQ ID NO: 4069959 - RNA, 17 nt, Staphylococcus aureus subsp. aureus N315
uuacuuccauugcuucu

SEQ ID NO: 4069960 - RNA, 21 nt, Staphylococcus aureus subsp. aureus N315
uuacuugcuuuuucaaauaau

SEQ ID NO: 4069961 - RNA, 12 nt, Staphylococcus aureus subsp. aureus N315
uuacuuuaacuu

SEQ ID NO: 4069962 - RNA, 11 nt, Staphylococcus aureus subsp. aureus N315
uuacuuugaaa

SEQ ID NO: 4069963 - RNA, 15 nt, Staphylococcus aureus subsp. aureus N315
uuacuuuuaaaacua

SEQ ID NO: 4069964 - RNA, 22 nt, Staphylococcus aureus subsp. aureus N315
uuacuuuuccuugauucuuaua

SEQ ID NO: 4069965 - RNA, 14 nt, Staphylococcus aureus subsp. aureus N315
uuagaaaaauauga

SEQ ID NO: 4069966 - RNA, 12 nt, Staphylococcus aureus subsp. aureus N315
uuagaaccauca

SEQ ID NO: 4069967 - RNA, 23 nt, Staphylococcus aureus subsp. aureus N315
uuagaagaacaauaauugaugaa

SEQ ID NO: 4069968 - RNA, 23 nt, Staphylococcus aureus subsp. aureus N315
uuagaagaugauuauucucuuua

SEQ ID NO: 4069969 - RNA, 18 nt, Staphylococcus aureus subsp. aureus N315
uuagaauaguuaccaaaa

SEQ ID NO: 4069970 - RNA, 13 nt, Staphylococcus aureus subsp. aureus N315
uuagacauuaaaa

SEQ ID NO: 4069971 - RNA, 16 nt, Staphylococcus aureus subsp. aureus N315
uuagacuaaaaaacua

SEQ ID NO: 4069972 - RNA, 17 nt, Staphylococcus aureus subsp. aureus N315
uuagacucacuucuuaa

SEQ ID NO: 4069973 - RNA, 18 nt, Staphylococcus aureus subsp. aureus N315
uuagacucacuucuuaaa

SEQ ID NO: 4069974 - RNA, 21 nt, Staphylococcus aureus subsp. aureus N315
uuagacucuccuuuuuuaaag

SEQ ID NO: 4069975 - RNA, 20 nt, Staphylococcus aureus subsp. aureus N315
uuagagaaaaaucuguuucu

SEQ ID NO: 4069976 - RNA, 18 nt, Staphylococcus aureus subsp. aureus N315
uuagagauuguaagaauu

SEQ ID NO: 4069977 - RNA, 14 nt, Staphylococcus aureus subsp. aureus N315
uuagaguuuuuauu

SEQ ID NO: 4069978 - RNA, 13 nt, Staphylococcus aureus subsp. aureus N315
uuagauaaaaauu

SEQ ID NO: 4069979 - RNA, 17 nt, Staphylococcus aureus subsp. aureus N315
uuagauaaaaauuacua

SEQ ID NO: 4069980 - RNA, 14 nt, Staphylococcus aureus subsp. aureus N315
uuagauaaauuaau

SEQ ID NO: 4069981 - RNA, 21 nt, Staphylococcus aureus subsp. aureus N315
uuagauaaauuaauaugaaca

SEQ ID NO: 4069982 - RNA, 14 nt, Staphylococcus aureus subsp. aureus N315
uuagauaauaagga

SEQ ID NO: 4069983 - RNA, 15 nt, Staphylococcus aureus subsp. aureus N315
uuagauaauaaggaa

SEQ ID NO: 4069984 - RNA, 17 nt, Staphylococcus aureus subsp. aureus N315
uuagauauuauaaaaac

SEQ ID NO: 4069985 - RNA, 15 nt, Staphylococcus aureus subsp. aureus N315
uuagaugacuuuguc

SEQ ID NO: 4069986 - RNA, 23 nt, Staphylococcus aureus subsp. aureus N315
uuagaugauauuuaacaaaauua

SEQ ID NO: 4069987 - RNA, 16 nt, Staphylococcus aureus subsp. aureus N315
uuagauuaucuuucaa

SEQ ID NO: 4069988 - RNA, 17 nt, Staphylococcus aureus subsp. aureus N315
uuagauucacuguauaa

SEQ ID NO: 4069989 - RNA, 21 nt, Staphylococcus aureus subsp. aureus N315
uuagauugacuaaguuuguuu

SEQ ID NO: 4069990 - RNA, 12 nt, Staphylococcus aureus subsp. aureus N315
uuagauuuaaaa

SEQ ID NO: 4069991 - RNA, 21 nt, Staphylococcus aureus subsp. aureus N315
uuagauuuuauauaaaaagaa

SEQ ID NO: 4069992 - RNA, 21 nt, Staphylococcus aureus subsp. aureus N315
uuagcaaaaauauuuaaacua

SEQ ID NO: 4069993 - RNA, 19 nt, Staphylococcus aureus subsp. aureus N315
uuagcauaccuuuauuauu

SEQ ID NO: 4069994 - RNA, 19 nt, Staphylococcus aureus subsp. aureus N315
uuagcaucuuuaccauaua

SEQ ID NO: 4069995 - RNA, 18 nt, Staphylococcus aureus subsp. aureus N315
uuagcaugacuguaagua

SEQ ID NO: 4069996 - RNA, 19 nt, Staphylococcus aureus subsp. aureus N315
uuagcauuaaauuccaugu

SEQ ID NO: 4069997 - RNA, 18 nt, Staphylococcus aureus subsp. aureus N315
uuagccaauaaaauguca

SEQ ID NO: 4069998 - RNA, 23 nt, Staphylococcus aureus subsp. aureus N315
uuagccccagcaaauacuucaag

SEQ ID NO: 4069999 - RNA, 23 nt, Staphylococcus aureus subsp. aureus N315
uuagcuuuuguaaagcuuuaguu

SEQ ID NO: 4070000 - RNA, 21 nt, Staphylococcus aureus subsp. aureus N315
uuaggaauaauucgauuaucu

SEQ ID NO: 4070001 - RNA, 15 nt, Staphylococcus aureus subsp. aureus N315
uuaggaaugaauaaa

SEQ ID NO: 4070002 - RNA, 15 nt, Staphylococcus aureus subsp. aureus N315
uuaggaaugauagau

SEQ ID NO: 4070003 - RNA, 18 nt, Staphylococcus aureus subsp. aureus N315
uuaggaaugauagauuua

SEQ ID NO: 4070004 - RNA, 20 nt, Staphylococcus aureus subsp. aureus N315
uuaggaaugauagauuuagg

SEQ ID NO: 4070005 - RNA, 18 nt, Staphylococcus aureus subsp. aureus N315
uuaggauccaauuuaucu

SEQ ID NO: 4070006 - RNA, 22 nt, Staphylococcus aureus subsp. aureus N315
uuaggauguucagcuaacucuu

SEQ ID NO: 4070007 - RNA, 17 nt, Staphylococcus aureus subsp. aureus N315
uuaggcgcuacaauguu

SEQ ID NO: 4070008 - RNA, 16 nt, Staphylococcus aureus subsp. aureus N315
uuaggcuuauuaacuu

SEQ ID NO: 4070009 - RNA, 16 nt, Staphylococcus aureus subsp. aureus N315
uuaggggcuuuuaugc

SEQ ID NO: 4070010 - RNA, 15 nt, Staphylococcus aureus subsp. aureus N315
uuagguccuuucaca

SEQ ID NO: 4070011 - RNA, 17 nt, Staphylococcus aureus subsp. aureus N315
uuagguugauuucugcu

SEQ ID NO: 4070012 - RNA, 15 nt, Staphylococcus aureus subsp. aureus N315
uuaguaauaacaucu

SEQ ID NO: 4070013 - RNA, 14 nt, Staphylococcus aureus subsp. aureus N315
uuaguacuaaaccg

SEQ ID NO: 4070014 - RNA, 19 nt, Staphylococcus aureus subsp. aureus N315
uuaguagauuuauuaaaua

SEQ ID NO: 4070015 - RNA, 20 nt, Staphylococcus aureus subsp. aureus N315
uuaguaguuuauaucaaaaa

SEQ ID NO: 4070016 - RNA, 22 nt, Staphylococcus aureus subsp. aureus N315
uuaucauuaaauugcuugaaau

SEQ ID NO: 4070017 - RNA, 16 nt, Staphylococcus aureus subsp. aureus N315
uuaucauuauucgcau

SEQ ID NO: 4070018 - RNA, 18 nt, Staphylococcus aureus subsp. aureus N315
uuauccaaaacauuuugu

SEQ ID NO: 4070019 - RNA, 22 nt, Staphylococcus aureus subsp. aureus N315
uuauccaaaccaauuuuaacuu

SEQ ID NO: 4070020 - RNA, 21 nt, Staphylococcus aureus subsp. aureus N315
uuauccaaggauguuauaaaa

SEQ ID NO: 4070021 - RNA, 15 nt, Staphylococcus aureus subsp. aureus N315
uuauccuacugcugu

SEQ ID NO: 4070022 - RNA, 17 nt, Staphylococcus aureus subsp. aureus N315
uuauccuacugcugucu

SEQ ID NO: 4070023 - RNA, 15 nt, Staphylococcus aureus subsp. aureus N315
uuaucgaagaaacau

SEQ ID NO: 4070024 - RNA, 22 nt, Staphylococcus aureus subsp. aureus N315
uuaucgacuuugucauuuugau

SEQ ID NO: 4070025 - RNA, 18 nt, Staphylococcus aureus subsp. aureus N315
uuaucgaucgguauuuuc

SEQ ID NO: 4070026 - RNA, 19 nt, Staphylococcus aureus subsp. aureus N315
uuaucgaucgguauuuuca

SEQ ID NO: 4070027 - RNA, 16 nt, Staphylococcus aureus subsp. aureus N315
uuaucguaaaaaaacg

SEQ ID NO: 4070028 - RNA, 16 nt, Staphylococcus aureus subsp. aureus N315
uuaucgugaagaaaaa

SEQ ID NO: 4070029 - RNA, 15 nt, Staphylococcus aureus subsp. aureus N315
uuaucuaaagcuaua

SEQ ID NO: 4070030 - RNA, 21 nt, Staphylococcus aureus subsp. aureus N315
uuaucuaacaaucguuuuaau

SEQ ID NO: 4070031 - RNA, 19 nt, Staphylococcus aureus subsp. aureus N315
uuaucuagacucaaggaaa

SEQ ID NO: 4070032 - RNA, 17 nt, Staphylococcus aureus subsp. aureus N315
uuaucuauauaugaaga

SEQ ID NO: 4070033 - RNA, 22 nt, Staphylococcus aureus subsp. aureus N315
uuaucucuuacguccuaauccc

SEQ ID NO: 4070034 - RNA, 15 nt, Staphylococcus aureus subsp. aureus N315
uuaucugaaaauauc

SEQ ID NO: 4070035 - RNA, 18 nt, Staphylococcus aureus subsp. aureus N315
uuaucugaagcuaaaugc

SEQ ID NO: 4070036 - RNA, 18 nt, Staphylococcus aureus subsp. aureus N315
uuaucugacauuguugcu

SEQ ID NO: 4070037 - RNA, 17 nt, Staphylococcus aureus subsp. aureus N315
uuaucugaccaguauac

SEQ ID NO: 4070038 - RNA, 15 nt, Staphylococcus aureus subsp. aureus N315
uuaucugcaaaaugc

SEQ ID NO: 4070039 - RNA, 16 nt, Staphylococcus aureus subsp. aureus N315
uuaucugcaaaaugca

SEQ ID NO: 4070040 - RNA, 18 nt, Staphylococcus aureus subsp. aureus N315
uuaucuguaauuaaucca

SEQ ID NO: 4070041 - RNA, 17 nt, Staphylococcus aureus subsp. aureus N315
uuaucuguaucaaaauc

SEQ ID NO: 4070042 - RNA, 12 nt, Staphylococcus aureus subsp. aureus N315
uuaucuuuauaa

SEQ ID NO: 4070043 - RNA, 15 nt, Staphylococcus aureus subsp. aureus N315
uuaugaaaacauuau

SEQ ID NO: 4070044 - RNA, 15 nt, Staphylococcus aureus subsp. aureus N315
uuaugaauugaguau

SEQ ID NO: 4070045 - RNA, 19 nt, Staphylococcus aureus subsp. aureus N315
uuaugacuaacauugguac

SEQ ID NO: 4070046 - RNA, 19 nt, Staphylococcus aureus subsp. aureus N315
uuaugacuuauuuuucauc

SEQ ID NO: 4070047 - RNA, 17 nt, Staphylococcus aureus subsp. aureus N315
uuaugagcuucuuuaaa

SEQ ID NO: 4070048 - RNA, 21 nt, Staphylococcus aureus subsp. aureus N315
uuaugauauacgagcuuugcu

SEQ ID NO: 4070049 - RNA, 14 nt, Staphylococcus aureus subsp. aureus N315
uuaugaugucaugu

SEQ ID NO: 4070050 - RNA, 15 nt, Staphylococcus aureus subsp. aureus N315
uuaugauuauauuuu

SEQ ID NO: 4070051 - RNA, 19 nt, Staphylococcus aureus subsp. aureus N315
uuaugauugcuuauuuauu

SEQ ID NO: 4070052 - RNA, 15 nt, Staphylococcus aureus subsp. aureus N315
uuaugcaaaauuaau

SEQ ID NO: 4070053 - RNA, 17 nt, Staphylococcus aureus subsp. aureus N315
uuaugcggucuaaaugc

SEQ ID NO: 4070054 - RNA, 13 nt, Staphylococcus aureus subsp. aureus N315
uuaugcuauuuug

SEQ ID NO: 4070055 - RNA, 22 nt, Staphylococcus aureus subsp. aureus N315
uuauggcgguuugaaaaugacg

SEQ ID NO: 4070056 - RNA, 19 nt, Staphylococcus aureus subsp. aureus N315
uuaugguauuuacccaaca

SEQ ID NO: 4070057 - RNA, 20 nt, Staphylococcus aureus subsp. aureus N315
uuauguaucuauacaacagu

SEQ ID NO: 4070058 - RNA, 12 nt, Staphylococcus aureus subsp. aureus N315
uuauguauuuau

SEQ ID NO: 4070059 - RNA, 19 nt, Staphylococcus aureus subsp. aureus N315
uuauguauuuuuauuuaua

SEQ ID NO: 4070060 - RNA, 23 nt, Staphylococcus aureus subsp. aureus N315
uuauguauuuuuauuuauacuaa

SEQ ID NO: 4070061 - RNA, 23 nt, Staphylococcus aureus subsp. aureus N315
uuaugucuuaggcgcuacaaugu

SEQ ID NO: 4070062 - RNA, 16 nt, Staphylococcus aureus subsp. aureus N315
uuauguuuaaacauuu

SEQ ID NO: 4070063 - RNA, 13 nt, Staphylococcus aureus subsp. aureus N315
uuauguuuaauuu

SEQ ID NO: 4070064 - RNA, 17 nt, Staphylococcus aureus subsp. aureus N315
uuauuaaaauuaaauaa

SEQ ID NO: 4070065 - RNA, 23 nt, Staphylococcus aureus subsp. aureus N315
uuauuaaacacgcgguaaaacga

SEQ ID NO: 4070066 - RNA, 18 nt, Staphylococcus aureus subsp. aureus N315
uuauuaaaucuuuuacua

SEQ ID NO: 4070067 - RNA, 20 nt, Staphylococcus aureus subsp. aureus N315
uuauuaaaucuuuuacuaaa

SEQ ID NO: 4070068 - RNA, 13 nt, Staphylococcus aureus subsp. aureus N315
uuauuaacucaug

SEQ ID NO: 4070069 - RNA, 12 nt, Staphylococcus aureus subsp. aureus N315
uuauuaacugua

SEQ ID NO: 4070070 - RNA, 13 nt, Staphylococcus aureus subsp. aureus N315
uuauuaacugugu

SEQ ID NO: 4070071 - RNA, 17 nt, Staphylococcus aureus subsp. aureus N315
uuauuagaauauucaga

SEQ ID NO: 4070072 - RNA, 15 nt, Staphylococcus aureus subsp. aureus N315
uuauuagaaugaaac

SEQ ID NO: 4070073 - RNA, 17 nt, Staphylococcus aureus subsp. aureus N315
uuauuagauacuucuuu

SEQ ID NO: 4070074 - RNA, 15 nt, Staphylococcus aureus subsp. aureus N315
uuauuaguauucaaa

SEQ ID NO: 4070075 - RNA, 14 nt, Staphylococcus aureus subsp. aureus N315
uuauuauaaaauaa

SEQ ID NO: 4070076 - RNA, 14 nt, Staphylococcus aureus subsp. aureus N315
uuauuauaauagcu

SEQ ID NO: 4070077 - RNA, 22 nt, Staphylococcus aureus subsp. aureus N315
uuauuaucagcccaaucaguuu

SEQ ID NO: 4070078 - RNA, 14 nt, Staphylococcus aureus subsp. aureus N315
uuauuauuaaauua

SEQ ID NO: 4070079 - RNA, 13 nt, Staphylococcus aureus subsp. aureus N315
uuauuauugaaau

SEQ ID NO: 4070080 - RNA, 22 nt, Staphylococcus aureus subsp. aureus N315
uuauuauugucaucauguucua

SEQ ID NO: 4070081 - RNA, 12 nt, Staphylococcus aureus subsp. aureus N315
uuauuauuuauc

SEQ ID NO: 4070082 - RNA, 19 nt, Staphylococcus aureus subsp. aureus N315
uuauucaaaauucaauauu

SEQ ID NO: 4070083 - RNA, 14 nt, Staphylococcus aureus subsp. aureus N315
uuauucaaaucaua

SEQ ID NO: 4070084 - RNA, 17 nt, Staphylococcus aureus subsp. aureus N315
uuauucaauugauuaca

SEQ ID NO: 4070085 - RNA, 14 nt, Staphylococcus aureus subsp. aureus N315
uuauuccaaauuug

SEQ ID NO: 4070086 - RNA, 23 nt, Staphylococcus aureus subsp. aureus N315
uuauuccaaauuugaaacaaugc

SEQ ID NO: 4070087 - RNA, 15 nt, Staphylococcus aureus subsp. aureus N315
uuauuccgcaacuug

SEQ ID NO: 4070088 - RNA, 17 nt, Staphylococcus aureus subsp. aureus N315
uuauucuaaguuaaaac

SEQ ID NO: 4070089 - RNA, 18 nt, Staphylococcus aureus subsp. aureus N315
uuauucuuaauuuaagua

SEQ ID NO: 4070090 - RNA, 22 nt, Staphylococcus aureus subsp. aureus N315
uuauucuucacuuucaguagau

SEQ ID NO: 4070091 - RNA, 22 nt, Staphylococcus aureus subsp. aureus N315
uuauucuuuauauuugugaaug

SEQ ID NO: 4070092 - RNA, 20 nt, Staphylococcus aureus subsp. aureus N315
uuauugaaaagauaaacaag

SEQ ID NO: 4070093 - RNA, 21 nt, Staphylococcus aureus subsp. aureus N315
uuauugaaauuuuuaauauac

SEQ ID NO: 4070094 - RNA, 23 nt, Staphylococcus aureus subsp. aureus N315
uuauugaauuugaauaagugguu

SEQ ID NO: 4070095 - RNA, 15 nt, Staphylococcus aureus subsp. aureus N315
uuauugagaauauuu

SEQ ID NO: 4070096 - RNA, 20 nt, Staphylococcus aureus subsp. aureus N315
uuauugaguaucaugcuuuu

SEQ ID NO: 4070097 - RNA, 15 nt, Staphylococcus aureus subsp. aureus N315
uuauugcaauaaaau

SEQ ID NO: 4070098 - RNA, 21 nt, Staphylococcus aureus subsp. aureus N315
uuauugccgguuaaauuauuu

SEQ ID NO: 4070099 - RNA, 20 nt, Staphylococcus aureus subsp. aureus N315
uuauugguuacuguaguacu

SEQ ID NO: 4070100 - RNA, 17 nt, Staphylococcus aureus subsp. aureus N315
uuauugguugaaauuaa

SEQ ID NO: 4070101 - RNA, 17 nt, Staphylococcus aureus subsp. aureus N315
uuauuguuccaaucuuu

SEQ ID NO: 4070102 - RNA, 15 nt, Staphylococcus aureus subsp. aureus N315
uuauuuaaaaauagc

SEQ ID NO: 4070103 - RNA, 24 nt, Staphylococcus aureus subsp. aureus N315
uucaaucauucacuucaaguuaug

SEQ ID NO: 4070104 - RNA, 12 nt, Staphylococcus aureus subsp. aureus N315
uucaauccuuug

SEQ ID NO: 4070105 - RNA, 16 nt, Staphylococcus aureus subsp. aureus N315
uucaaucgcauuuugu

SEQ ID NO: 4070106 - RNA, 13 nt, Staphylococcus aureus subsp. aureus N315
uucaaucgucaca

SEQ ID NO: 4070107 - RNA, 16 nt, Staphylococcus aureus subsp. aureus N315
uucaaucgucacauca

SEQ ID NO: 4070108 - RNA, 15 nt, Staphylococcus aureus subsp. aureus N315
uucaaugauuuuaua

SEQ ID NO: 4070109 - RNA, 18 nt, Staphylococcus aureus subsp. aureus N315
uucaaugauuuuauaaua

SEQ ID NO: 4070110 - RNA, 18 nt, Staphylococcus aureus subsp. aureus N315
uucaaugauuuuuaaaaa

SEQ ID NO: 4070111 - RNA, 19 nt, Staphylococcus aureus subsp. aureus N315
uucaaugauuuuuaaaaau

SEQ ID NO: 4070112 - RNA, 19 nt, Staphylococcus aureus subsp. aureus N315
uucaauguaauuuucacuu

SEQ ID NO: 4070113 - RNA, 22 nt, Staphylococcus aureus subsp. aureus N315
uucaaugucugcaucagaccua

SEQ ID NO: 4070114 - RNA, 16 nt, Staphylococcus aureus subsp. aureus N315
uucaauguucaauuca

SEQ ID NO: 4070115 - RNA, 14 nt, Staphylococcus aureus subsp. aureus N315
uucaauguuuuaaa

SEQ ID NO: 4070116 - RNA, 17 nt, Staphylococcus aureus subsp. aureus N315
uucaauguuuuaaauuu

SEQ ID NO: 4070117 - RNA, 16 nt, Staphylococcus aureus subsp. aureus N315
uucaauuaaauguuua

SEQ ID NO: 4070118 - RNA, 20 nt, Staphylococcus aureus subsp. aureus N315
uucaauuaauuuaaaugcuu

SEQ ID NO: 4070119 - RNA, 21 nt, Staphylococcus aureus subsp. aureus N315
uucaauucgcucacaugugaa

SEQ ID NO: 4070120 - RNA, 15 nt, Staphylococcus aureus subsp. aureus N315
uucaauucuuacacc

SEQ ID NO: 4070121 - RNA, 16 nt, Staphylococcus aureus subsp. aureus N315
uucaauugacauuaau

SEQ ID NO: 4070122 - RNA, 15 nt, Staphylococcus aureus subsp. aureus N315
uucaauugucucaau

SEQ ID NO: 4070123 - RNA, 18 nt, Staphylococcus aureus subsp. aureus N315
uucaauuuaauagacauu

SEQ ID NO: 4070124 - RNA, 22 nt, Staphylococcus aureus subsp. aureus N315
uucaauuucauuuuugauaacu

SEQ ID NO: 4070125 - RNA, 18 nt, Staphylococcus aureus subsp. aureus N315
uucacacagcuucauuaa

SEQ ID NO: 4070126 - RNA, 22 nt, Staphylococcus aureus subsp. aureus N315
uucacaugaauuuuaauauauu

SEQ ID NO: 4070127 - RNA, 13 nt, Staphylococcus aureus subsp. aureus N315
uucacauuuaucc

SEQ ID NO: 4070128 - RNA, 18 nt, Staphylococcus aureus subsp. aureus N315
uucacauuuauccuuuaa

SEQ ID NO: 4070129 - RNA, 14 nt, Staphylococcus aureus subsp. aureus N315
uucaccaauauuaa

SEQ ID NO: 4070130 - RNA, 21 nt, Staphylococcus aureus subsp. aureus N315
uucacgaauaucuuaaagaau

SEQ ID NO: 4070131 - RNA, 16 nt, Staphylococcus aureus subsp. aureus N315
uucacgcugaaauuuu

SEQ ID NO: 4070132 - RNA, 16 nt, Staphylococcus aureus subsp. aureus N315
uucacguaaugaauca

SEQ ID NO: 4070133 - RNA, 20 nt, Staphylococcus aureus subsp. aureus N315
uucacguaauugaguuguug

SEQ ID NO: 4070134 - RNA, 16 nt, Staphylococcus aureus subsp. aureus N315
uucacuaaaaauauau

SEQ ID NO: 4070135 - RNA, 20 nt, Staphylococcus aureus subsp. aureus N315
uucacuaaaaauauauuuca

SEQ ID NO: 4070136 - RNA, 18 nt, Staphylococcus aureus subsp. aureus N315
uucacuaaauucaauaau

SEQ ID NO: 4070137 - RNA, 20 nt, Staphylococcus aureus subsp. aureus N315
uucacuaaauucaauaaucu

SEQ ID NO: 4070138 - RNA, 13 nt, Staphylococcus aureus subsp. aureus N315
uucacuacuuuuu

SEQ ID NO: 4070139 - RNA, 19 nt, Staphylococcus aureus subsp. aureus N315
uucacuguauaaggaugua

SEQ ID NO: 4070140 - RNA, 12 nt, Staphylococcus aureus subsp. aureus N315
uucacuguuuua

SEQ ID NO: 4070141 - RNA, 23 nt, Staphylococcus aureus subsp. aureus N315
uucacuucgccaagccaucuuuc

SEQ ID NO: 4070142 - RNA, 13 nt, Staphylococcus aureus subsp. aureus N315
uucacuuuaacuu

SEQ ID NO: 4070143 - RNA, 16 nt, Staphylococcus aureus subsp. aureus N315
uucacuuuuuauauca

SEQ ID NO: 4070144 - RNA, 19 nt, Staphylococcus aureus subsp. aureus N315
uucagaacuaugaauagau

SEQ ID NO: 4070145 - RNA, 23 nt, Staphylococcus aureus subsp. aureus N315
uucagaugaauaauguuuccauu

SEQ ID NO: 4070146 - RNA, 16 nt, Staphylococcus aureus subsp. aureus N315
uucagauuuguauuuu

SEQ ID NO: 4070147 - RNA, 19 nt, Staphylococcus aureus subsp. aureus N315
uucagcauugggacauaaa

SEQ ID NO: 4070148 - RNA, 15 nt, Staphylococcus aureus subsp. aureus N315
uucagcauuugcugu

SEQ ID NO: 4070149 - RNA, 22 nt, Staphylococcus aureus subsp. aureus N315
uucagcgauaacguacaaugua

SEQ ID NO: 4070150 - RNA, 21 nt, Staphylococcus aureus subsp. aureus N315
uucagguuuuaugaauugagu

SEQ ID NO: 4070151 - RNA, 21 nt, Staphylococcus aureus subsp. aureus N315
uucaguaacguacuguguaau

SEQ ID NO: 4070152 - RNA, 21 nt, Staphylococcus aureus subsp. aureus N315
uucaguacgguuauuuaauaa

SEQ ID NO: 4070153 - RNA, 15 nt, Staphylococcus aureus subsp. aureus N315
uucaguauacucauc

SEQ ID NO: 4070154 - RNA, 17 nt, Staphylococcus aureus subsp. aureus N315
uucaguucaaacagaaa

SEQ ID NO: 4070155 - RNA, 17 nt, Staphylococcus aureus subsp. aureus N315
uucaguuuguuggucuu

SEQ ID NO: 4070156 - RNA, 16 nt, Staphylococcus aureus subsp. aureus N315
uucauaaacucuuaca

SEQ ID NO: 4070157 - RNA, 18 nt, Staphylococcus aureus subsp. aureus N315
uucauaaaugacugaauu

SEQ ID NO: 4070158 - RNA, 20 nt, Staphylococcus aureus subsp. aureus N315
uucauaaaugacugaauuaa

SEQ ID NO: 4070159 - RNA, 14 nt, Staphylococcus aureus subsp. aureus N315
uucauaaauuguuu

SEQ ID NO: 4070160 - RNA, 19 nt, Staphylococcus aureus subsp. aureus N315
uucauaagaaaaauguguu

SEQ ID NO: 4070161 - RNA, 22 nt, Staphylococcus aureus subsp. aureus N315
uucauaagucuuaacaaauuaa

SEQ ID NO: 4070162 - RNA, 14 nt, Staphylococcus aureus subsp. aureus N315
uucauaaugaucaa

SEQ ID NO: 4070163 - RNA, 14 nt, Staphylococcus aureus subsp. aureus N315
uucauaauuuguug

SEQ ID NO: 4070164 - RNA, 15 nt, Staphylococcus aureus subsp. aureus N315
uucauacauaacaca

SEQ ID NO: 4070165 - RNA, 18 nt, Staphylococcus aureus subsp. aureus N315
uucauagaugcauaaaaa

SEQ ID NO: 4070166 - RNA, 19 nt, Staphylococcus aureus subsp. aureus N315
uucauagaugcauaaaaac

SEQ ID NO: 4070167 - RNA, 14 nt, Staphylococcus aureus subsp. aureus N315
uucauaguuuaugu

SEQ ID NO: 4070168 - RNA, 13 nt, Staphylococcus aureus subsp. aureus N315
uucauauaaugcu

SEQ ID NO: 4070169 - RNA, 20 nt, Staphylococcus aureus subsp. aureus N315
uucauauauuuuguuaauaa

SEQ ID NO: 4070170 - RNA, 14 nt, Staphylococcus aureus subsp. aureus N315
uucauaucuuucaa

SEQ ID NO: 4070171 - RNA, 16 nt, Staphylococcus aureus subsp. aureus N315
uucauauggugaacug

SEQ ID NO: 4070172 - RNA, 13 nt, Staphylococcus aureus subsp. aureus N315
uucauauuaacug

SEQ ID NO: 4070173 - RNA, 14 nt, Staphylococcus aureus subsp. aureus N315
uucauauuaacugu

SEQ ID NO: 4070174 - RNA, 17 nt, Staphylococcus aureus subsp. aureus N315
uucauauucaaauuuac

SEQ ID NO: 4070175 - RNA, 12 nt, Staphylococcus aureus subsp. aureus N315
uucauauuguuu

SEQ ID NO: 4070176 - RNA, 16 nt, Staphylococcus aureus subsp. aureus N315
uucauauuguuuagga

SEQ ID NO: 4070177 - RNA, 19 nt, Staphylococcus aureus subsp. aureus N315
uucaucaaacaacaucacu

SEQ ID NO: 4070178 - RNA, 15 nt, Staphylococcus aureus subsp. aureus N315
uucaucaauaacuau

SEQ ID NO: 4070179 - RNA, 19 nt, Staphylococcus aureus subsp. aureus N315
uucaucaguaccaaagaaa

SEQ ID NO: 4070180 - RNA, 19 nt, Staphylococcus aureus subsp. aureus N315
uucaucauaaucugcugcu

SEQ ID NO: 4070181 - RNA, 14 nt, Staphylococcus aureus subsp. aureus N315
uucaucauuaaaau

SEQ ID NO: 4070182 - RNA, 21 nt, Staphylococcus aureus subsp. aureus N315
uucaucguucauauauuuugu

SEQ ID NO: 4070183 - RNA, 12 nt, Staphylococcus aureus subsp. aureus N315
uucaucuaaaug

SEQ ID NO: 4070184 - RNA, 15 nt, Staphylococcus aureus subsp. aureus N315
uucaucuaaaugaug

SEQ ID NO: 4070185 - RNA, 15 nt, Staphylococcus aureus subsp. aureus N315
uucaucucagcaaua

SEQ ID NO: 4070186 - RNA, 19 nt, Staphylococcus aureus subsp. aureus N315
uucaucucuuauaaguuca

SEQ ID NO: 4070187 - RNA, 12 nt, Staphylococcus aureus subsp. aureus N315
uucaucuucaaa

SEQ ID NO: 4070188 - RNA, 16 nt, Staphylococcus aureus subsp. aureus N315
uucaucuucuucaaaa

SEQ ID NO: 4070189 - RNA, 21 nt, Staphylococcus aureus subsp. aureus N315
uucaucuugcaaguauuuucu

SEQ ID NO: 4070190 - RNA, 12 nt, Staphylococcus aureus subsp. aureus N315
uucaucuuucaa

SEQ ID NO: 4070191 - RNA, 18 nt, Staphylococcus aureus subsp. aureus N315
uucgcuaauguaccaauc

SEQ ID NO: 4070192 - RNA, 16 nt, Staphylococcus aureus subsp. aureus N315
uucguaacauuuaaaa

SEQ ID NO: 4070193 - RNA, 17 nt, Staphylococcus aureus subsp. aureus N315
uucguaacauuuaaaaa

SEQ ID NO: 4070194 - RNA, 19 nt, Staphylococcus aureus subsp. aureus N315
uucguaacauuuaaaaaau

SEQ ID NO: 4070195 - RNA, 13 nt, Staphylococcus aureus subsp. aureus N315
uucguaauaaaca

SEQ ID NO: 4070196 - RNA, 21 nt, Staphylococcus aureus subsp. aureus N315
uucguaauugucuuuauaaaa

SEQ ID NO: 4070197 - RNA, 23 nt, Staphylococcus aureus subsp. aureus N315
uucguccaacauguaacaaaaua

SEQ ID NO: 4070198 - RNA, 22 nt, Staphylococcus aureus subsp. aureus N315
uucgucuacuauuuuuucuaau

SEQ ID NO: 4070199 - RNA, 21 nt, Staphylococcus aureus subsp. aureus N315
uucgugauuacauucuauacu

SEQ ID NO: 4070200 - RNA, 21 nt, Staphylococcus aureus subsp. aureus N315
uucguuauagacuaacuguac

SEQ ID NO: 4070201 - RNA, 20 nt, Staphylococcus aureus subsp. aureus N315
uucguugcacuuuaauauca

SEQ ID NO: 4070202 - RNA, 15 nt, Staphylococcus aureus subsp. aureus N315
uucguuugaauuauu

SEQ ID NO: 4070203 - RNA, 23 nt, Staphylococcus aureus subsp. aureus N315
uucguuuugcuaaccaucauaaa

SEQ ID NO: 4070204 - RNA, 19 nt, Staphylococcus aureus subsp. aureus N315
uucuaaaaaauuaaaaauu

SEQ ID NO: 4070205 - RNA, 17 nt, Staphylococcus aureus subsp. aureus N315
uucuaaaagaauuauuc

SEQ ID NO: 4070206 - RNA, 22 nt, Staphylococcus aureus subsp. aureus N315
uucuaaaagaauuauucaagua

SEQ ID NO: 4070207 - RNA, 12 nt, Staphylococcus aureus subsp. aureus N315
uucuaaaaguug

SEQ ID NO: 4070208 - RNA, 14 nt, Staphylococcus aureus subsp. aureus N315
uucuaaaauaaaac

SEQ ID NO: 4070209 - RNA, 18 nt, Staphylococcus aureus subsp. aureus N315
uucuaaacaacuucugaa

SEQ ID NO: 4070210 - RNA, 23 nt, Staphylococcus aureus subsp. aureus N315
uucuaaagcgauuuccaucauuu

SEQ ID NO: 4070211 - RNA, 16 nt, Staphylococcus aureus subsp. aureus N315
uucuaaaucaauauaa

SEQ ID NO: 4070212 - RNA, 22 nt, Staphylococcus aureus subsp. aureus N315
uucuaaauuauuuauucauuau

SEQ ID NO: 4070213 - RNA, 13 nt, Staphylococcus aureus subsp. aureus N315
uucuaaccacuuc

SEQ ID NO: 4070214 - RNA, 17 nt, Staphylococcus aureus subsp. aureus N315
uucuaaccauucguaau

SEQ ID NO: 4070215 - RNA, 17 nt, Staphylococcus aureus subsp. aureus N315
uucuaacgguaaauaac

SEQ ID NO: 4070216 - RNA, 19 nt, Staphylococcus aureus subsp. aureus N315
uucuaagucucuugucauu

SEQ ID NO: 4070217 - RNA, 16 nt, Staphylococcus aureus subsp. aureus N315
uucuaaguguuuuaua

SEQ ID NO: 4070218 - RNA, 19 nt, Staphylococcus aureus subsp. aureus N315
uucuaauacaccaaaucca

SEQ ID NO: 4070219 - RNA, 17 nt, Staphylococcus aureus subsp. aureus N315
uucuaaugcuaauuuaa

SEQ ID NO: 4070220 - RNA, 20 nt, Staphylococcus aureus subsp. aureus N315
uucuaaugcuaauuuaacug

SEQ ID NO: 4070221 - RNA, 19 nt, Staphylococcus aureus subsp. aureus N315
uucuaaugcugcuucuuca

SEQ ID NO: 4070222 - RNA, 14 nt, Staphylococcus aureus subsp. aureus N315
uucuaauucugaaa

SEQ ID NO: 4070223 - RNA, 13 nt, Staphylococcus aureus subsp. aureus N315
uucuaauuugcaa

SEQ ID NO: 4070224 - RNA, 13 nt, Staphylococcus aureus subsp. aureus N315
uucuaauuuuuca

SEQ ID NO: 4070225 - RNA, 22 nt, Staphylococcus aureus subsp. aureus N315
uucuacaacuucauuaguugcc

SEQ ID NO: 4070226 - RNA, 21 nt, Staphylococcus aureus subsp. aureus N315
uucuacagcacugaaaucuag

SEQ ID NO: 4070227 - RNA, 21 nt, Staphylococcus aureus subsp. aureus N315
uucuacaggcaaugcaaguug

SEQ ID NO: 4070228 - RNA, 14 nt, Staphylococcus aureus subsp. aureus N315
uucuacagguaaug

SEQ ID NO: 4070229 - RNA, 17 nt, Staphylococcus aureus subsp. aureus N315
uucuacagguaaugcaa

SEQ ID NO: 4070230 - RNA, 19 nt, Staphylococcus aureus subsp. aureus N315
uucuacagguaaugcaagu

SEQ ID NO: 4070231 - RNA, 23 nt, Staphylococcus aureus subsp. aureus N315
uucuacaguuggagguccauaau

SEQ ID NO: 4070232 - RNA, 16 nt, Staphylococcus aureus subsp. aureus N315
uucuaccaauaauucc

SEQ ID NO: 4070233 - RNA, 21 nt, Staphylococcus aureus subsp. aureus N315
uucuacucuagcggaacguaa

SEQ ID NO: 4070234 - RNA, 18 nt, Staphylococcus aureus subsp. aureus N315
uucuacuuaguaauaaga

SEQ ID NO: 4070235 - RNA, 19 nt, Staphylococcus aureus subsp. aureus N315
uucuagauucauauuuaua

SEQ ID NO: 4070236 - RNA, 22 nt, Staphylococcus aureus subsp. aureus N315
uucuagcaacugaucauuuuca

SEQ ID NO: 4070237 - RNA, 21 nt, Staphylococcus aureus subsp. aureus N315
uucuagcaucgauguuaucga

SEQ ID NO: 4070238 - RNA, 13 nt, Staphylococcus aureus subsp. aureus N315
uucuagcuuuagu

SEQ ID NO: 4070239 - RNA, 12 nt, Staphylococcus aureus subsp. aureus N315
uucuagguaaua

SEQ ID NO: 4070240 - RNA, 16 nt, Staphylococcus aureus subsp. aureus N315
uucuaguagcuugaau

SEQ ID NO: 4070241 - RNA, 23 nt, Staphylococcus aureus subsp. aureus N315
uucuauacaaugaauuucuaauu

SEQ ID NO: 4070242 - RNA, 20 nt, Staphylococcus aureus subsp. aureus N315
uucuauacauuccaaaguac

SEQ ID NO: 4070243 - RNA, 13 nt, Staphylococcus aureus subsp. aureus N315
uucuauacuuuua

SEQ ID NO: 4070244 - RNA, 13 nt, Staphylococcus aureus subsp. aureus N315
uucuauagaaaaa

SEQ ID NO: 4070245 - RNA, 17 nt, Staphylococcus aureus subsp. aureus N315
uucuauauaauuuauuu

SEQ ID NO: 4070246 - RNA, 13 nt, Staphylococcus aureus subsp. aureus N315
uucuaucuucaca

SEQ ID NO: 4070247 - RNA, 18 nt, Staphylococcus aureus subsp. aureus N315
uucuaugcucuacgaagu

SEQ ID NO: 4070248 - RNA, 17 nt, Staphylococcus aureus subsp. aureus N315
uucuauggcacaaauga

SEQ ID NO: 4070249 - RNA, 22 nt, Staphylococcus aureus subsp. aureus N315
uucuauguagcaggcaacuuuu

SEQ ID NO: 4070250 - RNA, 19 nt, Staphylococcus aureus subsp. aureus N315
uucuauuaaacauuuuuga

SEQ ID NO: 4070251 - RNA, 13 nt, Staphylococcus aureus subsp. aureus N315
uucuauuaagaaa

SEQ ID NO: 4070252 - RNA, 19 nt, Staphylococcus aureus subsp. aureus N315
uucuauuaagaaauacuca

SEQ ID NO: 4070253 - RNA, 12 nt, Staphylococcus aureus subsp. aureus N315
uucuauucaaaa

SEQ ID NO: 4070254 - RNA, 15 nt, Staphylococcus aureus subsp. aureus N315
uucuauucaaaaagg

SEQ ID NO: 4070255 - RNA, 20 nt, Staphylococcus aureus subsp. aureus N315
uucuauuuuugauuuaauaa

SEQ ID NO: 4070256 - RNA, 16 nt, Staphylococcus aureus subsp. aureus N315
uucucaauuaauuuag

SEQ ID NO: 4070257 - RNA, 17 nt, Staphylococcus aureus subsp. aureus N315
uucucacugcuguucuu

SEQ ID NO: 4070258 - RNA, 17 nt, Staphylococcus aureus subsp. aureus N315
uucucauuaaccuuaca

SEQ ID NO: 4070259 - RNA, 13 nt, Staphylococcus aureus subsp. aureus N315
uucucauugaaau

SEQ ID NO: 4070260 - RNA, 15 nt, Staphylococcus aureus subsp. aureus N315
uucucccuuaaauac

SEQ ID NO: 4070261 - RNA, 21 nt, Staphylococcus aureus subsp. aureus N315
uucucgauacaaaggauuauu

SEQ ID NO: 4070262 - RNA, 13 nt, Staphylococcus aureus subsp. aureus N315
uucucuacuaaua

SEQ ID NO: 4070263 - RNA, 20 nt, Staphylococcus aureus subsp. aureus N315
uucucuaucaguaugaaguu

SEQ ID NO: 4070264 - RNA, 23 nt, Staphylococcus aureus subsp. aureus N315
uucucuauugauuguaccaguaa

SEQ ID NO: 4070265 - RNA, 15 nt, Staphylococcus aureus subsp. aureus N315
uucucugcuucuaaa

SEQ ID NO: 4070266 - RNA, 21 nt, Staphylococcus aureus subsp. aureus N315
uucucugcuucuaaaacauca

SEQ ID NO: 4070267 - RNA, 13 nt, Staphylococcus aureus subsp. aureus N315
uucucuuaaauau

SEQ ID NO: 4070268 - RNA, 21 nt, Staphylococcus aureus subsp. aureus N315
uucugaaaugauacauuauua

SEQ ID NO: 4070269 - RNA, 23 nt, Staphylococcus aureus subsp. aureus N315
uucugaaaugauacauuauuaaa

SEQ ID NO: 4070270 - RNA, 15 nt, Staphylococcus aureus subsp. aureus N315
uucugauuauguuca

SEQ ID NO: 4070271 - RNA, 19 nt, Staphylococcus aureus subsp. aureus N315
uucugcaugggcuucugcu

SEQ ID NO: 4070272 - RNA, 20 nt, Staphylococcus aureus subsp. aureus N315
uucugcgugcuuaauuacaa

SEQ ID NO: 4070273 - RNA, 19 nt, Staphylococcus aureus subsp. aureus N315
uucuguacguuuuaaauaa

SEQ ID NO: 4070274 - RNA, 23 nt, Staphylococcus aureus subsp. aureus N315
uucuguguuggggcccacacccc

SEQ ID NO: 4070275 - RNA, 19 nt, Staphylococcus aureus subsp. aureus N315
uucuguugcaguuucaauc

SEQ ID NO: 4070276 - RNA, 15 nt, Staphylococcus aureus subsp. aureus N315
uucuguuucaucacc

SEQ ID NO: 4070277 - RNA, 11 nt, Staphylococcus aureus subsp. aureus N315
uucuuaaaaag

SEQ ID NO: 4070278 - RNA, 23 nt, Staphylococcus aureus subsp. aureus N315
uugaaugauauuaacuguaccau

SEQ ID NO: 4070279 - RNA, 20 nt, Staphylococcus aureus subsp. aureus N315
uugaauggcucguuuuuuua

SEQ ID NO: 4070280 - RNA, 17 nt, Staphylococcus aureus subsp. aureus N315
uugaauugaaaaauuaa

SEQ ID NO: 4070281 - RNA, 21 nt, Staphylococcus aureus subsp. aureus N315
uugaauuuaauacuauaguaa

SEQ ID NO: 4070282 - RNA, 20 nt, Staphylococcus aureus subsp. aureus N315
uugaauuugaauaagugguu

SEQ ID NO: 4070283 - RNA, 16 nt, Staphylococcus aureus subsp. aureus N315
uugaauuuuauuaggu

SEQ ID NO: 4070284 - RNA, 13 nt, Staphylococcus aureus subsp. aureus N315
uugacaauacaaa

SEQ ID NO: 4070285 - RNA, 19 nt, Staphylococcus aureus subsp. aureus N315
uugacacacccaaauuuag

SEQ ID NO: 4070286 - RNA, 18 nt, Staphylococcus aureus subsp. aureus N315
uugacacauuauugaaau

SEQ ID NO: 4070287 - RNA, 23 nt, Staphylococcus aureus subsp. aureus N315
uugacauaauccagccacaccaa

SEQ ID NO: 4070288 - RNA, 14 nt, Staphylococcus aureus subsp. aureus N315
uugacauuuacauc

SEQ ID NO: 4070289 - RNA, 14 nt, Staphylococcus aureus subsp. aureus N315
uugacauuugacca

SEQ ID NO: 4070290 - RNA, 15 nt, Staphylococcus aureus subsp. aureus N315
uugacauuugaccaa

SEQ ID NO: 4070291 - RNA, 17 nt, Staphylococcus aureus subsp. aureus N315
uugaccacaacuucuuu

SEQ ID NO: 4070292 - RNA, 19 nt, Staphylococcus aureus subsp. aureus N315
uugaccaccugauaaugca

SEQ ID NO: 4070293 - RNA, 14 nt, Staphylococcus aureus subsp. aureus N315
uugacguucugauc

SEQ ID NO: 4070294 - RNA, 17 nt, Staphylococcus aureus subsp. aureus N315
uugacuuuaauugcucu

SEQ ID NO: 4070295 - RNA, 19 nt, Staphylococcus aureus subsp. aureus N315
uugagaaagacuauauaac

SEQ ID NO: 4070296 - RNA, 18 nt, Staphylococcus aureus subsp. aureus N315
uugagacaauucguaaau

SEQ ID NO: 4070297 - RNA, 18 nt, Staphylococcus aureus subsp. aureus N315
uugagcaaugucuuuaau

SEQ ID NO: 4070298 - RNA, 22 nt, Staphylococcus aureus subsp. aureus N315
uugagcaauucuugaaaaguuu

SEQ ID NO: 4070299 - RNA, 23 nt, Staphylococcus aureus subsp. aureus N315
uugaggaccacggucuugauauu

SEQ ID NO: 4070300 - RNA, 16 nt, Staphylococcus aureus subsp. aureus N315
uugagguguggaguaa

SEQ ID NO: 4070301 - RNA, 13 nt, Staphylococcus aureus subsp. aureus N315
uugaguauuaaau

SEQ ID NO: 4070302 - RNA, 14 nt, Staphylococcus aureus subsp. aureus N315
uugaguauuaaauu

SEQ ID NO: 4070303 - RNA, 21 nt, Staphylococcus aureus subsp. aureus N315
uugaguguguccaucauuugu

SEQ ID NO: 4070304 - RNA, 13 nt, Staphylococcus aureus subsp. aureus N315
uugaguuauauuu

SEQ ID NO: 4070305 - RNA, 18 nt, Staphylococcus aureus subsp. aureus N315
uugaguugaaaauaaucg

SEQ ID NO: 4070306 - RNA, 21 nt, Staphylococcus aureus subsp. aureus N315
uugauaaaaaaugaauguuaa

SEQ ID NO: 4070307 - RNA, 13 nt, Staphylococcus aureus subsp. aureus N315
uugauaaaacuaa

SEQ ID NO: 4070308 - RNA, 18 nt, Staphylococcus aureus subsp. aureus N315
uugauaaaugcgguugau

SEQ ID NO: 4070309 - RNA, 16 nt, Staphylococcus aureus subsp. aureus N315
uugauaacaauuuuaa

SEQ ID NO: 4070310 - RNA, 13 nt, Staphylococcus aureus subsp. aureus N315
uugauaagucuug

SEQ ID NO: 4070311 - RNA, 12 nt, Staphylococcus aureus subsp. aureus N315
uugauaauagcc

SEQ ID NO: 4070312 - RNA, 23 nt, Staphylococcus aureus subsp. aureus N315
uugauaaugcuacuauuaaauaa

SEQ ID NO: 4070313 - RNA, 15 nt, Staphylococcus aureus subsp. aureus N315
uugauagauagaaau

SEQ ID NO: 4070314 - RNA, 15 nt, Staphylococcus aureus subsp. aureus N315
uugauagcuaaugca

SEQ ID NO: 4070315 - RNA, 11 nt, Staphylococcus aureus subsp. aureus N315
uugauagucac

SEQ ID NO: 4070316 - RNA, 12 nt, Staphylococcus aureus subsp. aureus N315
uugauauaaaaa

SEQ ID NO: 4070317 - RNA, 13 nt, Staphylococcus aureus subsp. aureus N315
uugauauaaaaag

SEQ ID NO: 4070318 - RNA, 21 nt, Staphylococcus aureus subsp. aureus N315
uugauauaaaaagugaaagua

SEQ ID NO: 4070319 - RNA, 23 nt, Staphylococcus aureus subsp. aureus N315
uugauauaaaaagugaaaguauu

SEQ ID NO: 4070320 - RNA, 21 nt, Staphylococcus aureus subsp. aureus N315
uugauauaguuauaugugcuu

SEQ ID NO: 4070321 - RNA, 13 nt, Staphylococcus aureus subsp. aureus N315
uugauauauauuu

SEQ ID NO: 4070322 - RNA, 18 nt, Staphylococcus aureus subsp. aureus N315
uugauauauauuuugcaa

SEQ ID NO: 4070323 - RNA, 21 nt, Staphylococcus aureus subsp. aureus N315
uugauaucgaaacgcuuugca

SEQ ID NO: 4070324 - RNA, 23 nt, Staphylococcus aureus subsp. aureus N315
uugauaucuacagagaaucaauu

SEQ ID NO: 4070325 - RNA, 19 nt, Staphylococcus aureus subsp. aureus N315
uugauaugcucucuucaaa

SEQ ID NO: 4070326 - RNA, 19 nt, Staphylococcus aureus subsp. aureus N315
uugauaugguuagagaaaa

SEQ ID NO: 4070327 - RNA, 20 nt, Staphylococcus aureus subsp. aureus N315
uugauauguuuccucuuuaa

SEQ ID NO: 4070328 - RNA, 16 nt, Staphylococcus aureus subsp. aureus N315
uugaucaaaaagacag

SEQ ID NO: 4070329 - RNA, 11 nt, Staphylococcus aureus subsp. aureus N315
uugaucaaccu

SEQ ID NO: 4070330 - RNA, 17 nt, Staphylococcus aureus subsp. aureus N315
uugaucaacuauauaua

SEQ ID NO: 4070331 - RNA, 19 nt, Staphylococcus aureus subsp. aureus N315
uugaucauuugacauaauc

SEQ ID NO: 4070332 - RNA, 16 nt, Staphylococcus aureus subsp. aureus N315
uugaucugauuucacu

SEQ ID NO: 4070333 - RNA, 13 nt, Staphylococcus aureus subsp. aureus N315
uugaucuuuuaua

SEQ ID NO: 4070334 - RNA, 12 nt, Staphylococcus aureus subsp. aureus N315
uugaugaaaaca

SEQ ID NO: 4070335 - RNA, 12 nt, Staphylococcus aureus subsp. aureus N315
uugaugaauaaa

SEQ ID NO: 4070336 - RNA, 15 nt, Staphylococcus aureus subsp. aureus N315
uugauggauauucaa

SEQ ID NO: 4070337 - RNA, 16 nt, Staphylococcus aureus subsp. aureus N315
uugauggauauucaau

SEQ ID NO: 4070338 - RNA, 23 nt, Staphylococcus aureus subsp. aureus N315
uugaugguuaaugacuaugcaaa

SEQ ID NO: 4070339 - RNA, 15 nt, Staphylococcus aureus subsp. aureus N315
uugauguaauucugu

SEQ ID NO: 4070340 - RNA, 14 nt, Staphylococcus aureus subsp. aureus N315
uugauguguugcau

SEQ ID NO: 4070341 - RNA, 15 nt, Staphylococcus aureus subsp. aureus N315
uugauuaaaaguguu

SEQ ID NO: 4070342 - RNA, 12 nt, Staphylococcus aureus subsp. aureus N315
uugauuaaaauc

SEQ ID NO: 4070343 - RNA, 19 nt, Staphylococcus aureus subsp. aureus N315
uugauuaacacaauccuuu

SEQ ID NO: 4070344 - RNA, 12 nt, Staphylococcus aureus subsp. aureus N315
uugauuauguaa

SEQ ID NO: 4070345 - RNA, 13 nt, Staphylococcus aureus subsp. aureus N315
uugauucuaaaua

SEQ ID NO: 4070346 - RNA, 14 nt, Staphylococcus aureus subsp. aureus N315
uugauucuuauaug

SEQ ID NO: 4070347 - RNA, 15 nt, Staphylococcus aureus subsp. aureus N315
uugauugauaugguu

SEQ ID NO: 4070348 - RNA, 16 nt, Staphylococcus aureus subsp. aureus N315
uugauuuaacaaccuc

SEQ ID NO: 4070349 - RNA, 18 nt, Staphylococcus aureus subsp. aureus N315
uugauuuagcauacauua

SEQ ID NO: 4070350 - RNA, 19 nt, Staphylococcus aureus subsp. aureus N315
uugauuuggguaauguuuu

SEQ ID NO: 4070351 - RNA, 14 nt, Staphylococcus aureus subsp. aureus N315
uugcaaaaaaacaa

SEQ ID NO: 4070352 - RNA, 20 nt, Staphylococcus aureus subsp. aureus N315
uugcaaaaaaacaaauauua

SEQ ID NO: 4070353 - RNA, 20 nt, Staphylococcus aureus subsp. aureus N315
uugcaaaacgcauuucaugu

SEQ ID NO: 4070354 - RNA, 22 nt, Staphylococcus aureus subsp. aureus N315
uugcaaaacgcauuucaugugu

SEQ ID NO: 4070355 - RNA, 15 nt, Staphylococcus aureus subsp. aureus N315
uugcaaauuaucauu

SEQ ID NO: 4070356 - RNA, 15 nt, Staphylococcus aureus subsp. aureus N315
uugcaacauauuuuc

SEQ ID NO: 4070357 - RNA, 13 nt, Staphylococcus aureus subsp. aureus N315
uugcaauaaaauu

SEQ ID NO: 4070358 - RNA, 22 nt, Staphylococcus aureus subsp. aureus N315
uugcaauaaaauuagccuaauu

SEQ ID NO: 4070359 - RNA, 16 nt, Staphylococcus aureus subsp. aureus N315
uugcaaucguauguaa

SEQ ID NO: 4070360 - RNA, 19 nt, Staphylococcus aureus subsp. aureus N315
uugcaaugcauauugugcc

SEQ ID NO: 4070361 - RNA, 18 nt, Staphylococcus aureus subsp. aureus N315
uugcaauggcaaccuuuu

SEQ ID NO: 4070362 - RNA, 22 nt, Staphylococcus aureus subsp. aureus N315
uugcacgggugguuuuuaauuu

SEQ ID NO: 4070363 - RNA, 18 nt, Staphylococcus aureus subsp. aureus N315
uugcacgucuuguaucaa

SEQ ID NO: 4070364 - RNA, 17 nt, Staphylococcus aureus subsp. aureus N315
uugcacuaugcauaaua

SEQ ID NO: 4070365 - RNA, 18 nt, Staphylococcus aureus subsp. aureus N315
uugcagauuuugcaaucu

SEQ ID NO: 4070366 - RNA, 15 nt, Staphylococcus aureus subsp. aureus N315
uuguaauuuaaaaua

SEQ ID NO: 4070367 - RNA, 19 nt, Staphylococcus aureus subsp. aureus N315
uuguacacauccucauaau

SEQ ID NO: 4070368 - RNA, 20 nt, Staphylococcus aureus subsp. aureus N315
uuguacacauccucauaauu

SEQ ID NO: 4070369 - RNA, 18 nt, Staphylococcus aureus subsp. aureus N315
uuguacaucauuaaauau

SEQ ID NO: 4070370 - RNA, 22 nt, Staphylococcus aureus subsp. aureus N315
uuguaccaaauaaauuaaauuu

SEQ ID NO: 4070371 - RNA, 16 nt, Staphylococcus aureus subsp. aureus N315
uuguacuucuuugguc

SEQ ID NO: 4070372 - RNA, 20 nt, Staphylococcus aureus subsp. aureus N315
uuguagccuucaacuaaugu

SEQ ID NO: 4070373 - RNA, 18 nt, Staphylococcus aureus subsp. aureus N315
uuguaggaagaccacuau

SEQ ID NO: 4070374 - RNA, 22 nt, Staphylococcus aureus subsp. aureus N315
uuguaggaagaccacuauuuuu

SEQ ID NO: 4070375 - RNA, 19 nt, Staphylococcus aureus subsp. aureus N315
uuguauaccuauuccuauu

SEQ ID NO: 4070376 - RNA, 16 nt, Staphylococcus aureus subsp. aureus N315
uuguaucaacauuaau

SEQ ID NO: 4070377 - RNA, 20 nt, Staphylococcus aureus subsp. aureus N315
uuguaugacggugaaaguuc

SEQ ID NO: 4070378 - RNA, 16 nt, Staphylococcus aureus subsp. aureus N315
uuguaugauaaccauu

SEQ ID NO: 4070379 - RNA, 22 nt, Staphylococcus aureus subsp. aureus N315
uuguauuguuuguagaaauuag

SEQ ID NO: 4070380 - RNA, 18 nt, Staphylococcus aureus subsp. aureus N315
uuguauuguuuucaucau

SEQ ID NO: 4070381 - RNA, 14 nt, Staphylococcus aureus subsp. aureus N315
uuguauuuaaaauc

SEQ ID NO: 4070382 - RNA, 15 nt, Staphylococcus aureus subsp. aureus N315
uuguauuuaaaauca

SEQ ID NO: 4070383 - RNA, 17 nt, Staphylococcus aureus subsp. aureus N315
uuguauuuuauuuauuu

SEQ ID NO: 4070384 - RNA, 16 nt, Staphylococcus aureus subsp. aureus N315
uugucacgaucaaauu

SEQ ID NO: 4070385 - RNA, 19 nt, Staphylococcus aureus subsp. aureus N315
uugucacgaucaaauuuaa

SEQ ID NO: 4070386 - RNA, 19 nt, Staphylococcus aureus subsp. aureus N315
uugucacuuggauucaaau

SEQ ID NO: 4070387 - RNA, 20 nt, Staphylococcus aureus subsp. aureus N315
uugucaguuuuuuuauaagc

SEQ ID NO: 4070388 - RNA, 18 nt, Staphylococcus aureus subsp. aureus N315
uugucaucauguucuaau

SEQ ID NO: 4070389 - RNA, 11 nt, Staphylococcus aureus subsp. aureus N315
uugucaugccu

SEQ ID NO: 4070390 - RNA, 14 nt, Staphylococcus aureus subsp. aureus N315
uuguccaugccuua

SEQ ID NO: 4070391 - RNA, 20 nt, Staphylococcus aureus subsp. aureus N315
uuguccuaacgcuaauuuua

SEQ ID NO: 4070392 - RNA, 23 nt, Staphylococcus aureus subsp. aureus N315
uuguccuuuaagaacauaaccua

SEQ ID NO: 4070393 - RNA, 20 nt, Staphylococcus aureus subsp. aureus N315
uugucucaucauuuaaaauu

SEQ ID NO: 4070394 - RNA, 21 nt, Staphylococcus aureus subsp. aureus N315
uugucucaucauuuaaaauuu

SEQ ID NO: 4070395 - RNA, 13 nt, Staphylococcus aureus subsp. aureus N315
uugucuguauuau

SEQ ID NO: 4070396 - RNA, 16 nt, Staphylococcus aureus subsp. aureus N315
uugucuuaauaugcaa

SEQ ID NO: 4070397 - RNA, 13 nt, Staphylococcus aureus subsp. aureus N315
uugucuuugaaug

SEQ ID NO: 4070398 - RNA, 13 nt, Staphylococcus aureus subsp. aureus N315
uugucuuuuauau

SEQ ID NO: 4070399 - RNA, 16 nt, Staphylococcus aureus subsp. aureus N315
uugugaauaaaauugu

SEQ ID NO: 4070400 - RNA, 18 nt, Staphylococcus aureus subsp. aureus N315
uugugaauuuauuuugua

SEQ ID NO: 4070401 - RNA, 15 nt, Staphylococcus aureus subsp. aureus N315
uugugaguucauaau

SEQ ID NO: 4070402 - RNA, 18 nt, Staphylococcus aureus subsp. aureus N315
uugugauaauucuucaac

SEQ ID NO: 4070403 - RNA, 23 nt, Staphylococcus aureus subsp. aureus N315
uugugaugauaauuaaugccauu

SEQ ID NO: 4070404 - RNA, 13 nt, Staphylococcus aureus subsp. aureus N315
uugugauuuuuug

SEQ ID NO: 4070405 - RNA, 14 nt, Staphylococcus aureus subsp. aureus N315
uugugcuuuuccau

SEQ ID NO: 4070406 - RNA, 23 nt, Staphylococcus aureus subsp. aureus N315
uugugguuguuaauguauuaauu

SEQ ID NO: 4070407 - RNA, 21 nt, Staphylococcus aureus subsp. aureus N315
uuguguguuuuaaaauuauuu

SEQ ID NO: 4070408 - RNA, 13 nt, Staphylococcus aureus subsp. aureus N315
uuguguuugcuuu

SEQ ID NO: 4070409 - RNA, 20 nt, Staphylococcus aureus subsp. aureus N315
uuguguuuuuaauguuugcu

SEQ ID NO: 4070410 - RNA, 23 nt, Staphylococcus aureus subsp. aureus N315
uuguuaauucaacggaacuacua

SEQ ID NO: 4070411 - RNA, 18 nt, Staphylococcus aureus subsp. aureus N315
uuguuaauuuaaagucuu

SEQ ID NO: 4070412 - RNA, 13 nt, Staphylococcus aureus subsp. aureus N315
uuguuaauuucaa

SEQ ID NO: 4070413 - RNA, 14 nt, Staphylococcus aureus subsp. aureus N315
uuguuacauauugc

SEQ ID NO: 4070414 - RNA, 17 nt, Staphylococcus aureus subsp. aureus N315
uuguuaccaaacaauac

SEQ ID NO: 4070415 - RNA, 17 nt, Staphylococcus aureus subsp. aureus N315
uuguuaguuuucuuaaa

SEQ ID NO: 4070416 - RNA, 14 nt, Staphylococcus aureus subsp. aureus N315
uuguuauaaaggaa

SEQ ID NO: 4070417 - RNA, 16 nt, Staphylococcus aureus subsp. aureus N315
uuguucaacuaaauuu

SEQ ID NO: 4070418 - RNA, 22 nt, Staphylococcus aureus subsp. aureus N315
uuguucaacuaaauuuucuaaa

SEQ ID NO: 4070419 - RNA, 19 nt, Staphylococcus aureus subsp. aureus N315
uuguucaguuaaaucugua

SEQ ID NO: 4070420 - RNA, 13 nt, Staphylococcus aureus subsp. aureus N315
uuguuccagacuc

SEQ ID NO: 4070421 - RNA, 12 nt, Staphylococcus aureus subsp. aureus N315
uuguucggcuuu

SEQ ID NO: 4070422 - RNA, 21 nt, Staphylococcus aureus subsp. aureus N315
uuguucuccgaucaugccuuc

SEQ ID NO: 4070423 - RNA, 14 nt, Staphylococcus aureus subsp. aureus N315
uuguugaaauuucu

SEQ ID NO: 4070424 - RNA, 22 nt, Staphylococcus aureus subsp. aureus N315
uuguugaauaauuaauguuucu

SEQ ID NO: 4070425 - RNA, 16 nt, Staphylococcus aureus subsp. aureus N315
uuguugauaguaaucu

SEQ ID NO: 4070426 - RNA, 23 nt, Staphylococcus aureus subsp. aureus N315
uuguuggucuaucgccuaaaaau

SEQ ID NO: 4070427 - RNA, 14 nt, Staphylococcus aureus subsp. aureus N315
uuguuuaauaacaa

SEQ ID NO: 4070428 - RNA, 19 nt, Staphylococcus aureus subsp. aureus N315
uuguuuagaagcuucugca

SEQ ID NO: 4070429 - RNA, 21 nt, Staphylococcus aureus subsp. aureus N315
uuguuuagaagcuucugcaug

SEQ ID NO: 4070430 - RNA, 18 nt, Staphylococcus aureus subsp. aureus N315
uuguuuaucuguaucaaa

SEQ ID NO: 4070431 - RNA, 14 nt, Staphylococcus aureus subsp. aureus N315
uuguuuaugccaug

SEQ ID NO: 4070432 - RNA, 17 nt, Staphylococcus aureus subsp. aureus N315
uuguuuaugccaugcuc

SEQ ID NO: 4070433 - RNA, 12 nt, Staphylococcus aureus subsp. aureus N315
uuguuucaccag

SEQ ID NO: 4070434 - RNA, 13 nt, Staphylococcus aureus subsp. aureus N315
uuguuucuaaauu

SEQ ID NO: 4070435 - RNA, 14 nt, Staphylococcus aureus subsp. aureus N315
uuguuucuaaugcu

SEQ ID NO: 4070436 - RNA, 16 nt, Staphylococcus aureus subsp. aureus N315
uuguuugauuuauuau

SEQ ID NO: 4070437 - RNA, 12 nt, Staphylococcus aureus subsp. aureus N315
uuguuuguagaa

SEQ ID NO: 4070438 - RNA, 12 nt, Staphylococcus aureus subsp. aureus N315
uuguuuucacug

SEQ ID NO: 4070439 - RNA, 23 nt, Staphylococcus aureus subsp. aureus N315
uuguuuuccaauaauaaaccuaa

SEQ ID NO: 4070440 - RNA, 20 nt, Staphylococcus aureus subsp. aureus N315
uuguuuugaauguuucuccu

SEQ ID NO: 4070441 - RNA, 16 nt, Staphylococcus aureus subsp. aureus N315
uuguuuuuaaaaucuc

SEQ ID NO: 4070442 - RNA, 12 nt, Staphylococcus aureus subsp. aureus N315
uuguuuuuauau

SEQ ID NO: 4070443 - RNA, 21 nt, Staphylococcus aureus subsp. aureus N315
uuguuuuucacuguuaaaguc

SEQ ID NO: 4070444 - RNA, 23 nt, Staphylococcus aureus subsp. aureus N315
uuguuuuuuauaagaacaugaua

SEQ ID NO: 4070445 - RNA, 16 nt, Staphylococcus aureus subsp. aureus N315
uuuaaaaaauuuaaau

SEQ ID NO: 4070446 - RNA, 13 nt, Staphylococcus aureus subsp. aureus N315
uuuaaaaaguaau

SEQ ID NO: 4070447 - RNA, 21 nt, Staphylococcus aureus subsp. aureus N315
uuuaaaaaguaauuaauuccu

SEQ ID NO: 4070448 - RNA, 13 nt, Staphylococcus aureus subsp. aureus N315
uuuaaaaaguuaa

SEQ ID NO: 4070449 - RNA, 15 nt, Staphylococcus aureus subsp. aureus N315
uuuaaaaaucaaaga

SEQ ID NO: 4070450 - RNA, 12 nt, Staphylococcus aureus subsp. aureus N315
uuuaaaaaugcu

SEQ ID NO: 4070451 - RNA, 21 nt, Staphylococcus aureus subsp. aureus N315
uuuaaaaaugcuguuuuaugg

SEQ ID NO: 4070452 - RNA, 15 nt, Staphylococcus aureus subsp. aureus N315
uuuaaaacaaugauu

SEQ ID NO: 4070453 - RNA, 13 nt, Staphylococcus aureus subsp. aureus N315
uuuaaaagagaau

SEQ ID NO: 4070454 - RNA, 17 nt, Staphylococcus aureus subsp. aureus N315
uuuaauugucucaucau

SEQ ID NO: 4070455 - RNA, 17 nt, Staphylococcus aureus subsp. aureus N315
uuuaauuguuuaauaac

SEQ ID NO: 4070456 - RNA, 21 nt, Staphylococcus aureus subsp. aureus N315
uuuaauuguuuaauaacaaaa

SEQ ID NO: 4070457 - RNA, 23 nt, Staphylococcus aureus subsp. aureus N315
uuuaauuucugguaaaaaaauaa

SEQ ID NO: 4070458 - RNA, 20 nt, Staphylococcus aureus subsp. aureus N315
uuuaauuugauuaaauucuu

SEQ ID NO: 4070459 - RNA, 14 nt, Staphylococcus aureus subsp. aureus N315
uuuaauuuucuaaa

SEQ ID NO: 4070460 - RNA, 17 nt, Staphylococcus aureus subsp. aureus N315
uuuaauuuucuaaauau

SEQ ID NO: 4070461 - RNA, 18 nt, Staphylococcus aureus subsp. aureus N315
uuuaauuuucuaaauaua

SEQ ID NO: 4070462 - RNA, 23 nt, Staphylococcus aureus subsp. aureus N315
uuuaauuuugacauaaaaaauaa

SEQ ID NO: 4070463 - RNA, 19 nt, Staphylococcus aureus subsp. aureus N315
uuuacaaacuucacaucau

SEQ ID NO: 4070464 - RNA, 22 nt, Staphylococcus aureus subsp. aureus N315
uuuacaaauguauaaauaauaa

SEQ ID NO: 4070465 - RNA, 22 nt, Staphylococcus aureus subsp. aureus N315
uuuacaaucaucacacauaaau

SEQ ID NO: 4070466 - RNA, 22 nt, Staphylococcus aureus subsp. aureus N315
uuuacaauuaauuacuguaaau

SEQ ID NO: 4070467 - RNA, 18 nt, Staphylococcus aureus subsp. aureus N315
uuuacaccuauaccucau

SEQ ID NO: 4070468 - RNA, 18 nt, Staphylococcus aureus subsp. aureus N315
uuuacaccuauaccucgu

SEQ ID NO: 4070469 - RNA, 16 nt, Staphylococcus aureus subsp. aureus N315
uuuacagguugaauaa

SEQ ID NO: 4070470 - RNA, 16 nt, Staphylococcus aureus subsp. aureus N315
uuuacagucaacugcu

SEQ ID NO: 4070471 - RNA, 21 nt, Staphylococcus aureus subsp. aureus N315
uuuacauccaacuaaauguag

SEQ ID NO: 4070472 - RNA, 20 nt, Staphylococcus aureus subsp. aureus N315
uuuacauggcuuagguuuaa

SEQ ID NO: 4070473 - RNA, 14 nt, Staphylococcus aureus subsp. aureus N315
uuuacauucguuua

SEQ ID NO: 4070474 - RNA, 11 nt, Staphylococcus aureus subsp. aureus N315
uuuacauugcc

SEQ ID NO: 4070475 - RNA, 15 nt, Staphylococcus aureus subsp. aureus N315
uuuacauuucucguu

SEQ ID NO: 4070476 - RNA, 20 nt, Staphylococcus aureus subsp. aureus N315
uuuaccauguuuuacaaguu

SEQ ID NO: 4070477 - RNA, 17 nt, Staphylococcus aureus subsp. aureus N315
uuuaccauugugaauaa

SEQ ID NO: 4070478 - RNA, 20 nt, Staphylococcus aureus subsp. aureus N315
uuuaccuguuucuuuacuuc

SEQ ID NO: 4070479 - RNA, 18 nt, Staphylococcus aureus subsp. aureus N315
uuuacgauaaacuaaaaa

SEQ ID NO: 4070480 - RNA, 16 nt, Staphylococcus aureus subsp. aureus N315
uuuacguucugauuca

SEQ ID NO: 4070481 - RNA, 14 nt, Staphylococcus aureus subsp. aureus N315
uuuacuaaaugaau

SEQ ID NO: 4070482 - RNA, 17 nt, Staphylococcus aureus subsp. aureus N315
uuuacucaaaccaucuu

SEQ ID NO: 4070483 - RNA, 16 nt, Staphylococcus aureus subsp. aureus N315
uuuacucauauugaau

SEQ ID NO: 4070484 - RNA, 15 nt, Staphylococcus aureus subsp. aureus N315
uuuacugcuucaauc

SEQ ID NO: 4070485 - RNA, 12 nt, Staphylococcus aureus subsp. aureus N315
uuuacuuaaucu

SEQ ID NO: 4070486 - RNA, 17 nt, Staphylococcus aureus subsp. aureus N315
uuuacuuacuuuucuaa

SEQ ID NO: 4070487 - RNA, 21 nt, Staphylococcus aureus subsp. aureus N315
uuuacuugcuuuuucaaauaa

SEQ ID NO: 4070488 - RNA, 17 nt, Staphylococcus aureus subsp. aureus N315
uuuacuuuuccuugauu

SEQ ID NO: 4070489 - RNA, 18 nt, Staphylococcus aureus subsp. aureus N315
uuuagaaaaggauuauag

SEQ ID NO: 4070490 - RNA, 18 nt, Staphylococcus aureus subsp. aureus N315
uuuagaaagaauacaguu

SEQ ID NO: 4070491 - RNA, 18 nt, Staphylococcus aureus subsp. aureus N315
uuuagaauaagaaauaaa

SEQ ID NO: 4070492 - RNA, 14 nt, Staphylococcus aureus subsp. aureus N315
uuuagaauaguuac

SEQ ID NO: 4070493 - RNA, 22 nt, Staphylococcus aureus subsp. aureus N315
uuuagaaucaaccguuuuauug

SEQ ID NO: 4070494 - RNA, 14 nt, Staphylococcus aureus subsp. aureus N315
uuuagacauaaaaa

SEQ ID NO: 4070495 - RNA, 15 nt, Staphylococcus aureus subsp. aureus N315
uuuagauaaaaauua

SEQ ID NO: 4070496 - RNA, 15 nt, Staphylococcus aureus subsp. aureus N315
uuuagaugcauaaaa

SEQ ID NO: 4070497 - RNA, 14 nt, Staphylococcus aureus subsp. aureus N315
uuuagauuuaguuu

SEQ ID NO: 4070498 - RNA, 13 nt, Staphylococcus aureus subsp. aureus N315
uuuagauuuauaa
